United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 36

SEQ ID NO: 1291130 - RNA, 20 nt, Mycobacterium tuberculosis H37Rv
cggccggaugagcgaacgcc

SEQ ID NO: 1291131 - RNA, 17 nt, Mycobacterium tuberculosis H37Rv
cggccggcaagcagucg

SEQ ID NO: 1291132 - RNA, 19 nt, Mycobacterium tuberculosis H37Rv
cggcgcccagcgccucgau

SEQ ID NO: 1291133 - RNA, 14 nt, Mycobacterium tuberculosis H37Rv
cggcgccagcagug

SEQ ID NO: 1291134 - RNA, 16 nt, Mycobacterium tuberculosis H37Rv
cggcgcccaggccgau

SEQ ID NO: 1291135 - RNA, 17 nt, Mycobacterium tuberculosis H37Rv
cggcgcccaggccgauc

SEQ ID NO: 1291136 - RNA, 15 nt, Mycobacterium tuberculosis H37Rv
cggcgcccagcgcua

SEQ ID NO: 1291137 - RNA, 15 nt, Mycobacterium tuberculosis H37Rv
cggcgcccagcucga

SEQ ID NO: 1291138 - RNA, 14 nt, Mycobacterium tuberculosis H37Rv
cggcgcccgcccga

SEQ ID NO: 1291139 - RNA, 12 nt, Mycobacterium tuberculosis H37Rv
cggcgccccggu

SEQ ID NO: 1291140 - RNA, 20 nt, Mycobacterium tuberculosis H37Rv
cggcgcccaggccgaucagc

SEQ ID NO: 1291141 - RNA, 21 nt, Mycobacterium tuberculosis H37Rv
cggcgcccccguuaccgccgu

SEQ ID NO: 1291142 - RNA, 23 nt, Mycobacterium tuberculosis H37Rv
cggcgcccccguuaccgccgucg

SEQ ID NO: 1291143 - RNA, 13 nt, Mycobacterium tuberculosis H37Rv
cggcgccagcaga

SEQ ID NO: 1291144 - RNA, 14 nt, Mycobacterium tuberculosis H37Rv
cggcgccagaucga

SEQ ID NO: 1291145 - RNA, 14 nt, Mycobacterium tuberculosis H37Rv
cggcgcagcgaccg

SEQ ID NO: 1291146 - RNA, 12 nt, Mycobacterium tuberculosis H37Rv
cggcgccaccgu

SEQ ID NO: 1291147 - RNA, 20 nt, Mycobacterium tuberculosis H37Rv
cggcgccgcagaucaccgcc

SEQ ID NO: 1291148 - RNA, 16 nt, Mycobacterium tuberculosis H37Rv
cggcgccgcaccaagc

SEQ ID NO: 1291149 - RNA, 23 nt, Mycobacterium tuberculosis H37Rv
cggcgccgcaaugacgucgucgg

SEQ ID NO: 1291150 - RNA, 23 nt, Mycobacterium tuberculosis H37Rv
cggcgccgcagaucaccgccagc

SEQ ID NO: 1291151 - RNA, 17 nt, Mycobacterium tuberculosis H37Rv
cggcgccgccacggauc

SEQ ID NO: 1291152 - RNA, 13 nt, Mycobacterium tuberculosis H37Rv
cggcgccgagguc

SEQ ID NO: 1291153 - RNA, 16 nt, Mycobacterium tuberculosis H37Rv
cggcgccgaacccggu

SEQ ID NO: 1291154 - RNA, 14 nt, Mycobacterium tuberculosis H37Rv
cggcgccgaacccg

SEQ ID NO: 1291155 - RNA, 18 nt, Mycobacterium tuberculosis H37Rv
cggcgccgaaaccgccgg

SEQ ID NO: 1291156 - RNA, 20 nt, Mycobacterium tuberculosis H37Rv
cggcgccgaaaccgccggga

SEQ ID NO: 1291157 - RNA, 15 nt, Mycobacterium tuberculosis H37Rv
cggcgccgaacaccg

SEQ ID NO: 1291158 - RNA, 16 nt, Mycobacterium tuberculosis H37Rv
cggcgcccgccgcgaa

SEQ ID NO: 1291159 - RNA, 17 nt, Mycobacterium tuberculosis H37Rv
cggcgcccgcucggccg

SEQ ID NO: 1291160 - RNA, 14 nt, Mycobacterium tuberculosis H37Rv
cggcgcccgcucgg

SEQ ID NO: 1291161 - RNA, 16 nt, Mycobacterium tuberculosis H37Rv
cggcgaugaauagguc

SEQ ID NO: 1291162 - RNA, 21 nt, Mycobacterium tuberculosis H37Rv
cggcgaugcggucggccacau

SEQ ID NO: 1291163 - RNA, 19 nt, Mycobacterium tuberculosis H37Rv
cggcgaugcggucggccac

SEQ ID NO: 1291164 - RNA, 16 nt, Mycobacterium tuberculosis H37Rv
cggcgaugcugagccg

SEQ ID NO: 1291165 - RNA, 21 nt, Mycobacterium tuberculosis H37Rv
cggcgaugguaucgccgcuag

SEQ ID NO: 1291166 - RNA, 16 nt, Mycobacterium tuberculosis H37Rv
cggcgauggcggcauc

SEQ ID NO: 1291167 - RNA, 13 nt, Mycobacterium tuberculosis H37Rv
cggcgauggcgcg

SEQ ID NO: 1291168 - RNA, 23 nt, Mycobacterium tuberculosis H37Rv
cggcgauggcgcgcaacguagcc

SEQ ID NO: 1291169 - RNA, 17 nt, Mycobacterium tuberculosis H37Rv
cggcgaugguaucgccg

SEQ ID NO: 1291170 - RNA, 19 nt, Mycobacterium tuberculosis H37Rv
cggcgcaccacaccacggu

SEQ ID NO: 1291171 - RNA, 15 nt, Mycobacterium tuberculosis H37Rv
cggcgcacaacccgu

SEQ ID NO: 1291172 - RNA, 15 nt, Mycobacterium tuberculosis H37Rv
cggcgcaccaucgcg

SEQ ID NO: 1291173 - RNA, 16 nt, Mycobacterium tuberculosis H37Rv
cggcgcagcgaccggu

SEQ ID NO: 1291174 - RNA, 21 nt, Mycobacterium tuberculosis H37Rv
cggcgcagcgacgcgauuucg

SEQ ID NO: 1291175 - RNA, 16 nt, Mycobacterium tuberculosis H37Rv
cggcgcagcaccgucg

SEQ ID NO: 1291176 - RNA, 16 nt, Mycobacterium tuberculosis H37Rv
cggcgaugaccagaug

SEQ ID NO: 1291177 - RNA, 21 nt, Mycobacterium tuberculosis H37Rv
cggcgaugaacgggaucgacc

SEQ ID NO: 1291178 - RNA, 17 nt, Mycobacterium tuberculosis H37Rv
cggcgaucugcuguguc

SEQ ID NO: 1291179 - RNA, 11 nt, Mycobacterium tuberculosis H37Rv
cggcgaucugg

SEQ ID NO: 1291180 - RNA, 13 nt, Mycobacterium tuberculosis H37Rv
cggcgaucugguc

SEQ ID NO: 1291181 - RNA, 16 nt, Mycobacterium tuberculosis H37Rv
cggcgauccccgacgu

SEQ ID NO: 1291182 - RNA, 19 nt, Mycobacterium tuberculosis H37Rv
cggcgauccccgacgucgg

SEQ ID NO: 1291183 - RNA, 19 nt, Mycobacterium tuberculosis H37Rv
cggcgacgucucgcaugcu

SEQ ID NO: 1291184 - RNA, 13 nt, Mycobacterium tuberculosis H37Rv
cggcgaucaccgu

SEQ ID NO: 1291185 - RNA, 19 nt, Mycobacterium tuberculosis H37Rv
cggcgaucagcagcgccag

SEQ ID NO: 1291186 - RNA, 16 nt, Mycobacterium tuberculosis H37Rv
cggcgacgggucgggc

SEQ ID NO: 1291187 - RNA, 21 nt, Mycobacterium tuberculosis H37Rv
cggcgacguggcgccgacagg

SEQ ID NO: 1291188 - RNA, 19 nt, Mycobacterium tuberculosis H37Rv
cggcgacguagacgguccg

SEQ ID NO: 1291189 - RNA, 14 nt, Mycobacterium tuberculosis H37Rv
cggcgccucggacc

SEQ ID NO: 1291190 - RNA, 15 nt, Mycobacterium tuberculosis H37Rv
cggcgccucguugcc

SEQ ID NO: 1291191 - RNA, 17 nt, Mycobacterium tuberculosis H37Rv
cggcgccucguugccgu

SEQ ID NO: 1291192 - RNA, 16 nt, Mycobacterium tuberculosis H37Rv
cggcgccuccggcacc

SEQ ID NO: 1291193 - RNA, 15 nt, Mycobacterium tuberculosis H37Rv
cggcgccgugucacc

SEQ ID NO: 1291194 - RNA, 14 nt, Mycobacterium tuberculosis H37Rv
cggcgccguugccg

SEQ ID NO: 1291195 - RNA, 17 nt, Mycobacterium tuberculosis H37Rv
cggcgccuuggucgccg

SEQ ID NO: 1291196 - RNA, 20 nt, Mycobacterium tuberculosis H37Rv
cggcgccuuggucgccgccu

SEQ ID NO: 1291197 - RNA, 23 nt, Mycobacterium tuberculosis H37Rv
cggcgccuuggucgccgccuuac

SEQ ID NO: 1291198 - RNA, 23 nt, Mycobacterium tuberculosis H37Rv
cggcgccuuguggaaccaucccu

SEQ ID NO: 1291199 - RNA, 16 nt, Mycobacterium tuberculosis H37Rv
cggcgccuuggucgcc

SEQ ID NO: 1291200 - RNA, 23 nt, Mycobacterium tuberculosis H37Rv
cggcgccgucggagccggccacc

SEQ ID NO: 1291201 - RNA, 16 nt, Mycobacterium tuberculosis H37Rv
cggcgccgucgcccag

SEQ ID NO: 1291202 - RNA, 17 nt, Mycobacterium tuberculosis H37Rv
cggcgccggugccgccu

SEQ ID NO: 1291203 - RNA, 15 nt, Mycobacterium tuberculosis H37Rv
cggcgccggcgucgg

SEQ ID NO: 1291204 - RNA, 14 nt, Mycobacterium tuberculosis H37Rv
cggcgccggcgucg

SEQ ID NO: 1291205 - RNA, 14 nt, Mycobacterium tuberculosis H37Rv
cggcgccggcgcug

SEQ ID NO: 1291206 - RNA, 17 nt, Mycobacterium tuberculosis H37Rv
cggcgccggcaucgacg

SEQ ID NO: 1291207 - RNA, 15 nt, Mycobacterium tuberculosis H37Rv
cggcgccgccuggac

SEQ ID NO: 1291208 - RNA, 14 nt, Mycobacterium tuberculosis H37Rv
cggcgccgcgccgu

SEQ ID NO: 1291209 - RNA, 14 nt, Mycobacterium tuberculosis H37Rv
cggcgccgcucacg

SEQ ID NO: 1291210 - RNA, 19 nt, Mycobacterium tuberculosis H37Rv
cggcgccgcgggugcggca

SEQ ID NO: 1291211 - RNA, 20 nt, Mycobacterium tuberculosis H37Rv
cggcgccgccguuaccgccg

SEQ ID NO: 1291212 - RNA, 14 nt, Mycobacterium tuberculosis H37Rv
cggcgccgccguua

SEQ ID NO: 1291213 - RNA, 21 nt, Mycobacterium tuberculosis H37Rv
cggcgccgccgucgccgccgu

SEQ ID NO: 1291214 - RNA, 15 nt, Mycobacterium tuberculosis H37Rv
cggcgccgccgucgc

SEQ ID NO: 1291215 - RNA, 21 nt, Mycobacterium tuberculosis H37Rv
cggcgccgccggugccaccgg

SEQ ID NO: 1291216 - RNA, 14 nt, Mycobacterium tuberculosis H37Rv
cggcgccgccgucg

SEQ ID NO: 1291217 - RNA, 12 nt, Mycobacterium tuberculosis H37Rv
cggcgccgccgu

SEQ ID NO: 1291218 - RNA, 20 nt, Mycobacterium tuberculosis H37Rv
cggcgccgccggcaccgggg

SEQ ID NO: 1291219 - RNA, 14 nt, Mycobacterium tuberculosis H37Rv
cggcgccgccggug

SEQ ID NO: 1291220 - RNA, 13 nt, Mycobacterium tuberculosis H37Rv
cggcgccgcccga

SEQ ID NO: 1291221 - RNA, 23 nt, Mycobacterium tuberculosis H37Rv
cggcgccgccagcaccaccggcu

SEQ ID NO: 1291222 - RNA, 17 nt, Mycobacterium tuberculosis H37Rv
cggcgccgccauugcca

SEQ ID NO: 1291223 - RNA, 13 nt, Mycobacterium tuberculosis H37Rv
cggcgccgccagc

SEQ ID NO: 1291224 - RNA, 23 nt, Mycobacterium tuberculosis H37Rv
cggcgccgccacugccggcagcg

SEQ ID NO: 1291225 - RNA, 16 nt, Mycobacterium tuberculosis H37Rv
cggcgccgccacugcc

SEQ ID NO: 1291226 - RNA, 17 nt, Mycobacterium tuberculosis H37Rv
cggcgccgcccuugccg

SEQ ID NO: 1291227 - RNA, 14 nt, Mycobacterium tuberculosis H37Rv
cggcgccgcccuug

SEQ ID NO: 1291228 - RNA, 13 nt, Mycobacterium tuberculosis H37Rv
cggcgccgcccuu

SEQ ID NO: 1291229 - RNA, 17 nt, Mycobacterium tuberculosis H37Rv
cggcgccgccggcacca

SEQ ID NO: 1291230 - RNA, 19 nt, Mycobacterium tuberculosis H37Rv
cggcgcgaucgacgcucgg

SEQ ID NO: 1291231 - RNA, 19 nt, Mycobacterium tuberculosis H37Rv
cggcgcgauggcgauagcg

SEQ ID NO: 1291232 - RNA, 18 nt, Mycobacterium tuberculosis H37Rv
cggcgcgcaccucggcga

SEQ ID NO: 1291233 - RNA, 18 nt, Mycobacterium tuberculosis H37Rv
cggcgcgaagucuugacc

SEQ ID NO: 1291234 - RNA, 15 nt, Mycobacterium tuberculosis H37Rv
cggcgcgaccgucug

SEQ ID NO: 1291235 - RNA, 16 nt, Mycobacterium tuberculosis H37Rv
cggcgcgagcagacgc

SEQ ID NO: 1291236 - RNA, 16 nt, Mycobacterium tuberculosis H37Rv
cggcgcgaggaacgcc

SEQ ID NO: 1291237 - RNA, 14 nt, Mycobacterium tuberculosis H37Rv
cggcgcgagccgca

SEQ ID NO: 1291238 - RNA, 15 nt, Mycobacterium tuberculosis H37Rv
cggcgcgagccugau

SEQ ID NO: 1291239 - RNA, 16 nt, Mycobacterium tuberculosis H37Rv
cggcgcgagcagacac

SEQ ID NO: 1291240 - RNA, 19 nt, Mycobacterium tuberculosis H37Rv
cggcgcgaggaggcuuaca

SEQ ID NO: 1291241 - RNA, 19 nt, Mycobacterium tuberculosis H37Rv
cggcgcgcgcgccggcugc

SEQ ID NO: 1291242 - RNA, 19 nt, Mycobacterium tuberculosis H37Rv
cggcgcgccccgccgcacg

SEQ ID NO: 1291243 - RNA, 16 nt, Mycobacterium tuberculosis H37Rv
cggcgcgccccaccgc

SEQ ID NO: 1291244 - RNA, 21 nt, Mycobacterium tuberculosis H37Rv
cggcgcgcagcgauucgccua

SEQ ID NO: 1291245 - RNA, 17 nt, Mycobacterium tuberculosis H37Rv
cggcauguaccgaccgc

SEQ ID NO: 1291246 - RNA, 18 nt, Mycobacterium tuberculosis H37Rv
cggcauguaccgaccgcg

SEQ ID NO: 1291247 - RNA, 19 nt, Mycobacterium tuberculosis H37Rv
cggcauguaccgaccgcgu

SEQ ID NO: 1291248 - RNA, 20 nt, Mycobacterium tuberculosis H37Rv
cggcauguaccgaccgcguu

SEQ ID NO: 1291249 - RNA, 20 nt, Mycobacterium tuberculosis H37Rv
cggcaucgucgacgcccgau

SEQ ID NO: 1291250 - RNA, 14 nt, Mycobacterium tuberculosis H37Rv
cggcaucgucgcca

SEQ ID NO: 1291251 - RNA, 19 nt, Mycobacterium tuberculosis H37Rv
cggccaccaaccucaucgc

SEQ ID NO: 1291252 - RNA, 19 nt, Mycobacterium tuberculosis H37Rv
cggccaccaacucggcgac

SEQ ID NO: 1291253 - RNA, 19 nt, Mycobacterium tuberculosis H37Rv
cggccacauccagcgcuuc

SEQ ID NO: 1291254 - RNA, 22 nt, Mycobacterium tuberculosis H37Rv
cggccacagugcauacgguuga

SEQ ID NO: 1291255 - RNA, 21 nt, Mycobacterium tuberculosis H37Rv
cggccacaccgucacgccacc

SEQ ID NO: 1291256 - RNA, 18 nt, Mycobacterium tuberculosis H37Rv
cggccacaaugcggccgu

SEQ ID NO: 1291257 - RNA, 12 nt, Mycobacterium tuberculosis H37Rv
cggccacaccgu

SEQ ID NO: 1291258 - RNA, 14 nt, Mycobacterium tuberculosis H37Rv
cggcauuccacagg

SEQ ID NO: 1291259 - RNA, 18 nt, Mycobacterium tuberculosis H37Rv
cggccacaaccucgucgu

SEQ ID NO: 1291260 - RNA, 20 nt, Mycobacterium tuberculosis H37Rv
cggccaauugcgccgccaac

SEQ ID NO: 1291261 - RNA, 13 nt, Mycobacterium tuberculosis H37Rv
cggcaucgcgggc

SEQ ID NO: 1291262 - RNA, 15 nt, Mycobacterium tuberculosis H37Rv
cggcaucgccgagcu

SEQ ID NO: 1291263 - RNA, 17 nt, Mycobacterium tuberculosis H37Rv
cggcaucuccaccgucg

SEQ ID NO: 1291264 - RNA, 19 nt, Mycobacterium tuberculosis H37Rv
cggcaucgucgacgauguc

SEQ ID NO: 1291265 - RNA, 13 nt, Mycobacterium tuberculosis H37Rv
cggcaucggccac

SEQ ID NO: 1291266 - RNA, 12 nt, Mycobacterium tuberculosis H37Rv
cggcaucgauca

SEQ ID NO: 1291267 - RNA, 17 nt, Mycobacterium tuberculosis H37Rv
cggccacgguggcgcaa

SEQ ID NO: 1291268 - RNA, 17 nt, Mycobacterium tuberculosis H37Rv
cggccacgucaaacccg

SEQ ID NO: 1291269 - RNA, 21 nt, Mycobacterium tuberculosis H37Rv
cggccacucgcccgauccgga

SEQ ID NO: 1291270 - RNA, 16 nt, Mycobacterium tuberculosis H37Rv
cggccacguuguccgc

SEQ ID NO: 1291271 - RNA, 19 nt, Mycobacterium tuberculosis H37Rv
cggccacgguagaacacgu

SEQ ID NO: 1291272 - RNA, 21 nt, Mycobacterium tuberculosis H37Rv
cggccacgucgaugugcgccc

SEQ ID NO: 1291273 - RNA, 19 nt, Mycobacterium tuberculosis H37Rv
cggccaccggacgaaacga

SEQ ID NO: 1291274 - RNA, 13 nt, Mycobacterium tuberculosis H37Rv
cggccaccgccgc

SEQ ID NO: 1291275 - RNA, 19 nt, Mycobacterium tuberculosis H37Rv
cggccaccgcacgcuggcg

SEQ ID NO: 1291276 - RNA, 18 nt, Mycobacterium tuberculosis H37Rv
cggccaccgccgccgcca

SEQ ID NO: 1291277 - RNA, 14 nt, Mycobacterium tuberculosis H37Rv
cggccaccagcaug

SEQ ID NO: 1291278 - RNA, 20 nt, Mycobacterium tuberculosis H37Rv
cggccaccaccgcgccgucg

SEQ ID NO: 1291279 - RNA, 18 nt, Mycobacterium tuberculosis H37Rv
cggccaccaccgcgccgu

SEQ ID NO: 1291280 - RNA, 22 nt, Mycobacterium tuberculosis H37Rv
cggccaccaccgccgccggcac

SEQ ID NO: 1291281 - RNA, 14 nt, Mycobacterium tuberculosis H37Rv
cggccaccaccgcc

SEQ ID NO: 1291282 - RNA, 13 nt, Mycobacterium tuberculosis H37Rv
cggccaccaccgc

SEQ ID NO: 1291283 - RNA, 18 nt, Mycobacterium tuberculosis H37Rv
cggccagcaucgcggugg

SEQ ID NO: 1291284 - RNA, 20 nt, Mycobacterium tuberculosis H37Rv
cggccagcaucagcucgaug

SEQ ID NO: 1291285 - RNA, 12 nt, Mycobacterium tuberculosis H37Rv
cggccagcaucg

SEQ ID NO: 1291286 - RNA, 14 nt, Mycobacterium tuberculosis H37Rv
cggccagcaggaug

SEQ ID NO: 1291287 - RNA, 14 nt, Mycobacterium tuberculosis H37Rv
cggccagcagugcg

SEQ ID NO: 1291288 - RNA, 16 nt, Mycobacterium tuberculosis H37Rv
cggccagcagcagaug

SEQ ID NO: 1291289 - RNA, 16 nt, Mycobacterium tuberculosis H37Rv
cggccagaaacccggc

SEQ ID NO: 1291290 - RNA, 14 nt, Mycobacterium tuberculosis H37Rv
cggccagagccgcg

SEQ ID NO: 1291291 - RNA, 16 nt, Mycobacterium tuberculosis H37Rv
cggccagacggugcag

SEQ ID NO: 1291292 - RNA, 21 nt, Mycobacterium tuberculosis H37Rv
cggccagcaagugcgggcugu

SEQ ID NO: 1291293 - RNA, 20 nt, Mycobacterium tuberculosis H37Rv
cggccagaugguggcaugcu

SEQ ID NO: 1291294 - RNA, 16 nt, Mycobacterium tuberculosis H37Rv
cggccagaugguggca

SEQ ID NO: 1291295 - RNA, 19 nt, Mycobacterium tuberculosis H37Rv
cggccagcaccagcucacg

SEQ ID NO: 1291296 - RNA, 23 nt, Mycobacterium tuberculosis H37Rv
cggccagccuaccggcuacggcg

SEQ ID NO: 1291297 - RNA, 20 nt, Mycobacterium tuberculosis H37Rv
cggccagccgcacgguugcc

SEQ ID NO: 1291298 - RNA, 13 nt, Mycobacterium tuberculosis H37Rv
cggccagcgcacc

SEQ ID NO: 1291299 - RNA, 19 nt, Mycobacterium tuberculosis H37Rv
cggccagcgcaccgccgau

SEQ ID NO: 1291300 - RNA, 13 nt, Mycobacterium tuberculosis H37Rv
cggccagcgccuc

SEQ ID NO: 1291301 - RNA, 20 nt, Mycobacterium tuberculosis H37Rv
cggccagcgccucggugagc

SEQ ID NO: 1291302 - RNA, 23 nt, Mycobacterium tuberculosis H37Rv
cggccaggaugccugccacccgu

SEQ ID NO: 1291303 - RNA, 18 nt, Mycobacterium tuberculosis H37Rv
cggccagcuguucgagcc

SEQ ID NO: 1291304 - RNA, 22 nt, Mycobacterium tuberculosis H37Rv
cggccagcuccucagccaccgc

SEQ ID NO: 1291305 - RNA, 18 nt, Mycobacterium tuberculosis H37Rv
cggccagcucggccagcu

SEQ ID NO: 1291306 - RNA, 17 nt, Mycobacterium tuberculosis H37Rv
cggccagcgucaacagc

SEQ ID NO: 1291307 - RNA, 21 nt, Mycobacterium tuberculosis H37Rv
cggccagcguguccgccaagu

SEQ ID NO: 1291308 - RNA, 20 nt, Mycobacterium tuberculosis H37Rv
cggccagcuccucagccacc

SEQ ID NO: 1291309 - RNA, 16 nt, Mycobacterium tuberculosis H37Rv
cggccagcuccagcgc

SEQ ID NO: 1291310 - RNA, 21 nt, Mycobacterium tuberculosis H37Rv
cggccagcgggugaaucgaca

SEQ ID NO: 1291311 - RNA, 17 nt, Mycobacterium tuberculosis H37Rv
cggccagcgcgucggga

SEQ ID NO: 1291312 - RNA, 13 nt, Mycobacterium tuberculosis H37Rv
cggccagcgcguc

SEQ ID NO: 1291313 - RNA, 23 nt, Mycobacterium tuberculosis H37Rv
cggccaucgaguccaccaccugg

SEQ ID NO: 1291314 - RNA, 16 nt, Mycobacterium tuberculosis H37Rv
cggccaugguguucgg

SEQ ID NO: 1291315 - RNA, 20 nt, Mycobacterium tuberculosis H37Rv
cggccaugucuccgacauug

SEQ ID NO: 1291316 - RNA, 15 nt, Mycobacterium tuberculosis H37Rv
cggccaucgcccgau

SEQ ID NO: 1291317 - RNA, 18 nt, Mycobacterium tuberculosis H37Rv
cggccaucccgcguucga

SEQ ID NO: 1291318 - RNA, 21 nt, Mycobacterium tuberculosis H37Rv
cggccauccggucgcucgaug

SEQ ID NO: 1291319 - RNA, 22 nt, Mycobacterium tuberculosis H37Rv
cggccauaucgcccaccacgaa

SEQ ID NO: 1291320 - RNA, 12 nt, Mycobacterium tuberculosis H37Rv
cggccaggcggu

SEQ ID NO: 1291321 - RNA, 12 nt, Mycobacterium tuberculosis H37Rv
cggccaggccga

SEQ ID NO: 1291322 - RNA, 23 nt, Mycobacterium tuberculosis H37Rv
cggccccaccggugccgccguug

SEQ ID NO: 1291323 - RNA, 19 nt, Mycobacterium tuberculosis H37Rv
cggccccaccggugccgcc

SEQ ID NO: 1291324 - RNA, 21 nt, Mycobacterium tuberculosis H37Rv
cggccccaccggugccgccgu

SEQ ID NO: 1291325 - RNA, 14 nt, Mycobacterium tuberculosis H37Rv
cggccccaccggug

SEQ ID NO: 1291326 - RNA, 13 nt, Mycobacterium tuberculosis H37Rv
cggccccaccggu

SEQ ID NO: 1291327 - RNA, 15 nt, Mycobacterium tuberculosis H37Rv
cggccccaccgguac

SEQ ID NO: 1291328 - RNA, 18 nt, Mycobacterium tuberculosis H37Rv
cggcccccgaggcuggca

SEQ ID NO: 1291329 - RNA, 21 nt, Mycobacterium tuberculosis H37Rv
cggccccgaaacgauggccgg

SEQ ID NO: 1291330 - RNA, 18 nt, Mycobacterium tuberculosis H37Rv
cggccccgccgucaccgc

SEQ ID NO: 1291331 - RNA, 13 nt, Mycobacterium tuberculosis H37Rv
cggcccagcgcgc

SEQ ID NO: 1291332 - RNA, 22 nt, Mycobacterium tuberculosis H37Rv
cggcccacucacacaaccgacg

SEQ ID NO: 1291333 - RNA, 22 nt, Mycobacterium tuberculosis H37Rv
cggccauuagcagcacccgggc

SEQ ID NO: 1291334 - RNA, 20 nt, Mycobacterium tuberculosis H37Rv
cggcacgccggccgcgcuga

SEQ ID NO: 1291335 - RNA, 17 nt, Mycobacterium tuberculosis H37Rv
cggcaccucauugccgu

SEQ ID NO: 1291336 - RNA, 17 nt, Mycobacterium tuberculosis H37Rv
cggcaccuccgccggca

SEQ ID NO: 1291337 - RNA, 15 nt, Mycobacterium tuberculosis H37Rv
cggcaccuccggcac

SEQ ID NO: 1291338 - RNA, 17 nt, Mycobacterium tuberculosis H37Rv
cggcaccucgacgucga

SEQ ID NO: 1291339 - RNA, 18 nt, Mycobacterium tuberculosis H37Rv
cggcaccugguccaaucg

SEQ ID NO: 1291340 - RNA, 17 nt, Mycobacterium tuberculosis H37Rv
cggcaccuccagcacca

SEQ ID NO: 1291341 - RNA, 21 nt, Mycobacterium tuberculosis H37Rv
cggcaccguagagcaugccgc

SEQ ID NO: 1291342 - RNA, 18 nt, Mycobacterium tuberculosis H37Rv
cggcaccggccgugccgc

SEQ ID NO: 1291343 - RNA, 22 nt, Mycobacterium tuberculosis H37Rv
cggcaccggugcccaccaccga

SEQ ID NO: 1291344 - RNA, 21 nt, Mycobacterium tuberculosis H37Rv
cggcaccagaucaacaucauc

SEQ ID NO: 1291345 - RNA, 14 nt, Mycobacterium tuberculosis H37Rv
cggcaccacgauca

SEQ ID NO: 1291346 - RNA, 12 nt, Mycobacterium tuberculosis H37Rv
cggcaccaccgc

SEQ ID NO: 1291347 - RNA, 21 nt, Mycobacterium tuberculosis H37Rv
cggcaccaccguugccgccgu

SEQ ID NO: 1291348 - RNA, 19 nt, Mycobacterium tuberculosis H37Rv
cggcaccaccgcgaccucg

SEQ ID NO: 1291349 - RNA, 23 nt, Mycobacterium tuberculosis H37Rv
cggcaccgauggcgcaccggcgu

SEQ ID NO: 1291350 - RNA, 18 nt, Mycobacterium tuberculosis H37Rv
cggcaccgaucaacggaa

SEQ ID NO: 1291351 - RNA, 21 nt, Mycobacterium tuberculosis H37Rv
cggcacccgcuggcgguaagc

SEQ ID NO: 1291352 - RNA, 16 nt, Mycobacterium tuberculosis H37Rv
cggcacccgcacggcc

SEQ ID NO: 1291353 - RNA, 17 nt, Mycobacterium tuberculosis H37Rv
cggcacauugaucgacg

SEQ ID NO: 1291354 - RNA, 18 nt, Mycobacterium tuberculosis H37Rv
cggcaccaacgccaccgu

SEQ ID NO: 1291355 - RNA, 23 nt, Mycobacterium tuberculosis H37Rv
cggcacaggcggccagcaucgcg

SEQ ID NO: 1291356 - RNA, 14 nt, Mycobacterium tuberculosis H37Rv
cggcacaaucggcg

SEQ ID NO: 1291357 - RNA, 20 nt, Mycobacterium tuberculosis H37Rv
cggcacaccccgguucgacg

SEQ ID NO: 1291358 - RNA, 21 nt, Mycobacterium tuberculosis H37Rv
cggcaacguuuacgaugcuca

SEQ ID NO: 1291359 - RNA, 21 nt, Mycobacterium tuberculosis H37Rv
cggcaauggugcgggccacga

SEQ ID NO: 1291360 - RNA, 23 nt, Mycobacterium tuberculosis H37Rv
cggcacaaucggauagccgugcu

SEQ ID NO: 1291361 - RNA, 21 nt, Mycobacterium tuberculosis H37Rv
cggcacaaucggauagccgug

SEQ ID NO: 1291362 - RNA, 20 nt, Mycobacterium tuberculosis H37Rv
cggcacacccaucaccgcca

SEQ ID NO: 1291363 - RNA, 16 nt, Mycobacterium tuberculosis H37Rv
cggcaaccugcgacca

SEQ ID NO: 1291364 - RNA, 14 nt, Mycobacterium tuberculosis H37Rv
cggcaaccgccgug

SEQ ID NO: 1291365 - RNA, 17 nt, Mycobacterium tuberculosis H37Rv
cggcaacgcggucugcu

SEQ ID NO: 1291366 - RNA, 21 nt, Mycobacterium tuberculosis H37Rv
cggcaacgaucgacaccaggg

SEQ ID NO: 1291367 - RNA, 13 nt, Mycobacterium tuberculosis H37Rv
cggcagacgcguu

SEQ ID NO: 1291368 - RNA, 23 nt, Mycobacterium tuberculosis H37Rv
cggcagaccggugcugucgacgu

SEQ ID NO: 1291369 - RNA, 18 nt, Mycobacterium tuberculosis H37Rv
cggcagaucccacgccag

SEQ ID NO: 1291370 - RNA, 22 nt, Mycobacterium tuberculosis H37Rv
cggcagaucccacgccaggauc

SEQ ID NO: 1291371 - RNA, 18 nt, Mycobacterium tuberculosis H37Rv
cggcagauacucggcgac

SEQ ID NO: 1291372 - RNA, 23 nt, Mycobacterium tuberculosis H37Rv
cggcagcacccacaucagccgca

SEQ ID NO: 1291373 - RNA, 20 nt, Mycobacterium tuberculosis H37Rv
cggcacggaugcgauggccg

SEQ ID NO: 1291374 - RNA, 18 nt, Mycobacterium tuberculosis H37Rv
cggcacggaugcgauggc

SEQ ID NO: 1291375 - RNA, 22 nt, Mycobacterium tuberculosis H37Rv
cggcacggaugcgauggccgac

SEQ ID NO: 1291376 - RNA, 16 nt, Mycobacterium tuberculosis H37Rv
cggcacuuagcccgau

SEQ ID NO: 1291377 - RNA, 23 nt, Mycobacterium tuberculosis H37Rv
cggcacuuagcccgauggugccg

SEQ ID NO: 1291378 - RNA, 23 nt, Mycobacterium tuberculosis H37Rv
cggcacuugggaaggauggucga

SEQ ID NO: 1291379 - RNA, 17 nt, Mycobacterium tuberculosis H37Rv
cggcagaauccggucga

SEQ ID NO: 1291380 - RNA, 19 nt, Mycobacterium tuberculosis H37Rv
cggcagaccaagcccgucg

SEQ ID NO: 1291381 - RNA, 12 nt, Mycobacterium tuberculosis H37Rv
cggcagaccgac

SEQ ID NO: 1291382 - RNA, 18 nt, Mycobacterium tuberculosis H37Rv
cggcagacccgggccagu

SEQ ID NO: 1291383 - RNA, 17 nt, Mycobacterium tuberculosis H37Rv
cggcacuggguccacgc

SEQ ID NO: 1291384 - RNA, 15 nt, Mycobacterium tuberculosis H37Rv
cggcacgcugaccgg

SEQ ID NO: 1291385 - RNA, 20 nt, Mycobacterium tuberculosis H37Rv
cggcaggauucccucgacag

SEQ ID NO: 1291386 - RNA, 17 nt, Mycobacterium tuberculosis H37Rv
cggcaggauucccucga

SEQ ID NO: 1291387 - RNA, 20 nt, Mycobacterium tuberculosis H37Rv
cggcaggaaugccgcgggga

SEQ ID NO: 1291388 - RNA, 19 nt, Mycobacterium tuberculosis H37Rv
cggcaggaaucgggucagc

SEQ ID NO: 1291389 - RNA, 11 nt, Mycobacterium tuberculosis H37Rv
cggcagcgcgg

SEQ ID NO: 1291390 - RNA, 18 nt, Mycobacterium tuberculosis H37Rv
cggcagcgcggaugucgg

SEQ ID NO: 1291391 - RNA, 14 nt, Mycobacterium tuberculosis H37Rv
cggcagcgaucggg

SEQ ID NO: 1291392 - RNA, 21 nt, Mycobacterium tuberculosis H37Rv
cggcagcgaucggggcgguga

SEQ ID NO: 1291393 - RNA, 15 nt, Mycobacterium tuberculosis H37Rv
cggcagcgagucgac

SEQ ID NO: 1291394 - RNA, 17 nt, Mycobacterium tuberculosis H37Rv
cggcagcgaggcucgca

SEQ ID NO: 1291395 - RNA, 15 nt, Mycobacterium tuberculosis H37Rv
cggcagcgccaccga

SEQ ID NO: 1291396 - RNA, 20 nt, Mycobacterium tuberculosis H37Rv
cggcagcgagacuucgacgc

SEQ ID NO: 1291397 - RNA, 18 nt, Mycobacterium tuberculosis H37Rv
cggcagccaugcggcugc

SEQ ID NO: 1291398 - RNA, 19 nt, Mycobacterium tuberculosis H37Rv
cggcagccaccagcgacga

SEQ ID NO: 1291399 - RNA, 18 nt, Mycobacterium tuberculosis H37Rv
cggcagccaaccggcgca

SEQ ID NO: 1291400 - RNA, 15 nt, Mycobacterium tuberculosis H37Rv
cggcagcauccucga

SEQ ID NO: 1291401 - RNA, 22 nt, Mycobacterium tuberculosis H37Rv
cggauguggugucgaugccgau

SEQ ID NO: 1291402 - RNA, 19 nt, Mycobacterium tuberculosis H37Rv
cggauguugaccggcucga

SEQ ID NO: 1291403 - RNA, 20 nt, Mycobacterium tuberculosis H37Rv
cggauguugaccggcucgau

SEQ ID NO: 1291404 - RNA, 22 nt, Mycobacterium tuberculosis H37Rv
cggauguugaccggcucgaucu

SEQ ID NO: 1291405 - RNA, 19 nt, Mycobacterium tuberculosis H37Rv
cggaugucucggcaccaca

SEQ ID NO: 1291406 - RNA, 14 nt, Mycobacterium tuberculosis H37Rv
cggauguugaccgg

SEQ ID NO: 1291407 - RNA, 21 nt, Mycobacterium tuberculosis H37Rv
cggauucacgcacaagccucg

SEQ ID NO: 1291408 - RNA, 13 nt, Mycobacterium tuberculosis H37Rv
cggauggguacga

SEQ ID NO: 1291409 - RNA, 18 nt, Mycobacterium tuberculosis H37Rv
cggaugucgacgagcacc

SEQ ID NO: 1291410 - RNA, 22 nt, Mycobacterium tuberculosis H37Rv
cggaugucgugcgggcgcacca

SEQ ID NO: 1291411 - RNA, 20 nt, Mycobacterium tuberculosis H37Rv
cggauggccucgaacgccgc

SEQ ID NO: 1291412 - RNA, 17 nt, Mycobacterium tuberculosis H37Rv
cggaugcaacccgguga

SEQ ID NO: 1291413 - RNA, 22 nt, Mycobacterium tuberculosis H37Rv
cggaugacgcccagggcgucgg

SEQ ID NO: 1291414 - RNA, 17 nt, Mycobacterium tuberculosis H37Rv
cggaugacaccgaccgg

SEQ ID NO: 1291415 - RNA, 12 nt, Mycobacterium tuberculosis H37Rv
cggaugacaccg

SEQ ID NO: 1291416 - RNA, 17 nt, Mycobacterium tuberculosis H37Rv
cggaugagcucggccau

SEQ ID NO: 1291417 - RNA, 16 nt, Mycobacterium tuberculosis H37Rv
cggaugagcucggcca

SEQ ID NO: 1291418 - RNA, 20 nt, Mycobacterium tuberculosis H37Rv
cggcaaacuccagcuugccg

SEQ ID NO: 1291419 - RNA, 17 nt, Mycobacterium tuberculosis H37Rv
cggcaacaugagcgucg

SEQ ID NO: 1291420 - RNA, 19 nt, Mycobacterium tuberculosis H37Rv
cggcaacaugagcgucgcu

SEQ ID NO: 1291421 - RNA, 17 nt, Mycobacterium tuberculosis H37Rv
cggcaaccaccucgugg

SEQ ID NO: 1291422 - RNA, 17 nt, Mycobacterium tuberculosis H37Rv
cggcaacaaagucgcca

SEQ ID NO: 1291423 - RNA, 18 nt, Mycobacterium tuberculosis H37Rv
cggauuccggcucgucag

SEQ ID NO: 1291424 - RNA, 23 nt, Mycobacterium tuberculosis H37Rv
cggauugacgccgaaucuggggu

SEQ ID NO: 1291425 - RNA, 12 nt, Mycobacterium tuberculosis H37Rv
cggauucgggcg

SEQ ID NO: 1291426 - RNA, 22 nt, Mycobacterium tuberculosis H37Rv
cggauucaucacgggacgacgg

SEQ ID NO: 1291427 - RNA, 19 nt, Mycobacterium tuberculosis H37Rv
cggauucccgcccagcagc

SEQ ID NO: 1291428 - RNA, 21 nt, Mycobacterium tuberculosis H37Rv
cggauuucgucgggcaccgcc

SEQ ID NO: 1291429 - RNA, 17 nt, Mycobacterium tuberculosis H37Rv
cggauugcucgaucugu

SEQ ID NO: 1291430 - RNA, 15 nt, Mycobacterium tuberculosis H37Rv
cggagucacgcagcc

SEQ ID NO: 1291431 - RNA, 15 nt, Mycobacterium tuberculosis H37Rv
cggagucgacgacgu

SEQ ID NO: 1291432 - RNA, 22 nt, Mycobacterium tuberculosis H37Rv
cggaguacaagggaauugucga

SEQ ID NO: 1291433 - RNA, 14 nt, Mycobacterium tuberculosis H37Rv
cggaguaccgcgcg

SEQ ID NO: 1291434 - RNA, 18 nt, Mycobacterium tuberculosis H37Rv
cggaauccccccugucgc

SEQ ID NO: 1291435 - RNA, 14 nt, Mycobacterium tuberculosis H37Rv
cggaauauggcggc

SEQ ID NO: 1291436 - RNA, 21 nt, Mycobacterium tuberculosis H37Rv
cggaauagcaacgcugcagca

SEQ ID NO: 1291437 - RNA, 15 nt, Mycobacterium tuberculosis H37Rv
cggaaucgcgaaaca

SEQ ID NO: 1291438 - RNA, 12 nt, Mycobacterium tuberculosis H37Rv
cggaaucgcgac

SEQ ID NO: 1291439 - RNA, 16 nt, Mycobacterium tuberculosis H37Rv
cggaguugagcugucg

SEQ ID NO: 1291440 - RNA, 22 nt, Mycobacterium tuberculosis H37Rv
cggaguuuuucgggguggcggc

SEQ ID NO: 1291441 - RNA, 22 nt, Mycobacterium tuberculosis H37Rv
cggauacagccgccgccggcaa

SEQ ID NO: 1291442 - RNA, 17 nt, Mycobacterium tuberculosis H37Rv
cggaguuggcccgacgc

SEQ ID NO: 1291443 - RNA, 19 nt, Mycobacterium tuberculosis H37Rv
cggaguucuguaccggcug

SEQ ID NO: 1291444 - RNA, 20 nt, Mycobacterium tuberculosis H37Rv
cggaguucuuguagccgccg

SEQ ID NO: 1291445 - RNA, 19 nt, Mycobacterium tuberculosis H37Rv
cggaguuccgccauugccg

SEQ ID NO: 1291446 - RNA, 18 nt, Mycobacterium tuberculosis H37Rv
cggagucuucaacgucga

SEQ ID NO: 1291447 - RNA, 21 nt, Mycobacterium tuberculosis H37Rv
cggagucgguggucucggcau

SEQ ID NO: 1291448 - RNA, 18 nt, Mycobacterium tuberculosis H37Rv
cggagucuucgucgucgg

SEQ ID NO: 1291449 - RNA, 17 nt, Mycobacterium tuberculosis H37Rv
cggagucuucgucgucg

SEQ ID NO: 1291450 - RNA, 18 nt, Mycobacterium tuberculosis H37Rv
cggagugcauguccgacc

SEQ ID NO: 1291451 - RNA, 14 nt, Mycobacterium tuberculosis H37Rv
cggaguggccaguu

SEQ ID NO: 1291452 - RNA, 17 nt, Mycobacterium tuberculosis H37Rv
cggaucggccuguccac

SEQ ID NO: 1291453 - RNA, 14 nt, Mycobacterium tuberculosis H37Rv
cggaucggcucgcc

SEQ ID NO: 1291454 - RNA, 17 nt, Mycobacterium tuberculosis H37Rv
cggauccggaggcggcu

SEQ ID NO: 1291455 - RNA, 14 nt, Mycobacterium tuberculosis H37Rv
cggauccucggccg

SEQ ID NO: 1291456 - RNA, 20 nt, Mycobacterium tuberculosis H37Rv
cggaucccugugccagcagc

SEQ ID NO: 1291457 - RNA, 20 nt, Mycobacterium tuberculosis H37Rv
cggauacccuuugcacggug

SEQ ID NO: 1291458 - RNA, 20 nt, Mycobacterium tuberculosis H37Rv
cggauagcgucuggcgacau

SEQ ID NO: 1291459 - RNA, 12 nt, Mycobacterium tuberculosis H37Rv
gaucaccggcau

SEQ ID NO: 1291460 - RNA, 14 nt, Mycobacterium tuberculosis H37Rv
gaucaccgggguug

SEQ ID NO: 1291461 - RNA, 14 nt, Mycobacterium tuberculosis H37Rv
gaucaccgucgaca

SEQ ID NO: 1291462 - RNA, 18 nt, Mycobacterium tuberculosis H37Rv
gaucaccucccgcggcac

SEQ ID NO: 1291463 - RNA, 20 nt, Mycobacterium tuberculosis H37Rv
gaucaccucccgcggcaccu

SEQ ID NO: 1291464 - RNA, 13 nt, Mycobacterium tuberculosis H37Rv
gaucaccugcagc

SEQ ID NO: 1291465 - RNA, 19 nt, Mycobacterium tuberculosis H37Rv
gauaguugccgaggcggau

SEQ ID NO: 1291466 - RNA, 20 nt, Mycobacterium tuberculosis H37Rv
gauaguugccgaggcggaug

SEQ ID NO: 1291467 - RNA, 17 nt, Mycobacterium tuberculosis H37Rv
gauauggguugccagcg

SEQ ID NO: 1291468 - RNA, 21 nt, Mycobacterium tuberculosis H37Rv
gaucagcaugccuucggccaa

SEQ ID NO: 1291469 - RNA, 18 nt, Mycobacterium tuberculosis H37Rv
gaucacgucgucucggcg

SEQ ID NO: 1291470 - RNA, 23 nt, Mycobacterium tuberculosis H37Rv
gaucaccuucggccgaccgggcu

SEQ ID NO: 1291471 - RNA, 19 nt, Mycobacterium tuberculosis H37Rv
gaucagcaacggcagcgag

SEQ ID NO: 1291472 - RNA, 17 nt, Mycobacterium tuberculosis H37Rv
gaucagcagcggcgacc

SEQ ID NO: 1291473 - RNA, 18 nt, Mycobacterium tuberculosis H37Rv
gaucagcagccgccgaug

SEQ ID NO: 1291474 - RNA, 17 nt, Mycobacterium tuberculosis H37Rv
gaucagcaggaucggca

SEQ ID NO: 1291475 - RNA, 16 nt, Mycobacterium tuberculosis H37Rv
gauagcggcccgauca

SEQ ID NO: 1291476 - RNA, 23 nt, Mycobacterium tuberculosis H37Rv
gauagugcuccacguccggcgga

SEQ ID NO: 1291477 - RNA, 22 nt, Mycobacterium tuberculosis H37Rv
gauagcggcccgaucaccagcc

SEQ ID NO: 1291478 - RNA, 21 nt, Mycobacterium tuberculosis H37Rv
gauagcggcaaagccggguga

SEQ ID NO: 1291479 - RNA, 14 nt, Mycobacterium tuberculosis H37Rv
gauagccugcggcg

SEQ ID NO: 1291480 - RNA, 16 nt, Mycobacterium tuberculosis H37Rv
gauagccaccgacgac

SEQ ID NO: 1291481 - RNA, 20 nt, Mycobacterium tuberculosis H37Rv
gauacugcccgcguuugcga

SEQ ID NO: 1291482 - RNA, 14 nt, Mycobacterium tuberculosis H37Rv
gauagcaccggaau

SEQ ID NO: 1291483 - RNA, 16 nt, Mycobacterium tuberculosis H37Rv
gauagacuagccgauc

SEQ ID NO: 1291484 - RNA, 17 nt, Mycobacterium tuberculosis H37Rv
gauagacggcgacgaug

SEQ ID NO: 1291485 - RNA, 19 nt, Mycobacterium tuberculosis H37Rv
gauaccugcccacgcggau

SEQ ID NO: 1291486 - RNA, 19 nt, Mycobacterium tuberculosis H37Rv
gauacccgcguaccacggu

SEQ ID NO: 1291487 - RNA, 15 nt, Mycobacterium tuberculosis H37Rv
gauaccggucagcac

SEQ ID NO: 1291488 - RNA, 21 nt, Mycobacterium tuberculosis H37Rv
gaggcggugacgaagccgacc

SEQ ID NO: 1291489 - RNA, 20 nt, Mycobacterium tuberculosis H37Rv
gaggcguaccagcuggccac

SEQ ID NO: 1291490 - RNA, 21 nt, Mycobacterium tuberculosis H37Rv
gagggcaaggacaagccgcug

SEQ ID NO: 1291491 - RNA, 15 nt, Mycobacterium tuberculosis H37Rv
gaggcgugucgacuc

SEQ ID NO: 1291492 - RNA, 15 nt, Mycobacterium tuberculosis H37Rv
gaggcggcgacgacc

SEQ ID NO: 1291493 - RNA, 23 nt, Mycobacterium tuberculosis H37Rv
gaggccggugaacggcagcacgg

SEQ ID NO: 1291494 - RNA, 19 nt, Mycobacterium tuberculosis H37Rv
gagggcgucgccgccguug

SEQ ID NO: 1291495 - RNA, 14 nt, Mycobacterium tuberculosis H37Rv
gagggcgucgccgc

SEQ ID NO: 1291496 - RNA, 20 nt, Mycobacterium tuberculosis H37Rv
gagguagcugcgcgggucgu

SEQ ID NO: 1291497 - RNA, 13 nt, Mycobacterium tuberculosis H37Rv
gagguagucggcg

SEQ ID NO: 1291498 - RNA, 19 nt, Mycobacterium tuberculosis H37Rv
gaggucaccggcgaccggu

SEQ ID NO: 1291499 - RNA, 22 nt, Mycobacterium tuberculosis H37Rv
gagguauucguggucggccucg

SEQ ID NO: 1291500 - RNA, 14 nt, Mycobacterium tuberculosis H37Rv
gaggucaccggcga

SEQ ID NO: 1291501 - RNA, 17 nt, Mycobacterium tuberculosis H37Rv
gagggcggccgcgguga

SEQ ID NO: 1291502 - RNA, 18 nt, Mycobacterium tuberculosis H37Rv
gagggcggucagcggcca

SEQ ID NO: 1291503 - RNA, 24 nt, Mycobacterium tuberculosis H37Rv
gaggccgcacgucgaccucggcaa

SEQ ID NO: 1291504 - RNA, 13 nt, Mycobacterium tuberculosis H37Rv
gaggccgaccucg

SEQ ID NO: 1291505 - RNA, 13 nt, Mycobacterium tuberculosis H37Rv
gaggccgaccagc

SEQ ID NO: 1291506 - RNA, 21 nt, Mycobacterium tuberculosis H37Rv
gagcagacguaaaagcccccg

SEQ ID NO: 1291507 - RNA, 15 nt, Mycobacterium tuberculosis H37Rv
gagcagacgccgcgu

SEQ ID NO: 1291508 - RNA, 21 nt, Mycobacterium tuberculosis H37Rv
gagcagacgcauaagcccccg

SEQ ID NO: 1291509 - RNA, 21 nt, Mycobacterium tuberculosis H37Rv
gagcagacgcuaaagcccccg

SEQ ID NO: 1291510 - RNA, 14 nt, Mycobacterium tuberculosis H37Rv
gagcagaucgcggg

SEQ ID NO: 1291511 - RNA, 22 nt, Mycobacterium tuberculosis H37Rv
gaguucgaccggcgggacgucg

SEQ ID NO: 1291512 - RNA, 18 nt, Mycobacterium tuberculosis H37Rv
gaguuugaccaccugguu

SEQ ID NO: 1291513 - RNA, 14 nt, Mycobacterium tuberculosis H37Rv
gaguggccucgucc

SEQ ID NO: 1291514 - RNA, 20 nt, Mycobacterium tuberculosis H37Rv
gagugugaaucgcacgacgc

SEQ ID NO: 1291515 - RNA, 22 nt, Mycobacterium tuberculosis H37Rv
gagugguacggcucggcgcuga

SEQ ID NO: 1291516 - RNA, 23 nt, Mycobacterium tuberculosis H37Rv
gagugucuuagccagcagcacau

SEQ ID NO: 1291517 - RNA, 22 nt, Mycobacterium tuberculosis H37Rv
gagugugaaucgcacgacgcga

SEQ ID NO: 1291518 - RNA, 21 nt, Mycobacterium tuberculosis H37Rv
gaguggacgugucaucacggu

SEQ ID NO: 1291519 - RNA, 21 nt, Mycobacterium tuberculosis H37Rv
gaggugcucggaucggcucgc

SEQ ID NO: 1291520 - RNA, 19 nt, Mycobacterium tuberculosis H37Rv
gagguccuugaggauccgc

SEQ ID NO: 1291521 - RNA, 14 nt, Mycobacterium tuberculosis H37Rv
gagguccucgacga

SEQ ID NO: 1291522 - RNA, 22 nt, Mycobacterium tuberculosis H37Rv
gaggugccgcgcagcugccgca

SEQ ID NO: 1291523 - RNA, 14 nt, Mycobacterium tuberculosis H37Rv
gagguucugccgcg

SEQ ID NO: 1291524 - RNA, 14 nt, Mycobacterium tuberculosis H37Rv
gagucgucggcaug

SEQ ID NO: 1291525 - RNA, 15 nt, Mycobacterium tuberculosis H37Rv
gagugaacucguccu

SEQ ID NO: 1291526 - RNA, 20 nt, Mycobacterium tuberculosis H37Rv
gagucguuuggcgccgccga

SEQ ID NO: 1291527 - RNA, 13 nt, Mycobacterium tuberculosis H37Rv
gagugaauccggc

SEQ ID NO: 1291528 - RNA, 17 nt, Mycobacterium tuberculosis H37Rv
gagugauucggcgacga

SEQ ID NO: 1291529 - RNA, 14 nt, Mycobacterium tuberculosis H37Rv
gagucgggcuccgu

SEQ ID NO: 1291530 - RNA, 16 nt, Mycobacterium tuberculosis H37Rv
gaucaucccgaccagc

SEQ ID NO: 1291531 - RNA, 24 nt, Mycobacterium tuberculosis H37Rv
gaucaucgggaugcggacucagcg

SEQ ID NO: 1291532 - RNA, 21 nt, Mycobacterium tuberculosis H37Rv
gaucaguuugccaucgggacc

SEQ ID NO: 1291533 - RNA, 17 nt, Mycobacterium tuberculosis H37Rv
gaucaucaugucggcgc

SEQ ID NO: 1291534 - RNA, 15 nt, Mycobacterium tuberculosis H37Rv
gaucaucaccggcau

SEQ ID NO: 1291535 - RNA, 16 nt, Mycobacterium tuberculosis H37Rv
gaucaguucgugacgu

SEQ ID NO: 1291536 - RNA, 19 nt, Mycobacterium tuberculosis H37Rv
gaucauugcacccaccccg

SEQ ID NO: 1291537 - RNA, 21 nt, Mycobacterium tuberculosis H37Rv
gauccaccaagcucgcaaccg

SEQ ID NO: 1291538 - RNA, 23 nt, Mycobacterium tuberculosis H37Rv
gauccaccacgcuggccucgucg

SEQ ID NO: 1291539 - RNA, 13 nt, Mycobacterium tuberculosis H37Rv
gauccacgccgac

SEQ ID NO: 1291540 - RNA, 13 nt, Mycobacterium tuberculosis H37Rv
gauccaccggucc

SEQ ID NO: 1291541 - RNA, 18 nt, Mycobacterium tuberculosis H37Rv
gaucaugacgagccgagc

SEQ ID NO: 1291542 - RNA, 20 nt, Mycobacterium tuberculosis H37Rv
gaucaugaacgccagcagcg

SEQ ID NO: 1291543 - RNA, 23 nt, Mycobacterium tuberculosis H37Rv
gaucagggugucgaagagcaggc

SEQ ID NO: 1291544 - RNA, 14 nt, Mycobacterium tuberculosis H37Rv
gaucaggcgggcaa

SEQ ID NO: 1291545 - RNA, 13 nt, Mycobacterium tuberculosis H37Rv
gaucagcucgcgc

SEQ ID NO: 1291546 - RNA, 19 nt, Mycobacterium tuberculosis H37Rv
gaucagcgugucgccgaua

SEQ ID NO: 1291547 - RNA, 14 nt, Mycobacterium tuberculosis H37Rv
gaucagcucggucu

SEQ ID NO: 1291548 - RNA, 15 nt, Mycobacterium tuberculosis H37Rv
gaucagcgccggauc

SEQ ID NO: 1291549 - RNA, 14 nt, Mycobacterium tuberculosis H37Rv
gauccggcuccacc

SEQ ID NO: 1291550 - RNA, 18 nt, Mycobacterium tuberculosis H37Rv
gauccgcuagccccgauc

SEQ ID NO: 1291551 - RNA, 16 nt, Mycobacterium tuberculosis H37Rv
gauccgcgcuuggucc

SEQ ID NO: 1291552 - RNA, 14 nt, Mycobacterium tuberculosis H37Rv
gauccgccugccga

SEQ ID NO: 1291553 - RNA, 21 nt, Mycobacterium tuberculosis H37Rv
gauccagcaacgcgguggacc

SEQ ID NO: 1291554 - RNA, 16 nt, Mycobacterium tuberculosis H37Rv
gauccacucggcgauc

SEQ ID NO: 1291555 - RNA, 21 nt, Mycobacterium tuberculosis H37Rv
gauccacuguagggccgguga

SEQ ID NO: 1291556 - RNA, 17 nt, Mycobacterium tuberculosis H37Rv
gauccacuccggcgauc

SEQ ID NO: 1291557 - RNA, 13 nt, Mycobacterium tuberculosis H37Rv
gauccagcccgac

SEQ ID NO: 1291558 - RNA, 15 nt, Mycobacterium tuberculosis H37Rv
gauccagccgcgucg

SEQ ID NO: 1291559 - RNA, 14 nt, Mycobacterium tuberculosis H37Rv
gauccagcgcaccg

SEQ ID NO: 1291560 - RNA, 19 nt, Mycobacterium tuberculosis H37Rv
gauccagccgucggcgcug

SEQ ID NO: 1291561 - RNA, 17 nt, Mycobacterium tuberculosis H37Rv
gauccgcaccacgcccg

SEQ ID NO: 1291562 - RNA, 18 nt, Mycobacterium tuberculosis H37Rv
gauccaggcgucggugac

SEQ ID NO: 1291563 - RNA, 16 nt, Mycobacterium tuberculosis H37Rv
gauccagggagcggcu

SEQ ID NO: 1291564 - RNA, 15 nt, Mycobacterium tuberculosis H37Rv
gauccaggcccagcc

SEQ ID NO: 1291565 - RNA, 14 nt, Mycobacterium tuberculosis H37Rv
gaucgacacccgcu

SEQ ID NO: 1291566 - RNA, 17 nt, Mycobacterium tuberculosis H37Rv
gaucgacacccgcucgg

SEQ ID NO: 1291567 - RNA, 18 nt, Mycobacterium tuberculosis H37Rv
gaucgagguugacgucag

SEQ ID NO: 1291568 - RNA, 19 nt, Mycobacterium tuberculosis H37Rv
gaucgacacccgcucggcc

SEQ ID NO: 1291569 - RNA, 13 nt, Mycobacterium tuberculosis H37Rv
gaucgcaucgacg

SEQ ID NO: 1291570 - RNA, 21 nt, Mycobacterium tuberculosis H37Rv
gaucgcacaccaacaccgcgg

SEQ ID NO: 1291571 - RNA, 23 nt, Mycobacterium tuberculosis H37Rv
gaucgauucgucgcggaucagcc

SEQ ID NO: 1291572 - RNA, 15 nt, Mycobacterium tuberculosis H37Rv
gaucgccaccgguac

SEQ ID NO: 1291573 - RNA, 17 nt, Mycobacterium tuberculosis H37Rv
gaucgccaccgguaccg

SEQ ID NO: 1291574 - RNA, 14 nt, Mycobacterium tuberculosis H37Rv
gaucggucggcgug

SEQ ID NO: 1291575 - RNA, 15 nt, Mycobacterium tuberculosis H37Rv
gaucggucggcgugc

SEQ ID NO: 1291576 - RNA, 22 nt, Mycobacterium tuberculosis H37Rv
gaucgggcccaccgcugcggca

SEQ ID NO: 1291577 - RNA, 19 nt, Mycobacterium tuberculosis H37Rv
gaucggcuucuucuucuug

SEQ ID NO: 1291578 - RNA, 13 nt, Mycobacterium tuberculosis H37Rv
gaucggcucgcca

SEQ ID NO: 1291579 - RNA, 21 nt, Mycobacterium tuberculosis H37Rv
gaucggcucaccgaacgcgau

SEQ ID NO: 1291580 - RNA, 13 nt, Mycobacterium tuberculosis H37Rv
gaucggcucacga

SEQ ID NO: 1291581 - RNA, 18 nt, Mycobacterium tuberculosis H37Rv
gaucggcggccgcgacca

SEQ ID NO: 1291582 - RNA, 20 nt, Mycobacterium tuberculosis H37Rv
gaucggcggccgcgaccagc

SEQ ID NO: 1291583 - RNA, 23 nt, Mycobacterium tuberculosis H37Rv
gaucggcaggguggccagcaggc

SEQ ID NO: 1291584 - RNA, 21 nt, Mycobacterium tuberculosis H37Rv
gaucggcggaccgcagcguga

SEQ ID NO: 1291585 - RNA, 16 nt, Mycobacterium tuberculosis H37Rv
gaucggcggccgcgac

SEQ ID NO: 1291586 - RNA, 21 nt, Mycobacterium tuberculosis H37Rv
gaucggcaggguggccagcag

SEQ ID NO: 1291587 - RNA, 14 nt, Mycobacterium tuberculosis H37Rv
gaucggcgcgucga

SEQ ID NO: 1291588 - RNA, 15 nt, Mycobacterium tuberculosis H37Rv
gaucgccaggccguc

SEQ ID NO: 1291589 - RNA, 15 nt, Mycobacterium tuberculosis H37Rv
gaucgccaggccgag

SEQ ID NO: 1291590 - RNA, 17 nt, Mycobacterium tuberculosis H37Rv
gaucgccacuaccauca

SEQ ID NO: 1291591 - RNA, 16 nt, Mycobacterium tuberculosis H37Rv
gaucgccccagccaug

SEQ ID NO: 1291592 - RNA, 18 nt, Mycobacterium tuberculosis H37Rv
gaucgccgaggcagcguc

SEQ ID NO: 1291593 - RNA, 17 nt, Mycobacterium tuberculosis H37Rv
gaucgcccaggcgcgac

SEQ ID NO: 1291594 - RNA, 22 nt, Mycobacterium tuberculosis H37Rv
gaucgccgacaauggcagcgag

SEQ ID NO: 1291595 - RNA, 20 nt, Mycobacterium tuberculosis H37Rv
gaucgcccugacacccaucg

SEQ ID NO: 1291596 - RNA, 20 nt, Mycobacterium tuberculosis H37Rv
gaucggauugccuccgggua

SEQ ID NO: 1291597 - RNA, 22 nt, Mycobacterium tuberculosis H37Rv
gaucggauggugugucggguug

SEQ ID NO: 1291598 - RNA, 16 nt, Mycobacterium tuberculosis H37Rv
gaucggcaaucgacuc

SEQ ID NO: 1291599 - RNA, 24 nt, Mycobacterium tuberculosis H37Rv
gaucggcacuuagcccgauggugc

SEQ ID NO: 1291600 - RNA, 17 nt, Mycobacterium tuberculosis H37Rv
gaucgcggcggcgaucc

SEQ ID NO: 1291601 - RNA, 23 nt, Mycobacterium tuberculosis H37Rv
gaucgcggucaaauccagcagcc

SEQ ID NO: 1291602 - RNA, 12 nt, Mycobacterium tuberculosis H37Rv
gaucgucgacgc

SEQ ID NO: 1291603 - RNA, 15 nt, Mycobacterium tuberculosis H37Rv
gaucgucgcgaccuu

SEQ ID NO: 1291604 - RNA, 14 nt, Mycobacterium tuberculosis H37Rv
gaucguccagccca

SEQ ID NO: 1291605 - RNA, 19 nt, Mycobacterium tuberculosis H37Rv
gaucgucaguuacgcaucg

SEQ ID NO: 1291606 - RNA, 16 nt, Mycobacterium tuberculosis H37Rv
gaucgucacucccgac

SEQ ID NO: 1291607 - RNA, 17 nt, Mycobacterium tuberculosis H37Rv
gaucguccaccgccgac

SEQ ID NO: 1291608 - RNA, 17 nt, Mycobacterium tuberculosis H37Rv
gaucggugggcgggugc

SEQ ID NO: 1291609 - RNA, 19 nt, Mycobacterium tuberculosis H37Rv
gaucguagggacgccgagc

SEQ ID NO: 1291610 - RNA, 23 nt, Mycobacterium tuberculosis H37Rv
gaucgucacaccaguagcaccag

SEQ ID NO: 1291611 - RNA, 19 nt, Mycobacterium tuberculosis H37Rv
gaucguaggacucggcgga

SEQ ID NO: 1291612 - RNA, 17 nt, Mycobacterium tuberculosis H37Rv
gaucguagggacgccga

SEQ ID NO: 1291613 - RNA, 17 nt, Mycobacterium tuberculosis H37Rv
gaucucgucgcggucga

SEQ ID NO: 1291614 - RNA, 16 nt, Mycobacterium tuberculosis H37Rv
gaucucgaccggcuug

SEQ ID NO: 1291615 - RNA, 19 nt, Mycobacterium tuberculosis H37Rv
gaucucgacggccucgucg

SEQ ID NO: 1291616 - RNA, 22 nt, Mycobacterium tuberculosis H37Rv
gaucucugcggcggucucguca

SEQ ID NO: 1291617 - RNA, 19 nt, Mycobacterium tuberculosis H37Rv
gaucugcagcacucggugu

SEQ ID NO: 1291618 - RNA, 23 nt, Mycobacterium tuberculosis H37Rv
gaucugcagcgcggauucgguua

SEQ ID NO: 1291619 - RNA, 19 nt, Mycobacterium tuberculosis H37Rv
gaucuguuccucggugacu

SEQ ID NO: 1291620 - RNA, 23 nt, Mycobacterium tuberculosis H37Rv
gaucuggguaagggacaccagcu

SEQ ID NO: 1291621 - RNA, 17 nt, Mycobacterium tuberculosis H37Rv
gaucuucgagcgcauca

SEQ ID NO: 1291622 - RNA, 23 nt, Mycobacterium tuberculosis H37Rv
gaucuucgcgcuguacugcccca

SEQ ID NO: 1291623 - RNA, 19 nt, Mycobacterium tuberculosis H37Rv
gaugaacaguuucggcaug

SEQ ID NO: 1291624 - RNA, 16 nt, Mycobacterium tuberculosis H37Rv
gaugaacucggcgauc

SEQ ID NO: 1291625 - RNA, 18 nt, Mycobacterium tuberculosis H37Rv
gaugacaccgaccggguc

SEQ ID NO: 1291626 - RNA, 17 nt, Mycobacterium tuberculosis H37Rv
gaugacccacugcaggc

SEQ ID NO: 1291627 - RNA, 19 nt, Mycobacterium tuberculosis H37Rv
gaugaccaugaugaccggc

SEQ ID NO: 1291628 - RNA, 17 nt, Mycobacterium tuberculosis H37Rv
gaugacauccuugacgc

SEQ ID NO: 1291629 - RNA, 18 nt, Mycobacterium tuberculosis H37Rv
gaugaccagggucugcuc

SEQ ID NO: 1291630 - RNA, 12 nt, Mycobacterium tuberculosis H37Rv
gaugccgcggga

SEQ ID NO: 1291631 - RNA, 16 nt, Mycobacterium tuberculosis H37Rv
gaugccgccggcaccg

SEQ ID NO: 1291632 - RNA, 20 nt, Mycobacterium tuberculosis H37Rv
gaugccuugaccgcggucuu

SEQ ID NO: 1291633 - RNA, 14 nt, Mycobacterium tuberculosis H37Rv
gaugccuuccgacg

SEQ ID NO: 1291634 - RNA, 14 nt, Mycobacterium tuberculosis H37Rv
gaugcgacccgcag

SEQ ID NO: 1291635 - RNA, 19 nt, Mycobacterium tuberculosis H37Rv
gaugcucccuauugcugcg

SEQ ID NO: 1291636 - RNA, 23 nt, Mycobacterium tuberculosis H37Rv
gaugcgggcggcaagcucgacga

SEQ ID NO: 1291637 - RNA, 22 nt, Mycobacterium tuberculosis H37Rv
gaugcggccaugaaaaucggca

SEQ ID NO: 1291638 - RNA, 14 nt, Mycobacterium tuberculosis H37Rv
gaugcgcgccggcu

SEQ ID NO: 1291639 - RNA, 14 nt, Mycobacterium tuberculosis H37Rv
gaugcgcgcccgac

SEQ ID NO: 1291640 - RNA, 19 nt, Mycobacterium tuberculosis H37Rv
gauggccgcgcccgccucg

SEQ ID NO: 1291641 - RNA, 14 nt, Mycobacterium tuberculosis H37Rv
gauggcaucggcca

SEQ ID NO: 1291642 - RNA, 21 nt, Mycobacterium tuberculosis H37Rv
gauggcaccgcccccgucggc

SEQ ID NO: 1291643 - RNA, 19 nt, Mycobacterium tuberculosis H37Rv
gauggcaauauccgggagu

SEQ ID NO: 1291644 - RNA, 22 nt, Mycobacterium tuberculosis H37Rv
gauggcaccacuacaucgauca

SEQ ID NO: 1291645 - RNA, 12 nt, Mycobacterium tuberculosis H37Rv
gauggauuggcg

SEQ ID NO: 1291646 - RNA, 15 nt, Mycobacterium tuberculosis H37Rv
gauggauuggcguca

SEQ ID NO: 1291647 - RNA, 20 nt, Mycobacterium tuberculosis H37Rv
gauggcaaacgcacccaucg

SEQ ID NO: 1291648 - RNA, 14 nt, Mycobacterium tuberculosis H37Rv
gauggccucggcga

SEQ ID NO: 1291649 - RNA, 18 nt, Mycobacterium tuberculosis H37Rv
gauggccguccgaccgau

SEQ ID NO: 1291650 - RNA, 14 nt, Mycobacterium tuberculosis H37Rv
gauggccgucagcc

SEQ ID NO: 1291651 - RNA, 23 nt, Mycobacterium tuberculosis H37Rv
gauggcaagggccgacgucguug

SEQ ID NO: 1291652 - RNA, 20 nt, Mycobacterium tuberculosis H37Rv
gauggcgcaccggcgucggc

SEQ ID NO: 1291653 - RNA, 21 nt, Mycobacterium tuberculosis H37Rv
gauggcgaucaugagcagcac

SEQ ID NO: 1291654 - RNA, 22 nt, Mycobacterium tuberculosis H37Rv
gauggcgauacgcgcgucgggu

SEQ ID NO: 1291655 - RNA, 15 nt, Mycobacterium tuberculosis H37Rv
gaugggucaggccga

SEQ ID NO: 1291656 - RNA, 18 nt, Mycobacterium tuberculosis H37Rv
gaugggucaggccgacgu

SEQ ID NO: 1291657 - RNA, 19 nt, Mycobacterium tuberculosis H37Rv
gaugggucgaccggaaugc

SEQ ID NO: 1291658 - RNA, 14 nt, Mycobacterium tuberculosis H37Rv
gaugggugacggug

SEQ ID NO: 1291659 - RNA, 16 nt, Mycobacterium tuberculosis H37Rv
gauggucaaugccggc

SEQ ID NO: 1291660 - RNA, 17 nt, Mycobacterium tuberculosis H37Rv
gauggucagcagcucca

SEQ ID NO: 1291661 - RNA, 18 nt, Mycobacterium tuberculosis H37Rv
gauggguacccgaucacu

SEQ ID NO: 1291662 - RNA, 17 nt, Mycobacterium tuberculosis H37Rv
gauggguaccgcgggga

SEQ ID NO: 1291663 - RNA, 15 nt, Mycobacterium tuberculosis H37Rv
gaugggcgucgguca

SEQ ID NO: 1291664 - RNA, 23 nt, Mycobacterium tuberculosis H37Rv
gaugggccgguuccucagcggcc

SEQ ID NO: 1291665 - RNA, 14 nt, Mycobacterium tuberculosis H37Rv
gauggcgcgcaacg

SEQ ID NO: 1291666 - RNA, 12 nt, Mycobacterium tuberculosis H37Rv
gauggcgcgauc

SEQ ID NO: 1291667 - RNA, 18 nt, Mycobacterium tuberculosis H37Rv
gauucguugucgagcacg

SEQ ID NO: 1291668 - RNA, 14 nt, Mycobacterium tuberculosis H37Rv
gauucggcagcggc

SEQ ID NO: 1291669 - RNA, 17 nt, Mycobacterium tuberculosis H37Rv
gauucggacucgccgac

SEQ ID NO: 1291670 - RNA, 18 nt, Mycobacterium tuberculosis H37Rv
gauucgggaggcaaccca

SEQ ID NO: 1291671 - RNA, 15 nt, Mycobacterium tuberculosis H37Rv
gauucggcggucgcu

SEQ ID NO: 1291672 - RNA, 18 nt, Mycobacterium tuberculosis H37Rv
gauucgauguccucgaca

SEQ ID NO: 1291673 - RNA, 15 nt, Mycobacterium tuberculosis H37Rv
gauucgugucggugc

SEQ ID NO: 1291674 - RNA, 20 nt, Mycobacterium tuberculosis H37Rv
gauucugcgucugcucgcga

SEQ ID NO: 1291675 - RNA, 20 nt, Mycobacterium tuberculosis H37Rv
gauucugcgucugcucgcca

SEQ ID NO: 1291676 - RNA, 20 nt, Mycobacterium tuberculosis H37Rv
gauucugcgucugcucgcgc

SEQ ID NO: 1291677 - RNA, 22 nt, Mycobacterium tuberculosis H37Rv
gaugugcggcugcaccggcuug

SEQ ID NO: 1291678 - RNA, 15 nt, Mycobacterium tuberculosis H37Rv
gauguggucggacag

SEQ ID NO: 1291679 - RNA, 16 nt, Mycobacterium tuberculosis H37Rv
gaugugggcgcucgca

SEQ ID NO: 1291680 - RNA, 20 nt, Mycobacterium tuberculosis H37Rv
gaugugggcgccgucgccgu

SEQ ID NO: 1291681 - RNA, 23 nt, Mycobacterium tuberculosis H37Rv
gauggugaugggggagccgguga

SEQ ID NO: 1291682 - RNA, 19 nt, Mycobacterium tuberculosis H37Rv
gauggugcggccgcggcga

SEQ ID NO: 1291683 - RNA, 15 nt, Mycobacterium tuberculosis H37Rv
gcaaaccgaccguga

SEQ ID NO: 1291684 - RNA, 20 nt, Mycobacterium tuberculosis H37Rv
gauuucgugucgcugcggcg

SEQ ID NO: 1291685 - RNA, 20 nt, Mycobacterium tuberculosis H37Rv
gauuucgccggaacgcacgc

SEQ ID NO: 1291686 - RNA, 16 nt, Mycobacterium tuberculosis H37Rv
gauuucgcaguuggcg

SEQ ID NO: 1291687 - RNA, 18 nt, Mycobacterium tuberculosis H37Rv
gcaaaggccccggugacg

SEQ ID NO: 1291688 - RNA, 15 nt, Mycobacterium tuberculosis H37Rv
gcaaagcgagcaccg

SEQ ID NO: 1291689 - RNA, 20 nt, Mycobacterium tuberculosis H37Rv
gcaaacuucgcgcacgcccu

SEQ ID NO: 1291690 - RNA, 22 nt, Mycobacterium tuberculosis H37Rv
gcaaagccagcgcagccaggcu

SEQ ID NO: 1291691 - RNA, 14 nt, Mycobacterium tuberculosis H37Rv
gcaacaacguucgg

SEQ ID NO: 1291692 - RNA, 16 nt, Mycobacterium tuberculosis H37Rv
gcaacgggacgucacc

SEQ ID NO: 1291693 - RNA, 22 nt, Mycobacterium tuberculosis H37Rv
gcaacgggucgaugucggcaau

SEQ ID NO: 1291694 - RNA, 17 nt, Mycobacterium tuberculosis H37Rv
gcaacgggacgucaccg

SEQ ID NO: 1291695 - RNA, 23 nt, Mycobacterium tuberculosis H37Rv
gcaacggguacacccgcucgccc

SEQ ID NO: 1291696 - RNA, 16 nt, Mycobacterium tuberculosis H37Rv
gcaacgguuggucgaa

SEQ ID NO: 1291697 - RNA, 21 nt, Mycobacterium tuberculosis H37Rv
gcaacguguuaaccgggcacg

SEQ ID NO: 1291698 - RNA, 17 nt, Mycobacterium tuberculosis H37Rv
gcaacguguuaaccggg

SEQ ID NO: 1291699 - RNA, 20 nt, Mycobacterium tuberculosis H37Rv
gcaacguguuaaccgggcac

SEQ ID NO: 1291700 - RNA, 20 nt, Mycobacterium tuberculosis H37Rv
gcaacgcguauucggcaucg

SEQ ID NO: 1291701 - RNA, 13 nt, Mycobacterium tuberculosis H37Rv
gcaacgcgaaccg

SEQ ID NO: 1291702 - RNA, 21 nt, Mycobacterium tuberculosis H37Rv
gcaacgcgaucaccucgccac

SEQ ID NO: 1291703 - RNA, 18 nt, Mycobacterium tuberculosis H37Rv
gcaacggcgcgccgacca

SEQ ID NO: 1291704 - RNA, 20 nt, Mycobacterium tuberculosis H37Rv
gcaacggcgcgccgaccacc

SEQ ID NO: 1291705 - RNA, 15 nt, Mycobacterium tuberculosis H37Rv
gcaacggcgcgccga

SEQ ID NO: 1291706 - RNA, 14 nt, Mycobacterium tuberculosis H37Rv
gcaacggcagcgug

SEQ ID NO: 1291707 - RNA, 18 nt, Mycobacterium tuberculosis H37Rv
gcaacgcgaaccggccau

SEQ ID NO: 1291708 - RNA, 15 nt, Mycobacterium tuberculosis H37Rv
gcaacgccgauggcu

SEQ ID NO: 1291709 - RNA, 15 nt, Mycobacterium tuberculosis H37Rv
gcaacgaucgacacc

SEQ ID NO: 1291710 - RNA, 12 nt, Mycobacterium tuberculosis H37Rv
gcaacgaucgac

SEQ ID NO: 1291711 - RNA, 14 nt, Mycobacterium tuberculosis H37Rv
gcaacgaucgacac

SEQ ID NO: 1291712 - RNA, 18 nt, Mycobacterium tuberculosis H37Rv
gcaacgccauaccagcgu

SEQ ID NO: 1291713 - RNA, 12 nt, Mycobacterium tuberculosis H37Rv
gcaacgcaucga

SEQ ID NO: 1291714 - RNA, 18 nt, Mycobacterium tuberculosis H37Rv
gcaacgccaaaauggugc

SEQ ID NO: 1291715 - RNA, 19 nt, Mycobacterium tuberculosis H37Rv
gcaacgacggccgucgccc

SEQ ID NO: 1291716 - RNA, 21 nt, Mycobacterium tuberculosis H37Rv
gcaacgacauccagaugccca

SEQ ID NO: 1291717 - RNA, 18 nt, Mycobacterium tuberculosis H37Rv
gcaaccuguuccagcgug

SEQ ID NO: 1291718 - RNA, 17 nt, Mycobacterium tuberculosis H37Rv
gcaaccgugccgcauca

SEQ ID NO: 1291719 - RNA, 18 nt, Mycobacterium tuberculosis H37Rv
gcaaccgguaucgccgcu

SEQ ID NO: 1291720 - RNA, 21 nt, Mycobacterium tuberculosis H37Rv
gcaaccgggaggccaccgcga

SEQ ID NO: 1291721 - RNA, 14 nt, Mycobacterium tuberculosis H37Rv
gcaaccgguggaug

SEQ ID NO: 1291722 - RNA, 17 nt, Mycobacterium tuberculosis H37Rv
gcaacacgucggguugc

SEQ ID NO: 1291723 - RNA, 13 nt, Mycobacterium tuberculosis H37Rv
gcaacagcaacgg

SEQ ID NO: 1291724 - RNA, 18 nt, Mycobacterium tuberculosis H37Rv
gcaacagcgagcgguuga

SEQ ID NO: 1291725 - RNA, 12 nt, Mycobacterium tuberculosis H37Rv
gcaacagcgcca

SEQ ID NO: 1291726 - RNA, 20 nt, Mycobacterium tuberculosis H37Rv
gcaacauccccaugucggug

SEQ ID NO: 1291727 - RNA, 21 nt, Mycobacterium tuberculosis H37Rv
gcaacaucagcaggaccaacg

SEQ ID NO: 1291728 - RNA, 13 nt, Mycobacterium tuberculosis H37Rv
gcaacaucagcag

SEQ ID NO: 1291729 - RNA, 16 nt, Mycobacterium tuberculosis H37Rv
gcaacaucgagcgcca

SEQ ID NO: 1291730 - RNA, 23 nt, Mycobacterium tuberculosis H37Rv
gcaacaucgagcgccagccggug

SEQ ID NO: 1291731 - RNA, 17 nt, Mycobacterium tuberculosis H37Rv
gcaacaguucacgccgg

SEQ ID NO: 1291732 - RNA, 18 nt, Mycobacterium tuberculosis H37Rv
gcaacauuuucgcccgcu

SEQ ID NO: 1291733 - RNA, 20 nt, Mycobacterium tuberculosis H37Rv
gcaaccaauaggugucgacg

SEQ ID NO: 1291734 - RNA, 17 nt, Mycobacterium tuberculosis H37Rv
gcaaccacggcggcauc

SEQ ID NO: 1291735 - RNA, 14 nt, Mycobacterium tuberculosis H37Rv
gcaaccacguccgc

SEQ ID NO: 1291736 - RNA, 15 nt, Mycobacterium tuberculosis H37Rv
gcaaccacguccgca

SEQ ID NO: 1291737 - RNA, 21 nt, Mycobacterium tuberculosis H37Rv
gcaaccccaaguccagcagcg

SEQ ID NO: 1291738 - RNA, 14 nt, Mycobacterium tuberculosis H37Rv
gcaacccugcggug

SEQ ID NO: 1291739 - RNA, 13 nt, Mycobacterium tuberculosis H37Rv
gcaacccggucgg

SEQ ID NO: 1291740 - RNA, 14 nt, Mycobacterium tuberculosis H37Rv
gcaacccguugugg

SEQ ID NO: 1291741 - RNA, 14 nt, Mycobacterium tuberculosis H37Rv
gcaacccgccguug

SEQ ID NO: 1291742 - RNA, 19 nt, Mycobacterium tuberculosis H37Rv
gcaacccgccguugccacc

SEQ ID NO: 1291743 - RNA, 23 nt, Mycobacterium tuberculosis H37Rv
gcaacccgccguugccaccggug

SEQ ID NO: 1291744 - RNA, 13 nt, Mycobacterium tuberculosis H37Rv
gcaaccgccaucg

SEQ ID NO: 1291745 - RNA, 15 nt, Mycobacterium tuberculosis H37Rv
gcaaccgcucggcga

SEQ ID NO: 1291746 - RNA, 16 nt, Mycobacterium tuberculosis H37Rv
gcaaccggcgugucga

SEQ ID NO: 1291747 - RNA, 16 nt, Mycobacterium tuberculosis H37Rv
gcaaccgcucggcgau

SEQ ID NO: 1291748 - RNA, 19 nt, Mycobacterium tuberculosis H37Rv
gcaaccggauuucgucggg

SEQ ID NO: 1291749 - RNA, 19 nt, Mycobacterium tuberculosis H37Rv
gcaaccgccgugugccacg

SEQ ID NO: 1291750 - RNA, 15 nt, Mycobacterium tuberculosis H37Rv
gcaacucgaucgccu

SEQ ID NO: 1291751 - RNA, 16 nt, Mycobacterium tuberculosis H37Rv
gcaagaaugccgccga

SEQ ID NO: 1291752 - RNA, 23 nt, Mycobacterium tuberculosis H37Rv
gcaagaaaguuccacgacaaccg

SEQ ID NO: 1291753 - RNA, 15 nt, Mycobacterium tuberculosis H37Rv
gcaagaucaccuucg

SEQ ID NO: 1291754 - RNA, 23 nt, Mycobacterium tuberculosis H37Rv
gcaagccacgccggucgcgguca

SEQ ID NO: 1291755 - RNA, 21 nt, Mycobacterium tuberculosis H37Rv
gcaagaucaccuucgucgcgg

SEQ ID NO: 1291756 - RNA, 16 nt, Mycobacterium tuberculosis H37Rv
gcaagcugucgucgcc

SEQ ID NO: 1291757 - RNA, 15 nt, Mycobacterium tuberculosis H37Rv
gcaaggacguggcgc

SEQ ID NO: 1291758 - RNA, 15 nt, Mycobacterium tuberculosis H37Rv
gcaaggcccgcaccg

SEQ ID NO: 1291759 - RNA, 15 nt, Mycobacterium tuberculosis H37Rv
gcaaggcauccaacg

SEQ ID NO: 1291760 - RNA, 14 nt, Mycobacterium tuberculosis H37Rv
gcaagcugaccgcc

SEQ ID NO: 1291761 - RNA, 20 nt, Mycobacterium tuberculosis H37Rv
gcacaaucggauagccgugc

SEQ ID NO: 1291762 - RNA, 16 nt, Mycobacterium tuberculosis H37Rv
gcacacaccguaccga

SEQ ID NO: 1291763 - RNA, 13 nt, Mycobacterium tuberculosis H37Rv
gcacacagaccgu

SEQ ID NO: 1291764 - RNA, 15 nt, Mycobacterium tuberculosis H37Rv
gcacaccaccgccga

SEQ ID NO: 1291765 - RNA, 14 nt, Mycobacterium tuberculosis H37Rv
gcaauugccugcgc

SEQ ID NO: 1291766 - RNA, 18 nt, Mycobacterium tuberculosis H37Rv
gcacaagauccgccacgc

SEQ ID NO: 1291767 - RNA, 13 nt, Mycobacterium tuberculosis H37Rv
gcacaaggcguga

SEQ ID NO: 1291768 - RNA, 15 nt, Mycobacterium tuberculosis H37Rv
gcaaugacggccugc

SEQ ID NO: 1291769 - RNA, 17 nt, Mycobacterium tuberculosis H37Rv
gcaaugacgucgucggc

SEQ ID NO: 1291770 - RNA, 16 nt, Mycobacterium tuberculosis H37Rv
gcaaugaccugcagcg

SEQ ID NO: 1291771 - RNA, 21 nt, Mycobacterium tuberculosis H37Rv
gcaaugaccugcagcgcaucc

SEQ ID NO: 1291772 - RNA, 11 nt, Mycobacterium tuberculosis H37Rv
gcaauccgcaa

SEQ ID NO: 1291773 - RNA, 20 nt, Mycobacterium tuberculosis H37Rv
gcaauccccuggaaagggcc

SEQ ID NO: 1291774 - RNA, 22 nt, Mycobacterium tuberculosis H37Rv
gcaaucaucucccgaccgccga

SEQ ID NO: 1291775 - RNA, 13 nt, Mycobacterium tuberculosis H37Rv
gcaaggucgcugc

SEQ ID NO: 1291776 - RNA, 12 nt, Mycobacterium tuberculosis H37Rv
gcaagucgccga

SEQ ID NO: 1291777 - RNA, 17 nt, Mycobacterium tuberculosis H37Rv
gcaagugggugccggca

SEQ ID NO: 1291778 - RNA, 21 nt, Mycobacterium tuberculosis H37Rv
gcaagugucuccggcaacagc

SEQ ID NO: 1291779 - RNA, 18 nt, Mycobacterium tuberculosis H37Rv
gcacucagcaggggaucg

SEQ ID NO: 1291780 - RNA, 16 nt, Mycobacterium tuberculosis H37Rv
gcacuccacgaucggc

SEQ ID NO: 1291781 - RNA, 16 nt, Mycobacterium tuberculosis H37Rv
gcacguugucgggcug

SEQ ID NO: 1291782 - RNA, 15 nt, Mycobacterium tuberculosis H37Rv
gcacguugacgucca

SEQ ID NO: 1291783 - RNA, 16 nt, Mycobacterium tuberculosis H37Rv
gcacgugugcgggcac

SEQ ID NO: 1291784 - RNA, 17 nt, Mycobacterium tuberculosis H37Rv
gcacguugacguccaac

SEQ ID NO: 1291785 - RNA, 13 nt, Mycobacterium tuberculosis H37Rv
gcacguugccgaa

SEQ ID NO: 1291786 - RNA, 21 nt, Mycobacterium tuberculosis H37Rv
gcacgggugagcaccacgugc

SEQ ID NO: 1291787 - RNA, 14 nt, Mycobacterium tuberculosis H37Rv
gcacgguaucggug

SEQ ID NO: 1291788 - RNA, 19 nt, Mycobacterium tuberculosis H37Rv
gcacggguaaucaccgaau

SEQ ID NO: 1291789 - RNA, 22 nt, Mycobacterium tuberculosis H37Rv
gcacggucgcccgaucggcgga

SEQ ID NO: 1291790 - RNA, 15 nt, Mycobacterium tuberculosis H37Rv
gcacggucaacgauc

SEQ ID NO: 1291791 - RNA, 20 nt, Mycobacterium tuberculosis H37Rv
gcacggucgcccgaucggcg

SEQ ID NO: 1291792 - RNA, 12 nt, Mycobacterium tuberculosis H37Rv
gcacguggcgac

SEQ ID NO: 1291793 - RNA, 20 nt, Mycobacterium tuberculosis H37Rv
gcacgugaugcccugggggu

SEQ ID NO: 1291794 - RNA, 16 nt, Mycobacterium tuberculosis H37Rv
gcacugcggcagcgaa

SEQ ID NO: 1291795 - RNA, 16 nt, Mycobacterium tuberculosis H37Rv
gcacugccccgcaucg

SEQ ID NO: 1291796 - RNA, 21 nt, Mycobacterium tuberculosis H37Rv
gcacuucguuuuccagccgac

SEQ ID NO: 1291797 - RNA, 20 nt, Mycobacterium tuberculosis H37Rv
gcacuucggugccgugaucg

SEQ ID NO: 1291798 - RNA, 20 nt, Mycobacterium tuberculosis H37Rv
gcacuuccaagccgaccugc

SEQ ID NO: 1291799 - RNA, 14 nt, Mycobacterium tuberculosis H37Rv
gcacugugagguca

SEQ ID NO: 1291800 - RNA, 22 nt, Mycobacterium tuberculosis H37Rv
gcacuggugcccgacccgccga

SEQ ID NO: 1291801 - RNA, 22 nt, Mycobacterium tuberculosis H37Rv
gcacugucgagguggucgaccc

SEQ ID NO: 1291802 - RNA, 21 nt, Mycobacterium tuberculosis H37Rv
gcacugucgagguggucgacc

SEQ ID NO: 1291803 - RNA, 20 nt, Mycobacterium tuberculosis H37Rv
gcacuggugcccgacccgcc

SEQ ID NO: 1291804 - RNA, 13 nt, Mycobacterium tuberculosis H37Rv
gcacgaccugguu

SEQ ID NO: 1291805 - RNA, 22 nt, Mycobacterium tuberculosis H37Rv
gcacgacgacaaccggccagau

SEQ ID NO: 1291806 - RNA, 15 nt, Mycobacterium tuberculosis H37Rv
gcacgcccucgacgc

SEQ ID NO: 1291807 - RNA, 13 nt, Mycobacterium tuberculosis H37Rv
gcacgcucggcgu

SEQ ID NO: 1291808 - RNA, 14 nt, Mycobacterium tuberculosis H37Rv
gcacgcucggcacg

SEQ ID NO: 1291809 - RNA, 22 nt, Mycobacterium tuberculosis H37Rv
gcacgcgaggcgcucacccgcc

SEQ ID NO: 1291810 - RNA, 15 nt, Mycobacterium tuberculosis H37Rv
gcacgcugaccggau

SEQ ID NO: 1291811 - RNA, 15 nt, Mycobacterium tuberculosis H37Rv
gcacgcugcugcggg

SEQ ID NO: 1291812 - RNA, 22 nt, Mycobacterium tuberculosis H37Rv
gcacggcacccacccguucggc

SEQ ID NO: 1291813 - RNA, 13 nt, Mycobacterium tuberculosis H37Rv
gcacggccgagca

SEQ ID NO: 1291814 - RNA, 14 nt, Mycobacterium tuberculosis H37Rv
gcacggccgcagcc

SEQ ID NO: 1291815 - RNA, 21 nt, Mycobacterium tuberculosis H37Rv
gcacggccccugccacgacga

SEQ ID NO: 1291816 - RNA, 16 nt, Mycobacterium tuberculosis H37Rv
gcacggcgaucgguga

SEQ ID NO: 1291817 - RNA, 20 nt, Mycobacterium tuberculosis H37Rv
gcacggcgaaugcauuggcg

SEQ ID NO: 1291818 - RNA, 19 nt, Mycobacterium tuberculosis H37Rv
gcacggcgauugcccgugc

SEQ ID NO: 1291819 - RNA, 19 nt, Mycobacterium tuberculosis H37Rv
gcacggggaccuuggcgac

SEQ ID NO: 1291820 - RNA, 17 nt, Mycobacterium tuberculosis H37Rv
gcacggggaccgggcug

SEQ ID NO: 1291821 - RNA, 20 nt, Mycobacterium tuberculosis H37Rv
gcacggccgucgacgaucag

SEQ ID NO: 1291822 - RNA, 18 nt, Mycobacterium tuberculosis H37Rv
gcacggcgacgccagugu

SEQ ID NO: 1291823 - RNA, 13 nt, Mycobacterium tuberculosis H37Rv
gcacggccgucga

SEQ ID NO: 1291824 - RNA, 19 nt, Mycobacterium tuberculosis H37Rv
gcacggccgggacggcgau

SEQ ID NO: 1291825 - RNA, 20 nt, Mycobacterium tuberculosis H37Rv
gcacgaaaccgcagcgcgaa

SEQ ID NO: 1291826 - RNA, 14 nt, Mycobacterium tuberculosis H37Rv
gcacgaaccggucg

SEQ ID NO: 1291827 - RNA, 15 nt, Mycobacterium tuberculosis H37Rv
gcacgaaccggucga

SEQ ID NO: 1291828 - RNA, 17 nt, Mycobacterium tuberculosis H37Rv
gcacgaacgaguccaac

SEQ ID NO: 1291829 - RNA, 20 nt, Mycobacterium tuberculosis H37Rv
gcacgacccgggaaggaacc

SEQ ID NO: 1291830 - RNA, 16 nt, Mycobacterium tuberculosis H37Rv
gcaccugcgaggugcc

SEQ ID NO: 1291831 - RNA, 15 nt, Mycobacterium tuberculosis H37Rv
gcaccugaucgguca

SEQ ID NO: 1291832 - RNA, 21 nt, Mycobacterium tuberculosis H37Rv
gcaccuccagcaccaccggaa

SEQ ID NO: 1291833 - RNA, 13 nt, Mycobacterium tuberculosis H37Rv
gcaccuacccugc

SEQ ID NO: 1291834 - RNA, 22 nt, Mycobacterium tuberculosis H37Rv
gcaccgugggcccuucacuguu

SEQ ID NO: 1291835 - RNA, 18 nt, Mycobacterium tuberculosis H37Rv
gcaccgugucgacgguca

SEQ ID NO: 1291836 - RNA, 15 nt, Mycobacterium tuberculosis H37Rv
gcaccuccgccggca

SEQ ID NO: 1291837 - RNA, 13 nt, Mycobacterium tuberculosis H37Rv
gcaccucgaccgc

SEQ ID NO: 1291838 - RNA, 17 nt, Mycobacterium tuberculosis H37Rv
gcaccgugacagcggca

SEQ ID NO: 1291839 - RNA, 21 nt, Mycobacterium tuberculosis H37Rv
gcaccggccgugccgccgaca

SEQ ID NO: 1291840 - RNA, 15 nt, Mycobacterium tuberculosis H37Rv
gcaccggaucggcua

SEQ ID NO: 1291841 - RNA, 21 nt, Mycobacterium tuberculosis H37Rv
gcaccggagaacgggucgacg

SEQ ID NO: 1291842 - RNA, 22 nt, Mycobacterium tuberculosis H37Rv
gcaccgaugccuugaccgcggu

SEQ ID NO: 1291843 - RNA, 15 nt, Mycobacterium tuberculosis H37Rv
gcaccgauccuggac

SEQ ID NO: 1291844 - RNA, 18 nt, Mycobacterium tuberculosis H37Rv
gcaccgauuuuggcaagc

SEQ ID NO: 1291845 - RNA, 21 nt, Mycobacterium tuberculosis H37Rv
gcaccgauuuuggcaagcugc

SEQ ID NO: 1291846 - RNA, 20 nt, Mycobacterium tuberculosis H37Rv
gcaccgauuuccucugggcu

SEQ ID NO: 1291847 - RNA, 23 nt, Mycobacterium tuberculosis H37Rv
gcaccgcauaacgcgaacccgcg

SEQ ID NO: 1291848 - RNA, 18 nt, Mycobacterium tuberculosis H37Rv
gcaccgaugcugacgaug

SEQ ID NO: 1291849 - RNA, 13 nt, Mycobacterium tuberculosis H37Rv
gcaccgccggcaa

SEQ ID NO: 1291850 - RNA, 14 nt, Mycobacterium tuberculosis H37Rv
gcaccgccggcgac

SEQ ID NO: 1291851 - RNA, 19 nt, Mycobacterium tuberculosis H37Rv
gcaccgccggcaccgccgg

SEQ ID NO: 1291852 - RNA, 15 nt, Mycobacterium tuberculosis H37Rv
gcaccgcgccgaaca

SEQ ID NO: 1291853 - RNA, 13 nt, Mycobacterium tuberculosis H37Rv
gcaccgcgccgaa

SEQ ID NO: 1291854 - RNA, 14 nt, Mycobacterium tuberculosis H37Rv
gcaccgcggccagc

SEQ ID NO: 1291855 - RNA, 13 nt, Mycobacterium tuberculosis H37Rv
gcaccgccugcgc

SEQ ID NO: 1291856 - RNA, 19 nt, Mycobacterium tuberculosis H37Rv
gcaccgcgaaagaacaucu

SEQ ID NO: 1291857 - RNA, 13 nt, Mycobacterium tuberculosis H37Rv
gcaccgcgaccgc

SEQ ID NO: 1291858 - RNA, 12 nt, Mycobacterium tuberculosis H37Rv
gcacccgucggg

SEQ ID NO: 1291859 - RNA, 16 nt, Mycobacterium tuberculosis H37Rv
gcacccgugccgccga

SEQ ID NO: 1291860 - RNA, 14 nt, Mycobacterium tuberculosis H37Rv
gcacccggucggcc

SEQ ID NO: 1291861 - RNA, 21 nt, Mycobacterium tuberculosis H37Rv
gcacccggcuguucucgccga

SEQ ID NO: 1291862 - RNA, 17 nt, Mycobacterium tuberculosis H37Rv
gcacccggcuucgccgc

SEQ ID NO: 1291863 - RNA, 22 nt, Mycobacterium tuberculosis H37Rv
gcacccggcuguucucgccgaa

SEQ ID NO: 1291864 - RNA, 15 nt, Mycobacterium tuberculosis H37Rv
gcacccgggccacgu

SEQ ID NO: 1291865 - RNA, 20 nt, Mycobacterium tuberculosis H37Rv
gcacccgggccacgucgagc

SEQ ID NO: 1291866 - RNA, 22 nt, Mycobacterium tuberculosis H37Rv
gcacccgggccacgucgagcac

SEQ ID NO: 1291867 - RNA, 20 nt, Mycobacterium tuberculosis H37Rv
gcacccggggggccucguug

SEQ ID NO: 1291868 - RNA, 12 nt, Mycobacterium tuberculosis H37Rv
gcacaccgucgc

SEQ ID NO: 1291869 - RNA, 12 nt, Mycobacterium tuberculosis H37Rv
gcacccgcucgu

SEQ ID NO: 1291870 - RNA, 13 nt, Mycobacterium tuberculosis H37Rv
gcacaccggcacu

SEQ ID NO: 1291871 - RNA, 15 nt, Mycobacterium tuberculosis H37Rv
gcacccgcuggcggu

SEQ ID NO: 1291872 - RNA, 16 nt, Mycobacterium tuberculosis H37Rv
gcacccgcuggcggua

SEQ ID NO: 1291873 - RNA, 16 nt, Mycobacterium tuberculosis H37Rv
gcacccgcuggucgag

SEQ ID NO: 1291874 - RNA, 13 nt, Mycobacterium tuberculosis H37Rv
gcacccggccacc

SEQ ID NO: 1291875 - RNA, 16 nt, Mycobacterium tuberculosis H37Rv
gcacacccaucaccgc

SEQ ID NO: 1291876 - RNA, 14 nt, Mycobacterium tuberculosis H37Rv
gcacacccgcaccg

SEQ ID NO: 1291877 - RNA, 19 nt, Mycobacterium tuberculosis H37Rv
gcacacccaucaccgccag

SEQ ID NO: 1291878 - RNA, 21 nt, Mycobacterium tuberculosis H37Rv
gcacacccuccacagcggcca

SEQ ID NO: 1291879 - RNA, 14 nt, Mycobacterium tuberculosis H37Rv
gcacaccgccagcg

SEQ ID NO: 1291880 - RNA, 17 nt, Mycobacterium tuberculosis H37Rv
gcacaccgaggucgcca

SEQ ID NO: 1291881 - RNA, 17 nt, Mycobacterium tuberculosis H37Rv
gcagacgaaguagccga

SEQ ID NO: 1291882 - RNA, 20 nt, Mycobacterium tuberculosis H37Rv
gcagacgcagaaucgcccaa

SEQ ID NO: 1291883 - RNA, 20 nt, Mycobacterium tuberculosis H37Rv
gcagacgcagaaucgcauug

SEQ ID NO: 1291884 - RNA, 20 nt, Mycobacterium tuberculosis H37Rv
gcagacgcagaaucgcauga

SEQ ID NO: 1291885 - RNA, 20 nt, Mycobacterium tuberculosis H37Rv
gcagacgcagaaucgcacgc

SEQ ID NO: 1291886 - RNA, 19 nt, Mycobacterium tuberculosis H37Rv
gcagacgcagaaucgcaca

SEQ ID NO: 1291887 - RNA, 20 nt, Mycobacterium tuberculosis H37Rv
gcagacgcaaaaucgcccaa

SEQ ID NO: 1291888 - RNA, 19 nt, Mycobacterium tuberculosis H37Rv
gcagacgcaaaaucgcccg

SEQ ID NO: 1291889 - RNA, 22 nt, Mycobacterium tuberculosis H37Rv
gcagacgcguuucgucgaccgc

SEQ ID NO: 1291890 - RNA, 15 nt, Mycobacterium tuberculosis H37Rv
gcagacggcugccac

SEQ ID NO: 1291891 - RNA, 15 nt, Mycobacterium tuberculosis H37Rv
gcagaccaaguccgg

SEQ ID NO: 1291892 - RNA, 12 nt, Mycobacterium tuberculosis H37Rv
gcagacccgugc

SEQ ID NO: 1291893 - RNA, 17 nt, Mycobacterium tuberculosis H37Rv
gcagacccucgucgucg

SEQ ID NO: 1291894 - RNA, 22 nt, Mycobacterium tuberculosis H37Rv
gcagaccacaacgccucgccau

SEQ ID NO: 1291895 - RNA, 15 nt, Mycobacterium tuberculosis H37Rv
gcagaccgaucggca

SEQ ID NO: 1291896 - RNA, 18 nt, Mycobacterium tuberculosis H37Rv
gcagaccggugagcaccg

SEQ ID NO: 1291897 - RNA, 23 nt, Mycobacterium tuberculosis H37Rv
gcagaccgguuucuucggccagc

SEQ ID NO: 1291898 - RNA, 20 nt, Mycobacterium tuberculosis H37Rv
gcagacacagaaucgcccau

SEQ ID NO: 1291899 - RNA, 12 nt, Mycobacterium tuberculosis H37Rv
gcagaaucgccu

SEQ ID NO: 1291900 - RNA, 15 nt, Mycobacterium tuberculosis H37Rv
gcagaauccggucga

SEQ ID NO: 1291901 - RNA, 19 nt, Mycobacterium tuberculosis H37Rv
gcagaauccggucgaugac

SEQ ID NO: 1291902 - RNA, 20 nt, Mycobacterium tuberculosis H37Rv
gcagaauccggcaaccaccg

SEQ ID NO: 1291903 - RNA, 19 nt, Mycobacterium tuberculosis H37Rv
gcagaaguccucggcggac

SEQ ID NO: 1291904 - RNA, 15 nt, Mycobacterium tuberculosis H37Rv
gcagaagaguguccc

SEQ ID NO: 1291905 - RNA, 20 nt, Mycobacterium tuberculosis H37Rv
gcacuuuugcgugguggacg

SEQ ID NO: 1291906 - RNA, 14 nt, Mycobacterium tuberculosis H37Rv
gcagaaacaucgac

SEQ ID NO: 1291907 - RNA, 16 nt, Mycobacterium tuberculosis H37Rv
gcagaaaccauucggc

SEQ ID NO: 1291908 - RNA, 19 nt, Mycobacterium tuberculosis H37Rv
gcagaacaccaccgccaga

SEQ ID NO: 1291909 - RNA, 14 nt, Mycobacterium tuberculosis H37Rv
gcagcaacgacccg

SEQ ID NO: 1291910 - RNA, 21 nt, Mycobacterium tuberculosis H37Rv
gcagcaacggcggcgucgcgg

SEQ ID NO: 1291911 - RNA, 12 nt, Mycobacterium tuberculosis H37Rv
gcagacugccga

SEQ ID NO: 1291912 - RNA, 21 nt, Mycobacterium tuberculosis H37Rv
gcagacucgauaugcagcucg

SEQ ID NO: 1291913 - RNA, 13 nt, Mycobacterium tuberculosis H37Rv
gcagacucgccac

SEQ ID NO: 1291914 - RNA, 18 nt, Mycobacterium tuberculosis H37Rv
gcagagaccaagguccgc

SEQ ID NO: 1291915 - RNA, 14 nt, Mycobacterium tuberculosis H37Rv
gcagacucggcgau

SEQ ID NO: 1291916 - RNA, 15 nt, Mycobacterium tuberculosis H37Rv
gcagcagcgccgcgu

SEQ ID NO: 1291917 - RNA, 19 nt, Mycobacterium tuberculosis H37Rv
gcagcagcgggcuggcgaa

SEQ ID NO: 1291918 - RNA, 14 nt, Mycobacterium tuberculosis H37Rv
gcagcacgucaacc

SEQ ID NO: 1291919 - RNA, 15 nt, Mycobacterium tuberculosis H37Rv
gcagcacgucaaccu

SEQ ID NO: 1291920 - RNA, 17 nt, Mycobacterium tuberculosis H37Rv
gcagcacgucaaccucg

SEQ ID NO: 1291921 - RNA, 15 nt, Mycobacterium tuberculosis H37Rv
gcagcaccucgucga

SEQ ID NO: 1291922 - RNA, 17 nt, Mycobacterium tuberculosis H37Rv
gcagcaagccgccggug

SEQ ID NO: 1291923 - RNA, 13 nt, Mycobacterium tuberculosis H37Rv
gcagcaagccgcc

SEQ ID NO: 1291924 - RNA, 15 nt, Mycobacterium tuberculosis H37Rv
gcagcggcgucgucg

SEQ ID NO: 1291925 - RNA, 21 nt, Mycobacterium tuberculosis H37Rv
gcagcggcggaaggacggcag

SEQ ID NO: 1291926 - RNA, 23 nt, Mycobacterium tuberculosis H37Rv
gcagcggcggaaggacggcagcc

SEQ ID NO: 1291927 - RNA, 22 nt, Mycobacterium tuberculosis H37Rv
gcagcgggaucaugaccaucga

SEQ ID NO: 1291928 - RNA, 20 nt, Mycobacterium tuberculosis H37Rv
gcagcggcgaccgcggucgc

SEQ ID NO: 1291929 - RNA, 17 nt, Mycobacterium tuberculosis H37Rv
gcagcggcgaccgcggu

SEQ ID NO: 1291930 - RNA, 13 nt, Mycobacterium tuberculosis H37Rv
gcagcgcgucgcc

SEQ ID NO: 1291931 - RNA, 15 nt, Mycobacterium tuberculosis H37Rv
gcagcgcucguuccg

SEQ ID NO: 1291932 - RNA, 13 nt, Mycobacterium tuberculosis H37Rv
gcagcgcgaucgc

SEQ ID NO: 1291933 - RNA, 22 nt, Mycobacterium tuberculosis H37Rv
gcagcgcggccacccgcgacga

SEQ ID NO: 1291934 - RNA, 19 nt, Mycobacterium tuberculosis H37Rv
gcagcgcgacaaaguucga

SEQ ID NO: 1291935 - RNA, 23 nt, Mycobacterium tuberculosis H37Rv
gcagcgcgaucgauuccgcucgu

SEQ ID NO: 1291936 - RNA, 14 nt, Mycobacterium tuberculosis H37Rv
gcagcgauucgccu

SEQ ID NO: 1291937 - RNA, 21 nt, Mycobacterium tuberculosis H37Rv
gcagcgccacccgcgucaguc

SEQ ID NO: 1291938 - RNA, 14 nt, Mycobacterium tuberculosis H37Rv
gcagcgccucggua

SEQ ID NO: 1291939 - RNA, 17 nt, Mycobacterium tuberculosis H37Rv
gcagcgcaacggccagc

SEQ ID NO: 1291940 - RNA, 15 nt, Mycobacterium tuberculosis H37Rv
gcagcgaugacgacc

SEQ ID NO: 1291941 - RNA, 14 nt, Mycobacterium tuberculosis H37Rv
gcagcgaccgucgu

SEQ ID NO: 1291942 - RNA, 16 nt, Mycobacterium tuberculosis H37Rv
gcagcgacgacgccca

SEQ ID NO: 1291943 - RNA, 18 nt, Mycobacterium tuberculosis H37Rv
gcagcgaaacgagccggu

SEQ ID NO: 1291944 - RNA, 16 nt, Mycobacterium tuberculosis H37Rv
gcagcgaaacgagccg

SEQ ID NO: 1291945 - RNA, 22 nt, Mycobacterium tuberculosis H37Rv
gcagcgaaacaccggccagcgg

SEQ ID NO: 1291946 - RNA, 20 nt, Mycobacterium tuberculosis H37Rv
gcagcgaaaaccgucgcaga

SEQ ID NO: 1291947 - RNA, 13 nt, Mycobacterium tuberculosis H37Rv
gcagccgcgcggu

SEQ ID NO: 1291948 - RNA, 23 nt, Mycobacterium tuberculosis H37Rv
gcagccgcgcggugauggucacc

SEQ ID NO: 1291949 - RNA, 21 nt, Mycobacterium tuberculosis H37Rv
gcagccgcccgcccaccucga

SEQ ID NO: 1291950 - RNA, 20 nt, Mycobacterium tuberculosis H37Rv
gcagccgccucaaugaccac

SEQ ID NO: 1291951 - RNA, 11 nt, Mycobacterium tuberculosis H37Rv
gcagccggcau

SEQ ID NO: 1291952 - RNA, 23 nt, Mycobacterium tuberculosis H37Rv
gcagcgaaaacccggucggcgaa

SEQ ID NO: 1291953 - RNA, 18 nt, Mycobacterium tuberculosis H37Rv
gcagccgggcaccgaacu

SEQ ID NO: 1291954 - RNA, 16 nt, Mycobacterium tuberculosis H37Rv
gcagcccugcgcagcc

SEQ ID NO: 1291955 - RNA, 23 nt, Mycobacterium tuberculosis H37Rv
gcagccgaccgaaucagcacggu

SEQ ID NO: 1291956 - RNA, 13 nt, Mycobacterium tuberculosis H37Rv
gcagcccguucga

SEQ ID NO: 1291957 - RNA, 16 nt, Mycobacterium tuberculosis H37Rv
gcagcccgucggaccc

SEQ ID NO: 1291958 - RNA, 16 nt, Mycobacterium tuberculosis H37Rv
gcagcccgccgcugaa

SEQ ID NO: 1291959 - RNA, 23 nt, Mycobacterium tuberculosis H37Rv
gcagccccuccgcgccgaucagc

SEQ ID NO: 1291960 - RNA, 12 nt, Mycobacterium tuberculosis H37Rv
gcagcccggcga

SEQ ID NO: 1291961 - RNA, 18 nt, Mycobacterium tuberculosis H37Rv
gcagcccgacaguggucc

SEQ ID NO: 1291962 - RNA, 22 nt, Mycobacterium tuberculosis H37Rv
gcagcagcgugaccaccgccga

SEQ ID NO: 1291963 - RNA, 18 nt, Mycobacterium tuberculosis H37Rv
gcagcagcgugaccaccg

SEQ ID NO: 1291964 - RNA, 13 nt, Mycobacterium tuberculosis H37Rv
gcaggcauucccg

SEQ ID NO: 1291965 - RNA, 19 nt, Mycobacterium tuberculosis H37Rv
gcaggcagguuggccaccg

SEQ ID NO: 1291966 - RNA, 16 nt, Mycobacterium tuberculosis H37Rv
gcaggcccuggccacc

SEQ ID NO: 1291967 - RNA, 22 nt, Mycobacterium tuberculosis H37Rv
gcaggcccuggccacccagaau

SEQ ID NO: 1291968 - RNA, 15 nt, Mycobacterium tuberculosis H37Rv
gcagcgucgucuagc

SEQ ID NO: 1291969 - RNA, 14 nt, Mycobacterium tuberculosis H37Rv
gcagcgugaccacc

SEQ ID NO: 1291970 - RNA, 15 nt, Mycobacterium tuberculosis H37Rv
gcagcgugaccaccg

SEQ ID NO: 1291971 - RNA, 20 nt, Mycobacterium tuberculosis H37Rv
gcaggccgcgcucgucgaag

SEQ ID NO: 1291972 - RNA, 17 nt, Mycobacterium tuberculosis H37Rv
gcaggccgcguucgugg

SEQ ID NO: 1291973 - RNA, 18 nt, Mycobacterium tuberculosis H37Rv
gcagguacaucaccacga

SEQ ID NO: 1291974 - RNA, 18 nt, Mycobacterium tuberculosis H37Rv
gcagguauuugccgugcu

SEQ ID NO: 1291975 - RNA, 19 nt, Mycobacterium tuberculosis H37Rv
gcagguccaggguggucgu

SEQ ID NO: 1291976 - RNA, 13 nt, Mycobacterium tuberculosis H37Rv
gcaggucgucggc

SEQ ID NO: 1291977 - RNA, 20 nt, Mycobacterium tuberculosis H37Rv
gcaggucgucggcgucgcgg

SEQ ID NO: 1291978 - RNA, 17 nt, Mycobacterium tuberculosis H37Rv
gcaggucguccaucgcg

SEQ ID NO: 1291979 - RNA, 23 nt, Mycobacterium tuberculosis H37Rv
gcaggucgaugcugccagccaug

SEQ ID NO: 1291980 - RNA, 16 nt, Mycobacterium tuberculosis H37Rv
gcaggucgagcgccca

SEQ ID NO: 1291981 - RNA, 22 nt, Mycobacterium tuberculosis H37Rv
gcagguccgccaccgcgagcag

SEQ ID NO: 1291982 - RNA, 21 nt, Mycobacterium tuberculosis H37Rv
gcagggccucggucgccaugu

SEQ ID NO: 1291983 - RNA, 16 nt, Mycobacterium tuberculosis H37Rv
gcaggcucgaaccgac

SEQ ID NO: 1291984 - RNA, 15 nt, Mycobacterium tuberculosis H37Rv
gcaggggacgggcgg

SEQ ID NO: 1291985 - RNA, 14 nt, Mycobacterium tuberculosis H37Rv
gcagggcggcgaac

SEQ ID NO: 1291986 - RNA, 13 nt, Mycobacterium tuberculosis H37Rv
gcagggcgucggc

SEQ ID NO: 1291987 - RNA, 23 nt, Mycobacterium tuberculosis H37Rv
gcauagguaguugcucggcuucc

SEQ ID NO: 1291988 - RNA, 21 nt, Mycobacterium tuberculosis H37Rv
gcauaggccccgccagcgccg

SEQ ID NO: 1291989 - RNA, 18 nt, Mycobacterium tuberculosis H37Rv
gcaucacgccgucgcaga

SEQ ID NO: 1291990 - RNA, 24 nt, Mycobacterium tuberculosis H37Rv
gcaucacgaucacgucgucucggc

SEQ ID NO: 1291991 - RNA, 13 nt, Mycobacterium tuberculosis H37Rv
gcaucacgcccac

SEQ ID NO: 1291992 - RNA, 17 nt, Mycobacterium tuberculosis H37Rv
gcaucacgcccacgaua

SEQ ID NO: 1291993 - RNA, 15 nt, Mycobacterium tuberculosis H37Rv
gcauccgcgguuggc

SEQ ID NO: 1291994 - RNA, 15 nt, Mycobacterium tuberculosis H37Rv
gcaucgcggcaucga

SEQ ID NO: 1291995 - RNA, 13 nt, Mycobacterium tuberculosis H37Rv
gcaucgcggcauc

SEQ ID NO: 1291996 - RNA, 18 nt, Mycobacterium tuberculosis H37Rv
gcaucgcgaucggggcga

SEQ ID NO: 1291997 - RNA, 22 nt, Mycobacterium tuberculosis H37Rv
gcaucgcgauuccggcggccac

SEQ ID NO: 1291998 - RNA, 19 nt, Mycobacterium tuberculosis H37Rv
gcaucgccgcuggccagca

SEQ ID NO: 1291999 - RNA, 19 nt, Mycobacterium tuberculosis H37Rv
gcaucgccggcacggugaa

SEQ ID NO: 1292000 - RNA, 18 nt, Mycobacterium tuberculosis H37Rv
gcaucgccgacagcgccu

SEQ ID NO: 1292001 - RNA, 17 nt, Mycobacterium tuberculosis H37Rv
gcaucgauucgaugucc

SEQ ID NO: 1292002 - RNA, 15 nt, Mycobacterium tuberculosis H37Rv
gcaucgccaccauca

SEQ ID NO: 1292003 - RNA, 16 nt, Mycobacterium tuberculosis H37Rv
gcaucgagacgagcca

SEQ ID NO: 1292004 - RNA, 21 nt, Mycobacterium tuberculosis H37Rv
gcaucgaguugucucgcaucg

SEQ ID NO: 1292005 - RNA, 23 nt, Mycobacterium tuberculosis H37Rv
gcaucgaguugucucgcaucggc

SEQ ID NO: 1292006 - RNA, 16 nt, Mycobacterium tuberculosis H37Rv
gcagugcgacccgggc

SEQ ID NO: 1292007 - RNA, 23 nt, Mycobacterium tuberculosis H37Rv
gcagugcacccgggccgccucga

SEQ ID NO: 1292008 - RNA, 16 nt, Mycobacterium tuberculosis H37Rv
gcaggucucguaucgc

SEQ ID NO: 1292009 - RNA, 13 nt, Mycobacterium tuberculosis H37Rv
gcaggugcaucgc

SEQ ID NO: 1292010 - RNA, 22 nt, Mycobacterium tuberculosis H37Rv
gcaggugcccggccaaaauggc

SEQ ID NO: 1292011 - RNA, 14 nt, Mycobacterium tuberculosis H37Rv
gcaggugcggucaa

SEQ ID NO: 1292012 - RNA, 15 nt, Mycobacterium tuberculosis H37Rv
gcagguguuggugcg

SEQ ID NO: 1292013 - RNA, 15 nt, Mycobacterium tuberculosis H37Rv
gcagguuccacgcgu

SEQ ID NO: 1292014 - RNA, 18 nt, Mycobacterium tuberculosis H37Rv
gcagguggccgucgccga

SEQ ID NO: 1292015 - RNA, 17 nt, Mycobacterium tuberculosis H37Rv
gcagguggagugcacag

SEQ ID NO: 1292016 - RNA, 16 nt, Mycobacterium tuberculosis H37Rv
gcaguucgcggccauc

SEQ ID NO: 1292017 - RNA, 15 nt, Mycobacterium tuberculosis H37Rv
gcaguuggccaugca

SEQ ID NO: 1292018 - RNA, 20 nt, Mycobacterium tuberculosis H37Rv
gcauaacgccagucccggcg

SEQ ID NO: 1292019 - RNA, 22 nt, Mycobacterium tuberculosis H37Rv
gcauugucauaggagcuuccga

SEQ ID NO: 1292020 - RNA, 20 nt, Mycobacterium tuberculosis H37Rv
gccaaacuacccgcccacgg

SEQ ID NO: 1292021 - RNA, 12 nt, Mycobacterium tuberculosis H37Rv
gccaaagcgcgg

SEQ ID NO: 1292022 - RNA, 16 nt, Mycobacterium tuberculosis H37Rv
gccaaagccgucagcu

SEQ ID NO: 1292023 - RNA, 13 nt, Mycobacterium tuberculosis H37Rv
gccaaagcccgac

SEQ ID NO: 1292024 - RNA, 14 nt, Mycobacterium tuberculosis H37Rv
gccaaagcccgaca

SEQ ID NO: 1292025 - RNA, 17 nt, Mycobacterium tuberculosis H37Rv
gccaaagcccgacauga

SEQ ID NO: 1292026 - RNA, 23 nt, Mycobacterium tuberculosis H37Rv
gccaaaaguacuggcguugccac

SEQ ID NO: 1292027 - RNA, 13 nt, Mycobacterium tuberculosis H37Rv
gccaaaaacgccc

SEQ ID NO: 1292028 - RNA, 14 nt, Mycobacterium tuberculosis H37Rv
gccaaauaccguga

SEQ ID NO: 1292029 - RNA, 19 nt, Mycobacterium tuberculosis H37Rv
gccaaaugcgcugucgccc

SEQ ID NO: 1292030 - RNA, 16 nt, Mycobacterium tuberculosis H37Rv
gccaaccacuuuccgg

SEQ ID NO: 1292031 - RNA, 18 nt, Mycobacterium tuberculosis H37Rv
gccaacaacaucagcgac

SEQ ID NO: 1292032 - RNA, 15 nt, Mycobacterium tuberculosis H37Rv
gccaacagguccacc

SEQ ID NO: 1292033 - RNA, 18 nt, Mycobacterium tuberculosis H37Rv
gccaacaccggcgaucac

SEQ ID NO: 1292034 - RNA, 13 nt, Mycobacterium tuberculosis H37Rv
gccaacgccagca

SEQ ID NO: 1292035 - RNA, 17 nt, Mycobacterium tuberculosis H37Rv
gccaacgccagcaccag

SEQ ID NO: 1292036 - RNA, 20 nt, Mycobacterium tuberculosis H37Rv
gccaacgccaaaacggucga

SEQ ID NO: 1292037 - RNA, 11 nt, Mycobacterium tuberculosis H37Rv
gccaaccuggg

SEQ ID NO: 1292038 - RNA, 16 nt, Mycobacterium tuberculosis H37Rv
gccaaccgugcgcacu

SEQ ID NO: 1292039 - RNA, 23 nt, Mycobacterium tuberculosis H37Rv
gccaaccgguucgucgaacggau

SEQ ID NO: 1292040 - RNA, 21 nt, Mycobacterium tuberculosis H37Rv
gccaaccgggugugcgucgag

SEQ ID NO: 1292041 - RNA, 14 nt, Mycobacterium tuberculosis H37Rv
gccaaccggcgcag

SEQ ID NO: 1292042 - RNA, 23 nt, Mycobacterium tuberculosis H37Rv
gccaacccgauuuauccggaucg

SEQ ID NO: 1292043 - RNA, 21 nt, Mycobacterium tuberculosis H37Rv
gccaacccgucuuaucggcgu

SEQ ID NO: 1292044 - RNA, 13 nt, Mycobacterium tuberculosis H37Rv
gcauggucgccgg

SEQ ID NO: 1292045 - RNA, 17 nt, Mycobacterium tuberculosis H37Rv
gcaugguggcgccgacc

SEQ ID NO: 1292046 - RNA, 18 nt, Mycobacterium tuberculosis H37Rv
gcaugguccacagccggc

SEQ ID NO: 1292047 - RNA, 19 nt, Mycobacterium tuberculosis H37Rv
gcauguucuccacgccgau

SEQ ID NO: 1292048 - RNA, 18 nt, Mycobacterium tuberculosis H37Rv
gcaugucgggccgcucga

SEQ ID NO: 1292049 - RNA, 22 nt, Mycobacterium tuberculosis H37Rv
gcauguagaguaucgaauccgu

SEQ ID NO: 1292050 - RNA, 15 nt, Mycobacterium tuberculosis H37Rv
gcauuagcacgcugu

SEQ ID NO: 1292051 - RNA, 14 nt, Mycobacterium tuberculosis H37Rv
gcauugaguucggc

SEQ ID NO: 1292052 - RNA, 13 nt, Mycobacterium tuberculosis H37Rv
gcauuaccacuuc

SEQ ID NO: 1292053 - RNA, 20 nt, Mycobacterium tuberculosis H37Rv
gcauucgccgggcggcaucc

SEQ ID NO: 1292054 - RNA, 22 nt, Mycobacterium tuberculosis H37Rv
gcauugaccaauccacugauca

SEQ ID NO: 1292055 - RNA, 16 nt, Mycobacterium tuberculosis H37Rv
gcaugcggaucggcgg

SEQ ID NO: 1292056 - RNA, 14 nt, Mycobacterium tuberculosis H37Rv
gcaugcucgaucgc

SEQ ID NO: 1292057 - RNA, 11 nt, Mycobacterium tuberculosis H37Rv
gcaugcucgac

SEQ ID NO: 1292058 - RNA, 21 nt, Mycobacterium tuberculosis H37Rv
gcaugcucgaucgcguucugc

SEQ ID NO: 1292059 - RNA, 12 nt, Mycobacterium tuberculosis H37Rv
gcaugcucacga

SEQ ID NO: 1292060 - RNA, 14 nt, Mycobacterium tuberculosis H37Rv
gcaugcgugccggc

SEQ ID NO: 1292061 - RNA, 17 nt, Mycobacterium tuberculosis H37Rv
gcaugccggucuucgcg

SEQ ID NO: 1292062 - RNA, 14 nt, Mycobacterium tuberculosis H37Rv
gcaugcgacgucag

SEQ ID NO: 1292063 - RNA, 17 nt, Mycobacterium tuberculosis H37Rv
gcaugcgacgucagggu

SEQ ID NO: 1292064 - RNA, 18 nt, Mycobacterium tuberculosis H37Rv
gcaugcgaggggcggcaa

SEQ ID NO: 1292065 - RNA, 15 nt, Mycobacterium tuberculosis H37Rv
gcaugcgccguagcc

SEQ ID NO: 1292066 - RNA, 17 nt, Mycobacterium tuberculosis H37Rv
gcaugcgccguagccga

SEQ ID NO: 1292067 - RNA, 13 nt, Mycobacterium tuberculosis H37Rv
gcauggccugggu

SEQ ID NO: 1292068 - RNA, 20 nt, Mycobacterium tuberculosis H37Rv
gcauggcgaacacgucggcc

SEQ ID NO: 1292069 - RNA, 19 nt, Mycobacterium tuberculosis H37Rv
gcauggcgaacacgucggc

SEQ ID NO: 1292070 - RNA, 18 nt, Mycobacterium tuberculosis H37Rv
gcaugcuugaaacccagg

SEQ ID NO: 1292071 - RNA, 19 nt, Mycobacterium tuberculosis H37Rv
gcaugcuggaccucgcgac

SEQ ID NO: 1292072 - RNA, 16 nt, Mycobacterium tuberculosis H37Rv
gcaugacaccggccac

SEQ ID NO: 1292073 - RNA, 17 nt, Mycobacterium tuberculosis H37Rv
gcaugcagccccacuuc

SEQ ID NO: 1292074 - RNA, 19 nt, Mycobacterium tuberculosis H37Rv
gcaugcccuggaccagcgg

SEQ ID NO: 1292075 - RNA, 23 nt, Mycobacterium tuberculosis H37Rv
gcaugccgcccgcuccugcucgu

SEQ ID NO: 1292076 - RNA, 19 nt, Mycobacterium tuberculosis H37Rv
gcaugccgccaugcgcacc

SEQ ID NO: 1292077 - RNA, 17 nt, Mycobacterium tuberculosis H37Rv
gcaucugcucggcaucg

SEQ ID NO: 1292078 - RNA, 18 nt, Mycobacterium tuberculosis H37Rv
gcaucugcucggcaucga

SEQ ID NO: 1292079 - RNA, 22 nt, Mycobacterium tuberculosis H37Rv
gcaucuagguucaguuccaccg

SEQ ID NO: 1292080 - RNA, 15 nt, Mycobacterium tuberculosis H37Rv
gcaucuccgucggcc

SEQ ID NO: 1292081 - RNA, 23 nt, Mycobacterium tuberculosis H37Rv
gcaucucggccuugacgcacgac

SEQ ID NO: 1292082 - RNA, 17 nt, Mycobacterium tuberculosis H37Rv
gcaucguuuucgccgau

SEQ ID NO: 1292083 - RNA, 14 nt, Mycobacterium tuberculosis H37Rv
gcaucguugccgac

SEQ ID NO: 1292084 - RNA, 15 nt, Mycobacterium tuberculosis H37Rv
gcaucguugccgacc

SEQ ID NO: 1292085 - RNA, 16 nt, Mycobacterium tuberculosis H37Rv
gcaucgucgccgagcg

SEQ ID NO: 1292086 - RNA, 18 nt, Mycobacterium tuberculosis H37Rv
gcaucgucgacgcccgau

SEQ ID NO: 1292087 - RNA, 15 nt, Mycobacterium tuberculosis H37Rv
gcaucggcagcagcg

SEQ ID NO: 1292088 - RNA, 16 nt, Mycobacterium tuberculosis H37Rv
gcaucggcagcagcgc

SEQ ID NO: 1292089 - RNA, 13 nt, Mycobacterium tuberculosis H37Rv
gcaucgcggcgac

SEQ ID NO: 1292090 - RNA, 15 nt, Mycobacterium tuberculosis H37Rv
gcaucggccaccugu

SEQ ID NO: 1292091 - RNA, 14 nt, Mycobacterium tuberculosis H37Rv
gcaucggcggugaa

SEQ ID NO: 1292092 - RNA, 21 nt, Mycobacterium tuberculosis H37Rv
gcaucggcggcgucuucgucg

SEQ ID NO: 1292093 - RNA, 19 nt, Mycobacterium tuberculosis H37Rv
gcaucgggguuggugaacg

SEQ ID NO: 1292094 - RNA, 17 nt, Mycobacterium tuberculosis H37Rv
gcaucggucagcgccga

SEQ ID NO: 1292095 - RNA, 14 nt, Mycobacterium tuberculosis H37Rv
gcaucggugcagcc

SEQ ID NO: 1292096 - RNA, 15 nt, Mycobacterium tuberculosis H37Rv
gcaucggucaccgcg

SEQ ID NO: 1292097 - RNA, 19 nt, Mycobacterium tuberculosis H37Rv
gcaucgggcgagcucgucg

SEQ ID NO: 1292098 - RNA, 13 nt, Mycobacterium tuberculosis H37Rv
gcaucgucgccga

SEQ ID NO: 1292099 - RNA, 15 nt, Mycobacterium tuberculosis H37Rv
gcaucgucgccgacc

SEQ ID NO: 1292100 - RNA, 17 nt, Mycobacterium tuberculosis H37Rv
gcaucgucgccgaccgu

SEQ ID NO: 1292101 - RNA, 20 nt, Mycobacterium tuberculosis H37Rv
gcaucgucgacgaugucggc

SEQ ID NO: 1292102 - RNA, 20 nt, Mycobacterium tuberculosis H37Rv
gcaucgucgaauccucgcga

SEQ ID NO: 1292103 - RNA, 18 nt, Mycobacterium tuberculosis H37Rv
gcaucgucagcgaccacg

SEQ ID NO: 1292104 - RNA, 21 nt, Mycobacterium tuberculosis H37Rv
gcaucggugguaacaccggcg

SEQ ID NO: 1292105 - RNA, 12 nt, Mycobacterium tuberculosis H37Rv
gccggcggcgac

SEQ ID NO: 1292106 - RNA, 13 nt, Mycobacterium tuberculosis H37Rv
gccggcggcgacc

SEQ ID NO: 1292107 - RNA, 23 nt, Mycobacterium tuberculosis H37Rv
gccggcggccgcccagaugucuu

SEQ ID NO: 1292108 - RNA, 15 nt, Mycobacterium tuberculosis H37Rv
gccggcggccgcggu

SEQ ID NO: 1292109 - RNA, 17 nt, Mycobacterium tuberculosis H37Rv
gccggcggucagcagcg

SEQ ID NO: 1292110 - RNA, 23 nt, Mycobacterium tuberculosis H37Rv
gccggcgggcgagugucagcaga

SEQ ID NO: 1292111 - RNA, 20 nt, Mycobacterium tuberculosis H37Rv
gccggcgguagucggccagc

SEQ ID NO: 1292112 - RNA, 21 nt, Mycobacterium tuberculosis H37Rv
gccggcggcuguggucgcugc

SEQ ID NO: 1292113 - RNA, 18 nt, Mycobacterium tuberculosis H37Rv
gccggcggaaucgucggc

SEQ ID NO: 1292114 - RNA, 23 nt, Mycobacterium tuberculosis H37Rv
gccggcgcuggcgggcgaucucg

SEQ ID NO: 1292115 - RNA, 22 nt, Mycobacterium tuberculosis H37Rv
gccggcgcugcugccauugccg

SEQ ID NO: 1292116 - RNA, 15 nt, Mycobacterium tuberculosis H37Rv
gccggcgcggucucg

SEQ ID NO: 1292117 - RNA, 21 nt, Mycobacterium tuberculosis H37Rv
gccggcgcguaguaaugcucg

SEQ ID NO: 1292118 - RNA, 16 nt, Mycobacterium tuberculosis H37Rv
gccggcgcggcguaac

SEQ ID NO: 1292119 - RNA, 16 nt, Mycobacterium tuberculosis H37Rv
gccggcgcgccccacc

SEQ ID NO: 1292120 - RNA, 17 nt, Mycobacterium tuberculosis H37Rv
gccggcgcgcaccccgg

SEQ ID NO: 1292121 - RNA, 13 nt, Mycobacterium tuberculosis H37Rv
gccggcgucgacc

SEQ ID NO: 1292122 - RNA, 17 nt, Mycobacterium tuberculosis H37Rv
gccggcgucgacccugc

SEQ ID NO: 1292123 - RNA, 23 nt, Mycobacterium tuberculosis H37Rv
gccggcgucgacccugcccagca

SEQ ID NO: 1292124 - RNA, 13 nt, Mycobacterium tuberculosis H37Rv
gccggcgucgagc

SEQ ID NO: 1292125 - RNA, 14 nt, Mycobacterium tuberculosis H37Rv
gccggcgucgagcc

SEQ ID NO: 1292126 - RNA, 14 nt, Mycobacterium tuberculosis H37Rv
gccggcgucgauga

SEQ ID NO: 1292127 - RNA, 13 nt, Mycobacterium tuberculosis H37Rv
gccggcgucagcc

SEQ ID NO: 1292128 - RNA, 15 nt, Mycobacterium tuberculosis H37Rv
gccggcguagcggcg

SEQ ID NO: 1292129 - RNA, 12 nt, Mycobacterium tuberculosis H37Rv
gccggcguagcg

SEQ ID NO: 1292130 - RNA, 22 nt, Mycobacterium tuberculosis H37Rv
gccggcguagaucaucagcgac

SEQ ID NO: 1292131 - RNA, 12 nt, Mycobacterium tuberculosis H37Rv
gccggcggucgc

SEQ ID NO: 1292132 - RNA, 22 nt, Mycobacterium tuberculosis H37Rv
gccggcgguguuggcgccagcc

SEQ ID NO: 1292133 - RNA, 12 nt, Mycobacterium tuberculosis H37Rv
gccggcguuggc

SEQ ID NO: 1292134 - RNA, 20 nt, Mycobacterium tuberculosis H37Rv
gccggcgugucgcgucgugc

SEQ ID NO: 1292135 - RNA, 13 nt, Mycobacterium tuberculosis H37Rv
gccggcguuagcg

SEQ ID NO: 1292136 - RNA, 21 nt, Mycobacterium tuberculosis H37Rv
gccggcguuagcguagcccga

SEQ ID NO: 1292137 - RNA, 15 nt, Mycobacterium tuberculosis H37Rv
gccggcgugucgcgu

SEQ ID NO: 1292138 - RNA, 13 nt, Mycobacterium tuberculosis H37Rv
gccggcgugcggc

SEQ ID NO: 1292139 - RNA, 17 nt, Mycobacterium tuberculosis H37Rv
gccggcgucggucgucg

SEQ ID NO: 1292140 - RNA, 16 nt, Mycobacterium tuberculosis H37Rv
gccggcgugcacuccc

SEQ ID NO: 1292141 - RNA, 16 nt, Mycobacterium tuberculosis H37Rv
gccggcgugcaugagc

SEQ ID NO: 1292142 - RNA, 12 nt, Mycobacterium tuberculosis H37Rv
gccggcuucggc

SEQ ID NO: 1292143 - RNA, 16 nt, Mycobacterium tuberculosis H37Rv
gccggcuucggcgagc

SEQ ID NO: 1292144 - RNA, 19 nt, Mycobacterium tuberculosis H37Rv
gccggcuucggguguucgc

SEQ ID NO: 1292145 - RNA, 15 nt, Mycobacterium tuberculosis H37Rv
gccggcuucggcgag

SEQ ID NO: 1292146 - RNA, 15 nt, Mycobacterium tuberculosis H37Rv
gccggcuggcggccu

SEQ ID NO: 1292147 - RNA, 24 nt, Mycobacterium tuberculosis H37Rv
gccggcuugucgaccacgaccguc

SEQ ID NO: 1292148 - RNA, 15 nt, Mycobacterium tuberculosis H37Rv
gccggcuugucgacc

SEQ ID NO: 1292149 - RNA, 16 nt, Mycobacterium tuberculosis H37Rv
gccggcuuugagccgc

SEQ ID NO: 1292150 - RNA, 13 nt, Mycobacterium tuberculosis H37Rv
gccgggaagccgc

SEQ ID NO: 1292151 - RNA, 19 nt, Mycobacterium tuberculosis H37Rv
gccggcuucgcccagagcc

SEQ ID NO: 1292152 - RNA, 22 nt, Mycobacterium tuberculosis H37Rv
gccggcuuuuccacgaguccgc

SEQ ID NO: 1292153 - RNA, 17 nt, Mycobacterium tuberculosis H37Rv
gccggcuuuuccacgag

SEQ ID NO: 1292154 - RNA, 19 nt, Mycobacterium tuberculosis H37Rv
gccgggaaaguuguaucgc

SEQ ID NO: 1292155 - RNA, 16 nt, Mycobacterium tuberculosis H37Rv
gccggcuccgccguug

SEQ ID NO: 1292156 - RNA, 17 nt, Mycobacterium tuberculosis H37Rv
gccggcucaucgcagcc

SEQ ID NO: 1292157 - RNA, 16 nt, Mycobacterium tuberculosis H37Rv
gccggccgcugccacu

SEQ ID NO: 1292158 - RNA, 14 nt, Mycobacterium tuberculosis H37Rv
gccggccggucagg

SEQ ID NO: 1292159 - RNA, 14 nt, Mycobacterium tuberculosis H37Rv
gccggccgucggcc

SEQ ID NO: 1292160 - RNA, 18 nt, Mycobacterium tuberculosis H37Rv
gccggccgucggccggau

SEQ ID NO: 1292161 - RNA, 14 nt, Mycobacterium tuberculosis H37Rv
gccggccgucgauc

SEQ ID NO: 1292162 - RNA, 23 nt, Mycobacterium tuberculosis H37Rv
gccggccgucgaucuucuccucg

SEQ ID NO: 1292163 - RNA, 16 nt, Mycobacterium tuberculosis H37Rv
gccggccucgccgaag

SEQ ID NO: 1292164 - RNA, 23 nt, Mycobacterium tuberculosis H37Rv
gccggccgccagccgguccagca

SEQ ID NO: 1292165 - RNA, 17 nt, Mycobacterium tuberculosis H37Rv
gccggccgcgauccagc

SEQ ID NO: 1292166 - RNA, 15 nt, Mycobacterium tuberculosis H37Rv
gccggcccugcucgc

SEQ ID NO: 1292167 - RNA, 16 nt, Mycobacterium tuberculosis H37Rv
gccggcccgacgggua

SEQ ID NO: 1292168 - RNA, 12 nt, Mycobacterium tuberculosis H37Rv
gccggcccgcaa

SEQ ID NO: 1292169 - RNA, 14 nt, Mycobacterium tuberculosis H37Rv
gccggcccgcagcc

SEQ ID NO: 1292170 - RNA, 12 nt, Mycobacterium tuberculosis H37Rv
gccggcccgcag

SEQ ID NO: 1292171 - RNA, 13 nt, Mycobacterium tuberculosis H37Rv
gccggcgaggucg

SEQ ID NO: 1292172 - RNA, 13 nt, Mycobacterium tuberculosis H37Rv
gccggcgagcucg

SEQ ID NO: 1292173 - RNA, 14 nt, Mycobacterium tuberculosis H37Rv
gccggcgaaugcgg

SEQ ID NO: 1292174 - RNA, 15 nt, Mycobacterium tuberculosis H37Rv
gccggcgaccaaggc

SEQ ID NO: 1292175 - RNA, 22 nt, Mycobacterium tuberculosis H37Rv
gccggcgaagugcuccaccucg

SEQ ID NO: 1292176 - RNA, 20 nt, Mycobacterium tuberculosis H37Rv
gccggcgacaccgcaggugc

SEQ ID NO: 1292177 - RNA, 15 nt, Mycobacterium tuberculosis H37Rv
gccggcgccggugcc

SEQ ID NO: 1292178 - RNA, 16 nt, Mycobacterium tuberculosis H37Rv
gccggcgccggcaucu

SEQ ID NO: 1292179 - RNA, 23 nt, Mycobacterium tuberculosis H37Rv
gccggcgccgccguuaccgccgg

SEQ ID NO: 1292180 - RNA, 18 nt, Mycobacterium tuberculosis H37Rv
gccggcgccgccggugcc

SEQ ID NO: 1292181 - RNA, 19 nt, Mycobacterium tuberculosis H37Rv
gccggcgccgccggugcca

SEQ ID NO: 1292182 - RNA, 15 nt, Mycobacterium tuberculosis H37Rv
gccggcgccagcaga

SEQ ID NO: 1292183 - RNA, 20 nt, Mycobacterium tuberculosis H37Rv
gccggcgcccaggccgauca

SEQ ID NO: 1292184 - RNA, 23 nt, Mycobacterium tuberculosis H37Rv
gccggcgcccaggccgaucagcg

SEQ ID NO: 1292185 - RNA, 22 nt, Mycobacterium tuberculosis H37Rv
gccggcgccgccauugucgcca

SEQ ID NO: 1292186 - RNA, 19 nt, Mycobacterium tuberculosis H37Rv
gccggcgcccgccgcgaac

SEQ ID NO: 1292187 - RNA, 20 nt, Mycobacterium tuberculosis H37Rv
gccggcgccaccguugccga

SEQ ID NO: 1292188 - RNA, 16 nt, Mycobacterium tuberculosis H37Rv
gccggcgccaccgagu

SEQ ID NO: 1292189 - RNA, 13 nt, Mycobacterium tuberculosis H37Rv
gccggcgcagugg

SEQ ID NO: 1292190 - RNA, 15 nt, Mycobacterium tuberculosis H37Rv
gccgcgauccagcgc

SEQ ID NO: 1292191 - RNA, 16 nt, Mycobacterium tuberculosis H37Rv
gccgcgcggaacaccg

SEQ ID NO: 1292192 - RNA, 17 nt, Mycobacterium tuberculosis H37Rv
gccgcgcgcucgagcag

SEQ ID NO: 1292193 - RNA, 16 nt, Mycobacterium tuberculosis H37Rv
gccgcgcgcucgagca

SEQ ID NO: 1292194 - RNA, 22 nt, Mycobacterium tuberculosis H37Rv
gccgcgcgguacugcgcagcgc

SEQ ID NO: 1292195 - RNA, 16 nt, Mycobacterium tuberculosis H37Rv
gccgcgcgggucacga

SEQ ID NO: 1292196 - RNA, 14 nt, Mycobacterium tuberculosis H37Rv
gccgcgcgugacag

SEQ ID NO: 1292197 - RNA, 21 nt, Mycobacterium tuberculosis H37Rv
gccgcgcggugauggucaccg

SEQ ID NO: 1292198 - RNA, 21 nt, Mycobacterium tuberculosis H37Rv
gccgcgcucaucgcggcgaac

SEQ ID NO: 1292199 - RNA, 14 nt, Mycobacterium tuberculosis H37Rv
gccgcgcguucggc

SEQ ID NO: 1292200 - RNA, 14 nt, Mycobacterium tuberculosis H37Rv
gccgcgcggggugc

SEQ ID NO: 1292201 - RNA, 19 nt, Mycobacterium tuberculosis H37Rv
gccgcggcggauggcgucg

SEQ ID NO: 1292202 - RNA, 16 nt, Mycobacterium tuberculosis H37Rv
gccgcggcggcagcac

SEQ ID NO: 1292203 - RNA, 18 nt, Mycobacterium tuberculosis H37Rv
gccgcggcggcagcggcg

SEQ ID NO: 1292204 - RNA, 15 nt, Mycobacterium tuberculosis H37Rv
gccgcggagaaggcg

SEQ ID NO: 1292205 - RNA, 19 nt, Mycobacterium tuberculosis H37Rv
gccgcggaggcggccagcc

SEQ ID NO: 1292206 - RNA, 13 nt, Mycobacterium tuberculosis H37Rv
gccgcgcgucaag

SEQ ID NO: 1292207 - RNA, 21 nt, Mycobacterium tuberculosis H37Rv
gccgcggacgcaacucgacgc

SEQ ID NO: 1292208 - RNA, 15 nt, Mycobacterium tuberculosis H37Rv
gccgcggaccccgac

SEQ ID NO: 1292209 - RNA, 21 nt, Mycobacterium tuberculosis H37Rv
gccgcggacuugcgagccgua

SEQ ID NO: 1292210 - RNA, 18 nt, Mycobacterium tuberculosis H37Rv
gccgcggaggcggccagc

SEQ ID NO: 1292211 - RNA, 14 nt, Mycobacterium tuberculosis H37Rv
gccgcgcucgacga

SEQ ID NO: 1292212 - RNA, 16 nt, Mycobacterium tuberculosis H37Rv
gccgcgcucgacgagc

SEQ ID NO: 1292213 - RNA, 19 nt, Mycobacterium tuberculosis H37Rv
gccgcgcucgacgagcacg

SEQ ID NO: 1292214 - RNA, 14 nt, Mycobacterium tuberculosis H37Rv
gccgcgcucgccga

SEQ ID NO: 1292215 - RNA, 21 nt, Mycobacterium tuberculosis H37Rv
gccgcgcuugcgaucggcacu

SEQ ID NO: 1292216 - RNA, 13 nt, Mycobacterium tuberculosis H37Rv
gccgcgucacgga

SEQ ID NO: 1292217 - RNA, 16 nt, Mycobacterium tuberculosis H37Rv
gccgcgucaaccgauc

SEQ ID NO: 1292218 - RNA, 13 nt, Mycobacterium tuberculosis H37Rv
gccgcgucaaccg

SEQ ID NO: 1292219 - RNA, 21 nt, Mycobacterium tuberculosis H37Rv
gccgcguaggccuugcucagc

SEQ ID NO: 1292220 - RNA, 20 nt, Mycobacterium tuberculosis H37Rv
gccgcggucggcgacguaga

SEQ ID NO: 1292221 - RNA, 17 nt, Mycobacterium tuberculosis H37Rv
gccgcggugacgggauc

SEQ ID NO: 1292222 - RNA, 21 nt, Mycobacterium tuberculosis H37Rv
gccgcguugccggucgcaugg

SEQ ID NO: 1292223 - RNA, 18 nt, Mycobacterium tuberculosis H37Rv
gccgcguucguggaucuc

SEQ ID NO: 1292224 - RNA, 14 nt, Mycobacterium tuberculosis H37Rv
gccgcgucgagcac

SEQ ID NO: 1292225 - RNA, 21 nt, Mycobacterium tuberculosis H37Rv
gccgcgucgaucugugguugc

SEQ ID NO: 1292226 - RNA, 14 nt, Mycobacterium tuberculosis H37Rv
gccgcggucggcga

SEQ ID NO: 1292227 - RNA, 16 nt, Mycobacterium tuberculosis H37Rv
gccgcggucggaccac

SEQ ID NO: 1292228 - RNA, 15 nt, Mycobacterium tuberculosis H37Rv
gccgcggucggccac

SEQ ID NO: 1292229 - RNA, 22 nt, Mycobacterium tuberculosis H37Rv
gccgcggcuccgagggcugcgu

SEQ ID NO: 1292230 - RNA, 21 nt, Mycobacterium tuberculosis H37Rv
gccgcggcuaggccagcacgg

SEQ ID NO: 1292231 - RNA, 15 nt, Mycobacterium tuberculosis H37Rv
gccgcggcggccagc

SEQ ID NO: 1292232 - RNA, 22 nt, Mycobacterium tuberculosis H37Rv
gccgcuaauggauccagcccga

SEQ ID NO: 1292233 - RNA, 16 nt, Mycobacterium tuberculosis H37Rv
gccgcuaacgcaccug

SEQ ID NO: 1292234 - RNA, 19 nt, Mycobacterium tuberculosis H37Rv
gccgcuaccgcccgcgcca

SEQ ID NO: 1292235 - RNA, 21 nt, Mycobacterium tuberculosis H37Rv
gccgcuaccgcccgcgccacc

SEQ ID NO: 1292236 - RNA, 17 nt, Mycobacterium tuberculosis H37Rv
gccgcuagcggauucag

SEQ ID NO: 1292237 - RNA, 18 nt, Mycobacterium tuberculosis H37Rv
gccgcuccgcccauuccc

SEQ ID NO: 1292238 - RNA, 23 nt, Mycobacterium tuberculosis H37Rv
gccgcucccucuacacccggacu

SEQ ID NO: 1292239 - RNA, 14 nt, Mycobacterium tuberculosis H37Rv
gccgcucgauggcc

SEQ ID NO: 1292240 - RNA, 20 nt, Mycobacterium tuberculosis H37Rv
gccgcugaagccaggauugc

SEQ ID NO: 1292241 - RNA, 16 nt, Mycobacterium tuberculosis H37Rv
gccgcugacgguucgg

SEQ ID NO: 1292242 - RNA, 16 nt, Mycobacterium tuberculosis H37Rv
gccgcucuagcgucgu

SEQ ID NO: 1292243 - RNA, 16 nt, Mycobacterium tuberculosis H37Rv
gccgcugaauuggcgc

SEQ ID NO: 1292244 - RNA, 14 nt, Mycobacterium tuberculosis H37Rv
gccggccaccguca

SEQ ID NO: 1292245 - RNA, 14 nt, Mycobacterium tuberculosis H37Rv
gccggccaccaguc

SEQ ID NO: 1292246 - RNA, 19 nt, Mycobacterium tuberculosis H37Rv
gccggcauagaucgggucg

SEQ ID NO: 1292247 - RNA, 17 nt, Mycobacterium tuberculosis H37Rv
gccggccaagaccgcgg

SEQ ID NO: 1292248 - RNA, 17 nt, Mycobacterium tuberculosis H37Rv
gccggcauacaccguga

SEQ ID NO: 1292249 - RNA, 15 nt, Mycobacterium tuberculosis H37Rv
gccggcagcggcgag

SEQ ID NO: 1292250 - RNA, 15 nt, Mycobacterium tuberculosis H37Rv
gccggccaucgcccg

SEQ ID NO: 1292251 - RNA, 14 nt, Mycobacterium tuberculosis H37Rv
gccggccacgucga

SEQ ID NO: 1292252 - RNA, 18 nt, Mycobacterium tuberculosis H37Rv
gccggccaccucggugcg

SEQ ID NO: 1292253 - RNA, 14 nt, Mycobacterium tuberculosis H37Rv
gccggccacgaguc

SEQ ID NO: 1292254 - RNA, 13 nt, Mycobacterium tuberculosis H37Rv
gccggccaggauu

SEQ ID NO: 1292255 - RNA, 15 nt, Mycobacterium tuberculosis H37Rv
gccggauagcaccgg

SEQ ID NO: 1292256 - RNA, 19 nt, Mycobacterium tuberculosis H37Rv
gccggauacggcgacaccc

SEQ ID NO: 1292257 - RNA, 15 nt, Mycobacterium tuberculosis H37Rv
gccggauccgauccg

SEQ ID NO: 1292258 - RNA, 15 nt, Mycobacterium tuberculosis H37Rv
gccggauucgaugac

SEQ ID NO: 1292259 - RNA, 17 nt, Mycobacterium tuberculosis H37Rv
gccggaugucgacgagc

SEQ ID NO: 1292260 - RNA, 20 nt, Mycobacterium tuberculosis H37Rv
gccggcagcggcgcgcugca

SEQ ID NO: 1292261 - RNA, 13 nt, Mycobacterium tuberculosis H37Rv
gccggcagcgucc

SEQ ID NO: 1292262 - RNA, 13 nt, Mycobacterium tuberculosis H37Rv
gccggcagcggcg

SEQ ID NO: 1292263 - RNA, 19 nt, Mycobacterium tuberculosis H37Rv
gccggcaccuccggcaccg

SEQ ID NO: 1292264 - RNA, 16 nt, Mycobacterium tuberculosis H37Rv
gccggcaacagcucgc

SEQ ID NO: 1292265 - RNA, 17 nt, Mycobacterium tuberculosis H37Rv
gccggcaacaucgagcg

SEQ ID NO: 1292266 - RNA, 14 nt, Mycobacterium tuberculosis H37Rv
gccggcaccgccgg

SEQ ID NO: 1292267 - RNA, 22 nt, Mycobacterium tuberculosis H37Rv
gccggcaaaggacgucgaccug

SEQ ID NO: 1292268 - RNA, 17 nt, Mycobacterium tuberculosis H37Rv
gccgcuuagcaaucggc

SEQ ID NO: 1292269 - RNA, 23 nt, Mycobacterium tuberculosis H37Rv
gccgcugcgaaagcacgugcacg

SEQ ID NO: 1292270 - RNA, 16 nt, Mycobacterium tuberculosis H37Rv
gccgcugccuuggcgc

SEQ ID NO: 1292271 - RNA, 20 nt, Mycobacterium tuberculosis H37Rv
gccgcugugggucgauccgg

SEQ ID NO: 1292272 - RNA, 16 nt, Mycobacterium tuberculosis H37Rv
gccgcuguugaucgac

SEQ ID NO: 1292273 - RNA, 18 nt, Mycobacterium tuberculosis H37Rv
gccgcugugcggucguca

SEQ ID NO: 1292274 - RNA, 13 nt, Mycobacterium tuberculosis H37Rv
gccgcugcggcac

SEQ ID NO: 1292275 - RNA, 13 nt, Mycobacterium tuberculosis H37Rv
gccggaagcgccg

SEQ ID NO: 1292276 - RNA, 14 nt, Mycobacterium tuberculosis H37Rv
gccggaauacccgc

SEQ ID NO: 1292277 - RNA, 20 nt, Mycobacterium tuberculosis H37Rv
gccggaaucgagacgguagc

SEQ ID NO: 1292278 - RNA, 17 nt, Mycobacterium tuberculosis H37Rv
gccggagacgucgccgc

SEQ ID NO: 1292279 - RNA, 15 nt, Mycobacterium tuberculosis H37Rv
gccggauacggcgac

SEQ ID NO: 1292280 - RNA, 17 nt, Mycobacterium tuberculosis H37Rv
gccggauacaccggcac

SEQ ID NO: 1292281 - RNA, 15 nt, Mycobacterium tuberculosis H37Rv
gccggagcgcaccug

SEQ ID NO: 1292282 - RNA, 16 nt, Mycobacterium tuberculosis H37Rv
gccggacaaccugggg

SEQ ID NO: 1292283 - RNA, 15 nt, Mycobacterium tuberculosis H37Rv
gccggacaaccuggg

SEQ ID NO: 1292284 - RNA, 14 nt, Mycobacterium tuberculosis H37Rv
gccggagagucggg

SEQ ID NO: 1292285 - RNA, 14 nt, Mycobacterium tuberculosis H37Rv
gccgccaagcucgg

SEQ ID NO: 1292286 - RNA, 19 nt, Mycobacterium tuberculosis H37Rv
gccgccaagcucggccacc

SEQ ID NO: 1292287 - RNA, 16 nt, Mycobacterium tuberculosis H37Rv
gccgccaagcucggcc

SEQ ID NO: 1292288 - RNA, 21 nt, Mycobacterium tuberculosis H37Rv
gccgccacagcacccacgccg

SEQ ID NO: 1292289 - RNA, 21 nt, Mycobacterium tuberculosis H37Rv
gccgccaacuucaccacccug

SEQ ID NO: 1292290 - RNA, 21 nt, Mycobacterium tuberculosis H37Rv
gccgccaccaccgcugccggc

SEQ ID NO: 1292291 - RNA, 14 nt, Mycobacterium tuberculosis H37Rv
gccgcauuggcgac

SEQ ID NO: 1292292 - RNA, 16 nt, Mycobacterium tuberculosis H37Rv
gccgcauucggcgaug

SEQ ID NO: 1292293 - RNA, 14 nt, Mycobacterium tuberculosis H37Rv
gccgcauucgcgac

SEQ ID NO: 1292294 - RNA, 13 nt, Mycobacterium tuberculosis H37Rv
gccgcaucgguca

SEQ ID NO: 1292295 - RNA, 18 nt, Mycobacterium tuberculosis H37Rv
gccgcaucggcggugaac

SEQ ID NO: 1292296 - RNA, 21 nt, Mycobacterium tuberculosis H37Rv
gccgcaucguuuucgccgauc

SEQ ID NO: 1292297 - RNA, 21 nt, Mycobacterium tuberculosis H37Rv
gccgcauccccgguacgucga

SEQ ID NO: 1292298 - RNA, 22 nt, Mycobacterium tuberculosis H37Rv
gccgcauccccgguacgucgag

SEQ ID NO: 1292299 - RNA, 20 nt, Mycobacterium tuberculosis H37Rv
gccgcaucauagacagggcc

SEQ ID NO: 1292300 - RNA, 20 nt, Mycobacterium tuberculosis H37Rv
gccgcauaccaguaccguca

SEQ ID NO: 1292301 - RNA, 22 nt, Mycobacterium tuberculosis H37Rv
gccgcaggugggcguuggcgac

SEQ ID NO: 1292302 - RNA, 17 nt, Mycobacterium tuberculosis H37Rv
gccgcaguucaucgaga

SEQ ID NO: 1292303 - RNA, 18 nt, Mycobacterium tuberculosis H37Rv
gccgcagcggcggcaacc

SEQ ID NO: 1292304 - RNA, 14 nt, Mycobacterium tuberculosis H37Rv
gccgcagcguccgc

SEQ ID NO: 1292305 - RNA, 12 nt, Mycobacterium tuberculosis H37Rv
gccgcagcggcg

SEQ ID NO: 1292306 - RNA, 13 nt, Mycobacterium tuberculosis H37Rv
gccgcagcggccu

SEQ ID NO: 1292307 - RNA, 17 nt, Mycobacterium tuberculosis H37Rv
gccgcagcggcggcaac

SEQ ID NO: 1292308 - RNA, 19 nt, Mycobacterium tuberculosis H37Rv
gccgcagcuuggccucagc

SEQ ID NO: 1292309 - RNA, 21 nt, Mycobacterium tuberculosis H37Rv
gccgccaguucggcgucgucc

SEQ ID NO: 1292310 - RNA, 18 nt, Mycobacterium tuberculosis H37Rv
gccgccagaugaggacgg

SEQ ID NO: 1292311 - RNA, 19 nt, Mycobacterium tuberculosis H37Rv
gccgccacgggcggccacc

SEQ ID NO: 1292312 - RNA, 13 nt, Mycobacterium tuberculosis H37Rv
gccgccaccgcga

SEQ ID NO: 1292313 - RNA, 13 nt, Mycobacterium tuberculosis H37Rv
gccgccaccguca

SEQ ID NO: 1292314 - RNA, 17 nt, Mycobacterium tuberculosis H37Rv
gccgccaccgucaccgc

SEQ ID NO: 1292315 - RNA, 18 nt, Mycobacterium tuberculosis H37Rv
gccgccaccguacgacag

SEQ ID NO: 1292316 - RNA, 15 nt, Mycobacterium tuberculosis H37Rv
gccgccaccggcgac

SEQ ID NO: 1292317 - RNA, 23 nt, Mycobacterium tuberculosis H37Rv
gccgccauaccucggcgaccucc

SEQ ID NO: 1292318 - RNA, 19 nt, Mycobacterium tuberculosis H37Rv
gccgccauaccucggcgac

SEQ ID NO: 1292319 - RNA, 19 nt, Mycobacterium tuberculosis H37Rv
gccgccauugacgccguug

SEQ ID NO: 1292320 - RNA, 18 nt, Mycobacterium tuberculosis H37Rv
gccgccauuccagccggu

SEQ ID NO: 1292321 - RNA, 21 nt, Mycobacterium tuberculosis H37Rv
gccgccauggccgccguuggc

SEQ ID NO: 1292322 - RNA, 16 nt, Mycobacterium tuberculosis H37Rv
gccgccauugccauac

SEQ ID NO: 1292323 - RNA, 13 nt, Mycobacterium tuberculosis H37Rv
gccgccauugccg

SEQ ID NO: 1292324 - RNA, 23 nt, Mycobacterium tuberculosis H37Rv
gccgcccacaugaacgaccaccg

SEQ ID NO: 1292325 - RNA, 23 nt, Mycobacterium tuberculosis H37Rv
gccgcccgcagggccgccgcgaa

SEQ ID NO: 1292326 - RNA, 21 nt, Mycobacterium tuberculosis H37Rv
gccgcccgcaucgcggcaucg

SEQ ID NO: 1292327 - RNA, 18 nt, Mycobacterium tuberculosis H37Rv
gccgcccgcccaccucga

SEQ ID NO: 1292328 - RNA, 13 nt, Mycobacterium tuberculosis H37Rv
gccgcccgcgcca

SEQ ID NO: 1292329 - RNA, 21 nt, Mycobacterium tuberculosis H37Rv
gccgcccccauaacugcggcc

SEQ ID NO: 1292330 - RNA, 22 nt, Mycobacterium tuberculosis H37Rv
gccgcccaugccuccagaaccg

SEQ ID NO: 1292331 - RNA, 17 nt, Mycobacterium tuberculosis H37Rv
gccgccgggugcgccgu

SEQ ID NO: 1292332 - RNA, 19 nt, Mycobacterium tuberculosis H37Rv
gccgccggugaggaucagc

SEQ ID NO: 1292333 - RNA, 23 nt, Mycobacterium tuberculosis H37Rv
gccgccgguccccucggugccac

SEQ ID NO: 1292334 - RNA, 20 nt, Mycobacterium tuberculosis H37Rv
gccgccggugccaccgacgc

SEQ ID NO: 1292335 - RNA, 16 nt, Mycobacterium tuberculosis H37Rv
gccgccggugccaccc

SEQ ID NO: 1292336 - RNA, 15 nt, Mycobacterium tuberculosis H37Rv
gccgccggugccgcc

SEQ ID NO: 1292337 - RNA, 17 nt, Mycobacterium tuberculosis H37Rv
gccgccgucaccgccga

SEQ ID NO: 1292338 - RNA, 19 nt, Mycobacterium tuberculosis H37Rv
gccgccgucaccgccgacc

SEQ ID NO: 1292339 - RNA, 20 nt, Mycobacterium tuberculosis H37Rv
gccgccgguguaacccucga

SEQ ID NO: 1292340 - RNA, 23 nt, Mycobacterium tuberculosis H37Rv
gccgccguuaccgccguugccga

SEQ ID NO: 1292341 - RNA, 15 nt, Mycobacterium tuberculosis H37Rv
gccgccguggugauc

SEQ ID NO: 1292342 - RNA, 22 nt, Mycobacterium tuberculosis H37Rv
gccgccguucccacccacgccg

SEQ ID NO: 1292343 - RNA, 17 nt, Mycobacterium tuberculosis H37Rv
gccgccguugccaccgu

SEQ ID NO: 1292344 - RNA, 20 nt, Mycobacterium tuberculosis H37Rv
gccgccguccccaccgacgc

SEQ ID NO: 1292345 - RNA, 12 nt, Mycobacterium tuberculosis H37Rv
gccgccgucgcc

SEQ ID NO: 1292346 - RNA, 14 nt, Mycobacterium tuberculosis H37Rv
gccgccgucgccga

SEQ ID NO: 1292347 - RNA, 19 nt, Mycobacterium tuberculosis H37Rv
gccgccgucgccgaucagc

SEQ ID NO: 1292348 - RNA, 14 nt, Mycobacterium tuberculosis H37Rv
gccgccgucgccgc

SEQ ID NO: 1292349 - RNA, 13 nt, Mycobacterium tuberculosis H37Rv
gccgccgucgcca

SEQ ID NO: 1292350 - RNA, 13 nt, Mycobacterium tuberculosis H37Rv
gccgccgucgucg

SEQ ID NO: 1292351 - RNA, 23 nt, Mycobacterium tuberculosis H37Rv
gccgccgucgucgucggcagcgu

SEQ ID NO: 1292352 - RNA, 22 nt, Mycobacterium tuberculosis H37Rv
gccgcgagguacccaucgucga

SEQ ID NO: 1292353 - RNA, 18 nt, Mycobacterium tuberculosis H37Rv
gccgcgaguccaggcuga

SEQ ID NO: 1292354 - RNA, 17 nt, Mycobacterium tuberculosis H37Rv
gccgcgagccggugauc

SEQ ID NO: 1292355 - RNA, 16 nt, Mycobacterium tuberculosis H37Rv
gccgcgagcgcgcgac

SEQ ID NO: 1292356 - RNA, 16 nt, Mycobacterium tuberculosis H37Rv
gccgcgacgcggcguc

SEQ ID NO: 1292357 - RNA, 21 nt, Mycobacterium tuberculosis H37Rv
gccgccguugccgucgucgcc

SEQ ID NO: 1292358 - RNA, 17 nt, Mycobacterium tuberculosis H37Rv
gccgccguugccgccga

SEQ ID NO: 1292359 - RNA, 18 nt, Mycobacterium tuberculosis H37Rv
gccgccguugccgccaug

SEQ ID NO: 1292360 - RNA, 15 nt, Mycobacterium tuberculosis H37Rv
gccgccguugccgcc

SEQ ID NO: 1292361 - RNA, 14 nt, Mycobacterium tuberculosis H37Rv
gccgccguugccgc

SEQ ID NO: 1292362 - RNA, 19 nt, Mycobacterium tuberculosis H37Rv
gccgccucaaugaccaccg

SEQ ID NO: 1292363 - RNA, 23 nt, Mycobacterium tuberculosis H37Rv
gccgccguugccgucgucgccgu

SEQ ID NO: 1292364 - RNA, 21 nt, Mycobacterium tuberculosis H37Rv
gccgccguuggcaccgggugc

SEQ ID NO: 1292365 - RNA, 23 nt, Mycobacterium tuberculosis H37Rv
gccgcgaccgcgaccgcauugag

SEQ ID NO: 1292366 - RNA, 18 nt, Mycobacterium tuberculosis H37Rv
gccgccuccgccugcccc

SEQ ID NO: 1292367 - RNA, 21 nt, Mycobacterium tuberculosis H37Rv
gccgccgggaaauaucucggu

SEQ ID NO: 1292368 - RNA, 23 nt, Mycobacterium tuberculosis H37Rv
gccgccgggaaauaucucgguga

SEQ ID NO: 1292369 - RNA, 15 nt, Mycobacterium tuberculosis H37Rv
gccgccggcgccgga

SEQ ID NO: 1292370 - RNA, 18 nt, Mycobacterium tuberculosis H37Rv
gccgccggcaccucccug

SEQ ID NO: 1292371 - RNA, 23 nt, Mycobacterium tuberculosis H37Rv
gccgccggaggucgggcggcgac

SEQ ID NO: 1292372 - RNA, 14 nt, Mycobacterium tuberculosis H37Rv
gccgccggcagcgc

SEQ ID NO: 1292373 - RNA, 16 nt, Mycobacterium tuberculosis H37Rv
gccgccggcagcgcgg

SEQ ID NO: 1292374 - RNA, 14 nt, Mycobacterium tuberculosis H37Rv
gccgccggacccgu

SEQ ID NO: 1292375 - RNA, 13 nt, Mycobacterium tuberculosis H37Rv
gccgccggagauc

SEQ ID NO: 1292376 - RNA, 14 nt, Mycobacterium tuberculosis H37Rv
gccgccggagauga

SEQ ID NO: 1292377 - RNA, 23 nt, Mycobacterium tuberculosis H37Rv
gccgccggcaacccagugucagc

SEQ ID NO: 1292378 - RNA, 13 nt, Mycobacterium tuberculosis H37Rv
gccgccggaaucg

SEQ ID NO: 1292379 - RNA, 19 nt, Mycobacterium tuberculosis H37Rv
gccgccgcggcagggcggu

SEQ ID NO: 1292380 - RNA, 13 nt, Mycobacterium tuberculosis H37Rv
gccgccgcggcca

SEQ ID NO: 1292381 - RNA, 17 nt, Mycobacterium tuberculosis H37Rv
gccgccgccgucggcga

SEQ ID NO: 1292382 - RNA, 15 nt, Mycobacterium tuberculosis H37Rv
gccgccgcgauggcc

SEQ ID NO: 1292383 - RNA, 19 nt, Mycobacterium tuberculosis H37Rv
gccgccgaugccgccggca

SEQ ID NO: 1292384 - RNA, 18 nt, Mycobacterium tuberculosis H37Rv
gccgcccuggacgucggc

SEQ ID NO: 1292385 - RNA, 15 nt, Mycobacterium tuberculosis H37Rv
gccgcccgcuccgcc

SEQ ID NO: 1292386 - RNA, 19 nt, Mycobacterium tuberculosis H37Rv
gccgcccgcgccgccggac

SEQ ID NO: 1292387 - RNA, 21 nt, Mycobacterium tuberculosis H37Rv
gccgagcuugucgagcaggcc

SEQ ID NO: 1292388 - RNA, 18 nt, Mycobacterium tuberculosis H37Rv
gccgagcuugucgagcag

SEQ ID NO: 1292389 - RNA, 17 nt, Mycobacterium tuberculosis H37Rv
gccgagcuucagcgcgc

SEQ ID NO: 1292390 - RNA, 15 nt, Mycobacterium tuberculosis H37Rv
gccgagcggaccacc

SEQ ID NO: 1292391 - RNA, 23 nt, Mycobacterium tuberculosis H37Rv
gccgaggaauacucucgcgacau

SEQ ID NO: 1292392 - RNA, 21 nt, Mycobacterium tuberculosis H37Rv
gccgaggacuggaaagcagca

SEQ ID NO: 1292393 - RNA, 17 nt, Mycobacterium tuberculosis H37Rv
gccgaggaccagaggcg

SEQ ID NO: 1292394 - RNA, 15 nt, Mycobacterium tuberculosis H37Rv
gccgaguugaccgcc

SEQ ID NO: 1292395 - RNA, 16 nt, Mycobacterium tuberculosis H37Rv
gccgaguucgucagcg

SEQ ID NO: 1292396 - RNA, 17 nt, Mycobacterium tuberculosis H37Rv
gccgaguggccgcauua

SEQ ID NO: 1292397 - RNA, 21 nt, Mycobacterium tuberculosis H37Rv
gccgaucaccgcaucggugcc

SEQ ID NO: 1292398 - RNA, 23 nt, Mycobacterium tuberculosis H37Rv
gccgaucagcgaaccaccggcgc

SEQ ID NO: 1292399 - RNA, 14 nt, Mycobacterium tuberculosis H37Rv
gccgaucagcgaac

SEQ ID NO: 1292400 - RNA, 19 nt, Mycobacterium tuberculosis H37Rv
gccgaucagcccggccuug

SEQ ID NO: 1292401 - RNA, 13 nt, Mycobacterium tuberculosis H37Rv
gccgaucaccgcu

SEQ ID NO: 1292402 - RNA, 19 nt, Mycobacterium tuberculosis H37Rv
gccgaugaugugcggugac

SEQ ID NO: 1292403 - RNA, 17 nt, Mycobacterium tuberculosis H37Rv
gccgaugaugcggcgca

SEQ ID NO: 1292404 - RNA, 14 nt, Mycobacterium tuberculosis H37Rv
gccgaucugcucgc

SEQ ID NO: 1292405 - RNA, 15 nt, Mycobacterium tuberculosis H37Rv
gccgaucucggugac

SEQ ID NO: 1292406 - RNA, 22 nt, Mycobacterium tuberculosis H37Rv
gccgaucugcucgccgagcucg

SEQ ID NO: 1292407 - RNA, 23 nt, Mycobacterium tuberculosis H37Rv
gccgaucugcucgccgagcucgg

SEQ ID NO: 1292408 - RNA, 12 nt, Mycobacterium tuberculosis H37Rv
gccgaucggugc

SEQ ID NO: 1292409 - RNA, 13 nt, Mycobacterium tuberculosis H37Rv
gccgaucggugcc

SEQ ID NO: 1292410 - RNA, 18 nt, Mycobacterium tuberculosis H37Rv
gccgaucgcggcggccuc

SEQ ID NO: 1292411 - RNA, 17 nt, Mycobacterium tuberculosis H37Rv
gccgaucgcggcggccu

SEQ ID NO: 1292412 - RNA, 18 nt, Mycobacterium tuberculosis H37Rv
gccgauuccggaguucuu

SEQ ID NO: 1292413 - RNA, 15 nt, Mycobacterium tuberculosis H37Rv
gccgcaaccggcgau

SEQ ID NO: 1292414 - RNA, 17 nt, Mycobacterium tuberculosis H37Rv
gccgcaaccggcgaucg

SEQ ID NO: 1292415 - RNA, 15 nt, Mycobacterium tuberculosis H37Rv
gccgaugccggccaa

SEQ ID NO: 1292416 - RNA, 12 nt, Mycobacterium tuberculosis H37Rv
gccgaugccacc

SEQ ID NO: 1292417 - RNA, 17 nt, Mycobacterium tuberculosis H37Rv
gccgauuacggugaucg

SEQ ID NO: 1292418 - RNA, 16 nt, Mycobacterium tuberculosis H37Rv
gccgauuacggugauc

SEQ ID NO: 1292419 - RNA, 21 nt, Mycobacterium tuberculosis H37Rv
gccgauguuguugacgcccga

SEQ ID NO: 1292420 - RNA, 19 nt, Mycobacterium tuberculosis H37Rv
gccgauguggccggcgaug

SEQ ID NO: 1292421 - RNA, 22 nt, Mycobacterium tuberculosis H37Rv
gccgauguggccggcgauggcc

SEQ ID NO: 1292422 - RNA, 14 nt, Mycobacterium tuberculosis H37Rv
gccgauguggucgg

SEQ ID NO: 1292423 - RNA, 19 nt, Mycobacterium tuberculosis H37Rv
gccgauguggucggcuguc

SEQ ID NO: 1292424 - RNA, 17 nt, Mycobacterium tuberculosis H37Rv
gccgcacgucgaccucg

SEQ ID NO: 1292425 - RNA, 19 nt, Mycobacterium tuberculosis H37Rv
gccgcacccgaaacaccgu

SEQ ID NO: 1292426 - RNA, 20 nt, Mycobacterium tuberculosis H37Rv
gccgcacccccuccgcgaug

SEQ ID NO: 1292427 - RNA, 13 nt, Mycobacterium tuberculosis H37Rv
gccgcaccaaggc

SEQ ID NO: 1292428 - RNA, 16 nt, Mycobacterium tuberculosis H37Rv
gccgcaccaagcagcg

SEQ ID NO: 1292429 - RNA, 18 nt, Mycobacterium tuberculosis H37Rv
gccgcaccaagcagcgac

SEQ ID NO: 1292430 - RNA, 14 nt, Mycobacterium tuberculosis H37Rv
gccgcagacguccu

SEQ ID NO: 1292431 - RNA, 18 nt, Mycobacterium tuberculosis H37Rv
gccgcagaucaccgccag

SEQ ID NO: 1292432 - RNA, 19 nt, Mycobacterium tuberculosis H37Rv
gccgcagaucaccgccagc

SEQ ID NO: 1292433 - RNA, 19 nt, Mycobacterium tuberculosis H37Rv
gccgcacucacauccuggu

SEQ ID NO: 1292434 - RNA, 15 nt, Mycobacterium tuberculosis H37Rv
gccgcagcggccagc

SEQ ID NO: 1292435 - RNA, 14 nt, Mycobacterium tuberculosis H37Rv
gccgcagcggccag

SEQ ID NO: 1292436 - RNA, 20 nt, Mycobacterium tuberculosis H37Rv
gccgaaucggcaguugaacu

SEQ ID NO: 1292437 - RNA, 14 nt, Mycobacterium tuberculosis H37Rv
gccgaaucuggggu

SEQ ID NO: 1292438 - RNA, 18 nt, Mycobacterium tuberculosis H37Rv
gccgacagccgauccgau

SEQ ID NO: 1292439 - RNA, 16 nt, Mycobacterium tuberculosis H37Rv
gccgacacguugcagc

SEQ ID NO: 1292440 - RNA, 14 nt, Mycobacterium tuberculosis H37Rv
gccgacagccaccg

SEQ ID NO: 1292441 - RNA, 16 nt, Mycobacterium tuberculosis H37Rv
gcccgucgucgucgac

SEQ ID NO: 1292442 - RNA, 19 nt, Mycobacterium tuberculosis H37Rv
gccgaauaccacaccguga

SEQ ID NO: 1292443 - RNA, 14 nt, Mycobacterium tuberculosis H37Rv
gccgaauaccacac

SEQ ID NO: 1292444 - RNA, 14 nt, Mycobacterium tuberculosis H37Rv
gccgaaucccgcga

SEQ ID NO: 1292445 - RNA, 15 nt, Mycobacterium tuberculosis H37Rv
gcccucacaacgauu

SEQ ID NO: 1292446 - RNA, 15 nt, Mycobacterium tuberculosis H37Rv
gcccuauggguuccu

SEQ ID NO: 1292447 - RNA, 18 nt, Mycobacterium tuberculosis H37Rv
gcccucaguucacguucg

SEQ ID NO: 1292448 - RNA, 21 nt, Mycobacterium tuberculosis H37Rv
gccgaccaugcaagugggcgc

SEQ ID NO: 1292449 - RNA, 19 nt, Mycobacterium tuberculosis H37Rv
gccgaccuguccgauaacg

SEQ ID NO: 1292450 - RNA, 16 nt, Mycobacterium tuberculosis H37Rv
gccgaccucguucguc

SEQ ID NO: 1292451 - RNA, 20 nt, Mycobacterium tuberculosis H37Rv
gccgaccagcacccgcucgg

SEQ ID NO: 1292452 - RNA, 18 nt, Mycobacterium tuberculosis H37Rv
gccgacagcucaucgauc

SEQ ID NO: 1292453 - RNA, 18 nt, Mycobacterium tuberculosis H37Rv
gccgaccagcgcggcaca

SEQ ID NO: 1292454 - RNA, 16 nt, Mycobacterium tuberculosis H37Rv
gccgaccagccgauca

SEQ ID NO: 1292455 - RNA, 16 nt, Mycobacterium tuberculosis H37Rv
gccgaccaucucaccg

SEQ ID NO: 1292456 - RNA, 17 nt, Mycobacterium tuberculosis H37Rv
gccgaccaggaccaccg

SEQ ID NO: 1292457 - RNA, 23 nt, Mycobacterium tuberculosis H37Rv
gccgagaccgcguggucggcgaa

SEQ ID NO: 1292458 - RNA, 14 nt, Mycobacterium tuberculosis H37Rv
gccgagaucacgcc

SEQ ID NO: 1292459 - RNA, 15 nt, Mycobacterium tuberculosis H37Rv
gccgagcacgggcag

SEQ ID NO: 1292460 - RNA, 22 nt, Mycobacterium tuberculosis H37Rv
gccgagcacucggccacgacga

SEQ ID NO: 1292461 - RNA, 18 nt, Mycobacterium tuberculosis H37Rv
gccgagcagacacagaau

SEQ ID NO: 1292462 - RNA, 18 nt, Mycobacterium tuberculosis H37Rv
gccgagcagacgcaaaau

SEQ ID NO: 1292463 - RNA, 13 nt, Mycobacterium tuberculosis H37Rv
gccgagcacucgg

SEQ ID NO: 1292464 - RNA, 23 nt, Mycobacterium tuberculosis H37Rv
gccgagcgcaacucccagcacgg

SEQ ID NO: 1292465 - RNA, 17 nt, Mycobacterium tuberculosis H37Rv
gccgagcccgucgauca

SEQ ID NO: 1292466 - RNA, 17 nt, Mycobacterium tuberculosis H37Rv
gccgagcagggccggca

SEQ ID NO: 1292467 - RNA, 20 nt, Mycobacterium tuberculosis H37Rv
gccgacguggaugguggugc

SEQ ID NO: 1292468 - RNA, 14 nt, Mycobacterium tuberculosis H37Rv
gccgacgucgccga

SEQ ID NO: 1292469 - RNA, 20 nt, Mycobacterium tuberculosis H37Rv
gccgacgucgacgccggcca

SEQ ID NO: 1292470 - RNA, 15 nt, Mycobacterium tuberculosis H37Rv
gccgacggaucgccc

SEQ ID NO: 1292471 - RNA, 22 nt, Mycobacterium tuberculosis H37Rv
gccgacggcaagggcauacagc

SEQ ID NO: 1292472 - RNA, 13 nt, Mycobacterium tuberculosis H37Rv
gccgacgguuacc

SEQ ID NO: 1292473 - RNA, 15 nt, Mycobacterium tuberculosis H37Rv
gccgacgcgcggcca

SEQ ID NO: 1292474 - RNA, 17 nt, Mycobacterium tuberculosis H37Rv
gccgaccuuggcgucga

SEQ ID NO: 1292475 - RNA, 13 nt, Mycobacterium tuberculosis H37Rv
gccgaccuucggc

SEQ ID NO: 1292476 - RNA, 19 nt, Mycobacterium tuberculosis H37Rv
gccgaccuuggcgucgauc

SEQ ID NO: 1292477 - RNA, 18 nt, Mycobacterium tuberculosis H37Rv
gccgaccuuuugcggcaa

SEQ ID NO: 1292478 - RNA, 19 nt, Mycobacterium tuberculosis H37Rv
gccgacgccgccggcgcca

SEQ ID NO: 1292479 - RNA, 16 nt, Mycobacterium tuberculosis H37Rv
gccaggcgcgaucgcg

SEQ ID NO: 1292480 - RNA, 12 nt, Mycobacterium tuberculosis H37Rv
gccaggcgcagc

SEQ ID NO: 1292481 - RNA, 16 nt, Mycobacterium tuberculosis H37Rv
gccaggccgucggcgu

SEQ ID NO: 1292482 - RNA, 14 nt, Mycobacterium tuberculosis H37Rv
gccaggccgucggc

SEQ ID NO: 1292483 - RNA, 20 nt, Mycobacterium tuberculosis H37Rv
gccaggcacguccgaucggc

SEQ ID NO: 1292484 - RNA, 16 nt, Mycobacterium tuberculosis H37Rv
gccaggcacguccgau

SEQ ID NO: 1292485 - RNA, 14 nt, Mycobacterium tuberculosis H37Rv
gccaggcacguccg

SEQ ID NO: 1292486 - RNA, 17 nt, Mycobacterium tuberculosis H37Rv
gccaggccagugccacc

SEQ ID NO: 1292487 - RNA, 13 nt, Mycobacterium tuberculosis H37Rv
gccaggcccgugc

SEQ ID NO: 1292488 - RNA, 17 nt, Mycobacterium tuberculosis H37Rv
gccaggaguuugaccac

SEQ ID NO: 1292489 - RNA, 21 nt, Mycobacterium tuberculosis H37Rv
gccaggaguuugaccaccugg

SEQ ID NO: 1292490 - RNA, 22 nt, Mycobacterium tuberculosis H37Rv
gccaggaucgcuacgucgaccg

SEQ ID NO: 1292491 - RNA, 23 nt, Mycobacterium tuberculosis H37Rv
gccagcucgugaucuucggcgau

SEQ ID NO: 1292492 - RNA, 17 nt, Mycobacterium tuberculosis H37Rv
gccagggcuugccgggu

SEQ ID NO: 1292493 - RNA, 23 nt, Mycobacterium tuberculosis H37Rv
gccaggggugugccguggucgaa

SEQ ID NO: 1292494 - RNA, 22 nt, Mycobacterium tuberculosis H37Rv
gccagggagcgcagcgccggca

SEQ ID NO: 1292495 - RNA, 18 nt, Mycobacterium tuberculosis H37Rv
gccagggaucagccgugc

SEQ ID NO: 1292496 - RNA, 15 nt, Mycobacterium tuberculosis H37Rv
gccaggcuggcguca

SEQ ID NO: 1292497 - RNA, 13 nt, Mycobacterium tuberculosis H37Rv
gccaggcgugcac

SEQ ID NO: 1292498 - RNA, 16 nt, Mycobacterium tuberculosis H37Rv
gccaggggaucaccgg

SEQ ID NO: 1292499 - RNA, 16 nt, Mycobacterium tuberculosis H37Rv
gccagggugaccaggc

SEQ ID NO: 1292500 - RNA, 15 nt, Mycobacterium tuberculosis H37Rv
gccaggucgacaccg

SEQ ID NO: 1292501 - RNA, 21 nt, Mycobacterium tuberculosis H37Rv
gccagguguucgccggagacc

SEQ ID NO: 1292502 - RNA, 17 nt, Mycobacterium tuberculosis H37Rv
gccagguggccgcaucg

SEQ ID NO: 1292503 - RNA, 13 nt, Mycobacterium tuberculosis H37Rv
gccaggugcaggc

SEQ ID NO: 1292504 - RNA, 14 nt, Mycobacterium tuberculosis H37Rv
gccaggucggccac

SEQ ID NO: 1292505 - RNA, 21 nt, Mycobacterium tuberculosis H37Rv
gccaggucggccaccguggau

SEQ ID NO: 1292506 - RNA, 14 nt, Mycobacterium tuberculosis H37Rv
gccaggucggcgau

SEQ ID NO: 1292507 - RNA, 19 nt, Mycobacterium tuberculosis H37Rv
gccaggucggccaccgugg

SEQ ID NO: 1292508 - RNA, 20 nt, Mycobacterium tuberculosis H37Rv
gccaggucgcgauagccgcc

SEQ ID NO: 1292509 - RNA, 12 nt, Mycobacterium tuberculosis H37Rv
gcccaacgucgc

SEQ ID NO: 1292510 - RNA, 14 nt, Mycobacterium tuberculosis H37Rv
gcccaacgacauga

SEQ ID NO: 1292511 - RNA, 18 nt, Mycobacterium tuberculosis H37Rv
gcccaacggaagaccgcg

SEQ ID NO: 1292512 - RNA, 13 nt, Mycobacterium tuberculosis H37Rv
gcccaacccggau

SEQ ID NO: 1292513 - RNA, 22 nt, Mycobacterium tuberculosis H37Rv
gcccaaaaacggcagcauggcc

SEQ ID NO: 1292514 - RNA, 18 nt, Mycobacterium tuberculosis H37Rv
gcccaacagcaacccgcc

SEQ ID NO: 1292515 - RNA, 17 nt, Mycobacterium tuberculosis H37Rv
gcccaacagcaacccgc

SEQ ID NO: 1292516 - RNA, 15 nt, Mycobacterium tuberculosis H37Rv
gcccaacaccgccag

SEQ ID NO: 1292517 - RNA, 22 nt, Mycobacterium tuberculosis H37Rv
gccauugcccgggcgggagucg

SEQ ID NO: 1292518 - RNA, 15 nt, Mycobacterium tuberculosis H37Rv
gccauugcgggaacg

SEQ ID NO: 1292519 - RNA, 23 nt, Mycobacterium tuberculosis H37Rv
gccauucuuggugaucgcgaacu

SEQ ID NO: 1292520 - RNA, 18 nt, Mycobacterium tuberculosis H37Rv
gccauucuucgaucagcg

SEQ ID NO: 1292521 - RNA, 18 nt, Mycobacterium tuberculosis H37Rv
gccauucuuggugaucgc

SEQ ID NO: 1292522 - RNA, 15 nt, Mycobacterium tuberculosis H37Rv
gccauggcguucugc

SEQ ID NO: 1292523 - RNA, 20 nt, Mycobacterium tuberculosis H37Rv
gccaugggauucggccagac

SEQ ID NO: 1292524 - RNA, 19 nt, Mycobacterium tuberculosis H37Rv
gccaugggaguucaucgca

SEQ ID NO: 1292525 - RNA, 23 nt, Mycobacterium tuberculosis H37Rv
gccaugaagccgggcgcuugcac

SEQ ID NO: 1292526 - RNA, 15 nt, Mycobacterium tuberculosis H37Rv
gccaugaagccgggc

SEQ ID NO: 1292527 - RNA, 15 nt, Mycobacterium tuberculosis H37Rv
gccauguggcgucgc

SEQ ID NO: 1292528 - RNA, 19 nt, Mycobacterium tuberculosis H37Rv
gccauguagccguugccgc

SEQ ID NO: 1292529 - RNA, 20 nt, Mycobacterium tuberculosis H37Rv
gccaugucgauguccacgcc

SEQ ID NO: 1292530 - RNA, 15 nt, Mycobacterium tuberculosis H37Rv
gccaugguguucggc

SEQ ID NO: 1292531 - RNA, 18 nt, Mycobacterium tuberculosis H37Rv
gccaucuggguccgucga

SEQ ID NO: 1292532 - RNA, 14 nt, Mycobacterium tuberculosis H37Rv
gccaucgcccgaug

SEQ ID NO: 1292533 - RNA, 16 nt, Mycobacterium tuberculosis H37Rv
gccaucgccuccagcc

SEQ ID NO: 1292534 - RNA, 21 nt, Mycobacterium tuberculosis H37Rv
gccaucgccuccagccggcga

SEQ ID NO: 1292535 - RNA, 19 nt, Mycobacterium tuberculosis H37Rv
gccauccccuggccagcag

SEQ ID NO: 1292536 - RNA, 13 nt, Mycobacterium tuberculosis H37Rv
gccaucauggcgg

SEQ ID NO: 1292537 - RNA, 14 nt, Mycobacterium tuberculosis H37Rv
gccaucagcccggc

SEQ ID NO: 1292538 - RNA, 13 nt, Mycobacterium tuberculosis H37Rv
gccaucagcucgc

SEQ ID NO: 1292539 - RNA, 11 nt, Mycobacterium tuberculosis H37Rv
gccaucaccgc

SEQ ID NO: 1292540 - RNA, 16 nt, Mycobacterium tuberculosis H37Rv
gccagucccggcgcac

SEQ ID NO: 1292541 - RNA, 13 nt, Mycobacterium tuberculosis H37Rv
gccaguauggccg

SEQ ID NO: 1292542 - RNA, 21 nt, Mycobacterium tuberculosis H37Rv
gccaguccgcagcguccagcg

SEQ ID NO: 1292543 - RNA, 22 nt, Mycobacterium tuberculosis H37Rv
gccaacgcgcagagcguuccgc

SEQ ID NO: 1292544 - RNA, 19 nt, Mycobacterium tuberculosis H37Rv
gccaacggcacccugcggc

SEQ ID NO: 1292545 - RNA, 17 nt, Mycobacterium tuberculosis H37Rv
gccaacgcgcgaccgcg

SEQ ID NO: 1292546 - RNA, 22 nt, Mycobacterium tuberculosis H37Rv
gccaacgguaguugcgcggcau

SEQ ID NO: 1292547 - RNA, 16 nt, Mycobacterium tuberculosis H37Rv
gccaacggcuccgggc

SEQ ID NO: 1292548 - RNA, 21 nt, Mycobacterium tuberculosis H37Rv
gccaacggaccguuaccggac

SEQ ID NO: 1292549 - RNA, 20 nt, Mycobacterium tuberculosis H37Rv
gccacgagcaacgggcgaac

SEQ ID NO: 1292550 - RNA, 14 nt, Mycobacterium tuberculosis H37Rv
gccacgaccgccga

SEQ ID NO: 1292551 - RNA, 12 nt, Mycobacterium tuberculosis H37Rv
gccacgaccgcg

SEQ ID NO: 1292552 - RNA, 13 nt, Mycobacterium tuberculosis H37Rv
gccacgaggaccc

SEQ ID NO: 1292553 - RNA, 15 nt, Mycobacterium tuberculosis H37Rv
gccacgaugauccca

SEQ ID NO: 1292554 - RNA, 20 nt, Mycobacterium tuberculosis H37Rv
gccacgaugucgucgaugaa

SEQ ID NO: 1292555 - RNA, 18 nt, Mycobacterium tuberculosis H37Rv
gccacgaggacccgucga

SEQ ID NO: 1292556 - RNA, 14 nt, Mycobacterium tuberculosis H37Rv
gccacgccaccgcg

SEQ ID NO: 1292557 - RNA, 18 nt, Mycobacterium tuberculosis H37Rv
gccacgcaugggccaggu

SEQ ID NO: 1292558 - RNA, 12 nt, Mycobacterium tuberculosis H37Rv
gccacgccagcg

SEQ ID NO: 1292559 - RNA, 14 nt, Mycobacterium tuberculosis H37Rv
gccacgccagcguc

SEQ ID NO: 1292560 - RNA, 20 nt, Mycobacterium tuberculosis H37Rv
gccacgccagcgucgaccaa

SEQ ID NO: 1292561 - RNA, 17 nt, Mycobacterium tuberculosis H37Rv
gccacgcacccggcaau

SEQ ID NO: 1292562 - RNA, 15 nt, Mycobacterium tuberculosis H37Rv
gccacgucgagcacc

SEQ ID NO: 1292563 - RNA, 13 nt, Mycobacterium tuberculosis H37Rv
gccacgucgagca

SEQ ID NO: 1292564 - RNA, 17 nt, Mycobacterium tuberculosis H37Rv
gccacgucaaacccgac

SEQ ID NO: 1292565 - RNA, 22 nt, Mycobacterium tuberculosis H37Rv
gccacggccuucagcggucgca

SEQ ID NO: 1292566 - RNA, 14 nt, Mycobacterium tuberculosis H37Rv
gccacggcgucggc

SEQ ID NO: 1292567 - RNA, 15 nt, Mycobacterium tuberculosis H37Rv
gccacggcgucggcc

SEQ ID NO: 1292568 - RNA, 14 nt, Mycobacterium tuberculosis H37Rv
gccacggcugcgga

SEQ ID NO: 1292569 - RNA, 19 nt, Mycobacterium tuberculosis H37Rv
gccacgcucggcggccagc

SEQ ID NO: 1292570 - RNA, 15 nt, Mycobacterium tuberculosis H37Rv
gccacgccggucgcg

SEQ ID NO: 1292571 - RNA, 15 nt, Mycobacterium tuberculosis H37Rv
gccacgccacgucca

SEQ ID NO: 1292572 - RNA, 16 nt, Mycobacterium tuberculosis H37Rv
gccacgccaccgcggu

SEQ ID NO: 1292573 - RNA, 23 nt, Mycobacterium tuberculosis H37Rv
gccacgccgccggugaacgucac

SEQ ID NO: 1292574 - RNA, 16 nt, Mycobacterium tuberculosis H37Rv
gccacgcgggcgcggu

SEQ ID NO: 1292575 - RNA, 16 nt, Mycobacterium tuberculosis H37Rv
gccacgucgucgccca

SEQ ID NO: 1292576 - RNA, 17 nt, Mycobacterium tuberculosis H37Rv
gccacgucuccuucggc

SEQ ID NO: 1292577 - RNA, 19 nt, Mycobacterium tuberculosis H37Rv
gccacguugaucccgaacc

SEQ ID NO: 1292578 - RNA, 17 nt, Mycobacterium tuberculosis H37Rv
gccacguggucgagcag

SEQ ID NO: 1292579 - RNA, 15 nt, Mycobacterium tuberculosis H37Rv
gccacguggucggcg

SEQ ID NO: 1292580 - RNA, 14 nt, Mycobacterium tuberculosis H37Rv
gccacuaucggcuu

SEQ ID NO: 1292581 - RNA, 20 nt, Mycobacterium tuberculosis H37Rv
gccagaaacccggcgaccac

SEQ ID NO: 1292582 - RNA, 17 nt, Mycobacterium tuberculosis H37Rv
gccagaacggcgucgaa

SEQ ID NO: 1292583 - RNA, 21 nt, Mycobacterium tuberculosis H37Rv
gccagaccagggcagcggcca

SEQ ID NO: 1292584 - RNA, 15 nt, Mycobacterium tuberculosis H37Rv
gccagagaucgaggu

SEQ ID NO: 1292585 - RNA, 12 nt, Mycobacterium tuberculosis H37Rv
gccagagaucga

SEQ ID NO: 1292586 - RNA, 15 nt, Mycobacterium tuberculosis H37Rv
gccagaucgaacgca

SEQ ID NO: 1292587 - RNA, 15 nt, Mycobacterium tuberculosis H37Rv
gccagauccuucaac

SEQ ID NO: 1292588 - RNA, 22 nt, Mycobacterium tuberculosis H37Rv
gccagaucgcuaggaccgcggu

SEQ ID NO: 1292589 - RNA, 17 nt, Mycobacterium tuberculosis H37Rv
gccagaucggucggcca

SEQ ID NO: 1292590 - RNA, 21 nt, Mycobacterium tuberculosis H37Rv
gccagaucggccaacuugcuc

SEQ ID NO: 1292591 - RNA, 23 nt, Mycobacterium tuberculosis H37Rv
gccagaucggcggguggcgccag

SEQ ID NO: 1292592 - RNA, 21 nt, Mycobacterium tuberculosis H37Rv
gccagaugccucggagaucga

SEQ ID NO: 1292593 - RNA, 23 nt, Mycobacterium tuberculosis H37Rv
gccagccgcugccacaggugacc

SEQ ID NO: 1292594 - RNA, 20 nt, Mycobacterium tuberculosis H37Rv
gccagccggccgcgaccgcg

SEQ ID NO: 1292595 - RNA, 15 nt, Mycobacterium tuberculosis H37Rv
gccagcgccgcugaa

SEQ ID NO: 1292596 - RNA, 18 nt, Mycobacterium tuberculosis H37Rv
gccagcgccucggcaucg

SEQ ID NO: 1292597 - RNA, 23 nt, Mycobacterium tuberculosis H37Rv
gccagcgccucggugagcugcac

SEQ ID NO: 1292598 - RNA, 14 nt, Mycobacterium tuberculosis H37Rv
gccagcgccggcca

SEQ ID NO: 1292599 - RNA, 15 nt, Mycobacterium tuberculosis H37Rv
gccagcgccucggca

SEQ ID NO: 1292600 - RNA, 20 nt, Mycobacterium tuberculosis H37Rv
gccagcguccauggucgcgc

SEQ ID NO: 1292601 - RNA, 20 nt, Mycobacterium tuberculosis H37Rv
gccagcggcaauggccagca

SEQ ID NO: 1292602 - RNA, 19 nt, Mycobacterium tuberculosis H37Rv
gccagcgcgucgccgucga

SEQ ID NO: 1292603 - RNA, 19 nt, Mycobacterium tuberculosis H37Rv
gccagcaagucugcccgac

SEQ ID NO: 1292604 - RNA, 16 nt, Mycobacterium tuberculosis H37Rv
gccagcacaccgucga

SEQ ID NO: 1292605 - RNA, 18 nt, Mycobacterium tuberculosis H37Rv
gccagcacaccgucgacg

SEQ ID NO: 1292606 - RNA, 19 nt, Mycobacterium tuberculosis H37Rv
gccagcaccacggccagcg

SEQ ID NO: 1292607 - RNA, 21 nt, Mycobacterium tuberculosis H37Rv
gccagcaccacggccagcggg

SEQ ID NO: 1292608 - RNA, 13 nt, Mycobacterium tuberculosis H37Rv
gccagcaucgggu

SEQ ID NO: 1292609 - RNA, 19 nt, Mycobacterium tuberculosis H37Rv
gccagcaucggcagcagcg

SEQ ID NO: 1292610 - RNA, 20 nt, Mycobacterium tuberculosis H37Rv
gccagcagguuggucaccac

SEQ ID NO: 1292611 - RNA, 14 nt, Mycobacterium tuberculosis H37Rv
gccagcagguccgc

SEQ ID NO: 1292612 - RNA, 14 nt, Mycobacterium tuberculosis H37Rv
gccagcagugcggu

SEQ ID NO: 1292613 - RNA, 17 nt, Mycobacterium tuberculosis H37Rv
gccagcauugacccgac

SEQ ID NO: 1292614 - RNA, 15 nt, Mycobacterium tuberculosis H37Rv
gccagccacuccucg

SEQ ID NO: 1292615 - RNA, 16 nt, Mycobacterium tuberculosis H37Rv
gccagccaccgaucga

SEQ ID NO: 1292616 - RNA, 14 nt, Mycobacterium tuberculosis H37Rv
gccagccgcucacc

SEQ ID NO: 1292617 - RNA, 20 nt, Mycobacterium tuberculosis H37Rv
gccagccgcgagccggugau

SEQ ID NO: 1292618 - RNA, 19 nt, Mycobacterium tuberculosis H37Rv
gccagccccacccgcaugc

SEQ ID NO: 1292619 - RNA, 16 nt, Mycobacterium tuberculosis H37Rv
gcccgcggugaccacc

SEQ ID NO: 1292620 - RNA, 21 nt, Mycobacterium tuberculosis H37Rv
gcccgcgggcgguaaucgcga

SEQ ID NO: 1292621 - RNA, 20 nt, Mycobacterium tuberculosis H37Rv
gcccgcgggcaagccggaca

SEQ ID NO: 1292622 - RNA, 15 nt, Mycobacterium tuberculosis H37Rv
gcccgcgggaucagc

SEQ ID NO: 1292623 - RNA, 13 nt, Mycobacterium tuberculosis H37Rv
gcccgcgggauca

SEQ ID NO: 1292624 - RNA, 13 nt, Mycobacterium tuberculosis H37Rv
gcccgcgcggcca

SEQ ID NO: 1292625 - RNA, 14 nt, Mycobacterium tuberculosis H37Rv
gcccgcgcggcggu

SEQ ID NO: 1292626 - RNA, 18 nt, Mycobacterium tuberculosis H37Rv
gcccgcggacgugccggu

SEQ ID NO: 1292627 - RNA, 20 nt, Mycobacterium tuberculosis H37Rv
gcccgcgcagcacugcggca

SEQ ID NO: 1292628 - RNA, 13 nt, Mycobacterium tuberculosis H37Rv
gcccgcgaucggg

SEQ ID NO: 1292629 - RNA, 18 nt, Mycobacterium tuberculosis H37Rv
gcccgccaccggcgcgac

SEQ ID NO: 1292630 - RNA, 14 nt, Mycobacterium tuberculosis H37Rv
gcccgcccgcacga

SEQ ID NO: 1292631 - RNA, 15 nt, Mycobacterium tuberculosis H37Rv
gcccgcccuggcaac

SEQ ID NO: 1292632 - RNA, 14 nt, Mycobacterium tuberculosis H37Rv
gcccgccgacgcca

SEQ ID NO: 1292633 - RNA, 23 nt, Mycobacterium tuberculosis H37Rv
gcccgcgaacgaucccgccgauc

SEQ ID NO: 1292634 - RNA, 17 nt, Mycobacterium tuberculosis H37Rv
gcccgccgacgccagau

SEQ ID NO: 1292635 - RNA, 23 nt, Mycobacterium tuberculosis H37Rv
gcccgcugcgcggcccgcaucgu

SEQ ID NO: 1292636 - RNA, 20 nt, Mycobacterium tuberculosis H37Rv
gcccgcugagccagcuccac

SEQ ID NO: 1292637 - RNA, 23 nt, Mycobacterium tuberculosis H37Rv
gcccggaauguaguccagcucgc

SEQ ID NO: 1292638 - RNA, 18 nt, Mycobacterium tuberculosis H37Rv
gcccgcucagccguccgg

SEQ ID NO: 1292639 - RNA, 23 nt, Mycobacterium tuberculosis H37Rv
gcccgcucaacgggccgcaucgu

SEQ ID NO: 1292640 - RNA, 22 nt, Mycobacterium tuberculosis H37Rv
gcccgcucgggguugcucgcga

SEQ ID NO: 1292641 - RNA, 14 nt, Mycobacterium tuberculosis H37Rv
gcccgcucggccgc

SEQ ID NO: 1292642 - RNA, 13 nt, Mycobacterium tuberculosis H37Rv
gcccgcucgaugu

SEQ ID NO: 1292643 - RNA, 15 nt, Mycobacterium tuberculosis H37Rv
gcccgcucgaucggc

SEQ ID NO: 1292644 - RNA, 22 nt, Mycobacterium tuberculosis H37Rv
gcccggcaaugaucaucccggc

SEQ ID NO: 1292645 - RNA, 14 nt, Mycobacterium tuberculosis H37Rv
gcccggcaaugauc

SEQ ID NO: 1292646 - RNA, 18 nt, Mycobacterium tuberculosis H37Rv
gcccggauguccgccgac

SEQ ID NO: 1292647 - RNA, 13 nt, Mycobacterium tuberculosis H37Rv
gcccggauuggcg

SEQ ID NO: 1292648 - RNA, 10 nt, Mycobacterium tuberculosis H37Rv
gcccggaucu

SEQ ID NO: 1292649 - RNA, 22 nt, Mycobacterium tuberculosis H37Rv
gcccggacgauggcgucggcca

SEQ ID NO: 1292650 - RNA, 15 nt, Mycobacterium tuberculosis H37Rv
gcccggacugaucgu

SEQ ID NO: 1292651 - RNA, 15 nt, Mycobacterium tuberculosis H37Rv
gcccggagcggucag

SEQ ID NO: 1292652 - RNA, 12 nt, Mycobacterium tuberculosis H37Rv
gcccggcaucgc

SEQ ID NO: 1292653 - RNA, 16 nt, Mycobacterium tuberculosis H37Rv
gcccggcaggacuugg

SEQ ID NO: 1292654 - RNA, 13 nt, Mycobacterium tuberculosis H37Rv
gcccggcaccgcg

SEQ ID NO: 1292655 - RNA, 17 nt, Mycobacterium tuberculosis H37Rv
gcccggcacacggccuu

SEQ ID NO: 1292656 - RNA, 20 nt, Mycobacterium tuberculosis H37Rv
gcccgggugacccgugcggc

SEQ ID NO: 1292657 - RNA, 19 nt, Mycobacterium tuberculosis H37Rv
gcccgggguguucgucgac

SEQ ID NO: 1292658 - RNA, 18 nt, Mycobacterium tuberculosis H37Rv
gcccggggcgcucgugau

SEQ ID NO: 1292659 - RNA, 13 nt, Mycobacterium tuberculosis H37Rv
gcccgggcggcca

SEQ ID NO: 1292660 - RNA, 15 nt, Mycobacterium tuberculosis H37Rv
gcccgggcggccagc

SEQ ID NO: 1292661 - RNA, 16 nt, Mycobacterium tuberculosis H37Rv
gcccgggcggccagcu

SEQ ID NO: 1292662 - RNA, 21 nt, Mycobacterium tuberculosis H37Rv
gcccgggcggcgucggugagc

SEQ ID NO: 1292663 - RNA, 16 nt, Mycobacterium tuberculosis H37Rv
gcccgggcgggaucca

SEQ ID NO: 1292664 - RNA, 15 nt, Mycobacterium tuberculosis H37Rv
gcccgggcgucaagc

SEQ ID NO: 1292665 - RNA, 20 nt, Mycobacterium tuberculosis H37Rv
gcccgggcggaacgccggca

SEQ ID NO: 1292666 - RNA, 18 nt, Mycobacterium tuberculosis H37Rv
gcccgggcagcaccagcg

SEQ ID NO: 1292667 - RNA, 22 nt, Mycobacterium tuberculosis H37Rv
gcccgggcauccuucaccagcu

SEQ ID NO: 1292668 - RNA, 19 nt, Mycobacterium tuberculosis H37Rv
gcccgggccaccggaaucc

SEQ ID NO: 1292669 - RNA, 22 nt, Mycobacterium tuberculosis H37Rv
gcccgggcccgcgggaucagcg

SEQ ID NO: 1292670 - RNA, 19 nt, Mycobacterium tuberculosis H37Rv
gcccgggaucgggucaccg

SEQ ID NO: 1292671 - RNA, 13 nt, Mycobacterium tuberculosis H37Rv
gcccgggauaccg

SEQ ID NO: 1292672 - RNA, 21 nt, Mycobacterium tuberculosis H37Rv
gcccggcuuuugcgcccagca

SEQ ID NO: 1292673 - RNA, 16 nt, Mycobacterium tuberculosis H37Rv
gcccgggacaaguucg

SEQ ID NO: 1292674 - RNA, 22 nt, Mycobacterium tuberculosis H37Rv
gcccguccugcggguaggugac

SEQ ID NO: 1292675 - RNA, 20 nt, Mycobacterium tuberculosis H37Rv
gcccgucgcgucgaccggac

SEQ ID NO: 1292676 - RNA, 19 nt, Mycobacterium tuberculosis H37Rv
gcccggguggcccggaaca

SEQ ID NO: 1292677 - RNA, 14 nt, Mycobacterium tuberculosis H37Rv
gcccggcgaucagc

SEQ ID NO: 1292678 - RNA, 18 nt, Mycobacterium tuberculosis H37Rv
gcccggcgcaagcgccgc

SEQ ID NO: 1292679 - RNA, 16 nt, Mycobacterium tuberculosis H37Rv
gcccggcgcaagcgcc

SEQ ID NO: 1292680 - RNA, 15 nt, Mycobacterium tuberculosis H37Rv
gcccggccuugccgc

SEQ ID NO: 1292681 - RNA, 14 nt, Mycobacterium tuberculosis H37Rv
gcccggcgacgacc

SEQ ID NO: 1292682 - RNA, 14 nt, Mycobacterium tuberculosis H37Rv
gcccggccggucga

SEQ ID NO: 1292683 - RNA, 15 nt, Mycobacterium tuberculosis H37Rv
gcccggccgccagcg

SEQ ID NO: 1292684 - RNA, 16 nt, Mycobacterium tuberculosis H37Rv
gcccggccgccagcgc

SEQ ID NO: 1292685 - RNA, 18 nt, Mycobacterium tuberculosis H37Rv
gcccggccgccagcgcgc

SEQ ID NO: 1292686 - RNA, 17 nt, Mycobacterium tuberculosis H37Rv
gcccggcccgcucagcc

SEQ ID NO: 1292687 - RNA, 15 nt, Mycobacterium tuberculosis H37Rv
gcccggccgaacgcc

SEQ ID NO: 1292688 - RNA, 16 nt, Mycobacterium tuberculosis H37Rv
gcccggcccgcucagc

SEQ ID NO: 1292689 - RNA, 16 nt, Mycobacterium tuberculosis H37Rv
gcccggccaggucgac

SEQ ID NO: 1292690 - RNA, 15 nt, Mycobacterium tuberculosis H37Rv
gcccggccagcucgg

SEQ ID NO: 1292691 - RNA, 17 nt, Mycobacterium tuberculosis H37Rv
gcccggcucucagcgac

SEQ ID NO: 1292692 - RNA, 17 nt, Mycobacterium tuberculosis H37Rv
gcccggcuaacuggacu

SEQ ID NO: 1292693 - RNA, 21 nt, Mycobacterium tuberculosis H37Rv
gcccggcguggugagccucgg

SEQ ID NO: 1292694 - RNA, 17 nt, Mycobacterium tuberculosis H37Rv
gcccggcuacgacggcg

SEQ ID NO: 1292695 - RNA, 19 nt, Mycobacterium tuberculosis H37Rv
gcccggcucacagcacagc

SEQ ID NO: 1292696 - RNA, 21 nt, Mycobacterium tuberculosis H37Rv
gcccggcggccagcuccagcg

SEQ ID NO: 1292697 - RNA, 15 nt, Mycobacterium tuberculosis H37Rv
gcccggcggaucccg

SEQ ID NO: 1292698 - RNA, 18 nt, Mycobacterium tuberculosis H37Rv
gcccggcgcuagcgccgc

SEQ ID NO: 1292699 - RNA, 16 nt, Mycobacterium tuberculosis H37Rv
gcccggcgcgaagucg

SEQ ID NO: 1292700 - RNA, 20 nt, Mycobacterium tuberculosis H37Rv
gccccugucaacgccgcggu

SEQ ID NO: 1292701 - RNA, 18 nt, Mycobacterium tuberculosis H37Rv
gcccgaaccaccgcguug

SEQ ID NO: 1292702 - RNA, 23 nt, Mycobacterium tuberculosis H37Rv
gccccucaccucggcuuugccgc

SEQ ID NO: 1292703 - RNA, 16 nt, Mycobacterium tuberculosis H37Rv
gccccuccgcgccgau

SEQ ID NO: 1292704 - RNA, 23 nt, Mycobacterium tuberculosis H37Rv
gccccugucauguccugggccgc

SEQ ID NO: 1292705 - RNA, 17 nt, Mycobacterium tuberculosis H37Rv
gccccguuucggucgac

SEQ ID NO: 1292706 - RNA, 18 nt, Mycobacterium tuberculosis H37Rv
gccccguuucggucgaca

SEQ ID NO: 1292707 - RNA, 20 nt, Mycobacterium tuberculosis H37Rv
gccccguuucggucgacaac

SEQ ID NO: 1292708 - RNA, 23 nt, Mycobacterium tuberculosis H37Rv
gccccguuggucagcguggacgc

SEQ ID NO: 1292709 - RNA, 20 nt, Mycobacterium tuberculosis H37Rv
gccccguugugucaccggcg

SEQ ID NO: 1292710 - RNA, 20 nt, Mycobacterium tuberculosis H37Rv
gccccggggguccaccuugg

SEQ ID NO: 1292711 - RNA, 15 nt, Mycobacterium tuberculosis H37Rv
gccccggccgcguca

SEQ ID NO: 1292712 - RNA, 12 nt, Mycobacterium tuberculosis H37Rv
gccccgcucggu

SEQ ID NO: 1292713 - RNA, 17 nt, Mycobacterium tuberculosis H37Rv
gccccgcgcguucggcg

SEQ ID NO: 1292714 - RNA, 16 nt, Mycobacterium tuberculosis H37Rv
gccccgaaacgauggc

SEQ ID NO: 1292715 - RNA, 14 nt, Mycobacterium tuberculosis H37Rv
gccccgaccagcag

SEQ ID NO: 1292716 - RNA, 22 nt, Mycobacterium tuberculosis H37Rv
gccccgaauguugcgaucugcg

SEQ ID NO: 1292717 - RNA, 23 nt, Mycobacterium tuberculosis H37Rv
gccccgaagccggugccggcguu

SEQ ID NO: 1292718 - RNA, 23 nt, Mycobacterium tuberculosis H37Rv
gcccccguuaccgccgucgccga

SEQ ID NO: 1292719 - RNA, 15 nt, Mycobacterium tuberculosis H37Rv
gcccccggugucugc

SEQ ID NO: 1292720 - RNA, 21 nt, Mycobacterium tuberculosis H37Rv
gcccccguagauggugguggc

SEQ ID NO: 1292721 - RNA, 17 nt, Mycobacterium tuberculosis H37Rv
gcccccuaaaccggcag

SEQ ID NO: 1292722 - RNA, 18 nt, Mycobacterium tuberculosis H37Rv
gccccgccgcgacgggca

SEQ ID NO: 1292723 - RNA, 21 nt, Mycobacterium tuberculosis H37Rv
gccccgccggccccgccguca

SEQ ID NO: 1292724 - RNA, 15 nt, Mycobacterium tuberculosis H37Rv
gcccgcagcagcauc

SEQ ID NO: 1292725 - RNA, 17 nt, Mycobacterium tuberculosis H37Rv
gcccgcagcagcaucgg

SEQ ID NO: 1292726 - RNA, 15 nt, Mycobacterium tuberculosis H37Rv
gcccgcacgaucucg

SEQ ID NO: 1292727 - RNA, 13 nt, Mycobacterium tuberculosis H37Rv
gcccgcacgacga

SEQ ID NO: 1292728 - RNA, 12 nt, Mycobacterium tuberculosis H37Rv
gcccgcaccgcg

SEQ ID NO: 1292729 - RNA, 20 nt, Mycobacterium tuberculosis H37Rv
gcccgcacccaugaucccgc

SEQ ID NO: 1292730 - RNA, 23 nt, Mycobacterium tuberculosis H37Rv
gcccgcacccccgacaccgccga

SEQ ID NO: 1292731 - RNA, 19 nt, Mycobacterium tuberculosis H37Rv
gcccgaugcgccaccggcg

SEQ ID NO: 1292732 - RNA, 15 nt, Mycobacterium tuberculosis H37Rv
gcccgaugcgccagc

SEQ ID NO: 1292733 - RNA, 22 nt, Mycobacterium tuberculosis H37Rv
gcccgccacguacuuggacgac

SEQ ID NO: 1292734 - RNA, 16 nt, Mycobacterium tuberculosis H37Rv
gcccgccagaacggcg

SEQ ID NO: 1292735 - RNA, 22 nt, Mycobacterium tuberculosis H37Rv
gcccgccagaacggcgucgaau

SEQ ID NO: 1292736 - RNA, 16 nt, Mycobacterium tuberculosis H37Rv
gcccgccccgcgccuu

SEQ ID NO: 1292737 - RNA, 17 nt, Mycobacterium tuberculosis H37Rv
gcccgccacgcucgguu

SEQ ID NO: 1292738 - RNA, 22 nt, Mycobacterium tuberculosis H37Rv
gcccgccacgaugucgucgaug

SEQ ID NO: 1292739 - RNA, 16 nt, Mycobacterium tuberculosis H37Rv
gcccgccacccuuggc

SEQ ID NO: 1292740 - RNA, 15 nt, Mycobacterium tuberculosis H37Rv
gcccgccaauccgcg

SEQ ID NO: 1292741 - RNA, 15 nt, Mycobacterium tuberculosis H37Rv
gcccgaugaucccgc

SEQ ID NO: 1292742 - RNA, 21 nt, Mycobacterium tuberculosis H37Rv
gcccgaucguaggacucggcg

SEQ ID NO: 1292743 - RNA, 22 nt, Mycobacterium tuberculosis H37Rv
gcccgaucggccagggugucca

SEQ ID NO: 1292744 - RNA, 17 nt, Mycobacterium tuberculosis H37Rv
gcccgaggcgagacgcu

SEQ ID NO: 1292745 - RNA, 13 nt, Mycobacterium tuberculosis H37Rv
gcccgagccggug

SEQ ID NO: 1292746 - RNA, 15 nt, Mycobacterium tuberculosis H37Rv
gcccgagccggugcc

SEQ ID NO: 1292747 - RNA, 15 nt, Mycobacterium tuberculosis H37Rv
gcccgacccgccgau

SEQ ID NO: 1292748 - RNA, 13 nt, Mycobacterium tuberculosis H37Rv
gcccgagccgcug

SEQ ID NO: 1292749 - RNA, 20 nt, Mycobacterium tuberculosis H37Rv
gcccgacaccguccagcagc

SEQ ID NO: 1292750 - RNA, 12 nt, Mycobacterium tuberculosis H37Rv
gcccgacccgcc

SEQ ID NO: 1292751 - RNA, 20 nt, Mycobacterium tuberculosis H37Rv
gcccgacccaucaccagcgg

SEQ ID NO: 1292752 - RNA, 14 nt, Mycobacterium tuberculosis H37Rv
gcccgaaugcggug

SEQ ID NO: 1292753 - RNA, 21 nt, Mycobacterium tuberculosis H37Rv
gcccgaagagcacgucaacag

SEQ ID NO: 1292754 - RNA, 13 nt, Mycobacterium tuberculosis H37Rv
gcccgaagccggg

SEQ ID NO: 1292755 - RNA, 20 nt, Mycobacterium tuberculosis H37Rv
gcccgaacucguuggcgaac

SEQ ID NO: 1292756 - RNA, 20 nt, Mycobacterium tuberculosis H37Rv
gcccgaacgaggcgcccagc

SEQ ID NO: 1292757 - RNA, 22 nt, Mycobacterium tuberculosis H37Rv
gcccaccacgaacacguucggg

SEQ ID NO: 1292758 - RNA, 16 nt, Mycobacterium tuberculosis H37Rv
gcccagcgccgaauuc

SEQ ID NO: 1292759 - RNA, 19 nt, Mycobacterium tuberculosis H37Rv
gcccagcgcccccagcagc

SEQ ID NO: 1292760 - RNA, 15 nt, Mycobacterium tuberculosis H37Rv
gcccagcgcgccagc

SEQ ID NO: 1292761 - RNA, 16 nt, Mycobacterium tuberculosis H37Rv
gcccagcgccuccagc

SEQ ID NO: 1292762 - RNA, 16 nt, Mycobacterium tuberculosis H37Rv
gcccagcggccgcgau

SEQ ID NO: 1292763 - RNA, 17 nt, Mycobacterium tuberculosis H37Rv
gcccagcggaaucaccg

SEQ ID NO: 1292764 - RNA, 18 nt, Mycobacterium tuberculosis H37Rv
gcccagggcgucggcgac

SEQ ID NO: 1292765 - RNA, 20 nt, Mycobacterium tuberculosis H37Rv
gcccagugggacuggcguga

SEQ ID NO: 1292766 - RNA, 16 nt, Mycobacterium tuberculosis H37Rv
gcccaguagaucgcga

SEQ ID NO: 1292767 - RNA, 21 nt, Mycobacterium tuberculosis H37Rv
gcccaguguccggcgacgcgu

SEQ ID NO: 1292768 - RNA, 14 nt, Mycobacterium tuberculosis H37Rv
gcccaugucgagca

SEQ ID NO: 1292769 - RNA, 15 nt, Mycobacterium tuberculosis H37Rv
gcccaugucgagcac

SEQ ID NO: 1292770 - RNA, 22 nt, Mycobacterium tuberculosis H37Rv
gccccaagcgccugagcggccu

SEQ ID NO: 1292771 - RNA, 21 nt, Mycobacterium tuberculosis H37Rv
gccccacaaggguuggccgau

SEQ ID NO: 1292772 - RNA, 18 nt, Mycobacterium tuberculosis H37Rv
gccccaccgaacgugugg

SEQ ID NO: 1292773 - RNA, 16 nt, Mycobacterium tuberculosis H37Rv
gccccaccgagcggug

SEQ ID NO: 1292774 - RNA, 16 nt, Mycobacterium tuberculosis H37Rv
gccccacccgagcacu

SEQ ID NO: 1292775 - RNA, 16 nt, Mycobacterium tuberculosis H37Rv
gccccagcgacgucgc

SEQ ID NO: 1292776 - RNA, 14 nt, Mycobacterium tuberculosis H37Rv
gccccaugcaacac

SEQ ID NO: 1292777 - RNA, 16 nt, Mycobacterium tuberculosis H37Rv
gccccaggacaccuug

SEQ ID NO: 1292778 - RNA, 20 nt, Mycobacterium tuberculosis H37Rv
gcccccaaucagugcagcgu

SEQ ID NO: 1292779 - RNA, 20 nt, Mycobacterium tuberculosis H37Rv
gccccccgagcuguggucac

SEQ ID NO: 1292780 - RNA, 21 nt, Mycobacterium tuberculosis H37Rv
gccccccgagcccgccagcgc

SEQ ID NO: 1292781 - RNA, 22 nt, Mycobacterium tuberculosis H37Rv
gccccccggcgacggcguagcc

SEQ ID NO: 1292782 - RNA, 14 nt, Mycobacterium tuberculosis H37Rv
gcccccggcagcgu

SEQ ID NO: 1292783 - RNA, 14 nt, Mycobacterium tuberculosis H37Rv
gcccccggugccgc

SEQ ID NO: 1292784 - RNA, 20 nt, Mycobacterium tuberculosis H37Rv
gcccccgguaccgcccgcac

SEQ ID NO: 1292785 - RNA, 21 nt, Mycobacterium tuberculosis H37Rv
cuggugcguagcccacccggg

SEQ ID NO: 1292786 - RNA, 14 nt, Mycobacterium tuberculosis H37Rv
cugguggaccuccg

SEQ ID NO: 1292787 - RNA, 18 nt, Mycobacterium tuberculosis H37Rv
cuggugggccaucgucag

SEQ ID NO: 1292788 - RNA, 22 nt, Mycobacterium tuberculosis H37Rv
cugguguaccagacgaacgacc

SEQ ID NO: 1292789 - RNA, 14 nt, Mycobacterium tuberculosis H37Rv
cuggugauucgcag

SEQ ID NO: 1292790 - RNA, 20 nt, Mycobacterium tuberculosis H37Rv
cuggugaucugguccggcaa

SEQ ID NO: 1292791 - RNA, 22 nt, Mycobacterium tuberculosis H37Rv
cuggugccaacugcgccguucg

SEQ ID NO: 1292792 - RNA, 21 nt, Mycobacterium tuberculosis H37Rv
cugguagcacccacggcgaga

SEQ ID NO: 1292793 - RNA, 13 nt, Mycobacterium tuberculosis H37Rv
cuggucgagcacg

SEQ ID NO: 1292794 - RNA, 22 nt, Mycobacterium tuberculosis H37Rv
cuggucgagcacgcugcugcgg

SEQ ID NO: 1292795 - RNA, 17 nt, Mycobacterium tuberculosis H37Rv
cuggucgccguacagcg

SEQ ID NO: 1292796 - RNA, 22 nt, Mycobacterium tuberculosis H37Rv
cuggucgcguaccaacaggaug

SEQ ID NO: 1292797 - RNA, 15 nt, Mycobacterium tuberculosis H37Rv
cuggucgcuggugca

SEQ ID NO: 1292798 - RNA, 24 nt, Mycobacterium tuberculosis H37Rv
cuggucggccaggucgagcaccgg

SEQ ID NO: 1292799 - RNA, 14 nt, Mycobacterium tuberculosis H37Rv
cuggucgugccgcc

SEQ ID NO: 1292800 - RNA, 22 nt, Mycobacterium tuberculosis H37Rv
cuggucucccagaggucgagcg

SEQ ID NO: 1292801 - RNA, 17 nt, Mycobacterium tuberculosis H37Rv
cuggucgugggccacca

SEQ ID NO: 1292802 - RNA, 14 nt, Mycobacterium tuberculosis H37Rv
cuggcuugugccca

SEQ ID NO: 1292803 - RNA, 22 nt, Mycobacterium tuberculosis H37Rv
cuggcuguggcugaacaccgcg

SEQ ID NO: 1292804 - RNA, 21 nt, Mycobacterium tuberculosis H37Rv
cugggauguucgaucagcgac

SEQ ID NO: 1292805 - RNA, 19 nt, Mycobacterium tuberculosis H37Rv
cugggagggaccacccggu

SEQ ID NO: 1292806 - RNA, 15 nt, Mycobacterium tuberculosis H37Rv
cugggcaagaccgcg

SEQ ID NO: 1292807 - RNA, 14 nt, Mycobacterium tuberculosis H37Rv
cugggcaucaccgc

SEQ ID NO: 1292808 - RNA, 14 nt, Mycobacterium tuberculosis H37Rv
cugggcagaccgau

SEQ ID NO: 1292809 - RNA, 15 nt, Mycobacterium tuberculosis H37Rv
cuggcgcgccaccgu

SEQ ID NO: 1292810 - RNA, 19 nt, Mycobacterium tuberculosis H37Rv
cuggcggguaagcgaccga

SEQ ID NO: 1292811 - RNA, 20 nt, Mycobacterium tuberculosis H37Rv
cuggcgggcacucagcaggg

SEQ ID NO: 1292812 - RNA, 20 nt, Mycobacterium tuberculosis H37Rv
cuggcgggcgaucucggcga

SEQ ID NO: 1292813 - RNA, 13 nt, Mycobacterium tuberculosis H37Rv
cuggcggucccgc

SEQ ID NO: 1292814 - RNA, 17 nt, Mycobacterium tuberculosis H37Rv
cuggcggguggcgauga

SEQ ID NO: 1292815 - RNA, 17 nt, Mycobacterium tuberculosis H37Rv
cuggcgguaucgaaagc

SEQ ID NO: 1292816 - RNA, 13 nt, Mycobacterium tuberculosis H37Rv
cuggguggcgucg

SEQ ID NO: 1292817 - RNA, 19 nt, Mycobacterium tuberculosis H37Rv
cugggugccggcagcggcg

SEQ ID NO: 1292818 - RNA, 13 nt, Mycobacterium tuberculosis H37Rv
cugggugccggug

SEQ ID NO: 1292819 - RNA, 18 nt, Mycobacterium tuberculosis H37Rv
cuggggaacagcagcgca

SEQ ID NO: 1292820 - RNA, 20 nt, Mycobacterium tuberculosis H37Rv
cugggcugccuugauugccg

SEQ ID NO: 1292821 - RNA, 12 nt, Mycobacterium tuberculosis H37Rv
cugggcucgguc

SEQ ID NO: 1292822 - RNA, 17 nt, Mycobacterium tuberculosis H37Rv
cugggcuuugcagcguu

SEQ ID NO: 1292823 - RNA, 23 nt, Mycobacterium tuberculosis H37Rv
cugggcuuucugcacccgccagg

SEQ ID NO: 1292824 - RNA, 19 nt, Mycobacterium tuberculosis H37Rv
cugggcuuucagcaccgga

SEQ ID NO: 1292825 - RNA, 19 nt, Mycobacterium tuberculosis H37Rv
cugggcggcuacccauggc

SEQ ID NO: 1292826 - RNA, 23 nt, Mycobacterium tuberculosis H37Rv
cugggcccgaaucgccugccaca

SEQ ID NO: 1292827 - RNA, 14 nt, Mycobacterium tuberculosis H37Rv
cugggcccgccagc

SEQ ID NO: 1292828 - RNA, 15 nt, Mycobacterium tuberculosis H37Rv
cugggccagccgcuc

SEQ ID NO: 1292829 - RNA, 19 nt, Mycobacterium tuberculosis H37Rv
cugggcacggagaccgugg

SEQ ID NO: 1292830 - RNA, 21 nt, Mycobacterium tuberculosis H37Rv
cuggccgaauaacagcaggca

SEQ ID NO: 1292831 - RNA, 14 nt, Mycobacterium tuberculosis H37Rv
cuggcccgcaugcc

SEQ ID NO: 1292832 - RNA, 21 nt, Mycobacterium tuberculosis H37Rv
cuggcccgcacgaaccggucg

SEQ ID NO: 1292833 - RNA, 12 nt, Mycobacterium tuberculosis H37Rv
cuggccagcaca

SEQ ID NO: 1292834 - RNA, 13 nt, Mycobacterium tuberculosis H37Rv
cuggccugcccca

SEQ ID NO: 1292835 - RNA, 23 nt, Mycobacterium tuberculosis H37Rv
cuggccuuugagcgcggccacca

SEQ ID NO: 1292836 - RNA, 23 nt, Mycobacterium tuberculosis H37Rv
cuggcgaaugucgcucaaacccg

SEQ ID NO: 1292837 - RNA, 19 nt, Mycobacterium tuberculosis H37Rv
cuggcgacaucucggucag

SEQ ID NO: 1292838 - RNA, 16 nt, Mycobacterium tuberculosis H37Rv
cuggcgacgacgacac

SEQ ID NO: 1292839 - RNA, 18 nt, Mycobacterium tuberculosis H37Rv
cuggcgacguauuucgcc

SEQ ID NO: 1292840 - RNA, 23 nt, Mycobacterium tuberculosis H37Rv
cuggcgacucgugucugccucgg

SEQ ID NO: 1292841 - RNA, 17 nt, Mycobacterium tuberculosis H37Rv
cuggcgaugacgaucgc

SEQ ID NO: 1292842 - RNA, 17 nt, Mycobacterium tuberculosis H37Rv
cuggcgcccccgccauu

SEQ ID NO: 1292843 - RNA, 21 nt, Mycobacterium tuberculosis H37Rv
cuggcgccggugccgccgggu

SEQ ID NO: 1292844 - RNA, 21 nt, Mycobacterium tuberculosis H37Rv
cuggcgccgccggugccaccg

SEQ ID NO: 1292845 - RNA, 21 nt, Mycobacterium tuberculosis H37Rv
cuggcgccgaaguagccgacc

SEQ ID NO: 1292846 - RNA, 17 nt, Mycobacterium tuberculosis H37Rv
cuggaguucgucaccgu

SEQ ID NO: 1292847 - RNA, 13 nt, Mycobacterium tuberculosis H37Rv
cuggaucagcguc

SEQ ID NO: 1292848 - RNA, 18 nt, Mycobacterium tuberculosis H37Rv
cuggaucagcgucggugg

SEQ ID NO: 1292849 - RNA, 21 nt, Mycobacterium tuberculosis H37Rv
cuggacugcagcccugcgcag

SEQ ID NO: 1292850 - RNA, 13 nt, Mycobacterium tuberculosis H37Rv
cuggagaucacgc

SEQ ID NO: 1292851 - RNA, 21 nt, Mycobacterium tuberculosis H37Rv
cuggaggugaacucguucagc

SEQ ID NO: 1292852 - RNA, 22 nt, Mycobacterium tuberculosis H37Rv
cugcgagaggugcugcaccugg

SEQ ID NO: 1292853 - RNA, 16 nt, Mycobacterium tuberculosis H37Rv
cuggacggcgccgguu

SEQ ID NO: 1292854 - RNA, 19 nt, Mycobacterium tuberculosis H37Rv
cuggaucgucucgcgcacc

SEQ ID NO: 1292855 - RNA, 15 nt, Mycobacterium tuberculosis H37Rv
cuggaucuucgacag

SEQ ID NO: 1292856 - RNA, 15 nt, Mycobacterium tuberculosis H37Rv
cuggcagcggccucc

SEQ ID NO: 1292857 - RNA, 20 nt, Mycobacterium tuberculosis H37Rv
cuggccacuuucagaucgau

SEQ ID NO: 1292858 - RNA, 13 nt, Mycobacterium tuberculosis H37Rv
cuggccacccaga

SEQ ID NO: 1292859 - RNA, 13 nt, Mycobacterium tuberculosis H37Rv
cuguucgccgacg

SEQ ID NO: 1292860 - RNA, 17 nt, Mycobacterium tuberculosis H37Rv
cugugccuucgccucgu

SEQ ID NO: 1292861 - RNA, 21 nt, Mycobacterium tuberculosis H37Rv
cugugcccucaacgucccagc

SEQ ID NO: 1292862 - RNA, 16 nt, Mycobacterium tuberculosis H37Rv
cuguucuccgugaucg

SEQ ID NO: 1292863 - RNA, 18 nt, Mycobacterium tuberculosis H37Rv
cuguugacgccacgacgc

SEQ ID NO: 1292864 - RNA, 13 nt, Mycobacterium tuberculosis H37Rv
cuguugaagccgc

SEQ ID NO: 1292865 - RNA, 17 nt, Mycobacterium tuberculosis H37Rv
cuguuuggggcugugca

SEQ ID NO: 1292866 - RNA, 15 nt, Mycobacterium tuberculosis H37Rv
cuguugccaucgacg

SEQ ID NO: 1292867 - RNA, 13 nt, Mycobacterium tuberculosis H37Rv
cugucgcaccaga

SEQ ID NO: 1292868 - RNA, 17 nt, Mycobacterium tuberculosis H37Rv
cuguccgaaccgacguu

SEQ ID NO: 1292869 - RNA, 19 nt, Mycobacterium tuberculosis H37Rv
cuguccgacuucuccaggc

SEQ ID NO: 1292870 - RNA, 12 nt, Mycobacterium tuberculosis H37Rv
cuguagcgaaug

SEQ ID NO: 1292871 - RNA, 19 nt, Mycobacterium tuberculosis H37Rv
cuguagagggugucgcccu

SEQ ID NO: 1292872 - RNA, 13 nt, Mycobacterium tuberculosis H37Rv
cuguaggcgauca

SEQ ID NO: 1292873 - RNA, 14 nt, Mycobacterium tuberculosis H37Rv
cuguccaccgaugc

SEQ ID NO: 1292874 - RNA, 15 nt, Mycobacterium tuberculosis H37Rv
cugguugggccagcu

SEQ ID NO: 1292875 - RNA, 20 nt, Mycobacterium tuberculosis H37Rv
cugguugucgaucucggcca

SEQ ID NO: 1292876 - RNA, 15 nt, Mycobacterium tuberculosis H37Rv
cugguuucggccgca

SEQ ID NO: 1292877 - RNA, 19 nt, Mycobacterium tuberculosis H37Rv
cugguguugaucgucgggu

SEQ ID NO: 1292878 - RNA, 17 nt, Mycobacterium tuberculosis H37Rv
cuggugugacgaucccc

SEQ ID NO: 1292879 - RNA, 20 nt, Mycobacterium tuberculosis H37Rv
cuguacaacgacacgccgca

SEQ ID NO: 1292880 - RNA, 22 nt, Mycobacterium tuberculosis H37Rv
cuucgcuauggcggcuucgacg

SEQ ID NO: 1292881 - RNA, 21 nt, Mycobacterium tuberculosis H37Rv
cuucgcgguuggcggcgaugg

SEQ ID NO: 1292882 - RNA, 21 nt, Mycobacterium tuberculosis H37Rv
cuucgcguuggcccgccugac

SEQ ID NO: 1292883 - RNA, 22 nt, Mycobacterium tuberculosis H37Rv
cuucgcgucggcgaacagacgc

SEQ ID NO: 1292884 - RNA, 17 nt, Mycobacterium tuberculosis H37Rv
cuucgcggcggucguug

SEQ ID NO: 1292885 - RNA, 13 nt, Mycobacterium tuberculosis H37Rv
cuucgcgcgcugg

SEQ ID NO: 1292886 - RNA, 16 nt, Mycobacterium tuberculosis H37Rv
cuucgcgaagaacgac

SEQ ID NO: 1292887 - RNA, 15 nt, Mycobacterium tuberculosis H37Rv
cuucggcagaccggc

SEQ ID NO: 1292888 - RNA, 18 nt, Mycobacterium tuberculosis H37Rv
cuucggacagcagccggc

SEQ ID NO: 1292889 - RNA, 20 nt, Mycobacterium tuberculosis H37Rv
cuucgcugguauagcucacg

SEQ ID NO: 1292890 - RNA, 17 nt, Mycobacterium tuberculosis H37Rv
cuucggcgacaggccga

SEQ ID NO: 1292891 - RNA, 14 nt, Mycobacterium tuberculosis H37Rv
cuucggcgacaggc

SEQ ID NO: 1292892 - RNA, 18 nt, Mycobacterium tuberculosis H37Rv
cuuccauuucggaacgcc

SEQ ID NO: 1292893 - RNA, 14 nt, Mycobacterium tuberculosis H37Rv
cuuccauuuucgcc

SEQ ID NO: 1292894 - RNA, 21 nt, Mycobacterium tuberculosis H37Rv
cuuccucguaggcguacacca

SEQ ID NO: 1292895 - RNA, 13 nt, Mycobacterium tuberculosis H37Rv
cuuccucggccac

SEQ ID NO: 1292896 - RNA, 15 nt, Mycobacterium tuberculosis H37Rv
cuuccuggucgacgc

SEQ ID NO: 1292897 - RNA, 18 nt, Mycobacterium tuberculosis H37Rv
cuucgaguuuggcgacga

SEQ ID NO: 1292898 - RNA, 22 nt, Mycobacterium tuberculosis H37Rv
cuucgaucaucgaccuggccac

SEQ ID NO: 1292899 - RNA, 15 nt, Mycobacterium tuberculosis H37Rv
cuuccaggagcgccg

SEQ ID NO: 1292900 - RNA, 14 nt, Mycobacterium tuberculosis H37Rv
cuucaucggcgaua

SEQ ID NO: 1292901 - RNA, 17 nt, Mycobacterium tuberculosis H37Rv
cuucaucgccucgagga

SEQ ID NO: 1292902 - RNA, 18 nt, Mycobacterium tuberculosis H37Rv
cuucaggcccucgggacu

SEQ ID NO: 1292903 - RNA, 14 nt, Mycobacterium tuberculosis H37Rv
cuucagguccaccg

SEQ ID NO: 1292904 - RNA, 18 nt, Mycobacterium tuberculosis H37Rv
cuucagcaugguggacga

SEQ ID NO: 1292905 - RNA, 17 nt, Mycobacterium tuberculosis H37Rv
cuucaccucgucgacaa

SEQ ID NO: 1292906 - RNA, 17 nt, Mycobacterium tuberculosis H37Rv
cuucacgggccguccag

SEQ ID NO: 1292907 - RNA, 20 nt, Mycobacterium tuberculosis H37Rv
cuugcgccggaugacaccga

SEQ ID NO: 1292908 - RNA, 15 nt, Mycobacterium tuberculosis H37Rv
cuugcgauugcgcac

SEQ ID NO: 1292909 - RNA, 18 nt, Mycobacterium tuberculosis H37Rv
cuugcgcaucgccgacag

SEQ ID NO: 1292910 - RNA, 19 nt, Mycobacterium tuberculosis H37Rv
cuugcggcacccagucggc

SEQ ID NO: 1292911 - RNA, 13 nt, Mycobacterium tuberculosis H37Rv
cuugcggcaccca

SEQ ID NO: 1292912 - RNA, 14 nt, Mycobacterium tuberculosis H37Rv
cuugcggaccuggc

SEQ ID NO: 1292913 - RNA, 14 nt, Mycobacterium tuberculosis H37Rv
cuugcucagccggc

SEQ ID NO: 1292914 - RNA, 14 nt, Mycobacterium tuberculosis H37Rv
cuugcuccacaucg

SEQ ID NO: 1292915 - RNA, 22 nt, Mycobacterium tuberculosis H37Rv
cuugcugcacgcucugcgccac

SEQ ID NO: 1292916 - RNA, 19 nt, Mycobacterium tuberculosis H37Rv
cuugcugcuccuucucgcg

SEQ ID NO: 1292917 - RNA, 15 nt, Mycobacterium tuberculosis H37Rv
cuucgucggccagca

SEQ ID NO: 1292918 - RNA, 15 nt, Mycobacterium tuberculosis H37Rv
cuucgucggccggca

SEQ ID NO: 1292919 - RNA, 15 nt, Mycobacterium tuberculosis H37Rv
cuucguaaccacgac

SEQ ID NO: 1292920 - RNA, 17 nt, Mycobacterium tuberculosis H37Rv
cuucguauaggcgaugu

SEQ ID NO: 1292921 - RNA, 21 nt, Mycobacterium tuberculosis H37Rv
cuucguauaggcgauguucga

SEQ ID NO: 1292922 - RNA, 16 nt, Mycobacterium tuberculosis H37Rv
cuucuaccccggugac

SEQ ID NO: 1292923 - RNA, 15 nt, Mycobacterium tuberculosis H37Rv
cuugccgucgcugac

SEQ ID NO: 1292924 - RNA, 17 nt, Mycobacterium tuberculosis H37Rv
cuugccgaaauccuuga

SEQ ID NO: 1292925 - RNA, 22 nt, Mycobacterium tuberculosis H37Rv
cuugccccgccgagcaccgggc

SEQ ID NO: 1292926 - RNA, 18 nt, Mycobacterium tuberculosis H37Rv
cuugucgcggugcggcag

SEQ ID NO: 1292927 - RNA, 13 nt, Mycobacterium tuberculosis H37Rv
cuugguggccacc

SEQ ID NO: 1292928 - RNA, 23 nt, Mycobacterium tuberculosis H37Rv
cuugguggcguggcccucggcga

SEQ ID NO: 1292929 - RNA, 19 nt, Mycobacterium tuberculosis H37Rv
cuugugcccaauagccgga

SEQ ID NO: 1292930 - RNA, 16 nt, Mycobacterium tuberculosis H37Rv
cuugucggggugcaca

SEQ ID NO: 1292931 - RNA, 17 nt, Mycobacterium tuberculosis H37Rv
cuuggucuugaacccga

SEQ ID NO: 1292932 - RNA, 16 nt, Mycobacterium tuberculosis H37Rv
cuuggugaaccgcgcg

SEQ ID NO: 1292933 - RNA, 22 nt, Mycobacterium tuberculosis H37Rv
cuuggugaccugacgcucgguc

SEQ ID NO: 1292934 - RNA, 20 nt, Mycobacterium tuberculosis H37Rv
cuuggccaugcuggucagcg

SEQ ID NO: 1292935 - RNA, 17 nt, Mycobacterium tuberculosis H37Rv
cuuggccaugcugguca

SEQ ID NO: 1292936 - RNA, 21 nt, Mycobacterium tuberculosis H37Rv
cuuggccagcagcagcgcuuc

SEQ ID NO: 1292937 - RNA, 15 nt, Mycobacterium tuberculosis H37Rv
cuuguugaagccgau

SEQ ID NO: 1292938 - RNA, 15 nt, Mycobacterium tuberculosis H37Rv
cuuguugucgugcaa

SEQ ID NO: 1292939 - RNA, 18 nt, Mycobacterium tuberculosis H37Rv
cuuguugccgccggccau

SEQ ID NO: 1292940 - RNA, 18 nt, Mycobacterium tuberculosis H37Rv
gaaaggucggccugcgac

SEQ ID NO: 1292941 - RNA, 13 nt, Mycobacterium tuberculosis H37Rv
gaaaggcuuccgc

SEQ ID NO: 1292942 - RNA, 16 nt, Mycobacterium tuberculosis H37Rv
gaaaguuguaucgcag

SEQ ID NO: 1292943 - RNA, 20 nt, Mycobacterium tuberculosis H37Rv
gaaauagcccaagccgaucg

SEQ ID NO: 1292944 - RNA, 23 nt, Mycobacterium tuberculosis H37Rv
gaaauagucuucuuucgccuccg

SEQ ID NO: 1292945 - RNA, 22 nt, Mycobacterium tuberculosis H37Rv
gaaauacagauauuugucggcg

SEQ ID NO: 1292946 - RNA, 20 nt, Mycobacterium tuberculosis H37Rv
gaaagcguaaggccggaguc

SEQ ID NO: 1292947 - RNA, 20 nt, Mycobacterium tuberculosis H37Rv
gaaagcgccgaaacagcacc

SEQ ID NO: 1292948 - RNA, 17 nt, Mycobacterium tuberculosis H37Rv
gaaacugaugucgccga

SEQ ID NO: 1292949 - RNA, 23 nt, Mycobacterium tuberculosis H37Rv
gaaacagcacccagacgauggcc

SEQ ID NO: 1292950 - RNA, 14 nt, Mycobacterium tuberculosis H37Rv
gaaacaccgucugg

SEQ ID NO: 1292951 - RNA, 20 nt, Mycobacterium tuberculosis H37Rv
gaaacaggacgugucgguac

SEQ ID NO: 1292952 - RNA, 21 nt, Mycobacterium tuberculosis H37Rv
gaaacaggacgugucgguacu

SEQ ID NO: 1292953 - RNA, 19 nt, Mycobacterium tuberculosis H37Rv
gaaacucaagccacgucgu

SEQ ID NO: 1292954 - RNA, 19 nt, Mycobacterium tuberculosis H37Rv
gaaaacgggguggcacgca

SEQ ID NO: 1292955 - RNA, 15 nt, Mycobacterium tuberculosis H37Rv
cuuuuccggcguucc

SEQ ID NO: 1292956 - RNA, 19 nt, Mycobacterium tuberculosis H37Rv
cuuuugcgucuucucggcg

SEQ ID NO: 1292957 - RNA, 16 nt, Mycobacterium tuberculosis H37Rv
gaaccaguccucgacg

SEQ ID NO: 1292958 - RNA, 13 nt, Mycobacterium tuberculosis H37Rv
gaaccagucgacc

SEQ ID NO: 1292959 - RNA, 13 nt, Mycobacterium tuberculosis H37Rv
gaacccccucgcg

SEQ ID NO: 1292960 - RNA, 20 nt, Mycobacterium tuberculosis H37Rv
gaacccgcgagguugaccac

SEQ ID NO: 1292961 - RNA, 18 nt, Mycobacterium tuberculosis H37Rv
gaacccgaucgucgagcc

SEQ ID NO: 1292962 - RNA, 21 nt, Mycobacterium tuberculosis H37Rv
gaacccgauaacaaggccgcc

SEQ ID NO: 1292963 - RNA, 15 nt, Mycobacterium tuberculosis H37Rv
gaacccgguguugag

SEQ ID NO: 1292964 - RNA, 20 nt, Mycobacterium tuberculosis H37Rv
gaacccgcguugaaggcgcc

SEQ ID NO: 1292965 - RNA, 14 nt, Mycobacterium tuberculosis H37Rv
gaacccgcuuucgg

SEQ ID NO: 1292966 - RNA, 23 nt, Mycobacterium tuberculosis H37Rv
gaaccacgcgcccgcaccaccgg

SEQ ID NO: 1292967 - RNA, 15 nt, Mycobacterium tuberculosis H37Rv
gaaccacgccaucga

SEQ ID NO: 1292968 - RNA, 18 nt, Mycobacterium tuberculosis H37Rv
gaaccacccaccggccac

SEQ ID NO: 1292969 - RNA, 19 nt, Mycobacterium tuberculosis H37Rv
gaaccaccagcacggcgau

SEQ ID NO: 1292970 - RNA, 19 nt, Mycobacterium tuberculosis H37Rv
gaaccaggcggccgcgucg

SEQ ID NO: 1292971 - RNA, 17 nt, Mycobacterium tuberculosis H37Rv
gaaccagcccgccgauc

SEQ ID NO: 1292972 - RNA, 15 nt, Mycobacterium tuberculosis H37Rv
gaaccgugucgccgc

SEQ ID NO: 1292973 - RNA, 17 nt, Mycobacterium tuberculosis H37Rv
gaaccguucgacccagc

SEQ ID NO: 1292974 - RNA, 18 nt, Mycobacterium tuberculosis H37Rv
gaaccguucggcgacagc

SEQ ID NO: 1292975 - RNA, 17 nt, Mycobacterium tuberculosis H37Rv
gaaccucgaccgucacc

SEQ ID NO: 1292976 - RNA, 24 nt, Mycobacterium tuberculosis H37Rv
gaaccuccucggguucgucaguca

SEQ ID NO: 1292977 - RNA, 19 nt, Mycobacterium tuberculosis H37Rv
gaaccgugcugggcaucac

SEQ ID NO: 1292978 - RNA, 15 nt, Mycobacterium tuberculosis H37Rv
gaaccggucgauccc

SEQ ID NO: 1292979 - RNA, 14 nt, Mycobacterium tuberculosis H37Rv
gaaccggacagcgu

SEQ ID NO: 1292980 - RNA, 18 nt, Mycobacterium tuberculosis H37Rv
gaaccgcucgucacgugu

SEQ ID NO: 1292981 - RNA, 20 nt, Mycobacterium tuberculosis H37Rv
gaaccgcggaucgaccgcca

SEQ ID NO: 1292982 - RNA, 14 nt, Mycobacterium tuberculosis H37Rv
gaaccgcugcgggu

SEQ ID NO: 1292983 - RNA, 19 nt, Mycobacterium tuberculosis H37Rv
gaaccgaagccucggcaug

SEQ ID NO: 1292984 - RNA, 16 nt, Mycobacterium tuberculosis H37Rv
gaaccgaagccgucga

SEQ ID NO: 1292985 - RNA, 21 nt, Mycobacterium tuberculosis H37Rv
gaaccgacgcguccggugcac

SEQ ID NO: 1292986 - RNA, 15 nt, Mycobacterium tuberculosis H37Rv
gaaccgaucaucaua

SEQ ID NO: 1292987 - RNA, 21 nt, Mycobacterium tuberculosis H37Rv
gaacgccugcucgucggccac

SEQ ID NO: 1292988 - RNA, 18 nt, Mycobacterium tuberculosis H37Rv
gaacgacgcuuucccgau

SEQ ID NO: 1292989 - RNA, 14 nt, Mycobacterium tuberculosis H37Rv
gaacgcgagcgcua

SEQ ID NO: 1292990 - RNA, 13 nt, Mycobacterium tuberculosis H37Rv
gaacgcgagcgcu

SEQ ID NO: 1292991 - RNA, 20 nt, Mycobacterium tuberculosis H37Rv
gaacgcgaggugauugguca

SEQ ID NO: 1292992 - RNA, 17 nt, Mycobacterium tuberculosis H37Rv
gaaccuggcgacgcgac

SEQ ID NO: 1292993 - RNA, 12 nt, Mycobacterium tuberculosis H37Rv
gaaccugcggca

SEQ ID NO: 1292994 - RNA, 18 nt, Mycobacterium tuberculosis H37Rv
gaaccuggcgacgcgaca

SEQ ID NO: 1292995 - RNA, 18 nt, Mycobacterium tuberculosis H37Rv
gaaccuugaccgaccagc

SEQ ID NO: 1292996 - RNA, 14 nt, Mycobacterium tuberculosis H37Rv
gaacgaaccgccgc

SEQ ID NO: 1292997 - RNA, 15 nt, Mycobacterium tuberculosis H37Rv
gaacgaagucgacga

SEQ ID NO: 1292998 - RNA, 15 nt, Mycobacterium tuberculosis H37Rv
gaacgacauccggcc

SEQ ID NO: 1292999 - RNA, 20 nt, Mycobacterium tuberculosis H37Rv
gaacgcccgcuucagcacgg

SEQ ID NO: 1293000 - RNA, 11 nt, Mycobacterium tuberculosis H37Rv
gaacgaccucu

SEQ ID NO: 1293001 - RNA, 19 nt, Mycobacterium tuberculosis H37Rv
gaacuacugcgaucgcgag

SEQ ID NO: 1293002 - RNA, 18 nt, Mycobacterium tuberculosis H37Rv
gaacuccccggucgccgc

SEQ ID NO: 1293003 - RNA, 14 nt, Mycobacterium tuberculosis H37Rv
gaacuccaucacca

SEQ ID NO: 1293004 - RNA, 18 nt, Mycobacterium tuberculosis H37Rv
gaacuccgcggaacccag

SEQ ID NO: 1293005 - RNA, 22 nt, Mycobacterium tuberculosis H37Rv
gaacuccucgcugucgaucagc

SEQ ID NO: 1293006 - RNA, 16 nt, Mycobacterium tuberculosis H37Rv
gaacucgaacuggguc

SEQ ID NO: 1293007 - RNA, 17 nt, Mycobacterium tuberculosis H37Rv
gaacuccgcggaaccca

SEQ ID NO: 1293008 - RNA, 18 nt, Mycobacterium tuberculosis H37Rv
gaacggcgcaguuggcac

SEQ ID NO: 1293009 - RNA, 17 nt, Mycobacterium tuberculosis H37Rv
gaacggcgcaguuggca

SEQ ID NO: 1293010 - RNA, 16 nt, Mycobacterium tuberculosis H37Rv
gaacggcgcaguuggc

SEQ ID NO: 1293011 - RNA, 14 nt, Mycobacterium tuberculosis H37Rv
gaacggaugccggu

SEQ ID NO: 1293012 - RNA, 16 nt, Mycobacterium tuberculosis H37Rv
gaacggaauucagcga

SEQ ID NO: 1293013 - RNA, 16 nt, Mycobacterium tuberculosis H37Rv
gaacgcgcgugcagcc

SEQ ID NO: 1293014 - RNA, 20 nt, Mycobacterium tuberculosis H37Rv
gaacgcggccaccacaacgc

SEQ ID NO: 1293015 - RNA, 19 nt, Mycobacterium tuberculosis H37Rv
gaacgcggccaccgaccgc

SEQ ID NO: 1293016 - RNA, 13 nt, Mycobacterium tuberculosis H37Rv
gaacgcgcgcgug

SEQ ID NO: 1293017 - RNA, 18 nt, Mycobacterium tuberculosis H37Rv
gaacgcggccucgucgag

SEQ ID NO: 1293018 - RNA, 14 nt, Mycobacterium tuberculosis H37Rv
gaaaugacggcuga

SEQ ID NO: 1293019 - RNA, 17 nt, Mycobacterium tuberculosis H37Rv
gaaauccgagccgcgau

SEQ ID NO: 1293020 - RNA, 14 nt, Mycobacterium tuberculosis H37Rv
gaaauccgcgaucg

SEQ ID NO: 1293021 - RNA, 18 nt, Mycobacterium tuberculosis H37Rv
gaaaucgcccugacccgg

SEQ ID NO: 1293022 - RNA, 12 nt, Mycobacterium tuberculosis H37Rv
gaaauugacgug

SEQ ID NO: 1293023 - RNA, 23 nt, Mycobacterium tuberculosis H37Rv
gaacaacagcggcaacgccuccg

SEQ ID NO: 1293024 - RNA, 22 nt, Mycobacterium tuberculosis H37Rv
gaacaacgcggacuucguuccg

SEQ ID NO: 1293025 - RNA, 19 nt, Mycobacterium tuberculosis H37Rv
gaacaacggcguaaucggg

SEQ ID NO: 1293026 - RNA, 22 nt, Mycobacterium tuberculosis H37Rv
gaacaccagauggcucucggug

SEQ ID NO: 1293027 - RNA, 20 nt, Mycobacterium tuberculosis H37Rv
gaacaagauucgcucaccac

SEQ ID NO: 1293028 - RNA, 15 nt, Mycobacterium tuberculosis H37Rv
gaacaccaugaucag

SEQ ID NO: 1293029 - RNA, 16 nt, Mycobacterium tuberculosis H37Rv
gaacaccagcaggcgg

SEQ ID NO: 1293030 - RNA, 19 nt, Mycobacterium tuberculosis H37Rv
gaacaccggcgccucaucg

SEQ ID NO: 1293031 - RNA, 14 nt, Mycobacterium tuberculosis H37Rv
gaacacgucgacac

SEQ ID NO: 1293032 - RNA, 14 nt, Mycobacterium tuberculosis H37Rv
gaacagcgacgcca

SEQ ID NO: 1293033 - RNA, 22 nt, Mycobacterium tuberculosis H37Rv
gaacagcugcccgccagcgccg

SEQ ID NO: 1293034 - RNA, 19 nt, Mycobacterium tuberculosis H37Rv
gaacagcugaucccagauc

SEQ ID NO: 1293035 - RNA, 17 nt, Mycobacterium tuberculosis H37Rv
gaacagcucgaucagcc

SEQ ID NO: 1293036 - RNA, 16 nt, Mycobacterium tuberculosis H37Rv
gaacagcucguuggcg

SEQ ID NO: 1293037 - RNA, 15 nt, Mycobacterium tuberculosis H37Rv
gaacagcaugauccg

SEQ ID NO: 1293038 - RNA, 19 nt, Mycobacterium tuberculosis H37Rv
gaacagcaccgccggcgac

SEQ ID NO: 1293039 - RNA, 15 nt, Mycobacterium tuberculosis H37Rv
gaacacgucgggaug

SEQ ID NO: 1293040 - RNA, 16 nt, Mycobacterium tuberculosis H37Rv
gaacaguuucggcaug

SEQ ID NO: 1293041 - RNA, 20 nt, Mycobacterium tuberculosis H37Rv
gaacaguuucggcaugucgg

SEQ ID NO: 1293042 - RNA, 15 nt, Mycobacterium tuberculosis H37Rv
gaacaguaucgccgg

SEQ ID NO: 1293043 - RNA, 23 nt, Mycobacterium tuberculosis H37Rv
gaacagugccucgcguucgcugg

SEQ ID NO: 1293044 - RNA, 19 nt, Mycobacterium tuberculosis H37Rv
gaacaguugcggcuggcgc

SEQ ID NO: 1293045 - RNA, 22 nt, Mycobacterium tuberculosis H37Rv
gaaccaacgcgaccgcaucucg

SEQ ID NO: 1293046 - RNA, 18 nt, Mycobacterium tuberculosis H37Rv
gaacauguccagugccgu

SEQ ID NO: 1293047 - RNA, 18 nt, Mycobacterium tuberculosis H37Rv
gaaccaccagcacggcga

SEQ ID NO: 1293048 - RNA, 16 nt, Mycobacterium tuberculosis H37Rv
gaacaugcucacgauc

SEQ ID NO: 1293049 - RNA, 12 nt, Mycobacterium tuberculosis H37Rv
gaacaucaccgg

SEQ ID NO: 1293050 - RNA, 20 nt, Mycobacterium tuberculosis H37Rv
gaacaucaccucgaugccgc

SEQ ID NO: 1293051 - RNA, 14 nt, Mycobacterium tuberculosis H37Rv
gaacaucgccagcg

SEQ ID NO: 1293052 - RNA, 22 nt, Mycobacterium tuberculosis H37Rv
gaacaucgccagcgccggccag

SEQ ID NO: 1293053 - RNA, 13 nt, Mycobacterium tuberculosis H37Rv
gaacaucgucauc

SEQ ID NO: 1293054 - RNA, 21 nt, Mycobacterium tuberculosis H37Rv
gaacaucaucggguccacguc

SEQ ID NO: 1293055 - RNA, 15 nt, Mycobacterium tuberculosis H37Rv
gaccacaacgccucg

SEQ ID NO: 1293056 - RNA, 17 nt, Mycobacterium tuberculosis H37Rv
gaccaccucagcugcgg

SEQ ID NO: 1293057 - RNA, 16 nt, Mycobacterium tuberculosis H37Rv
gaccaccugcugcacg

SEQ ID NO: 1293058 - RNA, 20 nt, Mycobacterium tuberculosis H37Rv
gaccaccggguagccggcgu

SEQ ID NO: 1293059 - RNA, 17 nt, Mycobacterium tuberculosis H37Rv
gaccaccagcaucgugg

SEQ ID NO: 1293060 - RNA, 14 nt, Mycobacterium tuberculosis H37Rv
gaccaccgcucgcc

SEQ ID NO: 1293061 - RNA, 13 nt, Mycobacterium tuberculosis H37Rv
gaccaccgcugag

SEQ ID NO: 1293062 - RNA, 22 nt, Mycobacterium tuberculosis H37Rv
gaccaccggaauuugcgucgug

SEQ ID NO: 1293063 - RNA, 17 nt, Mycobacterium tuberculosis H37Rv
gaccaccggcagcgcga

SEQ ID NO: 1293064 - RNA, 14 nt, Mycobacterium tuberculosis H37Rv
gaccaccacgauga

SEQ ID NO: 1293065 - RNA, 21 nt, Mycobacterium tuberculosis H37Rv
gaccacagcggagacgaucgc

SEQ ID NO: 1293066 - RNA, 17 nt, Mycobacterium tuberculosis H37Rv
gaccacaccacgauggc

SEQ ID NO: 1293067 - RNA, 17 nt, Mycobacterium tuberculosis H37Rv
gaccacaacgccucgcc

SEQ ID NO: 1293068 - RNA, 13 nt, Mycobacterium tuberculosis H37Rv
gaccacggcguug

SEQ ID NO: 1293069 - RNA, 23 nt, Mycobacterium tuberculosis H37Rv
gaccacgguagacaagucggcgc

SEQ ID NO: 1293070 - RNA, 12 nt, Mycobacterium tuberculosis H37Rv
gaccacgcaccg

SEQ ID NO: 1293071 - RNA, 16 nt, Mycobacterium tuberculosis H37Rv
gaccacgaacgcgcgc

SEQ ID NO: 1293072 - RNA, 16 nt, Mycobacterium tuberculosis H37Rv
gaccagaacucgugau

SEQ ID NO: 1293073 - RNA, 14 nt, Mycobacterium tuberculosis H37Rv
gaccagacccacga

SEQ ID NO: 1293074 - RNA, 19 nt, Mycobacterium tuberculosis H37Rv
gaccagagccaacgaugau

SEQ ID NO: 1293075 - RNA, 13 nt, Mycobacterium tuberculosis H37Rv
gaccagcaccgcc

SEQ ID NO: 1293076 - RNA, 18 nt, Mycobacterium tuberculosis H37Rv
gaccagaggcgcuucgcc

SEQ ID NO: 1293077 - RNA, 17 nt, Mycobacterium tuberculosis H37Rv
gaccagauacgucgucg

SEQ ID NO: 1293078 - RNA, 20 nt, Mycobacterium tuberculosis H37Rv
gaccacuugcagcacaacgu

SEQ ID NO: 1293079 - RNA, 18 nt, Mycobacterium tuberculosis H37Rv
gaccacuucgauggcgca

SEQ ID NO: 1293080 - RNA, 17 nt, Mycobacterium tuberculosis H37Rv
gaccacuccacgcagcc

SEQ ID NO: 1293081 - RNA, 13 nt, Mycobacterium tuberculosis H37Rv
gacaggccgagca

SEQ ID NO: 1293082 - RNA, 12 nt, Mycobacterium tuberculosis H37Rv
gacagcggcgac

SEQ ID NO: 1293083 - RNA, 16 nt, Mycobacterium tuberculosis H37Rv
gacaggcggcggccug

SEQ ID NO: 1293084 - RNA, 21 nt, Mycobacterium tuberculosis H37Rv
gacaggcuuggcaugcggauc

SEQ ID NO: 1293085 - RNA, 14 nt, Mycobacterium tuberculosis H37Rv
gacagggcggcgag

SEQ ID NO: 1293086 - RNA, 17 nt, Mycobacterium tuberculosis H37Rv
gacagcggcaccggggu

SEQ ID NO: 1293087 - RNA, 23 nt, Mycobacterium tuberculosis H37Rv
gacaccgaaccgccgcugccgcg

SEQ ID NO: 1293088 - RNA, 16 nt, Mycobacterium tuberculosis H37Rv
gacacccaucgaccgc

SEQ ID NO: 1293089 - RNA, 17 nt, Mycobacterium tuberculosis H37Rv
gacaccccacaccgucu

SEQ ID NO: 1293090 - RNA, 20 nt, Mycobacterium tuberculosis H37Rv
gacaccacguugugcagcgc

SEQ ID NO: 1293091 - RNA, 21 nt, Mycobacterium tuberculosis H37Rv
gacaccacggaccagcgccgg

SEQ ID NO: 1293092 - RNA, 13 nt, Mycobacterium tuberculosis H37Rv
gacaccacggcgc

SEQ ID NO: 1293093 - RNA, 20 nt, Mycobacterium tuberculosis H37Rv
gacaccacggcgcgcagcga

SEQ ID NO: 1293094 - RNA, 17 nt, Mycobacterium tuberculosis H37Rv
gacaccacgucccggaa

SEQ ID NO: 1293095 - RNA, 13 nt, Mycobacterium tuberculosis H37Rv
gacaccaccggcg

SEQ ID NO: 1293096 - RNA, 15 nt, Mycobacterium tuberculosis H37Rv
gacaccagcgugugg

SEQ ID NO: 1293097 - RNA, 21 nt, Mycobacterium tuberculosis H37Rv
gacacccaccaacacccgggc

SEQ ID NO: 1293098 - RNA, 23 nt, Mycobacterium tuberculosis H37Rv
gacaccaucuccgccgucgccac

SEQ ID NO: 1293099 - RNA, 19 nt, Mycobacterium tuberculosis H37Rv
gacagcaucacgaucacgu

SEQ ID NO: 1293100 - RNA, 14 nt, Mycobacterium tuberculosis H37Rv
gacagcaucacgcc

SEQ ID NO: 1293101 - RNA, 16 nt, Mycobacterium tuberculosis H37Rv
gacagcagccggaucu

SEQ ID NO: 1293102 - RNA, 21 nt, Mycobacterium tuberculosis H37Rv
gacaccgccccgccgcgacgg

SEQ ID NO: 1293103 - RNA, 18 nt, Mycobacterium tuberculosis H37Rv
gacaccgcggcgaucugc

SEQ ID NO: 1293104 - RNA, 23 nt, Mycobacterium tuberculosis H37Rv
gacaccgccggggugcaccgucg

SEQ ID NO: 1293105 - RNA, 16 nt, Mycobacterium tuberculosis H37Rv
gaaucacguggaccac

SEQ ID NO: 1293106 - RNA, 22 nt, Mycobacterium tuberculosis H37Rv
gaaucagugaagacaccaggcc

SEQ ID NO: 1293107 - RNA, 19 nt, Mycobacterium tuberculosis H37Rv
gaauccaccagccgguagc

SEQ ID NO: 1293108 - RNA, 17 nt, Mycobacterium tuberculosis H37Rv
gaauccgcucgaggugg

SEQ ID NO: 1293109 - RNA, 19 nt, Mycobacterium tuberculosis H37Rv
gaauccgcucgaggugguc

SEQ ID NO: 1293110 - RNA, 21 nt, Mycobacterium tuberculosis H37Rv
gaauccggaguuuaagacgcc

SEQ ID NO: 1293111 - RNA, 14 nt, Mycobacterium tuberculosis H37Rv
gaaucgucugacga

SEQ ID NO: 1293112 - RNA, 12 nt, Mycobacterium tuberculosis H37Rv
gaauccugcgcu

SEQ ID NO: 1293113 - RNA, 15 nt, Mycobacterium tuberculosis H37Rv
gaauccguucgacga

SEQ ID NO: 1293114 - RNA, 19 nt, Mycobacterium tuberculosis H37Rv
gaaucguuggcgaucgcga

SEQ ID NO: 1293115 - RNA, 14 nt, Mycobacterium tuberculosis H37Rv
gaaucugacgacgc

SEQ ID NO: 1293116 - RNA, 13 nt, Mycobacterium tuberculosis H37Rv
gaaugaaggcacc

SEQ ID NO: 1293117 - RNA, 19 nt, Mycobacterium tuberculosis H37Rv
gaacugaugaaccacggca

SEQ ID NO: 1293118 - RNA, 15 nt, Mycobacterium tuberculosis H37Rv
gaacugaucgaccgc

SEQ ID NO: 1293119 - RNA, 17 nt, Mycobacterium tuberculosis H37Rv
gaacucuggugacggug

SEQ ID NO: 1293120 - RNA, 18 nt, Mycobacterium tuberculosis H37Rv
gaacucgcgggcgaccac

SEQ ID NO: 1293121 - RNA, 22 nt, Mycobacterium tuberculosis H37Rv
gaacucguugagcagcuggacc

SEQ ID NO: 1293122 - RNA, 16 nt, Mycobacterium tuberculosis H37Rv
gaacucuggugacggu

SEQ ID NO: 1293123 - RNA, 13 nt, Mycobacterium tuberculosis H37Rv
gaacucgggcgac

SEQ ID NO: 1293124 - RNA, 13 nt, Mycobacterium tuberculosis H37Rv
gaaucaccggcaa

SEQ ID NO: 1293125 - RNA, 21 nt, Mycobacterium tuberculosis H37Rv
gaacugcugaugaaacgccgu

SEQ ID NO: 1293126 - RNA, 22 nt, Mycobacterium tuberculosis H37Rv
gacaaccgggcgggacucggcg

SEQ ID NO: 1293127 - RNA, 11 nt, Mycobacterium tuberculosis H37Rv
gacaaccuggg

SEQ ID NO: 1293128 - RNA, 18 nt, Mycobacterium tuberculosis H37Rv
gacaaccucgucgaucuc

SEQ ID NO: 1293129 - RNA, 14 nt, Mycobacterium tuberculosis H37Rv
gaauguccggcauc

SEQ ID NO: 1293130 - RNA, 22 nt, Mycobacterium tuberculosis H37Rv
gaaugucgaaacccacguacgc

SEQ ID NO: 1293131 - RNA, 18 nt, Mycobacterium tuberculosis H37Rv
gaaugcuugcgcagcacc

SEQ ID NO: 1293132 - RNA, 20 nt, Mycobacterium tuberculosis H37Rv
gaaugcgguccucgaucggu

SEQ ID NO: 1293133 - RNA, 21 nt, Mycobacterium tuberculosis H37Rv
gacaaggguucaggucggggu

SEQ ID NO: 1293134 - RNA, 16 nt, Mycobacterium tuberculosis H37Rv
gacaaggacugaccgu

SEQ ID NO: 1293135 - RNA, 23 nt, Mycobacterium tuberculosis H37Rv
gacaacuaucgucgugucgccgc

SEQ ID NO: 1293136 - RNA, 14 nt, Mycobacterium tuberculosis H37Rv
gacacagaaucgcc

SEQ ID NO: 1293137 - RNA, 15 nt, Mycobacterium tuberculosis H37Rv
gacacaacgaucugc

SEQ ID NO: 1293138 - RNA, 17 nt, Mycobacterium tuberculosis H37Rv
gacacauagugcggcac

SEQ ID NO: 1293139 - RNA, 21 nt, Mycobacterium tuberculosis H37Rv
gacacauagugcggcaccgcc

SEQ ID NO: 1293140 - RNA, 19 nt, Mycobacterium tuberculosis H37Rv
gacaagugccggcgcggag

SEQ ID NO: 1293141 - RNA, 17 nt, Mycobacterium tuberculosis H37Rv
gacaaguccgcgauggc

SEQ ID NO: 1293142 - RNA, 19 nt, Mycobacterium tuberculosis H37Rv
gacaaucguccacccgagc

SEQ ID NO: 1293143 - RNA, 21 nt, Mycobacterium tuberculosis H37Rv
gaccaucgaggcgaucaccgc

SEQ ID NO: 1293144 - RNA, 22 nt, Mycobacterium tuberculosis H37Rv
gaccauagccugcgccgacccg

SEQ ID NO: 1293145 - RNA, 19 nt, Mycobacterium tuberculosis H37Rv
gaccaugagcuugguggcc

SEQ ID NO: 1293146 - RNA, 18 nt, Mycobacterium tuberculosis H37Rv
gaccaugcgaccggcaac

SEQ ID NO: 1293147 - RNA, 20 nt, Mycobacterium tuberculosis H37Rv
gaccaugaugccuaccgggc

SEQ ID NO: 1293148 - RNA, 17 nt, Mycobacterium tuberculosis H37Rv
gaccaugaugaccggca

SEQ ID NO: 1293149 - RNA, 23 nt, Mycobacterium tuberculosis H37Rv
gaccccgcgccgacacguugcag

SEQ ID NO: 1293150 - RNA, 18 nt, Mycobacterium tuberculosis H37Rv
gaccccggaaugcccgag

SEQ ID NO: 1293151 - RNA, 20 nt, Mycobacterium tuberculosis H37Rv
gacccgcaauuccggugauc

SEQ ID NO: 1293152 - RNA, 17 nt, Mycobacterium tuberculosis H37Rv
gacccgcauccacgucg

SEQ ID NO: 1293153 - RNA, 19 nt, Mycobacterium tuberculosis H37Rv
gacccgagcgcucgaucac

SEQ ID NO: 1293154 - RNA, 23 nt, Mycobacterium tuberculosis H37Rv
gacccgaugacccacugcaggcu

SEQ ID NO: 1293155 - RNA, 16 nt, Mycobacterium tuberculosis H37Rv
gacccgagaucaccgg

SEQ ID NO: 1293156 - RNA, 15 nt, Mycobacterium tuberculosis H37Rv
gacccgagaucaccg

SEQ ID NO: 1293157 - RNA, 14 nt, Mycobacterium tuberculosis H37Rv
gacccgacaugguc

SEQ ID NO: 1293158 - RNA, 22 nt, Mycobacterium tuberculosis H37Rv
gaccccggcguugccgccguug

SEQ ID NO: 1293159 - RNA, 15 nt, Mycobacterium tuberculosis H37Rv
gaccccggcugcgcu

SEQ ID NO: 1293160 - RNA, 16 nt, Mycobacterium tuberculosis H37Rv
gaccccggcgguaccg

SEQ ID NO: 1293161 - RNA, 15 nt, Mycobacterium tuberculosis H37Rv
gaccgacgucgccca

SEQ ID NO: 1293162 - RNA, 16 nt, Mycobacterium tuberculosis H37Rv
gaccgaccucggcgac

SEQ ID NO: 1293163 - RNA, 14 nt, Mycobacterium tuberculosis H37Rv
gaccgaccucggcg

SEQ ID NO: 1293164 - RNA, 19 nt, Mycobacterium tuberculosis H37Rv
gaccgacagcggcaccggg

SEQ ID NO: 1293165 - RNA, 18 nt, Mycobacterium tuberculosis H37Rv
gaccgaggcacgucgaaa

SEQ ID NO: 1293166 - RNA, 22 nt, Mycobacterium tuberculosis H37Rv
gaccgaguaccgauagccugcg

SEQ ID NO: 1293167 - RNA, 13 nt, Mycobacterium tuberculosis H37Rv
gaccgaaccuggu

SEQ ID NO: 1293168 - RNA, 15 nt, Mycobacterium tuberculosis H37Rv
gacccggggccguug

SEQ ID NO: 1293169 - RNA, 14 nt, Mycobacterium tuberculosis H37Rv
gaccgaacgacucg

SEQ ID NO: 1293170 - RNA, 22 nt, Mycobacterium tuberculosis H37Rv
gaccgaaugugaaaugcgcgau

SEQ ID NO: 1293171 - RNA, 21 nt, Mycobacterium tuberculosis H37Rv
gacccgggcgagcgcggccug

SEQ ID NO: 1293172 - RNA, 21 nt, Mycobacterium tuberculosis H37Rv
gacccgggaaggaaccgggca

SEQ ID NO: 1293173 - RNA, 16 nt, Mycobacterium tuberculosis H37Rv
gacccggccagcggca

SEQ ID NO: 1293174 - RNA, 22 nt, Mycobacterium tuberculosis H37Rv
gacccgggaaggaaccgggcaa

SEQ ID NO: 1293175 - RNA, 18 nt, Mycobacterium tuberculosis H37Rv
gacccggaaucccgaguc

SEQ ID NO: 1293176 - RNA, 22 nt, Mycobacterium tuberculosis H37Rv
gacccggagccgccaggugcuc

SEQ ID NO: 1293177 - RNA, 17 nt, Mycobacterium tuberculosis H37Rv
gacccgggaaggaaccg

SEQ ID NO: 1293178 - RNA, 17 nt, Mycobacterium tuberculosis H37Rv
gaccagucgcggcguuc

SEQ ID NO: 1293179 - RNA, 14 nt, Mycobacterium tuberculosis H37Rv
gaccaggucgguca

SEQ ID NO: 1293180 - RNA, 18 nt, Mycobacterium tuberculosis H37Rv
gaccaggucugcggugcu

SEQ ID NO: 1293181 - RNA, 15 nt, Mycobacterium tuberculosis H37Rv
gaccagggucugcuc

SEQ ID NO: 1293182 - RNA, 13 nt, Mycobacterium tuberculosis H37Rv
gaccaggaccacc

SEQ ID NO: 1293183 - RNA, 16 nt, Mycobacterium tuberculosis H37Rv
gaccaggcgcggcgac

SEQ ID NO: 1293184 - RNA, 22 nt, Mycobacterium tuberculosis H37Rv
gaccagcguccagccgcccucg

SEQ ID NO: 1293185 - RNA, 14 nt, Mycobacterium tuberculosis H37Rv
gaccagcgcggcac

SEQ ID NO: 1293186 - RNA, 23 nt, Mycobacterium tuberculosis H37Rv
gaccagcgucuucagguccaccg

SEQ ID NO: 1293187 - RNA, 18 nt, Mycobacterium tuberculosis H37Rv
gaccagcguccagccgcc

SEQ ID NO: 1293188 - RNA, 14 nt, Mycobacterium tuberculosis H37Rv
gaccagccggucuu

SEQ ID NO: 1293189 - RNA, 21 nt, Mycobacterium tuberculosis H37Rv
gaccagcaccagaaccggugc

SEQ ID NO: 1293190 - RNA, 17 nt, Mycobacterium tuberculosis H37Rv
gaccgcacuugaucgac

SEQ ID NO: 1293191 - RNA, 17 nt, Mycobacterium tuberculosis H37Rv
gaccgcaccgugccgac

SEQ ID NO: 1293192 - RNA, 13 nt, Mycobacterium tuberculosis H37Rv
gaccgcaccgugc

SEQ ID NO: 1293193 - RNA, 18 nt, Mycobacterium tuberculosis H37Rv
gaccgauugucggcaacg

SEQ ID NO: 1293194 - RNA, 19 nt, Mycobacterium tuberculosis H37Rv
gaccgcaucauggugcgcu

SEQ ID NO: 1293195 - RNA, 17 nt, Mycobacterium tuberculosis H37Rv
gaccgcagucgcugggu

SEQ ID NO: 1293196 - RNA, 18 nt, Mycobacterium tuberculosis H37Rv
gaccgcagggaccgguua

SEQ ID NO: 1293197 - RNA, 13 nt, Mycobacterium tuberculosis H37Rv
gaccgcgcucacc

SEQ ID NO: 1293198 - RNA, 15 nt, Mycobacterium tuberculosis H37Rv
gaccggccgacguga

SEQ ID NO: 1293199 - RNA, 19 nt, Mycobacterium tuberculosis H37Rv
gaccgcggucauggcgacg

SEQ ID NO: 1293200 - RNA, 13 nt, Mycobacterium tuberculosis H37Rv
gaccgcggccgcu

SEQ ID NO: 1293201 - RNA, 13 nt, Mycobacterium tuberculosis H37Rv
gaccgcggcguua

SEQ ID NO: 1293202 - RNA, 17 nt, Mycobacterium tuberculosis H37Rv
gaccgcggucauggcga

SEQ ID NO: 1293203 - RNA, 16 nt, Mycobacterium tuberculosis H37Rv
gaccgcgggccgacgc

SEQ ID NO: 1293204 - RNA, 17 nt, Mycobacterium tuberculosis H37Rv
gaccgggaucgucaggc

SEQ ID NO: 1293205 - RNA, 20 nt, Mycobacterium tuberculosis H37Rv
gaccgggccaagacggcggg

SEQ ID NO: 1293206 - RNA, 12 nt, Mycobacterium tuberculosis H37Rv
gaccggcuccgg

SEQ ID NO: 1293207 - RNA, 13 nt, Mycobacterium tuberculosis H37Rv
gaccggcgucggc

SEQ ID NO: 1293208 - RNA, 23 nt, Mycobacterium tuberculosis H37Rv
gaccggucgacagcgaaggcgcc

SEQ ID NO: 1293209 - RNA, 12 nt, Mycobacterium tuberculosis H37Rv
gaccggucgaca

SEQ ID NO: 1293210 - RNA, 21 nt, Mycobacterium tuberculosis H37Rv
gaccgguggccaucgcgcgga

SEQ ID NO: 1293211 - RNA, 21 nt, Mycobacterium tuberculosis H37Rv
gaccgguggcgucaugcccag

SEQ ID NO: 1293212 - RNA, 13 nt, Mycobacterium tuberculosis H37Rv
gaccggugggucu

SEQ ID NO: 1293213 - RNA, 19 nt, Mycobacterium tuberculosis H37Rv
gaccgguguuccgcccagc

SEQ ID NO: 1293214 - RNA, 23 nt, Mycobacterium tuberculosis H37Rv
gaccggugcugucgacgucggca

SEQ ID NO: 1293215 - RNA, 15 nt, Mycobacterium tuberculosis H37Rv
gaccgggucgccgau

SEQ ID NO: 1293216 - RNA, 14 nt, Mycobacterium tuberculosis H37Rv
gaccgggugggucg

SEQ ID NO: 1293217 - RNA, 15 nt, Mycobacterium tuberculosis H37Rv
gaccgggucgaugac

SEQ ID NO: 1293218 - RNA, 14 nt, Mycobacterium tuberculosis H37Rv
gaccgggucgccga

SEQ ID NO: 1293219 - RNA, 11 nt, Mycobacterium tuberculosis H37Rv
gaccguggcgc

SEQ ID NO: 1293220 - RNA, 23 nt, Mycobacterium tuberculosis H37Rv
gaccguggcggggaaaccggcca

SEQ ID NO: 1293221 - RNA, 12 nt, Mycobacterium tuberculosis H37Rv
gaccguggucgg

SEQ ID NO: 1293222 - RNA, 21 nt, Mycobacterium tuberculosis H37Rv
gaccguggcgccggucgccgg

SEQ ID NO: 1293223 - RNA, 19 nt, Mycobacterium tuberculosis H37Rv
gaccguggcgccggucgcc

SEQ ID NO: 1293224 - RNA, 15 nt, Mycobacterium tuberculosis H37Rv
gaccguggcggggaa

SEQ ID NO: 1293225 - RNA, 16 nt, Mycobacterium tuberculosis H37Rv
gaccguauugaccagc

SEQ ID NO: 1293226 - RNA, 15 nt, Mycobacterium tuberculosis H37Rv
gaccgugaucagcgc

SEQ ID NO: 1293227 - RNA, 23 nt, Mycobacterium tuberculosis H37Rv
gaccgucuuuggugccgagcagc

SEQ ID NO: 1293228 - RNA, 21 nt, Mycobacterium tuberculosis H37Rv
gaccgugacguagggcagcgc

SEQ ID NO: 1293229 - RNA, 22 nt, Mycobacterium tuberculosis H37Rv
gaccuggacaaccucgucgauc

SEQ ID NO: 1293230 - RNA, 19 nt, Mycobacterium tuberculosis H37Rv
gaccuggacaaccucgucg

SEQ ID NO: 1293231 - RNA, 22 nt, Mycobacterium tuberculosis H37Rv
gaccugcucgggcgugaucccg

SEQ ID NO: 1293232 - RNA, 20 nt, Mycobacterium tuberculosis H37Rv
gaccucguugcugccggcgu

SEQ ID NO: 1293233 - RNA, 16 nt, Mycobacterium tuberculosis H37Rv
gaccucugcacggccg

SEQ ID NO: 1293234 - RNA, 20 nt, Mycobacterium tuberculosis H37Rv
gaccucgugguucugcaggu

SEQ ID NO: 1293235 - RNA, 17 nt, Mycobacterium tuberculosis H37Rv
gaccucggcgaugucgc

SEQ ID NO: 1293236 - RNA, 13 nt, Mycobacterium tuberculosis H37Rv
gaccucggcgauc

SEQ ID NO: 1293237 - RNA, 13 nt, Mycobacterium tuberculosis H37Rv
gacgaaauccgcc

SEQ ID NO: 1293238 - RNA, 18 nt, Mycobacterium tuberculosis H37Rv
gacgaacaacgcgacgaa

SEQ ID NO: 1293239 - RNA, 23 nt, Mycobacterium tuberculosis H37Rv
gacgaacaccccgggcgccgauc

SEQ ID NO: 1293240 - RNA, 20 nt, Mycobacterium tuberculosis H37Rv
gacgaacaacgcgacgaagc

SEQ ID NO: 1293241 - RNA, 14 nt, Mycobacterium tuberculosis H37Rv
gacgaacaccagcg

SEQ ID NO: 1293242 - RNA, 22 nt, Mycobacterium tuberculosis H37Rv
gacgaaccccauaaucacaucg

SEQ ID NO: 1293243 - RNA, 21 nt, Mycobacterium tuberculosis H37Rv
gacgaaguagccgaccauggu

SEQ ID NO: 1293244 - RNA, 20 nt, Mycobacterium tuberculosis H37Rv
gaccuucucacgcaccaugu

SEQ ID NO: 1293245 - RNA, 20 nt, Mycobacterium tuberculosis H37Rv
gaccuugagcacuccgucgu

SEQ ID NO: 1293246 - RNA, 15 nt, Mycobacterium tuberculosis H37Rv
gaccuuggccgugcc

SEQ ID NO: 1293247 - RNA, 22 nt, Mycobacterium tuberculosis H37Rv
gaccuucgagccgcacaaacgg

SEQ ID NO: 1293248 - RNA, 21 nt, Mycobacterium tuberculosis H37Rv
gaccuucucgucggccagugc

SEQ ID NO: 1293249 - RNA, 14 nt, Mycobacterium tuberculosis H37Rv
gacggagcccaaaa

SEQ ID NO: 1293250 - RNA, 17 nt, Mycobacterium tuberculosis H37Rv
gacggaguucgacgucg

SEQ ID NO: 1293251 - RNA, 12 nt, Mycobacterium tuberculosis H37Rv
gacgcuggccac

SEQ ID NO: 1293252 - RNA, 17 nt, Mycobacterium tuberculosis H37Rv
gacgcuguccaggucug

SEQ ID NO: 1293253 - RNA, 16 nt, Mycobacterium tuberculosis H37Rv
gacgcucgcugcagca

SEQ ID NO: 1293254 - RNA, 16 nt, Mycobacterium tuberculosis H37Rv
gacgcgucagcggcga

SEQ ID NO: 1293255 - RNA, 14 nt, Mycobacterium tuberculosis H37Rv
gacgcgggccgacc

SEQ ID NO: 1293256 - RNA, 21 nt, Mycobacterium tuberculosis H37Rv
gacgcggucaucgagcugacc

SEQ ID NO: 1293257 - RNA, 15 nt, Mycobacterium tuberculosis H37Rv
gacgcggucgacgac

SEQ ID NO: 1293258 - RNA, 16 nt, Mycobacterium tuberculosis H37Rv
gacgcgcauucgccgg

SEQ ID NO: 1293259 - RNA, 19 nt, Mycobacterium tuberculosis H37Rv
gacgcgggagucaucgcgg

SEQ ID NO: 1293260 - RNA, 20 nt, Mycobacterium tuberculosis H37Rv
gacgcgggagucaucgcggc

SEQ ID NO: 1293261 - RNA, 20 nt, Mycobacterium tuberculosis H37Rv
gacgcgcaacgccgccagcc

SEQ ID NO: 1293262 - RNA, 12 nt, Mycobacterium tuberculosis H37Rv
gacgccgucagc

SEQ ID NO: 1293263 - RNA, 24 nt, Mycobacterium tuberculosis H37Rv
gacgccgaaaaugccgcccagcga

SEQ ID NO: 1293264 - RNA, 19 nt, Mycobacterium tuberculosis H37Rv
gacgccgaacgcgagguuc

SEQ ID NO: 1293265 - RNA, 17 nt, Mycobacterium tuberculosis H37Rv
gacgccgagaccgccgc

SEQ ID NO: 1293266 - RNA, 18 nt, Mycobacterium tuberculosis H37Rv
gacgcccggcgcaccauc

SEQ ID NO: 1293267 - RNA, 19 nt, Mycobacterium tuberculosis H37Rv
gacgcccggcgcaccaucg

SEQ ID NO: 1293268 - RNA, 17 nt, Mycobacterium tuberculosis H37Rv
gacgcccgggcaccggc

SEQ ID NO: 1293269 - RNA, 17 nt, Mycobacterium tuberculosis H37Rv
gacgccccgaucggcca

SEQ ID NO: 1293270 - RNA, 17 nt, Mycobacterium tuberculosis H37Rv
gacgcccgcccgcacga

SEQ ID NO: 1293271 - RNA, 21 nt, Mycobacterium tuberculosis H37Rv
gacgccccuucccuaucacga

SEQ ID NO: 1293272 - RNA, 18 nt, Mycobacterium tuberculosis H37Rv
gacgccgagcugguugac

SEQ ID NO: 1293273 - RNA, 21 nt, Mycobacterium tuberculosis H37Rv
gacgccgagcuagaucacgga

SEQ ID NO: 1293274 - RNA, 19 nt, Mycobacterium tuberculosis H37Rv
gacgccgaugugcucgguu

SEQ ID NO: 1293275 - RNA, 13 nt, Mycobacterium tuberculosis H37Rv
gacgccgcagcgu

SEQ ID NO: 1293276 - RNA, 12 nt, Mycobacterium tuberculosis H37Rv
gacgccgguccc

SEQ ID NO: 1293277 - RNA, 13 nt, Mycobacterium tuberculosis H37Rv
gacgccggcgaug

SEQ ID NO: 1293278 - RNA, 15 nt, Mycobacterium tuberculosis H37Rv
gacgccggccagcgg

SEQ ID NO: 1293279 - RNA, 19 nt, Mycobacterium tuberculosis H37Rv
gacgcauaagcccccgaca

SEQ ID NO: 1293280 - RNA, 16 nt, Mycobacterium tuberculosis H37Rv
gacgcagugcccgauc

SEQ ID NO: 1293281 - RNA, 21 nt, Mycobacterium tuberculosis H37Rv
gacgcauaagcccccgacacg

SEQ ID NO: 1293282 - RNA, 17 nt, Mycobacterium tuberculosis H37Rv
gacgccauucaucggca

SEQ ID NO: 1293283 - RNA, 14 nt, Mycobacterium tuberculosis H37Rv
gacgcccaccgaca

SEQ ID NO: 1293284 - RNA, 22 nt, Mycobacterium tuberculosis H37Rv
gacgccauucaucggcaucgac

SEQ ID NO: 1293285 - RNA, 19 nt, Mycobacterium tuberculosis H37Rv
gacgcccauggcgucgaac

SEQ ID NO: 1293286 - RNA, 15 nt, Mycobacterium tuberculosis H37Rv
gacgacaaacggcga

SEQ ID NO: 1293287 - RNA, 19 nt, Mycobacterium tuberculosis H37Rv
gacgaauugguugcccuug

SEQ ID NO: 1293288 - RNA, 16 nt, Mycobacterium tuberculosis H37Rv
gacgacaacaggccgu

SEQ ID NO: 1293289 - RNA, 12 nt, Mycobacterium tuberculosis H37Rv
gacgaaucccgc

SEQ ID NO: 1293290 - RNA, 19 nt, Mycobacterium tuberculosis H37Rv
gacgaaggucuccggcaag

SEQ ID NO: 1293291 - RNA, 21 nt, Mycobacterium tuberculosis H37Rv
gacgcagcuugcccgacggcg

SEQ ID NO: 1293292 - RNA, 22 nt, Mycobacterium tuberculosis H37Rv
gacgcaggaucacacuggccug

SEQ ID NO: 1293293 - RNA, 16 nt, Mycobacterium tuberculosis H37Rv
gacggaugaucagcga

SEQ ID NO: 1293294 - RNA, 17 nt, Mycobacterium tuberculosis H37Rv
gacggcacccccgacga

SEQ ID NO: 1293295 - RNA, 15 nt, Mycobacterium tuberculosis H37Rv
gacggcggccgcgau

SEQ ID NO: 1293296 - RNA, 18 nt, Mycobacterium tuberculosis H37Rv
gacggcguagacguccgc

SEQ ID NO: 1293297 - RNA, 16 nt, Mycobacterium tuberculosis H37Rv
gacggcugccacgcgu

SEQ ID NO: 1293298 - RNA, 17 nt, Mycobacterium tuberculosis H37Rv
gacggggucgcgaugcu

SEQ ID NO: 1293299 - RNA, 19 nt, Mycobacterium tuberculosis H37Rv
gacggcguugagcaggugc

SEQ ID NO: 1293300 - RNA, 17 nt, Mycobacterium tuberculosis H37Rv
gacgggucgccgccauc

SEQ ID NO: 1293301 - RNA, 15 nt, Mycobacterium tuberculosis H37Rv
gacgggucgcggugu

SEQ ID NO: 1293302 - RNA, 16 nt, Mycobacterium tuberculosis H37Rv
gacgggguugaccgcc

SEQ ID NO: 1293303 - RNA, 16 nt, Mycobacterium tuberculosis H37Rv
gacggguggcccgacc

SEQ ID NO: 1293304 - RNA, 16 nt, Mycobacterium tuberculosis H37Rv
gacgggugcgggccga

SEQ ID NO: 1293305 - RNA, 12 nt, Mycobacterium tuberculosis H37Rv
gacggucagccg

SEQ ID NO: 1293306 - RNA, 18 nt, Mycobacterium tuberculosis H37Rv
gacgguaaaugucgaaca

SEQ ID NO: 1293307 - RNA, 12 nt, Mycobacterium tuberculosis H37Rv
gacggucgccgu

SEQ ID NO: 1293308 - RNA, 14 nt, Mycobacterium tuberculosis H37Rv
gacggucgucgauc

SEQ ID NO: 1293309 - RNA, 22 nt, Mycobacterium tuberculosis H37Rv
gacgguggcgcugauccggucg

SEQ ID NO: 1293310 - RNA, 23 nt, Mycobacterium tuberculosis H37Rv
gacgguccgcuacggcguccaag

SEQ ID NO: 1293311 - RNA, 14 nt, Mycobacterium tuberculosis H37Rv
gacggucauccggc

SEQ ID NO: 1293312 - RNA, 15 nt, Mycobacterium tuberculosis H37Rv
gacggucccggcacg

SEQ ID NO: 1293313 - RNA, 21 nt, Mycobacterium tuberculosis H37Rv
gacgguguugcucgccgucgu

SEQ ID NO: 1293314 - RNA, 20 nt, Mycobacterium tuberculosis H37Rv
gacggugucagccgucgcca

SEQ ID NO: 1293315 - RNA, 17 nt, Mycobacterium tuberculosis H37Rv
gacggucgucgaucacg

SEQ ID NO: 1293316 - RNA, 23 nt, Mycobacterium tuberculosis H37Rv
gacgguguaacugcguuggcgac

SEQ ID NO: 1293317 - RNA, 22 nt, Mycobacterium tuberculosis H37Rv
gacgguggggucgccgucgaac

SEQ ID NO: 1293318 - RNA, 13 nt, Mycobacterium tuberculosis H37Rv
gacgguggugacg

SEQ ID NO: 1293319 - RNA, 16 nt, Mycobacterium tuberculosis H37Rv
gacguuaccgaccgcg

SEQ ID NO: 1293320 - RNA, 18 nt, Mycobacterium tuberculosis H37Rv
gacguggacuuugguguc

SEQ ID NO: 1293321 - RNA, 20 nt, Mycobacterium tuberculosis H37Rv
gacguggcugcguucgccgg

SEQ ID NO: 1293322 - RNA, 21 nt, Mycobacterium tuberculosis H37Rv
gacguuagcauugaguucggc

SEQ ID NO: 1293323 - RNA, 23 nt, Mycobacterium tuberculosis H37Rv
gacguucaucuucaccacgccgu

SEQ ID NO: 1293324 - RNA, 17 nt, Mycobacterium tuberculosis H37Rv
gacguucgggucgagcc

SEQ ID NO: 1293325 - RNA, 14 nt, Mycobacterium tuberculosis H37Rv
gacguugaucgcca

SEQ ID NO: 1293326 - RNA, 23 nt, Mycobacterium tuberculosis H37Rv
gacguugccgaagccggaugcgc

SEQ ID NO: 1293327 - RNA, 18 nt, Mycobacterium tuberculosis H37Rv
gacguuguccaccgccac

SEQ ID NO: 1293328 - RNA, 22 nt, Mycobacterium tuberculosis H37Rv
gacguugucgccaacccgguug

SEQ ID NO: 1293329 - RNA, 12 nt, Mycobacterium tuberculosis H37Rv
gacguuguccac

SEQ ID NO: 1293330 - RNA, 20 nt, Mycobacterium tuberculosis H37Rv
gacguuguagauucccgaga

SEQ ID NO: 1293331 - RNA, 16 nt, Mycobacterium tuberculosis H37Rv
gacgucggccgcaucg

SEQ ID NO: 1293332 - RNA, 22 nt, Mycobacterium tuberculosis H37Rv
gacgucuuggaacacggccgga

SEQ ID NO: 1293333 - RNA, 22 nt, Mycobacterium tuberculosis H37Rv
gacgucgcggcgccugaggugc

SEQ ID NO: 1293334 - RNA, 14 nt, Mycobacterium tuberculosis H37Rv
gacgucggaccagc

SEQ ID NO: 1293335 - RNA, 23 nt, Mycobacterium tuberculosis H37Rv
gacgucgcuagaucccaguccga

SEQ ID NO: 1293336 - RNA, 14 nt, Mycobacterium tuberculosis H37Rv
gacgucggcaucgg

SEQ ID NO: 1293337 - RNA, 18 nt, Mycobacterium tuberculosis H37Rv
gacgucggcaaucucgau

SEQ ID NO: 1293338 - RNA, 17 nt, Mycobacterium tuberculosis H37Rv
gacguaccacggcgauc

SEQ ID NO: 1293339 - RNA, 15 nt, Mycobacterium tuberculosis H37Rv
gacgguucggucggg

SEQ ID NO: 1293340 - RNA, 14 nt, Mycobacterium tuberculosis H37Rv
gacgguuccggucg

SEQ ID NO: 1293341 - RNA, 18 nt, Mycobacterium tuberculosis H37Rv
gacgguugguccgccguc

SEQ ID NO: 1293342 - RNA, 16 nt, Mycobacterium tuberculosis H37Rv
gacgguuucgaccacc

SEQ ID NO: 1293343 - RNA, 12 nt, Mycobacterium tuberculosis H37Rv
gacgucgccgac

SEQ ID NO: 1293344 - RNA, 16 nt, Mycobacterium tuberculosis H37Rv
gacguagacgacgucg

SEQ ID NO: 1293345 - RNA, 18 nt, Mycobacterium tuberculosis H37Rv
gacguagacgacgucggc

SEQ ID NO: 1293346 - RNA, 20 nt, Mycobacterium tuberculosis H37Rv
gagcacgcgcggcgucgugg

SEQ ID NO: 1293347 - RNA, 20 nt, Mycobacterium tuberculosis H37Rv
gagcaccucuaccguggcac

SEQ ID NO: 1293348 - RNA, 20 nt, Mycobacterium tuberculosis H37Rv
gagcacgggcucgcugcacc

SEQ ID NO: 1293349 - RNA, 16 nt, Mycobacterium tuberculosis H37Rv
gagcacuccgucguag

SEQ ID NO: 1293350 - RNA, 21 nt, Mycobacterium tuberculosis H37Rv
gagcagacacuaaagcccucg

SEQ ID NO: 1293351 - RNA, 14 nt, Mycobacterium tuberculosis H37Rv
gagcacgucaacag

SEQ ID NO: 1293352 - RNA, 16 nt, Mycobacterium tuberculosis H37Rv
gagcacugccaguagu

SEQ ID NO: 1293353 - RNA, 21 nt, Mycobacterium tuberculosis H37Rv
gagcagacgcaaaaucgccca

SEQ ID NO: 1293354 - RNA, 22 nt, Mycobacterium tuberculosis H37Rv
gagcaccuccagauacaggaac

SEQ ID NO: 1293355 - RNA, 14 nt, Mycobacterium tuberculosis H37Rv
gagcaccgaccagg

SEQ ID NO: 1293356 - RNA, 22 nt, Mycobacterium tuberculosis H37Rv
gagcacacguccggcgaugacc

SEQ ID NO: 1293357 - RNA, 20 nt, Mycobacterium tuberculosis H37Rv
gagcaccaccccagcggcca

SEQ ID NO: 1293358 - RNA, 19 nt, Mycobacterium tuberculosis H37Rv
gagaucguagggacgccga

SEQ ID NO: 1293359 - RNA, 14 nt, Mycobacterium tuberculosis H37Rv
gagaugcguuccgc

SEQ ID NO: 1293360 - RNA, 17 nt, Mycobacterium tuberculosis H37Rv
gagaugcguuccgcgac

SEQ ID NO: 1293361 - RNA, 14 nt, Mycobacterium tuberculosis H37Rv
gagaucgcggcgac

SEQ ID NO: 1293362 - RNA, 21 nt, Mycobacterium tuberculosis H37Rv
gagauuucuugaccgcgguga

SEQ ID NO: 1293363 - RNA, 16 nt, Mycobacterium tuberculosis H37Rv
gagcacaccgucgucg

SEQ ID NO: 1293364 - RNA, 16 nt, Mycobacterium tuberculosis H37Rv
gagcaauuccacgauc

SEQ ID NO: 1293365 - RNA, 13 nt, Mycobacterium tuberculosis H37Rv
gagacaugccggc

SEQ ID NO: 1293366 - RNA, 17 nt, Mycobacterium tuberculosis H37Rv
gagacgcacggccaccg

SEQ ID NO: 1293367 - RNA, 17 nt, Mycobacterium tuberculosis H37Rv
gagaccaugccgacgac

SEQ ID NO: 1293368 - RNA, 23 nt, Mycobacterium tuberculosis H37Rv
gagacgaccuccucgaugaccgg

SEQ ID NO: 1293369 - RNA, 16 nt, Mycobacterium tuberculosis H37Rv
gagaccggccggguga

SEQ ID NO: 1293370 - RNA, 15 nt, Mycobacterium tuberculosis H37Rv
gagaaguucgugagc

SEQ ID NO: 1293371 - RNA, 17 nt, Mycobacterium tuberculosis H37Rv
gagaacggcgggcgauu

SEQ ID NO: 1293372 - RNA, 13 nt, Mycobacterium tuberculosis H37Rv
gagaacgaugucc

SEQ ID NO: 1293373 - RNA, 21 nt, Mycobacterium tuberculosis H37Rv
gagacgguguugcucgccguc

SEQ ID NO: 1293374 - RNA, 22 nt, Mycobacterium tuberculosis H37Rv
gagacgccgucgacgucgaugg

SEQ ID NO: 1293375 - RNA, 13 nt, Mycobacterium tuberculosis H37Rv
gagacgaucgcca

SEQ ID NO: 1293376 - RNA, 14 nt, Mycobacterium tuberculosis H37Rv
gagacucgcucgga

SEQ ID NO: 1293377 - RNA, 15 nt, Mycobacterium tuberculosis H37Rv
gagacguuuugcggc

SEQ ID NO: 1293378 - RNA, 16 nt, Mycobacterium tuberculosis H37Rv
gagagauggucgggcg

SEQ ID NO: 1293379 - RNA, 18 nt, Mycobacterium tuberculosis H37Rv
gagagcagcacgucugcg

SEQ ID NO: 1293380 - RNA, 20 nt, Mycobacterium tuberculosis H37Rv
gagagccggcggcgaccaga

SEQ ID NO: 1293381 - RNA, 14 nt, Mycobacterium tuberculosis H37Rv
gagagccucggcca

SEQ ID NO: 1293382 - RNA, 19 nt, Mycobacterium tuberculosis H37Rv
gagagcaugcgggagguuu

SEQ ID NO: 1293383 - RNA, 15 nt, Mycobacterium tuberculosis H37Rv
gagaggugcugcacc

SEQ ID NO: 1293384 - RNA, 15 nt, Mycobacterium tuberculosis H37Rv
gagagccucggccau

SEQ ID NO: 1293385 - RNA, 22 nt, Mycobacterium tuberculosis H37Rv
gacuccgguguaguacagcgca

SEQ ID NO: 1293386 - RNA, 16 nt, Mycobacterium tuberculosis H37Rv
gacuccguaccggguu

SEQ ID NO: 1293387 - RNA, 16 nt, Mycobacterium tuberculosis H37Rv
gacuccugcggcaccg

SEQ ID NO: 1293388 - RNA, 19 nt, Mycobacterium tuberculosis H37Rv
gacuccugcggcaccgcug

SEQ ID NO: 1293389 - RNA, 18 nt, Mycobacterium tuberculosis H37Rv
gacucaucaccgauggca

SEQ ID NO: 1293390 - RNA, 20 nt, Mycobacterium tuberculosis H37Rv
gacucaucggcgugcuugcc

SEQ ID NO: 1293391 - RNA, 22 nt, Mycobacterium tuberculosis H37Rv
gacuccagcaaggccagcacgg

SEQ ID NO: 1293392 - RNA, 13 nt, Mycobacterium tuberculosis H37Rv
gacucacgaggca

SEQ ID NO: 1293393 - RNA, 15 nt, Mycobacterium tuberculosis H37Rv
gacuagcugggguca

SEQ ID NO: 1293394 - RNA, 24 nt, Mycobacterium tuberculosis H37Rv
gacguuucagccgggugccacaac

SEQ ID NO: 1293395 - RNA, 15 nt, Mycobacterium tuberculosis H37Rv
gacuaccaccgcguu

SEQ ID NO: 1293396 - RNA, 15 nt, Mycobacterium tuberculosis H37Rv
gacucggugcgguga

SEQ ID NO: 1293397 - RNA, 17 nt, Mycobacterium tuberculosis H37Rv
gacucggccucuagcuu

SEQ ID NO: 1293398 - RNA, 22 nt, Mycobacterium tuberculosis H37Rv
gacucgccacauuucaccaccg

SEQ ID NO: 1293399 - RNA, 17 nt, Mycobacterium tuberculosis H37Rv
gacucggccgcaccagc

SEQ ID NO: 1293400 - RNA, 16 nt, Mycobacterium tuberculosis H37Rv
gacucgaucaccauga

SEQ ID NO: 1293401 - RNA, 21 nt, Mycobacterium tuberculosis H37Rv
gacucgcaauugcucguagcc

SEQ ID NO: 1293402 - RNA, 18 nt, Mycobacterium tuberculosis H37Rv
gacucgaccgcgacggca

SEQ ID NO: 1293403 - RNA, 20 nt, Mycobacterium tuberculosis H37Rv
gacucugcguccaccacgca

SEQ ID NO: 1293404 - RNA, 16 nt, Mycobacterium tuberculosis H37Rv
gacugaacgucaccgu

SEQ ID NO: 1293405 - RNA, 20 nt, Mycobacterium tuberculosis H37Rv
gacugaucaagugccagcgu

SEQ ID NO: 1293406 - RNA, 18 nt, Mycobacterium tuberculosis H37Rv
gacugcagcccugcgcag

SEQ ID NO: 1293407 - RNA, 17 nt, Mycobacterium tuberculosis H37Rv
gacugcagcccugcgca

SEQ ID NO: 1293408 - RNA, 14 nt, Mycobacterium tuberculosis H37Rv
gacuggcaggccgg

SEQ ID NO: 1293409 - RNA, 20 nt, Mycobacterium tuberculosis H37Rv
gacuggcaggccggcgucga

SEQ ID NO: 1293410 - RNA, 15 nt, Mycobacterium tuberculosis H37Rv
gacugcggcccgacc

SEQ ID NO: 1293411 - RNA, 18 nt, Mycobacterium tuberculosis H37Rv
gacugcggauaggugccg

SEQ ID NO: 1293412 - RNA, 12 nt, Mycobacterium tuberculosis H37Rv
gacugcgcggcu

SEQ ID NO: 1293413 - RNA, 14 nt, Mycobacterium tuberculosis H37Rv
gacugcagugccgu

SEQ ID NO: 1293414 - RNA, 15 nt, Mycobacterium tuberculosis H37Rv
gacugcagcgccucg

SEQ ID NO: 1293415 - RNA, 13 nt, Mycobacterium tuberculosis H37Rv
gacugcagcggcg

SEQ ID NO: 1293416 - RNA, 16 nt, Mycobacterium tuberculosis H37Rv
gacuggaccgcgguga

SEQ ID NO: 1293417 - RNA, 16 nt, Mycobacterium tuberculosis H37Rv
gacuggccguuucggc

SEQ ID NO: 1293418 - RNA, 17 nt, Mycobacterium tuberculosis H37Rv
gacuggccgcccggcga

SEQ ID NO: 1293419 - RNA, 15 nt, Mycobacterium tuberculosis H37Rv
gacugugcgccgcag

SEQ ID NO: 1293420 - RNA, 20 nt, Mycobacterium tuberculosis H37Rv
gacugugaaucugacgacgc

SEQ ID NO: 1293421 - RNA, 10 nt, Mycobacterium tuberculosis H37Rv
gacuguccca

SEQ ID NO: 1293422 - RNA, 17 nt, Mycobacterium tuberculosis H37Rv
gacugucccaccaggua

SEQ ID NO: 1293423 - RNA, 18 nt, Mycobacterium tuberculosis H37Rv
gacugugaaucugacgac

SEQ ID NO: 1293424 - RNA, 15 nt, Mycobacterium tuberculosis H37Rv
gacuuauccggccag

SEQ ID NO: 1293425 - RNA, 21 nt, Mycobacterium tuberculosis H37Rv
gacuucagcaggcccagcgga

SEQ ID NO: 1293426 - RNA, 18 nt, Mycobacterium tuberculosis H37Rv
gacuucgauggugugccc

SEQ ID NO: 1293427 - RNA, 17 nt, Mycobacterium tuberculosis H37Rv
gacuucguggccuugac

SEQ ID NO: 1293428 - RNA, 15 nt, Mycobacterium tuberculosis H37Rv
gacuugugccacuuc

SEQ ID NO: 1293429 - RNA, 18 nt, Mycobacterium tuberculosis H37Rv
gacuuggggcguuucggc

SEQ ID NO: 1293430 - RNA, 17 nt, Mycobacterium tuberculosis H37Rv
gacuuggccagcagccg

SEQ ID NO: 1293431 - RNA, 17 nt, Mycobacterium tuberculosis H37Rv
gacuuugggucggcgau

SEQ ID NO: 1293432 - RNA, 19 nt, Mycobacterium tuberculosis H37Rv
gagaacacguucggcgucg

SEQ ID NO: 1293433 - RNA, 19 nt, Mycobacterium tuberculosis H37Rv
cguccagcgaucccgguga

SEQ ID NO: 1293434 - RNA, 19 nt, Mycobacterium tuberculosis H37Rv
cguccagcccagauccagc

SEQ ID NO: 1293435 - RNA, 21 nt, Mycobacterium tuberculosis H37Rv
cguccagcccguccaggcgcu

SEQ ID NO: 1293436 - RNA, 12 nt, Mycobacterium tuberculosis H37Rv
cguccagcagga

SEQ ID NO: 1293437 - RNA, 15 nt, Mycobacterium tuberculosis H37Rv
cguccaggucaugcc

SEQ ID NO: 1293438 - RNA, 22 nt, Mycobacterium tuberculosis H37Rv
cguccaucagagacagcagcgu

SEQ ID NO: 1293439 - RNA, 13 nt, Mycobacterium tuberculosis H37Rv
cguccaucgccac

SEQ ID NO: 1293440 - RNA, 21 nt, Mycobacterium tuberculosis H37Rv
cgucccaguguucgacgaggu

SEQ ID NO: 1293441 - RNA, 17 nt, Mycobacterium tuberculosis H37Rv
cguccccggcguccgac

SEQ ID NO: 1293442 - RNA, 24 nt, Mycobacterium tuberculosis H37Rv
cgucccgcauaccuaacgagccgu

SEQ ID NO: 1293443 - RNA, 12 nt, Mycobacterium tuberculosis H37Rv
cguccccgacgu

SEQ ID NO: 1293444 - RNA, 19 nt, Mycobacterium tuberculosis H37Rv
cgucccgaaccgaucauca

SEQ ID NO: 1293445 - RNA, 18 nt, Mycobacterium tuberculosis H37Rv
cgucccgaaacgccgggu

SEQ ID NO: 1293446 - RNA, 19 nt, Mycobacterium tuberculosis H37Rv
cguccgaccgguacccgua

SEQ ID NO: 1293447 - RNA, 13 nt, Mycobacterium tuberculosis H37Rv
cguccgaccaggg

SEQ ID NO: 1293448 - RNA, 15 nt, Mycobacterium tuberculosis H37Rv
cguccgaucggcgcg

SEQ ID NO: 1293449 - RNA, 14 nt, Mycobacterium tuberculosis H37Rv
cguccgcaccggcg

SEQ ID NO: 1293450 - RNA, 22 nt, Mycobacterium tuberculosis H37Rv
cguccgcggacuuggcggucgg

SEQ ID NO: 1293451 - RNA, 18 nt, Mycobacterium tuberculosis H37Rv
cguccgcgaucugcagcg

SEQ ID NO: 1293452 - RNA, 18 nt, Mycobacterium tuberculosis H37Rv
cgucaucgucggcggauu

SEQ ID NO: 1293453 - RNA, 21 nt, Mycobacterium tuberculosis H37Rv
cgucaucgaguaacaccccga

SEQ ID NO: 1293454 - RNA, 22 nt, Mycobacterium tuberculosis H37Rv
cgucaucugguggaccuccgga

SEQ ID NO: 1293455 - RNA, 17 nt, Mycobacterium tuberculosis H37Rv
cgucaucuccgacucga

SEQ ID NO: 1293456 - RNA, 16 nt, Mycobacterium tuberculosis H37Rv
cgucauccuggucacc

SEQ ID NO: 1293457 - RNA, 17 nt, Mycobacterium tuberculosis H37Rv
cgucauccuggucacca

SEQ ID NO: 1293458 - RNA, 16 nt, Mycobacterium tuberculosis H37Rv
cgucagcccgacguug

SEQ ID NO: 1293459 - RNA, 19 nt, Mycobacterium tuberculosis H37Rv
cgucagcccgauacgggug

SEQ ID NO: 1293460 - RNA, 14 nt, Mycobacterium tuberculosis H37Rv
cgucagccguucgg

SEQ ID NO: 1293461 - RNA, 16 nt, Mycobacterium tuberculosis H37Rv
cguccacccacgauca

SEQ ID NO: 1293462 - RNA, 21 nt, Mycobacterium tuberculosis H37Rv
cguccacccacgaucagcagc

SEQ ID NO: 1293463 - RNA, 13 nt, Mycobacterium tuberculosis H37Rv
cguccaccgacgu

SEQ ID NO: 1293464 - RNA, 22 nt, Mycobacterium tuberculosis H37Rv
cguccacgugagugccggcgug

SEQ ID NO: 1293465 - RNA, 21 nt, Mycobacterium tuberculosis H37Rv
cguccacgaccccggcgguac

SEQ ID NO: 1293466 - RNA, 21 nt, Mycobacterium tuberculosis H37Rv
cguccaagccguagaccaggc

SEQ ID NO: 1293467 - RNA, 22 nt, Mycobacterium tuberculosis H37Rv
cgucaugcccaucuccaacagg

SEQ ID NO: 1293468 - RNA, 17 nt, Mycobacterium tuberculosis H37Rv
cgucauggcccgaucga

SEQ ID NO: 1293469 - RNA, 18 nt, Mycobacterium tuberculosis H37Rv
cguccgcgggggaccgcc

SEQ ID NO: 1293470 - RNA, 17 nt, Mycobacterium tuberculosis H37Rv
cguccgcggucgcagca

SEQ ID NO: 1293471 - RNA, 16 nt, Mycobacterium tuberculosis H37Rv
cguccgcggagcucaa

SEQ ID NO: 1293472 - RNA, 20 nt, Mycobacterium tuberculosis H37Rv
cguccgggucgacgcgauga

SEQ ID NO: 1293473 - RNA, 16 nt, Mycobacterium tuberculosis H37Rv
cguccgguggaccgcc

SEQ ID NO: 1293474 - RNA, 19 nt, Mycobacterium tuberculosis H37Rv
cguccgguggaccgccgau

SEQ ID NO: 1293475 - RNA, 22 nt, Mycobacterium tuberculosis H37Rv
cgucgaccacaggcaucggagg

SEQ ID NO: 1293476 - RNA, 14 nt, Mycobacterium tuberculosis H37Rv
cgucgacaccgagg

SEQ ID NO: 1293477 - RNA, 14 nt, Mycobacterium tuberculosis H37Rv
cgucgacacgguga

SEQ ID NO: 1293478 - RNA, 13 nt, Mycobacterium tuberculosis H37Rv
cgucgacaccgag

SEQ ID NO: 1293479 - RNA, 17 nt, Mycobacterium tuberculosis H37Rv
cgucgacagcgucucgc

SEQ ID NO: 1293480 - RNA, 21 nt, Mycobacterium tuberculosis H37Rv
cgucgacagucaacagggcca

SEQ ID NO: 1293481 - RNA, 17 nt, Mycobacterium tuberculosis H37Rv
cgucgaaccagucgaag

SEQ ID NO: 1293482 - RNA, 19 nt, Mycobacterium tuberculosis H37Rv
cgucgaacgguagcacggu

SEQ ID NO: 1293483 - RNA, 17 nt, Mycobacterium tuberculosis H37Rv
cgucgaacuucagcggc

SEQ ID NO: 1293484 - RNA, 18 nt, Mycobacterium tuberculosis H37Rv
cgucgaacuuugucgcgc

SEQ ID NO: 1293485 - RNA, 13 nt, Mycobacterium tuberculosis H37Rv
cgucgaagacggc

SEQ ID NO: 1293486 - RNA, 21 nt, Mycobacterium tuberculosis H37Rv
cgucgaacauggcacgcggga

SEQ ID NO: 1293487 - RNA, 23 nt, Mycobacterium tuberculosis H37Rv
cgucgaaccagaggucacgcagc

SEQ ID NO: 1293488 - RNA, 14 nt, Mycobacterium tuberculosis H37Rv
cgucgacgaucagc

SEQ ID NO: 1293489 - RNA, 18 nt, Mycobacterium tuberculosis H37Rv
cgucgacgccggccagcg

SEQ ID NO: 1293490 - RNA, 18 nt, Mycobacterium tuberculosis H37Rv
cgucgacgccgaucgcgg

SEQ ID NO: 1293491 - RNA, 20 nt, Mycobacterium tuberculosis H37Rv
cgucgacgcgggagucaucg

SEQ ID NO: 1293492 - RNA, 13 nt, Mycobacterium tuberculosis H37Rv
cgucgacgcguug

SEQ ID NO: 1293493 - RNA, 15 nt, Mycobacterium tuberculosis H37Rv
cgucgacgcgguccu

SEQ ID NO: 1293494 - RNA, 14 nt, Mycobacterium tuberculosis H37Rv
cgucgacggcgaug

SEQ ID NO: 1293495 - RNA, 18 nt, Mycobacterium tuberculosis H37Rv
cgucgagagguucgccgu

SEQ ID NO: 1293496 - RNA, 17 nt, Mycobacterium tuberculosis H37Rv
cgucgagauagccgacg

SEQ ID NO: 1293497 - RNA, 14 nt, Mycobacterium tuberculosis H37Rv
cgucgagacuucgg

SEQ ID NO: 1293498 - RNA, 21 nt, Mycobacterium tuberculosis H37Rv
cgucgagacuucgguguagcc

SEQ ID NO: 1293499 - RNA, 15 nt, Mycobacterium tuberculosis H37Rv
cgucgacggcgaugg

SEQ ID NO: 1293500 - RNA, 18 nt, Mycobacterium tuberculosis H37Rv
cgucgagcacguccucga

SEQ ID NO: 1293501 - RNA, 21 nt, Mycobacterium tuberculosis H37Rv
cgucgacccaccaugugcgac

SEQ ID NO: 1293502 - RNA, 18 nt, Mycobacterium tuberculosis H37Rv
cgucgagcaccacccggg

SEQ ID NO: 1293503 - RNA, 18 nt, Mycobacterium tuberculosis H37Rv
cgucgagauagccgacgu

SEQ ID NO: 1293504 - RNA, 23 nt, Mycobacterium tuberculosis H37Rv
cgucgaggcacgagccaucgucg

SEQ ID NO: 1293505 - RNA, 16 nt, Mycobacterium tuberculosis H37Rv
cgucgaggcugaccgu

SEQ ID NO: 1293506 - RNA, 18 nt, Mycobacterium tuberculosis H37Rv
cgucgaggcugaccgugg

SEQ ID NO: 1293507 - RNA, 18 nt, Mycobacterium tuberculosis H37Rv
cgucgccauuccaucgcg

SEQ ID NO: 1293508 - RNA, 21 nt, Mycobacterium tuberculosis H37Rv
cgucgcccagugcgcaaccca

SEQ ID NO: 1293509 - RNA, 20 nt, Mycobacterium tuberculosis H37Rv
cgucgcccgcauugaucucg

SEQ ID NO: 1293510 - RNA, 23 nt, Mycobacterium tuberculosis H37Rv
cgucgccgaaguuccagccgacg

SEQ ID NO: 1293511 - RNA, 14 nt, Mycobacterium tuberculosis H37Rv
cgucgccggccuug

SEQ ID NO: 1293512 - RNA, 15 nt, Mycobacterium tuberculosis H37Rv
cgucgccgccgguga

SEQ ID NO: 1293513 - RNA, 23 nt, Mycobacterium tuberculosis H37Rv
cgucgcgggaaaacgggguggca

SEQ ID NO: 1293514 - RNA, 17 nt, Mycobacterium tuberculosis H37Rv
cgucgccggcggcggug

SEQ ID NO: 1293515 - RNA, 15 nt, Mycobacterium tuberculosis H37Rv
cgucgaugcgcugcu

SEQ ID NO: 1293516 - RNA, 14 nt, Mycobacterium tuberculosis H37Rv
cgucgaugccggug

SEQ ID NO: 1293517 - RNA, 15 nt, Mycobacterium tuberculosis H37Rv
cgucgauuucgacga

SEQ ID NO: 1293518 - RNA, 22 nt, Mycobacterium tuberculosis H37Rv
cgucgaucagaacgugacgguc

SEQ ID NO: 1293519 - RNA, 16 nt, Mycobacterium tuberculosis H37Rv
cgucgauagucgccgu

SEQ ID NO: 1293520 - RNA, 14 nt, Mycobacterium tuberculosis H37Rv
cgucgagucgccga

SEQ ID NO: 1293521 - RNA, 19 nt, Mycobacterium tuberculosis H37Rv
cgucgaguuuugcggccag

SEQ ID NO: 1293522 - RNA, 16 nt, Mycobacterium tuberculosis H37Rv
cgucgagguccucgag

SEQ ID NO: 1293523 - RNA, 21 nt, Mycobacterium tuberculosis H37Rv
cgucgagguuuuucgaugggu

SEQ ID NO: 1293524 - RNA, 15 nt, Mycobacterium tuberculosis H37Rv
cgucgagucgacaag

SEQ ID NO: 1293525 - RNA, 14 nt, Mycobacterium tuberculosis H37Rv
cgucgagucgacgg

SEQ ID NO: 1293526 - RNA, 14 nt, Mycobacterium tuberculosis H37Rv
cguauggacgagga

SEQ ID NO: 1293527 - RNA, 18 nt, Mycobacterium tuberculosis H37Rv
cguaguaaugcucgacgu

SEQ ID NO: 1293528 - RNA, 13 nt, Mycobacterium tuberculosis H37Rv
cguaggcgcugaa

SEQ ID NO: 1293529 - RNA, 22 nt, Mycobacterium tuberculosis H37Rv
cguauuucguccacgaccccgg

SEQ ID NO: 1293530 - RNA, 14 nt, Mycobacterium tuberculosis H37Rv
cgucaacagcgugg

SEQ ID NO: 1293531 - RNA, 23 nt, Mycobacterium tuberculosis H37Rv
cgucaacaccaugguggugaugc

SEQ ID NO: 1293532 - RNA, 20 nt, Mycobacterium tuberculosis H37Rv
cgucaaauccagcgagguga

SEQ ID NO: 1293533 - RNA, 20 nt, Mycobacterium tuberculosis H37Rv
cgucaacgacuggguggugc

SEQ ID NO: 1293534 - RNA, 24 nt, Mycobacterium tuberculosis H37Rv
cgucaaccaccaggagcggauagc

SEQ ID NO: 1293535 - RNA, 17 nt, Mycobacterium tuberculosis H37Rv
cgucaaacccgacaucg

SEQ ID NO: 1293536 - RNA, 14 nt, Mycobacterium tuberculosis H37Rv
cgucaccaucgggu

SEQ ID NO: 1293537 - RNA, 14 nt, Mycobacterium tuberculosis H37Rv
cgucaccacgaucg

SEQ ID NO: 1293538 - RNA, 15 nt, Mycobacterium tuberculosis H37Rv
cgucaccacgagggc

SEQ ID NO: 1293539 - RNA, 12 nt, Mycobacterium tuberculosis H37Rv
cgucaccgccga

SEQ ID NO: 1293540 - RNA, 17 nt, Mycobacterium tuberculosis H37Rv
cgucaccgccauugcca

SEQ ID NO: 1293541 - RNA, 12 nt, Mycobacterium tuberculosis H37Rv
cgucaccgccgu

SEQ ID NO: 1293542 - RNA, 13 nt, Mycobacterium tuberculosis H37Rv
cgucacccgcaac

SEQ ID NO: 1293543 - RNA, 20 nt, Mycobacterium tuberculosis H37Rv
cgucaccccggucccgccga

SEQ ID NO: 1293544 - RNA, 14 nt, Mycobacterium tuberculosis H37Rv
cgucacccgguguc

SEQ ID NO: 1293545 - RNA, 22 nt, Mycobacterium tuberculosis H37Rv
cgucagcaugggaauccgcugu

SEQ ID NO: 1293546 - RNA, 17 nt, Mycobacterium tuberculosis H37Rv
cgucagcagcaacggau

SEQ ID NO: 1293547 - RNA, 23 nt, Mycobacterium tuberculosis H37Rv
cgucacggaggccuccacauacg

SEQ ID NO: 1293548 - RNA, 16 nt, Mycobacterium tuberculosis H37Rv
cgucacgccaccgcaa

SEQ ID NO: 1293549 - RNA, 20 nt, Mycobacterium tuberculosis H37Rv
cguagcgaagugcgcgcugg

SEQ ID NO: 1293550 - RNA, 15 nt, Mycobacterium tuberculosis H37Rv
cguagaggacugcgg

SEQ ID NO: 1293551 - RNA, 17 nt, Mycobacterium tuberculosis H37Rv
cguagagccgcucggcg

SEQ ID NO: 1293552 - RNA, 19 nt, Mycobacterium tuberculosis H37Rv
cguagcuggcgaucugguc

SEQ ID NO: 1293553 - RNA, 20 nt, Mycobacterium tuberculosis H37Rv
cguagcgggucagcucgacc

SEQ ID NO: 1293554 - RNA, 15 nt, Mycobacterium tuberculosis H37Rv
cguagcugcgcagcg

SEQ ID NO: 1293555 - RNA, 18 nt, Mycobacterium tuberculosis H37Rv
cguagcgggucagcucga

SEQ ID NO: 1293556 - RNA, 22 nt, Mycobacterium tuberculosis H37Rv
cguagcggucugugcugcgcug

SEQ ID NO: 1293557 - RNA, 20 nt, Mycobacterium tuberculosis H37Rv
cguagcgggggagcgaacgg

SEQ ID NO: 1293558 - RNA, 17 nt, Mycobacterium tuberculosis H37Rv
cguagcgcggccgauac

SEQ ID NO: 1293559 - RNA, 16 nt, Mycobacterium tuberculosis H37Rv
cguacuccaccgcgcc

SEQ ID NO: 1293560 - RNA, 16 nt, Mycobacterium tuberculosis H37Rv
cguacgacagucgcag

SEQ ID NO: 1293561 - RNA, 20 nt, Mycobacterium tuberculosis H37Rv
cguacgggucggcgacgaac

SEQ ID NO: 1293562 - RNA, 18 nt, Mycobacterium tuberculosis H37Rv
cguagacgacgucggccg

SEQ ID NO: 1293563 - RNA, 20 nt, Mycobacterium tuberculosis H37Rv
cguagacguccgcggucgca

SEQ ID NO: 1293564 - RNA, 22 nt, Mycobacterium tuberculosis H37Rv
cguacucggugaucgcgguggc

SEQ ID NO: 1293565 - RNA, 12 nt, Mycobacterium tuberculosis H37Rv
cguacucggcgc

SEQ ID NO: 1293566 - RNA, 21 nt, Mycobacterium tuberculosis H37Rv
cguaccguucgggccguccuc

SEQ ID NO: 1293567 - RNA, 20 nt, Mycobacterium tuberculosis H37Rv
cguaccuaaggcucaccagg

SEQ ID NO: 1293568 - RNA, 17 nt, Mycobacterium tuberculosis H37Rv
cguaccuaaggcucacc

SEQ ID NO: 1293569 - RNA, 16 nt, Mycobacterium tuberculosis H37Rv
cguacgccggacccgg

SEQ ID NO: 1293570 - RNA, 15 nt, Mycobacterium tuberculosis H37Rv
cguaccgcgcguugu

SEQ ID NO: 1293571 - RNA, 13 nt, Mycobacterium tuberculosis H37Rv
cguaccgauucca

SEQ ID NO: 1293572 - RNA, 15 nt, Mycobacterium tuberculosis H37Rv
cggugucgucgacca

SEQ ID NO: 1293573 - RNA, 15 nt, Mycobacterium tuberculosis H37Rv
cgguguuagccccga

SEQ ID NO: 1293574 - RNA, 15 nt, Mycobacterium tuberculosis H37Rv
cggugucgucgaggu

SEQ ID NO: 1293575 - RNA, 21 nt, Mycobacterium tuberculosis H37Rv
cggugucucccuugccgccau

SEQ ID NO: 1293576 - RNA, 15 nt, Mycobacterium tuberculosis H37Rv
cggugucugaaccgc

SEQ ID NO: 1293577 - RNA, 13 nt, Mycobacterium tuberculosis H37Rv
cggugucugggug

SEQ ID NO: 1293578 - RNA, 13 nt, Mycobacterium tuberculosis H37Rv
cgguguguucggc

SEQ ID NO: 1293579 - RNA, 15 nt, Mycobacterium tuberculosis H37Rv
cgguguugagaucgc

SEQ ID NO: 1293580 - RNA, 18 nt, Mycobacterium tuberculosis H37Rv
cgguguugccgaagcccg

SEQ ID NO: 1293581 - RNA, 21 nt, Mycobacterium tuberculosis H37Rv
cgguguuggacacucccgggu

SEQ ID NO: 1293582 - RNA, 22 nt, Mycobacterium tuberculosis H37Rv
cgguguugcucccggccgccga

SEQ ID NO: 1293583 - RNA, 20 nt, Mycobacterium tuberculosis H37Rv
cgguguugccggagacgucg

SEQ ID NO: 1293584 - RNA, 15 nt, Mycobacterium tuberculosis H37Rv
cggugucgcgaugcu

SEQ ID NO: 1293585 - RNA, 18 nt, Mycobacterium tuberculosis H37Rv
cggugucgcgcgaccugg

SEQ ID NO: 1293586 - RNA, 19 nt, Mycobacterium tuberculosis H37Rv
cggugucaaaaccguuguc

SEQ ID NO: 1293587 - RNA, 13 nt, Mycobacterium tuberculosis H37Rv
cggugucggugac

SEQ ID NO: 1293588 - RNA, 15 nt, Mycobacterium tuberculosis H37Rv
cggugucggcugguc

SEQ ID NO: 1293589 - RNA, 12 nt, Mycobacterium tuberculosis H37Rv
cggugucgucga

SEQ ID NO: 1293590 - RNA, 13 nt, Mycobacterium tuberculosis H37Rv
cgguguauccgac

SEQ ID NO: 1293591 - RNA, 20 nt, Mycobacterium tuberculosis H37Rv
cgguguauccgacgucggug

SEQ ID NO: 1293592 - RNA, 19 nt, Mycobacterium tuberculosis H37Rv
cgguguagcccagccgggu

SEQ ID NO: 1293593 - RNA, 15 nt, Mycobacterium tuberculosis H37Rv
cgguguagcccaucg

SEQ ID NO: 1293594 - RNA, 17 nt, Mycobacterium tuberculosis H37Rv
cgguguagcagcgccag

SEQ ID NO: 1293595 - RNA, 18 nt, Mycobacterium tuberculosis H37Rv
cgguguagcguucccaca

SEQ ID NO: 1293596 - RNA, 21 nt, Mycobacterium tuberculosis H37Rv
cggugacaagcggcccgcugu

SEQ ID NO: 1293597 - RNA, 19 nt, Mycobacterium tuberculosis H37Rv
cggugacaaauucggcgug

SEQ ID NO: 1293598 - RNA, 22 nt, Mycobacterium tuberculosis H37Rv
cggugacauagacguugccgga

SEQ ID NO: 1293599 - RNA, 18 nt, Mycobacterium tuberculosis H37Rv
cggugaaguagugcucgc

SEQ ID NO: 1293600 - RNA, 20 nt, Mycobacterium tuberculosis H37Rv
cggugaaguagugcucgcag

SEQ ID NO: 1293601 - RNA, 22 nt, Mycobacterium tuberculosis H37Rv
cggugaagccguuugcgcuggc

SEQ ID NO: 1293602 - RNA, 19 nt, Mycobacterium tuberculosis H37Rv
cggugaaggucaccgucga

SEQ ID NO: 1293603 - RNA, 21 nt, Mycobacterium tuberculosis H37Rv
cggugaaggucaccgucgagu

SEQ ID NO: 1293604 - RNA, 14 nt, Mycobacterium tuberculosis H37Rv
cgguggucguaggu

SEQ ID NO: 1293605 - RNA, 14 nt, Mycobacterium tuberculosis H37Rv
cgguggucugcgcg

SEQ ID NO: 1293606 - RNA, 14 nt, Mycobacterium tuberculosis H37Rv
cgguggucggcgcg

SEQ ID NO: 1293607 - RNA, 15 nt, Mycobacterium tuberculosis H37Rv
cgguggugaucacgu

SEQ ID NO: 1293608 - RNA, 19 nt, Mycobacterium tuberculosis H37Rv
cgguggugauugacggugc

SEQ ID NO: 1293609 - RNA, 15 nt, Mycobacterium tuberculosis H37Rv
cgguggugcggucuc

SEQ ID NO: 1293610 - RNA, 18 nt, Mycobacterium tuberculosis H37Rv
cgguguacgcccgcucgg

SEQ ID NO: 1293611 - RNA, 17 nt, Mycobacterium tuberculosis H37Rv
cgguguacgcgaacccu

SEQ ID NO: 1293612 - RNA, 17 nt, Mycobacterium tuberculosis H37Rv
cgguggugcggucuccg

SEQ ID NO: 1293613 - RNA, 16 nt, Mycobacterium tuberculosis H37Rv
cgguggugcucgucgg

SEQ ID NO: 1293614 - RNA, 14 nt, Mycobacterium tuberculosis H37Rv
cgguguacgcccgc

SEQ ID NO: 1293615 - RNA, 21 nt, Mycobacterium tuberculosis H37Rv
cgguugcggucaucggcgcca

SEQ ID NO: 1293616 - RNA, 20 nt, Mycobacterium tuberculosis H37Rv
cgguugcggucaucggcgcc

SEQ ID NO: 1293617 - RNA, 17 nt, Mycobacterium tuberculosis H37Rv
cgguugcggcugcguug

SEQ ID NO: 1293618 - RNA, 23 nt, Mycobacterium tuberculosis H37Rv
cgguuggaccacgugaucgacga

SEQ ID NO: 1293619 - RNA, 18 nt, Mycobacterium tuberculosis H37Rv
cgguuggacugacgucga

SEQ ID NO: 1293620 - RNA, 23 nt, Mycobacterium tuberculosis H37Rv
cgguuggccagccacagccgacc

SEQ ID NO: 1293621 - RNA, 18 nt, Mycobacterium tuberculosis H37Rv
cgguugcugugucguggu

SEQ ID NO: 1293622 - RNA, 22 nt, Mycobacterium tuberculosis H37Rv
cgguuggagguaauccggcugc

SEQ ID NO: 1293623 - RNA, 18 nt, Mycobacterium tuberculosis H37Rv
cgguugaugguccgccag

SEQ ID NO: 1293624 - RNA, 19 nt, Mycobacterium tuberculosis H37Rv
cgguugaugguccgccaga

SEQ ID NO: 1293625 - RNA, 19 nt, Mycobacterium tuberculosis H37Rv
cgguugccacgccgccggu

SEQ ID NO: 1293626 - RNA, 15 nt, Mycobacterium tuberculosis H37Rv
cgguugccauccguc

SEQ ID NO: 1293627 - RNA, 14 nt, Mycobacterium tuberculosis H37Rv
cgguuccacgcugc

SEQ ID NO: 1293628 - RNA, 22 nt, Mycobacterium tuberculosis H37Rv
cgguucagccacgcagcacggc

SEQ ID NO: 1293629 - RNA, 21 nt, Mycobacterium tuberculosis H37Rv
cgguugaugcauccagaagua

SEQ ID NO: 1293630 - RNA, 15 nt, Mycobacterium tuberculosis H37Rv
cgguugaugcaucca

SEQ ID NO: 1293631 - RNA, 14 nt, Mycobacterium tuberculosis H37Rv
cgguugaucggcca

SEQ ID NO: 1293632 - RNA, 17 nt, Mycobacterium tuberculosis H37Rv
cgguugaucuccucgau

SEQ ID NO: 1293633 - RNA, 19 nt, Mycobacterium tuberculosis H37Rv
cgguugaucgccggccugc

SEQ ID NO: 1293634 - RNA, 13 nt, Mycobacterium tuberculosis H37Rv
cgguucagcugcg

SEQ ID NO: 1293635 - RNA, 13 nt, Mycobacterium tuberculosis H37Rv
cguaacgccgcuc

SEQ ID NO: 1293636 - RNA, 16 nt, Mycobacterium tuberculosis H37Rv
cguaacgccgcgguga

SEQ ID NO: 1293637 - RNA, 23 nt, Mycobacterium tuberculosis H37Rv
cgguuguggcugaucccggccag

SEQ ID NO: 1293638 - RNA, 21 nt, Mycobacterium tuberculosis H37Rv
cgguuguggucagcugcugcc

SEQ ID NO: 1293639 - RNA, 22 nt, Mycobacterium tuberculosis H37Rv
cgguuguuguagaucugcgcca

SEQ ID NO: 1293640 - RNA, 13 nt, Mycobacterium tuberculosis H37Rv
cgguuuagccgcu

SEQ ID NO: 1293641 - RNA, 18 nt, Mycobacterium tuberculosis H37Rv
cgguuggugcagcgugca

SEQ ID NO: 1293642 - RNA, 16 nt, Mycobacterium tuberculosis H37Rv
cgguuggcggcgaugg

SEQ ID NO: 1293643 - RNA, 13 nt, Mycobacterium tuberculosis H37Rv
cgguuggaucggc

SEQ ID NO: 1293644 - RNA, 17 nt, Mycobacterium tuberculosis H37Rv
cguggccacggcauucg

SEQ ID NO: 1293645 - RNA, 16 nt, Mycobacterium tuberculosis H37Rv
cguggccaauccggcg

SEQ ID NO: 1293646 - RNA, 15 nt, Mycobacterium tuberculosis H37Rv
cguggaugucgcggu

SEQ ID NO: 1293647 - RNA, 20 nt, Mycobacterium tuberculosis H37Rv
cguggccccaccgaacgugu

SEQ ID NO: 1293648 - RNA, 21 nt, Mycobacterium tuberculosis H37Rv
cguggcccaguccgcuggcca

SEQ ID NO: 1293649 - RNA, 14 nt, Mycobacterium tuberculosis H37Rv
cguggcgcucggcg

SEQ ID NO: 1293650 - RNA, 20 nt, Mycobacterium tuberculosis H37Rv
cguggcgcucggcgagcaac

SEQ ID NO: 1293651 - RNA, 12 nt, Mycobacterium tuberculosis H37Rv
cguggcgcgacg

SEQ ID NO: 1293652 - RNA, 20 nt, Mycobacterium tuberculosis H37Rv
cguggcggcgggccucggcg

SEQ ID NO: 1293653 - RNA, 17 nt, Mycobacterium tuberculosis H37Rv
cguggcgggcugcagcc

SEQ ID NO: 1293654 - RNA, 16 nt, Mycobacterium tuberculosis H37Rv
cguggcgggcugcagc

SEQ ID NO: 1293655 - RNA, 15 nt, Mycobacterium tuberculosis H37Rv
cguggcugcguucgc

SEQ ID NO: 1293656 - RNA, 14 nt, Mycobacterium tuberculosis H37Rv
cgugggcagcgcga

SEQ ID NO: 1293657 - RNA, 20 nt, Mycobacterium tuberculosis H37Rv
cgugggccacuugaugcucg

SEQ ID NO: 1293658 - RNA, 22 nt, Mycobacterium tuberculosis H37Rv
cgugggccacuugaugcucgau

SEQ ID NO: 1293659 - RNA, 13 nt, Mycobacterium tuberculosis H37Rv
cgugggccucgau

SEQ ID NO: 1293660 - RNA, 15 nt, Mycobacterium tuberculosis H37Rv
cgugggcgacggcgg

SEQ ID NO: 1293661 - RNA, 18 nt, Mycobacterium tuberculosis H37Rv
cgugggcgcggcgccaga

SEQ ID NO: 1293662 - RNA, 12 nt, Mycobacterium tuberculosis H37Rv
cgugucaccggg

SEQ ID NO: 1293663 - RNA, 17 nt, Mycobacterium tuberculosis H37Rv
cguguacgucgaucagg

SEQ ID NO: 1293664 - RNA, 12 nt, Mycobacterium tuberculosis H37Rv
cguguaccuguc

SEQ ID NO: 1293665 - RNA, 16 nt, Mycobacterium tuberculosis H37Rv
cguguagcugcggguc

SEQ ID NO: 1293666 - RNA, 22 nt, Mycobacterium tuberculosis H37Rv
cguguaggcaaccuuuggccgc

SEQ ID NO: 1293667 - RNA, 19 nt, Mycobacterium tuberculosis H37Rv
cgugucgacuccgaucggg

SEQ ID NO: 1293668 - RNA, 23 nt, Mycobacterium tuberculosis H37Rv
cguguccgccggauagcaccggc

SEQ ID NO: 1293669 - RNA, 22 nt, Mycobacterium tuberculosis H37Rv
cguguccgccggauagcaccgg

SEQ ID NO: 1293670 - RNA, 21 nt, Mycobacterium tuberculosis H37Rv
cguguccggggaccucggcga

SEQ ID NO: 1293671 - RNA, 15 nt, Mycobacterium tuberculosis H37Rv
cguguaacgccgacu

SEQ ID NO: 1293672 - RNA, 20 nt, Mycobacterium tuberculosis H37Rv
cgugguuuugucgacguucg

SEQ ID NO: 1293673 - RNA, 23 nt, Mycobacterium tuberculosis H37Rv
cgugguucggcggcgccccgguu

SEQ ID NO: 1293674 - RNA, 19 nt, Mycobacterium tuberculosis H37Rv
cgugguuguaccagccgaa

SEQ ID NO: 1293675 - RNA, 20 nt, Mycobacterium tuberculosis H37Rv
cguguacauugccgacccgu

SEQ ID NO: 1293676 - RNA, 20 nt, Mycobacterium tuberculosis H37Rv
cguguaccagcccagcggcu

SEQ ID NO: 1293677 - RNA, 17 nt, Mycobacterium tuberculosis H37Rv
cgugguuuugucgacgu

SEQ ID NO: 1293678 - RNA, 19 nt, Mycobacterium tuberculosis H37Rv
cgugguugccgaagccgga

SEQ ID NO: 1293679 - RNA, 16 nt, Mycobacterium tuberculosis H37Rv
cgugguucggcgucga

SEQ ID NO: 1293680 - RNA, 17 nt, Mycobacterium tuberculosis H37Rv
cgugguggucgggcgca

SEQ ID NO: 1293681 - RNA, 14 nt, Mycobacterium tuberculosis H37Rv
cgugguguacccgc

SEQ ID NO: 1293682 - RNA, 18 nt, Mycobacterium tuberculosis H37Rv
cguggugcugaccgcgcc

SEQ ID NO: 1293683 - RNA, 19 nt, Mycobacterium tuberculosis H37Rv
cgugguggacgaccgcgcg

SEQ ID NO: 1293684 - RNA, 16 nt, Mycobacterium tuberculosis H37Rv
cguggggacuggcagg

SEQ ID NO: 1293685 - RNA, 17 nt, Mycobacterium tuberculosis H37Rv
cgugguagcgccucgug

SEQ ID NO: 1293686 - RNA, 19 nt, Mycobacterium tuberculosis H37Rv
cgugguacuuucacgcucg

SEQ ID NO: 1293687 - RNA, 16 nt, Mycobacterium tuberculosis H37Rv
cgugguagcgccucgu

SEQ ID NO: 1293688 - RNA, 17 nt, Mycobacterium tuberculosis H37Rv
cgugggguguggcggcg

SEQ ID NO: 1293689 - RNA, 14 nt, Mycobacterium tuberculosis H37Rv
cgugggugucggug

SEQ ID NO: 1293690 - RNA, 22 nt, Mycobacterium tuberculosis H37Rv
cgugguaccgcuuguccaccgu

SEQ ID NO: 1293691 - RNA, 18 nt, Mycobacterium tuberculosis H37Rv
cguggucgcgcggcaccg

SEQ ID NO: 1293692 - RNA, 13 nt, Mycobacterium tuberculosis H37Rv
cguggucggcaaa

SEQ ID NO: 1293693 - RNA, 13 nt, Mycobacterium tuberculosis H37Rv
cguggucggccac

SEQ ID NO: 1293694 - RNA, 20 nt, Mycobacterium tuberculosis H37Rv
cguggucgacgugaucgcgg

SEQ ID NO: 1293695 - RNA, 17 nt, Mycobacterium tuberculosis H37Rv
cguggucgugggugagc

SEQ ID NO: 1293696 - RNA, 18 nt, Mycobacterium tuberculosis H37Rv
cguggugagccucggcga

SEQ ID NO: 1293697 - RNA, 21 nt, Mycobacterium tuberculosis H37Rv
cguucaugaucggcagaaucc

SEQ ID NO: 1293698 - RNA, 18 nt, Mycobacterium tuberculosis H37Rv
cguucaucauccacaccg

SEQ ID NO: 1293699 - RNA, 16 nt, Mycobacterium tuberculosis H37Rv
cguucaugaucggcag

SEQ ID NO: 1293700 - RNA, 23 nt, Mycobacterium tuberculosis H37Rv
cguuccacgagucgucguccgac

SEQ ID NO: 1293701 - RNA, 20 nt, Mycobacterium tuberculosis H37Rv
cguuccagcaguacaccgcc

SEQ ID NO: 1293702 - RNA, 21 nt, Mycobacterium tuberculosis H37Rv
cguucccacccacgccgacua

SEQ ID NO: 1293703 - RNA, 13 nt, Mycobacterium tuberculosis H37Rv
cguucagcgacca

SEQ ID NO: 1293704 - RNA, 14 nt, Mycobacterium tuberculosis H37Rv
cguucagccaggcg

SEQ ID NO: 1293705 - RNA, 19 nt, Mycobacterium tuberculosis H37Rv
cguucagcggccagcagug

SEQ ID NO: 1293706 - RNA, 20 nt, Mycobacterium tuberculosis H37Rv
cguucagcggccagcagugc

SEQ ID NO: 1293707 - RNA, 15 nt, Mycobacterium tuberculosis H37Rv
cguucggcugccgcg

SEQ ID NO: 1293708 - RNA, 13 nt, Mycobacterium tuberculosis H37Rv
cguucggcgcaca

SEQ ID NO: 1293709 - RNA, 15 nt, Mycobacterium tuberculosis H37Rv
cguucggcgucguug

SEQ ID NO: 1293710 - RNA, 22 nt, Mycobacterium tuberculosis H37Rv
cguucugcccaggcaaaccgau

SEQ ID NO: 1293711 - RNA, 16 nt, Mycobacterium tuberculosis H37Rv
cguucgggcccguagc

SEQ ID NO: 1293712 - RNA, 16 nt, Mycobacterium tuberculosis H37Rv
cguuccaucgccgacg

SEQ ID NO: 1293713 - RNA, 18 nt, Mycobacterium tuberculosis H37Rv
cguucgcgucacaccagc

SEQ ID NO: 1293714 - RNA, 22 nt, Mycobacterium tuberculosis H37Rv
cguucgcgucacaccagcgggc

SEQ ID NO: 1293715 - RNA, 18 nt, Mycobacterium tuberculosis H37Rv
cguucgccgucggugaug

SEQ ID NO: 1293716 - RNA, 17 nt, Mycobacterium tuberculosis H37Rv
cguucgccgaguauugg

SEQ ID NO: 1293717 - RNA, 23 nt, Mycobacterium tuberculosis H37Rv
cguucgccgaguauuggucggug

SEQ ID NO: 1293718 - RNA, 16 nt, Mycobacterium tuberculosis H37Rv
cgugucggguccaacc

SEQ ID NO: 1293719 - RNA, 23 nt, Mycobacterium tuberculosis H37Rv
cgugucggacaaggacugaccgu

SEQ ID NO: 1293720 - RNA, 19 nt, Mycobacterium tuberculosis H37Rv
cgugucgcugcggcgcugg

SEQ ID NO: 1293721 - RNA, 16 nt, Mycobacterium tuberculosis H37Rv
cgugucgcugcggcgc

SEQ ID NO: 1293722 - RNA, 19 nt, Mycobacterium tuberculosis H37Rv
cguguggcacguggcgacc

SEQ ID NO: 1293723 - RNA, 22 nt, Mycobacterium tuberculosis H37Rv
cguguucgaccaucaucucggu

SEQ ID NO: 1293724 - RNA, 14 nt, Mycobacterium tuberculosis H37Rv
cguguugaccgggu

SEQ ID NO: 1293725 - RNA, 20 nt, Mycobacterium tuberculosis H37Rv
cguguucgggggcggucgcg

SEQ ID NO: 1293726 - RNA, 20 nt, Mycobacterium tuberculosis H37Rv
cguguucgucacgggcguug

SEQ ID NO: 1293727 - RNA, 16 nt, Mycobacterium tuberculosis H37Rv
cguguugcguucggug

SEQ ID NO: 1293728 - RNA, 17 nt, Mycobacterium tuberculosis H37Rv
cguguuguugaagcccg

SEQ ID NO: 1293729 - RNA, 14 nt, Mycobacterium tuberculosis H37Rv
cguucaacgacggc

SEQ ID NO: 1293730 - RNA, 12 nt, Mycobacterium tuberculosis H37Rv
cguuaccgagcc

SEQ ID NO: 1293731 - RNA, 21 nt, Mycobacterium tuberculosis H37Rv
cguuaaugcuucgcgucgacc

SEQ ID NO: 1293732 - RNA, 12 nt, Mycobacterium tuberculosis H37Rv
cguuacgccgag

SEQ ID NO: 1293733 - RNA, 12 nt, Mycobacterium tuberculosis H37Rv
cguuaccgccgu

SEQ ID NO: 1293734 - RNA, 18 nt, Mycobacterium tuberculosis H37Rv
cguuagcauugaguucgg

SEQ ID NO: 1293735 - RNA, 21 nt, Mycobacterium tuberculosis H37Rv
cguuagccaggucgauaccgg

SEQ ID NO: 1293736 - RNA, 12 nt, Mycobacterium tuberculosis H37Rv
cgucgucgaucg

SEQ ID NO: 1293737 - RNA, 13 nt, Mycobacterium tuberculosis H37Rv
cgucgucgaucca

SEQ ID NO: 1293738 - RNA, 16 nt, Mycobacterium tuberculosis H37Rv
cgucgucgagcaccac

SEQ ID NO: 1293739 - RNA, 20 nt, Mycobacterium tuberculosis H37Rv
cgucgucaccuucaccgggu

SEQ ID NO: 1293740 - RNA, 20 nt, Mycobacterium tuberculosis H37Rv
cgucgucaccgcgacggaac

SEQ ID NO: 1293741 - RNA, 21 nt, Mycobacterium tuberculosis H37Rv
cgucgucgaccacgacguucg

SEQ ID NO: 1293742 - RNA, 12 nt, Mycobacterium tuberculosis H37Rv
cgucgucgacca

SEQ ID NO: 1293743 - RNA, 20 nt, Mycobacterium tuberculosis H37Rv
cgucgucgagauagccgacg

SEQ ID NO: 1293744 - RNA, 14 nt, Mycobacterium tuberculosis H37Rv
cgucgucgcgggaa

SEQ ID NO: 1293745 - RNA, 17 nt, Mycobacterium tuberculosis H37Rv
cgucgucgccgucggug

SEQ ID NO: 1293746 - RNA, 15 nt, Mycobacterium tuberculosis H37Rv
cgucgucggugauca

SEQ ID NO: 1293747 - RNA, 16 nt, Mycobacterium tuberculosis H37Rv
cgucggguugcgacga

SEQ ID NO: 1293748 - RNA, 23 nt, Mycobacterium tuberculosis H37Rv
cgucguacggcucauaaaugggu

SEQ ID NO: 1293749 - RNA, 21 nt, Mycobacterium tuberculosis H37Rv
cgucgguaagcgccaaggcga

SEQ ID NO: 1293750 - RNA, 21 nt, Mycobacterium tuberculosis H37Rv
cgucgguaaagggcucgaugg

SEQ ID NO: 1293751 - RNA, 16 nt, Mycobacterium tuberculosis H37Rv
cgucggucaccuggcg

SEQ ID NO: 1293752 - RNA, 22 nt, Mycobacterium tuberculosis H37Rv
cgucguagguggccggcuugca

SEQ ID NO: 1293753 - RNA, 19 nt, Mycobacterium tuberculosis H37Rv
cgucguagcuggcgaucug

SEQ ID NO: 1293754 - RNA, 13 nt, Mycobacterium tuberculosis H37Rv
cgucgcgguaggc

SEQ ID NO: 1293755 - RNA, 12 nt, Mycobacterium tuberculosis H37Rv
cgucgcgguagg

SEQ ID NO: 1293756 - RNA, 15 nt, Mycobacterium tuberculosis H37Rv
cgucggcuccagguc

SEQ ID NO: 1293757 - RNA, 17 nt, Mycobacterium tuberculosis H37Rv
cgucggcuucaccuuua

SEQ ID NO: 1293758 - RNA, 22 nt, Mycobacterium tuberculosis H37Rv
cgucgggcgucccggcggucag

SEQ ID NO: 1293759 - RNA, 14 nt, Mycobacterium tuberculosis H37Rv
cgucggcucgucgc

SEQ ID NO: 1293760 - RNA, 20 nt, Mycobacterium tuberculosis H37Rv
cgucgggguguucgaugggu

SEQ ID NO: 1293761 - RNA, 18 nt, Mycobacterium tuberculosis H37Rv
cgucggguaggccgccgu

SEQ ID NO: 1293762 - RNA, 13 nt, Mycobacterium tuberculosis H37Rv
cgucggguagauc

SEQ ID NO: 1293763 - RNA, 14 nt, Mycobacterium tuberculosis H37Rv
cgucgggucaccca

SEQ ID NO: 1293764 - RNA, 22 nt, Mycobacterium tuberculosis H37Rv
cgucgggucaaugcuggcagcg

SEQ ID NO: 1293765 - RNA, 13 nt, Mycobacterium tuberculosis H37Rv
cgucggguagugc

SEQ ID NO: 1293766 - RNA, 19 nt, Mycobacterium tuberculosis H37Rv
cgucgggucaaugcuggca

SEQ ID NO: 1293767 - RNA, 22 nt, Mycobacterium tuberculosis H37Rv
cgucugguggcagcgcacccgg

SEQ ID NO: 1293768 - RNA, 19 nt, Mycobacterium tuberculosis H37Rv
cgucugugucccgucgaug

SEQ ID NO: 1293769 - RNA, 17 nt, Mycobacterium tuberculosis H37Rv
cgucuucacucacgacg

SEQ ID NO: 1293770 - RNA, 23 nt, Mycobacterium tuberculosis H37Rv
cgucuuaccugaagccgcgcugc

SEQ ID NO: 1293771 - RNA, 19 nt, Mycobacterium tuberculosis H37Rv
cgucucggcaugcucgaca

SEQ ID NO: 1293772 - RNA, 12 nt, Mycobacterium tuberculosis H37Rv
cgucucggccag

SEQ ID NO: 1293773 - RNA, 17 nt, Mycobacterium tuberculosis H37Rv
cgucugguggcagcgca

SEQ ID NO: 1293774 - RNA, 15 nt, Mycobacterium tuberculosis H37Rv
cgucugguggcagcg

SEQ ID NO: 1293775 - RNA, 20 nt, Mycobacterium tuberculosis H37Rv
cgugacaccggggacgucga

SEQ ID NO: 1293776 - RNA, 15 nt, Mycobacterium tuberculosis H37Rv
cgugaccaccgccga

SEQ ID NO: 1293777 - RNA, 14 nt, Mycobacterium tuberculosis H37Rv
cgugacccgacaug

SEQ ID NO: 1293778 - RNA, 18 nt, Mycobacterium tuberculosis H37Rv
cgugacccauucucggcc

SEQ ID NO: 1293779 - RNA, 19 nt, Mycobacterium tuberculosis H37Rv
cgucgucggaaucggaguc

SEQ ID NO: 1293780 - RNA, 15 nt, Mycobacterium tuberculosis H37Rv
cgucgucguugagca

SEQ ID NO: 1293781 - RNA, 18 nt, Mycobacterium tuberculosis H37Rv
cgucgugcgcggccggca

SEQ ID NO: 1293782 - RNA, 16 nt, Mycobacterium tuberculosis H37Rv
cgucgugcgauucaca

SEQ ID NO: 1293783 - RNA, 14 nt, Mycobacterium tuberculosis H37Rv
cgucgugccaccgu

SEQ ID NO: 1293784 - RNA, 20 nt, Mycobacterium tuberculosis H37Rv
cgucgugcauaagcccgcga

SEQ ID NO: 1293785 - RNA, 15 nt, Mycobacterium tuberculosis H37Rv
cgucgugaucggcga

SEQ ID NO: 1293786 - RNA, 20 nt, Mycobacterium tuberculosis H37Rv
cgucgugaugucaacguguc

SEQ ID NO: 1293787 - RNA, 15 nt, Mycobacterium tuberculosis H37Rv
cgucgugcaccucgu

SEQ ID NO: 1293788 - RNA, 14 nt, Mycobacterium tuberculosis H37Rv
cgucgugcacgacg

SEQ ID NO: 1293789 - RNA, 21 nt, Mycobacterium tuberculosis H37Rv
cgucguugugccggucgauga

SEQ ID NO: 1293790 - RNA, 20 nt, Mycobacterium tuberculosis H37Rv
cgucguuuucagagccgggc

SEQ ID NO: 1293791 - RNA, 18 nt, Mycobacterium tuberculosis H37Rv
cgucguugccggcgacca

SEQ ID NO: 1293792 - RNA, 15 nt, Mycobacterium tuberculosis H37Rv
cgucguggagcucac

SEQ ID NO: 1293793 - RNA, 19 nt, Mycobacterium tuberculosis H37Rv
cgucguugggauccggugg

SEQ ID NO: 1293794 - RNA, 15 nt, Mycobacterium tuberculosis H37Rv
cgucguugcucgguc

SEQ ID NO: 1293795 - RNA, 17 nt, Mycobacterium tuberculosis H37Rv
cgucguugcucggucuc

SEQ ID NO: 1293796 - RNA, 21 nt, Mycobacterium tuberculosis H37Rv
cgucucgccgggaaacaccgg

SEQ ID NO: 1293797 - RNA, 17 nt, Mycobacterium tuberculosis H37Rv
cgucucgcagcaacggc

SEQ ID NO: 1293798 - RNA, 13 nt, Mycobacterium tuberculosis H37Rv
cgucucgaucacc

SEQ ID NO: 1293799 - RNA, 13 nt, Mycobacterium tuberculosis H37Rv
cgucucgcaccgc

SEQ ID NO: 1293800 - RNA, 20 nt, Mycobacterium tuberculosis H37Rv
cguggaucugccucucgacc

SEQ ID NO: 1293801 - RNA, 15 nt, Mycobacterium tuberculosis H37Rv
cguggauccagccau

SEQ ID NO: 1293802 - RNA, 13 nt, Mycobacterium tuberculosis H37Rv
cguggagcgcuug

SEQ ID NO: 1293803 - RNA, 17 nt, Mycobacterium tuberculosis H37Rv
cguggaucuuggccagc

SEQ ID NO: 1293804 - RNA, 17 nt, Mycobacterium tuberculosis H37Rv
cguggauggccgccagg

SEQ ID NO: 1293805 - RNA, 17 nt, Mycobacterium tuberculosis H37Rv
cguggacuuuggugucg

SEQ ID NO: 1293806 - RNA, 15 nt, Mycobacterium tuberculosis H37Rv
cguggaagacgucga

SEQ ID NO: 1293807 - RNA, 15 nt, Mycobacterium tuberculosis H37Rv
cgugcggccacgguu

SEQ ID NO: 1293808 - RNA, 14 nt, Mycobacterium tuberculosis H37Rv
cgugcucucggcga

SEQ ID NO: 1293809 - RNA, 18 nt, Mycobacterium tuberculosis H37Rv
cgugcugaacuccgccgc

SEQ ID NO: 1293810 - RNA, 14 nt, Mycobacterium tuberculosis H37Rv
cgugcugggccgac

SEQ ID NO: 1293811 - RNA, 12 nt, Mycobacterium tuberculosis H37Rv
cgugcuggcgac

SEQ ID NO: 1293812 - RNA, 12 nt, Mycobacterium tuberculosis H37Rv
cgugcugccauu

SEQ ID NO: 1293813 - RNA, 23 nt, Mycobacterium tuberculosis H37Rv
cgugccgaacagggaggucgccg

SEQ ID NO: 1293814 - RNA, 22 nt, Mycobacterium tuberculosis H37Rv
cgugccgaacacgguguauugg

SEQ ID NO: 1293815 - RNA, 16 nt, Mycobacterium tuberculosis H37Rv
cgugccgaaaaucgca

SEQ ID NO: 1293816 - RNA, 15 nt, Mycobacterium tuberculosis H37Rv
cgugccgaaaaucgc

SEQ ID NO: 1293817 - RNA, 16 nt, Mycobacterium tuberculosis H37Rv
cgugcgcaucagcggu

SEQ ID NO: 1293818 - RNA, 15 nt, Mycobacterium tuberculosis H37Rv
cgugcgcaucgucga

SEQ ID NO: 1293819 - RNA, 15 nt, Mycobacterium tuberculosis H37Rv
cgugccccggcggua

SEQ ID NO: 1293820 - RNA, 17 nt, Mycobacterium tuberculosis H37Rv
cgugcccugggugaugg

SEQ ID NO: 1293821 - RNA, 20 nt, Mycobacterium tuberculosis H37Rv
cgugcccugggugauggccg

SEQ ID NO: 1293822 - RNA, 20 nt, Mycobacterium tuberculosis H37Rv
cgugcgccgugcgaucguca

SEQ ID NO: 1293823 - RNA, 22 nt, Mycobacterium tuberculosis H37Rv
cgugcaugggacauccagaucg

SEQ ID NO: 1293824 - RNA, 20 nt, Mycobacterium tuberculosis H37Rv
cgugcauaggccgcgucgau

SEQ ID NO: 1293825 - RNA, 19 nt, Mycobacterium tuberculosis H37Rv
cgugccacagcucgccgug

SEQ ID NO: 1293826 - RNA, 14 nt, Mycobacterium tuberculosis H37Rv
cgugccacagcucg

SEQ ID NO: 1293827 - RNA, 16 nt, Mycobacterium tuberculosis H37Rv
cgugccccaguccgaa

SEQ ID NO: 1293828 - RNA, 18 nt, Mycobacterium tuberculosis H37Rv
cgugcaccucgucccagc

SEQ ID NO: 1293829 - RNA, 21 nt, Mycobacterium tuberculosis H37Rv
cgugcaccgucgggauggacg

SEQ ID NO: 1293830 - RNA, 23 nt, Mycobacterium tuberculosis H37Rv
cgugcaucugugagauaccgacg

SEQ ID NO: 1293831 - RNA, 19 nt, Mycobacterium tuberculosis H37Rv
cgugcacgcacagcccgau

SEQ ID NO: 1293832 - RNA, 16 nt, Mycobacterium tuberculosis H37Rv
cgugcacgaucgcggu

SEQ ID NO: 1293833 - RNA, 20 nt, Mycobacterium tuberculosis H37Rv
cgugcacaggcaucguccgc

SEQ ID NO: 1293834 - RNA, 17 nt, Mycobacterium tuberculosis H37Rv
cgugauugucggcgaaa

SEQ ID NO: 1293835 - RNA, 17 nt, Mycobacterium tuberculosis H37Rv
cgugagcucgucgaggc

SEQ ID NO: 1293836 - RNA, 20 nt, Mycobacterium tuberculosis H37Rv
cgugagcuaugcuggcagcu

SEQ ID NO: 1293837 - RNA, 17 nt, Mycobacterium tuberculosis H37Rv
cgugagccccagcgacg

SEQ ID NO: 1293838 - RNA, 15 nt, Mycobacterium tuberculosis H37Rv
cgugagccuguccac

SEQ ID NO: 1293839 - RNA, 20 nt, Mycobacterium tuberculosis H37Rv
cgugaccggcaaccgccgug

SEQ ID NO: 1293840 - RNA, 23 nt, Mycobacterium tuberculosis H37Rv
cgugaccgugccgucggcgugca

SEQ ID NO: 1293841 - RNA, 21 nt, Mycobacterium tuberculosis H37Rv
cgugaccgugccgucggcgug

SEQ ID NO: 1293842 - RNA, 14 nt, Mycobacterium tuberculosis H37Rv
cgugaccgacugcg

SEQ ID NO: 1293843 - RNA, 17 nt, Mycobacterium tuberculosis H37Rv
cgugaccgacgccgucg

SEQ ID NO: 1293844 - RNA, 21 nt, Mycobacterium tuberculosis H37Rv
cgugacccugggguugcauca

SEQ ID NO: 1293845 - RNA, 16 nt, Mycobacterium tuberculosis H37Rv
cgugaccgacgccguc

SEQ ID NO: 1293846 - RNA, 17 nt, Mycobacterium tuberculosis H37Rv
cgugacucggccgacga

SEQ ID NO: 1293847 - RNA, 17 nt, Mycobacterium tuberculosis H37Rv
cgugacuggugaacggg

SEQ ID NO: 1293848 - RNA, 22 nt, Mycobacterium tuberculosis H37Rv
cgugacguuguaggagaacguc

SEQ ID NO: 1293849 - RNA, 20 nt, Mycobacterium tuberculosis H37Rv
cgugacguuguaggagaacg

SEQ ID NO: 1293850 - RNA, 15 nt, Mycobacterium tuberculosis H37Rv
cugacauagucacgg

SEQ ID NO: 1293851 - RNA, 14 nt, Mycobacterium tuberculosis H37Rv
cugacaucggccaa

SEQ ID NO: 1293852 - RNA, 15 nt, Mycobacterium tuberculosis H37Rv
cugacaucggccaag

SEQ ID NO: 1293853 - RNA, 22 nt, Mycobacterium tuberculosis H37Rv
cugaaucgguucggccagaacg

SEQ ID NO: 1293854 - RNA, 14 nt, Mycobacterium tuberculosis H37Rv
cugaagguguccgc

SEQ ID NO: 1293855 - RNA, 22 nt, Mycobacterium tuberculosis H37Rv
cugaaccagaugggugacccgc

SEQ ID NO: 1293856 - RNA, 19 nt, Mycobacterium tuberculosis H37Rv
cugaaccggccgcgacgac

SEQ ID NO: 1293857 - RNA, 23 nt, Mycobacterium tuberculosis H37Rv
cugaacgguuucuuucggcagcg

SEQ ID NO: 1293858 - RNA, 21 nt, Mycobacterium tuberculosis H37Rv
cugaacgcuguaagcaugccg

SEQ ID NO: 1293859 - RNA, 15 nt, Mycobacterium tuberculosis H37Rv
cucugcguccagcaa

SEQ ID NO: 1293860 - RNA, 17 nt, Mycobacterium tuberculosis H37Rv
cucugcgacaccacgaa

SEQ ID NO: 1293861 - RNA, 13 nt, Mycobacterium tuberculosis H37Rv
cugaacaggccgg

SEQ ID NO: 1293862 - RNA, 19 nt, Mycobacterium tuberculosis H37Rv
cugaacaguugcacaccgg

SEQ ID NO: 1293863 - RNA, 15 nt, Mycobacterium tuberculosis H37Rv
cucguaacgcggcac

SEQ ID NO: 1293864 - RNA, 19 nt, Mycobacterium tuberculosis H37Rv
cucggugugcucgccgacc

SEQ ID NO: 1293865 - RNA, 15 nt, Mycobacterium tuberculosis H37Rv
cucgucccacagguu

SEQ ID NO: 1293866 - RNA, 21 nt, Mycobacterium tuberculosis H37Rv
cucgucccacagguuugcgcc

SEQ ID NO: 1293867 - RNA, 18 nt, Mycobacterium tuberculosis H37Rv
cucgguugguccucggcg

SEQ ID NO: 1293868 - RNA, 18 nt, Mycobacterium tuberculosis H37Rv
cucgucgaggcugaccgu

SEQ ID NO: 1293869 - RNA, 16 nt, Mycobacterium tuberculosis H37Rv
cucgucgacgucggca

SEQ ID NO: 1293870 - RNA, 22 nt, Mycobacterium tuberculosis H37Rv
cucgucgagagguucgccgucg

SEQ ID NO: 1293871 - RNA, 19 nt, Mycobacterium tuberculosis H37Rv
cucgucgaaguagccgacg

SEQ ID NO: 1293872 - RNA, 14 nt, Mycobacterium tuberculosis H37Rv
cucgguggacggca

SEQ ID NO: 1293873 - RNA, 19 nt, Mycobacterium tuberculosis H37Rv
cucggugcugcgccgauac

SEQ ID NO: 1293874 - RNA, 16 nt, Mycobacterium tuberculosis H37Rv
cucggccuguucggcg

SEQ ID NO: 1293875 - RNA, 13 nt, Mycobacterium tuberculosis H37Rv
cucggccgugacc

SEQ ID NO: 1293876 - RNA, 14 nt, Mycobacterium tuberculosis H37Rv
cucggccgugaccg

SEQ ID NO: 1293877 - RNA, 15 nt, Mycobacterium tuberculosis H37Rv
cucgucgagccgacc

SEQ ID NO: 1293878 - RNA, 23 nt, Mycobacterium tuberculosis H37Rv
cucgucggugugccagugcugca

SEQ ID NO: 1293879 - RNA, 12 nt, Mycobacterium tuberculosis H37Rv
cucgucggcgcc

SEQ ID NO: 1293880 - RNA, 17 nt, Mycobacterium tuberculosis H37Rv
cucgugaucuucggcga

SEQ ID NO: 1293881 - RNA, 23 nt, Mycobacterium tuberculosis H37Rv
cucguucaacuuggggucguucg

SEQ ID NO: 1293882 - RNA, 23 nt, Mycobacterium tuberculosis H37Rv
cucgucgugagacugggcgcugg

SEQ ID NO: 1293883 - RNA, 18 nt, Mycobacterium tuberculosis H37Rv
cucgugacagcggcgauc

SEQ ID NO: 1293884 - RNA, 21 nt, Mycobacterium tuberculosis H37Rv
cucuagcaaagccagcgcagc

SEQ ID NO: 1293885 - RNA, 19 nt, Mycobacterium tuberculosis H37Rv
cucuaucagacgauucggc

SEQ ID NO: 1293886 - RNA, 15 nt, Mycobacterium tuberculosis H37Rv
cucguugccgaccau

SEQ ID NO: 1293887 - RNA, 16 nt, Mycobacterium tuberculosis H37Rv
cucguugcugccggcg

SEQ ID NO: 1293888 - RNA, 20 nt, Mycobacterium tuberculosis H37Rv
cucguugcuggcggccagca

SEQ ID NO: 1293889 - RNA, 18 nt, Mycobacterium tuberculosis H37Rv
cugcacccaggcaucggu

SEQ ID NO: 1293890 - RNA, 15 nt, Mycobacterium tuberculosis H37Rv
cugcacggcgcugac

SEQ ID NO: 1293891 - RNA, 16 nt, Mycobacterium tuberculosis H37Rv
cugcacggcgcugacg

SEQ ID NO: 1293892 - RNA, 19 nt, Mycobacterium tuberculosis H37Rv
cugcagauaggacccagcc

SEQ ID NO: 1293893 - RNA, 14 nt, Mycobacterium tuberculosis H37Rv
cugcagaucggccg

SEQ ID NO: 1293894 - RNA, 18 nt, Mycobacterium tuberculosis H37Rv
cugcagcaggucgaugcu

SEQ ID NO: 1293895 - RNA, 13 nt, Mycobacterium tuberculosis H37Rv
cugcagacccguu

SEQ ID NO: 1293896 - RNA, 13 nt, Mycobacterium tuberculosis H37Rv
cugcaaccgccgg

SEQ ID NO: 1293897 - RNA, 20 nt, Mycobacterium tuberculosis H37Rv
cugcaacgucacucccuggc

SEQ ID NO: 1293898 - RNA, 22 nt, Mycobacterium tuberculosis H37Rv
cugaugaagaugauuucgccga

SEQ ID NO: 1293899 - RNA, 16 nt, Mycobacterium tuberculosis H37Rv
cugaucuggggcacca

SEQ ID NO: 1293900 - RNA, 15 nt, Mycobacterium tuberculosis H37Rv
cugaucgcgcgcacc

SEQ ID NO: 1293901 - RNA, 17 nt, Mycobacterium tuberculosis H37Rv
cugaugaaccacggcag

SEQ ID NO: 1293902 - RNA, 22 nt, Mycobacterium tuberculosis H37Rv
cugaucgugaacacgucgcggu

SEQ ID NO: 1293903 - RNA, 17 nt, Mycobacterium tuberculosis H37Rv
cugaucgcgaagcguuc

SEQ ID NO: 1293904 - RNA, 14 nt, Mycobacterium tuberculosis H37Rv
cugaucgcgaagcg

SEQ ID NO: 1293905 - RNA, 20 nt, Mycobacterium tuberculosis H37Rv
cugauagcggucggucacca

SEQ ID NO: 1293906 - RNA, 13 nt, Mycobacterium tuberculosis H37Rv
cugauagggcugu

SEQ ID NO: 1293907 - RNA, 18 nt, Mycobacterium tuberculosis H37Rv
cugagcguccgacaacga

SEQ ID NO: 1293908 - RNA, 17 nt, Mycobacterium tuberculosis H37Rv
cugagcggccucgggac

SEQ ID NO: 1293909 - RNA, 23 nt, Mycobacterium tuberculosis H37Rv
cugagcggccucgggacucccgc

SEQ ID NO: 1293910 - RNA, 12 nt, Mycobacterium tuberculosis H37Rv
cugacgucacca

SEQ ID NO: 1293911 - RNA, 20 nt, Mycobacterium tuberculosis H37Rv
cugacgucacguucggcgca

SEQ ID NO: 1293912 - RNA, 19 nt, Mycobacterium tuberculosis H37Rv
cugaucaggccgaugacga

SEQ ID NO: 1293913 - RNA, 14 nt, Mycobacterium tuberculosis H37Rv
cugagcgucgucgc

SEQ ID NO: 1293914 - RNA, 16 nt, Mycobacterium tuberculosis H37Rv
cugaucgccacccggu

SEQ ID NO: 1293915 - RNA, 21 nt, Mycobacterium tuberculosis H37Rv
cugauccacgauaucgaugcg

SEQ ID NO: 1293916 - RNA, 14 nt, Mycobacterium tuberculosis H37Rv
cugaccaugaccgg

SEQ ID NO: 1293917 - RNA, 13 nt, Mycobacterium tuberculosis H37Rv
cugacccaccgcc

SEQ ID NO: 1293918 - RNA, 23 nt, Mycobacterium tuberculosis H37Rv
cugacccagcagcggcacgucgg

SEQ ID NO: 1293919 - RNA, 13 nt, Mycobacterium tuberculosis H37Rv
cugaccgccagcg

SEQ ID NO: 1293920 - RNA, 13 nt, Mycobacterium tuberculosis H37Rv
cugaccgaauggc

SEQ ID NO: 1293921 - RNA, 13 nt, Mycobacterium tuberculosis H37Rv
cugaccgccaccc

SEQ ID NO: 1293922 - RNA, 20 nt, Mycobacterium tuberculosis H37Rv
cugaccgaauggccgccgca

SEQ ID NO: 1293923 - RNA, 20 nt, Mycobacterium tuberculosis H37Rv
cugaccccgccgccacgggu

SEQ ID NO: 1293924 - RNA, 23 nt, Mycobacterium tuberculosis H37Rv
cugacccggagccgccaggugcu

SEQ ID NO: 1293925 - RNA, 12 nt, Mycobacterium tuberculosis H37Rv
cugacggcaucu

SEQ ID NO: 1293926 - RNA, 15 nt, Mycobacterium tuberculosis H37Rv
cugacggcgcaacac

SEQ ID NO: 1293927 - RNA, 14 nt, Mycobacterium tuberculosis H37Rv
cugacgguucgguc

SEQ ID NO: 1293928 - RNA, 16 nt, Mycobacterium tuberculosis H37Rv
cugacgguggugaccg

SEQ ID NO: 1293929 - RNA, 19 nt, Mycobacterium tuberculosis H37Rv
cugacggcuugcgugaugg

SEQ ID NO: 1293930 - RNA, 16 nt, Mycobacterium tuberculosis H37Rv
cugcgaagucgcaugg

SEQ ID NO: 1293931 - RNA, 21 nt, Mycobacterium tuberculosis H37Rv
cugcgacaggacgucggcgaa

SEQ ID NO: 1293932 - RNA, 21 nt, Mycobacterium tuberculosis H37Rv
cugcgacaagaccggcgggca

SEQ ID NO: 1293933 - RNA, 22 nt, Mycobacterium tuberculosis H37Rv
cugcgaccaggcgcggcgacaa

SEQ ID NO: 1293934 - RNA, 18 nt, Mycobacterium tuberculosis H37Rv
cugcgacgagcccaccgu

SEQ ID NO: 1293935 - RNA, 16 nt, Mycobacterium tuberculosis H37Rv
cugcgacuggaucgcg

SEQ ID NO: 1293936 - RNA, 12 nt, Mycobacterium tuberculosis H37Rv
cugccucaccgc

SEQ ID NO: 1293937 - RNA, 13 nt, Mycobacterium tuberculosis H37Rv
cugccucaccgcc

SEQ ID NO: 1293938 - RNA, 14 nt, Mycobacterium tuberculosis H37Rv
cugccucucgaccu

SEQ ID NO: 1293939 - RNA, 15 nt, Mycobacterium tuberculosis H37Rv
cugccuuggccggcu

SEQ ID NO: 1293940 - RNA, 15 nt, Mycobacterium tuberculosis H37Rv
cugccuuacacgccu

SEQ ID NO: 1293941 - RNA, 20 nt, Mycobacterium tuberculosis H37Rv
cugccgguagcacagcagca

SEQ ID NO: 1293942 - RNA, 17 nt, Mycobacterium tuberculosis H37Rv
cugccgguagcacagca

SEQ ID NO: 1293943 - RNA, 15 nt, Mycobacterium tuberculosis H37Rv
cugccggcgccgcca

SEQ ID NO: 1293944 - RNA, 24 nt, Mycobacterium tuberculosis H37Rv
cugccggguggguaauacaggccg

SEQ ID NO: 1293945 - RNA, 23 nt, Mycobacterium tuberculosis H37Rv
cugccguauccaggcgugcaucg

SEQ ID NO: 1293946 - RNA, 17 nt, Mycobacterium tuberculosis H37Rv
cugccguggcggcagcg

SEQ ID NO: 1293947 - RNA, 12 nt, Mycobacterium tuberculosis H37Rv
cugccgucucgu

SEQ ID NO: 1293948 - RNA, 13 nt, Mycobacterium tuberculosis H37Rv
cugccgucggugc

SEQ ID NO: 1293949 - RNA, 16 nt, Mycobacterium tuberculosis H37Rv
cugccguugggcaccg

SEQ ID NO: 1293950 - RNA, 19 nt, Mycobacterium tuberculosis H37Rv
cugccgcucgccgguaggc

SEQ ID NO: 1293951 - RNA, 15 nt, Mycobacterium tuberculosis H37Rv
cugccgcugcgccgu

SEQ ID NO: 1293952 - RNA, 13 nt, Mycobacterium tuberculosis H37Rv
cugccgcucgacc

SEQ ID NO: 1293953 - RNA, 13 nt, Mycobacterium tuberculosis H37Rv
cugccggagacac

SEQ ID NO: 1293954 - RNA, 14 nt, Mycobacterium tuberculosis H37Rv
cugccgcgcucgcg

SEQ ID NO: 1293955 - RNA, 18 nt, Mycobacterium tuberculosis H37Rv
cugccgcgcucgcgcacc

SEQ ID NO: 1293956 - RNA, 17 nt, Mycobacterium tuberculosis H37Rv
cugccgccaggcucgag

SEQ ID NO: 1293957 - RNA, 21 nt, Mycobacterium tuberculosis H37Rv
cugcccuguucguagucucga

SEQ ID NO: 1293958 - RNA, 16 nt, Mycobacterium tuberculosis H37Rv
cugccgaaacgccgac

SEQ ID NO: 1293959 - RNA, 18 nt, Mycobacterium tuberculosis H37Rv
cugccgaagcggccaccg

SEQ ID NO: 1293960 - RNA, 20 nt, Mycobacterium tuberculosis H37Rv
cugccgaacaguucggcgag

SEQ ID NO: 1293961 - RNA, 16 nt, Mycobacterium tuberculosis H37Rv
cugccgaccagcgcgc

SEQ ID NO: 1293962 - RNA, 15 nt, Mycobacterium tuberculosis H37Rv
cugccgacucaucgg

SEQ ID NO: 1293963 - RNA, 18 nt, Mycobacterium tuberculosis H37Rv
cugccgacucaucggccg

SEQ ID NO: 1293964 - RNA, 22 nt, Mycobacterium tuberculosis H37Rv
cugccgauagggauggcgaugg

SEQ ID NO: 1293965 - RNA, 15 nt, Mycobacterium tuberculosis H37Rv
cugccgcaccggugc

SEQ ID NO: 1293966 - RNA, 22 nt, Mycobacterium tuberculosis H37Rv
cugccgcacccggucgagcguu

SEQ ID NO: 1293967 - RNA, 18 nt, Mycobacterium tuberculosis H37Rv
cugccaucacgcgcucac

SEQ ID NO: 1293968 - RNA, 21 nt, Mycobacterium tuberculosis H37Rv
cugcccgaugaucugugccgc

SEQ ID NO: 1293969 - RNA, 13 nt, Mycobacterium tuberculosis H37Rv
cugcccgccguua

SEQ ID NO: 1293970 - RNA, 17 nt, Mycobacterium tuberculosis H37Rv
cugcccggggugcugac

SEQ ID NO: 1293971 - RNA, 21 nt, Mycobacterium tuberculosis H37Rv
cugcccgauacccggugaugg

SEQ ID NO: 1293972 - RNA, 16 nt, Mycobacterium tuberculosis H37Rv
cugcccgaguucgcga

SEQ ID NO: 1293973 - RNA, 21 nt, Mycobacterium tuberculosis H37Rv
cugcccgauggcuaccuugga

SEQ ID NO: 1293974 - RNA, 23 nt, Mycobacterium tuberculosis H37Rv
cugcccgagaucgcgugcgacga

SEQ ID NO: 1293975 - RNA, 18 nt, Mycobacterium tuberculosis H37Rv
cugccaugugucccggac

SEQ ID NO: 1293976 - RNA, 20 nt, Mycobacterium tuberculosis H37Rv
cugcccaguguccggcgacg

SEQ ID NO: 1293977 - RNA, 16 nt, Mycobacterium tuberculosis H37Rv
cugccaaugcugcagg

SEQ ID NO: 1293978 - RNA, 19 nt, Mycobacterium tuberculosis H37Rv
cugccaacgcccguguuga

SEQ ID NO: 1293979 - RNA, 20 nt, Mycobacterium tuberculosis H37Rv
cugccaaacuaacggcagcc

SEQ ID NO: 1293980 - RNA, 20 nt, Mycobacterium tuberculosis H37Rv
cugccaccagacaacgccgu

SEQ ID NO: 1293981 - RNA, 16 nt, Mycobacterium tuberculosis H37Rv
cugccaacgcccgugu

SEQ ID NO: 1293982 - RNA, 15 nt, Mycobacterium tuberculosis H37Rv
cugccacaggcguuu

SEQ ID NO: 1293983 - RNA, 17 nt, Mycobacterium tuberculosis H37Rv
cugccacagcgacagcg

SEQ ID NO: 1293984 - RNA, 15 nt, Mycobacterium tuberculosis H37Rv
cugcaucacaagggu

SEQ ID NO: 1293985 - RNA, 16 nt, Mycobacterium tuberculosis H37Rv
cugcagugcggcguua

SEQ ID NO: 1293986 - RNA, 17 nt, Mycobacterium tuberculosis H37Rv
cugcagguuuccggccu

SEQ ID NO: 1293987 - RNA, 20 nt, Mycobacterium tuberculosis H37Rv
cugcagguuguuucguucga

SEQ ID NO: 1293988 - RNA, 20 nt, Mycobacterium tuberculosis H37Rv
cugcagcccgggcagcacca

SEQ ID NO: 1293989 - RNA, 15 nt, Mycobacterium tuberculosis H37Rv
cugcagcccgggcag

SEQ ID NO: 1293990 - RNA, 14 nt, Mycobacterium tuberculosis H37Rv
cugcagcgcggugg

SEQ ID NO: 1293991 - RNA, 14 nt, Mycobacterium tuberculosis H37Rv
cugcagcgaugcgg

SEQ ID NO: 1293992 - RNA, 18 nt, Mycobacterium tuberculosis H37Rv
cugcagguuccacgcguu

SEQ ID NO: 1293993 - RNA, 20 nt, Mycobacterium tuberculosis H37Rv
cugcagguuccacgcguuga

SEQ ID NO: 1293994 - RNA, 20 nt, Mycobacterium tuberculosis H37Rv
cugcagguucuugaccagca

SEQ ID NO: 1293995 - RNA, 15 nt, Mycobacterium tuberculosis H37Rv
cugcaggaaggcuuc

SEQ ID NO: 1293996 - RNA, 22 nt, Mycobacterium tuberculosis H37Rv
cucgcaucaucggaaccguuug

SEQ ID NO: 1293997 - RNA, 17 nt, Mycobacterium tuberculosis H37Rv
cucgcacccgcucggcg

SEQ ID NO: 1293998 - RNA, 22 nt, Mycobacterium tuberculosis H37Rv
cucgccagagucggagacccgu

SEQ ID NO: 1293999 - RNA, 18 nt, Mycobacterium tuberculosis H37Rv
cucgccaggccuaggccg

SEQ ID NO: 1294000 - RNA, 15 nt, Mycobacterium tuberculosis H37Rv
cucgcccaccuccug

SEQ ID NO: 1294001 - RNA, 17 nt, Mycobacterium tuberculosis H37Rv
cucgcccaccaccacug

SEQ ID NO: 1294002 - RNA, 16 nt, Mycobacterium tuberculosis H37Rv
cucgccaggcaagcca

SEQ ID NO: 1294003 - RNA, 21 nt, Mycobacterium tuberculosis H37Rv
cucgcagcaacggcggcgucg

SEQ ID NO: 1294004 - RNA, 21 nt, Mycobacterium tuberculosis H37Rv
cucgagcccucguuaucgacc

SEQ ID NO: 1294005 - RNA, 16 nt, Mycobacterium tuberculosis H37Rv
cucgagcuugccgucg

SEQ ID NO: 1294006 - RNA, 14 nt, Mycobacterium tuberculosis H37Rv
cucgaggaccugcu

SEQ ID NO: 1294007 - RNA, 13 nt, Mycobacterium tuberculosis H37Rv
cucgccgcgcacc

SEQ ID NO: 1294008 - RNA, 19 nt, Mycobacterium tuberculosis H37Rv
cucgccgacggcaagggca

SEQ ID NO: 1294009 - RNA, 17 nt, Mycobacterium tuberculosis H37Rv
cucgccgcacgccggca

SEQ ID NO: 1294010 - RNA, 16 nt, Mycobacterium tuberculosis H37Rv
cucgccgacggcaagg

SEQ ID NO: 1294011 - RNA, 12 nt, Mycobacterium tuberculosis H37Rv
cucgccgaagcg

SEQ ID NO: 1294012 - RNA, 18 nt, Mycobacterium tuberculosis H37Rv
cucgcccugacgucacgu

SEQ ID NO: 1294013 - RNA, 15 nt, Mycobacterium tuberculosis H37Rv
cucgcccgcaccagc

SEQ ID NO: 1294014 - RNA, 20 nt, Mycobacterium tuberculosis H37Rv
cucgcccagugaaucggacc

SEQ ID NO: 1294015 - RNA, 15 nt, Mycobacterium tuberculosis H37Rv
cucggcaggccgacc

SEQ ID NO: 1294016 - RNA, 17 nt, Mycobacterium tuberculosis H37Rv
cucggcauccaggcugu

SEQ ID NO: 1294017 - RNA, 22 nt, Mycobacterium tuberculosis H37Rv
cucggccaucugcucgugggua

SEQ ID NO: 1294018 - RNA, 14 nt, Mycobacterium tuberculosis H37Rv
cucggcccggguga

SEQ ID NO: 1294019 - RNA, 16 nt, Mycobacterium tuberculosis H37Rv
cucggccgcaccagca

SEQ ID NO: 1294020 - RNA, 14 nt, Mycobacterium tuberculosis H37Rv
cucgcugcagcagg

SEQ ID NO: 1294021 - RNA, 18 nt, Mycobacterium tuberculosis H37Rv
cucgcugcaccagcugcu

SEQ ID NO: 1294022 - RNA, 21 nt, Mycobacterium tuberculosis H37Rv
cucggcaaccugcgaccaggc

SEQ ID NO: 1294023 - RNA, 16 nt, Mycobacterium tuberculosis H37Rv
cucggcaagucgacgc

SEQ ID NO: 1294024 - RNA, 20 nt, Mycobacterium tuberculosis H37Rv
cucggcacccggcagagcac

SEQ ID NO: 1294025 - RNA, 14 nt, Mycobacterium tuberculosis H37Rv
cucgcugaccuugu

SEQ ID NO: 1294026 - RNA, 16 nt, Mycobacterium tuberculosis H37Rv
cucgcgggcggcgugg

SEQ ID NO: 1294027 - RNA, 21 nt, Mycobacterium tuberculosis H37Rv
cucgcucgccgagcugugcgc

SEQ ID NO: 1294028 - RNA, 15 nt, Mycobacterium tuberculosis H37Rv
cucgcucgccgagcu

SEQ ID NO: 1294029 - RNA, 19 nt, Mycobacterium tuberculosis H37Rv
cucgcggguugccucggcg

SEQ ID NO: 1294030 - RNA, 15 nt, Mycobacterium tuberculosis H37Rv
cucgcgggcggcgug

SEQ ID NO: 1294031 - RNA, 19 nt, Mycobacterium tuberculosis H37Rv
cucgccugcccgaaccacc

SEQ ID NO: 1294032 - RNA, 16 nt, Mycobacterium tuberculosis H37Rv
cucgccggcgaagacc

SEQ ID NO: 1294033 - RNA, 15 nt, Mycobacterium tuberculosis H37Rv
cucgcgacaucaccg

SEQ ID NO: 1294034 - RNA, 18 nt, Mycobacterium tuberculosis H37Rv
cucgcgacaucaccgaac

SEQ ID NO: 1294035 - RNA, 14 nt, Mycobacterium tuberculosis H37Rv
cucgccuucgccgc

SEQ ID NO: 1294036 - RNA, 18 nt, Mycobacterium tuberculosis H37Rv
cucccugggcgucgacca

SEQ ID NO: 1294037 - RNA, 22 nt, Mycobacterium tuberculosis H37Rv
cucccuggcccccgguaccgcc

SEQ ID NO: 1294038 - RNA, 16 nt, Mycobacterium tuberculosis H37Rv
cuccgaaguccacgca

SEQ ID NO: 1294039 - RNA, 23 nt, Mycobacterium tuberculosis H37Rv
cuccgaucgggcccaccgcugcg

SEQ ID NO: 1294040 - RNA, 16 nt, Mycobacterium tuberculosis H37Rv
cuccgcagcgaagacc

SEQ ID NO: 1294041 - RNA, 12 nt, Mycobacterium tuberculosis H37Rv
cuccgcagcuau

SEQ ID NO: 1294042 - RNA, 13 nt, Mycobacterium tuberculosis H37Rv
cuccgccaccauc

SEQ ID NO: 1294043 - RNA, 14 nt, Mycobacterium tuberculosis H37Rv
cuccgccugccgcu

SEQ ID NO: 1294044 - RNA, 15 nt, Mycobacterium tuberculosis H37Rv
cuccgccguugccgc

SEQ ID NO: 1294045 - RNA, 12 nt, Mycobacterium tuberculosis H37Rv
cuccgccgguca

SEQ ID NO: 1294046 - RNA, 19 nt, Mycobacterium tuberculosis H37Rv
cuccgccguugacgccguu

SEQ ID NO: 1294047 - RNA, 16 nt, Mycobacterium tuberculosis H37Rv
cuccggcgcagcgacc

SEQ ID NO: 1294048 - RNA, 17 nt, Mycobacterium tuberculosis H37Rv
cuccggcgcagcgaccg

SEQ ID NO: 1294049 - RNA, 14 nt, Mycobacterium tuberculosis H37Rv
cuccggccggccua

SEQ ID NO: 1294050 - RNA, 22 nt, Mycobacterium tuberculosis H37Rv
cuccggccaggggaucaccggc

SEQ ID NO: 1294051 - RNA, 15 nt, Mycobacterium tuberculosis H37Rv
cuccggcgcaccugg

SEQ ID NO: 1294052 - RNA, 21 nt, Mycobacterium tuberculosis H37Rv
cuccggcaacagcaccagugu

SEQ ID NO: 1294053 - RNA, 17 nt, Mycobacterium tuberculosis H37Rv
cuccgcggaacccagca

SEQ ID NO: 1294054 - RNA, 19 nt, Mycobacterium tuberculosis H37Rv
cuccgcgguuguuucggcg

SEQ ID NO: 1294055 - RNA, 15 nt, Mycobacterium tuberculosis H37Rv
cuccgcgaucaccga

SEQ ID NO: 1294056 - RNA, 13 nt, Mycobacterium tuberculosis H37Rv
cuccgcugccgcc

SEQ ID NO: 1294057 - RNA, 18 nt, Mycobacterium tuberculosis H37Rv
cuccgcugaugagccgca

SEQ ID NO: 1294058 - RNA, 19 nt, Mycobacterium tuberculosis H37Rv
cuccggacaccccgcacgg

SEQ ID NO: 1294059 - RNA, 19 nt, Mycobacterium tuberculosis H37Rv
cuccggauaacccagcggc

SEQ ID NO: 1294060 - RNA, 15 nt, Mycobacterium tuberculosis H37Rv
cuccggauccucggc

SEQ ID NO: 1294061 - RNA, 16 nt, Mycobacterium tuberculosis H37Rv
cuccggaucgccgaau

SEQ ID NO: 1294062 - RNA, 18 nt, Mycobacterium tuberculosis H37Rv
cuccggauaacccagcgg

SEQ ID NO: 1294063 - RNA, 19 nt, Mycobacterium tuberculosis H37Rv
cuccggaaagcucucggca

SEQ ID NO: 1294064 - RNA, 19 nt, Mycobacterium tuberculosis H37Rv
cuccggagaauccgggacg

SEQ ID NO: 1294065 - RNA, 16 nt, Mycobacterium tuberculosis H37Rv
cucgacguaggccagg

SEQ ID NO: 1294066 - RNA, 12 nt, Mycobacterium tuberculosis H37Rv
cucgaacgcuga

SEQ ID NO: 1294067 - RNA, 19 nt, Mycobacterium tuberculosis H37Rv
cucgaccguauugaccagc

SEQ ID NO: 1294068 - RNA, 18 nt, Mycobacterium tuberculosis H37Rv
cucgacgagcacgccgac

SEQ ID NO: 1294069 - RNA, 17 nt, Mycobacterium tuberculosis H37Rv
cucgaccugacugguca

SEQ ID NO: 1294070 - RNA, 14 nt, Mycobacterium tuberculosis H37Rv
cuccucggccagcg

SEQ ID NO: 1294071 - RNA, 17 nt, Mycobacterium tuberculosis H37Rv
cuccucgacgucggcga

SEQ ID NO: 1294072 - RNA, 17 nt, Mycobacterium tuberculosis H37Rv
cuccucgaccgcggccu

SEQ ID NO: 1294073 - RNA, 20 nt, Mycobacterium tuberculosis H37Rv
cuccuccguuuggcugccga

SEQ ID NO: 1294074 - RNA, 21 nt, Mycobacterium tuberculosis H37Rv
cuccuuugcgggacuaggucc

SEQ ID NO: 1294075 - RNA, 18 nt, Mycobacterium tuberculosis H37Rv
cuccuggguuugccgaug

SEQ ID NO: 1294076 - RNA, 18 nt, Mycobacterium tuberculosis H37Rv
cuccuguggggauuccgc

SEQ ID NO: 1294077 - RNA, 21 nt, Mycobacterium tuberculosis H37Rv
cuccugguugaccucggugaa

SEQ ID NO: 1294078 - RNA, 19 nt, Mycobacterium tuberculosis H37Rv
cuccuguaacugcuccugg

SEQ ID NO: 1294079 - RNA, 16 nt, Mycobacterium tuberculosis H37Rv
cuccuuggcccagcgg

SEQ ID NO: 1294080 - RNA, 12 nt, Mycobacterium tuberculosis H37Rv
cuagccgaagcg

SEQ ID NO: 1294081 - RNA, 22 nt, Mycobacterium tuberculosis H37Rv
cuagccgcggcaccgccgagca

SEQ ID NO: 1294082 - RNA, 15 nt, Mycobacterium tuberculosis H37Rv
cuagcccggcagcac

SEQ ID NO: 1294083 - RNA, 19 nt, Mycobacterium tuberculosis H37Rv
cuagcccgguaucgucccg

SEQ ID NO: 1294084 - RNA, 14 nt, Mycobacterium tuberculosis H37Rv
cuagcccggcagca

SEQ ID NO: 1294085 - RNA, 16 nt, Mycobacterium tuberculosis H37Rv
cuagcaaagccagcgc

SEQ ID NO: 1294086 - RNA, 16 nt, Mycobacterium tuberculosis H37Rv
cuagcgcccgaacccc

SEQ ID NO: 1294087 - RNA, 23 nt, Mycobacterium tuberculosis H37Rv
cuagccggguguuggggaucgca

SEQ ID NO: 1294088 - RNA, 13 nt, Mycobacterium tuberculosis H37Rv
cuagccguucggc

SEQ ID NO: 1294089 - RNA, 17 nt, Mycobacterium tuberculosis H37Rv
cuaucuccaugcucgag

SEQ ID NO: 1294090 - RNA, 22 nt, Mycobacterium tuberculosis H37Rv
cuaugccaacgacaggcgccca

SEQ ID NO: 1294091 - RNA, 16 nt, Mycobacterium tuberculosis H37Rv
cuaugccaacgacagg

SEQ ID NO: 1294092 - RNA, 17 nt, Mycobacterium tuberculosis H37Rv
cucaacaaucggugguc

SEQ ID NO: 1294093 - RNA, 21 nt, Mycobacterium tuberculosis H37Rv
cucaacacuuccgggcgguga

SEQ ID NO: 1294094 - RNA, 20 nt, Mycobacterium tuberculosis H37Rv
cucaaccagcagacgccgua

SEQ ID NO: 1294095 - RNA, 19 nt, Mycobacterium tuberculosis H37Rv
cucaagcgcgucgucacga

SEQ ID NO: 1294096 - RNA, 13 nt, Mycobacterium tuberculosis H37Rv
cucaaggcuucgg

SEQ ID NO: 1294097 - RNA, 12 nt, Mycobacterium tuberculosis H37Rv
cucaacgaucgc

SEQ ID NO: 1294098 - RNA, 21 nt, Mycobacterium tuberculosis H37Rv
cguugagguucuucugcgcca

SEQ ID NO: 1294099 - RNA, 20 nt, Mycobacterium tuberculosis H37Rv
cuacacccguagaccuucga

SEQ ID NO: 1294100 - RNA, 15 nt, Mycobacterium tuberculosis H37Rv
cuaccaacgcaacac

SEQ ID NO: 1294101 - RNA, 14 nt, Mycobacterium tuberculosis H37Rv
cguugaggccggug

SEQ ID NO: 1294102 - RNA, 15 nt, Mycobacterium tuberculosis H37Rv
cguugagaagcguca

SEQ ID NO: 1294103 - RNA, 17 nt, Mycobacterium tuberculosis H37Rv
cguugacucugcgucca

SEQ ID NO: 1294104 - RNA, 23 nt, Mycobacterium tuberculosis H37Rv
cguugaacucgaguugcucgaca

SEQ ID NO: 1294105 - RNA, 17 nt, Mycobacterium tuberculosis H37Rv
cguucuugggaccgacu

SEQ ID NO: 1294106 - RNA, 20 nt, Mycobacterium tuberculosis H37Rv
cguucugucccggcgcgcca

SEQ ID NO: 1294107 - RNA, 21 nt, Mycobacterium tuberculosis H37Rv
cuaccgagaucaccgccacca

SEQ ID NO: 1294108 - RNA, 17 nt, Mycobacterium tuberculosis H37Rv
cuaccgagaucaccgcc

SEQ ID NO: 1294109 - RNA, 14 nt, Mycobacterium tuberculosis H37Rv
cuacgugcugcggg

SEQ ID NO: 1294110 - RNA, 22 nt, Mycobacterium tuberculosis H37Rv
cuagaggcggcccccggcagcg

SEQ ID NO: 1294111 - RNA, 18 nt, Mycobacterium tuberculosis H37Rv
cuacuccaacugaucccg

SEQ ID NO: 1294112 - RNA, 20 nt, Mycobacterium tuberculosis H37Rv
cucaucgauuggcucgagca

SEQ ID NO: 1294113 - RNA, 20 nt, Mycobacterium tuberculosis H37Rv
cucaucgcagacggcugcca

SEQ ID NO: 1294114 - RNA, 18 nt, Mycobacterium tuberculosis H37Rv
cucaucgacucgacccgg

SEQ ID NO: 1294115 - RNA, 18 nt, Mycobacterium tuberculosis H37Rv
cucaugccgagcgaccgu

SEQ ID NO: 1294116 - RNA, 16 nt, Mycobacterium tuberculosis H37Rv
cucaugccgagcgacc

SEQ ID NO: 1294117 - RNA, 14 nt, Mycobacterium tuberculosis H37Rv
cucaggucaccggc

SEQ ID NO: 1294118 - RNA, 19 nt, Mycobacterium tuberculosis H37Rv
cucaggguguucacguuca

SEQ ID NO: 1294119 - RNA, 16 nt, Mycobacterium tuberculosis H37Rv
cucagucgcucucggg

SEQ ID NO: 1294120 - RNA, 14 nt, Mycobacterium tuberculosis H37Rv
cucacguuugccgg

SEQ ID NO: 1294121 - RNA, 17 nt, Mycobacterium tuberculosis H37Rv
cucacguggacugaccu

SEQ ID NO: 1294122 - RNA, 20 nt, Mycobacterium tuberculosis H37Rv
cucacgugcugccgauagcg

SEQ ID NO: 1294123 - RNA, 12 nt, Mycobacterium tuberculosis H37Rv
cucagccguccg

SEQ ID NO: 1294124 - RNA, 13 nt, Mycobacterium tuberculosis H37Rv
cucagcgacagcu

SEQ ID NO: 1294125 - RNA, 23 nt, Mycobacterium tuberculosis H37Rv
cucacagcacagcgcagccugca

SEQ ID NO: 1294126 - RNA, 23 nt, Mycobacterium tuberculosis H37Rv
cucaccaaucugcgggccgguga

SEQ ID NO: 1294127 - RNA, 15 nt, Mycobacterium tuberculosis H37Rv
cucaccacaucggug

SEQ ID NO: 1294128 - RNA, 17 nt, Mycobacterium tuberculosis H37Rv
cucacggcauccgcuca

SEQ ID NO: 1294129 - RNA, 21 nt, Mycobacterium tuberculosis H37Rv
cucacggauucgggcgaagcu

SEQ ID NO: 1294130 - RNA, 18 nt, Mycobacterium tuberculosis H37Rv
cucacgggcgaucgugcg

SEQ ID NO: 1294131 - RNA, 14 nt, Mycobacterium tuberculosis H37Rv
cucaugggcgccau

SEQ ID NO: 1294132 - RNA, 15 nt, Mycobacterium tuberculosis H37Rv
cucauguucucgacc

SEQ ID NO: 1294133 - RNA, 16 nt, Mycobacterium tuberculosis H37Rv
cuccagcagcgacggu

SEQ ID NO: 1294134 - RNA, 22 nt, Mycobacterium tuberculosis H37Rv
cuccagcacccggucgauucgg

SEQ ID NO: 1294135 - RNA, 17 nt, Mycobacterium tuberculosis H37Rv
cuccagcagcccggugg

SEQ ID NO: 1294136 - RNA, 16 nt, Mycobacterium tuberculosis H37Rv
cuccagcgcccgguca

SEQ ID NO: 1294137 - RNA, 21 nt, Mycobacterium tuberculosis H37Rv
cuccagcgcacuacucgaaca

SEQ ID NO: 1294138 - RNA, 18 nt, Mycobacterium tuberculosis H37Rv
cuccagcgccgcggugac

SEQ ID NO: 1294139 - RNA, 16 nt, Mycobacterium tuberculosis H37Rv
cuccagcugggugacc

SEQ ID NO: 1294140 - RNA, 21 nt, Mycobacterium tuberculosis H37Rv
cuccagguagucgcgguaggc

SEQ ID NO: 1294141 - RNA, 20 nt, Mycobacterium tuberculosis H37Rv
cuccaggccuaguccggcac

SEQ ID NO: 1294142 - RNA, 13 nt, Mycobacterium tuberculosis H37Rv
cucccguacgccg

SEQ ID NO: 1294143 - RNA, 22 nt, Mycobacterium tuberculosis H37Rv
cucccgguugggguggcggugc

SEQ ID NO: 1294144 - RNA, 22 nt, Mycobacterium tuberculosis H37Rv
cucccgggugcgacgcgaccgc

SEQ ID NO: 1294145 - RNA, 14 nt, Mycobacterium tuberculosis H37Rv
cucccacgcuucgg

SEQ ID NO: 1294146 - RNA, 20 nt, Mycobacterium tuberculosis H37Rv
cucccacagguagaccgucu

SEQ ID NO: 1294147 - RNA, 23 nt, Mycobacterium tuberculosis H37Rv
cagcgccaccguuaccgccguuu

SEQ ID NO: 1294148 - RNA, 15 nt, Mycobacterium tuberculosis H37Rv
cagcgccaccgaccg

SEQ ID NO: 1294149 - RNA, 14 nt, Mycobacterium tuberculosis H37Rv
cagcgccacccggu

SEQ ID NO: 1294150 - RNA, 15 nt, Mycobacterium tuberculosis H37Rv
cagcgccagcgagca

SEQ ID NO: 1294151 - RNA, 16 nt, Mycobacterium tuberculosis H37Rv
cagcgccagcgccugc

SEQ ID NO: 1294152 - RNA, 18 nt, Mycobacterium tuberculosis H37Rv
cagcgccaagacgucggc

SEQ ID NO: 1294153 - RNA, 20 nt, Mycobacterium tuberculosis H37Rv
cagcgccaacucgagagugg

SEQ ID NO: 1294154 - RNA, 22 nt, Mycobacterium tuberculosis H37Rv
cagcgcaucggucaccaacucc

SEQ ID NO: 1294155 - RNA, 21 nt, Mycobacterium tuberculosis H37Rv
cagcgccaagacgucggcgug

SEQ ID NO: 1294156 - RNA, 16 nt, Mycobacterium tuberculosis H37Rv
cagcgccaucgaugcg

SEQ ID NO: 1294157 - RNA, 22 nt, Mycobacterium tuberculosis H37Rv
cagcgccauuccaagacguugc

SEQ ID NO: 1294158 - RNA, 21 nt, Mycobacterium tuberculosis H37Rv
cagcgcccccagcagcugcga

SEQ ID NO: 1294159 - RNA, 21 nt, Mycobacterium tuberculosis H37Rv
cagcgcccagaucgccgagau

SEQ ID NO: 1294160 - RNA, 15 nt, Mycobacterium tuberculosis H37Rv
cagcgccaggggugu

SEQ ID NO: 1294161 - RNA, 16 nt, Mycobacterium tuberculosis H37Rv
cagcgccaggccguug

SEQ ID NO: 1294162 - RNA, 21 nt, Mycobacterium tuberculosis H37Rv
cagcgccgacccguaccagcc

SEQ ID NO: 1294163 - RNA, 18 nt, Mycobacterium tuberculosis H37Rv
cagcgccgacuccaguuc

SEQ ID NO: 1294164 - RNA, 14 nt, Mycobacterium tuberculosis H37Rv
cagcgccgacagcc

SEQ ID NO: 1294165 - RNA, 19 nt, Mycobacterium tuberculosis H37Rv
cagcgcccuuggacgcgau

SEQ ID NO: 1294166 - RNA, 16 nt, Mycobacterium tuberculosis H37Rv
cagcgccgauaccagc

SEQ ID NO: 1294167 - RNA, 18 nt, Mycobacterium tuberculosis H37Rv
cagcgccgagagcaccgc

SEQ ID NO: 1294168 - RNA, 20 nt, Mycobacterium tuberculosis H37Rv
cagcgcccggcccgccaccc

SEQ ID NO: 1294169 - RNA, 13 nt, Mycobacterium tuberculosis H37Rv
cagcgccgcguug

SEQ ID NO: 1294170 - RNA, 13 nt, Mycobacterium tuberculosis H37Rv
cagcgccgcggug

SEQ ID NO: 1294171 - RNA, 13 nt, Mycobacterium tuberculosis H37Rv
cagcgccgcugac

SEQ ID NO: 1294172 - RNA, 17 nt, Mycobacterium tuberculosis H37Rv
cagcgccggcagcagca

SEQ ID NO: 1294173 - RNA, 20 nt, Mycobacterium tuberculosis H37Rv
cagcgccggccaagaccgcg

SEQ ID NO: 1294174 - RNA, 14 nt, Mycobacterium tuberculosis H37Rv
cagcgccggcagca

SEQ ID NO: 1294175 - RNA, 14 nt, Mycobacterium tuberculosis H37Rv
cagcgccgccaccg

SEQ ID NO: 1294176 - RNA, 17 nt, Mycobacterium tuberculosis H37Rv
cagcgccuccagcacca

SEQ ID NO: 1294177 - RNA, 13 nt, Mycobacterium tuberculosis H37Rv
cagcgccucgacc

SEQ ID NO: 1294178 - RNA, 19 nt, Mycobacterium tuberculosis H37Rv
cagcgccucauccuccagu

SEQ ID NO: 1294179 - RNA, 19 nt, Mycobacterium tuberculosis H37Rv
cagcgccuccagcaccacg

SEQ ID NO: 1294180 - RNA, 21 nt, Mycobacterium tuberculosis H37Rv
cagcgcgacguccaccagccg

SEQ ID NO: 1294181 - RNA, 17 nt, Mycobacterium tuberculosis H37Rv
cagcgcgacguccacca

SEQ ID NO: 1294182 - RNA, 21 nt, Mycobacterium tuberculosis H37Rv
cagcgcgaacaccaugaucag

SEQ ID NO: 1294183 - RNA, 23 nt, Mycobacterium tuberculosis H37Rv
cagcgccuuguggcacacccgca

SEQ ID NO: 1294184 - RNA, 18 nt, Mycobacterium tuberculosis H37Rv
cagcgccuuguggcacac

SEQ ID NO: 1294185 - RNA, 17 nt, Mycobacterium tuberculosis H37Rv
cagcgccuugaccagca

SEQ ID NO: 1294186 - RNA, 18 nt, Mycobacterium tuberculosis H37Rv
cagcgaaacaccggccag

SEQ ID NO: 1294187 - RNA, 18 nt, Mycobacterium tuberculosis H37Rv
cagccuaccggcuacggc

SEQ ID NO: 1294188 - RNA, 14 nt, Mycobacterium tuberculosis H37Rv
cagccugugcugcc

SEQ ID NO: 1294189 - RNA, 17 nt, Mycobacterium tuberculosis H37Rv
cagccguuugaggucua

SEQ ID NO: 1294190 - RNA, 15 nt, Mycobacterium tuberculosis H37Rv
cagccgguccagacc

SEQ ID NO: 1294191 - RNA, 11 nt, Mycobacterium tuberculosis H37Rv
cagccggucga

SEQ ID NO: 1294192 - RNA, 15 nt, Mycobacterium tuberculosis H37Rv
cagccggucgaugcc

SEQ ID NO: 1294193 - RNA, 14 nt, Mycobacterium tuberculosis H37Rv
cagccggucgucgc

SEQ ID NO: 1294194 - RNA, 19 nt, Mycobacterium tuberculosis H37Rv
cagccguucccggugacca

SEQ ID NO: 1294195 - RNA, 19 nt, Mycobacterium tuberculosis H37Rv
cagccgagcguggcguugg

SEQ ID NO: 1294196 - RNA, 17 nt, Mycobacterium tuberculosis H37Rv
cagccgauccgaucgca

SEQ ID NO: 1294197 - RNA, 18 nt, Mycobacterium tuberculosis H37Rv
cagccgaugacguacggc

SEQ ID NO: 1294198 - RNA, 17 nt, Mycobacterium tuberculosis H37Rv
cagccgggcacccuugc

SEQ ID NO: 1294199 - RNA, 14 nt, Mycobacterium tuberculosis H37Rv
cagccgggcgucgc

SEQ ID NO: 1294200 - RNA, 18 nt, Mycobacterium tuberculosis H37Rv
cagccgggugcgcacccg

SEQ ID NO: 1294201 - RNA, 19 nt, Mycobacterium tuberculosis H37Rv
cagccgggucuacagcguu

SEQ ID NO: 1294202 - RNA, 21 nt, Mycobacterium tuberculosis H37Rv
cagcgaggugggcgucaucga

SEQ ID NO: 1294203 - RNA, 14 nt, Mycobacterium tuberculosis H37Rv
cagcgaggccagcg

SEQ ID NO: 1294204 - RNA, 19 nt, Mycobacterium tuberculosis H37Rv
cagcgagcgguugaucgcg

SEQ ID NO: 1294205 - RNA, 15 nt, Mycobacterium tuberculosis H37Rv
cagcgaccucacugc

SEQ ID NO: 1294206 - RNA, 14 nt, Mycobacterium tuberculosis H37Rv
cagcgaccucacga

SEQ ID NO: 1294207 - RNA, 15 nt, Mycobacterium tuberculosis H37Rv
cagcgaccgguaauc

SEQ ID NO: 1294208 - RNA, 17 nt, Mycobacterium tuberculosis H37Rv
cagcgaccgucguccag

SEQ ID NO: 1294209 - RNA, 19 nt, Mycobacterium tuberculosis H37Rv
cagcgagacuucgacgcgg

SEQ ID NO: 1294210 - RNA, 22 nt, Mycobacterium tuberculosis H37Rv
cagcgagacuucgacgcggcga

SEQ ID NO: 1294211 - RNA, 17 nt, Mycobacterium tuberculosis H37Rv
cagcgacccggccagcg

SEQ ID NO: 1294212 - RNA, 12 nt, Mycobacterium tuberculosis H37Rv
cagcgacccguu

SEQ ID NO: 1294213 - RNA, 20 nt, Mycobacterium tuberculosis H37Rv
cagcgcaaagcccuccucga

SEQ ID NO: 1294214 - RNA, 19 nt, Mycobacterium tuberculosis H37Rv
cagcgauuccacggcagca

SEQ ID NO: 1294215 - RNA, 23 nt, Mycobacterium tuberculosis H37Rv
cagcgcaagguugccaacgccuu

SEQ ID NO: 1294216 - RNA, 21 nt, Mycobacterium tuberculosis H37Rv
cagcgaucggggcggugacuc

SEQ ID NO: 1294217 - RNA, 15 nt, Mycobacterium tuberculosis H37Rv
cagcgaugacgacca

SEQ ID NO: 1294218 - RNA, 22 nt, Mycobacterium tuberculosis H37Rv
cagcgauucacgggugcgccac

SEQ ID NO: 1294219 - RNA, 15 nt, Mycobacterium tuberculosis H37Rv
cagcgaucccgguga

SEQ ID NO: 1294220 - RNA, 14 nt, Mycobacterium tuberculosis H37Rv
cagcgaucgccgca

SEQ ID NO: 1294221 - RNA, 19 nt, Mycobacterium tuberculosis H37Rv
cagcgauauccacaauccg

SEQ ID NO: 1294222 - RNA, 23 nt, Mycobacterium tuberculosis H37Rv
cagcgauauugagggugagccga

SEQ ID NO: 1294223 - RNA, 15 nt, Mycobacterium tuberculosis H37Rv
cagcgauauccacaa

SEQ ID NO: 1294224 - RNA, 18 nt, Mycobacterium tuberculosis H37Rv
cagcgcacacuaccgccg

SEQ ID NO: 1294225 - RNA, 14 nt, Mycobacterium tuberculosis H37Rv
cagcgcacggacca

SEQ ID NO: 1294226 - RNA, 13 nt, Mycobacterium tuberculosis H37Rv
cagcgcagcagcg

SEQ ID NO: 1294227 - RNA, 14 nt, Mycobacterium tuberculosis H37Rv
cagcgcacgcagcc

SEQ ID NO: 1294228 - RNA, 21 nt, Mycobacterium tuberculosis H37Rv
cagcaguucggcgaugcgcgg

SEQ ID NO: 1294229 - RNA, 16 nt, Mycobacterium tuberculosis H37Rv
cagcaucggcagcagc

SEQ ID NO: 1294230 - RNA, 14 nt, Mycobacterium tuberculosis H37Rv
cagcaucggucaca

SEQ ID NO: 1294231 - RNA, 17 nt, Mycobacterium tuberculosis H37Rv
cagcaucgucgccacga

SEQ ID NO: 1294232 - RNA, 23 nt, Mycobacterium tuberculosis H37Rv
cagcaugucgggccgcucgaaau

SEQ ID NO: 1294233 - RNA, 20 nt, Mycobacterium tuberculosis H37Rv
cagcaugguuagcggugaug

SEQ ID NO: 1294234 - RNA, 19 nt, Mycobacterium tuberculosis H37Rv
cagcauguccgcagcggug

SEQ ID NO: 1294235 - RNA, 23 nt, Mycobacterium tuberculosis H37Rv
cagcaugggguagaucucuucgg

SEQ ID NO: 1294236 - RNA, 16 nt, Mycobacterium tuberculosis H37Rv
cagccaccaccagguc

SEQ ID NO: 1294237 - RNA, 13 nt, Mycobacterium tuberculosis H37Rv
cagccaccgcgcg

SEQ ID NO: 1294238 - RNA, 22 nt, Mycobacterium tuberculosis H37Rv
cagccaccggugagcgcagcuu

SEQ ID NO: 1294239 - RNA, 13 nt, Mycobacterium tuberculosis H37Rv
cagccaccgcggu

SEQ ID NO: 1294240 - RNA, 15 nt, Mycobacterium tuberculosis H37Rv
cagccaccagccggg

SEQ ID NO: 1294241 - RNA, 16 nt, Mycobacterium tuberculosis H37Rv
cagccaccagccgggc

SEQ ID NO: 1294242 - RNA, 13 nt, Mycobacterium tuberculosis H37Rv
cagccacuccucg

SEQ ID NO: 1294243 - RNA, 15 nt, Mycobacterium tuberculosis H37Rv
cagccagggcgccga

SEQ ID NO: 1294244 - RNA, 24 nt, Mycobacterium tuberculosis H37Rv
cagccagggucccgccgccuggaa

SEQ ID NO: 1294245 - RNA, 22 nt, Mycobacterium tuberculosis H37Rv
cagccaggugcccaagcagucc

SEQ ID NO: 1294246 - RNA, 14 nt, Mycobacterium tuberculosis H37Rv
cagccauacuccga

SEQ ID NO: 1294247 - RNA, 14 nt, Mycobacterium tuberculosis H37Rv
cagccaugcggcug

SEQ ID NO: 1294248 - RNA, 17 nt, Mycobacterium tuberculosis H37Rv
cagccccgcggccagca

SEQ ID NO: 1294249 - RNA, 20 nt, Mycobacterium tuberculosis H37Rv
cagccccuuguaucccucgg

SEQ ID NO: 1294250 - RNA, 17 nt, Mycobacterium tuberculosis H37Rv
cagcccgaacucguugg

SEQ ID NO: 1294251 - RNA, 18 nt, Mycobacterium tuberculosis H37Rv
cagcccgaaccguuuggu

SEQ ID NO: 1294252 - RNA, 20 nt, Mycobacterium tuberculosis H37Rv
cagccgaaccggcaccagcg

SEQ ID NO: 1294253 - RNA, 18 nt, Mycobacterium tuberculosis H37Rv
cagccgaaccggcaccag

SEQ ID NO: 1294254 - RNA, 18 nt, Mycobacterium tuberculosis H37Rv
cagccgaagcgcccguug

SEQ ID NO: 1294255 - RNA, 23 nt, Mycobacterium tuberculosis H37Rv
cagcccuguuugacugcgaccgg

SEQ ID NO: 1294256 - RNA, 18 nt, Mycobacterium tuberculosis H37Rv
cagcccuguuugacugcg

SEQ ID NO: 1294257 - RNA, 16 nt, Mycobacterium tuberculosis H37Rv
cagcccggccagccgc

SEQ ID NO: 1294258 - RNA, 21 nt, Mycobacterium tuberculosis H37Rv
cagcccggcacugaccgcgau

SEQ ID NO: 1294259 - RNA, 22 nt, Mycobacterium tuberculosis H37Rv
cagcccggacguaggcaccccg

SEQ ID NO: 1294260 - RNA, 15 nt, Mycobacterium tuberculosis H37Rv
cagcccgcuggccgu

SEQ ID NO: 1294261 - RNA, 23 nt, Mycobacterium tuberculosis H37Rv
cagcccgaugaucccgccaccga

SEQ ID NO: 1294262 - RNA, 22 nt, Mycobacterium tuberculosis H37Rv
cagcccgaugaucccgccaccg

SEQ ID NO: 1294263 - RNA, 17 nt, Mycobacterium tuberculosis H37Rv
cagcccgaugaucccgc

SEQ ID NO: 1294264 - RNA, 14 nt, Mycobacterium tuberculosis H37Rv
cagcccgacguugc

SEQ ID NO: 1294265 - RNA, 15 nt, Mycobacterium tuberculosis H37Rv
cagcaggcucgaacc

SEQ ID NO: 1294266 - RNA, 14 nt, Mycobacterium tuberculosis H37Rv
cagcagggccacca

SEQ ID NO: 1294267 - RNA, 20 nt, Mycobacterium tuberculosis H37Rv
cagcaggcccuggccaccca

SEQ ID NO: 1294268 - RNA, 18 nt, Mycobacterium tuberculosis H37Rv
cagcaggcccuggccacc

SEQ ID NO: 1294269 - RNA, 15 nt, Mycobacterium tuberculosis H37Rv
cagcagcgggcuggc

SEQ ID NO: 1294270 - RNA, 16 nt, Mycobacterium tuberculosis H37Rv
cagcagcggcgaccgc

SEQ ID NO: 1294271 - RNA, 20 nt, Mycobacterium tuberculosis H37Rv
cagcagcgcgaucugcucgc

SEQ ID NO: 1294272 - RNA, 18 nt, Mycobacterium tuberculosis H37Rv
cagcagguauuugccgug

SEQ ID NO: 1294273 - RNA, 17 nt, Mycobacterium tuberculosis H37Rv
cagcagguccgccaccg

SEQ ID NO: 1294274 - RNA, 16 nt, Mycobacterium tuberculosis H37Rv
cagcaggugagccagu

SEQ ID NO: 1294275 - RNA, 22 nt, Mycobacterium tuberculosis H37Rv
cagcaggucgucggcgucgcgg

SEQ ID NO: 1294276 - RNA, 17 nt, Mycobacterium tuberculosis H37Rv
cagcaguacaccgcccg

SEQ ID NO: 1294277 - RNA, 16 nt, Mycobacterium tuberculosis H37Rv
cagcagugccgugcug

SEQ ID NO: 1294278 - RNA, 15 nt, Mycobacterium tuberculosis H37Rv
cagcagugccgugcu

SEQ ID NO: 1294279 - RNA, 15 nt, Mycobacterium tuberculosis H37Rv
cagcagugccaccgg

SEQ ID NO: 1294280 - RNA, 14 nt, Mycobacterium tuberculosis H37Rv
cagcacuccgcggg

SEQ ID NO: 1294281 - RNA, 20 nt, Mycobacterium tuberculosis H37Rv
cagcacugccaucgcggcgu

SEQ ID NO: 1294282 - RNA, 17 nt, Mycobacterium tuberculosis H37Rv
cagcagcaaacaucgca

SEQ ID NO: 1294283 - RNA, 17 nt, Mycobacterium tuberculosis H37Rv
cagcagcaccugcaccg

SEQ ID NO: 1294284 - RNA, 14 nt, Mycobacterium tuberculosis H37Rv
cagcagccaggagc

SEQ ID NO: 1294285 - RNA, 14 nt, Mycobacterium tuberculosis H37Rv
cagcagcgcgacgg

SEQ ID NO: 1294286 - RNA, 21 nt, Mycobacterium tuberculosis H37Rv
cagcagcgaaaaccgucgcag

SEQ ID NO: 1294287 - RNA, 23 nt, Mycobacterium tuberculosis H37Rv
cagcagccggcguacuucgacag

SEQ ID NO: 1294288 - RNA, 17 nt, Mycobacterium tuberculosis H37Rv
cagcacggugaucagca

SEQ ID NO: 1294289 - RNA, 21 nt, Mycobacterium tuberculosis H37Rv
cagcacgguguugcgcacccg

SEQ ID NO: 1294290 - RNA, 21 nt, Mycobacterium tuberculosis H37Rv
cagcacgguggcuucgacggc

SEQ ID NO: 1294291 - RNA, 15 nt, Mycobacterium tuberculosis H37Rv
cagcacggucaacgu

SEQ ID NO: 1294292 - RNA, 18 nt, Mycobacterium tuberculosis H37Rv
cagcacgugugcgggcac

SEQ ID NO: 1294293 - RNA, 13 nt, Mycobacterium tuberculosis H37Rv
cagcacguacugc

SEQ ID NO: 1294294 - RNA, 12 nt, Mycobacterium tuberculosis H37Rv
cagcacgucgca

SEQ ID NO: 1294295 - RNA, 14 nt, Mycobacterium tuberculosis H37Rv
cagcaagagccgca

SEQ ID NO: 1294296 - RNA, 20 nt, Mycobacterium tuberculosis H37Rv
cacgccgggugccgccacgu

SEQ ID NO: 1294297 - RNA, 15 nt, Mycobacterium tuberculosis H37Rv
cacgccgggugccgc

SEQ ID NO: 1294298 - RNA, 12 nt, Mycobacterium tuberculosis H37Rv
cacgccgucacc

SEQ ID NO: 1294299 - RNA, 14 nt, Mycobacterium tuberculosis H37Rv
cacgccgucaccgc

SEQ ID NO: 1294300 - RNA, 17 nt, Mycobacterium tuberculosis H37Rv
cacgccgucaccgcuga

SEQ ID NO: 1294301 - RNA, 19 nt, Mycobacterium tuberculosis H37Rv
cacgccggugucguucggc

SEQ ID NO: 1294302 - RNA, 23 nt, Mycobacterium tuberculosis H37Rv
cacgccguagcgcagcgccuccu

SEQ ID NO: 1294303 - RNA, 13 nt, Mycobacterium tuberculosis H37Rv
cacgccgucgaca

SEQ ID NO: 1294304 - RNA, 20 nt, Mycobacterium tuberculosis H37Rv
cacgccucgccgaagugguc

SEQ ID NO: 1294305 - RNA, 17 nt, Mycobacterium tuberculosis H37Rv
cacgcggaccucgaagc

SEQ ID NO: 1294306 - RNA, 13 nt, Mycobacterium tuberculosis H37Rv
cacgcggcaaugg

SEQ ID NO: 1294307 - RNA, 14 nt, Mycobacterium tuberculosis H37Rv
cacgcgggugccga

SEQ ID NO: 1294308 - RNA, 13 nt, Mycobacterium tuberculosis H37Rv
cacgcgggcguug

SEQ ID NO: 1294309 - RNA, 12 nt, Mycobacterium tuberculosis H37Rv
cacgcggcgaug

SEQ ID NO: 1294310 - RNA, 13 nt, Mycobacterium tuberculosis H37Rv
cacgccgauaccg

SEQ ID NO: 1294311 - RNA, 19 nt, Mycobacterium tuberculosis H37Rv
cacgccgaccaucucaccg

SEQ ID NO: 1294312 - RNA, 22 nt, Mycobacterium tuberculosis H37Rv
cacgccgaugauggacaccagc

SEQ ID NO: 1294313 - RNA, 13 nt, Mycobacterium tuberculosis H37Rv
cacgccgauucgc

SEQ ID NO: 1294314 - RNA, 15 nt, Mycobacterium tuberculosis H37Rv
cacgccgaugaugga

SEQ ID NO: 1294315 - RNA, 20 nt, Mycobacterium tuberculosis H37Rv
cacgccggcaucgucgacgc

SEQ ID NO: 1294316 - RNA, 18 nt, Mycobacterium tuberculosis H37Rv
cacgcccacagcugacga

SEQ ID NO: 1294317 - RNA, 21 nt, Mycobacterium tuberculosis H37Rv
caccuccagguagucgcggua

SEQ ID NO: 1294318 - RNA, 17 nt, Mycobacterium tuberculosis H37Rv
caccucaugaucucacc

SEQ ID NO: 1294319 - RNA, 16 nt, Mycobacterium tuberculosis H37Rv
cacgcugucgaucuga

SEQ ID NO: 1294320 - RNA, 15 nt, Mycobacterium tuberculosis H37Rv
cacgcugugcucgac

SEQ ID NO: 1294321 - RNA, 15 nt, Mycobacterium tuberculosis H37Rv
cacgcugucgaucug

SEQ ID NO: 1294322 - RNA, 13 nt, Mycobacterium tuberculosis H37Rv
cacgcugucgauc

SEQ ID NO: 1294323 - RNA, 22 nt, Mycobacterium tuberculosis H37Rv
cacgcugcuggugacgaaagcg

SEQ ID NO: 1294324 - RNA, 19 nt, Mycobacterium tuberculosis H37Rv
cacggcagccuugaucucg

SEQ ID NO: 1294325 - RNA, 18 nt, Mycobacterium tuberculosis H37Rv
cacggcagacacgcugca

SEQ ID NO: 1294326 - RNA, 15 nt, Mycobacterium tuberculosis H37Rv
cacggcaucggccac

SEQ ID NO: 1294327 - RNA, 21 nt, Mycobacterium tuberculosis H37Rv
cacgcuuguacaagucgacca

SEQ ID NO: 1294328 - RNA, 21 nt, Mycobacterium tuberculosis H37Rv
cacggaccagcgccggaccgu

SEQ ID NO: 1294329 - RNA, 22 nt, Mycobacterium tuberculosis H37Rv
cacgcugaccggaucugacggc

SEQ ID NO: 1294330 - RNA, 20 nt, Mycobacterium tuberculosis H37Rv
cacgcugagccggucgcgca

SEQ ID NO: 1294331 - RNA, 17 nt, Mycobacterium tuberculosis H37Rv
cacgcugcagauggaac

SEQ ID NO: 1294332 - RNA, 20 nt, Mycobacterium tuberculosis H37Rv
cacgcucggcggccagcucc

SEQ ID NO: 1294333 - RNA, 13 nt, Mycobacterium tuberculosis H37Rv
cacgcucggcgug

SEQ ID NO: 1294334 - RNA, 14 nt, Mycobacterium tuberculosis H37Rv
cacgcucggcgugu

SEQ ID NO: 1294335 - RNA, 19 nt, Mycobacterium tuberculosis H37Rv
cacgcucgggggauccggc

SEQ ID NO: 1294336 - RNA, 21 nt, Mycobacterium tuberculosis H37Rv
cacgcucggugaaggucaccg

SEQ ID NO: 1294337 - RNA, 22 nt, Mycobacterium tuberculosis H37Rv
cacgcucggugaaggucaccgu

SEQ ID NO: 1294338 - RNA, 15 nt, Mycobacterium tuberculosis H37Rv
cacgcuagccgacag

SEQ ID NO: 1294339 - RNA, 20 nt, Mycobacterium tuberculosis H37Rv
cacgcguuucgaaccgcacg

SEQ ID NO: 1294340 - RNA, 22 nt, Mycobacterium tuberculosis H37Rv
cacgcguuccauggcccgcucg

SEQ ID NO: 1294341 - RNA, 21 nt, Mycobacterium tuberculosis H37Rv
cacgcgugacucggccgacga

SEQ ID NO: 1294342 - RNA, 18 nt, Mycobacterium tuberculosis H37Rv
cacgcgugacucggccga

SEQ ID NO: 1294343 - RNA, 14 nt, Mycobacterium tuberculosis H37Rv
cacgcguagcgguc

SEQ ID NO: 1294344 - RNA, 18 nt, Mycobacterium tuberculosis H37Rv
cacgcucacccggcgucu

SEQ ID NO: 1294345 - RNA, 20 nt, Mycobacterium tuberculosis H37Rv
cacgggaguacgggagccgg

SEQ ID NO: 1294346 - RNA, 15 nt, Mycobacterium tuberculosis H37Rv
cacgggcacgaucgu

SEQ ID NO: 1294347 - RNA, 21 nt, Mycobacterium tuberculosis H37Rv
cacggcuucggcgagcgcauc

SEQ ID NO: 1294348 - RNA, 16 nt, Mycobacterium tuberculosis H37Rv
cacggcgaggugcucg

SEQ ID NO: 1294349 - RNA, 15 nt, Mycobacterium tuberculosis H37Rv
cacgggacgacggca

SEQ ID NO: 1294350 - RNA, 22 nt, Mycobacterium tuberculosis H37Rv
cacggucagcucgcugacggca

SEQ ID NO: 1294351 - RNA, 16 nt, Mycobacterium tuberculosis H37Rv
cacggucacacgccag

SEQ ID NO: 1294352 - RNA, 15 nt, Mycobacterium tuberculosis H37Rv
cacgggcgaccugcg

SEQ ID NO: 1294353 - RNA, 16 nt, Mycobacterium tuberculosis H37Rv
cacggcgaggccgaac

SEQ ID NO: 1294354 - RNA, 17 nt, Mycobacterium tuberculosis H37Rv
cacggcgaccacgccgc

SEQ ID NO: 1294355 - RNA, 14 nt, Mycobacterium tuberculosis H37Rv
cacggcgacgccag

SEQ ID NO: 1294356 - RNA, 14 nt, Mycobacterium tuberculosis H37Rv
cacggucgccgacc

SEQ ID NO: 1294357 - RNA, 18 nt, Mycobacterium tuberculosis H37Rv
cacggucagcacgcugac

SEQ ID NO: 1294358 - RNA, 16 nt, Mycobacterium tuberculosis H37Rv
cacgguucgggcagca

SEQ ID NO: 1294359 - RNA, 17 nt, Mycobacterium tuberculosis H37Rv
cacgguucuuggcgucu

SEQ ID NO: 1294360 - RNA, 13 nt, Mycobacterium tuberculosis H37Rv
cacgguuggccac

SEQ ID NO: 1294361 - RNA, 14 nt, Mycobacterium tuberculosis H37Rv
cacgguugccggcg

SEQ ID NO: 1294362 - RNA, 17 nt, Mycobacterium tuberculosis H37Rv
cacguaacgccgcggug

SEQ ID NO: 1294363 - RNA, 21 nt, Mycobacterium tuberculosis H37Rv
cacguacuuggacgacccggg

SEQ ID NO: 1294364 - RNA, 23 nt, Mycobacterium tuberculosis H37Rv
cacguagcagcagacgacgauca

SEQ ID NO: 1294365 - RNA, 18 nt, Mycobacterium tuberculosis H37Rv
cacgucaucggcuggccg

SEQ ID NO: 1294366 - RNA, 22 nt, Mycobacterium tuberculosis H37Rv
cacgucauaucucgagcccucg

SEQ ID NO: 1294367 - RNA, 21 nt, Mycobacterium tuberculosis H37Rv
cacgucaagaagaacucggug

SEQ ID NO: 1294368 - RNA, 17 nt, Mycobacterium tuberculosis H37Rv
cacguaguagccgagca

SEQ ID NO: 1294369 - RNA, 14 nt, Mycobacterium tuberculosis H37Rv
cacgugcacggcga

SEQ ID NO: 1294370 - RNA, 17 nt, Mycobacterium tuberculosis H37Rv
cacgucgaggcggcagu

SEQ ID NO: 1294371 - RNA, 16 nt, Mycobacterium tuberculosis H37Rv
cacgucgagcacccgc

SEQ ID NO: 1294372 - RNA, 22 nt, Mycobacterium tuberculosis H37Rv
cacgucgaccgaacccgacguc

SEQ ID NO: 1294373 - RNA, 13 nt, Mycobacterium tuberculosis H37Rv
cacgucgagcacc

SEQ ID NO: 1294374 - RNA, 23 nt, Mycobacterium tuberculosis H37Rv
cacgucgaacucguugaagaauc

SEQ ID NO: 1294375 - RNA, 20 nt, Mycobacterium tuberculosis H37Rv
cacgucgacaccgaggaccu

SEQ ID NO: 1294376 - RNA, 22 nt, Mycobacterium tuberculosis H37Rv
cacgucgaaaucggugcacaac

SEQ ID NO: 1294377 - RNA, 18 nt, Mycobacterium tuberculosis H37Rv
cacgucgacccccugcca

SEQ ID NO: 1294378 - RNA, 17 nt, Mycobacterium tuberculosis H37Rv
cacgucgaaaucggugc

SEQ ID NO: 1294379 - RNA, 13 nt, Mycobacterium tuberculosis H37Rv
cacguucacgcgc

SEQ ID NO: 1294380 - RNA, 16 nt, Mycobacterium tuberculosis H37Rv
cacguucggcugcgaa

SEQ ID NO: 1294381 - RNA, 14 nt, Mycobacterium tuberculosis H37Rv
cacguggucgagca

SEQ ID NO: 1294382 - RNA, 14 nt, Mycobacterium tuberculosis H37Rv
cacguggucggcca

SEQ ID NO: 1294383 - RNA, 22 nt, Mycobacterium tuberculosis H37Rv
cacgugugcggaagcaucggcu

SEQ ID NO: 1294384 - RNA, 22 nt, Mycobacterium tuberculosis H37Rv
cacguguggugugucaccggau

SEQ ID NO: 1294385 - RNA, 16 nt, Mycobacterium tuberculosis H37Rv
cacgugggccaugcua

SEQ ID NO: 1294386 - RNA, 16 nt, Mycobacterium tuberculosis H37Rv
cacgugggcacucauc

SEQ ID NO: 1294387 - RNA, 19 nt, Mycobacterium tuberculosis H37Rv
cacgugcccgcgcggcgca

SEQ ID NO: 1294388 - RNA, 23 nt, Mycobacterium tuberculosis H37Rv
cacguggagucgaaagaacaacc

SEQ ID NO: 1294389 - RNA, 12 nt, Mycobacterium tuberculosis H37Rv
cacucagcaggg

SEQ ID NO: 1294390 - RNA, 20 nt, Mycobacterium tuberculosis H37Rv
cacuaaccuggcguagauca

SEQ ID NO: 1294391 - RNA, 23 nt, Mycobacterium tuberculosis H37Rv
cacguugccgaucccggcgagca

SEQ ID NO: 1294392 - RNA, 14 nt, Mycobacterium tuberculosis H37Rv
cacguugauucggg

SEQ ID NO: 1294393 - RNA, 16 nt, Mycobacterium tuberculosis H37Rv
cacguugauccgcgca

SEQ ID NO: 1294394 - RNA, 19 nt, Mycobacterium tuberculosis H37Rv
cacguugaugaugccggcg

SEQ ID NO: 1294395 - RNA, 19 nt, Mycobacterium tuberculosis H37Rv
cacguugugcagcgcguca

SEQ ID NO: 1294396 - RNA, 13 nt, Mycobacterium tuberculosis H37Rv
cagaccgugacgu

SEQ ID NO: 1294397 - RNA, 19 nt, Mycobacterium tuberculosis H37Rv
cagaccgccgacgccguug

SEQ ID NO: 1294398 - RNA, 17 nt, Mycobacterium tuberculosis H37Rv
cagaccggcucgucggg

SEQ ID NO: 1294399 - RNA, 16 nt, Mycobacterium tuberculosis H37Rv
cagaccggugcugucg

SEQ ID NO: 1294400 - RNA, 19 nt, Mycobacterium tuberculosis H37Rv
cagacgccgucugacagca

SEQ ID NO: 1294401 - RNA, 17 nt, Mycobacterium tuberculosis H37Rv
cagacgccggccgccga

SEQ ID NO: 1294402 - RNA, 23 nt, Mycobacterium tuberculosis H37Rv
cagacgccacugccagccgugca

SEQ ID NO: 1294403 - RNA, 19 nt, Mycobacterium tuberculosis H37Rv
cagacgcaaaaucgcccau

SEQ ID NO: 1294404 - RNA, 13 nt, Mycobacterium tuberculosis H37Rv
cagacgauggcca

SEQ ID NO: 1294405 - RNA, 16 nt, Mycobacterium tuberculosis H37Rv
cagacgcagagucgca

SEQ ID NO: 1294406 - RNA, 20 nt, Mycobacterium tuberculosis H37Rv
cagacgcaaaaucgcccaau

SEQ ID NO: 1294407 - RNA, 11 nt, Mycobacterium tuberculosis H37Rv
cagacgacguc

SEQ ID NO: 1294408 - RNA, 13 nt, Mycobacterium tuberculosis H37Rv
cagacgacgucgg

SEQ ID NO: 1294409 - RNA, 18 nt, Mycobacterium tuberculosis H37Rv
cagacgaaguagccgacc

SEQ ID NO: 1294410 - RNA, 18 nt, Mycobacterium tuberculosis H37Rv
cagacgauggccagguug

SEQ ID NO: 1294411 - RNA, 14 nt, Mycobacterium tuberculosis H37Rv
cagacgauggccag

SEQ ID NO: 1294412 - RNA, 18 nt, Mycobacterium tuberculosis H37Rv
cagaccgaacagcaccga

SEQ ID NO: 1294413 - RNA, 16 nt, Mycobacterium tuberculosis H37Rv
cagacccgugccguca

SEQ ID NO: 1294414 - RNA, 14 nt, Mycobacterium tuberculosis H37Rv
cagacccaccaccg

SEQ ID NO: 1294415 - RNA, 13 nt, Mycobacterium tuberculosis H37Rv
cagacccacgaug

SEQ ID NO: 1294416 - RNA, 23 nt, Mycobacterium tuberculosis H37Rv
cagaccaagcccgucgucgugca

SEQ ID NO: 1294417 - RNA, 20 nt, Mycobacterium tuberculosis H37Rv
cagacacugcugcggcagcg

SEQ ID NO: 1294418 - RNA, 15 nt, Mycobacterium tuberculosis H37Rv
cagacacagaaucgc

SEQ ID NO: 1294419 - RNA, 23 nt, Mycobacterium tuberculosis H37Rv
cagaacggcguugcggaaucagc

SEQ ID NO: 1294420 - RNA, 22 nt, Mycobacterium tuberculosis H37Rv
cagaacuggacaagcuccucgc

SEQ ID NO: 1294421 - RNA, 17 nt, Mycobacterium tuberculosis H37Rv
cacucguugaccggccg

SEQ ID NO: 1294422 - RNA, 15 nt, Mycobacterium tuberculosis H37Rv
cacucguugccgacc

SEQ ID NO: 1294423 - RNA, 15 nt, Mycobacterium tuberculosis H37Rv
cacucguugaccggc

SEQ ID NO: 1294424 - RNA, 13 nt, Mycobacterium tuberculosis H37Rv
cacuugaucgacg

SEQ ID NO: 1294425 - RNA, 21 nt, Mycobacterium tuberculosis H37Rv
cacuucuuucgaaaugagguc

SEQ ID NO: 1294426 - RNA, 17 nt, Mycobacterium tuberculosis H37Rv
cacuucgguguuggaca

SEQ ID NO: 1294427 - RNA, 21 nt, Mycobacterium tuberculosis H37Rv
cacuucggugccgugaucggc

SEQ ID NO: 1294428 - RNA, 18 nt, Mycobacterium tuberculosis H37Rv
cacuucggcguccaaggc

SEQ ID NO: 1294429 - RNA, 20 nt, Mycobacterium tuberculosis H37Rv
cacuccaagucacagcucac

SEQ ID NO: 1294430 - RNA, 14 nt, Mycobacterium tuberculosis H37Rv
cacucaucggugug

SEQ ID NO: 1294431 - RNA, 17 nt, Mycobacterium tuberculosis H37Rv
cacuccggagcccacac

SEQ ID NO: 1294432 - RNA, 21 nt, Mycobacterium tuberculosis H37Rv
cacucgcggauccgggcgugg

SEQ ID NO: 1294433 - RNA, 18 nt, Mycobacterium tuberculosis H37Rv
cacucgcggguugccucg

SEQ ID NO: 1294434 - RNA, 17 nt, Mycobacterium tuberculosis H37Rv
cacucgguuugacgaga

SEQ ID NO: 1294435 - RNA, 18 nt, Mycobacterium tuberculosis H37Rv
cacucgggauucggcagc

SEQ ID NO: 1294436 - RNA, 14 nt, Mycobacterium tuberculosis H37Rv
cagacgcugcccaa

SEQ ID NO: 1294437 - RNA, 20 nt, Mycobacterium tuberculosis H37Rv
cagacgcggaaucgcaccgu

SEQ ID NO: 1294438 - RNA, 13 nt, Mycobacterium tuberculosis H37Rv
cagacgucaugcg

SEQ ID NO: 1294439 - RNA, 14 nt, Mycobacterium tuberculosis H37Rv
cagacggugcagcu

SEQ ID NO: 1294440 - RNA, 21 nt, Mycobacterium tuberculosis H37Rv
cagacggguggcccgaccggg

SEQ ID NO: 1294441 - RNA, 14 nt, Mycobacterium tuberculosis H37Rv
cagacugucgagcg

SEQ ID NO: 1294442 - RNA, 20 nt, Mycobacterium tuberculosis H37Rv
cagagcguuccgcucgaauc

SEQ ID NO: 1294443 - RNA, 15 nt, Mycobacterium tuberculosis H37Rv
cagaggucggucagc

SEQ ID NO: 1294444 - RNA, 20 nt, Mycobacterium tuberculosis H37Rv
cagagacgaucaucucgucg

SEQ ID NO: 1294445 - RNA, 17 nt, Mycobacterium tuberculosis H37Rv
cagauccacgccgacca

SEQ ID NO: 1294446 - RNA, 18 nt, Mycobacterium tuberculosis H37Rv
cagagucaacaucagcac

SEQ ID NO: 1294447 - RNA, 14 nt, Mycobacterium tuberculosis H37Rv
cagagucgcccgca

SEQ ID NO: 1294448 - RNA, 17 nt, Mycobacterium tuberculosis H37Rv
cagaguugccgggucga

SEQ ID NO: 1294449 - RNA, 18 nt, Mycobacterium tuberculosis H37Rv
cagauccgggcaugcgcc

SEQ ID NO: 1294450 - RNA, 19 nt, Mycobacterium tuberculosis H37Rv
cagauccgacgaccgcauu

SEQ ID NO: 1294451 - RNA, 15 nt, Mycobacterium tuberculosis H37Rv
cagauccgcagcguc

SEQ ID NO: 1294452 - RNA, 16 nt, Mycobacterium tuberculosis H37Rv
cagaucggccggauac

SEQ ID NO: 1294453 - RNA, 13 nt, Mycobacterium tuberculosis H37Rv
cagaugcaccucg

SEQ ID NO: 1294454 - RNA, 17 nt, Mycobacterium tuberculosis H37Rv
cagaucuuccgagcacu

SEQ ID NO: 1294455 - RNA, 12 nt, Mycobacterium tuberculosis H37Rv
cagaucuugcag

SEQ ID NO: 1294456 - RNA, 17 nt, Mycobacterium tuberculosis H37Rv
cagaucuccccgaccgc

SEQ ID NO: 1294457 - RNA, 14 nt, Mycobacterium tuberculosis H37Rv
cagaucguccaccg

SEQ ID NO: 1294458 - RNA, 24 nt, Mycobacterium tuberculosis H37Rv
cagaugcaccucgcccugcagacg

SEQ ID NO: 1294459 - RNA, 21 nt, Mycobacterium tuberculosis H37Rv
cagauuggaagacgccggcga

SEQ ID NO: 1294460 - RNA, 23 nt, Mycobacterium tuberculosis H37Rv
cagcaaaaacgcugccgccguuc

SEQ ID NO: 1294461 - RNA, 17 nt, Mycobacterium tuberculosis H37Rv
cagcaacagcgcggugu

SEQ ID NO: 1294462 - RNA, 17 nt, Mycobacterium tuberculosis H37Rv
caggcccacggcgacca

SEQ ID NO: 1294463 - RNA, 17 nt, Mycobacterium tuberculosis H37Rv
caggcaccccgaucacc

SEQ ID NO: 1294464 - RNA, 15 nt, Mycobacterium tuberculosis H37Rv
caggcaccacgaccg

SEQ ID NO: 1294465 - RNA, 19 nt, Mycobacterium tuberculosis H37Rv
caggcccauacgugccgcc

SEQ ID NO: 1294466 - RNA, 19 nt, Mycobacterium tuberculosis H37Rv
caggcccaggucaacgacg

SEQ ID NO: 1294467 - RNA, 14 nt, Mycobacterium tuberculosis H37Rv
caggcccucgggac

SEQ ID NO: 1294468 - RNA, 23 nt, Mycobacterium tuberculosis H37Rv
caggccgacaaugucggcgaugc

SEQ ID NO: 1294469 - RNA, 16 nt, Mycobacterium tuberculosis H37Rv
caggcccgggcggaug

SEQ ID NO: 1294470 - RNA, 17 nt, Mycobacterium tuberculosis H37Rv
caggcccggcaccgcgu

SEQ ID NO: 1294471 - RNA, 15 nt, Mycobacterium tuberculosis H37Rv
caggccggccaccag

SEQ ID NO: 1294472 - RNA, 15 nt, Mycobacterium tuberculosis H37Rv
caggccgagcucguu

SEQ ID NO: 1294473 - RNA, 15 nt, Mycobacterium tuberculosis H37Rv
caggccgaggcgagu

SEQ ID NO: 1294474 - RNA, 15 nt, Mycobacterium tuberculosis H37Rv
caggccgaccgcgca

SEQ ID NO: 1294475 - RNA, 14 nt, Mycobacterium tuberculosis H37Rv
caggccgggcgcaa

SEQ ID NO: 1294476 - RNA, 16 nt, Mycobacterium tuberculosis H37Rv
caggccgguaccggga

SEQ ID NO: 1294477 - RNA, 19 nt, Mycobacterium tuberculosis H37Rv
caggccguguacgugcucg

SEQ ID NO: 1294478 - RNA, 16 nt, Mycobacterium tuberculosis H37Rv
caggccguaguggccg

SEQ ID NO: 1294479 - RNA, 19 nt, Mycobacterium tuberculosis H37Rv
caggccguagcccacgacg

SEQ ID NO: 1294480 - RNA, 18 nt, Mycobacterium tuberculosis H37Rv
caggccguagcccacgac

SEQ ID NO: 1294481 - RNA, 17 nt, Mycobacterium tuberculosis H37Rv
caggccgucaggcgugc

SEQ ID NO: 1294482 - RNA, 19 nt, Mycobacterium tuberculosis H37Rv
caggccguccucggucagc

SEQ ID NO: 1294483 - RNA, 14 nt, Mycobacterium tuberculosis H37Rv
caggcgcugcagca

SEQ ID NO: 1294484 - RNA, 15 nt, Mycobacterium tuberculosis H37Rv
caggcgccgucucgc

SEQ ID NO: 1294485 - RNA, 22 nt, Mycobacterium tuberculosis H37Rv
caggcggcggccuggcacccgg

SEQ ID NO: 1294486 - RNA, 23 nt, Mycobacterium tuberculosis H37Rv
caggcggcggccuggcacccggg

SEQ ID NO: 1294487 - RNA, 20 nt, Mycobacterium tuberculosis H37Rv
caggcggccgucgucggcca

SEQ ID NO: 1294488 - RNA, 17 nt, Mycobacterium tuberculosis H37Rv
caggcggccuugccggg

SEQ ID NO: 1294489 - RNA, 22 nt, Mycobacterium tuberculosis H37Rv
caggcggcugaacggcagccga

SEQ ID NO: 1294490 - RNA, 20 nt, Mycobacterium tuberculosis H37Rv
caggcggcuggcccgcaugc

SEQ ID NO: 1294491 - RNA, 14 nt, Mycobacterium tuberculosis H37Rv
caggcggccgucgu

SEQ ID NO: 1294492 - RNA, 15 nt, Mycobacterium tuberculosis H37Rv
caggcggccgucguc

SEQ ID NO: 1294493 - RNA, 19 nt, Mycobacterium tuberculosis H37Rv
caggcggcggacccgcucg

SEQ ID NO: 1294494 - RNA, 17 nt, Mycobacterium tuberculosis H37Rv
caggcugcagucgagca

SEQ ID NO: 1294495 - RNA, 22 nt, Mycobacterium tuberculosis H37Rv
caggcugaucccgaugcuggca

SEQ ID NO: 1294496 - RNA, 18 nt, Mycobacterium tuberculosis H37Rv
caggcuggcgagggcuga

SEQ ID NO: 1294497 - RNA, 22 nt, Mycobacterium tuberculosis H37Rv
caggcucacacucggccgggcu

SEQ ID NO: 1294498 - RNA, 17 nt, Mycobacterium tuberculosis H37Rv
caggcucgccgaugcug

SEQ ID NO: 1294499 - RNA, 23 nt, Mycobacterium tuberculosis H37Rv
caggcugaaggacggcagcuugg

SEQ ID NO: 1294500 - RNA, 20 nt, Mycobacterium tuberculosis H37Rv
caggcgucccagccgaucac

SEQ ID NO: 1294501 - RNA, 16 nt, Mycobacterium tuberculosis H37Rv
caggcgucggugaccu

SEQ ID NO: 1294502 - RNA, 19 nt, Mycobacterium tuberculosis H37Rv
caggcgugcacaggucagc

SEQ ID NO: 1294503 - RNA, 19 nt, Mycobacterium tuberculosis H37Rv
caggcguuggaucccagcc

SEQ ID NO: 1294504 - RNA, 23 nt, Mycobacterium tuberculosis H37Rv
caggcguuggaucccagcccgaa

SEQ ID NO: 1294505 - RNA, 21 nt, Mycobacterium tuberculosis H37Rv
caggcgguacgggucgccgga

SEQ ID NO: 1294506 - RNA, 21 nt, Mycobacterium tuberculosis H37Rv
caggcguccaucagagacagc

SEQ ID NO: 1294507 - RNA, 16 nt, Mycobacterium tuberculosis H37Rv
caggcguccaucgcca

SEQ ID NO: 1294508 - RNA, 15 nt, Mycobacterium tuberculosis H37Rv
caggcgggaacgauc

SEQ ID NO: 1294509 - RNA, 16 nt, Mycobacterium tuberculosis H37Rv
caggcgggggaucucg

SEQ ID NO: 1294510 - RNA, 22 nt, Mycobacterium tuberculosis H37Rv
caggcgggggaucggugguacg

SEQ ID NO: 1294511 - RNA, 16 nt, Mycobacterium tuberculosis H37Rv
caggcgggggaucggu

SEQ ID NO: 1294512 - RNA, 22 nt, Mycobacterium tuberculosis H37Rv
cagggacccgagaucaccggua

SEQ ID NO: 1294513 - RNA, 18 nt, Mycobacterium tuberculosis H37Rv
cagggaaccauugcccga

SEQ ID NO: 1294514 - RNA, 13 nt, Mycobacterium tuberculosis H37Rv
caggcuugcggca

SEQ ID NO: 1294515 - RNA, 15 nt, Mycobacterium tuberculosis H37Rv
caggcuuggcaugcg

SEQ ID NO: 1294516 - RNA, 17 nt, Mycobacterium tuberculosis H37Rv
caggcugucaauccgcc

SEQ ID NO: 1294517 - RNA, 23 nt, Mycobacterium tuberculosis H37Rv
caggcuguggccagcaucaucaa

SEQ ID NO: 1294518 - RNA, 13 nt, Mycobacterium tuberculosis H37Rv
caggcuuccagcc

SEQ ID NO: 1294519 - RNA, 22 nt, Mycobacterium tuberculosis H37Rv
cagggcacguucggcgcacagc

SEQ ID NO: 1294520 - RNA, 15 nt, Mycobacterium tuberculosis H37Rv
cagggcaacacuugu

SEQ ID NO: 1294521 - RNA, 12 nt, Mycobacterium tuberculosis H37Rv
cagggcagcccg

SEQ ID NO: 1294522 - RNA, 18 nt, Mycobacterium tuberculosis H37Rv
cagggccucgaccgccag

SEQ ID NO: 1294523 - RNA, 16 nt, Mycobacterium tuberculosis H37Rv
cagggcgucgaccgcg

SEQ ID NO: 1294524 - RNA, 20 nt, Mycobacterium tuberculosis H37Rv
cagggcgucggcgacgucca

SEQ ID NO: 1294525 - RNA, 19 nt, Mycobacterium tuberculosis H37Rv
cagggcgucggcgacgucc

SEQ ID NO: 1294526 - RNA, 17 nt, Mycobacterium tuberculosis H37Rv
cagggcgucgaccgcgg

SEQ ID NO: 1294527 - RNA, 14 nt, Mycobacterium tuberculosis H37Rv
cagggcgucgaccu

SEQ ID NO: 1294528 - RNA, 18 nt, Mycobacterium tuberculosis H37Rv
cagggcggugcucuucgg

SEQ ID NO: 1294529 - RNA, 19 nt, Mycobacterium tuberculosis H37Rv
cagggcgacgagaucugcg

SEQ ID NO: 1294530 - RNA, 16 nt, Mycobacterium tuberculosis H37Rv
cagcucgauacccaga

SEQ ID NO: 1294531 - RNA, 21 nt, Mycobacterium tuberculosis H37Rv
cagcucgaggaccaccugguc

SEQ ID NO: 1294532 - RNA, 16 nt, Mycobacterium tuberculosis H37Rv
cagcucgaacagcucg

SEQ ID NO: 1294533 - RNA, 15 nt, Mycobacterium tuberculosis H37Rv
cagcucgccaggguc

SEQ ID NO: 1294534 - RNA, 23 nt, Mycobacterium tuberculosis H37Rv
cagcucgcacucguugccgacca

SEQ ID NO: 1294535 - RNA, 17 nt, Mycobacterium tuberculosis H37Rv
cagcucgccggcacgca

SEQ ID NO: 1294536 - RNA, 20 nt, Mycobacterium tuberculosis H37Rv
cagcucgccgugaccaggug

SEQ ID NO: 1294537 - RNA, 15 nt, Mycobacterium tuberculosis H37Rv
cagcucgcgcucgcu

SEQ ID NO: 1294538 - RNA, 23 nt, Mycobacterium tuberculosis H37Rv
cagcucgccuaguugcaacgggu

SEQ ID NO: 1294539 - RNA, 15 nt, Mycobacterium tuberculosis H37Rv
cagcucggccugguc

SEQ ID NO: 1294540 - RNA, 23 nt, Mycobacterium tuberculosis H37Rv
cagcucggcagcaucuccgucgg

SEQ ID NO: 1294541 - RNA, 22 nt, Mycobacterium tuberculosis H37Rv
cagcuacggggcggucgagcca

SEQ ID NO: 1294542 - RNA, 23 nt, Mycobacterium tuberculosis H37Rv
cagcuccaccaggacguggucgg

SEQ ID NO: 1294543 - RNA, 16 nt, Mycobacterium tuberculosis H37Rv
cagcuccccgccggaa

SEQ ID NO: 1294544 - RNA, 16 nt, Mycobacterium tuberculosis H37Rv
cagcuccccgaccgaa

SEQ ID NO: 1294545 - RNA, 18 nt, Mycobacterium tuberculosis H37Rv
cagcucccgccacgucgc

SEQ ID NO: 1294546 - RNA, 20 nt, Mycobacterium tuberculosis H37Rv
cagcgugcagcggcgggcga

SEQ ID NO: 1294547 - RNA, 20 nt, Mycobacterium tuberculosis H37Rv
cagcgugcccgccaccggcg

SEQ ID NO: 1294548 - RNA, 15 nt, Mycobacterium tuberculosis H37Rv
cagcgugagugcagc

SEQ ID NO: 1294549 - RNA, 17 nt, Mycobacterium tuberculosis H37Rv
cagcguuggcggcgauc

SEQ ID NO: 1294550 - RNA, 15 nt, Mycobacterium tuberculosis H37Rv
cagcguuugaacgca

SEQ ID NO: 1294551 - RNA, 20 nt, Mycobacterium tuberculosis H37Rv
cagcguugacggcuucggca

SEQ ID NO: 1294552 - RNA, 13 nt, Mycobacterium tuberculosis H37Rv
cagcgguagccga

SEQ ID NO: 1294553 - RNA, 18 nt, Mycobacterium tuberculosis H37Rv
cagcgguaagcgcaucga

SEQ ID NO: 1294554 - RNA, 17 nt, Mycobacterium tuberculosis H37Rv
cagcgggcuggcgaagg

SEQ ID NO: 1294555 - RNA, 14 nt, Mycobacterium tuberculosis H37Rv
cagcgggcuggcga

SEQ ID NO: 1294556 - RNA, 13 nt, Mycobacterium tuberculosis H37Rv
cagcgggcuggcg

SEQ ID NO: 1294557 - RNA, 15 nt, Mycobacterium tuberculosis H37Rv
cagcgggcuccccgg

SEQ ID NO: 1294558 - RNA, 22 nt, Mycobacterium tuberculosis H37Rv
cagcgcgagcccgaaccaccgc

SEQ ID NO: 1294559 - RNA, 21 nt, Mycobacterium tuberculosis H37Rv
cagcgcgagcccgaaccaccg

SEQ ID NO: 1294560 - RNA, 19 nt, Mycobacterium tuberculosis H37Rv
cagcgcgaucaacgcguug

SEQ ID NO: 1294561 - RNA, 14 nt, Mycobacterium tuberculosis H37Rv
cagcgcgaucaccg

SEQ ID NO: 1294562 - RNA, 15 nt, Mycobacterium tuberculosis H37Rv
cagcgcgcccgacac

SEQ ID NO: 1294563 - RNA, 17 nt, Mycobacterium tuberculosis H37Rv
cagcgcgcccgacaccc

SEQ ID NO: 1294564 - RNA, 13 nt, Mycobacterium tuberculosis H37Rv
cagcgcgccagcu

SEQ ID NO: 1294565 - RNA, 19 nt, Mycobacterium tuberculosis H37Rv
cagcgcgcaaagacaccga

SEQ ID NO: 1294566 - RNA, 21 nt, Mycobacterium tuberculosis H37Rv
cagcgugaccaccgccgacag

SEQ ID NO: 1294567 - RNA, 22 nt, Mycobacterium tuberculosis H37Rv
cagcgugaccaccgccgacagg

SEQ ID NO: 1294568 - RNA, 23 nt, Mycobacterium tuberculosis H37Rv
cagcguccccaugcagcgcgucg

SEQ ID NO: 1294569 - RNA, 14 nt, Mycobacterium tuberculosis H37Rv
cagcgucccgaugu

SEQ ID NO: 1294570 - RNA, 16 nt, Mycobacterium tuberculosis H37Rv
cagcgguggucggcgc

SEQ ID NO: 1294571 - RNA, 16 nt, Mycobacterium tuberculosis H37Rv
cagcguaagaccugag

SEQ ID NO: 1294572 - RNA, 17 nt, Mycobacterium tuberculosis H37Rv
cagcggucgcagcucgu

SEQ ID NO: 1294573 - RNA, 20 nt, Mycobacterium tuberculosis H37Rv
cagcgguccagccaccgccg

SEQ ID NO: 1294574 - RNA, 18 nt, Mycobacterium tuberculosis H37Rv
cagcgguccagacaucag

SEQ ID NO: 1294575 - RNA, 19 nt, Mycobacterium tuberculosis H37Rv
cagcgguggcccgccggca

SEQ ID NO: 1294576 - RNA, 19 nt, Mycobacterium tuberculosis H37Rv
cagcucgucgacgucguag

SEQ ID NO: 1294577 - RNA, 17 nt, Mycobacterium tuberculosis H37Rv
cagcucgucgcugaaca

SEQ ID NO: 1294578 - RNA, 17 nt, Mycobacterium tuberculosis H37Rv
cagcucgucgacgucgu

SEQ ID NO: 1294579 - RNA, 16 nt, Mycobacterium tuberculosis H37Rv
cagcucgguggcaucg

SEQ ID NO: 1294580 - RNA, 14 nt, Mycobacterium tuberculosis H37Rv
cagcucggugcacg

SEQ ID NO: 1294581 - RNA, 17 nt, Mycobacterium tuberculosis H37Rv
cagcucggcgggcucgu

SEQ ID NO: 1294582 - RNA, 23 nt, Mycobacterium tuberculosis H37Rv
cagcucgggcagggaccgcaucg

SEQ ID NO: 1294583 - RNA, 18 nt, Mycobacterium tuberculosis H37Rv
cagcucgucgucggcgua

SEQ ID NO: 1294584 - RNA, 20 nt, Mycobacterium tuberculosis H37Rv
cagcugaaucguucucgguc

SEQ ID NO: 1294585 - RNA, 20 nt, Mycobacterium tuberculosis H37Rv
cagcucgugaucuucggcga

SEQ ID NO: 1294586 - RNA, 21 nt, Mycobacterium tuberculosis H37Rv
cagcugcaccuccgacggccg

SEQ ID NO: 1294587 - RNA, 15 nt, Mycobacterium tuberculosis H37Rv
cagcugacggcgcaa

SEQ ID NO: 1294588 - RNA, 21 nt, Mycobacterium tuberculosis H37Rv
cagcugaacacgaauccggcc

SEQ ID NO: 1294589 - RNA, 21 nt, Mycobacterium tuberculosis H37Rv
cagcugagaugaggauggcug

SEQ ID NO: 1294590 - RNA, 13 nt, Mycobacterium tuberculosis H37Rv
cagcuucggccag

SEQ ID NO: 1294591 - RNA, 17 nt, Mycobacterium tuberculosis H37Rv
cagcuugcagugccgcc

SEQ ID NO: 1294592 - RNA, 15 nt, Mycobacterium tuberculosis H37Rv
cagcuugagcacacg

SEQ ID NO: 1294593 - RNA, 14 nt, Mycobacterium tuberculosis H37Rv
cagcuugagcacac

SEQ ID NO: 1294594 - RNA, 15 nt, Mycobacterium tuberculosis H37Rv
cagcugcccgacguu

SEQ ID NO: 1294595 - RNA, 13 nt, Mycobacterium tuberculosis H37Rv
cagcugcucgguc

SEQ ID NO: 1294596 - RNA, 20 nt, Mycobacterium tuberculosis H37Rv
cagcugcucgucuuggcggc

SEQ ID NO: 1294597 - RNA, 23 nt, Mycobacterium tuberculosis H37Rv
cagcugcucgucgucgauccagc

SEQ ID NO: 1294598 - RNA, 21 nt, Mycobacterium tuberculosis H37Rv
cagcuggccgcggcgaguacu

SEQ ID NO: 1294599 - RNA, 19 nt, Mycobacterium tuberculosis H37Rv
cagcuggacuccggucagc

SEQ ID NO: 1294600 - RNA, 16 nt, Mycobacterium tuberculosis H37Rv
caggaccggcugcagg

SEQ ID NO: 1294601 - RNA, 23 nt, Mycobacterium tuberculosis H37Rv
caggaaugaucguuccgauccgg

SEQ ID NO: 1294602 - RNA, 22 nt, Mycobacterium tuberculosis H37Rv
caggaaucgggucagcaccacc

SEQ ID NO: 1294603 - RNA, 17 nt, Mycobacterium tuberculosis H37Rv
caggaagucgcggacgu

SEQ ID NO: 1294604 - RNA, 20 nt, Mycobacterium tuberculosis H37Rv
caggaauuccccaccgucgu

SEQ ID NO: 1294605 - RNA, 19 nt, Mycobacterium tuberculosis H37Rv
caggaaugccgcggggauc

SEQ ID NO: 1294606 - RNA, 14 nt, Mycobacterium tuberculosis H37Rv
caggaaugccgcgg

SEQ ID NO: 1294607 - RNA, 22 nt, Mycobacterium tuberculosis H37Rv
caggacaccuugcguccguagc

SEQ ID NO: 1294608 - RNA, 24 nt, Mycobacterium tuberculosis H37Rv
caggacaccuaccgagaucaccgc

SEQ ID NO: 1294609 - RNA, 20 nt, Mycobacterium tuberculosis H37Rv
cagcuugcugcgcaccaagg

SEQ ID NO: 1294610 - RNA, 13 nt, Mycobacterium tuberculosis H37Rv
cagcuugcugcgc

SEQ ID NO: 1294611 - RNA, 15 nt, Mycobacterium tuberculosis H37Rv
cagcuugcugcgcac

SEQ ID NO: 1294612 - RNA, 22 nt, Mycobacterium tuberculosis H37Rv
cagcuuggccucagccaccggg

SEQ ID NO: 1294613 - RNA, 21 nt, Mycobacterium tuberculosis H37Rv
cagcuuggccucagccaccgg

SEQ ID NO: 1294614 - RNA, 13 nt, Mycobacterium tuberculosis H37Rv
caggaagucgcgg

SEQ ID NO: 1294615 - RNA, 15 nt, Mycobacterium tuberculosis H37Rv
caggaagccggcgug

SEQ ID NO: 1294616 - RNA, 22 nt, Mycobacterium tuberculosis H37Rv
caggaagccggcgugcucggga

SEQ ID NO: 1294617 - RNA, 13 nt, Mycobacterium tuberculosis H37Rv
caggauuucgcag

SEQ ID NO: 1294618 - RNA, 17 nt, Mycobacterium tuberculosis H37Rv
caggauugccgccguug

SEQ ID NO: 1294619 - RNA, 15 nt, Mycobacterium tuberculosis H37Rv
caggcaaaccgauca

SEQ ID NO: 1294620 - RNA, 23 nt, Mycobacterium tuberculosis H37Rv
caggaggcgaaugucuucgccgu

SEQ ID NO: 1294621 - RNA, 22 nt, Mycobacterium tuberculosis H37Rv
caggaggcgaaugucuucgccg

SEQ ID NO: 1294622 - RNA, 20 nt, Mycobacterium tuberculosis H37Rv
caggaguuugaccaccuggu

SEQ ID NO: 1294623 - RNA, 18 nt, Mycobacterium tuberculosis H37Rv
caggaugguugcgacggc

SEQ ID NO: 1294624 - RNA, 17 nt, Mycobacterium tuberculosis H37Rv
cagugccaauuccagcc

SEQ ID NO: 1294625 - RNA, 17 nt, Mycobacterium tuberculosis H37Rv
cagugccaucuacaucg

SEQ ID NO: 1294626 - RNA, 23 nt, Mycobacterium tuberculosis H37Rv
cagugcccgcacugccgccgguu

SEQ ID NO: 1294627 - RNA, 17 nt, Mycobacterium tuberculosis H37Rv
cagugcggccuuggcga

SEQ ID NO: 1294628 - RNA, 18 nt, Mycobacterium tuberculosis H37Rv
cagugcgcggaucaacag

SEQ ID NO: 1294629 - RNA, 22 nt, Mycobacterium tuberculosis H37Rv
cagugccgcacccagaccgccg

SEQ ID NO: 1294630 - RNA, 15 nt, Mycobacterium tuberculosis H37Rv
cagugaccugggcgc

SEQ ID NO: 1294631 - RNA, 17 nt, Mycobacterium tuberculosis H37Rv
cagugaagacaccaggc

SEQ ID NO: 1294632 - RNA, 16 nt, Mycobacterium tuberculosis H37Rv
cagugcaccgcgucgu

SEQ ID NO: 1294633 - RNA, 14 nt, Mycobacterium tuberculosis H37Rv
caguguggcgauga

SEQ ID NO: 1294634 - RNA, 20 nt, Mycobacterium tuberculosis H37Rv
cagugucagcacgacgacaa

SEQ ID NO: 1294635 - RNA, 13 nt, Mycobacterium tuberculosis H37Rv
caguggcagcccg

SEQ ID NO: 1294636 - RNA, 20 nt, Mycobacterium tuberculosis H37Rv
caguggcaagcugucgucgc

SEQ ID NO: 1294637 - RNA, 18 nt, Mycobacterium tuberculosis H37Rv
cagugcugcagacccguu

SEQ ID NO: 1294638 - RNA, 15 nt, Mycobacterium tuberculosis H37Rv
cagugcucgcccagu

SEQ ID NO: 1294639 - RNA, 11 nt, Mycobacterium tuberculosis H37Rv
cagugcucgca

SEQ ID NO: 1294640 - RNA, 19 nt, Mycobacterium tuberculosis H37Rv
caguuagccggguuggccg

SEQ ID NO: 1294641 - RNA, 15 nt, Mycobacterium tuberculosis H37Rv
caguucggauccgga

SEQ ID NO: 1294642 - RNA, 19 nt, Mycobacterium tuberculosis H37Rv
cauacgcgugugcgcgugc

SEQ ID NO: 1294643 - RNA, 20 nt, Mycobacterium tuberculosis H37Rv
cauaccuaacgagccgucca

SEQ ID NO: 1294644 - RNA, 17 nt, Mycobacterium tuberculosis H37Rv
cauaccuuccagaucgc

SEQ ID NO: 1294645 - RNA, 11 nt, Mycobacterium tuberculosis H37Rv
cauaccugaau

SEQ ID NO: 1294646 - RNA, 19 nt, Mycobacterium tuberculosis H37Rv
cauaaaccucgccggugac

SEQ ID NO: 1294647 - RNA, 18 nt, Mycobacterium tuberculosis H37Rv
cauaagcucguagagcac

SEQ ID NO: 1294648 - RNA, 16 nt, Mycobacterium tuberculosis H37Rv
caguucguggcuggca

SEQ ID NO: 1294649 - RNA, 15 nt, Mycobacterium tuberculosis H37Rv
caguugaacucgacc

SEQ ID NO: 1294650 - RNA, 14 nt, Mycobacterium tuberculosis H37Rv
cagucgugggcugu

SEQ ID NO: 1294651 - RNA, 15 nt, Mycobacterium tuberculosis H37Rv
cagucugggcgaucg

SEQ ID NO: 1294652 - RNA, 23 nt, Mycobacterium tuberculosis H37Rv
cagucugggcgaucgcuucgcaa

SEQ ID NO: 1294653 - RNA, 19 nt, Mycobacterium tuberculosis H37Rv
cagucucaagguuucgaca

SEQ ID NO: 1294654 - RNA, 15 nt, Mycobacterium tuberculosis H37Rv
cagucgagcaccugc

SEQ ID NO: 1294655 - RNA, 15 nt, Mycobacterium tuberculosis H37Rv
caguccguccagguc

SEQ ID NO: 1294656 - RNA, 23 nt, Mycobacterium tuberculosis H37Rv
cagucgcaacaguucacgccggu

SEQ ID NO: 1294657 - RNA, 20 nt, Mycobacterium tuberculosis H37Rv
cagguugccgagguugcgga

SEQ ID NO: 1294658 - RNA, 18 nt, Mycobacterium tuberculosis H37Rv
caguauggccgccaccgc

SEQ ID NO: 1294659 - RNA, 17 nt, Mycobacterium tuberculosis H37Rv
cagucaccaaccacaug

SEQ ID NO: 1294660 - RNA, 16 nt, Mycobacterium tuberculosis H37Rv
caguccgguagcagcg

SEQ ID NO: 1294661 - RNA, 20 nt, Mycobacterium tuberculosis H37Rv
caggucgccaccuucgacga

SEQ ID NO: 1294662 - RNA, 20 nt, Mycobacterium tuberculosis H37Rv
caggucgccuucccagccga

SEQ ID NO: 1294663 - RNA, 18 nt, Mycobacterium tuberculosis H37Rv
caggugaacaacagcgcu

SEQ ID NO: 1294664 - RNA, 21 nt, Mycobacterium tuberculosis H37Rv
caggugaccaguaggcaagca

SEQ ID NO: 1294665 - RNA, 21 nt, Mycobacterium tuberculosis H37Rv
caggucuccaucaaccgcgcu

SEQ ID NO: 1294666 - RNA, 21 nt, Mycobacterium tuberculosis H37Rv
caggucucguaucgcacccgc

SEQ ID NO: 1294667 - RNA, 18 nt, Mycobacterium tuberculosis H37Rv
cagguuaggcaauagccg

SEQ ID NO: 1294668 - RNA, 23 nt, Mycobacterium tuberculosis H37Rv
cagguguccccgcccggccagcu

SEQ ID NO: 1294669 - RNA, 17 nt, Mycobacterium tuberculosis H37Rv
cagguuccacgcguuga

SEQ ID NO: 1294670 - RNA, 16 nt, Mycobacterium tuberculosis H37Rv
cagguuccacggccag

SEQ ID NO: 1294671 - RNA, 19 nt, Mycobacterium tuberculosis H37Rv
cagguucaaccccguugcg

SEQ ID NO: 1294672 - RNA, 19 nt, Mycobacterium tuberculosis H37Rv
cagguucggcgacucugcg

SEQ ID NO: 1294673 - RNA, 20 nt, Mycobacterium tuberculosis H37Rv
caggugagccaguuggccag

SEQ ID NO: 1294674 - RNA, 17 nt, Mycobacterium tuberculosis H37Rv
caggugagcgacgcuga

SEQ ID NO: 1294675 - RNA, 15 nt, Mycobacterium tuberculosis H37Rv
caggugagaccaggu

SEQ ID NO: 1294676 - RNA, 17 nt, Mycobacterium tuberculosis H37Rv
caggugagaccagguuc

SEQ ID NO: 1294677 - RNA, 13 nt, Mycobacterium tuberculosis H37Rv
caggugaucgcga

SEQ ID NO: 1294678 - RNA, 12 nt, Mycobacterium tuberculosis H37Rv
caggugaugccg

SEQ ID NO: 1294679 - RNA, 21 nt, Mycobacterium tuberculosis H37Rv
caggugcgccuggcuggccag

SEQ ID NO: 1294680 - RNA, 20 nt, Mycobacterium tuberculosis H37Rv
caggugcucgucauccaucc

SEQ ID NO: 1294681 - RNA, 23 nt, Mycobacterium tuberculosis H37Rv
caggugcgccuggcuggccagcu

SEQ ID NO: 1294682 - RNA, 14 nt, Mycobacterium tuberculosis H37Rv
caggugcugggcga

SEQ ID NO: 1294683 - RNA, 14 nt, Mycobacterium tuberculosis H37Rv
caggugcucgucga

SEQ ID NO: 1294684 - RNA, 23 nt, Mycobacterium tuberculosis H37Rv
caucgauaaccgaaacucgacgu

SEQ ID NO: 1294685 - RNA, 17 nt, Mycobacterium tuberculosis H37Rv
caucgaguugucucgca

SEQ ID NO: 1294686 - RNA, 14 nt, Mycobacterium tuberculosis H37Rv
caucgaggccagca

SEQ ID NO: 1294687 - RNA, 14 nt, Mycobacterium tuberculosis H37Rv
caucgcacaacugc

SEQ ID NO: 1294688 - RNA, 22 nt, Mycobacterium tuberculosis H37Rv
caucgcaggcaccccgaucacc

SEQ ID NO: 1294689 - RNA, 23 nt, Mycobacterium tuberculosis H37Rv
caucgcauccccagcacaaccag

SEQ ID NO: 1294690 - RNA, 17 nt, Mycobacterium tuberculosis H37Rv
caucgauuggcucgagc

SEQ ID NO: 1294691 - RNA, 22 nt, Mycobacterium tuberculosis H37Rv
caucgacgcucaucucgggcac

SEQ ID NO: 1294692 - RNA, 20 nt, Mycobacterium tuberculosis H37Rv
caucgagaguugaauccggg

SEQ ID NO: 1294693 - RNA, 15 nt, Mycobacterium tuberculosis H37Rv
caucgagcgccagcc

SEQ ID NO: 1294694 - RNA, 23 nt, Mycobacterium tuberculosis H37Rv
caucgcccugggcgccggcgucc

SEQ ID NO: 1294695 - RNA, 20 nt, Mycobacterium tuberculosis H37Rv
caucgcccggaaccggcgug

SEQ ID NO: 1294696 - RNA, 14 nt, Mycobacterium tuberculosis H37Rv
caucgccgccguug

SEQ ID NO: 1294697 - RNA, 14 nt, Mycobacterium tuberculosis H37Rv
caucgccgccggug

SEQ ID NO: 1294698 - RNA, 21 nt, Mycobacterium tuberculosis H37Rv
caucgccgcccgagcacccca

SEQ ID NO: 1294699 - RNA, 18 nt, Mycobacterium tuberculosis H37Rv
caucgccgaacgggacga

SEQ ID NO: 1294700 - RNA, 17 nt, Mycobacterium tuberculosis H37Rv
caucgccgcuaccguca

SEQ ID NO: 1294701 - RNA, 13 nt, Mycobacterium tuberculosis H37Rv
caucgcggcgacg

SEQ ID NO: 1294702 - RNA, 17 nt, Mycobacterium tuberculosis H37Rv
caucgcgcugcggccca

SEQ ID NO: 1294703 - RNA, 17 nt, Mycobacterium tuberculosis H37Rv
caucgcgggcggcgcug

SEQ ID NO: 1294704 - RNA, 15 nt, Mycobacterium tuberculosis H37Rv
caucgcgcgccgacc

SEQ ID NO: 1294705 - RNA, 15 nt, Mycobacterium tuberculosis H37Rv
caucgcgcugcggcc

SEQ ID NO: 1294706 - RNA, 14 nt, Mycobacterium tuberculosis H37Rv
caucgcgcggacca

SEQ ID NO: 1294707 - RNA, 12 nt, Mycobacterium tuberculosis H37Rv
caucgcgcggcu

SEQ ID NO: 1294708 - RNA, 12 nt, Mycobacterium tuberculosis H37Rv
caucgcgacauc

SEQ ID NO: 1294709 - RNA, 22 nt, Mycobacterium tuberculosis H37Rv
caucgcgaaaccggaccugacc

SEQ ID NO: 1294710 - RNA, 14 nt, Mycobacterium tuberculosis H37Rv
caucgccuccucga

SEQ ID NO: 1294711 - RNA, 12 nt, Mycobacterium tuberculosis H37Rv
caucgccucgag

SEQ ID NO: 1294712 - RNA, 20 nt, Mycobacterium tuberculosis H37Rv
caucgccucggcgcugcgca

SEQ ID NO: 1294713 - RNA, 21 nt, Mycobacterium tuberculosis H37Rv
caucggagauacgggccaccg

SEQ ID NO: 1294714 - RNA, 20 nt, Mycobacterium tuberculosis H37Rv
caucggagauacgggccacc

SEQ ID NO: 1294715 - RNA, 21 nt, Mycobacterium tuberculosis H37Rv
caucggcacaggcggccagca

SEQ ID NO: 1294716 - RNA, 21 nt, Mycobacterium tuberculosis H37Rv
caucggaaccguuugacgcgc

SEQ ID NO: 1294717 - RNA, 17 nt, Mycobacterium tuberculosis H37Rv
caucgcucaucgucacc

SEQ ID NO: 1294718 - RNA, 16 nt, Mycobacterium tuberculosis H37Rv
caucgcuggucgaugg

SEQ ID NO: 1294719 - RNA, 16 nt, Mycobacterium tuberculosis H37Rv
caucggcaccgucucg

SEQ ID NO: 1294720 - RNA, 14 nt, Mycobacterium tuberculosis H37Rv
caucggcagcagga

SEQ ID NO: 1294721 - RNA, 22 nt, Mycobacterium tuberculosis H37Rv
caucggaugaccagugaucagc

SEQ ID NO: 1294722 - RNA, 23 nt, Mycobacterium tuberculosis H37Rv
caucggcauccgcggggagucga

SEQ ID NO: 1294723 - RNA, 24 nt, Mycobacterium tuberculosis H37Rv
caucggccaacaccacuagcggcu

SEQ ID NO: 1294724 - RNA, 19 nt, Mycobacterium tuberculosis H37Rv
caucggccagccguucucg

SEQ ID NO: 1294725 - RNA, 12 nt, Mycobacterium tuberculosis H37Rv
caucggccagca

SEQ ID NO: 1294726 - RNA, 18 nt, Mycobacterium tuberculosis H37Rv
caucggccucugaccagc

SEQ ID NO: 1294727 - RNA, 19 nt, Mycobacterium tuberculosis H37Rv
caucggccucugaccagcc

SEQ ID NO: 1294728 - RNA, 16 nt, Mycobacterium tuberculosis H37Rv
caucggcgaccgccug

SEQ ID NO: 1294729 - RNA, 16 nt, Mycobacterium tuberculosis H37Rv
caucggccggcgucag

SEQ ID NO: 1294730 - RNA, 15 nt, Mycobacterium tuberculosis H37Rv
cauccaugauggccg

SEQ ID NO: 1294731 - RNA, 17 nt, Mycobacterium tuberculosis H37Rv
cauccaggcugucgcgg

SEQ ID NO: 1294732 - RNA, 17 nt, Mycobacterium tuberculosis H37Rv
cauccaguaaccguccg

SEQ ID NO: 1294733 - RNA, 15 nt, Mycobacterium tuberculosis H37Rv
cauccagcgcuucgg

SEQ ID NO: 1294734 - RNA, 20 nt, Mycobacterium tuberculosis H37Rv
cauccagaagccggccacua

SEQ ID NO: 1294735 - RNA, 16 nt, Mycobacterium tuberculosis H37Rv
cauccacuccgccaac

SEQ ID NO: 1294736 - RNA, 20 nt, Mycobacterium tuberculosis H37Rv
caucaggaagcgugcggucg

SEQ ID NO: 1294737 - RNA, 21 nt, Mycobacterium tuberculosis H37Rv
cauccuucgccggcgccagca

SEQ ID NO: 1294738 - RNA, 18 nt, Mycobacterium tuberculosis H37Rv
cauccuggcggcugcagc

SEQ ID NO: 1294739 - RNA, 14 nt, Mycobacterium tuberculosis H37Rv
cauccuggucacca

SEQ ID NO: 1294740 - RNA, 18 nt, Mycobacterium tuberculosis H37Rv
cauccuccucgucgacgu

SEQ ID NO: 1294741 - RNA, 17 nt, Mycobacterium tuberculosis H37Rv
cauagccgaacagcgga

SEQ ID NO: 1294742 - RNA, 16 nt, Mycobacterium tuberculosis H37Rv
cauagccgcgcucgaa

SEQ ID NO: 1294743 - RNA, 18 nt, Mycobacterium tuberculosis H37Rv
cauagcaauccgcacagc

SEQ ID NO: 1294744 - RNA, 15 nt, Mycobacterium tuberculosis H37Rv
cauagcccgagcgcu

SEQ ID NO: 1294745 - RNA, 18 nt, Mycobacterium tuberculosis H37Rv
caucaaggacucggacgc

SEQ ID NO: 1294746 - RNA, 18 nt, Mycobacterium tuberculosis H37Rv
cauaggacaggaacggcc

SEQ ID NO: 1294747 - RNA, 17 nt, Mycobacterium tuberculosis H37Rv
caucacgaaggcguucg

SEQ ID NO: 1294748 - RNA, 17 nt, Mycobacterium tuberculosis H37Rv
caucacgccccagguuc

SEQ ID NO: 1294749 - RNA, 21 nt, Mycobacterium tuberculosis H37Rv
caucacgaaggcguucgccgg

SEQ ID NO: 1294750 - RNA, 20 nt, Mycobacterium tuberculosis H37Rv
caucacgcgcucaccgacgc

SEQ ID NO: 1294751 - RNA, 17 nt, Mycobacterium tuberculosis H37Rv
caucacgggacgacggc

SEQ ID NO: 1294752 - RNA, 15 nt, Mycobacterium tuberculosis H37Rv
caucacgggacgacg

SEQ ID NO: 1294753 - RNA, 17 nt, Mycobacterium tuberculosis H37Rv
caucacggucagcucgc

SEQ ID NO: 1294754 - RNA, 20 nt, Mycobacterium tuberculosis H37Rv
caucacggucagcucgcuga

SEQ ID NO: 1294755 - RNA, 14 nt, Mycobacterium tuberculosis H37Rv
caucagcccucggc

SEQ ID NO: 1294756 - RNA, 17 nt, Mycobacterium tuberculosis H37Rv
caucagcccuucagcga

SEQ ID NO: 1294757 - RNA, 16 nt, Mycobacterium tuberculosis H37Rv
cccuucaaagcggccu

SEQ ID NO: 1294758 - RNA, 22 nt, Mycobacterium tuberculosis H37Rv
cccugugucgccgucgcggcac

SEQ ID NO: 1294759 - RNA, 16 nt, Mycobacterium tuberculosis H37Rv
cccuucgucggcauga

SEQ ID NO: 1294760 - RNA, 21 nt, Mycobacterium tuberculosis H37Rv
cccuugccgccguugccgccg

SEQ ID NO: 1294761 - RNA, 20 nt, Mycobacterium tuberculosis H37Rv
cccuuggccagcagggccac

SEQ ID NO: 1294762 - RNA, 12 nt, Mycobacterium tuberculosis H37Rv
cccuugccgucc

SEQ ID NO: 1294763 - RNA, 22 nt, Mycobacterium tuberculosis H37Rv
cccuuguggaguacggcgaugc

SEQ ID NO: 1294764 - RNA, 14 nt, Mycobacterium tuberculosis H37Rv
ccgaacugccgcgc

SEQ ID NO: 1294765 - RNA, 22 nt, Mycobacterium tuberculosis H37Rv
ccgaacgugcaaccauggcggc

SEQ ID NO: 1294766 - RNA, 14 nt, Mycobacterium tuberculosis H37Rv
ccgaacgucgcggc

SEQ ID NO: 1294767 - RNA, 12 nt, Mycobacterium tuberculosis H37Rv
ccgaacgugcgg

SEQ ID NO: 1294768 - RNA, 13 nt, Mycobacterium tuberculosis H37Rv
ccgaacgcgaggu

SEQ ID NO: 1294769 - RNA, 15 nt, Mycobacterium tuberculosis H37Rv
ccgaacgcgauccgg

SEQ ID NO: 1294770 - RNA, 12 nt, Mycobacterium tuberculosis H37Rv
ccgaacgcacgu

SEQ ID NO: 1294771 - RNA, 13 nt, Mycobacterium tuberculosis H37Rv
ccgaacagcgggu

SEQ ID NO: 1294772 - RNA, 12 nt, Mycobacterium tuberculosis H37Rv
ccgaacagcugg

SEQ ID NO: 1294773 - RNA, 15 nt, Mycobacterium tuberculosis H37Rv
ccgaacagcggcagc

SEQ ID NO: 1294774 - RNA, 13 nt, Mycobacterium tuberculosis H37Rv
ccgaacagccgag

SEQ ID NO: 1294775 - RNA, 20 nt, Mycobacterium tuberculosis H37Rv
ccgaacaccacaccgagcac

SEQ ID NO: 1294776 - RNA, 12 nt, Mycobacterium tuberculosis H37Rv
cccuaucagccg

SEQ ID NO: 1294777 - RNA, 22 nt, Mycobacterium tuberculosis H37Rv
cccguugccgccguugccgccg

SEQ ID NO: 1294778 - RNA, 13 nt, Mycobacterium tuberculosis H37Rv
cccguugaucgcg

SEQ ID NO: 1294779 - RNA, 23 nt, Mycobacterium tuberculosis H37Rv
cccguugguagccggugaccgcg

SEQ ID NO: 1294780 - RNA, 16 nt, Mycobacterium tuberculosis H37Rv
cccguugugucaccgg

SEQ ID NO: 1294781 - RNA, 22 nt, Mycobacterium tuberculosis H37Rv
cccguugagcauaugacgucgc

SEQ ID NO: 1294782 - RNA, 20 nt, Mycobacterium tuberculosis H37Rv
cccguucgaggucggcgauc

SEQ ID NO: 1294783 - RNA, 12 nt, Mycobacterium tuberculosis H37Rv
cccguucgccgu

SEQ ID NO: 1294784 - RNA, 22 nt, Mycobacterium tuberculosis H37Rv
cccgguggcguggucucgguca

SEQ ID NO: 1294785 - RNA, 17 nt, Mycobacterium tuberculosis H37Rv
cccgguucgacgucugc

SEQ ID NO: 1294786 - RNA, 19 nt, Mycobacterium tuberculosis H37Rv
cccgguccugcucgcacag

SEQ ID NO: 1294787 - RNA, 23 nt, Mycobacterium tuberculosis H37Rv
cccggugccgcagcaggggacga

SEQ ID NO: 1294788 - RNA, 21 nt, Mycobacterium tuberculosis H37Rv
cccggugccguuggagccgcc

SEQ ID NO: 1294789 - RNA, 16 nt, Mycobacterium tuberculosis H37Rv
cccggugcuaaccgac

SEQ ID NO: 1294790 - RNA, 21 nt, Mycobacterium tuberculosis H37Rv
cccgguggacagaaucgaccg

SEQ ID NO: 1294791 - RNA, 22 nt, Mycobacterium tuberculosis H37Rv
cccugacgucacguucggcgca

SEQ ID NO: 1294792 - RNA, 22 nt, Mycobacterium tuberculosis H37Rv
cccucgccgaaguagacggugg

SEQ ID NO: 1294793 - RNA, 19 nt, Mycobacterium tuberculosis H37Rv
cccugcauaggcgcgguca

SEQ ID NO: 1294794 - RNA, 23 nt, Mycobacterium tuberculosis H37Rv
cccugcgggccgagaucacgccg

SEQ ID NO: 1294795 - RNA, 13 nt, Mycobacterium tuberculosis H37Rv
cccugcgggccga

SEQ ID NO: 1294796 - RNA, 18 nt, Mycobacterium tuberculosis H37Rv
cccugcucgaacgcugag

SEQ ID NO: 1294797 - RNA, 15 nt, Mycobacterium tuberculosis H37Rv
cccugauggacccga

SEQ ID NO: 1294798 - RNA, 14 nt, Mycobacterium tuberculosis H37Rv
cccugaucgugcgg

SEQ ID NO: 1294799 - RNA, 21 nt, Mycobacterium tuberculosis H37Rv
cccugcacccagccgugccca

SEQ ID NO: 1294800 - RNA, 20 nt, Mycobacterium tuberculosis H37Rv
ccgaagaugcacaggccgac

SEQ ID NO: 1294801 - RNA, 20 nt, Mycobacterium tuberculosis H37Rv
ccgaaggcggcuccaccggg

SEQ ID NO: 1294802 - RNA, 16 nt, Mycobacterium tuberculosis H37Rv
ccgaaguagaagccca

SEQ ID NO: 1294803 - RNA, 23 nt, Mycobacterium tuberculosis H37Rv
ccgaaggcuugucgguagguguc

SEQ ID NO: 1294804 - RNA, 19 nt, Mycobacterium tuberculosis H37Rv
ccgaagagugugacggcgg

SEQ ID NO: 1294805 - RNA, 14 nt, Mycobacterium tuberculosis H37Rv
ccgaagagccagca

SEQ ID NO: 1294806 - RNA, 17 nt, Mycobacterium tuberculosis H37Rv
ccgaagaggagaacgag

SEQ ID NO: 1294807 - RNA, 13 nt, Mycobacterium tuberculosis H37Rv
ccgaagaagcccg

SEQ ID NO: 1294808 - RNA, 20 nt, Mycobacterium tuberculosis H37Rv
ccgaagagcacgucaacagc

SEQ ID NO: 1294809 - RNA, 20 nt, Mycobacterium tuberculosis H37Rv
ccgaagaccuccucggugua

SEQ ID NO: 1294810 - RNA, 19 nt, Mycobacterium tuberculosis H37Rv
ccgacaccggccgcgacgg

SEQ ID NO: 1294811 - RNA, 16 nt, Mycobacterium tuberculosis H37Rv
ccgacaccggcggcau

SEQ ID NO: 1294812 - RNA, 17 nt, Mycobacterium tuberculosis H37Rv
ccgaaguccacgcacca

SEQ ID NO: 1294813 - RNA, 23 nt, Mycobacterium tuberculosis H37Rv
ccgaagucacaggauccguggcc

SEQ ID NO: 1294814 - RNA, 17 nt, Mycobacterium tuberculosis H37Rv
ccgacaccacggaccag

SEQ ID NO: 1294815 - RNA, 19 nt, Mycobacterium tuberculosis H37Rv
ccgacacguuucacguggu

SEQ ID NO: 1294816 - RNA, 15 nt, Mycobacterium tuberculosis H37Rv
ccgacaccgugucgc

SEQ ID NO: 1294817 - RNA, 13 nt, Mycobacterium tuberculosis H37Rv
ccgacacgccgug

SEQ ID NO: 1294818 - RNA, 12 nt, Mycobacterium tuberculosis H37Rv
ccgacaucguca

SEQ ID NO: 1294819 - RNA, 20 nt, Mycobacterium tuberculosis H37Rv
ccgacaugaauccacugaac

SEQ ID NO: 1294820 - RNA, 13 nt, Mycobacterium tuberculosis H37Rv
ccgacaugguccg

SEQ ID NO: 1294821 - RNA, 14 nt, Mycobacterium tuberculosis H37Rv
ccgacaucggccag

SEQ ID NO: 1294822 - RNA, 16 nt, Mycobacterium tuberculosis H37Rv
ccgacaucggccagcg

SEQ ID NO: 1294823 - RNA, 16 nt, Mycobacterium tuberculosis H37Rv
ccgacaucgucaucca

SEQ ID NO: 1294824 - RNA, 21 nt, Mycobacterium tuberculosis H37Rv
ccgacaugguccgaccagcgg

SEQ ID NO: 1294825 - RNA, 13 nt, Mycobacterium tuberculosis H37Rv
ccgacaugcgccg

SEQ ID NO: 1294826 - RNA, 19 nt, Mycobacterium tuberculosis H37Rv
ccgaccacgcgagggcauc

SEQ ID NO: 1294827 - RNA, 16 nt, Mycobacterium tuberculosis H37Rv
ccgacaggccggccac

SEQ ID NO: 1294828 - RNA, 21 nt, Mycobacterium tuberculosis H37Rv
ccgacaggugcucgucaucca

SEQ ID NO: 1294829 - RNA, 15 nt, Mycobacterium tuberculosis H37Rv
ccgacaguggcucac

SEQ ID NO: 1294830 - RNA, 15 nt, Mycobacterium tuberculosis H37Rv
ccgacagcagccggu

SEQ ID NO: 1294831 - RNA, 18 nt, Mycobacterium tuberculosis H37Rv
ccgacagcacccggccac

SEQ ID NO: 1294832 - RNA, 23 nt, Mycobacterium tuberculosis H37Rv
ccgacagcacccaaugccaccgc

SEQ ID NO: 1294833 - RNA, 15 nt, Mycobacterium tuberculosis H37Rv
ccgaccgucacugau

SEQ ID NO: 1294834 - RNA, 19 nt, Mycobacterium tuberculosis H37Rv
ccgaccggucuggcgauga

SEQ ID NO: 1294835 - RNA, 16 nt, Mycobacterium tuberculosis H37Rv
ccgaccucaucggcac

SEQ ID NO: 1294836 - RNA, 23 nt, Mycobacterium tuberculosis H37Rv
ccgaccuagucaccuugaccggg

SEQ ID NO: 1294837 - RNA, 20 nt, Mycobacterium tuberculosis H37Rv
ccgaccuaaagaucguugcc

SEQ ID NO: 1294838 - RNA, 23 nt, Mycobacterium tuberculosis H37Rv
ccgaccguuucuccgccgcccag

SEQ ID NO: 1294839 - RNA, 16 nt, Mycobacterium tuberculosis H37Rv
ccgaccgugaucagcg

SEQ ID NO: 1294840 - RNA, 18 nt, Mycobacterium tuberculosis H37Rv
ccgaccguggugagcugg

SEQ ID NO: 1294841 - RNA, 12 nt, Mycobacterium tuberculosis H37Rv
ccgaccgguugg

SEQ ID NO: 1294842 - RNA, 14 nt, Mycobacterium tuberculosis H37Rv
ccgaccggaccggg

SEQ ID NO: 1294843 - RNA, 14 nt, Mycobacterium tuberculosis H37Rv
ccgaccgccgagcg

SEQ ID NO: 1294844 - RNA, 13 nt, Mycobacterium tuberculosis H37Rv
ccgaccgccugau

SEQ ID NO: 1294845 - RNA, 14 nt, Mycobacterium tuberculosis H37Rv
ccgaccgcgacccg

SEQ ID NO: 1294846 - RNA, 23 nt, Mycobacterium tuberculosis H37Rv
ccgacgaagguggcauucgucga

SEQ ID NO: 1294847 - RNA, 17 nt, Mycobacterium tuberculosis H37Rv
ccgacgacaccagagcg

SEQ ID NO: 1294848 - RNA, 23 nt, Mycobacterium tuberculosis H37Rv
ccgacgacaccagagcgaacccc

SEQ ID NO: 1294849 - RNA, 17 nt, Mycobacterium tuberculosis H37Rv
ccgacgaccagcagauc

SEQ ID NO: 1294850 - RNA, 17 nt, Mycobacterium tuberculosis H37Rv
ccgacgacaucgguggc

SEQ ID NO: 1294851 - RNA, 15 nt, Mycobacterium tuberculosis H37Rv
ccgacgaacgaaccg

SEQ ID NO: 1294852 - RNA, 15 nt, Mycobacterium tuberculosis H37Rv
ccgacgaagaucgcu

SEQ ID NO: 1294853 - RNA, 14 nt, Mycobacterium tuberculosis H37Rv
ccgaccuucggccc

SEQ ID NO: 1294854 - RNA, 15 nt, Mycobacterium tuberculosis H37Rv
ccgaccuucucggcg

SEQ ID NO: 1294855 - RNA, 16 nt, Mycobacterium tuberculosis H37Rv
ccgaccugcgcgacgg

SEQ ID NO: 1294856 - RNA, 22 nt, Mycobacterium tuberculosis H37Rv
ccgaccucgagugcgaaccacg

SEQ ID NO: 1294857 - RNA, 17 nt, Mycobacterium tuberculosis H37Rv
ccgaccugguaugccgc

SEQ ID NO: 1294858 - RNA, 23 nt, Mycobacterium tuberculosis H37Rv
ccgaccugguaugccgcccgcag

SEQ ID NO: 1294859 - RNA, 23 nt, Mycobacterium tuberculosis H37Rv
ccgaccacuccacgcagcccguc

SEQ ID NO: 1294860 - RNA, 12 nt, Mycobacterium tuberculosis H37Rv
ccgaccagaacg

SEQ ID NO: 1294861 - RNA, 13 nt, Mycobacterium tuberculosis H37Rv
ccgaccagcuuga

SEQ ID NO: 1294862 - RNA, 19 nt, Mycobacterium tuberculosis H37Rv
ccgaccagucgacgucucu

SEQ ID NO: 1294863 - RNA, 16 nt, Mycobacterium tuberculosis H37Rv
ccgacccgacgcuggu

SEQ ID NO: 1294864 - RNA, 16 nt, Mycobacterium tuberculosis H37Rv
ccgacccgcccgaaga

SEQ ID NO: 1294865 - RNA, 19 nt, Mycobacterium tuberculosis H37Rv
ccgaccgacaccaccaggu

SEQ ID NO: 1294866 - RNA, 17 nt, Mycobacterium tuberculosis H37Rv
ccgaccgaaccgucagc

SEQ ID NO: 1294867 - RNA, 15 nt, Mycobacterium tuberculosis H37Rv
ccgaccgaaccguca

SEQ ID NO: 1294868 - RNA, 19 nt, Mycobacterium tuberculosis H37Rv
ccgaccgaaagccgcacca

SEQ ID NO: 1294869 - RNA, 14 nt, Mycobacterium tuberculosis H37Rv
ccgaccgccaccgc

SEQ ID NO: 1294870 - RNA, 15 nt, Mycobacterium tuberculosis H37Rv
cccgcgccgcgcauc

SEQ ID NO: 1294871 - RNA, 18 nt, Mycobacterium tuberculosis H37Rv
cccgcgccaccggcaccg

SEQ ID NO: 1294872 - RNA, 19 nt, Mycobacterium tuberculosis H37Rv
cccgcgaaccgcggaucga

SEQ ID NO: 1294873 - RNA, 15 nt, Mycobacterium tuberculosis H37Rv
cccgcgccaccagca

SEQ ID NO: 1294874 - RNA, 15 nt, Mycobacterium tuberculosis H37Rv
cccgcgccggcgaca

SEQ ID NO: 1294875 - RNA, 18 nt, Mycobacterium tuberculosis H37Rv
cccgcgccggcgacaccg

SEQ ID NO: 1294876 - RNA, 19 nt, Mycobacterium tuberculosis H37Rv
cccgcgcugagcacgcgga

SEQ ID NO: 1294877 - RNA, 13 nt, Mycobacterium tuberculosis H37Rv
cccgcgcuggaca

SEQ ID NO: 1294878 - RNA, 14 nt, Mycobacterium tuberculosis H37Rv
cccgccucgaccgc

SEQ ID NO: 1294879 - RNA, 22 nt, Mycobacterium tuberculosis H37Rv
cccgccguugccgccgucaccg

SEQ ID NO: 1294880 - RNA, 14 nt, Mycobacterium tuberculosis H37Rv
cccgccguugccgc

SEQ ID NO: 1294881 - RNA, 18 nt, Mycobacterium tuberculosis H37Rv
cccgccucgggccggcgu

SEQ ID NO: 1294882 - RNA, 14 nt, Mycobacterium tuberculosis H37Rv
cccgccgucaccgc

SEQ ID NO: 1294883 - RNA, 13 nt, Mycobacterium tuberculosis H37Rv
cccgccgcgcauc

SEQ ID NO: 1294884 - RNA, 21 nt, Mycobacterium tuberculosis H37Rv
cccgcgggccccaucgccugg

SEQ ID NO: 1294885 - RNA, 17 nt, Mycobacterium tuberculosis H37Rv
cccgcgggcaagccgga

SEQ ID NO: 1294886 - RNA, 19 nt, Mycobacterium tuberculosis H37Rv
cccgcuauucggcggcaug

SEQ ID NO: 1294887 - RNA, 20 nt, Mycobacterium tuberculosis H37Rv
cccgcucaacgggccgcauc

SEQ ID NO: 1294888 - RNA, 15 nt, Mycobacterium tuberculosis H37Rv
cccgcuacgcgcgcu

SEQ ID NO: 1294889 - RNA, 16 nt, Mycobacterium tuberculosis H37Rv
cccgcguucgagagcc

SEQ ID NO: 1294890 - RNA, 12 nt, Mycobacterium tuberculosis H37Rv
cccgcugccauu

SEQ ID NO: 1294891 - RNA, 18 nt, Mycobacterium tuberculosis H37Rv
cccgcucgggguugcucg

SEQ ID NO: 1294892 - RNA, 21 nt, Mycobacterium tuberculosis H37Rv
cccgcucgggguugcucgcga

SEQ ID NO: 1294893 - RNA, 12 nt, Mycobacterium tuberculosis H37Rv
cccgcaccgcgu

SEQ ID NO: 1294894 - RNA, 16 nt, Mycobacterium tuberculosis H37Rv
cccgcaccgcgguacg

SEQ ID NO: 1294895 - RNA, 14 nt, Mycobacterium tuberculosis H37Rv
cccgcacccaugau

SEQ ID NO: 1294896 - RNA, 15 nt, Mycobacterium tuberculosis H37Rv
cccgcaccggaucgg

SEQ ID NO: 1294897 - RNA, 21 nt, Mycobacterium tuberculosis H37Rv
cccgaucagguacgccaggug

SEQ ID NO: 1294898 - RNA, 22 nt, Mycobacterium tuberculosis H37Rv
cccgaucaccuucggccgaccg

SEQ ID NO: 1294899 - RNA, 13 nt, Mycobacterium tuberculosis H37Rv
cccgaucagcgac

SEQ ID NO: 1294900 - RNA, 19 nt, Mycobacterium tuberculosis H37Rv
cccgaucaggcgggcaacg

SEQ ID NO: 1294901 - RNA, 13 nt, Mycobacterium tuberculosis H37Rv
ccccggcgguacc

SEQ ID NO: 1294902 - RNA, 20 nt, Mycobacterium tuberculosis H37Rv
ccccggcguccgaccgguac

SEQ ID NO: 1294903 - RNA, 23 nt, Mycobacterium tuberculosis H37Rv
ccccggcgagcagacgcauaagc

SEQ ID NO: 1294904 - RNA, 15 nt, Mycobacterium tuberculosis H37Rv
ccccggcgacggcgu

SEQ ID NO: 1294905 - RNA, 13 nt, Mycobacterium tuberculosis H37Rv
ccccggcgacccg

SEQ ID NO: 1294906 - RNA, 13 nt, Mycobacterium tuberculosis H37Rv
ccccggccgaucu

SEQ ID NO: 1294907 - RNA, 13 nt, Mycobacterium tuberculosis H37Rv
cccgcacggugua

SEQ ID NO: 1294908 - RNA, 18 nt, Mycobacterium tuberculosis H37Rv
cccgcacuccacgaucgg

SEQ ID NO: 1294909 - RNA, 13 nt, Mycobacterium tuberculosis H37Rv
cccgcacgaaccg

SEQ ID NO: 1294910 - RNA, 16 nt, Mycobacterium tuberculosis H37Rv
cccgcccggaacgggu

SEQ ID NO: 1294911 - RNA, 20 nt, Mycobacterium tuberculosis H37Rv
cccgccgccacgggugacga

SEQ ID NO: 1294912 - RNA, 15 nt, Mycobacterium tuberculosis H37Rv
cccgccgacgaccgc

SEQ ID NO: 1294913 - RNA, 14 nt, Mycobacterium tuberculosis H37Rv
cccgccgaucaccg

SEQ ID NO: 1294914 - RNA, 15 nt, Mycobacterium tuberculosis H37Rv
cccgccgaucaccgc

SEQ ID NO: 1294915 - RNA, 14 nt, Mycobacterium tuberculosis H37Rv
cccgccgaccgaca

SEQ ID NO: 1294916 - RNA, 16 nt, Mycobacterium tuberculosis H37Rv
cccgcccuugccgcca

SEQ ID NO: 1294917 - RNA, 14 nt, Mycobacterium tuberculosis H37Rv
cccggccgucgcgc

SEQ ID NO: 1294918 - RNA, 23 nt, Mycobacterium tuberculosis H37Rv
cccggccgucgcgcgaccgacca

SEQ ID NO: 1294919 - RNA, 23 nt, Mycobacterium tuberculosis H37Rv
cccggccgcgucacggaccugga

SEQ ID NO: 1294920 - RNA, 21 nt, Mycobacterium tuberculosis H37Rv
cccggcccagugggacagguc

SEQ ID NO: 1294921 - RNA, 14 nt, Mycobacterium tuberculosis H37Rv
cccggcccgaucgg

SEQ ID NO: 1294922 - RNA, 16 nt, Mycobacterium tuberculosis H37Rv
cccggaaucgucgcgg

SEQ ID NO: 1294923 - RNA, 14 nt, Mycobacterium tuberculosis H37Rv
cccggaccuucggc

SEQ ID NO: 1294924 - RNA, 16 nt, Mycobacterium tuberculosis H37Rv
cccggaccuucggcgg

SEQ ID NO: 1294925 - RNA, 14 nt, Mycobacterium tuberculosis H37Rv
cccggaugaucccg

SEQ ID NO: 1294926 - RNA, 17 nt, Mycobacterium tuberculosis H37Rv
cccggcacccggugaga

SEQ ID NO: 1294927 - RNA, 20 nt, Mycobacterium tuberculosis H37Rv
cccggcaguucgcggccauc

SEQ ID NO: 1294928 - RNA, 13 nt, Mycobacterium tuberculosis H37Rv
cccggcaucgcga

SEQ ID NO: 1294929 - RNA, 17 nt, Mycobacterium tuberculosis H37Rv
cccggcaucgcgaucgg

SEQ ID NO: 1294930 - RNA, 18 nt, Mycobacterium tuberculosis H37Rv
cccggccuggagcagcca

SEQ ID NO: 1294931 - RNA, 14 nt, Mycobacterium tuberculosis H37Rv
cccggccuugccgc

SEQ ID NO: 1294932 - RNA, 15 nt, Mycobacterium tuberculosis H37Rv
cccggccuugccacc

SEQ ID NO: 1294933 - RNA, 21 nt, Mycobacterium tuberculosis H37Rv
cccggccuuggcggcggcaua

SEQ ID NO: 1294934 - RNA, 23 nt, Mycobacterium tuberculosis H37Rv
cccggcgaauacgaccgucgcgc

SEQ ID NO: 1294935 - RNA, 23 nt, Mycobacterium tuberculosis H37Rv
cccggcggccaucccgcguucga

SEQ ID NO: 1294936 - RNA, 23 nt, Mycobacterium tuberculosis H37Rv
cccggcgaucagcagcgccagca

SEQ ID NO: 1294937 - RNA, 15 nt, Mycobacterium tuberculosis H37Rv
cccggcgacguuccg

SEQ ID NO: 1294938 - RNA, 15 nt, Mycobacterium tuberculosis H37Rv
cccggcucgacgcgu

SEQ ID NO: 1294939 - RNA, 18 nt, Mycobacterium tuberculosis H37Rv
cccggcgugucgccgcca

SEQ ID NO: 1294940 - RNA, 14 nt, Mycobacterium tuberculosis H37Rv
cccggcgucgacga

SEQ ID NO: 1294941 - RNA, 16 nt, Mycobacterium tuberculosis H37Rv
cccggcgugucgccgc

SEQ ID NO: 1294942 - RNA, 20 nt, Mycobacterium tuberculosis H37Rv
cccggcguauugcaccgcca

SEQ ID NO: 1294943 - RNA, 23 nt, Mycobacterium tuberculosis H37Rv
cccggucacgcugugcgguaucg

SEQ ID NO: 1294944 - RNA, 22 nt, Mycobacterium tuberculosis H37Rv
cccggucacgcugugcgguauc

SEQ ID NO: 1294945 - RNA, 12 nt, Mycobacterium tuberculosis H37Rv
cccggguggcac

SEQ ID NO: 1294946 - RNA, 12 nt, Mycobacterium tuberculosis H37Rv
cccgggcggucg

SEQ ID NO: 1294947 - RNA, 14 nt, Mycobacterium tuberculosis H37Rv
cccgggccugaacc

SEQ ID NO: 1294948 - RNA, 15 nt, Mycobacterium tuberculosis H37Rv
cccgggccguccggc

SEQ ID NO: 1294949 - RNA, 17 nt, Mycobacterium tuberculosis H37Rv
cccgggccguccggcgc

SEQ ID NO: 1294950 - RNA, 17 nt, Mycobacterium tuberculosis H37Rv
cccggcucucuucgcgc

SEQ ID NO: 1294951 - RNA, 22 nt, Mycobacterium tuberculosis H37Rv
cccggcucucuucgcgcgcugg

SEQ ID NO: 1294952 - RNA, 22 nt, Mycobacterium tuberculosis H37Rv
cccaucaacgccggcgacggcg

SEQ ID NO: 1294953 - RNA, 17 nt, Mycobacterium tuberculosis H37Rv
cccaucacacccgguau

SEQ ID NO: 1294954 - RNA, 13 nt, Mycobacterium tuberculosis H37Rv
cccagcugcaggg

SEQ ID NO: 1294955 - RNA, 19 nt, Mycobacterium tuberculosis H37Rv
cccaggccaagguggccac

SEQ ID NO: 1294956 - RNA, 14 nt, Mycobacterium tuberculosis H37Rv
cccaggccaccggc

SEQ ID NO: 1294957 - RNA, 22 nt, Mycobacterium tuberculosis H37Rv
cccaggccaccggcugcaacca

SEQ ID NO: 1294958 - RNA, 16 nt, Mycobacterium tuberculosis H37Rv
cccaggcaucggugag

SEQ ID NO: 1294959 - RNA, 21 nt, Mycobacterium tuberculosis H37Rv
cccagcgcgcugggaagcucg

SEQ ID NO: 1294960 - RNA, 19 nt, Mycobacterium tuberculosis H37Rv
cccagcgccuccagcacca

SEQ ID NO: 1294961 - RNA, 13 nt, Mycobacterium tuberculosis H37Rv
cccagcacgguca

SEQ ID NO: 1294962 - RNA, 16 nt, Mycobacterium tuberculosis H37Rv
cccagcacauucugca

SEQ ID NO: 1294963 - RNA, 12 nt, Mycobacterium tuberculosis H37Rv
cccagcugacca

SEQ ID NO: 1294964 - RNA, 16 nt, Mycobacterium tuberculosis H37Rv
cccagcugaccagcgu

SEQ ID NO: 1294965 - RNA, 18 nt, Mycobacterium tuberculosis H37Rv
cccagcgguaucccccag

SEQ ID NO: 1294966 - RNA, 19 nt, Mycobacterium tuberculosis H37Rv
cccagcgugcccgccaccg

SEQ ID NO: 1294967 - RNA, 18 nt, Mycobacterium tuberculosis H37Rv
cccagcgguagccgagcu

SEQ ID NO: 1294968 - RNA, 21 nt, Mycobacterium tuberculosis H37Rv
cccagcgggacaaaaucagca

SEQ ID NO: 1294969 - RNA, 18 nt, Mycobacterium tuberculosis H37Rv
cccagcgcugucguaccg

SEQ ID NO: 1294970 - RNA, 22 nt, Mycobacterium tuberculosis H37Rv
ccauugccgccggugccgccga

SEQ ID NO: 1294971 - RNA, 19 nt, Mycobacterium tuberculosis H37Rv
ccauugccgccgucgccga

SEQ ID NO: 1294972 - RNA, 13 nt, Mycobacterium tuberculosis H37Rv
ccauucucggccg

SEQ ID NO: 1294973 - RNA, 18 nt, Mycobacterium tuberculosis H37Rv
ccauucuuggugaucgcg

SEQ ID NO: 1294974 - RNA, 14 nt, Mycobacterium tuberculosis H37Rv
ccauuccaucgcgc

SEQ ID NO: 1294975 - RNA, 16 nt, Mycobacterium tuberculosis H37Rv
cccaccaugugcgaca

SEQ ID NO: 1294976 - RNA, 17 nt, Mycobacterium tuberculosis H37Rv
cccaccgaagcgaacgg

SEQ ID NO: 1294977 - RNA, 13 nt, Mycobacterium tuberculosis H37Rv
cccaccgacgccg

SEQ ID NO: 1294978 - RNA, 13 nt, Mycobacterium tuberculosis H37Rv
cccacccgcaccg

SEQ ID NO: 1294979 - RNA, 13 nt, Mycobacterium tuberculosis H37Rv
cccacccgcacca

SEQ ID NO: 1294980 - RNA, 15 nt, Mycobacterium tuberculosis H37Rv
cccaccggucgccgc

SEQ ID NO: 1294981 - RNA, 13 nt, Mycobacterium tuberculosis H37Rv
cccaccggucgcg

SEQ ID NO: 1294982 - RNA, 15 nt, Mycobacterium tuberculosis H37Rv
cccaccgguaccgcc

SEQ ID NO: 1294983 - RNA, 12 nt, Mycobacterium tuberculosis H37Rv
cccaccggcacc

SEQ ID NO: 1294984 - RNA, 20 nt, Mycobacterium tuberculosis H37Rv
cccacgaggacugggugcgc

SEQ ID NO: 1294985 - RNA, 13 nt, Mycobacterium tuberculosis H37Rv
cccaccuucgagu

SEQ ID NO: 1294986 - RNA, 21 nt, Mycobacterium tuberculosis H37Rv
cccacgagagcgcugucccga

SEQ ID NO: 1294987 - RNA, 22 nt, Mycobacterium tuberculosis H37Rv
cccaccuucaucaacgacacca

SEQ ID NO: 1294988 - RNA, 16 nt, Mycobacterium tuberculosis H37Rv
cccaccuggaucagcg

SEQ ID NO: 1294989 - RNA, 16 nt, Mycobacterium tuberculosis H37Rv
cccacggccggccgcu

SEQ ID NO: 1294990 - RNA, 14 nt, Mycobacterium tuberculosis H37Rv
cccacgcuucggcc

SEQ ID NO: 1294991 - RNA, 14 nt, Mycobacterium tuberculosis H37Rv
cccacgaucagcag

SEQ ID NO: 1294992 - RNA, 18 nt, Mycobacterium tuberculosis H37Rv
cccacgauaggugaacgc

SEQ ID NO: 1294993 - RNA, 16 nt, Mycobacterium tuberculosis H37Rv
cccagacugucgagcg

SEQ ID NO: 1294994 - RNA, 17 nt, Mycobacterium tuberculosis H37Rv
cccagauacccgcguac

SEQ ID NO: 1294995 - RNA, 13 nt, Mycobacterium tuberculosis H37Rv
cccagaucggcgu

SEQ ID NO: 1294996 - RNA, 12 nt, Mycobacterium tuberculosis H37Rv
ccccgaucaccc

SEQ ID NO: 1294997 - RNA, 15 nt, Mycobacterium tuberculosis H37Rv
ccccgaccgaaccgu

SEQ ID NO: 1294998 - RNA, 12 nt, Mycobacterium tuberculosis H37Rv
ccccgaccgccg

SEQ ID NO: 1294999 - RNA, 12 nt, Mycobacterium tuberculosis H37Rv
ccccgcagcugc

SEQ ID NO: 1295000 - RNA, 20 nt, Mycobacterium tuberculosis H37Rv
ccccgcagcugcgucccgga

SEQ ID NO: 1295001 - RNA, 14 nt, Mycobacterium tuberculosis H37Rv
ccccgcacgcucgg

SEQ ID NO: 1295002 - RNA, 13 nt, Mycobacterium tuberculosis H37Rv
cccccggugccgc

SEQ ID NO: 1295003 - RNA, 18 nt, Mycobacterium tuberculosis H37Rv
cccccgcacgcucggcgu

SEQ ID NO: 1295004 - RNA, 21 nt, Mycobacterium tuberculosis H37Rv
ccccgaaguggugaccgacgc

SEQ ID NO: 1295005 - RNA, 15 nt, Mycobacterium tuberculosis H37Rv
ccccgaaguggugac

SEQ ID NO: 1295006 - RNA, 19 nt, Mycobacterium tuberculosis H37Rv
ccccgaacauugcgcccag

SEQ ID NO: 1295007 - RNA, 20 nt, Mycobacterium tuberculosis H37Rv
ccccgaacauugcgcccagc

SEQ ID NO: 1295008 - RNA, 18 nt, Mycobacterium tuberculosis H37Rv
ccccgaagcucaucaccg

SEQ ID NO: 1295009 - RNA, 16 nt, Mycobacterium tuberculosis H37Rv
ccccggaccaucgaca

SEQ ID NO: 1295010 - RNA, 16 nt, Mycobacterium tuberculosis H37Rv
ccccggaccgcggcca

SEQ ID NO: 1295011 - RNA, 21 nt, Mycobacterium tuberculosis H37Rv
ccccggaaugcccgagcagga

SEQ ID NO: 1295012 - RNA, 12 nt, Mycobacterium tuberculosis H37Rv
ccccggccacca

SEQ ID NO: 1295013 - RNA, 19 nt, Mycobacterium tuberculosis H37Rv
ccccgcuacgcgcgcucgc

SEQ ID NO: 1295014 - RNA, 14 nt, Mycobacterium tuberculosis H37Rv
ccccgccgucaccg

SEQ ID NO: 1295015 - RNA, 17 nt, Mycobacterium tuberculosis H37Rv
ccccgccggcugcggag

SEQ ID NO: 1295016 - RNA, 13 nt, Mycobacterium tuberculosis H37Rv
ccccgccguaccg

SEQ ID NO: 1295017 - RNA, 23 nt, Mycobacterium tuberculosis H37Rv
ccccgccguugccgccgacgccg

SEQ ID NO: 1295018 - RNA, 15 nt, Mycobacterium tuberculosis H37Rv
ccccgccgucaccgc

SEQ ID NO: 1295019 - RNA, 13 nt, Mycobacterium tuberculosis H37Rv
ccccgcgcgaacc

SEQ ID NO: 1295020 - RNA, 15 nt, Mycobacterium tuberculosis H37Rv
ccccgccgaucaccg

SEQ ID NO: 1295021 - RNA, 13 nt, Mycobacterium tuberculosis H37Rv
ccccgccgagcgg

SEQ ID NO: 1295022 - RNA, 15 nt, Mycobacterium tuberculosis H37Rv
ccccgccauugccgc

SEQ ID NO: 1295023 - RNA, 13 nt, Mycobacterium tuberculosis H37Rv
ccccauugccgcc

SEQ ID NO: 1295024 - RNA, 17 nt, Mycobacterium tuberculosis H37Rv
cccccaaucagugcagc

SEQ ID NO: 1295025 - RNA, 15 nt, Mycobacterium tuberculosis H37Rv
cccccaguucggcgu

SEQ ID NO: 1295026 - RNA, 12 nt, Mycobacterium tuberculosis H37Rv
cccccgacaccg

SEQ ID NO: 1295027 - RNA, 12 nt, Mycobacterium tuberculosis H37Rv
ccccagcgacgu

SEQ ID NO: 1295028 - RNA, 19 nt, Mycobacterium tuberculosis H37Rv
ccccagcgacgucgcaaua

SEQ ID NO: 1295029 - RNA, 19 nt, Mycobacterium tuberculosis H37Rv
ccccagcgacaugcccgcc

SEQ ID NO: 1295030 - RNA, 17 nt, Mycobacterium tuberculosis H37Rv
ccccagccggcagcagc

SEQ ID NO: 1295031 - RNA, 15 nt, Mycobacterium tuberculosis H37Rv
ccccagcgccaccgu

SEQ ID NO: 1295032 - RNA, 16 nt, Mycobacterium tuberculosis H37Rv
ccccagcuugcgguga

SEQ ID NO: 1295033 - RNA, 14 nt, Mycobacterium tuberculosis H37Rv
ccccaggcgaacag

SEQ ID NO: 1295034 - RNA, 13 nt, Mycobacterium tuberculosis H37Rv
ccccagggugcgc

SEQ ID NO: 1295035 - RNA, 16 nt, Mycobacterium tuberculosis H37Rv
ccccagggagugccgc

SEQ ID NO: 1295036 - RNA, 14 nt, Mycobacterium tuberculosis H37Rv
ccccaagucgacgg

SEQ ID NO: 1295037 - RNA, 18 nt, Mycobacterium tuberculosis H37Rv
ccccaagcgccugagcgg

SEQ ID NO: 1295038 - RNA, 13 nt, Mycobacterium tuberculosis H37Rv
cccauuucggcac

SEQ ID NO: 1295039 - RNA, 17 nt, Mycobacterium tuberculosis H37Rv
cccauuucgucagcgac

SEQ ID NO: 1295040 - RNA, 12 nt, Mycobacterium tuberculosis H37Rv
ccccaccgguua

SEQ ID NO: 1295041 - RNA, 16 nt, Mycobacterium tuberculosis H37Rv
ccccaccggugccgcc

SEQ ID NO: 1295042 - RNA, 16 nt, Mycobacterium tuberculosis H37Rv
ccccaccgguaccgcc

SEQ ID NO: 1295043 - RNA, 13 nt, Mycobacterium tuberculosis H37Rv
ccccacacagucg

SEQ ID NO: 1295044 - RNA, 12 nt, Mycobacterium tuberculosis H37Rv
ccccaccggcac

SEQ ID NO: 1295045 - RNA, 15 nt, Mycobacterium tuberculosis H37Rv
ccccacuggugcagc

SEQ ID NO: 1295046 - RNA, 22 nt, Mycobacterium tuberculosis H37Rv
ccccagcacccggcuucgccgc

SEQ ID NO: 1295047 - RNA, 16 nt, Mycobacterium tuberculosis H37Rv
ccagggcgcggaucug

SEQ ID NO: 1295048 - RNA, 15 nt, Mycobacterium tuberculosis H37Rv
ccagggcgacggcca

SEQ ID NO: 1295049 - RNA, 16 nt, Mycobacterium tuberculosis H37Rv
ccagggccgagcagcu

SEQ ID NO: 1295050 - RNA, 21 nt, Mycobacterium tuberculosis H37Rv
ccaggaucucuucucggcuac

SEQ ID NO: 1295051 - RNA, 24 nt, Mycobacterium tuberculosis H37Rv
ccaggagugcgggcaugccggcga

SEQ ID NO: 1295052 - RNA, 15 nt, Mycobacterium tuberculosis H37Rv
ccaggagccgaucac

SEQ ID NO: 1295053 - RNA, 15 nt, Mycobacterium tuberculosis H37Rv
ccaggauaaguccgg

SEQ ID NO: 1295054 - RNA, 13 nt, Mycobacterium tuberculosis H37Rv
ccaggagcaccuc

SEQ ID NO: 1295055 - RNA, 18 nt, Mycobacterium tuberculosis H37Rv
ccaggagugauucggcga

SEQ ID NO: 1295056 - RNA, 18 nt, Mycobacterium tuberculosis H37Rv
ccaggucauugccggcga

SEQ ID NO: 1295057 - RNA, 16 nt, Mycobacterium tuberculosis H37Rv
ccagguagucgaccau

SEQ ID NO: 1295058 - RNA, 20 nt, Mycobacterium tuberculosis H37Rv
ccaggucggcuucgacaacc

SEQ ID NO: 1295059 - RNA, 15 nt, Mycobacterium tuberculosis H37Rv
ccaggucggcggacg

SEQ ID NO: 1295060 - RNA, 22 nt, Mycobacterium tuberculosis H37Rv
ccaggucggucauccggauggg

SEQ ID NO: 1295061 - RNA, 15 nt, Mycobacterium tuberculosis H37Rv
ccagggcgugcgcga

SEQ ID NO: 1295062 - RNA, 20 nt, Mycobacterium tuberculosis H37Rv
ccaggggaccgcggcgcguc

SEQ ID NO: 1295063 - RNA, 13 nt, Mycobacterium tuberculosis H37Rv
ccagugggaugac

SEQ ID NO: 1295064 - RNA, 23 nt, Mycobacterium tuberculosis H37Rv
ccagugucagcacgacgacaacc

SEQ ID NO: 1295065 - RNA, 19 nt, Mycobacterium tuberculosis H37Rv
ccaguguccggcgacgcgu

SEQ ID NO: 1295066 - RNA, 14 nt, Mycobacterium tuberculosis H37Rv
ccagugcacgcucg

SEQ ID NO: 1295067 - RNA, 15 nt, Mycobacterium tuberculosis H37Rv
ccagugagcaugcga

SEQ ID NO: 1295068 - RNA, 19 nt, Mycobacterium tuberculosis H37Rv
ccagugcacgcucggcgcc

SEQ ID NO: 1295069 - RNA, 16 nt, Mycobacterium tuberculosis H37Rv
ccaguguugcgcugcg

SEQ ID NO: 1295070 - RNA, 19 nt, Mycobacterium tuberculosis H37Rv
ccaguuauucggugcgcgg

SEQ ID NO: 1295071 - RNA, 18 nt, Mycobacterium tuberculosis H37Rv
ccaguugaucaggccgau

SEQ ID NO: 1295072 - RNA, 16 nt, Mycobacterium tuberculosis H37Rv
ccagguuuugccgcgu

SEQ ID NO: 1295073 - RNA, 15 nt, Mycobacterium tuberculosis H37Rv
ccagguuuugccgcg

SEQ ID NO: 1295074 - RNA, 14 nt, Mycobacterium tuberculosis H37Rv
ccagucgaucgcgg

SEQ ID NO: 1295075 - RNA, 20 nt, Mycobacterium tuberculosis H37Rv
ccagucgaagaagacccgug

SEQ ID NO: 1295076 - RNA, 17 nt, Mycobacterium tuberculosis H37Rv
ccagucgcggcguucgg

SEQ ID NO: 1295077 - RNA, 20 nt, Mycobacterium tuberculosis H37Rv
ccagucggcgccgccgucca

SEQ ID NO: 1295078 - RNA, 17 nt, Mycobacterium tuberculosis H37Rv
ccagucgauucggccca

SEQ ID NO: 1295079 - RNA, 20 nt, Mycobacterium tuberculosis H37Rv
ccagucgcaggaucggcgga

SEQ ID NO: 1295080 - RNA, 20 nt, Mycobacterium tuberculosis H37Rv
ccagguugaagaaugccguc

SEQ ID NO: 1295081 - RNA, 18 nt, Mycobacterium tuberculosis H37Rv
ccaggugagcgacgcuga

SEQ ID NO: 1295082 - RNA, 20 nt, Mycobacterium tuberculosis H37Rv
ccaucgaccgcccgccagcg

SEQ ID NO: 1295083 - RNA, 19 nt, Mycobacterium tuberculosis H37Rv
ccaucgaggcgaucaccgc

SEQ ID NO: 1295084 - RNA, 18 nt, Mycobacterium tuberculosis H37Rv
ccaucgaggcgaucaccg

SEQ ID NO: 1295085 - RNA, 13 nt, Mycobacterium tuberculosis H37Rv
ccaucgccaccgc

SEQ ID NO: 1295086 - RNA, 16 nt, Mycobacterium tuberculosis H37Rv
ccaucgccgacggcga

SEQ ID NO: 1295087 - RNA, 19 nt, Mycobacterium tuberculosis H37Rv
ccaucgccaccgcgucacu

SEQ ID NO: 1295088 - RNA, 16 nt, Mycobacterium tuberculosis H37Rv
ccaucgccaccgcguc

SEQ ID NO: 1295089 - RNA, 22 nt, Mycobacterium tuberculosis H37Rv
ccaucgccgccgcgcguucggc

SEQ ID NO: 1295090 - RNA, 20 nt, Mycobacterium tuberculosis H37Rv
ccauccgggccgcggccaca

SEQ ID NO: 1295091 - RNA, 20 nt, Mycobacterium tuberculosis H37Rv
ccauccucgaguuuggccag

SEQ ID NO: 1295092 - RNA, 19 nt, Mycobacterium tuberculosis H37Rv
ccauccaugauggccguca

SEQ ID NO: 1295093 - RNA, 17 nt, Mycobacterium tuberculosis H37Rv
ccauccccuggccagca

SEQ ID NO: 1295094 - RNA, 19 nt, Mycobacterium tuberculosis H37Rv
ccaucccgauccuggccac

SEQ ID NO: 1295095 - RNA, 20 nt, Mycobacterium tuberculosis H37Rv
ccaucauguucuuuugcguc

SEQ ID NO: 1295096 - RNA, 17 nt, Mycobacterium tuberculosis H37Rv
ccauacccgcgcgcacc

SEQ ID NO: 1295097 - RNA, 15 nt, Mycobacterium tuberculosis H37Rv
ccauaccggccgcca

SEQ ID NO: 1295098 - RNA, 16 nt, Mycobacterium tuberculosis H37Rv
ccauaccggccgccau

SEQ ID NO: 1295099 - RNA, 20 nt, Mycobacterium tuberculosis H37Rv
ccauagaugcccgcgaucau

SEQ ID NO: 1295100 - RNA, 17 nt, Mycobacterium tuberculosis H37Rv
ccaugccgcucggcaac

SEQ ID NO: 1295101 - RNA, 19 nt, Mycobacterium tuberculosis H37Rv
ccaugcuccuaucacugga

SEQ ID NO: 1295102 - RNA, 11 nt, Mycobacterium tuberculosis H37Rv
ccaugcugcgc

SEQ ID NO: 1295103 - RNA, 14 nt, Mycobacterium tuberculosis H37Rv
ccaugcugcgcaac

SEQ ID NO: 1295104 - RNA, 17 nt, Mycobacterium tuberculosis H37Rv
ccaugcuaggaccacca

SEQ ID NO: 1295105 - RNA, 14 nt, Mycobacterium tuberculosis H37Rv
ccaugcacguugcc

SEQ ID NO: 1295106 - RNA, 17 nt, Mycobacterium tuberculosis H37Rv
ccaugccacaacgccuc

SEQ ID NO: 1295107 - RNA, 23 nt, Mycobacterium tuberculosis H37Rv
ccaugccgaucggccugcagcga

SEQ ID NO: 1295108 - RNA, 18 nt, Mycobacterium tuberculosis H37Rv
ccaugcccgcacgcucgg

SEQ ID NO: 1295109 - RNA, 15 nt, Mycobacterium tuberculosis H37Rv
ccauggcccguuggc

SEQ ID NO: 1295110 - RNA, 14 nt, Mycobacterium tuberculosis H37Rv
ccauggccaccagg

SEQ ID NO: 1295111 - RNA, 12 nt, Mycobacterium tuberculosis H37Rv
ccauggccaccg

SEQ ID NO: 1295112 - RNA, 20 nt, Mycobacterium tuberculosis H37Rv
ccauucccaacacagccguc

SEQ ID NO: 1295113 - RNA, 21 nt, Mycobacterium tuberculosis H37Rv
ccauuaaaaagcccagcgauu

SEQ ID NO: 1295114 - RNA, 15 nt, Mycobacterium tuberculosis H37Rv
ccaugauggacagcu

SEQ ID NO: 1295115 - RNA, 13 nt, Mycobacterium tuberculosis H37Rv
ccaugauggacag

SEQ ID NO: 1295116 - RNA, 16 nt, Mycobacterium tuberculosis H37Rv
ccaugauggccgucag

SEQ ID NO: 1295117 - RNA, 19 nt, Mycobacterium tuberculosis H37Rv
ccaugaucuggugcgcgga

SEQ ID NO: 1295118 - RNA, 19 nt, Mycobacterium tuberculosis H37Rv
ccaugagcuugguggccac

SEQ ID NO: 1295119 - RNA, 20 nt, Mycobacterium tuberculosis H37Rv
ccaugauggccgucagccag

SEQ ID NO: 1295120 - RNA, 16 nt, Mycobacterium tuberculosis H37Rv
ccaugcaccgaugccg

SEQ ID NO: 1295121 - RNA, 18 nt, Mycobacterium tuberculosis H37Rv
ccaugaucacaccgagcg

SEQ ID NO: 1295122 - RNA, 16 nt, Mycobacterium tuberculosis H37Rv
ccaugaccgggcuggc

SEQ ID NO: 1295123 - RNA, 20 nt, Mycobacterium tuberculosis H37Rv
ccaucgcgacuagacgccgc

SEQ ID NO: 1295124 - RNA, 13 nt, Mycobacterium tuberculosis H37Rv
ccaucgcgucggc

SEQ ID NO: 1295125 - RNA, 19 nt, Mycobacterium tuberculosis H37Rv
ccaucgcgucggcgaugaa

SEQ ID NO: 1295126 - RNA, 15 nt, Mycobacterium tuberculosis H37Rv
ccaucgcuugcgcac

SEQ ID NO: 1295127 - RNA, 15 nt, Mycobacterium tuberculosis H37Rv
ccaucgcgacggccc

SEQ ID NO: 1295128 - RNA, 14 nt, Mycobacterium tuberculosis H37Rv
ccaugaagucgagg

SEQ ID NO: 1295129 - RNA, 13 nt, Mycobacterium tuberculosis H37Rv
ccagagucgcccg

SEQ ID NO: 1295130 - RNA, 18 nt, Mycobacterium tuberculosis H37Rv
ccagaggcgcuucgccac

SEQ ID NO: 1295131 - RNA, 14 nt, Mycobacterium tuberculosis H37Rv
ccagagucgcccgc

SEQ ID NO: 1295132 - RNA, 16 nt, Mycobacterium tuberculosis H37Rv
ccagaggcgugucgac

SEQ ID NO: 1295133 - RNA, 17 nt, Mycobacterium tuberculosis H37Rv
ccagagcgucgaacacg

SEQ ID NO: 1295134 - RNA, 13 nt, Mycobacterium tuberculosis H37Rv
ccagagcaucagg

SEQ ID NO: 1295135 - RNA, 14 nt, Mycobacterium tuberculosis H37Rv
ccagcaacugccgc

SEQ ID NO: 1295136 - RNA, 17 nt, Mycobacterium tuberculosis H37Rv
ccagcaacagcgagcgg

SEQ ID NO: 1295137 - RNA, 19 nt, Mycobacterium tuberculosis H37Rv
ccagcaaaccuucgauaac

SEQ ID NO: 1295138 - RNA, 23 nt, Mycobacterium tuberculosis H37Rv
ccagcaacagcgagcgguugauc

SEQ ID NO: 1295139 - RNA, 15 nt, Mycobacterium tuberculosis H37Rv
ccagcaacagcgcgg

SEQ ID NO: 1295140 - RNA, 15 nt, Mycobacterium tuberculosis H37Rv
ccagcaaugccgacu

SEQ ID NO: 1295141 - RNA, 14 nt, Mycobacterium tuberculosis H37Rv
ccagcaaugccgac

SEQ ID NO: 1295142 - RNA, 15 nt, Mycobacterium tuberculosis H37Rv
ccagcaaggccagca

SEQ ID NO: 1295143 - RNA, 19 nt, Mycobacterium tuberculosis H37Rv
ccagcaauaccugagcgcg

SEQ ID NO: 1295144 - RNA, 18 nt, Mycobacterium tuberculosis H37Rv
ccagcacaaccaucgcga

SEQ ID NO: 1295145 - RNA, 21 nt, Mycobacterium tuberculosis H37Rv
ccagcaccacgucgacgaugu

SEQ ID NO: 1295146 - RNA, 18 nt, Mycobacterium tuberculosis H37Rv
ccagcaccacgucgacga

SEQ ID NO: 1295147 - RNA, 13 nt, Mycobacterium tuberculosis H37Rv
ccagcacccgagc

SEQ ID NO: 1295148 - RNA, 18 nt, Mycobacterium tuberculosis H37Rv
ccagcacccgagcgaugc

SEQ ID NO: 1295149 - RNA, 12 nt, Mycobacterium tuberculosis H37Rv
ccagcacccggc

SEQ ID NO: 1295150 - RNA, 19 nt, Mycobacterium tuberculosis H37Rv
ccagcacccgcagccgcga

SEQ ID NO: 1295151 - RNA, 17 nt, Mycobacterium tuberculosis H37Rv
ccagcagcucgccggca

SEQ ID NO: 1295152 - RNA, 15 nt, Mycobacterium tuberculosis H37Rv
ccagcaggacgguga

SEQ ID NO: 1295153 - RNA, 13 nt, Mycobacterium tuberculosis H37Rv
ccagcagcggcga

SEQ ID NO: 1295154 - RNA, 18 nt, Mycobacterium tuberculosis H37Rv
ccagcaggccacugcguu

SEQ ID NO: 1295155 - RNA, 20 nt, Mycobacterium tuberculosis H37Rv
ccagcagguuccacggccag

SEQ ID NO: 1295156 - RNA, 21 nt, Mycobacterium tuberculosis H37Rv
ccagcagguccgccaccgcga

SEQ ID NO: 1295157 - RNA, 21 nt, Mycobacterium tuberculosis H37Rv
ccagcagcagugccaccgguu

SEQ ID NO: 1295158 - RNA, 12 nt, Mycobacterium tuberculosis H37Rv
ccagcacggugg

SEQ ID NO: 1295159 - RNA, 13 nt, Mycobacterium tuberculosis H37Rv
ccagcacgugcca

SEQ ID NO: 1295160 - RNA, 22 nt, Mycobacterium tuberculosis H37Rv
ccagcacggucaacgugaugcg

SEQ ID NO: 1295161 - RNA, 15 nt, Mycobacterium tuberculosis H37Rv
ccagcacggcaacca

SEQ ID NO: 1295162 - RNA, 21 nt, Mycobacterium tuberculosis H37Rv
ccagcacgcgcgcgaccucgc

SEQ ID NO: 1295163 - RNA, 12 nt, Mycobacterium tuberculosis H37Rv
ccagcacgcugg

SEQ ID NO: 1295164 - RNA, 15 nt, Mycobacterium tuberculosis H37Rv
ccacgcugaccaacg

SEQ ID NO: 1295165 - RNA, 18 nt, Mycobacterium tuberculosis H37Rv
ccacgcucggugcugcgc

SEQ ID NO: 1295166 - RNA, 23 nt, Mycobacterium tuberculosis H37Rv
ccaccguagccagcaggaacgcc

SEQ ID NO: 1295167 - RNA, 18 nt, Mycobacterium tuberculosis H37Rv
ccaccgucaccgccguca

SEQ ID NO: 1295168 - RNA, 14 nt, Mycobacterium tuberculosis H37Rv
ccaccggucgccgc

SEQ ID NO: 1295169 - RNA, 12 nt, Mycobacterium tuberculosis H37Rv
ccaccggucgcg

SEQ ID NO: 1295170 - RNA, 17 nt, Mycobacterium tuberculosis H37Rv
ccacggacgugacgucg

SEQ ID NO: 1295171 - RNA, 13 nt, Mycobacterium tuberculosis H37Rv
ccacggaccagcg

SEQ ID NO: 1295172 - RNA, 23 nt, Mycobacterium tuberculosis H37Rv
ccacgcugugcucgacgaagauc

SEQ ID NO: 1295173 - RNA, 13 nt, Mycobacterium tuberculosis H37Rv
ccacggagaccgg

SEQ ID NO: 1295174 - RNA, 19 nt, Mycobacterium tuberculosis H37Rv
ccacggcuucgccgcggga

SEQ ID NO: 1295175 - RNA, 22 nt, Mycobacterium tuberculosis H37Rv
ccacggcugcccaugguggcga

SEQ ID NO: 1295176 - RNA, 15 nt, Mycobacterium tuberculosis H37Rv
ccacggcuucgccgc

SEQ ID NO: 1295177 - RNA, 19 nt, Mycobacterium tuberculosis H37Rv
ccacggcugcccauggugg

SEQ ID NO: 1295178 - RNA, 22 nt, Mycobacterium tuberculosis H37Rv
ccacggcgauccggucggccag

SEQ ID NO: 1295179 - RNA, 19 nt, Mycobacterium tuberculosis H37Rv
ccacggcgauccggucggc

SEQ ID NO: 1295180 - RNA, 23 nt, Mycobacterium tuberculosis H37Rv
ccacguagcagcgccggcaccga

SEQ ID NO: 1295181 - RNA, 22 nt, Mycobacterium tuberculosis H37Rv
ccacguagcagcgccggcaccg

SEQ ID NO: 1295182 - RNA, 16 nt, Mycobacterium tuberculosis H37Rv
ccacguacgcggcugc

SEQ ID NO: 1295183 - RNA, 16 nt, Mycobacterium tuberculosis H37Rv
ccacguaauuccccag

SEQ ID NO: 1295184 - RNA, 20 nt, Mycobacterium tuberculosis H37Rv
ccacgucaaacccgacaucg

SEQ ID NO: 1295185 - RNA, 19 nt, Mycobacterium tuberculosis H37Rv
ccagacguuccaucacgga

SEQ ID NO: 1295186 - RNA, 14 nt, Mycobacterium tuberculosis H37Rv
ccagacaauccgcc

SEQ ID NO: 1295187 - RNA, 15 nt, Mycobacterium tuberculosis H37Rv
ccagaaaacauugcg

SEQ ID NO: 1295188 - RNA, 14 nt, Mycobacterium tuberculosis H37Rv
ccagaacggcgauc

SEQ ID NO: 1295189 - RNA, 20 nt, Mycobacterium tuberculosis H37Rv
ccagaaccuggagccgugcg

SEQ ID NO: 1295190 - RNA, 15 nt, Mycobacterium tuberculosis H37Rv
ccagaaccggugcgg

SEQ ID NO: 1295191 - RNA, 20 nt, Mycobacterium tuberculosis H37Rv
ccagaaggccggggcggaac

SEQ ID NO: 1295192 - RNA, 15 nt, Mycobacterium tuberculosis H37Rv
ccagaagccggccac

SEQ ID NO: 1295193 - RNA, 23 nt, Mycobacterium tuberculosis H37Rv
ccagaagaagaugaucgcgaaca

SEQ ID NO: 1295194 - RNA, 20 nt, Mycobacterium tuberculosis H37Rv
ccagaaguaggcgaccgcca

SEQ ID NO: 1295195 - RNA, 20 nt, Mycobacterium tuberculosis H37Rv
ccacugcaugaacugcucgc

SEQ ID NO: 1295196 - RNA, 15 nt, Mycobacterium tuberculosis H37Rv
ccacuguuacggcca

SEQ ID NO: 1295197 - RNA, 16 nt, Mycobacterium tuberculosis H37Rv
ccacuguuacggccac

SEQ ID NO: 1295198 - RNA, 16 nt, Mycobacterium tuberculosis H37Rv
ccacugaucaggccga

SEQ ID NO: 1295199 - RNA, 16 nt, Mycobacterium tuberculosis H37Rv
ccacucgagcgcucac

SEQ ID NO: 1295200 - RNA, 18 nt, Mycobacterium tuberculosis H37Rv
ccacuccgguggccaaca

SEQ ID NO: 1295201 - RNA, 12 nt, Mycobacterium tuberculosis H37Rv
ccacucgaccug

SEQ ID NO: 1295202 - RNA, 13 nt, Mycobacterium tuberculosis H37Rv
ccacuucggcguc

SEQ ID NO: 1295203 - RNA, 17 nt, Mycobacterium tuberculosis H37Rv
ccacuucagaucggcga

SEQ ID NO: 1295204 - RNA, 18 nt, Mycobacterium tuberculosis H37Rv
ccagcgaucccggugagg

SEQ ID NO: 1295205 - RNA, 16 nt, Mycobacterium tuberculosis H37Rv
ccagcgauaucggcgg

SEQ ID NO: 1295206 - RNA, 20 nt, Mycobacterium tuberculosis H37Rv
ccagcgacaugucgaacgcc

SEQ ID NO: 1295207 - RNA, 17 nt, Mycobacterium tuberculosis H37Rv
ccagcgaauccagccgc

SEQ ID NO: 1295208 - RNA, 19 nt, Mycobacterium tuberculosis H37Rv
ccagcgacaugucgaacgc

SEQ ID NO: 1295209 - RNA, 18 nt, Mycobacterium tuberculosis H37Rv
ccagcgaauccagccgcg

SEQ ID NO: 1295210 - RNA, 19 nt, Mycobacterium tuberculosis H37Rv
ccagcgaauggggcagcuc

SEQ ID NO: 1295211 - RNA, 17 nt, Mycobacterium tuberculosis H37Rv
ccagccguggugguuga

SEQ ID NO: 1295212 - RNA, 22 nt, Mycobacterium tuberculosis H37Rv
ccagccguggugguugaucagc

SEQ ID NO: 1295213 - RNA, 18 nt, Mycobacterium tuberculosis H37Rv
ccagccuuuuucgacaag

SEQ ID NO: 1295214 - RNA, 15 nt, Mycobacterium tuberculosis H37Rv
ccagcaugacaccgg

SEQ ID NO: 1295215 - RNA, 14 nt, Mycobacterium tuberculosis H37Rv
ccagcaucucggcg

SEQ ID NO: 1295216 - RNA, 17 nt, Mycobacterium tuberculosis H37Rv
ccagccggcagcagcgg

SEQ ID NO: 1295217 - RNA, 18 nt, Mycobacterium tuberculosis H37Rv
ccagccgguagccgggca

SEQ ID NO: 1295218 - RNA, 21 nt, Mycobacterium tuberculosis H37Rv
ccagccgggcacccuugccga

SEQ ID NO: 1295219 - RNA, 16 nt, Mycobacterium tuberculosis H37Rv
ccagccggcgcacucc

SEQ ID NO: 1295220 - RNA, 13 nt, Mycobacterium tuberculosis H37Rv
ccagccggcagca

SEQ ID NO: 1295221 - RNA, 15 nt, Mycobacterium tuberculosis H37Rv
ccagccggcgcacuc

SEQ ID NO: 1295222 - RNA, 20 nt, Mycobacterium tuberculosis H37Rv
ccagccggucuuggacagca

SEQ ID NO: 1295223 - RNA, 19 nt, Mycobacterium tuberculosis H37Rv
ccagccgguccagcagcuc

SEQ ID NO: 1295224 - RNA, 16 nt, Mycobacterium tuberculosis H37Rv
ccagccgucaccgcga

SEQ ID NO: 1295225 - RNA, 19 nt, Mycobacterium tuberculosis H37Rv
ccagcgcguuguccucgaa

SEQ ID NO: 1295226 - RNA, 17 nt, Mycobacterium tuberculosis H37Rv
ccagcgcgucucguuga

SEQ ID NO: 1295227 - RNA, 16 nt, Mycobacterium tuberculosis H37Rv
ccagcgcuucggccug

SEQ ID NO: 1295228 - RNA, 18 nt, Mycobacterium tuberculosis H37Rv
ccagcgcuucgucggccg

SEQ ID NO: 1295229 - RNA, 22 nt, Mycobacterium tuberculosis H37Rv
ccagcgcgguguagagcgcacc

SEQ ID NO: 1295230 - RNA, 15 nt, Mycobacterium tuberculosis H37Rv
ccagcgccuugacgc

SEQ ID NO: 1295231 - RNA, 16 nt, Mycobacterium tuberculosis H37Rv
ccagcgcccgccggca

SEQ ID NO: 1295232 - RNA, 15 nt, Mycobacterium tuberculosis H37Rv
ccagcgccucgguga

SEQ ID NO: 1295233 - RNA, 21 nt, Mycobacterium tuberculosis H37Rv
ccagcgccucggugagcugca

SEQ ID NO: 1295234 - RNA, 14 nt, Mycobacterium tuberculosis H37Rv
ccagcgcgcuggga

SEQ ID NO: 1295235 - RNA, 18 nt, Mycobacterium tuberculosis H37Rv
ccagcgcgccacgagcaa

SEQ ID NO: 1295236 - RNA, 14 nt, Mycobacterium tuberculosis H37Rv
ccagcgcggcacac

SEQ ID NO: 1295237 - RNA, 18 nt, Mycobacterium tuberculosis H37Rv
ccagcgauucagccugau

SEQ ID NO: 1295238 - RNA, 14 nt, Mycobacterium tuberculosis H37Rv
ccagcuccgccugc

SEQ ID NO: 1295239 - RNA, 16 nt, Mycobacterium tuberculosis H37Rv
ccagcuccucagccac

SEQ ID NO: 1295240 - RNA, 19 nt, Mycobacterium tuberculosis H37Rv
ccagcuccucagccaccgc

SEQ ID NO: 1295241 - RNA, 16 nt, Mycobacterium tuberculosis H37Rv
ccagcucgucgacguc

SEQ ID NO: 1295242 - RNA, 21 nt, Mycobacterium tuberculosis H37Rv
ccagcucggugaucaccauga

SEQ ID NO: 1295243 - RNA, 20 nt, Mycobacterium tuberculosis H37Rv
ccagcucggugcuguugcgc

SEQ ID NO: 1295244 - RNA, 19 nt, Mycobacterium tuberculosis H37Rv
ccagcucgcgcacccagcc

SEQ ID NO: 1295245 - RNA, 14 nt, Mycobacterium tuberculosis H37Rv
ccagcucgcugcgc

SEQ ID NO: 1295246 - RNA, 14 nt, Mycobacterium tuberculosis H37Rv
ccagcucgcgcacc

SEQ ID NO: 1295247 - RNA, 20 nt, Mycobacterium tuberculosis H37Rv
ccagcucgcugcgcgcccac

SEQ ID NO: 1295248 - RNA, 16 nt, Mycobacterium tuberculosis H37Rv
ccagcucagcugcgga

SEQ ID NO: 1295249 - RNA, 21 nt, Mycobacterium tuberculosis H37Rv
ccagcguuugaacgcaugcga

SEQ ID NO: 1295250 - RNA, 19 nt, Mycobacterium tuberculosis H37Rv
ccagcggcaauggccagca

SEQ ID NO: 1295251 - RNA, 19 nt, Mycobacterium tuberculosis H37Rv
ccagcggccgggcggccag

SEQ ID NO: 1295252 - RNA, 17 nt, Mycobacterium tuberculosis H37Rv
ccagcggcgaaggucug

SEQ ID NO: 1295253 - RNA, 17 nt, Mycobacterium tuberculosis H37Rv
ccagcguggggccgcca

SEQ ID NO: 1295254 - RNA, 21 nt, Mycobacterium tuberculosis H37Rv
ccagcucgugaucuucggcga

SEQ ID NO: 1295255 - RNA, 17 nt, Mycobacterium tuberculosis H37Rv
ccagcugacggcgcaac

SEQ ID NO: 1295256 - RNA, 18 nt, Mycobacterium tuberculosis H37Rv
ccagcugcagcagacccg

SEQ ID NO: 1295257 - RNA, 18 nt, Mycobacterium tuberculosis H37Rv
ccagcugcgcagcgcaac

SEQ ID NO: 1295258 - RNA, 15 nt, Mycobacterium tuberculosis H37Rv
ccagcuguugucgcg

SEQ ID NO: 1295259 - RNA, 13 nt, Mycobacterium tuberculosis H37Rv
ccaggaacccgug

SEQ ID NO: 1295260 - RNA, 16 nt, Mycobacterium tuberculosis H37Rv
ccaggagccgaggaau

SEQ ID NO: 1295261 - RNA, 22 nt, Mycobacterium tuberculosis H37Rv
ccaggacuggcaccgccagcca

SEQ ID NO: 1295262 - RNA, 20 nt, Mycobacterium tuberculosis H37Rv
ccaggacggaucgucgugca

SEQ ID NO: 1295263 - RNA, 23 nt, Mycobacterium tuberculosis H37Rv
caugcccgggaugacugggcaaa

SEQ ID NO: 1295264 - RNA, 16 nt, Mycobacterium tuberculosis H37Rv
caugcccgcaccgucg

SEQ ID NO: 1295265 - RNA, 15 nt, Mycobacterium tuberculosis H37Rv
caugccgcucggcaa

SEQ ID NO: 1295266 - RNA, 16 nt, Mycobacterium tuberculosis H37Rv
caugccgggauugccg

SEQ ID NO: 1295267 - RNA, 12 nt, Mycobacterium tuberculosis H37Rv
caugccggcgug

SEQ ID NO: 1295268 - RNA, 22 nt, Mycobacterium tuberculosis H37Rv
caugcgggucugacaucggcca

SEQ ID NO: 1295269 - RNA, 15 nt, Mycobacterium tuberculosis H37Rv
caugcuaggaccacc

SEQ ID NO: 1295270 - RNA, 13 nt, Mycobacterium tuberculosis H37Rv
caugcuaggccac

SEQ ID NO: 1295271 - RNA, 19 nt, Mycobacterium tuberculosis H37Rv
caugcgugacccgacaugg

SEQ ID NO: 1295272 - RNA, 19 nt, Mycobacterium tuberculosis H37Rv
caugcguuggggcacgacg

SEQ ID NO: 1295273 - RNA, 20 nt, Mycobacterium tuberculosis H37Rv
caugcguuggggcacgacgc

SEQ ID NO: 1295274 - RNA, 17 nt, Mycobacterium tuberculosis H37Rv
caugccccgaccgcgua

SEQ ID NO: 1295275 - RNA, 21 nt, Mycobacterium tuberculosis H37Rv
caugcccagaaaaccgccgca

SEQ ID NO: 1295276 - RNA, 18 nt, Mycobacterium tuberculosis H37Rv
caugcaacacaccgcgga

SEQ ID NO: 1295277 - RNA, 13 nt, Mycobacterium tuberculosis H37Rv
caucggcgccaau

SEQ ID NO: 1295278 - RNA, 23 nt, Mycobacterium tuberculosis H37Rv
cauguuccuugcggccgcugauc

SEQ ID NO: 1295279 - RNA, 21 nt, Mycobacterium tuberculosis H37Rv
caugugguggcgccggccggu

SEQ ID NO: 1295280 - RNA, 13 nt, Mycobacterium tuberculosis H37Rv
caugucggugagg

SEQ ID NO: 1295281 - RNA, 20 nt, Mycobacterium tuberculosis H37Rv
caugucggugaccguucggc

SEQ ID NO: 1295282 - RNA, 15 nt, Mycobacterium tuberculosis H37Rv
cauguaccgaccgcg

SEQ ID NO: 1295283 - RNA, 20 nt, Mycobacterium tuberculosis H37Rv
caugguggcgccgaccugga

SEQ ID NO: 1295284 - RNA, 21 nt, Mycobacterium tuberculosis H37Rv
caugguggcgccgaccuggac

SEQ ID NO: 1295285 - RNA, 19 nt, Mycobacterium tuberculosis H37Rv
caugguggcgccgaccugg

SEQ ID NO: 1295286 - RNA, 16 nt, Mycobacterium tuberculosis H37Rv
cauggugggucgacga

SEQ ID NO: 1295287 - RNA, 14 nt, Mycobacterium tuberculosis H37Rv
caugucggccaccg

SEQ ID NO: 1295288 - RNA, 17 nt, Mycobacterium tuberculosis H37Rv
caugucggccacccgga

SEQ ID NO: 1295289 - RNA, 23 nt, Mycobacterium tuberculosis H37Rv
caugucggccggggccacccgca

SEQ ID NO: 1295290 - RNA, 17 nt, Mycobacterium tuberculosis H37Rv
caugucgggccaggcga

SEQ ID NO: 1295291 - RNA, 16 nt, Mycobacterium tuberculosis H37Rv
cauguagcggucguag

SEQ ID NO: 1295292 - RNA, 19 nt, Mycobacterium tuberculosis H37Rv
cauggcuagggcgaugagg

SEQ ID NO: 1295293 - RNA, 19 nt, Mycobacterium tuberculosis H37Rv
caugggaugcucaccggga

SEQ ID NO: 1295294 - RNA, 16 nt, Mycobacterium tuberculosis H37Rv
cauggguagccgccca

SEQ ID NO: 1295295 - RNA, 22 nt, Mycobacterium tuberculosis H37Rv
caugcucgacgcccgccaccgg

SEQ ID NO: 1295296 - RNA, 23 nt, Mycobacterium tuberculosis H37Rv
caugcucaccgaaacgaugcggc

SEQ ID NO: 1295297 - RNA, 23 nt, Mycobacterium tuberculosis H37Rv
caugcuggaaguugugcgcacuc

SEQ ID NO: 1295298 - RNA, 18 nt, Mycobacterium tuberculosis H37Rv
cauggcgaaccgucagcg

SEQ ID NO: 1295299 - RNA, 16 nt, Mycobacterium tuberculosis H37Rv
cauggcgaaccgucag

SEQ ID NO: 1295300 - RNA, 18 nt, Mycobacterium tuberculosis H37Rv
cauucgggcgugcucgcc

SEQ ID NO: 1295301 - RNA, 19 nt, Mycobacterium tuberculosis H37Rv
cauucggucagccagccca

SEQ ID NO: 1295302 - RNA, 21 nt, Mycobacterium tuberculosis H37Rv
cauuccuugauaacgacccuc

SEQ ID NO: 1295303 - RNA, 16 nt, Mycobacterium tuberculosis H37Rv
cauuccguaggccaca

SEQ ID NO: 1295304 - RNA, 19 nt, Mycobacterium tuberculosis H37Rv
cauuaggcucucguagcgc

SEQ ID NO: 1295305 - RNA, 22 nt, Mycobacterium tuberculosis H37Rv
cauguuuugcugcaugccgacc

SEQ ID NO: 1295306 - RNA, 22 nt, Mycobacterium tuberculosis H37Rv
cauguugcccugcaacccgguc

SEQ ID NO: 1295307 - RNA, 20 nt, Mycobacterium tuberculosis H37Rv
cauguugaccucgcgcaccg

SEQ ID NO: 1295308 - RNA, 20 nt, Mycobacterium tuberculosis H37Rv
cauguucggggcgcaccacg

SEQ ID NO: 1295309 - RNA, 16 nt, Mycobacterium tuberculosis H37Rv
cauuagcagcacccgg

SEQ ID NO: 1295310 - RNA, 18 nt, Mycobacterium tuberculosis H37Rv
ccaacacgucgagcagcc

SEQ ID NO: 1295311 - RNA, 17 nt, Mycobacterium tuberculosis H37Rv
ccaacacgucgagcagc

SEQ ID NO: 1295312 - RNA, 15 nt, Mycobacterium tuberculosis H37Rv
ccaacaccgccagca

SEQ ID NO: 1295313 - RNA, 16 nt, Mycobacterium tuberculosis H37Rv
ccaacaccagcgcguu

SEQ ID NO: 1295314 - RNA, 17 nt, Mycobacterium tuberculosis H37Rv
ccaacacagccgucgca

SEQ ID NO: 1295315 - RNA, 13 nt, Mycobacterium tuberculosis H37Rv
ccaacacagccgu

SEQ ID NO: 1295316 - RNA, 14 nt, Mycobacterium tuberculosis H37Rv
cauuucggaacgcc

SEQ ID NO: 1295317 - RNA, 12 nt, Mycobacterium tuberculosis H37Rv
ccaaaagcgcgg

SEQ ID NO: 1295318 - RNA, 13 nt, Mycobacterium tuberculosis H37Rv
ccaaaagcccggu

SEQ ID NO: 1295319 - RNA, 17 nt, Mycobacterium tuberculosis H37Rv
ccaaaaaguagcugcgg

SEQ ID NO: 1295320 - RNA, 17 nt, Mycobacterium tuberculosis H37Rv
ccaaaaacccggugacc

SEQ ID NO: 1295321 - RNA, 13 nt, Mycobacterium tuberculosis H37Rv
cauugaccaggug

SEQ ID NO: 1295322 - RNA, 16 nt, Mycobacterium tuberculosis H37Rv
cauugaguucggccac

SEQ ID NO: 1295323 - RNA, 21 nt, Mycobacterium tuberculosis H37Rv
cauuuccacauccaacgaccu

SEQ ID NO: 1295324 - RNA, 16 nt, Mycobacterium tuberculosis H37Rv
ccacccguucggcugc

SEQ ID NO: 1295325 - RNA, 23 nt, Mycobacterium tuberculosis H37Rv
ccaccgaaauacccagcgcagca

SEQ ID NO: 1295326 - RNA, 12 nt, Mycobacterium tuberculosis H37Rv
ccaccgacagca

SEQ ID NO: 1295327 - RNA, 23 nt, Mycobacterium tuberculosis H37Rv
ccaccgacagcacccggccaccg

SEQ ID NO: 1295328 - RNA, 15 nt, Mycobacterium tuberculosis H37Rv
ccaccgaccgcacga

SEQ ID NO: 1295329 - RNA, 20 nt, Mycobacterium tuberculosis H37Rv
ccaccgaccgcacgaucgca

SEQ ID NO: 1295330 - RNA, 20 nt, Mycobacterium tuberculosis H37Rv
ccaccgacgacaucgguggc

SEQ ID NO: 1295331 - RNA, 21 nt, Mycobacterium tuberculosis H37Rv
ccaccgagaucaugccggcga

SEQ ID NO: 1295332 - RNA, 13 nt, Mycobacterium tuberculosis H37Rv
ccaccgaucgacu

SEQ ID NO: 1295333 - RNA, 21 nt, Mycobacterium tuberculosis H37Rv
ccaccgauaccgucagcgccg

SEQ ID NO: 1295334 - RNA, 14 nt, Mycobacterium tuberculosis H37Rv
ccaccgcaaaggag

SEQ ID NO: 1295335 - RNA, 21 nt, Mycobacterium tuberculosis H37Rv
ccaccgaguagaacuucgcca

SEQ ID NO: 1295336 - RNA, 13 nt, Mycobacterium tuberculosis H37Rv
ccaccgagcgcaa

SEQ ID NO: 1295337 - RNA, 14 nt, Mycobacterium tuberculosis H37Rv
ccacccggugccgc

SEQ ID NO: 1295338 - RNA, 12 nt, Mycobacterium tuberculosis H37Rv
ccacccgguggc

SEQ ID NO: 1295339 - RNA, 19 nt, Mycobacterium tuberculosis H37Rv
ccacccgcgcgaugcuggc

SEQ ID NO: 1295340 - RNA, 18 nt, Mycobacterium tuberculosis H37Rv
ccacccagacaccggcua

SEQ ID NO: 1295341 - RNA, 13 nt, Mycobacterium tuberculosis H37Rv
ccacccagaugca

SEQ ID NO: 1295342 - RNA, 16 nt, Mycobacterium tuberculosis H37Rv
ccacccacgaucagca

SEQ ID NO: 1295343 - RNA, 12 nt, Mycobacterium tuberculosis H37Rv
ccacccacccgc

SEQ ID NO: 1295344 - RNA, 13 nt, Mycobacterium tuberculosis H37Rv
ccaccagcggcau

SEQ ID NO: 1295345 - RNA, 14 nt, Mycobacterium tuberculosis H37Rv
ccaccagcgcccgu

SEQ ID NO: 1295346 - RNA, 15 nt, Mycobacterium tuberculosis H37Rv
ccacccauauccgag

SEQ ID NO: 1295347 - RNA, 15 nt, Mycobacterium tuberculosis H37Rv
ccaccccgagcucac

SEQ ID NO: 1295348 - RNA, 22 nt, Mycobacterium tuberculosis H37Rv
ccaccccgucugcagggucgag

SEQ ID NO: 1295349 - RNA, 18 nt, Mycobacterium tuberculosis H37Rv
ccaccccguuggcggugg

SEQ ID NO: 1295350 - RNA, 17 nt, Mycobacterium tuberculosis H37Rv
ccacccgacaugcgccg

SEQ ID NO: 1295351 - RNA, 13 nt, Mycobacterium tuberculosis H37Rv
ccaccccggccaa

SEQ ID NO: 1295352 - RNA, 19 nt, Mycobacterium tuberculosis H37Rv
ccacccgauauucggccau

SEQ ID NO: 1295353 - RNA, 16 nt, Mycobacterium tuberculosis H37Rv
ccacccgcaccgcggu

SEQ ID NO: 1295354 - RNA, 12 nt, Mycobacterium tuberculosis H37Rv
ccaccgcugcga

SEQ ID NO: 1295355 - RNA, 15 nt, Mycobacterium tuberculosis H37Rv
ccaccgcugccggca

SEQ ID NO: 1295356 - RNA, 19 nt, Mycobacterium tuberculosis H37Rv
ccaccggaccgaccaccgc

SEQ ID NO: 1295357 - RNA, 18 nt, Mycobacterium tuberculosis H37Rv
ccaccgcgguggcggcga

SEQ ID NO: 1295358 - RNA, 17 nt, Mycobacterium tuberculosis H37Rv
ccaccgcguuggccaca

SEQ ID NO: 1295359 - RNA, 17 nt, Mycobacterium tuberculosis H37Rv
ccaccggcacccccguc

SEQ ID NO: 1295360 - RNA, 19 nt, Mycobacterium tuberculosis H37Rv
ccaccggcacccccgucgc

SEQ ID NO: 1295361 - RNA, 21 nt, Mycobacterium tuberculosis H37Rv
ccaccggaccgaccaccgcga

SEQ ID NO: 1295362 - RNA, 17 nt, Mycobacterium tuberculosis H37Rv
ccaccggcaacaucagc

SEQ ID NO: 1295363 - RNA, 17 nt, Mycobacterium tuberculosis H37Rv
ccaccgggccgacagca

SEQ ID NO: 1295364 - RNA, 19 nt, Mycobacterium tuberculosis H37Rv
ccaccggcgucgacgucgg

SEQ ID NO: 1295365 - RNA, 16 nt, Mycobacterium tuberculosis H37Rv
ccaccggcgcgaccgc

SEQ ID NO: 1295366 - RNA, 19 nt, Mycobacterium tuberculosis H37Rv
ccaccggcgccgccgucgc

SEQ ID NO: 1295367 - RNA, 12 nt, Mycobacterium tuberculosis H37Rv
ccaccggcccca

SEQ ID NO: 1295368 - RNA, 21 nt, Mycobacterium tuberculosis H37Rv
ccaccggccggcgcaguggug

SEQ ID NO: 1295369 - RNA, 16 nt, Mycobacterium tuberculosis H37Rv
ccaccggccgucccgc

SEQ ID NO: 1295370 - RNA, 13 nt, Mycobacterium tuberculosis H37Rv
ccaccggcaccgc

SEQ ID NO: 1295371 - RNA, 14 nt, Mycobacterium tuberculosis H37Rv
ccaccggcacggug

SEQ ID NO: 1295372 - RNA, 20 nt, Mycobacterium tuberculosis H37Rv
ccaccgcggccgcggucgau

SEQ ID NO: 1295373 - RNA, 12 nt, Mycobacterium tuberculosis H37Rv
ccaccgcggcga

SEQ ID NO: 1295374 - RNA, 16 nt, Mycobacterium tuberculosis H37Rv
ccaccgcgccgucguc

SEQ ID NO: 1295375 - RNA, 18 nt, Mycobacterium tuberculosis H37Rv
ccaccgcggcggcggcca

SEQ ID NO: 1295376 - RNA, 20 nt, Mycobacterium tuberculosis H37Rv
ccaccgcggcgucgccgugc

SEQ ID NO: 1295377 - RNA, 14 nt, Mycobacterium tuberculosis H37Rv
ccaccgcggucagc

SEQ ID NO: 1295378 - RNA, 13 nt, Mycobacterium tuberculosis H37Rv
ccaccgcgaugac

SEQ ID NO: 1295379 - RNA, 15 nt, Mycobacterium tuberculosis H37Rv
ccaccgcgccgagca

SEQ ID NO: 1295380 - RNA, 17 nt, Mycobacterium tuberculosis H37Rv
ccaccgcgccgagcaga

SEQ ID NO: 1295381 - RNA, 15 nt, Mycobacterium tuberculosis H37Rv
ccaccgccgccggag

SEQ ID NO: 1295382 - RNA, 15 nt, Mycobacterium tuberculosis H37Rv
ccaccgccgccggca

SEQ ID NO: 1295383 - RNA, 19 nt, Mycobacterium tuberculosis H37Rv
ccaccgccgccggcaccgc

SEQ ID NO: 1295384 - RNA, 12 nt, Mycobacterium tuberculosis H37Rv
ccaccgccggca

SEQ ID NO: 1295385 - RNA, 17 nt, Mycobacterium tuberculosis H37Rv
ccacagaccgaacagca

SEQ ID NO: 1295386 - RNA, 20 nt, Mycobacterium tuberculosis H37Rv
ccacagcauaaagaucagca

SEQ ID NO: 1295387 - RNA, 16 nt, Mycobacterium tuberculosis H37Rv
ccacaccagcgcagca

SEQ ID NO: 1295388 - RNA, 14 nt, Mycobacterium tuberculosis H37Rv
ccacaccaggccga

SEQ ID NO: 1295389 - RNA, 14 nt, Mycobacterium tuberculosis H37Rv
ccacagcgacagcg

SEQ ID NO: 1295390 - RNA, 22 nt, Mycobacterium tuberculosis H37Rv
ccacagcggcgauuggcuguga

SEQ ID NO: 1295391 - RNA, 19 nt, Mycobacterium tuberculosis H37Rv
ccacaggcugaagacgaau

SEQ ID NO: 1295392 - RNA, 13 nt, Mycobacterium tuberculosis H37Rv
ccacaggaagcga

SEQ ID NO: 1295393 - RNA, 16 nt, Mycobacterium tuberculosis H37Rv
ccacagguagaccguc

SEQ ID NO: 1295394 - RNA, 17 nt, Mycobacterium tuberculosis H37Rv
ccacagguuugcgccgc

SEQ ID NO: 1295395 - RNA, 22 nt, Mycobacterium tuberculosis H37Rv
ccacagugaaauccgagccgcg

SEQ ID NO: 1295396 - RNA, 18 nt, Mycobacterium tuberculosis H37Rv
ccaccacaccggagccga

SEQ ID NO: 1295397 - RNA, 14 nt, Mycobacterium tuberculosis H37Rv
ccaccacagacgac

SEQ ID NO: 1295398 - RNA, 15 nt, Mycobacterium tuberculosis H37Rv
ccaccacagacgacg

SEQ ID NO: 1295399 - RNA, 13 nt, Mycobacterium tuberculosis H37Rv
ccaccacgccguc

SEQ ID NO: 1295400 - RNA, 13 nt, Mycobacterium tuberculosis H37Rv
ccaccaccgguga

SEQ ID NO: 1295401 - RNA, 14 nt, Mycobacterium tuberculosis H37Rv
ccaccaccgucgag

SEQ ID NO: 1295402 - RNA, 18 nt, Mycobacterium tuberculosis H37Rv
ccaccacgacgucgguga

SEQ ID NO: 1295403 - RNA, 15 nt, Mycobacterium tuberculosis H37Rv
ccaccaccgacgagg

SEQ ID NO: 1295404 - RNA, 15 nt, Mycobacterium tuberculosis H37Rv
ccaagcucggcccag

SEQ ID NO: 1295405 - RNA, 14 nt, Mycobacterium tuberculosis H37Rv
ccaagcucgacaac

SEQ ID NO: 1295406 - RNA, 21 nt, Mycobacterium tuberculosis H37Rv
ccaaggcgacgaaucggcaac

SEQ ID NO: 1295407 - RNA, 17 nt, Mycobacterium tuberculosis H37Rv
ccaaggcucagcagcgc

SEQ ID NO: 1295408 - RNA, 16 nt, Mycobacterium tuberculosis H37Rv
ccaaggccgucgaccc

SEQ ID NO: 1295409 - RNA, 18 nt, Mycobacterium tuberculosis H37Rv
ccaaggccgucgacccag

SEQ ID NO: 1295410 - RNA, 16 nt, Mycobacterium tuberculosis H37Rv
ccaaccacgagcauca

SEQ ID NO: 1295411 - RNA, 17 nt, Mycobacterium tuberculosis H37Rv
ccaacaucccggaccga

SEQ ID NO: 1295412 - RNA, 16 nt, Mycobacterium tuberculosis H37Rv
ccaauauugcguucgg

SEQ ID NO: 1295413 - RNA, 18 nt, Mycobacterium tuberculosis H37Rv
ccaauauugcguucgggc

SEQ ID NO: 1295414 - RNA, 12 nt, Mycobacterium tuberculosis H37Rv
ccaaucgcacgc

SEQ ID NO: 1295415 - RNA, 21 nt, Mycobacterium tuberculosis H37Rv
ccaaggucuucaggccgcgca

SEQ ID NO: 1295416 - RNA, 19 nt, Mycobacterium tuberculosis H37Rv
ccaaggucuucaggccgcg

SEQ ID NO: 1295417 - RNA, 15 nt, Mycobacterium tuberculosis H37Rv
ccaagguccgcacga

SEQ ID NO: 1295418 - RNA, 13 nt, Mycobacterium tuberculosis H37Rv
ccaaggucgaccc

SEQ ID NO: 1295419 - RNA, 17 nt, Mycobacterium tuberculosis H37Rv
ccaaugcccuuggccag

SEQ ID NO: 1295420 - RNA, 13 nt, Mycobacterium tuberculosis H37Rv
ccaaugccuugag

SEQ ID NO: 1295421 - RNA, 20 nt, Mycobacterium tuberculosis H37Rv
ccaaucgccgucagcaccgc

SEQ ID NO: 1295422 - RNA, 19 nt, Mycobacterium tuberculosis H37Rv
ccaauuacagcuugcgcag

SEQ ID NO: 1295423 - RNA, 16 nt, Mycobacterium tuberculosis H37Rv
ccaauugcgccgagcu

SEQ ID NO: 1295424 - RNA, 13 nt, Mycobacterium tuberculosis H37Rv
ccaauuggcgucg

SEQ ID NO: 1295425 - RNA, 13 nt, Mycobacterium tuberculosis H37Rv
ccacaauccgcuc

SEQ ID NO: 1295426 - RNA, 21 nt, Mycobacterium tuberculosis H37Rv
ccacaaugcaaauagccuugu

SEQ ID NO: 1295427 - RNA, 13 nt, Mycobacterium tuberculosis H37Rv
ccacaaugcggcc

SEQ ID NO: 1295428 - RNA, 23 nt, Mycobacterium tuberculosis H37Rv
ccacaacgccucgauggcggugg

SEQ ID NO: 1295429 - RNA, 21 nt, Mycobacterium tuberculosis H37Rv
agcugaccgagcugauccggg

SEQ ID NO: 1295430 - RNA, 12 nt, Mycobacterium tuberculosis H37Rv
agcugaccgcca

SEQ ID NO: 1295431 - RNA, 14 nt, Mycobacterium tuberculosis H37Rv
agcugacacgacga

SEQ ID NO: 1295432 - RNA, 22 nt, Mycobacterium tuberculosis H37Rv
agcugaacuacugcgaucgcga

SEQ ID NO: 1295433 - RNA, 13 nt, Mycobacterium tuberculosis H37Rv
agcucuucggaca

SEQ ID NO: 1295434 - RNA, 16 nt, Mycobacterium tuberculosis H37Rv
agcugacgggccgcug

SEQ ID NO: 1295435 - RNA, 17 nt, Mycobacterium tuberculosis H37Rv
agcugauacgcaugcga

SEQ ID NO: 1295436 - RNA, 19 nt, Mycobacterium tuberculosis H37Rv
agcugauuaccgacaccgu

SEQ ID NO: 1295437 - RNA, 22 nt, Mycobacterium tuberculosis H37Rv
agcucggcuagguagucgacga

SEQ ID NO: 1295438 - RNA, 16 nt, Mycobacterium tuberculosis H37Rv
agcucguccggugcga

SEQ ID NO: 1295439 - RNA, 17 nt, Mycobacterium tuberculosis H37Rv
agcucggucagcgucag

SEQ ID NO: 1295440 - RNA, 13 nt, Mycobacterium tuberculosis H37Rv
agcucgcugcgcg

SEQ ID NO: 1295441 - RNA, 23 nt, Mycobacterium tuberculosis H37Rv
agcucgcgguuuuggucgcgaug

SEQ ID NO: 1295442 - RNA, 21 nt, Mycobacterium tuberculosis H37Rv
agcucgcggugggcuuccaac

SEQ ID NO: 1295443 - RNA, 20 nt, Mycobacterium tuberculosis H37Rv
agcucggcgcccagcucguc

SEQ ID NO: 1295444 - RNA, 16 nt, Mycobacterium tuberculosis H37Rv
agcucggggcgaugag

SEQ ID NO: 1295445 - RNA, 16 nt, Mycobacterium tuberculosis H37Rv
agcucggccaccagcg

SEQ ID NO: 1295446 - RNA, 13 nt, Mycobacterium tuberculosis H37Rv
agcucgccggcga

SEQ ID NO: 1295447 - RNA, 13 nt, Mycobacterium tuberculosis H37Rv
agcucgaugccgu

SEQ ID NO: 1295448 - RNA, 16 nt, Mycobacterium tuberculosis H37Rv
agcucgcacucguugc

SEQ ID NO: 1295449 - RNA, 22 nt, Mycobacterium tuberculosis H37Rv
agcucgacgaaugugagcgcgc

SEQ ID NO: 1295450 - RNA, 14 nt, Mycobacterium tuberculosis H37Rv
agcucgauccgcag

SEQ ID NO: 1295451 - RNA, 20 nt, Mycobacterium tuberculosis H37Rv
agcucgaacagcucgaucag

SEQ ID NO: 1295452 - RNA, 20 nt, Mycobacterium tuberculosis H37Rv
agcucgaccccggugcccau

SEQ ID NO: 1295453 - RNA, 12 nt, Mycobacterium tuberculosis H37Rv
agcucgaaguug

SEQ ID NO: 1295454 - RNA, 22 nt, Mycobacterium tuberculosis H37Rv
agcucaauggcuucgaagcgau

SEQ ID NO: 1295455 - RNA, 21 nt, Mycobacterium tuberculosis H37Rv
agcuaugucaccugggccagc

SEQ ID NO: 1295456 - RNA, 18 nt, Mycobacterium tuberculosis H37Rv
agcuagcccucagcuagc

SEQ ID NO: 1295457 - RNA, 13 nt, Mycobacterium tuberculosis H37Rv
agcguugaccgcg

SEQ ID NO: 1295458 - RNA, 24 nt, Mycobacterium tuberculosis H37Rv
agcuccccgccggaacugcgcaac

SEQ ID NO: 1295459 - RNA, 20 nt, Mycobacterium tuberculosis H37Rv
agcucccugggcgucgacca

SEQ ID NO: 1295460 - RNA, 17 nt, Mycobacterium tuberculosis H37Rv
agcucccugggcgucga

SEQ ID NO: 1295461 - RNA, 16 nt, Mycobacterium tuberculosis H37Rv
agcuccgccugccgcu

SEQ ID NO: 1295462 - RNA, 21 nt, Mycobacterium tuberculosis H37Rv
agcuccgggucgacgacgucg

SEQ ID NO: 1295463 - RNA, 15 nt, Mycobacterium tuberculosis H37Rv
agcuccuugagcaau

SEQ ID NO: 1295464 - RNA, 22 nt, Mycobacterium tuberculosis H37Rv
agcucaucgauccucgcccgca

SEQ ID NO: 1295465 - RNA, 13 nt, Mycobacterium tuberculosis H37Rv
agcucaucgccgc

SEQ ID NO: 1295466 - RNA, 19 nt, Mycobacterium tuberculosis H37Rv
agcuccaaccaugcgguua

SEQ ID NO: 1295467 - RNA, 19 nt, Mycobacterium tuberculosis H37Rv
agcggucggcgaccaccag

SEQ ID NO: 1295468 - RNA, 18 nt, Mycobacterium tuberculosis H37Rv
agcggucugugcugcgcu

SEQ ID NO: 1295469 - RNA, 17 nt, Mycobacterium tuberculosis H37Rv
agcggugaauucggcga

SEQ ID NO: 1295470 - RNA, 13 nt, Mycobacterium tuberculosis H37Rv
agcggugccguca

SEQ ID NO: 1295471 - RNA, 21 nt, Mycobacterium tuberculosis H37Rv
agcggguucgacguugaucgc

SEQ ID NO: 1295472 - RNA, 19 nt, Mycobacterium tuberculosis H37Rv
agcggucgcgcucgcgaaa

SEQ ID NO: 1295473 - RNA, 15 nt, Mycobacterium tuberculosis H37Rv
agcggguugcgguca

SEQ ID NO: 1295474 - RNA, 23 nt, Mycobacterium tuberculosis H37Rv
agcgggugcgggcgugguaacca

SEQ ID NO: 1295475 - RNA, 17 nt, Mycobacterium tuberculosis H37Rv
agcggguggccaucacc

SEQ ID NO: 1295476 - RNA, 22 nt, Mycobacterium tuberculosis H37Rv
agcggguggccaucaccgcgcu

SEQ ID NO: 1295477 - RNA, 13 nt, Mycobacterium tuberculosis H37Rv
agcgucgaucacg

SEQ ID NO: 1295478 - RNA, 20 nt, Mycobacterium tuberculosis H37Rv
agcgguuagaucacccgcag

SEQ ID NO: 1295479 - RNA, 19 nt, Mycobacterium tuberculosis H37Rv
agcguccgggucgacgcga

SEQ ID NO: 1295480 - RNA, 20 nt, Mycobacterium tuberculosis H37Rv
agcguguggagcucgcggcg

SEQ ID NO: 1295481 - RNA, 15 nt, Mycobacterium tuberculosis H37Rv
agcguggugaagucg

SEQ ID NO: 1295482 - RNA, 14 nt, Mycobacterium tuberculosis H37Rv
agcguucaaggucu

SEQ ID NO: 1295483 - RNA, 14 nt, Mycobacterium tuberculosis H37Rv
agcgugcagcggcg

SEQ ID NO: 1295484 - RNA, 15 nt, Mycobacterium tuberculosis H37Rv
agcgugcauggcggu

SEQ ID NO: 1295485 - RNA, 17 nt, Mycobacterium tuberculosis H37Rv
agcgugcccgccaccgg

SEQ ID NO: 1295486 - RNA, 13 nt, Mycobacterium tuberculosis H37Rv
agcgugcccgcca

SEQ ID NO: 1295487 - RNA, 14 nt, Mycobacterium tuberculosis H37Rv
agcgugaucugcag

SEQ ID NO: 1295488 - RNA, 18 nt, Mycobacterium tuberculosis H37Rv
agcgugacccgccggcga

SEQ ID NO: 1295489 - RNA, 19 nt, Mycobacterium tuberculosis H37Rv
agcgugaccaccgccgaca

SEQ ID NO: 1295490 - RNA, 18 nt, Mycobacterium tuberculosis H37Rv
agcgugagccaugccgcu

SEQ ID NO: 1295491 - RNA, 22 nt, Mycobacterium tuberculosis H37Rv
agcgugccugcaguucggcgua

SEQ ID NO: 1295492 - RNA, 22 nt, Mycobacterium tuberculosis H37Rv
agcgugccgcagcggcggcaac

SEQ ID NO: 1295493 - RNA, 23 nt, Mycobacterium tuberculosis H37Rv
agcgugccgaacagggaggucgc

SEQ ID NO: 1295494 - RNA, 15 nt, Mycobacterium tuberculosis H37Rv
agcgggcaagucgcc

SEQ ID NO: 1295495 - RNA, 18 nt, Mycobacterium tuberculosis H37Rv
agcgggcaagaugaucgc

SEQ ID NO: 1295496 - RNA, 13 nt, Mycobacterium tuberculosis H37Rv
agcgggccagcac

SEQ ID NO: 1295497 - RNA, 14 nt, Mycobacterium tuberculosis H37Rv
agcgggauugccga

SEQ ID NO: 1295498 - RNA, 22 nt, Mycobacterium tuberculosis H37Rv
agcggcuugguguauucgcgga

SEQ ID NO: 1295499 - RNA, 22 nt, Mycobacterium tuberculosis H37Rv
agcgggaucugacccagcagcg

SEQ ID NO: 1295500 - RNA, 13 nt, Mycobacterium tuberculosis H37Rv
agcgggcccgcag

SEQ ID NO: 1295501 - RNA, 18 nt, Mycobacterium tuberculosis H37Rv
agcggguccccggucagg

SEQ ID NO: 1295502 - RNA, 13 nt, Mycobacterium tuberculosis H37Rv
agcggguccguca

SEQ ID NO: 1295503 - RNA, 21 nt, Mycobacterium tuberculosis H37Rv
agcgggucgcgggugccgaag

SEQ ID NO: 1295504 - RNA, 20 nt, Mycobacterium tuberculosis H37Rv
agcgggugaaucgacaccgc

SEQ ID NO: 1295505 - RNA, 21 nt, Mycobacterium tuberculosis H37Rv
agcgggaaggguggaccgggg

SEQ ID NO: 1295506 - RNA, 23 nt, Mycobacterium tuberculosis H37Rv
agcggcugguugcgccacugcgu

SEQ ID NO: 1295507 - RNA, 17 nt, Mycobacterium tuberculosis H37Rv
agcggcguucgaugcca

SEQ ID NO: 1295508 - RNA, 14 nt, Mycobacterium tuberculosis H37Rv
agcggcucaccgcg

SEQ ID NO: 1295509 - RNA, 21 nt, Mycobacterium tuberculosis H37Rv
agcggcugcccgagaucgcgu

SEQ ID NO: 1295510 - RNA, 23 nt, Mycobacterium tuberculosis H37Rv
agcggcguuccgggccgaucacc

SEQ ID NO: 1295511 - RNA, 22 nt, Mycobacterium tuberculosis H37Rv
agcggcgugacgucgucggugc

SEQ ID NO: 1295512 - RNA, 20 nt, Mycobacterium tuberculosis H37Rv
agcggcgcgaggaacgccgg

SEQ ID NO: 1295513 - RNA, 13 nt, Mycobacterium tuberculosis H37Rv
agcggcgcgagca

SEQ ID NO: 1295514 - RNA, 17 nt, Mycobacterium tuberculosis H37Rv
agcggcgucgucgucga

SEQ ID NO: 1295515 - RNA, 22 nt, Mycobacterium tuberculosis H37Rv
agcggcgccgccuggacgccgc

SEQ ID NO: 1295516 - RNA, 18 nt, Mycobacterium tuberculosis H37Rv
agcggcgcccgccaccgg

SEQ ID NO: 1295517 - RNA, 19 nt, Mycobacterium tuberculosis H37Rv
agcggcgcagcgugagugc

SEQ ID NO: 1295518 - RNA, 16 nt, Mycobacterium tuberculosis H37Rv
agcggcgagccaaacu

SEQ ID NO: 1295519 - RNA, 16 nt, Mycobacterium tuberculosis H37Rv
agcggcaauggccagc

SEQ ID NO: 1295520 - RNA, 17 nt, Mycobacterium tuberculosis H37Rv
agcggauucagcgucgc

SEQ ID NO: 1295521 - RNA, 12 nt, Mycobacterium tuberculosis H37Rv
agcggcgaucag

SEQ ID NO: 1295522 - RNA, 19 nt, Mycobacterium tuberculosis H37Rv
agcggcaacgccuccggag

SEQ ID NO: 1295523 - RNA, 16 nt, Mycobacterium tuberculosis H37Rv
agcggauucacgcacc

SEQ ID NO: 1295524 - RNA, 22 nt, Mycobacterium tuberculosis H37Rv
agcggaucaggucuggcgcgga

SEQ ID NO: 1295525 - RNA, 17 nt, Mycobacterium tuberculosis H37Rv
agcggaagcgguugacc

SEQ ID NO: 1295526 - RNA, 17 nt, Mycobacterium tuberculosis H37Rv
agcggaucgcggucagc

SEQ ID NO: 1295527 - RNA, 17 nt, Mycobacterium tuberculosis H37Rv
agcgcucagcugagaug

SEQ ID NO: 1295528 - RNA, 13 nt, Mycobacterium tuberculosis H37Rv
agcgcgucgccgu

SEQ ID NO: 1295529 - RNA, 18 nt, Mycobacterium tuberculosis H37Rv
agcgcgucgccgucgaug

SEQ ID NO: 1295530 - RNA, 20 nt, Mycobacterium tuberculosis H37Rv
agcggaaccgagggccguca

SEQ ID NO: 1295531 - RNA, 21 nt, Mycobacterium tuberculosis H37Rv
agcgcuucgucggccggcacc

SEQ ID NO: 1295532 - RNA, 18 nt, Mycobacterium tuberculosis H37Rv
agcgcuucggcggucgcc

SEQ ID NO: 1295533 - RNA, 19 nt, Mycobacterium tuberculosis H37Rv
agcgcuugaccccgccgaa

SEQ ID NO: 1295534 - RNA, 21 nt, Mycobacterium tuberculosis H37Rv
agcgcucguagaaucggcuca

SEQ ID NO: 1295535 - RNA, 20 nt, Mycobacterium tuberculosis H37Rv
agcgcucguagaaucggcuc

SEQ ID NO: 1295536 - RNA, 13 nt, Mycobacterium tuberculosis H37Rv
agcgcucguuccg

SEQ ID NO: 1295537 - RNA, 14 nt, Mycobacterium tuberculosis H37Rv
agcgcgcgccgcag

SEQ ID NO: 1295538 - RNA, 13 nt, Mycobacterium tuberculosis H37Rv
agcgcgcaacgua

SEQ ID NO: 1295539 - RNA, 21 nt, Mycobacterium tuberculosis H37Rv
agcgcgcaacguacgcacgca

SEQ ID NO: 1295540 - RNA, 14 nt, Mycobacterium tuberculosis H37Rv
agcgcgccggcguc

SEQ ID NO: 1295541 - RNA, 20 nt, Mycobacterium tuberculosis H37Rv
agcgcgcagcaguuggucgc

SEQ ID NO: 1295542 - RNA, 14 nt, Mycobacterium tuberculosis H37Rv
agcgcgaucgcggu

SEQ ID NO: 1295543 - RNA, 17 nt, Mycobacterium tuberculosis H37Rv
agcgcgaucgcggucaa

SEQ ID NO: 1295544 - RNA, 22 nt, Mycobacterium tuberculosis H37Rv
agcgcgguggucgcgaccgacc

SEQ ID NO: 1295545 - RNA, 22 nt, Mycobacterium tuberculosis H37Rv
agcgcggcgcgcggggccucgc

SEQ ID NO: 1295546 - RNA, 19 nt, Mycobacterium tuberculosis H37Rv
agcgcggcgagggcgguca

SEQ ID NO: 1295547 - RNA, 16 nt, Mycobacterium tuberculosis H37Rv
agcgcggcgaagccgg

SEQ ID NO: 1295548 - RNA, 14 nt, Mycobacterium tuberculosis H37Rv
agcgccucggcauc

SEQ ID NO: 1295549 - RNA, 18 nt, Mycobacterium tuberculosis H37Rv
agcgccucgccggccacc

SEQ ID NO: 1295550 - RNA, 14 nt, Mycobacterium tuberculosis H37Rv
agcgcgagcagacg

SEQ ID NO: 1295551 - RNA, 12 nt, Mycobacterium tuberculosis H37Rv
agcgccucgaug

SEQ ID NO: 1295552 - RNA, 23 nt, Mycobacterium tuberculosis H37Rv
agcgccggauggguggccagcaa

SEQ ID NO: 1295553 - RNA, 17 nt, Mycobacterium tuberculosis H37Rv
agcgccggccaggcuau

SEQ ID NO: 1295554 - RNA, 14 nt, Mycobacterium tuberculosis H37Rv
agcgccggcaucgc

SEQ ID NO: 1295555 - RNA, 19 nt, Mycobacterium tuberculosis H37Rv
agcgccgcuuggcgauccg

SEQ ID NO: 1295556 - RNA, 16 nt, Mycobacterium tuberculosis H37Rv
agcgccgcuuggcgau

SEQ ID NO: 1295557 - RNA, 16 nt, Mycobacterium tuberculosis H37Rv
agcgcccggcugaucu

SEQ ID NO: 1295558 - RNA, 14 nt, Mycobacterium tuberculosis H37Rv
agcgccaacccggc

SEQ ID NO: 1295559 - RNA, 19 nt, Mycobacterium tuberculosis H37Rv
agcgccaagccgugccgca

SEQ ID NO: 1295560 - RNA, 21 nt, Mycobacterium tuberculosis H37Rv
agcgccaagccgugccgcaca

SEQ ID NO: 1295561 - RNA, 15 nt, Mycobacterium tuberculosis H37Rv
agcgccaccgaccga

SEQ ID NO: 1295562 - RNA, 19 nt, Mycobacterium tuberculosis H37Rv
agcgcccgcgcggccacuu

SEQ ID NO: 1295563 - RNA, 16 nt, Mycobacterium tuberculosis H37Rv
agcgcccgaaccccgg

SEQ ID NO: 1295564 - RNA, 14 nt, Mycobacterium tuberculosis H37Rv
agcgcccccagcag

SEQ ID NO: 1295565 - RNA, 22 nt, Mycobacterium tuberculosis H37Rv
agcgccagcgagcauaccgccg

SEQ ID NO: 1295566 - RNA, 17 nt, Mycobacterium tuberculosis H37Rv
agcgcccagaucgccga

SEQ ID NO: 1295567 - RNA, 13 nt, Mycobacterium tuberculosis H37Rv
agcgccagccggu

SEQ ID NO: 1295568 - RNA, 23 nt, Mycobacterium tuberculosis H37Rv
agccgugauauccguacagucca

SEQ ID NO: 1295569 - RNA, 14 nt, Mycobacterium tuberculosis H37Rv
agccgugcggucgc

SEQ ID NO: 1295570 - RNA, 16 nt, Mycobacterium tuberculosis H37Rv
agccguguucgaccgc

SEQ ID NO: 1295571 - RNA, 16 nt, Mycobacterium tuberculosis H37Rv
agccgugcaccucgug

SEQ ID NO: 1295572 - RNA, 20 nt, Mycobacterium tuberculosis H37Rv
agccgugauauccguacagu

SEQ ID NO: 1295573 - RNA, 18 nt, Mycobacterium tuberculosis H37Rv
agccgucgcgacgucggc

SEQ ID NO: 1295574 - RNA, 16 nt, Mycobacterium tuberculosis H37Rv
agccgucgcgacgucg

SEQ ID NO: 1295575 - RNA, 23 nt, Mycobacterium tuberculosis H37Rv
agccgucguccgcugacccgcca

SEQ ID NO: 1295576 - RNA, 12 nt, Mycobacterium tuberculosis H37Rv
agccgcgccagc

SEQ ID NO: 1295577 - RNA, 14 nt, Mycobacterium tuberculosis H37Rv
agccgucgaucccg

SEQ ID NO: 1295578 - RNA, 14 nt, Mycobacterium tuberculosis H37Rv
agccgcgagccggu

SEQ ID NO: 1295579 - RNA, 20 nt, Mycobacterium tuberculosis H37Rv
agccgcgaguccaggcugau

SEQ ID NO: 1295580 - RNA, 22 nt, Mycobacterium tuberculosis H37Rv
agccgcgaguccaggcugaucc

SEQ ID NO: 1295581 - RNA, 15 nt, Mycobacterium tuberculosis H37Rv
agccguucccgguga

SEQ ID NO: 1295582 - RNA, 12 nt, Mycobacterium tuberculosis H37Rv
agccguucgucg

SEQ ID NO: 1295583 - RNA, 17 nt, Mycobacterium tuberculosis H37Rv
agccgugggccacgaug

SEQ ID NO: 1295584 - RNA, 19 nt, Mycobacterium tuberculosis H37Rv
agccuaaaaccccgagccg

SEQ ID NO: 1295585 - RNA, 21 nt, Mycobacterium tuberculosis H37Rv
agccuaccggcuacggcgaca

SEQ ID NO: 1295586 - RNA, 16 nt, Mycobacterium tuberculosis H37Rv
agccuuggacgugcgc

SEQ ID NO: 1295587 - RNA, 12 nt, Mycobacterium tuberculosis H37Rv
agcgagcgcaca

SEQ ID NO: 1295588 - RNA, 17 nt, Mycobacterium tuberculosis H37Rv
agcgaggacaagcccgc

SEQ ID NO: 1295589 - RNA, 20 nt, Mycobacterium tuberculosis H37Rv
agcgagcccagcugcgccga

SEQ ID NO: 1295590 - RNA, 16 nt, Mycobacterium tuberculosis H37Rv
agcgacaugcccgcca

SEQ ID NO: 1295591 - RNA, 23 nt, Mycobacterium tuberculosis H37Rv
agcgaucggggcggugacuccgc

SEQ ID NO: 1295592 - RNA, 14 nt, Mycobacterium tuberculosis H37Rv
agcgcaaucgacca

SEQ ID NO: 1295593 - RNA, 20 nt, Mycobacterium tuberculosis H37Rv
agcgcaaugcgcgacgguca

SEQ ID NO: 1295594 - RNA, 12 nt, Mycobacterium tuberculosis H37Rv
agcgaucgccgg

SEQ ID NO: 1295595 - RNA, 21 nt, Mycobacterium tuberculosis H37Rv
agcgaggugauggucgucauc

SEQ ID NO: 1295596 - RNA, 17 nt, Mycobacterium tuberculosis H37Rv
agcgaggugggcgucau

SEQ ID NO: 1295597 - RNA, 13 nt, Mycobacterium tuberculosis H37Rv
agcgcaccgguga

SEQ ID NO: 1295598 - RNA, 20 nt, Mycobacterium tuberculosis H37Rv
agcgcaccacggcggucaac

SEQ ID NO: 1295599 - RNA, 20 nt, Mycobacterium tuberculosis H37Rv
agcgcacggaccaucgccag

SEQ ID NO: 1295600 - RNA, 13 nt, Mycobacterium tuberculosis H37Rv
agcgcacugggga

SEQ ID NO: 1295601 - RNA, 21 nt, Mycobacterium tuberculosis H37Rv
agcgcacuggggaggccaacc

SEQ ID NO: 1295602 - RNA, 15 nt, Mycobacterium tuberculosis H37Rv
agcgcagcagcggca

SEQ ID NO: 1295603 - RNA, 13 nt, Mycobacterium tuberculosis H37Rv
agcgcaucggcca

SEQ ID NO: 1295604 - RNA, 23 nt, Mycobacterium tuberculosis H37Rv
agcgcaucgccgcuggccagcac

SEQ ID NO: 1295605 - RNA, 14 nt, Mycobacterium tuberculosis H37Rv
agcgcaucgccaau

SEQ ID NO: 1295606 - RNA, 15 nt, Mycobacterium tuberculosis H37Rv
agcgcaucgcacagc

SEQ ID NO: 1295607 - RNA, 19 nt, Mycobacterium tuberculosis H37Rv
agcgcaucagggugggcga

SEQ ID NO: 1295608 - RNA, 16 nt, Mycobacterium tuberculosis H37Rv
agcgcagcgccggcag

SEQ ID NO: 1295609 - RNA, 21 nt, Mycobacterium tuberculosis H37Rv
agcgcagcgccggcagcagca

SEQ ID NO: 1295610 - RNA, 12 nt, Mycobacterium tuberculosis H37Rv
agcgcagcgugu

SEQ ID NO: 1295611 - RNA, 17 nt, Mycobacterium tuberculosis H37Rv
agcccgcugcgccgggu

SEQ ID NO: 1295612 - RNA, 17 nt, Mycobacterium tuberculosis H37Rv
agcccggagcggucagc

SEQ ID NO: 1295613 - RNA, 21 nt, Mycobacterium tuberculosis H37Rv
agcccguuguccagaacggcg

SEQ ID NO: 1295614 - RNA, 22 nt, Mycobacterium tuberculosis H37Rv
agcccguugguagccggugacc

SEQ ID NO: 1295615 - RNA, 15 nt, Mycobacterium tuberculosis H37Rv
agcccuccucgauga

SEQ ID NO: 1295616 - RNA, 19 nt, Mycobacterium tuberculosis H37Rv
agccgaccaggaccaccgc

SEQ ID NO: 1295617 - RNA, 18 nt, Mycobacterium tuberculosis H37Rv
agccgaccaggaccaccg

SEQ ID NO: 1295618 - RNA, 19 nt, Mycobacterium tuberculosis H37Rv
agcccuucagcgaagccgg

SEQ ID NO: 1295619 - RNA, 21 nt, Mycobacterium tuberculosis H37Rv
agccgacaacgacgucgccga

SEQ ID NO: 1295620 - RNA, 16 nt, Mycobacterium tuberculosis H37Rv
agccgaucaucaccgg

SEQ ID NO: 1295621 - RNA, 17 nt, Mycobacterium tuberculosis H37Rv
agccgcgaccagaggcg

SEQ ID NO: 1295622 - RNA, 15 nt, Mycobacterium tuberculosis H37Rv
agccgccgccggcaa

SEQ ID NO: 1295623 - RNA, 13 nt, Mycobacterium tuberculosis H37Rv
agccgccucaaug

SEQ ID NO: 1295624 - RNA, 15 nt, Mycobacterium tuberculosis H37Rv
agccgcccgcccgga

SEQ ID NO: 1295625 - RNA, 16 nt, Mycobacterium tuberculosis H37Rv
agccgcccgcccggac

SEQ ID NO: 1295626 - RNA, 19 nt, Mycobacterium tuberculosis H37Rv
agccgccgacuuccgcguc

SEQ ID NO: 1295627 - RNA, 23 nt, Mycobacterium tuberculosis H37Rv
agccgcccgcccaccucgaucgc

SEQ ID NO: 1295628 - RNA, 22 nt, Mycobacterium tuberculosis H37Rv
agccgaggacuggaaagcagca

SEQ ID NO: 1295629 - RNA, 20 nt, Mycobacterium tuberculosis H37Rv
agccgagguucaaagcagcg

SEQ ID NO: 1295630 - RNA, 21 nt, Mycobacterium tuberculosis H37Rv
agccgaccaugguagcgcccc

SEQ ID NO: 1295631 - RNA, 12 nt, Mycobacterium tuberculosis H37Rv
agccgaccgcgg

SEQ ID NO: 1295632 - RNA, 12 nt, Mycobacterium tuberculosis H37Rv
agccgagcucgu

SEQ ID NO: 1295633 - RNA, 17 nt, Mycobacterium tuberculosis H37Rv
agccgagcuccuccacc

SEQ ID NO: 1295634 - RNA, 18 nt, Mycobacterium tuberculosis H37Rv
agccgacgauccacggcg

SEQ ID NO: 1295635 - RNA, 20 nt, Mycobacterium tuberculosis H37Rv
agccgaccucgagugcgaac

SEQ ID NO: 1295636 - RNA, 18 nt, Mycobacterium tuberculosis H37Rv
agcccccgacacgccgug

SEQ ID NO: 1295637 - RNA, 17 nt, Mycobacterium tuberculosis H37Rv
agccccgcggccagcag

SEQ ID NO: 1295638 - RNA, 16 nt, Mycobacterium tuberculosis H37Rv
agcccgacagcagguu

SEQ ID NO: 1295639 - RNA, 14 nt, Mycobacterium tuberculosis H37Rv
agccccgucgaccu

SEQ ID NO: 1295640 - RNA, 18 nt, Mycobacterium tuberculosis H37Rv
agcccgauucagcgcccc

SEQ ID NO: 1295641 - RNA, 21 nt, Mycobacterium tuberculosis H37Rv
agcccgauggugccgacccgc

SEQ ID NO: 1295642 - RNA, 17 nt, Mycobacterium tuberculosis H37Rv
agcccaucuaccagcuc

SEQ ID NO: 1295643 - RNA, 16 nt, Mycobacterium tuberculosis H37Rv
agccccagcgacgucg

SEQ ID NO: 1295644 - RNA, 18 nt, Mycobacterium tuberculosis H37Rv
agcccaaagcgccagcag

SEQ ID NO: 1295645 - RNA, 14 nt, Mycobacterium tuberculosis H37Rv
agcccacgaucgcg

SEQ ID NO: 1295646 - RNA, 20 nt, Mycobacterium tuberculosis H37Rv
agcagguuggucaccaccug

SEQ ID NO: 1295647 - RNA, 13 nt, Mycobacterium tuberculosis H37Rv
agcaucagcgcca

SEQ ID NO: 1295648 - RNA, 19 nt, Mycobacterium tuberculosis H37Rv
agcauccccgcagcgucca

SEQ ID NO: 1295649 - RNA, 16 nt, Mycobacterium tuberculosis H37Rv
agcauccggccgucau

SEQ ID NO: 1295650 - RNA, 17 nt, Mycobacterium tuberculosis H37Rv
agcauccgacacugcgg

SEQ ID NO: 1295651 - RNA, 23 nt, Mycobacterium tuberculosis H37Rv
agcaugcccucgcuguuggccgg

SEQ ID NO: 1295652 - RNA, 16 nt, Mycobacterium tuberculosis H37Rv
agcagcagugccaccg

SEQ ID NO: 1295653 - RNA, 14 nt, Mycobacterium tuberculosis H37Rv
agcagcaugucgua

SEQ ID NO: 1295654 - RNA, 21 nt, Mycobacterium tuberculosis H37Rv
agcagccagcccagccgccag

SEQ ID NO: 1295655 - RNA, 15 nt, Mycobacterium tuberculosis H37Rv
agcagccagccaccg

SEQ ID NO: 1295656 - RNA, 20 nt, Mycobacterium tuberculosis H37Rv
agcagccagccaccgaucga

SEQ ID NO: 1295657 - RNA, 15 nt, Mycobacterium tuberculosis H37Rv
agcagccagcgucca

SEQ ID NO: 1295658 - RNA, 23 nt, Mycobacterium tuberculosis H37Rv
agcagguuccacggccaggucga

SEQ ID NO: 1295659 - RNA, 20 nt, Mycobacterium tuberculosis H37Rv
agcagguuccgcacgaucag

SEQ ID NO: 1295660 - RNA, 16 nt, Mycobacterium tuberculosis H37Rv
agcagggcggcgaacu

SEQ ID NO: 1295661 - RNA, 20 nt, Mycobacterium tuberculosis H37Rv
agccaggauugccgccguug

SEQ ID NO: 1295662 - RNA, 18 nt, Mycobacterium tuberculosis H37Rv
agccagcuugcgcaacgu

SEQ ID NO: 1295663 - RNA, 13 nt, Mycobacterium tuberculosis H37Rv
agccaggccgcaa

SEQ ID NO: 1295664 - RNA, 14 nt, Mycobacterium tuberculosis H37Rv
agccagcggcgaag

SEQ ID NO: 1295665 - RNA, 13 nt, Mycobacterium tuberculosis H37Rv
agccagcgcagcc

SEQ ID NO: 1295666 - RNA, 14 nt, Mycobacterium tuberculosis H37Rv
agccagggucccgc

SEQ ID NO: 1295667 - RNA, 20 nt, Mycobacterium tuberculosis H37Rv
agccaguguugcaguggcga

SEQ ID NO: 1295668 - RNA, 13 nt, Mycobacterium tuberculosis H37Rv
agccaugcucguc

SEQ ID NO: 1295669 - RNA, 18 nt, Mycobacterium tuberculosis H37Rv
agccaugcugcucgagga

SEQ ID NO: 1295670 - RNA, 22 nt, Mycobacterium tuberculosis H37Rv
agccaucucuugcaaccuggac

SEQ ID NO: 1295671 - RNA, 22 nt, Mycobacterium tuberculosis H37Rv
agccacucaucuucucgcagcc

SEQ ID NO: 1295672 - RNA, 17 nt, Mycobacterium tuberculosis H37Rv
agccagcaagcgguagc

SEQ ID NO: 1295673 - RNA, 16 nt, Mycobacterium tuberculosis H37Rv
agccagcaucggcagc

SEQ ID NO: 1295674 - RNA, 13 nt, Mycobacterium tuberculosis H37Rv
agccagcagcaca

SEQ ID NO: 1295675 - RNA, 20 nt, Mycobacterium tuberculosis H37Rv
agccagcacugccaucgcgg

SEQ ID NO: 1295676 - RNA, 21 nt, Mycobacterium tuberculosis H37Rv
agccacgcaaaguucgucacc

SEQ ID NO: 1295677 - RNA, 16 nt, Mycobacterium tuberculosis H37Rv
agccacgcugucccgc

SEQ ID NO: 1295678 - RNA, 22 nt, Mycobacterium tuberculosis H37Rv
agccaaugcccuuggccagcag

SEQ ID NO: 1295679 - RNA, 20 nt, Mycobacterium tuberculosis H37Rv
agccaaugcccuuggccagc

SEQ ID NO: 1295680 - RNA, 15 nt, Mycobacterium tuberculosis H37Rv
agccaacgagcgcgc

SEQ ID NO: 1295681 - RNA, 19 nt, Mycobacterium tuberculosis H37Rv
agccaaccugaagccagcg

SEQ ID NO: 1295682 - RNA, 20 nt, Mycobacterium tuberculosis H37Rv
agccaaccguguaggccaug

SEQ ID NO: 1295683 - RNA, 13 nt, Mycobacterium tuberculosis H37Rv
agagacuugccga

SEQ ID NO: 1295684 - RNA, 21 nt, Mycobacterium tuberculosis H37Rv
agagacgucaaacgggagcga

SEQ ID NO: 1295685 - RNA, 12 nt, Mycobacterium tuberculosis H37Rv
agacuagcugcu

SEQ ID NO: 1295686 - RNA, 21 nt, Mycobacterium tuberculosis H37Rv
agacguuucccaggcccgaca

SEQ ID NO: 1295687 - RNA, 16 nt, Mycobacterium tuberculosis H37Rv
agaaacgucugccacg

SEQ ID NO: 1295688 - RNA, 13 nt, Mycobacterium tuberculosis H37Rv
agacgucgaccgu

SEQ ID NO: 1295689 - RNA, 21 nt, Mycobacterium tuberculosis H37Rv
agacgucgaacuucagcggcg

SEQ ID NO: 1295690 - RNA, 12 nt, Mycobacterium tuberculosis H37Rv
agagcaggccca

SEQ ID NO: 1295691 - RNA, 16 nt, Mycobacterium tuberculosis H37Rv
agagcguuccgcucga

SEQ ID NO: 1295692 - RNA, 14 nt, Mycobacterium tuberculosis H37Rv
agagcucgccggug

SEQ ID NO: 1295693 - RNA, 13 nt, Mycobacterium tuberculosis H37Rv
agagcuccgucgc

SEQ ID NO: 1295694 - RNA, 12 nt, Mycobacterium tuberculosis H37Rv
agaggcccgaaa

SEQ ID NO: 1295695 - RNA, 20 nt, Mycobacterium tuberculosis H37Rv
agaucucuucggagccgaug

SEQ ID NO: 1295696 - RNA, 13 nt, Mycobacterium tuberculosis H37Rv
agaugcagcgguc

SEQ ID NO: 1295697 - RNA, 16 nt, Mycobacterium tuberculosis H37Rv
agaugcacaggccgac

SEQ ID NO: 1295698 - RNA, 18 nt, Mycobacterium tuberculosis H37Rv
agaugcauccagcugcug

SEQ ID NO: 1295699 - RNA, 15 nt, Mycobacterium tuberculosis H37Rv
agaugauuucgccga

SEQ ID NO: 1295700 - RNA, 20 nt, Mycobacterium tuberculosis H37Rv
agaugaucgcgaacaucgcc

SEQ ID NO: 1295701 - RNA, 20 nt, Mycobacterium tuberculosis H37Rv
agaugccugcuagcagcagc

SEQ ID NO: 1295702 - RNA, 21 nt, Mycobacterium tuberculosis H37Rv
agauguaccucaucgcagacg

SEQ ID NO: 1295703 - RNA, 12 nt, Mycobacterium tuberculosis H37Rv
agaucgcccgag

SEQ ID NO: 1295704 - RNA, 20 nt, Mycobacterium tuberculosis H37Rv
agaucggcagcguggacauc

SEQ ID NO: 1295705 - RNA, 22 nt, Mycobacterium tuberculosis H37Rv
agaucguugaugacguugcagc

SEQ ID NO: 1295706 - RNA, 16 nt, Mycobacterium tuberculosis H37Rv
agauauggaccgccgc

SEQ ID NO: 1295707 - RNA, 22 nt, Mycobacterium tuberculosis H37Rv
agaucagcaacggcagcgaggc

SEQ ID NO: 1295708 - RNA, 19 nt, Mycobacterium tuberculosis H37Rv
agaucagcagcggcgaccg

SEQ ID NO: 1295709 - RNA, 23 nt, Mycobacterium tuberculosis H37Rv
agaucagcaugccuucggccaac

SEQ ID NO: 1295710 - RNA, 16 nt, Mycobacterium tuberculosis H37Rv
agcagcacgucgaacu

SEQ ID NO: 1295711 - RNA, 16 nt, Mycobacterium tuberculosis H37Rv
agcagcagagccaacg

SEQ ID NO: 1295712 - RNA, 13 nt, Mycobacterium tuberculosis H37Rv
agcagcagcggcg

SEQ ID NO: 1295713 - RNA, 18 nt, Mycobacterium tuberculosis H37Rv
agcagacgcggaaucgca

SEQ ID NO: 1295714 - RNA, 23 nt, Mycobacterium tuberculosis H37Rv
agcagacgcagagucgcacugcg

SEQ ID NO: 1295715 - RNA, 13 nt, Mycobacterium tuberculosis H37Rv
agcagacgccgua

SEQ ID NO: 1295716 - RNA, 21 nt, Mycobacterium tuberculosis H37Rv
agcagagccccggcaagcgca

SEQ ID NO: 1295717 - RNA, 12 nt, Mycobacterium tuberculosis H37Rv
agcacuccaccg

SEQ ID NO: 1295718 - RNA, 16 nt, Mycobacterium tuberculosis H37Rv
agcacguugcacagcu

SEQ ID NO: 1295719 - RNA, 15 nt, Mycobacterium tuberculosis H37Rv
agcacguugacgucc

SEQ ID NO: 1295720 - RNA, 14 nt, Mycobacterium tuberculosis H37Rv
agcacguugcacag

SEQ ID NO: 1295721 - RNA, 17 nt, Mycobacterium tuberculosis H37Rv
agcacguggaccggcac

SEQ ID NO: 1295722 - RNA, 19 nt, Mycobacterium tuberculosis H37Rv
agcagacgcagaaucgccc

SEQ ID NO: 1295723 - RNA, 21 nt, Mycobacterium tuberculosis H37Rv
agcagacgcagaaucgcccaa

SEQ ID NO: 1295724 - RNA, 19 nt, Mycobacterium tuberculosis H37Rv
agcagacgcagaaucgccu

SEQ ID NO: 1295725 - RNA, 20 nt, Mycobacterium tuberculosis H37Rv
agcagacgcagaagccccca

SEQ ID NO: 1295726 - RNA, 20 nt, Mycobacterium tuberculosis H37Rv
agcagacgcagaaucgcaca

SEQ ID NO: 1295727 - RNA, 19 nt, Mycobacterium tuberculosis H37Rv
agcagacgcaaaaucgccc

SEQ ID NO: 1295728 - RNA, 20 nt, Mycobacterium tuberculosis H37Rv
agcagacgcaaaaucgccca

SEQ ID NO: 1295729 - RNA, 21 nt, Mycobacterium tuberculosis H37Rv
agcagacgcaaaaucgcccaa

SEQ ID NO: 1295730 - RNA, 20 nt, Mycobacterium tuberculosis H37Rv
agcagacgcaaaaucgcccg

SEQ ID NO: 1295731 - RNA, 19 nt, Mycobacterium tuberculosis H37Rv
agcagacgcaaaaucgcac

SEQ ID NO: 1295732 - RNA, 13 nt, Mycobacterium tuberculosis H37Rv
agcacuccgucgu

SEQ ID NO: 1295733 - RNA, 17 nt, Mycobacterium tuberculosis H37Rv
agcagacgacgaucagc

SEQ ID NO: 1295734 - RNA, 20 nt, Mycobacterium tuberculosis H37Rv
agcagacgcaaaagccaccg

SEQ ID NO: 1295735 - RNA, 19 nt, Mycobacterium tuberculosis H37Rv
agcagacgcaaaauccccu

SEQ ID NO: 1295736 - RNA, 18 nt, Mycobacterium tuberculosis H37Rv
agcacggcgauccccgac

SEQ ID NO: 1295737 - RNA, 16 nt, Mycobacterium tuberculosis H37Rv
agcacguccucgaccc

SEQ ID NO: 1295738 - RNA, 13 nt, Mycobacterium tuberculosis H37Rv
agcacgucacgcg

SEQ ID NO: 1295739 - RNA, 14 nt, Mycobacterium tuberculosis H37Rv
agcacgggcacgau

SEQ ID NO: 1295740 - RNA, 13 nt, Mycobacterium tuberculosis H37Rv
agcacccgcagcc

SEQ ID NO: 1295741 - RNA, 20 nt, Mycobacterium tuberculosis H37Rv
agcacccuguuccagcgggu

SEQ ID NO: 1295742 - RNA, 14 nt, Mycobacterium tuberculosis H37Rv
agcaccgacaccgg

SEQ ID NO: 1295743 - RNA, 22 nt, Mycobacterium tuberculosis H37Rv
agcaccgacaccggccgcgacg

SEQ ID NO: 1295744 - RNA, 19 nt, Mycobacterium tuberculosis H37Rv
agcacccggccaccggacg

SEQ ID NO: 1295745 - RNA, 16 nt, Mycobacterium tuberculosis H37Rv
agcacccgcuggucga

SEQ ID NO: 1295746 - RNA, 21 nt, Mycobacterium tuberculosis H37Rv
agcaacucauuacgguagacg

SEQ ID NO: 1295747 - RNA, 22 nt, Mycobacterium tuberculosis H37Rv
agcaacggugcucuucgaugac

SEQ ID NO: 1295748 - RNA, 21 nt, Mycobacterium tuberculosis H37Rv
agcaacgcugcagcaggucga

SEQ ID NO: 1295749 - RNA, 13 nt, Mycobacterium tuberculosis H37Rv
agcaacaggccca

SEQ ID NO: 1295750 - RNA, 20 nt, Mycobacterium tuberculosis H37Rv
agcaacaccgucggcagcag

SEQ ID NO: 1295751 - RNA, 21 nt, Mycobacterium tuberculosis H37Rv
agcaacccgccguugccaccg

SEQ ID NO: 1295752 - RNA, 16 nt, Mycobacterium tuberculosis H37Rv
agcaacaacgucugca

SEQ ID NO: 1295753 - RNA, 14 nt, Mycobacterium tuberculosis H37Rv
agauucccgagacu

SEQ ID NO: 1295754 - RNA, 16 nt, Mycobacterium tuberculosis H37Rv
agcaauccgcacagcg

SEQ ID NO: 1295755 - RNA, 18 nt, Mycobacterium tuberculosis H37Rv
agcaauccaaggcucagc

SEQ ID NO: 1295756 - RNA, 15 nt, Mycobacterium tuberculosis H37Rv
agcaacugccgcacc

SEQ ID NO: 1295757 - RNA, 17 nt, Mycobacterium tuberculosis H37Rv
agcacccaaugccaccg

SEQ ID NO: 1295758 - RNA, 18 nt, Mycobacterium tuberculosis H37Rv
agcaccccauggccaccg

SEQ ID NO: 1295759 - RNA, 22 nt, Mycobacterium tuberculosis H37Rv
agcaccccauggccaccgaacg

SEQ ID NO: 1295760 - RNA, 19 nt, Mycobacterium tuberculosis H37Rv
agcaccccaaaaccgccgg

SEQ ID NO: 1295761 - RNA, 20 nt, Mycobacterium tuberculosis H37Rv
agcaccaguguggcgaugac

SEQ ID NO: 1295762 - RNA, 14 nt, Mycobacterium tuberculosis H37Rv
agcaccagcagcac

SEQ ID NO: 1295763 - RNA, 14 nt, Mycobacterium tuberculosis H37Rv
agcaccacgugcga

SEQ ID NO: 1295764 - RNA, 14 nt, Mycobacterium tuberculosis H37Rv
agcaccagccaaau

SEQ ID NO: 1295765 - RNA, 13 nt, Mycobacterium tuberculosis H37Rv
aggcgcggucacc

SEQ ID NO: 1295766 - RNA, 15 nt, Mycobacterium tuberculosis H37Rv
aggcgcggucaccgc

SEQ ID NO: 1295767 - RNA, 22 nt, Mycobacterium tuberculosis H37Rv
aggcgcccagcacccuguucca

SEQ ID NO: 1295768 - RNA, 22 nt, Mycobacterium tuberculosis H37Rv
aggcgccgcagggccgcgcgca

SEQ ID NO: 1295769 - RNA, 23 nt, Mycobacterium tuberculosis H37Rv
aggcgccgcgacaaaucggucga

SEQ ID NO: 1295770 - RNA, 22 nt, Mycobacterium tuberculosis H37Rv
aggcgcugaagaucaacaggcg

SEQ ID NO: 1295771 - RNA, 15 nt, Mycobacterium tuberculosis H37Rv
aggcgcugaacgcga

SEQ ID NO: 1295772 - RNA, 19 nt, Mycobacterium tuberculosis H37Rv
aggcgcugaacgcgagcaa

SEQ ID NO: 1295773 - RNA, 18 nt, Mycobacterium tuberculosis H37Rv
aggccggugaacggcagc

SEQ ID NO: 1295774 - RNA, 21 nt, Mycobacterium tuberculosis H37Rv
aggccggugacggggcugacc

SEQ ID NO: 1295775 - RNA, 13 nt, Mycobacterium tuberculosis H37Rv
aggccggugaacg

SEQ ID NO: 1295776 - RNA, 18 nt, Mycobacterium tuberculosis H37Rv
aggccguagcccacgacg

SEQ ID NO: 1295777 - RNA, 16 nt, Mycobacterium tuberculosis H37Rv
aggccguacucgauga

SEQ ID NO: 1295778 - RNA, 15 nt, Mycobacterium tuberculosis H37Rv
aggccguacucgaug

SEQ ID NO: 1295779 - RNA, 23 nt, Mycobacterium tuberculosis H37Rv
aggccgucgaacgguagcacggu

SEQ ID NO: 1295780 - RNA, 15 nt, Mycobacterium tuberculosis H37Rv
aggccgugguagacc

SEQ ID NO: 1295781 - RNA, 21 nt, Mycobacterium tuberculosis H37Rv
aggccgucgcgccucaucggc

SEQ ID NO: 1295782 - RNA, 16 nt, Mycobacterium tuberculosis H37Rv
aggccgucguugccgg

SEQ ID NO: 1295783 - RNA, 13 nt, Mycobacterium tuberculosis H37Rv
aggcgaucgcauc

SEQ ID NO: 1295784 - RNA, 20 nt, Mycobacterium tuberculosis H37Rv
aggcgaugagcgugccgcag

SEQ ID NO: 1295785 - RNA, 11 nt, Mycobacterium tuberculosis H37Rv
aggcgaugagc

SEQ ID NO: 1295786 - RNA, 16 nt, Mycobacterium tuberculosis H37Rv
aggcgauggucuccuc

SEQ ID NO: 1295787 - RNA, 23 nt, Mycobacterium tuberculosis H37Rv
aggcgauugcagcuucggccagc

SEQ ID NO: 1295788 - RNA, 20 nt, Mycobacterium tuberculosis H37Rv
aggcgguacgggucgccgga

SEQ ID NO: 1295789 - RNA, 23 nt, Mycobacterium tuberculosis H37Rv
aggcguucgacucgaccgcgacg

SEQ ID NO: 1295790 - RNA, 21 nt, Mycobacterium tuberculosis H37Rv
aggcguuguagcgguccagcg

SEQ ID NO: 1295791 - RNA, 21 nt, Mycobacterium tuberculosis H37Rv
aggcguucgacucgaccgcga

SEQ ID NO: 1295792 - RNA, 18 nt, Mycobacterium tuberculosis H37Rv
aggcgugcacaggucagc

SEQ ID NO: 1295793 - RNA, 20 nt, Mycobacterium tuberculosis H37Rv
aggcuuucgauauagccgcc

SEQ ID NO: 1295794 - RNA, 15 nt, Mycobacterium tuberculosis H37Rv
agggaaggacgcgca

SEQ ID NO: 1295795 - RNA, 22 nt, Mycobacterium tuberculosis H37Rv
aggcugaccguggcgccggucg

SEQ ID NO: 1295796 - RNA, 18 nt, Mycobacterium tuberculosis H37Rv
aggcuggaggugaacucg

SEQ ID NO: 1295797 - RNA, 14 nt, Mycobacterium tuberculosis H37Rv
aggcaugccacaca

SEQ ID NO: 1295798 - RNA, 14 nt, Mycobacterium tuberculosis H37Rv
aggcaugccgccca

SEQ ID NO: 1295799 - RNA, 17 nt, Mycobacterium tuberculosis H37Rv
aggcccagcaaccgcuc

SEQ ID NO: 1295800 - RNA, 22 nt, Mycobacterium tuberculosis H37Rv
aggcccagcaaccgcucggcga

SEQ ID NO: 1295801 - RNA, 16 nt, Mycobacterium tuberculosis H37Rv
aggcccagcacgguca

SEQ ID NO: 1295802 - RNA, 13 nt, Mycobacterium tuberculosis H37Rv
aggcccaacgcga

SEQ ID NO: 1295803 - RNA, 13 nt, Mycobacterium tuberculosis H37Rv
aggccagggcggu

SEQ ID NO: 1295804 - RNA, 21 nt, Mycobacterium tuberculosis H37Rv
agcugcaccuccgacggccgc

SEQ ID NO: 1295805 - RNA, 20 nt, Mycobacterium tuberculosis H37Rv
agcugcggauacagccgccg

SEQ ID NO: 1295806 - RNA, 22 nt, Mycobacterium tuberculosis H37Rv
agcugccaacgcccguguugaa

SEQ ID NO: 1295807 - RNA, 17 nt, Mycobacterium tuberculosis H37Rv
agcugcgcaucgccacc

SEQ ID NO: 1295808 - RNA, 16 nt, Mycobacterium tuberculosis H37Rv
aggccgcugccagcau

SEQ ID NO: 1295809 - RNA, 18 nt, Mycobacterium tuberculosis H37Rv
aggccgcuaugcagguca

SEQ ID NO: 1295810 - RNA, 12 nt, Mycobacterium tuberculosis H37Rv
aggccgcgguga

SEQ ID NO: 1295811 - RNA, 14 nt, Mycobacterium tuberculosis H37Rv
aggccgcgcccgag

SEQ ID NO: 1295812 - RNA, 15 nt, Mycobacterium tuberculosis H37Rv
aggccggggcgucgc

SEQ ID NO: 1295813 - RNA, 17 nt, Mycobacterium tuberculosis H37Rv
aggccggcuaccgcgcu

SEQ ID NO: 1295814 - RNA, 18 nt, Mycobacterium tuberculosis H37Rv
aggcccaggucaacgacg

SEQ ID NO: 1295815 - RNA, 16 nt, Mycobacterium tuberculosis H37Rv
aggccgccggacccgu

SEQ ID NO: 1295816 - RNA, 13 nt, Mycobacterium tuberculosis H37Rv
aggccgccggcca

SEQ ID NO: 1295817 - RNA, 16 nt, Mycobacterium tuberculosis H37Rv
aggccgccaucgccgc

SEQ ID NO: 1295818 - RNA, 22 nt, Mycobacterium tuberculosis H37Rv
aggccgaccuguaugccgcggu

SEQ ID NO: 1295819 - RNA, 21 nt, Mycobacterium tuberculosis H37Rv
aggccgaccucguucgucacc

SEQ ID NO: 1295820 - RNA, 12 nt, Mycobacterium tuberculosis H37Rv
aggucuccggca

SEQ ID NO: 1295821 - RNA, 20 nt, Mycobacterium tuberculosis H37Rv
aggucugacagaccgggcac

SEQ ID NO: 1295822 - RNA, 19 nt, Mycobacterium tuberculosis H37Rv
aggugaucccgauggucac

SEQ ID NO: 1295823 - RNA, 12 nt, Mycobacterium tuberculosis H37Rv
aggugcgcgacc

SEQ ID NO: 1295824 - RNA, 22 nt, Mycobacterium tuberculosis H37Rv
aggugcccaagcaguccacgag

SEQ ID NO: 1295825 - RNA, 17 nt, Mycobacterium tuberculosis H37Rv
aggucggugcggucauc

SEQ ID NO: 1295826 - RNA, 15 nt, Mycobacterium tuberculosis H37Rv
aggucgaugccggcu

SEQ ID NO: 1295827 - RNA, 17 nt, Mycobacterium tuberculosis H37Rv
aggucgaugcgggcgac

SEQ ID NO: 1295828 - RNA, 22 nt, Mycobacterium tuberculosis H37Rv
aggucgacccaacgcagaucag

SEQ ID NO: 1295829 - RNA, 14 nt, Mycobacterium tuberculosis H37Rv
aggucgacgggcac

SEQ ID NO: 1295830 - RNA, 16 nt, Mycobacterium tuberculosis H37Rv
agguccaccccgccga

SEQ ID NO: 1295831 - RNA, 15 nt, Mycobacterium tuberculosis H37Rv
aggucgaaccgccgg

SEQ ID NO: 1295832 - RNA, 17 nt, Mycobacterium tuberculosis H37Rv
aggucgacauaggccac

SEQ ID NO: 1295833 - RNA, 16 nt, Mycobacterium tuberculosis H37Rv
agggcaucgucgccga

SEQ ID NO: 1295834 - RNA, 21 nt, Mycobacterium tuberculosis H37Rv
agggauccgaagagccagcaa

SEQ ID NO: 1295835 - RNA, 20 nt, Mycobacterium tuberculosis H37Rv
agggcagcagcccgggcagc

SEQ ID NO: 1295836 - RNA, 18 nt, Mycobacterium tuberculosis H37Rv
aggggcgucgcaacgcga

SEQ ID NO: 1295837 - RNA, 17 nt, Mycobacterium tuberculosis H37Rv
aggggcuuuugcgucug

SEQ ID NO: 1295838 - RNA, 23 nt, Mycobacterium tuberculosis H37Rv
aggggcgucgcaacgcgaucacc

SEQ ID NO: 1295839 - RNA, 18 nt, Mycobacterium tuberculosis H37Rv
agggccacguagcagcag

SEQ ID NO: 1295840 - RNA, 15 nt, Mycobacterium tuberculosis H37Rv
aggucaccggucacc

SEQ ID NO: 1295841 - RNA, 13 nt, Mycobacterium tuberculosis H37Rv
aggucaccgucga

SEQ ID NO: 1295842 - RNA, 17 nt, Mycobacterium tuberculosis H37Rv
aggucaccggccgccga

SEQ ID NO: 1295843 - RNA, 18 nt, Mycobacterium tuberculosis H37Rv
aggucaacgccacgccga

SEQ ID NO: 1295844 - RNA, 14 nt, Mycobacterium tuberculosis H37Rv
agguagcgcgcaac

SEQ ID NO: 1295845 - RNA, 20 nt, Mycobacterium tuberculosis H37Rv
aggguggggcgguggccggc

SEQ ID NO: 1295846 - RNA, 14 nt, Mycobacterium tuberculosis H37Rv
aggguggccggucc

SEQ ID NO: 1295847 - RNA, 17 nt, Mycobacterium tuberculosis H37Rv
agggugcguuggaugaa

SEQ ID NO: 1295848 - RNA, 16 nt, Mycobacterium tuberculosis H37Rv
aggguggaccggucga

SEQ ID NO: 1295849 - RNA, 15 nt, Mycobacterium tuberculosis H37Rv
agggugccggucacg

SEQ ID NO: 1295850 - RNA, 22 nt, Mycobacterium tuberculosis H37Rv
aguaagcgaacagcggcacgau

SEQ ID NO: 1295851 - RNA, 17 nt, Mycobacterium tuberculosis H37Rv
aguccaacucggccaac

SEQ ID NO: 1295852 - RNA, 19 nt, Mycobacterium tuberculosis H37Rv
aguauggccgccaccgcga

SEQ ID NO: 1295853 - RNA, 20 nt, Mycobacterium tuberculosis H37Rv
aguccgcgcucagcuccggc

SEQ ID NO: 1295854 - RNA, 22 nt, Mycobacterium tuberculosis H37Rv
aguccgcgcucagcuccggcga

SEQ ID NO: 1295855 - RNA, 23 nt, Mycobacterium tuberculosis H37Rv
aguccgcggaucaccaucgccgc

SEQ ID NO: 1295856 - RNA, 20 nt, Mycobacterium tuberculosis H37Rv
aguccgacaccggcggcauc

SEQ ID NO: 1295857 - RNA, 14 nt, Mycobacterium tuberculosis H37Rv
aguccgacaccggc

SEQ ID NO: 1295858 - RNA, 19 nt, Mycobacterium tuberculosis H37Rv
agucccgugacgaacuucg

SEQ ID NO: 1295859 - RNA, 20 nt, Mycobacterium tuberculosis H37Rv
aguccgagggcgucgccgcc

SEQ ID NO: 1295860 - RNA, 20 nt, Mycobacterium tuberculosis H37Rv
aguccgcgccgacggccagc

SEQ ID NO: 1295861 - RNA, 18 nt, Mycobacterium tuberculosis H37Rv
agguguugcgguggguga

SEQ ID NO: 1295862 - RNA, 23 nt, Mycobacterium tuberculosis H37Rv
agguggucacgcagucgggcagc

SEQ ID NO: 1295863 - RNA, 17 nt, Mycobacterium tuberculosis H37Rv
aggugcgggccggugga

SEQ ID NO: 1295864 - RNA, 19 nt, Mycobacterium tuberculosis H37Rv
aggugggcguuggcgacga

SEQ ID NO: 1295865 - RNA, 16 nt, Mycobacterium tuberculosis H37Rv
agguucuucugcgcca

SEQ ID NO: 1295866 - RNA, 22 nt, Mycobacterium tuberculosis H37Rv
agguucgcaccggagucggcgu

SEQ ID NO: 1295867 - RNA, 22 nt, Mycobacterium tuberculosis H37Rv
agguuccgcugucgagccggug

SEQ ID NO: 1295868 - RNA, 15 nt, Mycobacterium tuberculosis H37Rv
agguugcguugcagg

SEQ ID NO: 1295869 - RNA, 14 nt, Mycobacterium tuberculosis H37Rv
agguugcggacggu

SEQ ID NO: 1295870 - RNA, 15 nt, Mycobacterium tuberculosis H37Rv
agguugccgaaguuu

SEQ ID NO: 1295871 - RNA, 21 nt, Mycobacterium tuberculosis H37Rv
agguugauuggggccagguug

SEQ ID NO: 1295872 - RNA, 17 nt, Mycobacterium tuberculosis H37Rv
agguugggccgguugau

SEQ ID NO: 1295873 - RNA, 16 nt, Mycobacterium tuberculosis H37Rv
aguaaccguccgcgga

SEQ ID NO: 1295874 - RNA, 22 nt, Mycobacterium tuberculosis H37Rv
aguggucccggugaugaccgga

SEQ ID NO: 1295875 - RNA, 22 nt, Mycobacterium tuberculosis H37Rv
aguggucggcccgcucaccuug

SEQ ID NO: 1295876 - RNA, 13 nt, Mycobacterium tuberculosis H37Rv
agugucagcagau

SEQ ID NO: 1295877 - RNA, 21 nt, Mycobacterium tuberculosis H37Rv
agugucagcaagaucggcagc

SEQ ID NO: 1295878 - RNA, 20 nt, Mycobacterium tuberculosis H37Rv
agucgauguacaccgugcgc

SEQ ID NO: 1295879 - RNA, 18 nt, Mycobacterium tuberculosis H37Rv
agucgaucgcggcccgca

SEQ ID NO: 1295880 - RNA, 16 nt, Mycobacterium tuberculosis H37Rv
agucgaucuccgucgg

SEQ ID NO: 1295881 - RNA, 19 nt, Mycobacterium tuberculosis H37Rv
agucgaagucguaccuaag

SEQ ID NO: 1295882 - RNA, 14 nt, Mycobacterium tuberculosis H37Rv
agucgacggucacg

SEQ ID NO: 1295883 - RNA, 15 nt, Mycobacterium tuberculosis H37Rv
agucgacgacguggc

SEQ ID NO: 1295884 - RNA, 16 nt, Mycobacterium tuberculosis H37Rv
agucgacgacguccuc

SEQ ID NO: 1295885 - RNA, 19 nt, Mycobacterium tuberculosis H37Rv
aguucugcgcucccguacg

SEQ ID NO: 1295886 - RNA, 16 nt, Mycobacterium tuberculosis H37Rv
aguucgucgggaucgu

SEQ ID NO: 1295887 - RNA, 14 nt, Mycobacterium tuberculosis H37Rv
aguugaagaagcca

SEQ ID NO: 1295888 - RNA, 22 nt, Mycobacterium tuberculosis H37Rv
aguucccuacacccauuacuga

SEQ ID NO: 1295889 - RNA, 20 nt, Mycobacterium tuberculosis H37Rv
aguucgguguagaucagcaa

SEQ ID NO: 1295890 - RNA, 15 nt, Mycobacterium tuberculosis H37Rv
aguuguagacgucga

SEQ ID NO: 1295891 - RNA, 23 nt, Mycobacterium tuberculosis H37Rv
auaauucaacagcaccgcgacga

SEQ ID NO: 1295892 - RNA, 23 nt, Mycobacterium tuberculosis H37Rv
auaccgaaccgguguagcagcgc

SEQ ID NO: 1295893 - RNA, 15 nt, Mycobacterium tuberculosis H37Rv
auagcaccucgauga

SEQ ID NO: 1295894 - RNA, 16 nt, Mycobacterium tuberculosis H37Rv
auagcaacucgaucgc

SEQ ID NO: 1295895 - RNA, 20 nt, Mycobacterium tuberculosis H37Rv
auagauucccggcucgaugg

SEQ ID NO: 1295896 - RNA, 15 nt, Mycobacterium tuberculosis H37Rv
auacuccgcgagccc

SEQ ID NO: 1295897 - RNA, 13 nt, Mycobacterium tuberculosis H37Rv
aucacaucgcccg

SEQ ID NO: 1295898 - RNA, 20 nt, Mycobacterium tuberculosis H37Rv
aucacaccgagcgcaaucga

SEQ ID NO: 1295899 - RNA, 15 nt, Mycobacterium tuberculosis H37Rv
aucacaccccaggca

SEQ ID NO: 1295900 - RNA, 17 nt, Mycobacterium tuberculosis H37Rv
aucaccgccguuaccgc

SEQ ID NO: 1295901 - RNA, 23 nt, Mycobacterium tuberculosis H37Rv
aucaccaugugggugaucgcggu

SEQ ID NO: 1295902 - RNA, 20 nt, Mycobacterium tuberculosis H37Rv
aucaccggcaauuacccgac

SEQ ID NO: 1295903 - RNA, 18 nt, Mycobacterium tuberculosis H37Rv
aucaccgguucggugagc

SEQ ID NO: 1295904 - RNA, 15 nt, Mycobacterium tuberculosis H37Rv
aucaccgucagggga

SEQ ID NO: 1295905 - RNA, 12 nt, Mycobacterium tuberculosis H37Rv
aucaccgucgac

SEQ ID NO: 1295906 - RNA, 15 nt, Mycobacterium tuberculosis H37Rv
aucaccgucgacagc

SEQ ID NO: 1295907 - RNA, 13 nt, Mycobacterium tuberculosis H37Rv
aucacgaccgcgc

SEQ ID NO: 1295908 - RNA, 12 nt, Mycobacterium tuberculosis H37Rv
aucacgaucaca

SEQ ID NO: 1295909 - RNA, 19 nt, Mycobacterium tuberculosis H37Rv
aucaccuugccuagccgca

SEQ ID NO: 1295910 - RNA, 14 nt, Mycobacterium tuberculosis H37Rv
aucacgccgggcga

SEQ ID NO: 1295911 - RNA, 14 nt, Mycobacterium tuberculosis H37Rv
aucacggccgucga

SEQ ID NO: 1295912 - RNA, 20 nt, Mycobacterium tuberculosis H37Rv
aucacgcacugaugucaccc

SEQ ID NO: 1295913 - RNA, 14 nt, Mycobacterium tuberculosis H37Rv
aucacgucggcguu

SEQ ID NO: 1295914 - RNA, 13 nt, Mycobacterium tuberculosis H37Rv
aucagaucgccga

SEQ ID NO: 1295915 - RNA, 22 nt, Mycobacterium tuberculosis H37Rv
aucagaaucaggcucgccgaug

SEQ ID NO: 1295916 - RNA, 22 nt, Mycobacterium tuberculosis H37Rv
aucacucccccacacacccgac

SEQ ID NO: 1295917 - RNA, 22 nt, Mycobacterium tuberculosis H37Rv
aucacuaaccuggcguagauca

SEQ ID NO: 1295918 - RNA, 19 nt, Mycobacterium tuberculosis H37Rv
aucagccguggcagucgca

SEQ ID NO: 1295919 - RNA, 15 nt, Mycobacterium tuberculosis H37Rv
aucagcgacagcgga

SEQ ID NO: 1295920 - RNA, 13 nt, Mycobacterium tuberculosis H37Rv
aucagcgacccgu

SEQ ID NO: 1295921 - RNA, 14 nt, Mycobacterium tuberculosis H37Rv
aucagcaccgacag

SEQ ID NO: 1295922 - RNA, 21 nt, Mycobacterium tuberculosis H37Rv
aucagcacguaacgccgcuca

SEQ ID NO: 1295923 - RNA, 14 nt, Mycobacterium tuberculosis H37Rv
aucagcaccgacgg

SEQ ID NO: 1295924 - RNA, 13 nt, Mycobacterium tuberculosis H37Rv
aucagcaugcccu

SEQ ID NO: 1295925 - RNA, 16 nt, Mycobacterium tuberculosis H37Rv
aucagcagcagcguga

SEQ ID NO: 1295926 - RNA, 14 nt, Mycobacterium tuberculosis H37Rv
aucagcagcgccag

SEQ ID NO: 1295927 - RNA, 22 nt, Mycobacterium tuberculosis H37Rv
aucaaccggacauccgaugcgu

SEQ ID NO: 1295928 - RNA, 17 nt, Mycobacterium tuberculosis H37Rv
aucaacgacaccagauc

SEQ ID NO: 1295929 - RNA, 18 nt, Mycobacterium tuberculosis H37Rv
aucaacaugccggucauc

SEQ ID NO: 1295930 - RNA, 21 nt, Mycobacterium tuberculosis H37Rv
aucaacauugugcucgccgau

SEQ ID NO: 1295931 - RNA, 17 nt, Mycobacterium tuberculosis H37Rv
aucaacaggcgucccgc

SEQ ID NO: 1295932 - RNA, 20 nt, Mycobacterium tuberculosis H37Rv
aucaaaaacgaacccaggca

SEQ ID NO: 1295933 - RNA, 19 nt, Mycobacterium tuberculosis H37Rv
aucaagaaguacagcuggc

SEQ ID NO: 1295934 - RNA, 16 nt, Mycobacterium tuberculosis H37Rv
aucaacgcgucgcccg

SEQ ID NO: 1295935 - RNA, 20 nt, Mycobacterium tuberculosis H37Rv
aucaacgcaaugccaaucgc

SEQ ID NO: 1295936 - RNA, 21 nt, Mycobacterium tuberculosis H37Rv
aucaaggugaucagcaggauc

SEQ ID NO: 1295937 - RNA, 14 nt, Mycobacterium tuberculosis H37Rv
aucaaggccggucc

SEQ ID NO: 1295938 - RNA, 19 nt, Mycobacterium tuberculosis H37Rv
aucaagccuucgucgaugc

SEQ ID NO: 1295939 - RNA, 16 nt, Mycobacterium tuberculosis H37Rv
auagccguucggcauc

SEQ ID NO: 1295940 - RNA, 17 nt, Mycobacterium tuberculosis H37Rv
auagccaccgacgacau

SEQ ID NO: 1295941 - RNA, 16 nt, Mycobacterium tuberculosis H37Rv
caccgaacagucgcag

SEQ ID NO: 1295942 - RNA, 17 nt, Mycobacterium tuberculosis H37Rv
caccgaaacgccgaccu

SEQ ID NO: 1295943 - RNA, 21 nt, Mycobacterium tuberculosis H37Rv
caccgaaacgcgcggaucguc

SEQ ID NO: 1295944 - RNA, 20 nt, Mycobacterium tuberculosis H37Rv
caccgaacccgccaccgcga

SEQ ID NO: 1295945 - RNA, 20 nt, Mycobacterium tuberculosis H37Rv
caccgaaccgccgcugccgc

SEQ ID NO: 1295946 - RNA, 17 nt, Mycobacterium tuberculosis H37Rv
caccgaaauacccagcg

SEQ ID NO: 1295947 - RNA, 20 nt, Mycobacterium tuberculosis H37Rv
cacccguccgccgcagacgc

SEQ ID NO: 1295948 - RNA, 14 nt, Mycobacterium tuberculosis H37Rv
cacccgugccgccg

SEQ ID NO: 1295949 - RNA, 17 nt, Mycobacterium tuberculosis H37Rv
cacccgugccgccgaug

SEQ ID NO: 1295950 - RNA, 20 nt, Mycobacterium tuberculosis H37Rv
cacccguugaucgcggacac

SEQ ID NO: 1295951 - RNA, 16 nt, Mycobacterium tuberculosis H37Rv
cacccgcuggucgagc

SEQ ID NO: 1295952 - RNA, 16 nt, Mycobacterium tuberculosis H37Rv
cacccguaagcggaug

SEQ ID NO: 1295953 - RNA, 17 nt, Mycobacterium tuberculosis H37Rv
cacccgguccugcucgc

SEQ ID NO: 1295954 - RNA, 19 nt, Mycobacterium tuberculosis H37Rv
cacccggucaucggccguc

SEQ ID NO: 1295955 - RNA, 17 nt, Mycobacterium tuberculosis H37Rv
cacccgcuccagcucgg

SEQ ID NO: 1295956 - RNA, 14 nt, Mycobacterium tuberculosis H37Rv
cacccgcucggcgc

SEQ ID NO: 1295957 - RNA, 16 nt, Mycobacterium tuberculosis H37Rv
cacccgcucgucggua

SEQ ID NO: 1295958 - RNA, 16 nt, Mycobacterium tuberculosis H37Rv
cacccgcgucgagugc

SEQ ID NO: 1295959 - RNA, 15 nt, Mycobacterium tuberculosis H37Rv
cacccgcggcgaacc

SEQ ID NO: 1295960 - RNA, 14 nt, Mycobacterium tuberculosis H37Rv
caccgacgacacca

SEQ ID NO: 1295961 - RNA, 15 nt, Mycobacterium tuberculosis H37Rv
caccgacgccgauac

SEQ ID NO: 1295962 - RNA, 21 nt, Mycobacterium tuberculosis H37Rv
caccgaccuggacgcggccaa

SEQ ID NO: 1295963 - RNA, 21 nt, Mycobacterium tuberculosis H37Rv
caccgaccuaccgucgaccac

SEQ ID NO: 1295964 - RNA, 16 nt, Mycobacterium tuberculosis H37Rv
caccgaccuaccgucg

SEQ ID NO: 1295965 - RNA, 15 nt, Mycobacterium tuberculosis H37Rv
caccgacugcuguca

SEQ ID NO: 1295966 - RNA, 18 nt, Mycobacterium tuberculosis H37Rv
caccgacggaugaucagc

SEQ ID NO: 1295967 - RNA, 14 nt, Mycobacterium tuberculosis H37Rv
caccgacgcgucgg

SEQ ID NO: 1295968 - RNA, 16 nt, Mycobacterium tuberculosis H37Rv
caccgaauuacgcacc

SEQ ID NO: 1295969 - RNA, 15 nt, Mycobacterium tuberculosis H37Rv
caccgaacgcaccga

SEQ ID NO: 1295970 - RNA, 16 nt, Mycobacterium tuberculosis H37Rv
caccgaacgcggccac

SEQ ID NO: 1295971 - RNA, 22 nt, Mycobacterium tuberculosis H37Rv
caccgaacgcggccaccgaccg

SEQ ID NO: 1295972 - RNA, 14 nt, Mycobacterium tuberculosis H37Rv
caccgacagcccga

SEQ ID NO: 1295973 - RNA, 22 nt, Mycobacterium tuberculosis H37Rv
caccgacaagaauggccgccuu

SEQ ID NO: 1295974 - RNA, 15 nt, Mycobacterium tuberculosis H37Rv
caccgacaccggccg

SEQ ID NO: 1295975 - RNA, 17 nt, Mycobacterium tuberculosis H37Rv
cacccagcgugcccgcc

SEQ ID NO: 1295976 - RNA, 20 nt, Mycobacterium tuberculosis H37Rv
cacccagcggcgugacgucg

SEQ ID NO: 1295977 - RNA, 16 nt, Mycobacterium tuberculosis H37Rv
cacccagcggaaccga

SEQ ID NO: 1295978 - RNA, 19 nt, Mycobacterium tuberculosis H37Rv
cacccaggcaucggugagc

SEQ ID NO: 1295979 - RNA, 14 nt, Mycobacterium tuberculosis H37Rv
cacccaggugucgc

SEQ ID NO: 1295980 - RNA, 12 nt, Mycobacterium tuberculosis H37Rv
cacccaggccga

SEQ ID NO: 1295981 - RNA, 15 nt, Mycobacterium tuberculosis H37Rv
cacccccaaccgccg

SEQ ID NO: 1295982 - RNA, 17 nt, Mycobacterium tuberculosis H37Rv
cacccccgacaccgccg

SEQ ID NO: 1295983 - RNA, 16 nt, Mycobacterium tuberculosis H37Rv
cacccgcgaagccgcc

SEQ ID NO: 1295984 - RNA, 12 nt, Mycobacterium tuberculosis H37Rv
cacccgcgacga

SEQ ID NO: 1295985 - RNA, 13 nt, Mycobacterium tuberculosis H37Rv
caccccgagcggc

SEQ ID NO: 1295986 - RNA, 14 nt, Mycobacterium tuberculosis H37Rv
caccccgacguucg

SEQ ID NO: 1295987 - RNA, 15 nt, Mycobacterium tuberculosis H37Rv
caccccgacguucgu

SEQ ID NO: 1295988 - RNA, 18 nt, Mycobacterium tuberculosis H37Rv
caccccgccaugcggcgc

SEQ ID NO: 1295989 - RNA, 13 nt, Mycobacterium tuberculosis H37Rv
cacccgccgcagc

SEQ ID NO: 1295990 - RNA, 12 nt, Mycobacterium tuberculosis H37Rv
cacccgcccgag

SEQ ID NO: 1295991 - RNA, 13 nt, Mycobacterium tuberculosis H37Rv
caccaggagcgga

SEQ ID NO: 1295992 - RNA, 15 nt, Mycobacterium tuberculosis H37Rv
caccaggcccgguuc

SEQ ID NO: 1295993 - RNA, 21 nt, Mycobacterium tuberculosis H37Rv
caccagggggcgagagcgcgg

SEQ ID NO: 1295994 - RNA, 19 nt, Mycobacterium tuberculosis H37Rv
caccagguacgcgaucagc

SEQ ID NO: 1295995 - RNA, 23 nt, Mycobacterium tuberculosis H37Rv
caccagguacgcgaucagcgcgc

SEQ ID NO: 1295996 - RNA, 14 nt, Mycobacterium tuberculosis H37Rv
cacccacgucgagc

SEQ ID NO: 1295997 - RNA, 14 nt, Mycobacterium tuberculosis H37Rv
cacccacgccggug

SEQ ID NO: 1295998 - RNA, 22 nt, Mycobacterium tuberculosis H37Rv
cacccagaaugacaucgucgcc

SEQ ID NO: 1295999 - RNA, 14 nt, Mycobacterium tuberculosis H37Rv
cacccagaugcagc

SEQ ID NO: 1296000 - RNA, 15 nt, Mycobacterium tuberculosis H37Rv
cacccagccgcagcc

SEQ ID NO: 1296001 - RNA, 14 nt, Mycobacterium tuberculosis H37Rv
cacccagccgcagc

SEQ ID NO: 1296002 - RNA, 20 nt, Mycobacterium tuberculosis H37Rv
caccagccggugagcgagcg

SEQ ID NO: 1296003 - RNA, 14 nt, Mycobacterium tuberculosis H37Rv
caccagccgucagc

SEQ ID NO: 1296004 - RNA, 15 nt, Mycobacterium tuberculosis H37Rv
caccagccggugagc

SEQ ID NO: 1296005 - RNA, 17 nt, Mycobacterium tuberculosis H37Rv
caccagccaaaucagcc

SEQ ID NO: 1296006 - RNA, 11 nt, Mycobacterium tuberculosis H37Rv
caccagcagga

SEQ ID NO: 1296007 - RNA, 17 nt, Mycobacterium tuberculosis H37Rv
caccagcgcaucggcca

SEQ ID NO: 1296008 - RNA, 20 nt, Mycobacterium tuberculosis H37Rv
caccagcgcagccgaucguc

SEQ ID NO: 1296009 - RNA, 15 nt, Mycobacterium tuberculosis H37Rv
caccagcgcagccga

SEQ ID NO: 1296010 - RNA, 12 nt, Mycobacterium tuberculosis H37Rv
caccagcgcagc

SEQ ID NO: 1296011 - RNA, 17 nt, Mycobacterium tuberculosis H37Rv
caccagcgccuugacgc

SEQ ID NO: 1296012 - RNA, 18 nt, Mycobacterium tuberculosis H37Rv
caccagcgucgcggccac

SEQ ID NO: 1296013 - RNA, 16 nt, Mycobacterium tuberculosis H37Rv
caccagcucacccgga

SEQ ID NO: 1296014 - RNA, 17 nt, Mycobacterium tuberculosis H37Rv
caccagcgucgcggcca

SEQ ID NO: 1296015 - RNA, 14 nt, Mycobacterium tuberculosis H37Rv
caccagcggucagc

SEQ ID NO: 1296016 - RNA, 17 nt, Mycobacterium tuberculosis H37Rv
caccagcugcgcgaugu

SEQ ID NO: 1296017 - RNA, 13 nt, Mycobacterium tuberculosis H37Rv
caccagcuggaag

SEQ ID NO: 1296018 - RNA, 20 nt, Mycobacterium tuberculosis H37Rv
caccagaaaugguucgcaca

SEQ ID NO: 1296019 - RNA, 18 nt, Mycobacterium tuberculosis H37Rv
caccagacaacgccgucg

SEQ ID NO: 1296020 - RNA, 17 nt, Mycobacterium tuberculosis H37Rv
caccagaugcaccucgc

SEQ ID NO: 1296021 - RNA, 22 nt, Mycobacterium tuberculosis H37Rv
caccacuucggcgccgcgccgu

SEQ ID NO: 1296022 - RNA, 12 nt, Mycobacterium tuberculosis H37Rv
caccacggccag

SEQ ID NO: 1296023 - RNA, 16 nt, Mycobacterium tuberculosis H37Rv
caccacggcgcgcagc

SEQ ID NO: 1296024 - RNA, 14 nt, Mycobacterium tuberculosis H37Rv
caccaccucgacga

SEQ ID NO: 1296025 - RNA, 18 nt, Mycobacterium tuberculosis H37Rv
caccaccuccgcgucgga

SEQ ID NO: 1296026 - RNA, 15 nt, Mycobacterium tuberculosis H37Rv
caccaccguugccgc

SEQ ID NO: 1296027 - RNA, 18 nt, Mycobacterium tuberculosis H37Rv
caccaccggccccaccga

SEQ ID NO: 1296028 - RNA, 11 nt, Mycobacterium tuberculosis H37Rv
caccaccggcc

SEQ ID NO: 1296029 - RNA, 12 nt, Mycobacterium tuberculosis H37Rv
caccaccgaccu

SEQ ID NO: 1296030 - RNA, 14 nt, Mycobacterium tuberculosis H37Rv
caccaccgacagca

SEQ ID NO: 1296031 - RNA, 20 nt, Mycobacterium tuberculosis H37Rv
cacacggggccgccagcugc

SEQ ID NO: 1296032 - RNA, 21 nt, Mycobacterium tuberculosis H37Rv
caccacagacgacgucggcgu

SEQ ID NO: 1296033 - RNA, 18 nt, Mycobacterium tuberculosis H37Rv
cacacuggcuuugacggg

SEQ ID NO: 1296034 - RNA, 18 nt, Mycobacterium tuberculosis H37Rv
cacacuggccugcucaac

SEQ ID NO: 1296035 - RNA, 18 nt, Mycobacterium tuberculosis H37Rv
caccaccaagcucggcca

SEQ ID NO: 1296036 - RNA, 17 nt, Mycobacterium tuberculosis H37Rv
caccaccaccgccggug

SEQ ID NO: 1296037 - RNA, 12 nt, Mycobacterium tuberculosis H37Rv
caccaccagguc

SEQ ID NO: 1296038 - RNA, 17 nt, Mycobacterium tuberculosis H37Rv
caccaccagcacgcucg

SEQ ID NO: 1296039 - RNA, 21 nt, Mycobacterium tuberculosis H37Rv
caccaccccagcggccaccga

SEQ ID NO: 1296040 - RNA, 17 nt, Mycobacterium tuberculosis H37Rv
caccaccccagcggcca

SEQ ID NO: 1296041 - RNA, 15 nt, Mycobacterium tuberculosis H37Rv
caccaccccagcggc

SEQ ID NO: 1296042 - RNA, 20 nt, Mycobacterium tuberculosis H37Rv
caccgccggcuccgccguug

SEQ ID NO: 1296043 - RNA, 19 nt, Mycobacterium tuberculosis H37Rv
caccgaugccuugaccgcg

SEQ ID NO: 1296044 - RNA, 17 nt, Mycobacterium tuberculosis H37Rv
caccgccggugccgcca

SEQ ID NO: 1296045 - RNA, 21 nt, Mycobacterium tuberculosis H37Rv
caccgccggugccgccaucgc

SEQ ID NO: 1296046 - RNA, 15 nt, Mycobacterium tuberculosis H37Rv
caccgccgguggcgc

SEQ ID NO: 1296047 - RNA, 19 nt, Mycobacterium tuberculosis H37Rv
caccgccgucaccgccauu

SEQ ID NO: 1296048 - RNA, 20 nt, Mycobacterium tuberculosis H37Rv
caccgccguuaccgccguua

SEQ ID NO: 1296049 - RNA, 15 nt, Mycobacterium tuberculosis H37Rv
caccgccugcgccgc

SEQ ID NO: 1296050 - RNA, 14 nt, Mycobacterium tuberculosis H37Rv
caccgccucacugg

SEQ ID NO: 1296051 - RNA, 16 nt, Mycobacterium tuberculosis H37Rv
caccgcgcaucaucgc

SEQ ID NO: 1296052 - RNA, 20 nt, Mycobacterium tuberculosis H37Rv
caccgcgcaucaucgcccac

SEQ ID NO: 1296053 - RNA, 16 nt, Mycobacterium tuberculosis H37Rv
caccgccugcgccuug

SEQ ID NO: 1296054 - RNA, 13 nt, Mycobacterium tuberculosis H37Rv
caccgcgccagcc

SEQ ID NO: 1296055 - RNA, 19 nt, Mycobacterium tuberculosis H37Rv
caccgaggugccgcgcagc

SEQ ID NO: 1296056 - RNA, 21 nt, Mycobacterium tuberculosis H37Rv
caccgaguauuuuucgaccag

SEQ ID NO: 1296057 - RNA, 21 nt, Mycobacterium tuberculosis H37Rv
caccgccggcgcccaggccga

SEQ ID NO: 1296058 - RNA, 22 nt, Mycobacterium tuberculosis H37Rv
caccgcggcgcugaugccgucu

SEQ ID NO: 1296059 - RNA, 14 nt, Mycobacterium tuberculosis H37Rv
caccgcgggaucgg

SEQ ID NO: 1296060 - RNA, 13 nt, Mycobacterium tuberculosis H37Rv
caccgcgggcaua

SEQ ID NO: 1296061 - RNA, 22 nt, Mycobacterium tuberculosis H37Rv
caccgcgggaucgguggcggca

SEQ ID NO: 1296062 - RNA, 13 nt, Mycobacterium tuberculosis H37Rv
caccgcgccgucg

SEQ ID NO: 1296063 - RNA, 12 nt, Mycobacterium tuberculosis H37Rv
caccgcggccga

SEQ ID NO: 1296064 - RNA, 23 nt, Mycobacterium tuberculosis H37Rv
caccgcggccagcaccagcucac

SEQ ID NO: 1296065 - RNA, 19 nt, Mycobacterium tuberculosis H37Rv
caccgcggccgcggucgau

SEQ ID NO: 1296066 - RNA, 17 nt, Mycobacterium tuberculosis H37Rv
caccgcgguacgccggu

SEQ ID NO: 1296067 - RNA, 15 nt, Mycobacterium tuberculosis H37Rv
caccgcgguagccga

SEQ ID NO: 1296068 - RNA, 17 nt, Mycobacterium tuberculosis H37Rv
caccgcgguggcggcga

SEQ ID NO: 1296069 - RNA, 20 nt, Mycobacterium tuberculosis H37Rv
caccgcgguggcggcgagca

SEQ ID NO: 1296070 - RNA, 22 nt, Mycobacterium tuberculosis H37Rv
caccgcguaauucgacuucggg

SEQ ID NO: 1296071 - RNA, 20 nt, Mycobacterium tuberculosis H37Rv
caccgcguaguccaggccgu

SEQ ID NO: 1296072 - RNA, 17 nt, Mycobacterium tuberculosis H37Rv
caccgcgucgggccgca

SEQ ID NO: 1296073 - RNA, 13 nt, Mycobacterium tuberculosis H37Rv
caccgcgucgggc

SEQ ID NO: 1296074 - RNA, 19 nt, Mycobacterium tuberculosis H37Rv
caccgcguugaugaccagg

SEQ ID NO: 1296075 - RNA, 20 nt, Mycobacterium tuberculosis H37Rv
caccgcguugaugaccaggu

SEQ ID NO: 1296076 - RNA, 16 nt, Mycobacterium tuberculosis H37Rv
caccggccacucggga

SEQ ID NO: 1296077 - RNA, 23 nt, Mycobacterium tuberculosis H37Rv
caccggccgguggguagccagcg

SEQ ID NO: 1296078 - RNA, 15 nt, Mycobacterium tuberculosis H37Rv
caccggcgaucaccg

SEQ ID NO: 1296079 - RNA, 14 nt, Mycobacterium tuberculosis H37Rv
caccggcgauccgg

SEQ ID NO: 1296080 - RNA, 18 nt, Mycobacterium tuberculosis H37Rv
caccggcgagugcugucg

SEQ ID NO: 1296081 - RNA, 13 nt, Mycobacterium tuberculosis H37Rv
caccggcgcaccg

SEQ ID NO: 1296082 - RNA, 17 nt, Mycobacterium tuberculosis H37Rv
caccggcgccgccgucg

SEQ ID NO: 1296083 - RNA, 13 nt, Mycobacterium tuberculosis H37Rv
caccggcgccacc

SEQ ID NO: 1296084 - RNA, 16 nt, Mycobacterium tuberculosis H37Rv
caccggccaccagggc

SEQ ID NO: 1296085 - RNA, 14 nt, Mycobacterium tuberculosis H37Rv
caccggcaugcgug

SEQ ID NO: 1296086 - RNA, 18 nt, Mycobacterium tuberculosis H37Rv
caccggcagcgcgaucga

SEQ ID NO: 1296087 - RNA, 22 nt, Mycobacterium tuberculosis H37Rv
caccggcacccccgucgccacc

SEQ ID NO: 1296088 - RNA, 21 nt, Mycobacterium tuberculosis H37Rv
caccggcacccccgucgccac

SEQ ID NO: 1296089 - RNA, 23 nt, Mycobacterium tuberculosis H37Rv
caccggcaccacgaucaacucgu

SEQ ID NO: 1296090 - RNA, 14 nt, Mycobacterium tuberculosis H37Rv
caccggcaccgcug

SEQ ID NO: 1296091 - RNA, 18 nt, Mycobacterium tuberculosis H37Rv
caccggcacugcccagca

SEQ ID NO: 1296092 - RNA, 21 nt, Mycobacterium tuberculosis H37Rv
caccgcugccggcacgcaugc

SEQ ID NO: 1296093 - RNA, 21 nt, Mycobacterium tuberculosis H37Rv
caccgcuucaggcgccacugc

SEQ ID NO: 1296094 - RNA, 14 nt, Mycobacterium tuberculosis H37Rv
caccgcuggaucga

SEQ ID NO: 1296095 - RNA, 20 nt, Mycobacterium tuberculosis H37Rv
caccgcuguugcaucgccgc

SEQ ID NO: 1296096 - RNA, 17 nt, Mycobacterium tuberculosis H37Rv
caccgcugcggccagcg

SEQ ID NO: 1296097 - RNA, 13 nt, Mycobacterium tuberculosis H37Rv
caccggacugcgc

SEQ ID NO: 1296098 - RNA, 23 nt, Mycobacterium tuberculosis H37Rv
caccggacugcgccgggugaggc

SEQ ID NO: 1296099 - RNA, 21 nt, Mycobacterium tuberculosis H37Rv
caccggagaacgggucgacgu

SEQ ID NO: 1296100 - RNA, 14 nt, Mycobacterium tuberculosis H37Rv
caccggaauccccc

SEQ ID NO: 1296101 - RNA, 14 nt, Mycobacterium tuberculosis H37Rv
caccgcuugcuggc

SEQ ID NO: 1296102 - RNA, 22 nt, Mycobacterium tuberculosis H37Rv
caccggaaccaccaguaccacc

SEQ ID NO: 1296103 - RNA, 14 nt, Mycobacterium tuberculosis H37Rv
caccggaggccgcc

SEQ ID NO: 1296104 - RNA, 19 nt, Mycobacterium tuberculosis H37Rv
caccggauacagccacgca

SEQ ID NO: 1296105 - RNA, 16 nt, Mycobacterium tuberculosis H37Rv
caccggagucggcguc

SEQ ID NO: 1296106 - RNA, 14 nt, Mycobacterium tuberculosis H37Rv
caccggauacagcc

SEQ ID NO: 1296107 - RNA, 14 nt, Mycobacterium tuberculosis H37Rv
caccggcaauaccg

SEQ ID NO: 1296108 - RNA, 17 nt, Mycobacterium tuberculosis H37Rv
caccggaucgccgucgc

SEQ ID NO: 1296109 - RNA, 12 nt, Mycobacterium tuberculosis H37Rv
caccggcgucgc

SEQ ID NO: 1296110 - RNA, 22 nt, Mycobacterium tuberculosis H37Rv
caccggcggucugcagugcagc

SEQ ID NO: 1296111 - RNA, 14 nt, Mycobacterium tuberculosis H37Rv
caccggcgucugcc

SEQ ID NO: 1296112 - RNA, 16 nt, Mycobacterium tuberculosis H37Rv
caccggcuggugccaa

SEQ ID NO: 1296113 - RNA, 20 nt, Mycobacterium tuberculosis H37Rv
caccggcuggugccaacugc

SEQ ID NO: 1296114 - RNA, 14 nt, Mycobacterium tuberculosis H37Rv
caccggcugcaacc

SEQ ID NO: 1296115 - RNA, 21 nt, Mycobacterium tuberculosis H37Rv
caccggcugauucgagccaca

SEQ ID NO: 1296116 - RNA, 17 nt, Mycobacterium tuberculosis H37Rv
caccggcugaccgaccc

SEQ ID NO: 1296117 - RNA, 15 nt, Mycobacterium tuberculosis H37Rv
caccggcucgacugc

SEQ ID NO: 1296118 - RNA, 14 nt, Mycobacterium tuberculosis H37Rv
caccggcucgucga

SEQ ID NO: 1296119 - RNA, 16 nt, Mycobacterium tuberculosis H37Rv
caccgggcggcggcga

SEQ ID NO: 1296120 - RNA, 17 nt, Mycobacterium tuberculosis H37Rv
caccgggcgucgucggu

SEQ ID NO: 1296121 - RNA, 22 nt, Mycobacterium tuberculosis H37Rv
caccggcuuggugaaccgcgcg

SEQ ID NO: 1296122 - RNA, 16 nt, Mycobacterium tuberculosis H37Rv
caccgguuugacgucc

SEQ ID NO: 1296123 - RNA, 20 nt, Mycobacterium tuberculosis H37Rv
caccggucgguuaauggguc

SEQ ID NO: 1296124 - RNA, 17 nt, Mycobacterium tuberculosis H37Rv
caccguacgacagucgc

SEQ ID NO: 1296125 - RNA, 22 nt, Mycobacterium tuberculosis H37Rv
caccguacgggacgaagaccgg

SEQ ID NO: 1296126 - RNA, 17 nt, Mycobacterium tuberculosis H37Rv
caccguaggcgaucuca

SEQ ID NO: 1296127 - RNA, 16 nt, Mycobacterium tuberculosis H37Rv
caccgucaacgacugg

SEQ ID NO: 1296128 - RNA, 23 nt, Mycobacterium tuberculosis H37Rv
caccgguucggggggcaggucga

SEQ ID NO: 1296129 - RNA, 20 nt, Mycobacterium tuberculosis H37Rv
caccggucagcgacgcacgc

SEQ ID NO: 1296130 - RNA, 23 nt, Mycobacterium tuberculosis H37Rv
caccgguauguucggcaaugacg

SEQ ID NO: 1296131 - RNA, 14 nt, Mycobacterium tuberculosis H37Rv
caccggugccggcg

SEQ ID NO: 1296132 - RNA, 18 nt, Mycobacterium tuberculosis H37Rv
caccggugcccaccaccg

SEQ ID NO: 1296133 - RNA, 16 nt, Mycobacterium tuberculosis H37Rv
caccgguaccgccacu

SEQ ID NO: 1296134 - RNA, 14 nt, Mycobacterium tuberculosis H37Rv
caccggguucaccg

SEQ ID NO: 1296135 - RNA, 22 nt, Mycobacterium tuberculosis H37Rv
caccgguauguucggcaaugac

SEQ ID NO: 1296136 - RNA, 15 nt, Mycobacterium tuberculosis H37Rv
caccggggacgucga

SEQ ID NO: 1296137 - RNA, 17 nt, Mycobacterium tuberculosis H37Rv
caccgggcggcggcgac

SEQ ID NO: 1296138 - RNA, 18 nt, Mycobacterium tuberculosis H37Rv
caccggggaagaucucgg

SEQ ID NO: 1296139 - RNA, 19 nt, Mycobacterium tuberculosis H37Rv
caccggguccaccgcacgg

SEQ ID NO: 1296140 - RNA, 23 nt, Mycobacterium tuberculosis H37Rv
caccggguccggugaacccgauu

SEQ ID NO: 1296141 - RNA, 19 nt, Mycobacterium tuberculosis H37Rv
caccgggugcgacggcguu

SEQ ID NO: 1296142 - RNA, 12 nt, Mycobacterium tuberculosis H37Rv
caccgggugacc

SEQ ID NO: 1296143 - RNA, 14 nt, Mycobacterium tuberculosis H37Rv
caccgucgacgaca

SEQ ID NO: 1296144 - RNA, 19 nt, Mycobacterium tuberculosis H37Rv
caccguccaauuggcgucg

SEQ ID NO: 1296145 - RNA, 16 nt, Mycobacterium tuberculosis H37Rv
caccguccgucggcgc

SEQ ID NO: 1296146 - RNA, 19 nt, Mycobacterium tuberculosis H37Rv
caccgucaugccgacgaca

SEQ ID NO: 1296147 - RNA, 17 nt, Mycobacterium tuberculosis H37Rv
caccgucaccgccggca

SEQ ID NO: 1296148 - RNA, 17 nt, Mycobacterium tuberculosis H37Rv
caccgucgcaccagcga

SEQ ID NO: 1296149 - RNA, 12 nt, Mycobacterium tuberculosis H37Rv
caccgucggcac

SEQ ID NO: 1296150 - RNA, 17 nt, Mycobacterium tuberculosis H37Rv
caccgucgcggcggcac

SEQ ID NO: 1296151 - RNA, 18 nt, Mycobacterium tuberculosis H37Rv
caccgucguacucggcgg

SEQ ID NO: 1296152 - RNA, 15 nt, Mycobacterium tuberculosis H37Rv
caccgucgagccgga

SEQ ID NO: 1296153 - RNA, 17 nt, Mycobacterium tuberculosis H37Rv
caccgucgccgccgguc

SEQ ID NO: 1296154 - RNA, 18 nt, Mycobacterium tuberculosis H37Rv
caccgucugcuggccggg

SEQ ID NO: 1296155 - RNA, 14 nt, Mycobacterium tuberculosis H37Rv
caccgugaccgccg

SEQ ID NO: 1296156 - RNA, 23 nt, Mycobacterium tuberculosis H37Rv
caccgugacagcggcauugccag

SEQ ID NO: 1296157 - RNA, 13 nt, Mycobacterium tuberculosis H37Rv
caccgugccgacg

SEQ ID NO: 1296158 - RNA, 16 nt, Mycobacterium tuberculosis H37Rv
caccgugcccugggug

SEQ ID NO: 1296159 - RNA, 14 nt, Mycobacterium tuberculosis H37Rv
caccgugcaccagc

SEQ ID NO: 1296160 - RNA, 21 nt, Mycobacterium tuberculosis H37Rv
caccgugcggggggcagcucc

SEQ ID NO: 1296161 - RNA, 18 nt, Mycobacterium tuberculosis H37Rv
caccgugcggaucgcgcu

SEQ ID NO: 1296162 - RNA, 15 nt, Mycobacterium tuberculosis H37Rv
caccgugcgccgaau

SEQ ID NO: 1296163 - RNA, 17 nt, Mycobacterium tuberculosis H37Rv
caccgugcgccgaaugg

SEQ ID NO: 1296164 - RNA, 15 nt, Mycobacterium tuberculosis H37Rv
caccguggaucggca

SEQ ID NO: 1296165 - RNA, 13 nt, Mycobacterium tuberculosis H37Rv
caccguggccgca

SEQ ID NO: 1296166 - RNA, 18 nt, Mycobacterium tuberculosis H37Rv
caccgugucgccggcgaa

SEQ ID NO: 1296167 - RNA, 20 nt, Mycobacterium tuberculosis H37Rv
caccgugugcacgcgauggc

SEQ ID NO: 1296168 - RNA, 21 nt, Mycobacterium tuberculosis H37Rv
caccgugguggcguaucgggc

SEQ ID NO: 1296169 - RNA, 14 nt, Mycobacterium tuberculosis H37Rv
caccgugucgccgg

SEQ ID NO: 1296170 - RNA, 16 nt, Mycobacterium tuberculosis H37Rv
caccgugguucggcgg

SEQ ID NO: 1296171 - RNA, 22 nt, Mycobacterium tuberculosis H37Rv
caccguugcguuggcgccacca

SEQ ID NO: 1296172 - RNA, 17 nt, Mycobacterium tuberculosis H37Rv
caccguugcguuggcgc

SEQ ID NO: 1296173 - RNA, 14 nt, Mycobacterium tuberculosis H37Rv
caccguugccgaac

SEQ ID NO: 1296174 - RNA, 14 nt, Mycobacterium tuberculosis H37Rv
caccguugccgccg

SEQ ID NO: 1296175 - RNA, 21 nt, Mycobacterium tuberculosis H37Rv
caccguugccgccgucaccgc

SEQ ID NO: 1296176 - RNA, 12 nt, Mycobacterium tuberculosis H37Rv
caccucaccagu

SEQ ID NO: 1296177 - RNA, 17 nt, Mycobacterium tuberculosis H37Rv
caccguuugagcggcca

SEQ ID NO: 1296178 - RNA, 13 nt, Mycobacterium tuberculosis H37Rv
caauuggcgucgu

SEQ ID NO: 1296179 - RNA, 14 nt, Mycobacterium tuberculosis H37Rv
caauugggcgaugc

SEQ ID NO: 1296180 - RNA, 20 nt, Mycobacterium tuberculosis H37Rv
cacaacgaucugcuggccga

SEQ ID NO: 1296181 - RNA, 15 nt, Mycobacterium tuberculosis H37Rv
cacaaccgcugcugc

SEQ ID NO: 1296182 - RNA, 19 nt, Mycobacterium tuberculosis H37Rv
caaugccguugaucgcaaa

SEQ ID NO: 1296183 - RNA, 13 nt, Mycobacterium tuberculosis H37Rv
caaugcgagcacc

SEQ ID NO: 1296184 - RNA, 15 nt, Mycobacterium tuberculosis H37Rv
caauggcggcgccgu

SEQ ID NO: 1296185 - RNA, 18 nt, Mycobacterium tuberculosis H37Rv
caauggcggcgccgucga

SEQ ID NO: 1296186 - RNA, 19 nt, Mycobacterium tuberculosis H37Rv
caaugugguucgucgucgu

SEQ ID NO: 1296187 - RNA, 15 nt, Mycobacterium tuberculosis H37Rv
caauggcguucgucg

SEQ ID NO: 1296188 - RNA, 15 nt, Mycobacterium tuberculosis H37Rv
cacaacgcgugacca

SEQ ID NO: 1296189 - RNA, 15 nt, Mycobacterium tuberculosis H37Rv
cacaacgucggcacc

SEQ ID NO: 1296190 - RNA, 15 nt, Mycobacterium tuberculosis H37Rv
cacaacgucgugauc

SEQ ID NO: 1296191 - RNA, 13 nt, Mycobacterium tuberculosis H37Rv
cacaagcgauggc

SEQ ID NO: 1296192 - RNA, 21 nt, Mycobacterium tuberculosis H37Rv
cacaaguagccgacuaucggc

SEQ ID NO: 1296193 - RNA, 21 nt, Mycobacterium tuberculosis H37Rv
cacaauccgcucggucgccuc

SEQ ID NO: 1296194 - RNA, 17 nt, Mycobacterium tuberculosis H37Rv
cacaauccacgucgcgg

SEQ ID NO: 1296195 - RNA, 14 nt, Mycobacterium tuberculosis H37Rv
cacacccccgucug

SEQ ID NO: 1296196 - RNA, 14 nt, Mycobacterium tuberculosis H37Rv
cacacccgcaccgg

SEQ ID NO: 1296197 - RNA, 16 nt, Mycobacterium tuberculosis H37Rv
cacaccgaacagucgc

SEQ ID NO: 1296198 - RNA, 14 nt, Mycobacterium tuberculosis H37Rv
cacaccggagccga

SEQ ID NO: 1296199 - RNA, 17 nt, Mycobacterium tuberculosis H37Rv
caauccacgcacucguc

SEQ ID NO: 1296200 - RNA, 14 nt, Mycobacterium tuberculosis H37Rv
caauccgcucgguc

SEQ ID NO: 1296201 - RNA, 18 nt, Mycobacterium tuberculosis H37Rv
caauccgcaaaacgagcu

SEQ ID NO: 1296202 - RNA, 17 nt, Mycobacterium tuberculosis H37Rv
caauccgcacagcgacg

SEQ ID NO: 1296203 - RNA, 13 nt, Mycobacterium tuberculosis H37Rv
caaucacccagcc

SEQ ID NO: 1296204 - RNA, 18 nt, Mycobacterium tuberculosis H37Rv
caaucacauagccgguca

SEQ ID NO: 1296205 - RNA, 17 nt, Mycobacterium tuberculosis H37Rv
caaucagcccgacaccg

SEQ ID NO: 1296206 - RNA, 19 nt, Mycobacterium tuberculosis H37Rv
caaucucggcguugccgcc

SEQ ID NO: 1296207 - RNA, 12 nt, Mycobacterium tuberculosis H37Rv
caaucucggccg

SEQ ID NO: 1296208 - RNA, 17 nt, Mycobacterium tuberculosis H37Rv
caaucucccauacgccg

SEQ ID NO: 1296209 - RNA, 18 nt, Mycobacterium tuberculosis H37Rv
caaucggauagccgugcu

SEQ ID NO: 1296210 - RNA, 16 nt, Mycobacterium tuberculosis H37Rv
caaucgggaucgcugc

SEQ ID NO: 1296211 - RNA, 17 nt, Mycobacterium tuberculosis H37Rv
caaucggcggcacccgg

SEQ ID NO: 1296212 - RNA, 18 nt, Mycobacterium tuberculosis H37Rv
caaucuucucgagccgcc

SEQ ID NO: 1296213 - RNA, 15 nt, Mycobacterium tuberculosis H37Rv
caauaccgcacccgc

SEQ ID NO: 1296214 - RNA, 20 nt, Mycobacterium tuberculosis H37Rv
caauagcgacagcagcgcca

SEQ ID NO: 1296215 - RNA, 14 nt, Mycobacterium tuberculosis H37Rv
caauagccggaucc

SEQ ID NO: 1296216 - RNA, 22 nt, Mycobacterium tuberculosis H37Rv
caauagcaacucgaucgccuga

SEQ ID NO: 1296217 - RNA, 12 nt, Mycobacterium tuberculosis H37Rv
caauagaccgca

SEQ ID NO: 1296218 - RNA, 19 nt, Mycobacterium tuberculosis H37Rv
caaguggccagcgccaacu

SEQ ID NO: 1296219 - RNA, 13 nt, Mycobacterium tuberculosis H37Rv
caagugucgccgc

SEQ ID NO: 1296220 - RNA, 23 nt, Mycobacterium tuberculosis H37Rv
caauacacguugccgaucccggc

SEQ ID NO: 1296221 - RNA, 20 nt, Mycobacterium tuberculosis H37Rv
caagucgacgguggcgccgu

SEQ ID NO: 1296222 - RNA, 17 nt, Mycobacterium tuberculosis H37Rv
caagucggcaccggugc

SEQ ID NO: 1296223 - RNA, 16 nt, Mycobacterium tuberculosis H37Rv
caagucugugcucacg

SEQ ID NO: 1296224 - RNA, 20 nt, Mycobacterium tuberculosis H37Rv
caaguagccgucgucgucga

SEQ ID NO: 1296225 - RNA, 19 nt, Mycobacterium tuberculosis H37Rv
caaguacgcgaccgcgauc

SEQ ID NO: 1296226 - RNA, 18 nt, Mycobacterium tuberculosis H37Rv
caagucgacacgccgaac

SEQ ID NO: 1296227 - RNA, 15 nt, Mycobacterium tuberculosis H37Rv
caagguguggugaca

SEQ ID NO: 1296228 - RNA, 15 nt, Mycobacterium tuberculosis H37Rv
caagguguugcggug

SEQ ID NO: 1296229 - RNA, 16 nt, Mycobacterium tuberculosis H37Rv
caagggccgacgucgu

SEQ ID NO: 1296230 - RNA, 15 nt, Mycobacterium tuberculosis H37Rv
caaggcucagcagcg

SEQ ID NO: 1296231 - RNA, 13 nt, Mycobacterium tuberculosis H37Rv
caaggacgcaccg

SEQ ID NO: 1296232 - RNA, 15 nt, Mycobacterium tuberculosis H37Rv
caaggccgucgaccc

SEQ ID NO: 1296233 - RNA, 14 nt, Mycobacterium tuberculosis H37Rv
caacucggccagcu

SEQ ID NO: 1296234 - RNA, 12 nt, Mycobacterium tuberculosis H37Rv
caacucggccac

SEQ ID NO: 1296235 - RNA, 20 nt, Mycobacterium tuberculosis H37Rv
caagccgggugggagcagcc

SEQ ID NO: 1296236 - RNA, 17 nt, Mycobacterium tuberculosis H37Rv
caagccuucgucgaugc

SEQ ID NO: 1296237 - RNA, 20 nt, Mycobacterium tuberculosis H37Rv
caagccucguggugagauca

SEQ ID NO: 1296238 - RNA, 15 nt, Mycobacterium tuberculosis H37Rv
caacucccagcacgg

SEQ ID NO: 1296239 - RNA, 17 nt, Mycobacterium tuberculosis H37Rv
caacucgaacgucacca

SEQ ID NO: 1296240 - RNA, 15 nt, Mycobacterium tuberculosis H37Rv
caacucgaucgccug

SEQ ID NO: 1296241 - RNA, 21 nt, Mycobacterium tuberculosis H37Rv
caacucggccacggcgucggc

SEQ ID NO: 1296242 - RNA, 11 nt, Mycobacterium tuberculosis H37Rv
caacucggcag

SEQ ID NO: 1296243 - RNA, 12 nt, Mycobacterium tuberculosis H37Rv
caagcgauggca

SEQ ID NO: 1296244 - RNA, 22 nt, Mycobacterium tuberculosis H37Rv
caagcgauccgagaccgcgugc

SEQ ID NO: 1296245 - RNA, 17 nt, Mycobacterium tuberculosis H37Rv
caagcgcagacacgacc

SEQ ID NO: 1296246 - RNA, 16 nt, Mycobacterium tuberculosis H37Rv
caagcgccgcgcuugc

SEQ ID NO: 1296247 - RNA, 14 nt, Mycobacterium tuberculosis H37Rv
caagcucgacaacu

SEQ ID NO: 1296248 - RNA, 15 nt, Mycobacterium tuberculosis H37Rv
caagcucggccagca

SEQ ID NO: 1296249 - RNA, 15 nt, Mycobacterium tuberculosis H37Rv
caagcucugcgucgu

SEQ ID NO: 1296250 - RNA, 12 nt, Mycobacterium tuberculosis H37Rv
caagcucguccg

SEQ ID NO: 1296251 - RNA, 21 nt, Mycobacterium tuberculosis H37Rv
caagcucguccggugcgaucc

SEQ ID NO: 1296252 - RNA, 18 nt, Mycobacterium tuberculosis H37Rv
caagcugccccgccaccu

SEQ ID NO: 1296253 - RNA, 16 nt, Mycobacterium tuberculosis H37Rv
caaggaacggcgucgu

SEQ ID NO: 1296254 - RNA, 23 nt, Mycobacterium tuberculosis H37Rv
caagcuguuuggggucgcgcugc

SEQ ID NO: 1296255 - RNA, 13 nt, Mycobacterium tuberculosis H37Rv
caacgcugggcgg

SEQ ID NO: 1296256 - RNA, 18 nt, Mycobacterium tuberculosis H37Rv
caacgcuucugccugcgc

SEQ ID NO: 1296257 - RNA, 21 nt, Mycobacterium tuberculosis H37Rv
caacgcguugcacagcagcgg

SEQ ID NO: 1296258 - RNA, 18 nt, Mycobacterium tuberculosis H37Rv
caacgcuucggcagcucc

SEQ ID NO: 1296259 - RNA, 15 nt, Mycobacterium tuberculosis H37Rv
caacgcggugggcac

SEQ ID NO: 1296260 - RNA, 15 nt, Mycobacterium tuberculosis H37Rv
caacgcgucgucggu

SEQ ID NO: 1296261 - RNA, 23 nt, Mycobacterium tuberculosis H37Rv
caacgaucugcuggccgaaccgg

SEQ ID NO: 1296262 - RNA, 22 nt, Mycobacterium tuberculosis H37Rv
caacgcggggaugucgaccgcg

SEQ ID NO: 1296263 - RNA, 16 nt, Mycobacterium tuberculosis H37Rv
caacgcgggugccggg

SEQ ID NO: 1296264 - RNA, 14 nt, Mycobacterium tuberculosis H37Rv
caacgcggugacga

SEQ ID NO: 1296265 - RNA, 16 nt, Mycobacterium tuberculosis H37Rv
caaccugcgcggcgau

SEQ ID NO: 1296266 - RNA, 13 nt, Mycobacterium tuberculosis H37Rv
caaccugcgacca

SEQ ID NO: 1296267 - RNA, 23 nt, Mycobacterium tuberculosis H37Rv
caaccucgucgucaucgaguugc

SEQ ID NO: 1296268 - RNA, 14 nt, Mycobacterium tuberculosis H37Rv
caaccguucccggc

SEQ ID NO: 1296269 - RNA, 23 nt, Mycobacterium tuberculosis H37Rv
caaccuggacugggucgccuccu

SEQ ID NO: 1296270 - RNA, 21 nt, Mycobacterium tuberculosis H37Rv
caacgaucgcgccgucgucga

SEQ ID NO: 1296271 - RNA, 20 nt, Mycobacterium tuberculosis H37Rv
caacgaucccggggugccga

SEQ ID NO: 1296272 - RNA, 19 nt, Mycobacterium tuberculosis H37Rv
caacgaugguggcgaucau

SEQ ID NO: 1296273 - RNA, 21 nt, Mycobacterium tuberculosis H37Rv
caacgacuucgggaacgcucg

SEQ ID NO: 1296274 - RNA, 17 nt, Mycobacterium tuberculosis H37Rv
caacguacgcacgcagc

SEQ ID NO: 1296275 - RNA, 20 nt, Mycobacterium tuberculosis H37Rv
caacggcguuggcgccguua

SEQ ID NO: 1296276 - RNA, 15 nt, Mycobacterium tuberculosis H37Rv
caacggcggcgucgc

SEQ ID NO: 1296277 - RNA, 15 nt, Mycobacterium tuberculosis H37Rv
caacgggaccgaucu

SEQ ID NO: 1296278 - RNA, 23 nt, Mycobacterium tuberculosis H37Rv
caacgugacccggauaucgacca

SEQ ID NO: 1296279 - RNA, 23 nt, Mycobacterium tuberculosis H37Rv
caacgucucuagauauggaccgc

SEQ ID NO: 1296280 - RNA, 20 nt, Mycobacterium tuberculosis H37Rv
caacgugcgcaacgcgucgu

SEQ ID NO: 1296281 - RNA, 18 nt, Mycobacterium tuberculosis H37Rv
caacgugaugcguucggc

SEQ ID NO: 1296282 - RNA, 20 nt, Mycobacterium tuberculosis H37Rv
caacgugguauugacguggc

SEQ ID NO: 1296283 - RNA, 20 nt, Mycobacterium tuberculosis H37Rv
caacguuuugggcgccggag

SEQ ID NO: 1296284 - RNA, 13 nt, Mycobacterium tuberculosis H37Rv
caacguucggcac

SEQ ID NO: 1296285 - RNA, 14 nt, Mycobacterium tuberculosis H37Rv
caacuccacgcgga

SEQ ID NO: 1296286 - RNA, 19 nt, Mycobacterium tuberculosis H37Rv
caacuaucgucgugucgcc

SEQ ID NO: 1296287 - RNA, 13 nt, Mycobacterium tuberculosis H37Rv
caacucaggccgg

SEQ ID NO: 1296288 - RNA, 21 nt, Mycobacterium tuberculosis H37Rv
caacccgccguugccaccggu

SEQ ID NO: 1296289 - RNA, 16 nt, Mycobacterium tuberculosis H37Rv
caacauuggugaggug

SEQ ID NO: 1296290 - RNA, 20 nt, Mycobacterium tuberculosis H37Rv
caaccaauaggugucgacgc

SEQ ID NO: 1296291 - RNA, 21 nt, Mycobacterium tuberculosis H37Rv
caacaccgucggcagcagcgg

SEQ ID NO: 1296292 - RNA, 15 nt, Mycobacterium tuberculosis H37Rv
caacaccucgucggc

SEQ ID NO: 1296293 - RNA, 17 nt, Mycobacterium tuberculosis H37Rv
caacacgagcgguacgc

SEQ ID NO: 1296294 - RNA, 21 nt, Mycobacterium tuberculosis H37Rv
caaccucccucuagcgcccga

SEQ ID NO: 1296295 - RNA, 18 nt, Mycobacterium tuberculosis H37Rv
caaccucgccacgcucgg

SEQ ID NO: 1296296 - RNA, 17 nt, Mycobacterium tuberculosis H37Rv
caaccgugagcaccagc

SEQ ID NO: 1296297 - RNA, 15 nt, Mycobacterium tuberculosis H37Rv
caaccgugagcacca

SEQ ID NO: 1296298 - RNA, 22 nt, Mycobacterium tuberculosis H37Rv
caaccgguguaauugccgacgc

SEQ ID NO: 1296299 - RNA, 21 nt, Mycobacterium tuberculosis H37Rv
caaccgguguaauugccgacg

SEQ ID NO: 1296300 - RNA, 18 nt, Mycobacterium tuberculosis H37Rv
caaccgggaggccaccgc

SEQ ID NO: 1296301 - RNA, 14 nt, Mycobacterium tuberculosis H37Rv
caaccgggacaacc

SEQ ID NO: 1296302 - RNA, 15 nt, Mycobacterium tuberculosis H37Rv
caaccggcggacacc

SEQ ID NO: 1296303 - RNA, 22 nt, Mycobacterium tuberculosis H37Rv
caaccggcgcaguagccgacca

SEQ ID NO: 1296304 - RNA, 15 nt, Mycobacterium tuberculosis H37Rv
caaccggcgaucggu

SEQ ID NO: 1296305 - RNA, 19 nt, Mycobacterium tuberculosis H37Rv
caaccggacgaccggaacg

SEQ ID NO: 1296306 - RNA, 19 nt, Mycobacterium tuberculosis H37Rv
caaccggacgcccucacgc

SEQ ID NO: 1296307 - RNA, 14 nt, Mycobacterium tuberculosis H37Rv
caaccggccgucca

SEQ ID NO: 1296308 - RNA, 15 nt, Mycobacterium tuberculosis H37Rv
caaccgggcgggacu

SEQ ID NO: 1296309 - RNA, 16 nt, Mycobacterium tuberculosis H37Rv
caaccgguacuccugg

SEQ ID NO: 1296310 - RNA, 19 nt, Mycobacterium tuberculosis H37Rv
caaccgggucagcccagcc

SEQ ID NO: 1296311 - RNA, 15 nt, Mycobacterium tuberculosis H37Rv
caaccgcccgaucag

SEQ ID NO: 1296312 - RNA, 19 nt, Mycobacterium tuberculosis H37Rv
caaccgcggccccgacugc

SEQ ID NO: 1296313 - RNA, 16 nt, Mycobacterium tuberculosis H37Rv
caaccgcugucaccgu

SEQ ID NO: 1296314 - RNA, 23 nt, Mycobacterium tuberculosis H37Rv
caaccggacauccgaugcgucac

SEQ ID NO: 1296315 - RNA, 12 nt, Mycobacterium tuberculosis H37Rv
caacccgcucgg

SEQ ID NO: 1296316 - RNA, 17 nt, Mycobacterium tuberculosis H37Rv
caaccgcaccagguguc

SEQ ID NO: 1296317 - RNA, 22 nt, Mycobacterium tuberculosis H37Rv
caacacccggcuagagugcgca

SEQ ID NO: 1296318 - RNA, 17 nt, Mycobacterium tuberculosis H37Rv
caacaccgcgccgacga

SEQ ID NO: 1296319 - RNA, 15 nt, Mycobacterium tuberculosis H37Rv
caacaccgcggcgcu

SEQ ID NO: 1296320 - RNA, 17 nt, Mycobacterium tuberculosis H37Rv
caacaccgcgucaacgc

SEQ ID NO: 1296321 - RNA, 14 nt, Mycobacterium tuberculosis H37Rv
caacacagccgucg

SEQ ID NO: 1296322 - RNA, 17 nt, Mycobacterium tuberculosis H37Rv
caacaaggggcagcacg

SEQ ID NO: 1296323 - RNA, 15 nt, Mycobacterium tuberculosis H37Rv
caacaagucgauggc

SEQ ID NO: 1296324 - RNA, 16 nt, Mycobacterium tuberculosis H37Rv
caacaacgucugcagc

SEQ ID NO: 1296325 - RNA, 16 nt, Mycobacterium tuberculosis H37Rv
caacaacgcuucggcg

SEQ ID NO: 1296326 - RNA, 22 nt, Mycobacterium tuberculosis H37Rv
caaaucaagcacagcccggcga

SEQ ID NO: 1296327 - RNA, 13 nt, Mycobacterium tuberculosis H37Rv
caaauccagcagc

SEQ ID NO: 1296328 - RNA, 14 nt, Mycobacterium tuberculosis H37Rv
caaaugcgcugucg

SEQ ID NO: 1296329 - RNA, 18 nt, Mycobacterium tuberculosis H37Rv
caaaugucguaggccgca

SEQ ID NO: 1296330 - RNA, 23 nt, Mycobacterium tuberculosis H37Rv
caaaucggucgacgaucucgccg

SEQ ID NO: 1296331 - RNA, 15 nt, Mycobacterium tuberculosis H37Rv
caaaucggucgacga

SEQ ID NO: 1296332 - RNA, 15 nt, Mycobacterium tuberculosis H37Rv
auugugggacgcgau

SEQ ID NO: 1296333 - RNA, 22 nt, Mycobacterium tuberculosis H37Rv
auuguugaagaaagcgaccguc

SEQ ID NO: 1296334 - RNA, 19 nt, Mycobacterium tuberculosis H37Rv
caaaccgcuguaaccggua

SEQ ID NO: 1296335 - RNA, 15 nt, Mycobacterium tuberculosis H37Rv
caaagcugcucgucg

SEQ ID NO: 1296336 - RNA, 17 nt, Mycobacterium tuberculosis H37Rv
caaagcgccagcagcca

SEQ ID NO: 1296337 - RNA, 22 nt, Mycobacterium tuberculosis H37Rv
caaagcgccagcagccacccga

SEQ ID NO: 1296338 - RNA, 15 nt, Mycobacterium tuberculosis H37Rv
caaacuuucgggaca

SEQ ID NO: 1296339 - RNA, 14 nt, Mycobacterium tuberculosis H37Rv
caaagcgacagcgc

SEQ ID NO: 1296340 - RNA, 20 nt, Mycobacterium tuberculosis H37Rv
augucggccaccggcgucug

SEQ ID NO: 1296341 - RNA, 13 nt, Mycobacterium tuberculosis H37Rv
augucggcaggua

SEQ ID NO: 1296342 - RNA, 17 nt, Mycobacterium tuberculosis H37Rv
augucagcggccugcuc

SEQ ID NO: 1296343 - RNA, 13 nt, Mycobacterium tuberculosis H37Rv
augucgucgacca

SEQ ID NO: 1296344 - RNA, 15 nt, Mycobacterium tuberculosis H37Rv
augucguugucugcc

SEQ ID NO: 1296345 - RNA, 23 nt, Mycobacterium tuberculosis H37Rv
augucuccgacauuggccgucau

SEQ ID NO: 1296346 - RNA, 19 nt, Mycobacterium tuberculosis H37Rv
augucuccaguagccggug

SEQ ID NO: 1296347 - RNA, 20 nt, Mycobacterium tuberculosis H37Rv
augugccaggugcggugauc

SEQ ID NO: 1296348 - RNA, 18 nt, Mycobacterium tuberculosis H37Rv
augugcccaugaugcucg

SEQ ID NO: 1296349 - RNA, 20 nt, Mycobacterium tuberculosis H37Rv
augugaucacccgcaucggc

SEQ ID NO: 1296350 - RNA, 22 nt, Mycobacterium tuberculosis H37Rv
auguggcgucgcucgucgucac

SEQ ID NO: 1296351 - RNA, 19 nt, Mycobacterium tuberculosis H37Rv
auguggccgccgucgacgu

SEQ ID NO: 1296352 - RNA, 16 nt, Mycobacterium tuberculosis H37Rv
auguggccggcgaugg

SEQ ID NO: 1296353 - RNA, 16 nt, Mycobacterium tuberculosis H37Rv
augugugagucccacg

SEQ ID NO: 1296354 - RNA, 14 nt, Mycobacterium tuberculosis H37Rv
auguucauccgcag

SEQ ID NO: 1296355 - RNA, 23 nt, Mycobacterium tuberculosis H37Rv
augggggugcuuccucgcgagcu

SEQ ID NO: 1296356 - RNA, 21 nt, Mycobacterium tuberculosis H37Rv
augggguguuugucgcggugg

SEQ ID NO: 1296357 - RNA, 19 nt, Mycobacterium tuberculosis H37Rv
auggggucagcucgccagc

SEQ ID NO: 1296358 - RNA, 13 nt, Mycobacterium tuberculosis H37Rv
auggguagccgcc

SEQ ID NO: 1296359 - RNA, 15 nt, Mycobacterium tuberculosis H37Rv
augggucaccucgga

SEQ ID NO: 1296360 - RNA, 13 nt, Mycobacterium tuberculosis H37Rv
augguaccgccac

SEQ ID NO: 1296361 - RNA, 14 nt, Mycobacterium tuberculosis H37Rv
auggguggccagca

SEQ ID NO: 1296362 - RNA, 16 nt, Mycobacterium tuberculosis H37Rv
augguguccucgucga

SEQ ID NO: 1296363 - RNA, 17 nt, Mycobacterium tuberculosis H37Rv
augguggugaugccauc

SEQ ID NO: 1296364 - RNA, 18 nt, Mycobacterium tuberculosis H37Rv
augguggggaccgcgaug

SEQ ID NO: 1296365 - RNA, 15 nt, Mycobacterium tuberculosis H37Rv
auggugggucgacga

SEQ ID NO: 1296366 - RNA, 22 nt, Mycobacterium tuberculosis H37Rv
auggugggucgacgaucucucc

SEQ ID NO: 1296367 - RNA, 14 nt, Mycobacterium tuberculosis H37Rv
auguauuccaggcg

SEQ ID NO: 1296368 - RNA, 17 nt, Mycobacterium tuberculosis H37Rv
augggagucgucguguu

SEQ ID NO: 1296369 - RNA, 13 nt, Mycobacterium tuberculosis H37Rv
auggcuugcucug

SEQ ID NO: 1296370 - RNA, 19 nt, Mycobacterium tuberculosis H37Rv
auggcgaacacgucggcca

SEQ ID NO: 1296371 - RNA, 19 nt, Mycobacterium tuberculosis H37Rv
augggcugcgcgucgagca

SEQ ID NO: 1296372 - RNA, 20 nt, Mycobacterium tuberculosis H37Rv
augggcugaggaacgccggc

SEQ ID NO: 1296373 - RNA, 15 nt, Mycobacterium tuberculosis H37Rv
augggggagccggug

SEQ ID NO: 1296374 - RNA, 22 nt, Mycobacterium tuberculosis H37Rv
auggggcucgaguguggccgaa

SEQ ID NO: 1296375 - RNA, 13 nt, Mycobacterium tuberculosis H37Rv
auggggaacgggu

SEQ ID NO: 1296376 - RNA, 18 nt, Mycobacterium tuberculosis H37Rv
augggcgagaaguccggg

SEQ ID NO: 1296377 - RNA, 22 nt, Mycobacterium tuberculosis H37Rv
augggacacaauccacgucgcg

SEQ ID NO: 1296378 - RNA, 17 nt, Mycobacterium tuberculosis H37Rv
augggcagcugguaacc

SEQ ID NO: 1296379 - RNA, 18 nt, Mycobacterium tuberculosis H37Rv
augggccgguuccucagc

SEQ ID NO: 1296380 - RNA, 15 nt, Mycobacterium tuberculosis H37Rv
augcgguccucgauc

SEQ ID NO: 1296381 - RNA, 18 nt, Mycobacterium tuberculosis H37Rv
augcgguccucgaucggu

SEQ ID NO: 1296382 - RNA, 15 nt, Mycobacterium tuberculosis H37Rv
augcggucggccaca

SEQ ID NO: 1296383 - RNA, 21 nt, Mycobacterium tuberculosis H37Rv
augcgggucugcggucaucgc

SEQ ID NO: 1296384 - RNA, 14 nt, Mycobacterium tuberculosis H37Rv
augcggugcggauc

SEQ ID NO: 1296385 - RNA, 22 nt, Mycobacterium tuberculosis H37Rv
augcggugguaggacgccagca

SEQ ID NO: 1296386 - RNA, 19 nt, Mycobacterium tuberculosis H37Rv
augcgguucucgagcucgg

SEQ ID NO: 1296387 - RNA, 22 nt, Mycobacterium tuberculosis H37Rv
augcggucgucacggaccgcca

SEQ ID NO: 1296388 - RNA, 19 nt, Mycobacterium tuberculosis H37Rv
augcgggccaucaagcgau

SEQ ID NO: 1296389 - RNA, 17 nt, Mycobacterium tuberculosis H37Rv
augcggcggcgcucguc

SEQ ID NO: 1296390 - RNA, 15 nt, Mycobacterium tuberculosis H37Rv
augcugcgcgccguu

SEQ ID NO: 1296391 - RNA, 20 nt, Mycobacterium tuberculosis H37Rv
augcugccagccauggccgc

SEQ ID NO: 1296392 - RNA, 21 nt, Mycobacterium tuberculosis H37Rv
augcugccagccauggccgcc

SEQ ID NO: 1296393 - RNA, 15 nt, Mycobacterium tuberculosis H37Rv
augcugccgcugcga

SEQ ID NO: 1296394 - RNA, 15 nt, Mycobacterium tuberculosis H37Rv
augcugagccgguca

SEQ ID NO: 1296395 - RNA, 14 nt, Mycobacterium tuberculosis H37Rv
augcugcacccgga

SEQ ID NO: 1296396 - RNA, 22 nt, Mycobacterium tuberculosis H37Rv
augcgcagugcaccgcgucgua

SEQ ID NO: 1296397 - RNA, 20 nt, Mycobacterium tuberculosis H37Rv
augcgauuccgcgucugcuc

SEQ ID NO: 1296398 - RNA, 15 nt, Mycobacterium tuberculosis H37Rv
augcgauugccgucg

SEQ ID NO: 1296399 - RNA, 20 nt, Mycobacterium tuberculosis H37Rv
augcgauucugcgucugcuc

SEQ ID NO: 1296400 - RNA, 19 nt, Mycobacterium tuberculosis H37Rv
augcgcaauagaccgcagu

SEQ ID NO: 1296401 - RNA, 22 nt, Mycobacterium tuberculosis H37Rv
augcggcaggugcccaucgggu

SEQ ID NO: 1296402 - RNA, 13 nt, Mycobacterium tuberculosis H37Rv
augcggcaggugc

SEQ ID NO: 1296403 - RNA, 16 nt, Mycobacterium tuberculosis H37Rv
augcgccagcgagcgc

SEQ ID NO: 1296404 - RNA, 21 nt, Mycobacterium tuberculosis H37Rv
augcgccauuucgagggcaac

SEQ ID NO: 1296405 - RNA, 22 nt, Mycobacterium tuberculosis H37Rv
augcgccaucucgacggugacc

SEQ ID NO: 1296406 - RNA, 21 nt, Mycobacterium tuberculosis H37Rv
auggccacccgcggaauccgc

SEQ ID NO: 1296407 - RNA, 21 nt, Mycobacterium tuberculosis H37Rv
auggcauuaccacuucggcgu

SEQ ID NO: 1296408 - RNA, 22 nt, Mycobacterium tuberculosis H37Rv
auggcauuaccacuucggcguc

SEQ ID NO: 1296409 - RNA, 14 nt, Mycobacterium tuberculosis H37Rv
auggccaucuggcc

SEQ ID NO: 1296410 - RNA, 17 nt, Mycobacterium tuberculosis H37Rv
auggccaggcuggcguc

SEQ ID NO: 1296411 - RNA, 13 nt, Mycobacterium tuberculosis H37Rv
auggcagcgccga

SEQ ID NO: 1296412 - RNA, 17 nt, Mycobacterium tuberculosis H37Rv
auggaugggucgaccgg

SEQ ID NO: 1296413 - RNA, 16 nt, Mycobacterium tuberculosis H37Rv
auggaccgccgccgac

SEQ ID NO: 1296414 - RNA, 17 nt, Mycobacterium tuberculosis H37Rv
auggaaugaucggcguc

SEQ ID NO: 1296415 - RNA, 20 nt, Mycobacterium tuberculosis H37Rv
auggaucccacgaguuggcc

SEQ ID NO: 1296416 - RNA, 19 nt, Mycobacterium tuberculosis H37Rv
augcuggcaaaguaucgca

SEQ ID NO: 1296417 - RNA, 12 nt, Mycobacterium tuberculosis H37Rv
auucugcgucug

SEQ ID NO: 1296418 - RNA, 19 nt, Mycobacterium tuberculosis H37Rv
auucugcgucugcucgcga

SEQ ID NO: 1296419 - RNA, 14 nt, Mycobacterium tuberculosis H37Rv
auucugcugccagc

SEQ ID NO: 1296420 - RNA, 18 nt, Mycobacterium tuberculosis H37Rv
auucgcgacaacucgcga

SEQ ID NO: 1296421 - RNA, 12 nt, Mycobacterium tuberculosis H37Rv
auucggccgcga

SEQ ID NO: 1296422 - RNA, 15 nt, Mycobacterium tuberculosis H37Rv
auucggacucgccga

SEQ ID NO: 1296423 - RNA, 16 nt, Mycobacterium tuberculosis H37Rv
auucacgaugcucgcc

SEQ ID NO: 1296424 - RNA, 14 nt, Mycobacterium tuberculosis H37Rv
auucacgagccgcu

SEQ ID NO: 1296425 - RNA, 23 nt, Mycobacterium tuberculosis H37Rv
auguuggugucaaugacaccggg

SEQ ID NO: 1296426 - RNA, 16 nt, Mycobacterium tuberculosis H37Rv
auguugcccugcaacc

SEQ ID NO: 1296427 - RNA, 19 nt, Mycobacterium tuberculosis H37Rv
auuccgcgucugcucgcga

SEQ ID NO: 1296428 - RNA, 20 nt, Mycobacterium tuberculosis H37Rv
auuccgcgucugcucggcgg

SEQ ID NO: 1296429 - RNA, 15 nt, Mycobacterium tuberculosis H37Rv
auuccgguggcaucc

SEQ ID NO: 1296430 - RNA, 17 nt, Mycobacterium tuberculosis H37Rv
auuccggcucaccgauc

SEQ ID NO: 1296431 - RNA, 13 nt, Mycobacterium tuberculosis H37Rv
auugcucgaucug

SEQ ID NO: 1296432 - RNA, 16 nt, Mycobacterium tuberculosis H37Rv
auugcgggagccucgc

SEQ ID NO: 1296433 - RNA, 21 nt, Mycobacterium tuberculosis H37Rv
auugcggaacaccaccaggcu

SEQ ID NO: 1296434 - RNA, 15 nt, Mycobacterium tuberculosis H37Rv
auugccgucgggguc

SEQ ID NO: 1296435 - RNA, 17 nt, Mycobacterium tuberculosis H37Rv
auugccggcgacgauau

SEQ ID NO: 1296436 - RNA, 16 nt, Mycobacterium tuberculosis H37Rv
auugcgcccggccaug

SEQ ID NO: 1296437 - RNA, 20 nt, Mycobacterium tuberculosis H37Rv
auugcgcgggcaucgucguc

SEQ ID NO: 1296438 - RNA, 14 nt, Mycobacterium tuberculosis H37Rv
auuggcgccgucac

SEQ ID NO: 1296439 - RNA, 20 nt, Mycobacterium tuberculosis H37Rv
auugggcgauucugcgucug

SEQ ID NO: 1296440 - RNA, 20 nt, Mycobacterium tuberculosis H37Rv
auugggugccguugcgucug

SEQ ID NO: 1296441 - RNA, 13 nt, Mycobacterium tuberculosis H37Rv
auugguaccggcu

SEQ ID NO: 1296442 - RNA, 17 nt, Mycobacterium tuberculosis H37Rv
auuggucgagucgauga

SEQ ID NO: 1296443 - RNA, 19 nt, Mycobacterium tuberculosis H37Rv
auugacccccuagaccggg

SEQ ID NO: 1296444 - RNA, 14 nt, Mycobacterium tuberculosis H37Rv
auugaggaagccgu

SEQ ID NO: 1296445 - RNA, 14 nt, Mycobacterium tuberculosis H37Rv
auugaacagcggau

SEQ ID NO: 1296446 - RNA, 17 nt, Mycobacterium tuberculosis H37Rv
auucuuggugaucgcga

SEQ ID NO: 1296447 - RNA, 22 nt, Mycobacterium tuberculosis H37Rv
auugcaugguuucguuccucga

SEQ ID NO: 1296448 - RNA, 14 nt, Mycobacterium tuberculosis H37Rv
auugccgaugguca

SEQ ID NO: 1296449 - RNA, 15 nt, Mycobacterium tuberculosis H37Rv
auugaugaucugcag

SEQ ID NO: 1296450 - RNA, 17 nt, Mycobacterium tuberculosis H37Rv
auugauuccgaccccgc

SEQ ID NO: 1296451 - RNA, 16 nt, Mycobacterium tuberculosis H37Rv
aucggcagaauccggu

SEQ ID NO: 1296452 - RNA, 22 nt, Mycobacterium tuberculosis H37Rv
aucggcaagacgcggucgacga

SEQ ID NO: 1296453 - RNA, 13 nt, Mycobacterium tuberculosis H37Rv
aucggcaccccgg

SEQ ID NO: 1296454 - RNA, 12 nt, Mycobacterium tuberculosis H37Rv
aucggcggaucg

SEQ ID NO: 1296455 - RNA, 13 nt, Mycobacterium tuberculosis H37Rv
aucggcgcgucga

SEQ ID NO: 1296456 - RNA, 14 nt, Mycobacterium tuberculosis H37Rv
aucggcgccgcaua

SEQ ID NO: 1296457 - RNA, 17 nt, Mycobacterium tuberculosis H37Rv
aucggcgaaucgggcaa

SEQ ID NO: 1296458 - RNA, 13 nt, Mycobacterium tuberculosis H37Rv
aucggcgacagga

SEQ ID NO: 1296459 - RNA, 22 nt, Mycobacterium tuberculosis H37Rv
aucggccgugaauucgccgaac

SEQ ID NO: 1296460 - RNA, 19 nt, Mycobacterium tuberculosis H37Rv
aucgcuccgcggcgcagca

SEQ ID NO: 1296461 - RNA, 18 nt, Mycobacterium tuberculosis H37Rv
aucgcucugugucgccga

SEQ ID NO: 1296462 - RNA, 16 nt, Mycobacterium tuberculosis H37Rv
aucgcucucggucagu

SEQ ID NO: 1296463 - RNA, 14 nt, Mycobacterium tuberculosis H37Rv
aucgcucucgguca

SEQ ID NO: 1296464 - RNA, 17 nt, Mycobacterium tuberculosis H37Rv
aucggauggcggccaca

SEQ ID NO: 1296465 - RNA, 23 nt, Mycobacterium tuberculosis H37Rv
aucggagucuucaacgucgagau

SEQ ID NO: 1296466 - RNA, 23 nt, Mycobacterium tuberculosis H37Rv
aucgcggcaucgacgcggccaac

SEQ ID NO: 1296467 - RNA, 23 nt, Mycobacterium tuberculosis H37Rv
aucgcgcucauguucucgaccgc

SEQ ID NO: 1296468 - RNA, 21 nt, Mycobacterium tuberculosis H37Rv
aucgcgcggcugugcccgauc

SEQ ID NO: 1296469 - RNA, 16 nt, Mycobacterium tuberculosis H37Rv
aucgcgccgucgucga

SEQ ID NO: 1296470 - RNA, 23 nt, Mycobacterium tuberculosis H37Rv
aucgccgcgcuggucggagacca

SEQ ID NO: 1296471 - RNA, 17 nt, Mycobacterium tuberculosis H37Rv
aucgccgucagcaccgc

SEQ ID NO: 1296472 - RNA, 18 nt, Mycobacterium tuberculosis H37Rv
aucgccgggugcaggcga

SEQ ID NO: 1296473 - RNA, 14 nt, Mycobacterium tuberculosis H37Rv
aucgcgauuccggc

SEQ ID NO: 1296474 - RNA, 24 nt, Mycobacterium tuberculosis H37Rv
aucgcgaucggggcgacgauccgc

SEQ ID NO: 1296475 - RNA, 22 nt, Mycobacterium tuberculosis H37Rv
aucgagcaguucucggucccgc

SEQ ID NO: 1296476 - RNA, 15 nt, Mycobacterium tuberculosis H37Rv
aucgagcccggagcg

SEQ ID NO: 1296477 - RNA, 21 nt, Mycobacterium tuberculosis H37Rv
aucgacugaucgccacccggu

SEQ ID NO: 1296478 - RNA, 18 nt, Mycobacterium tuberculosis H37Rv
aucgagcgggaucgggcc

SEQ ID NO: 1296479 - RNA, 16 nt, Mycobacterium tuberculosis H37Rv
aucgaggagaugccga

SEQ ID NO: 1296480 - RNA, 17 nt, Mycobacterium tuberculosis H37Rv
aucgagcgggaucgggc

SEQ ID NO: 1296481 - RNA, 16 nt, Mycobacterium tuberculosis H37Rv
auccggcaaccaccgg

SEQ ID NO: 1296482 - RNA, 17 nt, Mycobacterium tuberculosis H37Rv
auccggcaaccaccggc

SEQ ID NO: 1296483 - RNA, 19 nt, Mycobacterium tuberculosis H37Rv
auccgggcaaccgaugacg

SEQ ID NO: 1296484 - RNA, 23 nt, Mycobacterium tuberculosis H37Rv
auccggcgggugccgagcuggcg

SEQ ID NO: 1296485 - RNA, 19 nt, Mycobacterium tuberculosis H37Rv
auccggaucccaccaccgc

SEQ ID NO: 1296486 - RNA, 19 nt, Mycobacterium tuberculosis H37Rv
auccuccggguuggcgacg

SEQ ID NO: 1296487 - RNA, 15 nt, Mycobacterium tuberculosis H37Rv
auccuccucgucgac

SEQ ID NO: 1296488 - RNA, 18 nt, Mycobacterium tuberculosis H37Rv
auccuccucgucgacguc

SEQ ID NO: 1296489 - RNA, 22 nt, Mycobacterium tuberculosis H37Rv
auccuccucgucgacgucggca

SEQ ID NO: 1296490 - RNA, 22 nt, Mycobacterium tuberculosis H37Rv
auccuaggguggcgauccacag

SEQ ID NO: 1296491 - RNA, 19 nt, Mycobacterium tuberculosis H37Rv
auccggguggcgucaccgc

SEQ ID NO: 1296492 - RNA, 14 nt, Mycobacterium tuberculosis H37Rv
auccggguggcguc

SEQ ID NO: 1296493 - RNA, 13 nt, Mycobacterium tuberculosis H37Rv
auccgugucgaga

SEQ ID NO: 1296494 - RNA, 16 nt, Mycobacterium tuberculosis H37Rv
auccgugucgagaucu

SEQ ID NO: 1296495 - RNA, 13 nt, Mycobacterium tuberculosis H37Rv
auccggucagcgc

SEQ ID NO: 1296496 - RNA, 23 nt, Mycobacterium tuberculosis H37Rv
auccgcagugagcaaugccaacg

SEQ ID NO: 1296497 - RNA, 19 nt, Mycobacterium tuberculosis H37Rv
auccgcaccacgcccgacg

SEQ ID NO: 1296498 - RNA, 23 nt, Mycobacterium tuberculosis H37Rv
auccgcaccccauacucggcggc

SEQ ID NO: 1296499 - RNA, 21 nt, Mycobacterium tuberculosis H37Rv
auccgacaagcugucggcgac

SEQ ID NO: 1296500 - RNA, 15 nt, Mycobacterium tuberculosis H37Rv
auccgacgucgacga

SEQ ID NO: 1296501 - RNA, 15 nt, Mycobacterium tuberculosis H37Rv
auccgacgaccgcau

SEQ ID NO: 1296502 - RNA, 19 nt, Mycobacterium tuberculosis H37Rv
auccgaccugcucgauacg

SEQ ID NO: 1296503 - RNA, 22 nt, Mycobacterium tuberculosis H37Rv
aucagcggcaguuccugacgcc

SEQ ID NO: 1296504 - RNA, 16 nt, Mycobacterium tuberculosis H37Rv
aucagcgugucgccga

SEQ ID NO: 1296505 - RNA, 23 nt, Mycobacterium tuberculosis H37Rv
aucagcgguacguaaucgagcgc

SEQ ID NO: 1296506 - RNA, 16 nt, Mycobacterium tuberculosis H37Rv
aucgacaucaccaccg

SEQ ID NO: 1296507 - RNA, 13 nt, Mycobacterium tuberculosis H37Rv
aucgacagccccg

SEQ ID NO: 1296508 - RNA, 20 nt, Mycobacterium tuberculosis H37Rv
aucgaccaccucgaugccgc

SEQ ID NO: 1296509 - RNA, 18 nt, Mycobacterium tuberculosis H37Rv
aucgaccaauucgaccgc

SEQ ID NO: 1296510 - RNA, 11 nt, Mycobacterium tuberculosis H37Rv
aucgaccgcgg

SEQ ID NO: 1296511 - RNA, 18 nt, Mycobacterium tuberculosis H37Rv
aucgacccuccagcacgc

SEQ ID NO: 1296512 - RNA, 21 nt, Mycobacterium tuberculosis H37Rv
aucgacccuccagcacgccgu

SEQ ID NO: 1296513 - RNA, 20 nt, Mycobacterium tuberculosis H37Rv
aucgaccgaacgccagguca

SEQ ID NO: 1296514 - RNA, 17 nt, Mycobacterium tuberculosis H37Rv
aucgacccggucgacgg

SEQ ID NO: 1296515 - RNA, 15 nt, Mycobacterium tuberculosis H37Rv
aucgaccuggccacg

SEQ ID NO: 1296516 - RNA, 19 nt, Mycobacterium tuberculosis H37Rv
aucgacgagcgauacgucg

SEQ ID NO: 1296517 - RNA, 22 nt, Mycobacterium tuberculosis H37Rv
aucgacgagcgauacgucguca

SEQ ID NO: 1296518 - RNA, 18 nt, Mycobacterium tuberculosis H37Rv
aucgacaccgagccacga

SEQ ID NO: 1296519 - RNA, 19 nt, Mycobacterium tuberculosis H37Rv
aucgaauuaaagccaccag

SEQ ID NO: 1296520 - RNA, 18 nt, Mycobacterium tuberculosis H37Rv
auccucgauggaccgcca

SEQ ID NO: 1296521 - RNA, 13 nt, Mycobacterium tuberculosis H37Rv
auccucucgauca

SEQ ID NO: 1296522 - RNA, 15 nt, Mycobacterium tuberculosis H37Rv
auccuggucaccagc

SEQ ID NO: 1296523 - RNA, 17 nt, Mycobacterium tuberculosis H37Rv
auccugguugaggacuu

SEQ ID NO: 1296524 - RNA, 19 nt, Mycobacterium tuberculosis H37Rv
aucgaaagccaacucgacc

SEQ ID NO: 1296525 - RNA, 17 nt, Mycobacterium tuberculosis H37Rv
aucgaaagccaacucga

SEQ ID NO: 1296526 - RNA, 16 nt, Mycobacterium tuberculosis H37Rv
augaacgcaaccgagg

SEQ ID NO: 1296527 - RNA, 19 nt, Mycobacterium tuberculosis H37Rv
augaacgccagcagcgcga

SEQ ID NO: 1296528 - RNA, 23 nt, Mycobacterium tuberculosis H37Rv
augaacgccagcagcgcgaucug

SEQ ID NO: 1296529 - RNA, 13 nt, Mycobacterium tuberculosis H37Rv
augaacucggcga

SEQ ID NO: 1296530 - RNA, 17 nt, Mycobacterium tuberculosis H37Rv
augaacgggaucgaccc

SEQ ID NO: 1296531 - RNA, 16 nt, Mycobacterium tuberculosis H37Rv
augacaaaccugcaug

SEQ ID NO: 1296532 - RNA, 15 nt, Mycobacterium tuberculosis H37Rv
augacaccggccacc

SEQ ID NO: 1296533 - RNA, 21 nt, Mycobacterium tuberculosis H37Rv
augaauuuggugaagugaacc

SEQ ID NO: 1296534 - RNA, 13 nt, Mycobacterium tuberculosis H37Rv
augaccaccgguu

SEQ ID NO: 1296535 - RNA, 21 nt, Mycobacterium tuberculosis H37Rv
augaccaucgaggcgaucacc

SEQ ID NO: 1296536 - RNA, 20 nt, Mycobacterium tuberculosis H37Rv
augaccgcucgugcaaucgc

SEQ ID NO: 1296537 - RNA, 15 nt, Mycobacterium tuberculosis H37Rv
augaccucggcgacg

SEQ ID NO: 1296538 - RNA, 13 nt, Mycobacterium tuberculosis H37Rv
augacgacgccgu

SEQ ID NO: 1296539 - RNA, 15 nt, Mycobacterium tuberculosis H37Rv
augacgacggugacc

SEQ ID NO: 1296540 - RNA, 14 nt, Mycobacterium tuberculosis H37Rv
augagguucaucgc

SEQ ID NO: 1296541 - RNA, 14 nt, Mycobacterium tuberculosis H37Rv
augacgaucgcggc

SEQ ID NO: 1296542 - RNA, 17 nt, Mycobacterium tuberculosis H37Rv
augacgcagucgcccac

SEQ ID NO: 1296543 - RNA, 21 nt, Mycobacterium tuberculosis H37Rv
augacgccgucggcgcgcacc

SEQ ID NO: 1296544 - RNA, 11 nt, Mycobacterium tuberculosis H37Rv
augaucgccga

SEQ ID NO: 1296545 - RNA, 15 nt, Mycobacterium tuberculosis H37Rv
augaucacaccgagc

SEQ ID NO: 1296546 - RNA, 15 nt, Mycobacterium tuberculosis H37Rv
augcaggacucgcgu

SEQ ID NO: 1296547 - RNA, 21 nt, Mycobacterium tuberculosis H37Rv
augauguagcggcguuccggg

SEQ ID NO: 1296548 - RNA, 15 nt, Mycobacterium tuberculosis H37Rv
augauggcgcgaucg

SEQ ID NO: 1296549 - RNA, 16 nt, Mycobacterium tuberculosis H37Rv
aucugcugcucgauca

SEQ ID NO: 1296550 - RNA, 16 nt, Mycobacterium tuberculosis H37Rv
aucugcugcgagaucu

SEQ ID NO: 1296551 - RNA, 16 nt, Mycobacterium tuberculosis H37Rv
aucucggagcgcacga

SEQ ID NO: 1296552 - RNA, 18 nt, Mycobacterium tuberculosis H37Rv
aucugcgggccggugaac

SEQ ID NO: 1296553 - RNA, 17 nt, Mycobacterium tuberculosis H37Rv
aucugcgggucggcauc

SEQ ID NO: 1296554 - RNA, 14 nt, Mycobacterium tuberculosis H37Rv
aucugcgcgaugcc

SEQ ID NO: 1296555 - RNA, 13 nt, Mycobacterium tuberculosis H37Rv
aucuguccgcgaa

SEQ ID NO: 1296556 - RNA, 13 nt, Mycobacterium tuberculosis H37Rv
aucuggucgacga

SEQ ID NO: 1296557 - RNA, 17 nt, Mycobacterium tuberculosis H37Rv
aucuugucgaucugccc

SEQ ID NO: 1296558 - RNA, 17 nt, Mycobacterium tuberculosis H37Rv
aucuuggccagcagcgc

SEQ ID NO: 1296559 - RNA, 19 nt, Mycobacterium tuberculosis H37Rv
aucuugccgucggccggca

SEQ ID NO: 1296560 - RNA, 23 nt, Mycobacterium tuberculosis H37Rv
aucuucuccucgucgguuccggg

SEQ ID NO: 1296561 - RNA, 16 nt, Mycobacterium tuberculosis H37Rv
aucggcguuaucgaag

SEQ ID NO: 1296562 - RNA, 22 nt, Mycobacterium tuberculosis H37Rv
aucggcgucaggcacaacgcga

SEQ ID NO: 1296563 - RNA, 22 nt, Mycobacterium tuberculosis H37Rv
aucggcggccugcucgcagauc

SEQ ID NO: 1296564 - RNA, 16 nt, Mycobacterium tuberculosis H37Rv
aucgucgugucgccgc

SEQ ID NO: 1296565 - RNA, 23 nt, Mycobacterium tuberculosis H37Rv
aucgucguugucagcgaacggcc

SEQ ID NO: 1296566 - RNA, 13 nt, Mycobacterium tuberculosis H37Rv
aucgucucgguga

SEQ ID NO: 1296567 - RNA, 19 nt, Mycobacterium tuberculosis H37Rv
aucgucugacgaaauccgc

SEQ ID NO: 1296568 - RNA, 19 nt, Mycobacterium tuberculosis H37Rv
aucgucugguggcagcgca

SEQ ID NO: 1296569 - RNA, 16 nt, Mycobacterium tuberculosis H37Rv
aucgucuugucgccga

SEQ ID NO: 1296570 - RNA, 15 nt, Mycobacterium tuberculosis H37Rv
aucgugcagguugcc

SEQ ID NO: 1296571 - RNA, 20 nt, Mycobacterium tuberculosis H37Rv
aucuagaugcggaacgccga

SEQ ID NO: 1296572 - RNA, 16 nt, Mycobacterium tuberculosis H37Rv
aucuaccuuauggcga

SEQ ID NO: 1296573 - RNA, 17 nt, Mycobacterium tuberculosis H37Rv
aucucgacggccucguc

SEQ ID NO: 1296574 - RNA, 21 nt, Mycobacterium tuberculosis H37Rv
aucucgaaggccgccaaccgu

SEQ ID NO: 1296575 - RNA, 17 nt, Mycobacterium tuberculosis H37Rv
aucucgaccagcgccga

SEQ ID NO: 1296576 - RNA, 19 nt, Mycobacterium tuberculosis H37Rv
aucuccucggcgaugccgu

SEQ ID NO: 1296577 - RNA, 22 nt, Mycobacterium tuberculosis H37Rv
aucuccuccugugcgaugguca

SEQ ID NO: 1296578 - RNA, 13 nt, Mycobacterium tuberculosis H37Rv
aucuccucggcga

SEQ ID NO: 1296579 - RNA, 23 nt, Mycobacterium tuberculosis H37Rv
aucuccuccuugagccgggcaac

SEQ ID NO: 1296580 - RNA, 13 nt, Mycobacterium tuberculosis H37Rv
aucuccggcuggc

SEQ ID NO: 1296581 - RNA, 17 nt, Mycobacterium tuberculosis H37Rv
aucuccgccaaccgggu

SEQ ID NO: 1296582 - RNA, 23 nt, Mycobacterium tuberculosis H37Rv
aucucccgaccgccgagcggguu

SEQ ID NO: 1296583 - RNA, 20 nt, Mycobacterium tuberculosis H37Rv
accgcggcaagaguugccgg

SEQ ID NO: 1296584 - RNA, 17 nt, Mycobacterium tuberculosis H37Rv
accgcggccgcggucga

SEQ ID NO: 1296585 - RNA, 18 nt, Mycobacterium tuberculosis H37Rv
accgcggcccggacgucg

SEQ ID NO: 1296586 - RNA, 16 nt, Mycobacterium tuberculosis H37Rv
accgccgucaccgcca

SEQ ID NO: 1296587 - RNA, 15 nt, Mycobacterium tuberculosis H37Rv
accgcggacccgcag

SEQ ID NO: 1296588 - RNA, 22 nt, Mycobacterium tuberculosis H37Rv
accgcggacccgcagcugcgga

SEQ ID NO: 1296589 - RNA, 12 nt, Mycobacterium tuberculosis H37Rv
accgccgucgcc

SEQ ID NO: 1296590 - RNA, 16 nt, Mycobacterium tuberculosis H37Rv
accgccgggaagccgc

SEQ ID NO: 1296591 - RNA, 21 nt, Mycobacterium tuberculosis H37Rv
accgccggcgccgccgucgcc

SEQ ID NO: 1296592 - RNA, 17 nt, Mycobacterium tuberculosis H37Rv
accgccgggaucaccgg

SEQ ID NO: 1296593 - RNA, 20 nt, Mycobacterium tuberculosis H37Rv
accgccgggcccucgccaug

SEQ ID NO: 1296594 - RNA, 15 nt, Mycobacterium tuberculosis H37Rv
accgccggugcugac

SEQ ID NO: 1296595 - RNA, 14 nt, Mycobacterium tuberculosis H37Rv
accgcgguagccga

SEQ ID NO: 1296596 - RNA, 17 nt, Mycobacterium tuberculosis H37Rv
accgcgguagccgagcu

SEQ ID NO: 1296597 - RNA, 16 nt, Mycobacterium tuberculosis H37Rv
accgcggucgcugcga

SEQ ID NO: 1296598 - RNA, 17 nt, Mycobacterium tuberculosis H37Rv
accgcggcugucacgcc

SEQ ID NO: 1296599 - RNA, 22 nt, Mycobacterium tuberculosis H37Rv
accgcgggaucgguggcggcac

SEQ ID NO: 1296600 - RNA, 20 nt, Mycobacterium tuberculosis H37Rv
accgcgggcggcaucgccga

SEQ ID NO: 1296601 - RNA, 14 nt, Mycobacterium tuberculosis H37Rv
accgcggcgucgcc

SEQ ID NO: 1296602 - RNA, 16 nt, Mycobacterium tuberculosis H37Rv
accgcggcgucgccgu

SEQ ID NO: 1296603 - RNA, 19 nt, Mycobacterium tuberculosis H37Rv
accgcggcgaucugcgaca

SEQ ID NO: 1296604 - RNA, 17 nt, Mycobacterium tuberculosis H37Rv
accgcguacaggccggc

SEQ ID NO: 1296605 - RNA, 22 nt, Mycobacterium tuberculosis H37Rv
accgcguagaccagugaccgca

SEQ ID NO: 1296606 - RNA, 23 nt, Mycobacterium tuberculosis H37Rv
accgcgguggccagaucgaacgc

SEQ ID NO: 1296607 - RNA, 18 nt, Mycobacterium tuberculosis H37Rv
accgcggugugcguguca

SEQ ID NO: 1296608 - RNA, 14 nt, Mycobacterium tuberculosis H37Rv
accgcugcggcacc

SEQ ID NO: 1296609 - RNA, 15 nt, Mycobacterium tuberculosis H37Rv
accggaaucggcggc

SEQ ID NO: 1296610 - RNA, 23 nt, Mycobacterium tuberculosis H37Rv
accggaccgaagaccuccucggu

SEQ ID NO: 1296611 - RNA, 17 nt, Mycobacterium tuberculosis H37Rv
accggacaaagcugcuc

SEQ ID NO: 1296612 - RNA, 17 nt, Mycobacterium tuberculosis H37Rv
accggacaaacaucgca

SEQ ID NO: 1296613 - RNA, 22 nt, Mycobacterium tuberculosis H37Rv
accggacgaaacgaucgcgcca

SEQ ID NO: 1296614 - RNA, 15 nt, Mycobacterium tuberculosis H37Rv
accgcuggaucgcgu

SEQ ID NO: 1296615 - RNA, 22 nt, Mycobacterium tuberculosis H37Rv
accgcuggaaaaucgggucaca

SEQ ID NO: 1296616 - RNA, 17 nt, Mycobacterium tuberculosis H37Rv
accgcuggaucgacuuc

SEQ ID NO: 1296617 - RNA, 16 nt, Mycobacterium tuberculosis H37Rv
accgcugggucgccgu

SEQ ID NO: 1296618 - RNA, 19 nt, Mycobacterium tuberculosis H37Rv
accgcugggggcggucgcc

SEQ ID NO: 1296619 - RNA, 21 nt, Mycobacterium tuberculosis H37Rv
accgcugggggcggucgccuc

SEQ ID NO: 1296620 - RNA, 17 nt, Mycobacterium tuberculosis H37Rv
accgcuguucuugguga

SEQ ID NO: 1296621 - RNA, 15 nt, Mycobacterium tuberculosis H37Rv
accgcugucagccga

SEQ ID NO: 1296622 - RNA, 21 nt, Mycobacterium tuberculosis H37Rv
accggccaacagucgcagcac

SEQ ID NO: 1296623 - RNA, 22 nt, Mycobacterium tuberculosis H37Rv
accggccacgaccucgggaucg

SEQ ID NO: 1296624 - RNA, 17 nt, Mycobacterium tuberculosis H37Rv
accggccccaccggcac

SEQ ID NO: 1296625 - RNA, 15 nt, Mycobacterium tuberculosis H37Rv
accggcccaguggga

SEQ ID NO: 1296626 - RNA, 16 nt, Mycobacterium tuberculosis H37Rv
accggcccccggucga

SEQ ID NO: 1296627 - RNA, 15 nt, Mycobacterium tuberculosis H37Rv
accggcccgaugacc

SEQ ID NO: 1296628 - RNA, 19 nt, Mycobacterium tuberculosis H37Rv
accggcccgcagcagcauc

SEQ ID NO: 1296629 - RNA, 18 nt, Mycobacterium tuberculosis H37Rv
accggcccgcauccgcac

SEQ ID NO: 1296630 - RNA, 21 nt, Mycobacterium tuberculosis H37Rv
accggcaugccgccaugcgca

SEQ ID NO: 1296631 - RNA, 20 nt, Mycobacterium tuberculosis H37Rv
accggcaugccgccaugcgc

SEQ ID NO: 1296632 - RNA, 19 nt, Mycobacterium tuberculosis H37Rv
accggcaucgaagugcggc

SEQ ID NO: 1296633 - RNA, 20 nt, Mycobacterium tuberculosis H37Rv
accggcacgucgucguccca

SEQ ID NO: 1296634 - RNA, 16 nt, Mycobacterium tuberculosis H37Rv
accggagcgccgagcu

SEQ ID NO: 1296635 - RNA, 20 nt, Mycobacterium tuberculosis H37Rv
accggacgaaacgaucgcgc

SEQ ID NO: 1296636 - RNA, 20 nt, Mycobacterium tuberculosis H37Rv
accggagaacgggucgacgu

SEQ ID NO: 1296637 - RNA, 21 nt, Mycobacterium tuberculosis H37Rv
accggagaacgggucgacguu

SEQ ID NO: 1296638 - RNA, 16 nt, Mycobacterium tuberculosis H37Rv
accggcgucguugacc

SEQ ID NO: 1296639 - RNA, 20 nt, Mycobacterium tuberculosis H37Rv
accggcgggcgaacgcuuca

SEQ ID NO: 1296640 - RNA, 15 nt, Mycobacterium tuberculosis H37Rv
accggcgggcgaacg

SEQ ID NO: 1296641 - RNA, 19 nt, Mycobacterium tuberculosis H37Rv
accggcguugcguagacga

SEQ ID NO: 1296642 - RNA, 21 nt, Mycobacterium tuberculosis H37Rv
accggcugguugaccgaguug

SEQ ID NO: 1296643 - RNA, 21 nt, Mycobacterium tuberculosis H37Rv
accggcgccccugucgaccgc

SEQ ID NO: 1296644 - RNA, 14 nt, Mycobacterium tuberculosis H37Rv
accggcgccucauc

SEQ ID NO: 1296645 - RNA, 18 nt, Mycobacterium tuberculosis H37Rv
accggcgccgccgucgcc

SEQ ID NO: 1296646 - RNA, 20 nt, Mycobacterium tuberculosis H37Rv
accggcgcaguagccgacca

SEQ ID NO: 1296647 - RNA, 21 nt, Mycobacterium tuberculosis H37Rv
accggcgcccagcgccucgau

SEQ ID NO: 1296648 - RNA, 15 nt, Mycobacterium tuberculosis H37Rv
accggcgccaccgug

SEQ ID NO: 1296649 - RNA, 17 nt, Mycobacterium tuberculosis H37Rv
accggcgcaguagccga

SEQ ID NO: 1296650 - RNA, 20 nt, Mycobacterium tuberculosis H37Rv
accgucgaaaaaucgaucgu

SEQ ID NO: 1296651 - RNA, 22 nt, Mycobacterium tuberculosis H37Rv
accgucgaaccaugguugauga

SEQ ID NO: 1296652 - RNA, 19 nt, Mycobacterium tuberculosis H37Rv
accgucccugugucgccgu

SEQ ID NO: 1296653 - RNA, 12 nt, Mycobacterium tuberculosis H37Rv
accguccgcgga

SEQ ID NO: 1296654 - RNA, 17 nt, Mycobacterium tuberculosis H37Rv
accgucgagucgacggc

SEQ ID NO: 1296655 - RNA, 16 nt, Mycobacterium tuberculosis H37Rv
accgucgcuaugcgcc

SEQ ID NO: 1296656 - RNA, 16 nt, Mycobacterium tuberculosis H37Rv
accgucgcgggucaca

SEQ ID NO: 1296657 - RNA, 16 nt, Mycobacterium tuberculosis H37Rv
accgucgcggcggcac

SEQ ID NO: 1296658 - RNA, 14 nt, Mycobacterium tuberculosis H37Rv
accgucgcggguca

SEQ ID NO: 1296659 - RNA, 14 nt, Mycobacterium tuberculosis H37Rv
accgucgagccgga

SEQ ID NO: 1296660 - RNA, 23 nt, Mycobacterium tuberculosis H37Rv
accgucuccggcgccaccgccgc

SEQ ID NO: 1296661 - RNA, 14 nt, Mycobacterium tuberculosis H37Rv
accgucucgcaccg

SEQ ID NO: 1296662 - RNA, 22 nt, Mycobacterium tuberculosis H37Rv
accgucuggaguucgucaccgu

SEQ ID NO: 1296663 - RNA, 20 nt, Mycobacterium tuberculosis H37Rv
accgucuggaguucgucacc

SEQ ID NO: 1296664 - RNA, 16 nt, Mycobacterium tuberculosis H37Rv
accgucgucaccgcga

SEQ ID NO: 1296665 - RNA, 14 nt, Mycobacterium tuberculosis H37Rv
accgucgucaccgc

SEQ ID NO: 1296666 - RNA, 21 nt, Mycobacterium tuberculosis H37Rv
accgucguccgccgcagcgca

SEQ ID NO: 1296667 - RNA, 14 nt, Mycobacterium tuberculosis H37Rv
accgugaccgccgc

SEQ ID NO: 1296668 - RNA, 15 nt, Mycobacterium tuberculosis H37Rv
accgugagcaccagc

SEQ ID NO: 1296669 - RNA, 15 nt, Mycobacterium tuberculosis H37Rv
accguggccucgaag

SEQ ID NO: 1296670 - RNA, 20 nt, Mycobacterium tuberculosis H37Rv
accgugcugggcaucaccga

SEQ ID NO: 1296671 - RNA, 16 nt, Mycobacterium tuberculosis H37Rv
accgugcacgucagcg

SEQ ID NO: 1296672 - RNA, 21 nt, Mycobacterium tuberculosis H37Rv
accgugcgccgaauggcggug

SEQ ID NO: 1296673 - RNA, 17 nt, Mycobacterium tuberculosis H37Rv
accgugccgucggcgug

SEQ ID NO: 1296674 - RNA, 12 nt, Mycobacterium tuberculosis H37Rv
accgugccgucg

SEQ ID NO: 1296675 - RNA, 23 nt, Mycobacterium tuberculosis H37Rv
accguggcggccuccuccccgac

SEQ ID NO: 1296676 - RNA, 14 nt, Mycobacterium tuberculosis H37Rv
accguggcggggaa

SEQ ID NO: 1296677 - RNA, 21 nt, Mycobacterium tuberculosis H37Rv
accgugucgccggcgaaguug

SEQ ID NO: 1296678 - RNA, 14 nt, Mycobacterium tuberculosis H37Rv
accguugaccucuu

SEQ ID NO: 1296679 - RNA, 21 nt, Mycobacterium tuberculosis H37Rv
accguugccgaaccacgcgcc

SEQ ID NO: 1296680 - RNA, 23 nt, Mycobacterium tuberculosis H37Rv
accguucguucccgcucgggcaa

SEQ ID NO: 1296681 - RNA, 21 nt, Mycobacterium tuberculosis H37Rv
accguucgcucagggugucga

SEQ ID NO: 1296682 - RNA, 21 nt, Mycobacterium tuberculosis H37Rv
accguguugcugucgaaguug

SEQ ID NO: 1296683 - RNA, 19 nt, Mycobacterium tuberculosis H37Rv
accguuaccgccgucgcca

SEQ ID NO: 1296684 - RNA, 22 nt, Mycobacterium tuberculosis H37Rv
accgggcaaaucaagcacagcc

SEQ ID NO: 1296685 - RNA, 16 nt, Mycobacterium tuberculosis H37Rv
accgggcccgacgcgu

SEQ ID NO: 1296686 - RNA, 19 nt, Mycobacterium tuberculosis H37Rv
accgggccgcacggucagc

SEQ ID NO: 1296687 - RNA, 23 nt, Mycobacterium tuberculosis H37Rv
accgggccgcacggucagcgcgc

SEQ ID NO: 1296688 - RNA, 18 nt, Mycobacterium tuberculosis H37Rv
accgggacagcagccgga

SEQ ID NO: 1296689 - RNA, 16 nt, Mycobacterium tuberculosis H37Rv
accggugccugcaacg

SEQ ID NO: 1296690 - RNA, 21 nt, Mycobacterium tuberculosis H37Rv
accggucgaccaauuggucga

SEQ ID NO: 1296691 - RNA, 19 nt, Mycobacterium tuberculosis H37Rv
accgguccugggauccggc

SEQ ID NO: 1296692 - RNA, 15 nt, Mycobacterium tuberculosis H37Rv
accggucggcagcuu

SEQ ID NO: 1296693 - RNA, 21 nt, Mycobacterium tuberculosis H37Rv
accggucgguguagcaacggu

SEQ ID NO: 1296694 - RNA, 15 nt, Mycobacterium tuberculosis H37Rv
accgguguagcagcg

SEQ ID NO: 1296695 - RNA, 14 nt, Mycobacterium tuberculosis H37Rv
accgguguagcagc

SEQ ID NO: 1296696 - RNA, 18 nt, Mycobacterium tuberculosis H37Rv
accggugcccaccaccga

SEQ ID NO: 1296697 - RNA, 21 nt, Mycobacterium tuberculosis H37Rv
accgguggcagccugcugcac

SEQ ID NO: 1296698 - RNA, 13 nt, Mycobacterium tuberculosis H37Rv
accgguggaaacc

SEQ ID NO: 1296699 - RNA, 17 nt, Mycobacterium tuberculosis H37Rv
accggugcugucgacgu

SEQ ID NO: 1296700 - RNA, 22 nt, Mycobacterium tuberculosis H37Rv
accgguuggguagcaccgauuu

SEQ ID NO: 1296701 - RNA, 17 nt, Mycobacterium tuberculosis H37Rv
accgguucccgggcagc

SEQ ID NO: 1296702 - RNA, 22 nt, Mycobacterium tuberculosis H37Rv
accgguguugguauguaaguug

SEQ ID NO: 1296703 - RNA, 14 nt, Mycobacterium tuberculosis H37Rv
accgguucggcgua

SEQ ID NO: 1296704 - RNA, 22 nt, Mycobacterium tuberculosis H37Rv
accguaauuucuucacggucga

SEQ ID NO: 1296705 - RNA, 17 nt, Mycobacterium tuberculosis H37Rv
accgguuucuucggcca

SEQ ID NO: 1296706 - RNA, 16 nt, Mycobacterium tuberculosis H37Rv
accgguuucuucggcc

SEQ ID NO: 1296707 - RNA, 20 nt, Mycobacterium tuberculosis H37Rv
accgucacaagucgacacgc

SEQ ID NO: 1296708 - RNA, 14 nt, Mycobacterium tuberculosis H37Rv
accgucagcgcgac

SEQ ID NO: 1296709 - RNA, 15 nt, Mycobacterium tuberculosis H37Rv
accgucagcgcgacc

SEQ ID NO: 1296710 - RNA, 14 nt, Mycobacterium tuberculosis H37Rv
accgucaugccgac

SEQ ID NO: 1296711 - RNA, 15 nt, Mycobacterium tuberculosis H37Rv
accgccgccgccgac

SEQ ID NO: 1296712 - RNA, 16 nt, Mycobacterium tuberculosis H37Rv
accgccgccgccgcgu

SEQ ID NO: 1296713 - RNA, 13 nt, Mycobacterium tuberculosis H37Rv
accgccggcgacg

SEQ ID NO: 1296714 - RNA, 16 nt, Mycobacterium tuberculosis H37Rv
accgccgcgaccgccu

SEQ ID NO: 1296715 - RNA, 16 nt, Mycobacterium tuberculosis H37Rv
accgccgcgaccgcga

SEQ ID NO: 1296716 - RNA, 18 nt, Mycobacterium tuberculosis H37Rv
accgccgcgcagccgcuc

SEQ ID NO: 1296717 - RNA, 15 nt, Mycobacterium tuberculosis H37Rv
accgccgcgccggca

SEQ ID NO: 1296718 - RNA, 16 nt, Mycobacterium tuberculosis H37Rv
accgcccccagcgguu

SEQ ID NO: 1296719 - RNA, 15 nt, Mycobacterium tuberculosis H37Rv
accgcccccagcggu

SEQ ID NO: 1296720 - RNA, 15 nt, Mycobacterium tuberculosis H37Rv
accgccaugaacucg

SEQ ID NO: 1296721 - RNA, 22 nt, Mycobacterium tuberculosis H37Rv
accgcccgccaggccguugccc

SEQ ID NO: 1296722 - RNA, 23 nt, Mycobacterium tuberculosis H37Rv
accgccccgccguugaacggcac

SEQ ID NO: 1296723 - RNA, 17 nt, Mycobacterium tuberculosis H37Rv
accgccaccccggucgg

SEQ ID NO: 1296724 - RNA, 15 nt, Mycobacterium tuberculosis H37Rv
accgccaccacccag

SEQ ID NO: 1296725 - RNA, 14 nt, Mycobacterium tuberculosis H37Rv
accgccaccacggu

SEQ ID NO: 1296726 - RNA, 16 nt, Mycobacterium tuberculosis H37Rv
accgccaccacgguca

SEQ ID NO: 1296727 - RNA, 22 nt, Mycobacterium tuberculosis H37Rv
accgccagcugggcagccagau

SEQ ID NO: 1296728 - RNA, 17 nt, Mycobacterium tuberculosis H37Rv
accgccaccuuggcguu

SEQ ID NO: 1296729 - RNA, 15 nt, Mycobacterium tuberculosis H37Rv
accgcaaggcccaca

SEQ ID NO: 1296730 - RNA, 22 nt, Mycobacterium tuberculosis H37Rv
accgcaaucauccgaucgccgc

SEQ ID NO: 1296731 - RNA, 16 nt, Mycobacterium tuberculosis H37Rv
accgcaacucgccgaa

SEQ ID NO: 1296732 - RNA, 22 nt, Mycobacterium tuberculosis H37Rv
accgauggcucacaugcccgca

SEQ ID NO: 1296733 - RNA, 13 nt, Mycobacterium tuberculosis H37Rv
accgaucggcgcg

SEQ ID NO: 1296734 - RNA, 15 nt, Mycobacterium tuberculosis H37Rv
accgaucuuggccac

SEQ ID NO: 1296735 - RNA, 17 nt, Mycobacterium tuberculosis H37Rv
accgaucuuggccaccg

SEQ ID NO: 1296736 - RNA, 18 nt, Mycobacterium tuberculosis H37Rv
accgaugaucucacccag

SEQ ID NO: 1296737 - RNA, 17 nt, Mycobacterium tuberculosis H37Rv
accgauccggccgccga

SEQ ID NO: 1296738 - RNA, 21 nt, Mycobacterium tuberculosis H37Rv
accgagcgcccuccucgaugc

SEQ ID NO: 1296739 - RNA, 16 nt, Mycobacterium tuberculosis H37Rv
accgagcugagcggcc

SEQ ID NO: 1296740 - RNA, 20 nt, Mycobacterium tuberculosis H37Rv
accgagcgcaaucgaccacg

SEQ ID NO: 1296741 - RNA, 14 nt, Mycobacterium tuberculosis H37Rv
accgaggaccucgu

SEQ ID NO: 1296742 - RNA, 21 nt, Mycobacterium tuberculosis H37Rv
accgaggaacuugcauccggc

SEQ ID NO: 1296743 - RNA, 14 nt, Mycobacterium tuberculosis H37Rv
accgaggccgccga

SEQ ID NO: 1296744 - RNA, 16 nt, Mycobacterium tuberculosis H37Rv
accgaggugccgcgca

SEQ ID NO: 1296745 - RNA, 22 nt, Mycobacterium tuberculosis H37Rv
accgagggucgggcauuccggu

SEQ ID NO: 1296746 - RNA, 16 nt, Mycobacterium tuberculosis H37Rv
accgagggccgucaca

SEQ ID NO: 1296747 - RNA, 23 nt, Mycobacterium tuberculosis H37Rv
accgagggccgucacaggccgcc

SEQ ID NO: 1296748 - RNA, 15 nt, Mycobacterium tuberculosis H37Rv
accgagggucgggca

SEQ ID NO: 1296749 - RNA, 14 nt, Mycobacterium tuberculosis H37Rv
accgaggucggcca

SEQ ID NO: 1296750 - RNA, 21 nt, Mycobacterium tuberculosis H37Rv
accgaagagcuccgucgcggc

SEQ ID NO: 1296751 - RNA, 13 nt, Mycobacterium tuberculosis H37Rv
accgaagaagccc

SEQ ID NO: 1296752 - RNA, 15 nt, Mycobacterium tuberculosis H37Rv
accgaauaccgccgc

SEQ ID NO: 1296753 - RNA, 14 nt, Mycobacterium tuberculosis H37Rv
accgaagucugcag

SEQ ID NO: 1296754 - RNA, 13 nt, Mycobacterium tuberculosis H37Rv
accgaaucggcac

SEQ ID NO: 1296755 - RNA, 15 nt, Mycobacterium tuberculosis H37Rv
accgaagcggugacc

SEQ ID NO: 1296756 - RNA, 18 nt, Mycobacterium tuberculosis H37Rv
accgaauggccgccgcag

SEQ ID NO: 1296757 - RNA, 19 nt, Mycobacterium tuberculosis H37Rv
accgacgccgucgagcacg

SEQ ID NO: 1296758 - RNA, 15 nt, Mycobacterium tuberculosis H37Rv
accgacgcugaaguu

SEQ ID NO: 1296759 - RNA, 18 nt, Mycobacterium tuberculosis H37Rv
accgacggaaugucagcc

SEQ ID NO: 1296760 - RNA, 14 nt, Mycobacterium tuberculosis H37Rv
accgacgucgccca

SEQ ID NO: 1296761 - RNA, 15 nt, Mycobacterium tuberculosis H37Rv
accgagaucaccgcc

SEQ ID NO: 1296762 - RNA, 17 nt, Mycobacterium tuberculosis H37Rv
accgagacuugcuggcc

SEQ ID NO: 1296763 - RNA, 14 nt, Mycobacterium tuberculosis H37Rv
accgagaucaccgc

SEQ ID NO: 1296764 - RNA, 22 nt, Mycobacterium tuberculosis H37Rv
accgagaugcgcaauagaccgc

SEQ ID NO: 1296765 - RNA, 17 nt, Mycobacterium tuberculosis H37Rv
accgagaucaccgccac

SEQ ID NO: 1296766 - RNA, 18 nt, Mycobacterium tuberculosis H37Rv
accgagcaucucgucguc

SEQ ID NO: 1296767 - RNA, 15 nt, Mycobacterium tuberculosis H37Rv
accgagcacaucgcc

SEQ ID NO: 1296768 - RNA, 20 nt, Mycobacterium tuberculosis H37Rv
accgagcaccucggccagcg

SEQ ID NO: 1296769 - RNA, 21 nt, Mycobacterium tuberculosis H37Rv
accgagcacggguagcgucca

SEQ ID NO: 1296770 - RNA, 17 nt, Mycobacterium tuberculosis H37Rv
accgagccgucagcguc

SEQ ID NO: 1296771 - RNA, 22 nt, Mycobacterium tuberculosis H37Rv
acccgcacuccacgaucggccc

SEQ ID NO: 1296772 - RNA, 17 nt, Mycobacterium tuberculosis H37Rv
acccgcacuccaaguca

SEQ ID NO: 1296773 - RNA, 21 nt, Mycobacterium tuberculosis H37Rv
acccgcacguagaaguaggcg

SEQ ID NO: 1296774 - RNA, 21 nt, Mycobacterium tuberculosis H37Rv
acccgcaauuccggugaucgc

SEQ ID NO: 1296775 - RNA, 23 nt, Mycobacterium tuberculosis H37Rv
acccgcaacuacggcguccccga

SEQ ID NO: 1296776 - RNA, 16 nt, Mycobacterium tuberculosis H37Rv
acccgcaccgccggca

SEQ ID NO: 1296777 - RNA, 12 nt, Mycobacterium tuberculosis H37Rv
acccgcaccgcc

SEQ ID NO: 1296778 - RNA, 14 nt, Mycobacterium tuberculosis H37Rv
acccgcaccaccgg

SEQ ID NO: 1296779 - RNA, 16 nt, Mycobacterium tuberculosis H37Rv
acccgcaccucaccgg

SEQ ID NO: 1296780 - RNA, 21 nt, Mycobacterium tuberculosis H37Rv
acccgcgcgagcagcuacagc

SEQ ID NO: 1296781 - RNA, 16 nt, Mycobacterium tuberculosis H37Rv
acccgcgcgucgccca

SEQ ID NO: 1296782 - RNA, 13 nt, Mycobacterium tuberculosis H37Rv
acccgcgccgcca

SEQ ID NO: 1296783 - RNA, 21 nt, Mycobacterium tuberculosis H37Rv
acccgcgcaaucaggaaccgc

SEQ ID NO: 1296784 - RNA, 15 nt, Mycobacterium tuberculosis H37Rv
acccgcaaugaccgc

SEQ ID NO: 1296785 - RNA, 22 nt, Mycobacterium tuberculosis H37Rv
acccaacgcggugggcacagcc

SEQ ID NO: 1296786 - RNA, 14 nt, Mycobacterium tuberculosis H37Rv
acccaagucgccga

SEQ ID NO: 1296787 - RNA, 14 nt, Mycobacterium tuberculosis H37Rv
acccaauaggcgaa

SEQ ID NO: 1296788 - RNA, 20 nt, Mycobacterium tuberculosis H37Rv
acccaauccggcgccagcag

SEQ ID NO: 1296789 - RNA, 17 nt, Mycobacterium tuberculosis H37Rv
acccaccgaagcgaacg

SEQ ID NO: 1296790 - RNA, 12 nt, Mycobacterium tuberculosis H37Rv
acccaccgcucg

SEQ ID NO: 1296791 - RNA, 14 nt, Mycobacterium tuberculosis H37Rv
acccgacaugcgcc

SEQ ID NO: 1296792 - RNA, 20 nt, Mycobacterium tuberculosis H37Rv
acccacaugacgaucgcggc

SEQ ID NO: 1296793 - RNA, 24 nt, Mycobacterium tuberculosis H37Rv
acccaccagugcaucgaucaccgc

SEQ ID NO: 1296794 - RNA, 18 nt, Mycobacterium tuberculosis H37Rv
acccacccgcaccgccgg

SEQ ID NO: 1296795 - RNA, 12 nt, Mycobacterium tuberculosis H37Rv
acccgacccgau

SEQ ID NO: 1296796 - RNA, 11 nt, Mycobacterium tuberculosis H37Rv
acccgagauca

SEQ ID NO: 1296797 - RNA, 19 nt, Mycobacterium tuberculosis H37Rv
acccgagcgcucgaucacg

SEQ ID NO: 1296798 - RNA, 22 nt, Mycobacterium tuberculosis H37Rv
acccgagcucuuggagcuuggc

SEQ ID NO: 1296799 - RNA, 14 nt, Mycobacterium tuberculosis H37Rv
acccgaguucgggc

SEQ ID NO: 1296800 - RNA, 16 nt, Mycobacterium tuberculosis H37Rv
acccgagaucaccggu

SEQ ID NO: 1296801 - RNA, 15 nt, Mycobacterium tuberculosis H37Rv
acccgcucggccguc

SEQ ID NO: 1296802 - RNA, 15 nt, Mycobacterium tuberculosis H37Rv
acccgcucggcgguc

SEQ ID NO: 1296803 - RNA, 17 nt, Mycobacterium tuberculosis H37Rv
acccgcucggccgucag

SEQ ID NO: 1296804 - RNA, 14 nt, Mycobacterium tuberculosis H37Rv
acccgcucggccgc

SEQ ID NO: 1296805 - RNA, 15 nt, Mycobacterium tuberculosis H37Rv
acccgggcagccugc

SEQ ID NO: 1296806 - RNA, 18 nt, Mycobacterium tuberculosis H37Rv
acccgggaugaccaccgg

SEQ ID NO: 1296807 - RNA, 19 nt, Mycobacterium tuberculosis H37Rv
acccgggccaggcugcgca

SEQ ID NO: 1296808 - RNA, 12 nt, Mycobacterium tuberculosis H37Rv
acccgggccacg

SEQ ID NO: 1296809 - RNA, 16 nt, Mycobacterium tuberculosis H37Rv
acccgggccucggcgc

SEQ ID NO: 1296810 - RNA, 17 nt, Mycobacterium tuberculosis H37Rv
acccgggccucggcgcc

SEQ ID NO: 1296811 - RNA, 14 nt, Mycobacterium tuberculosis H37Rv
acccgggcgaccuc

SEQ ID NO: 1296812 - RNA, 18 nt, Mycobacterium tuberculosis H37Rv
acccggucggguccaacg

SEQ ID NO: 1296813 - RNA, 22 nt, Mycobacterium tuberculosis H37Rv
acccggucggguccaacgccgc

SEQ ID NO: 1296814 - RNA, 15 nt, Mycobacterium tuberculosis H37Rv
acccggugacccgcu

SEQ ID NO: 1296815 - RNA, 14 nt, Mycobacterium tuberculosis H37Rv
acccggucggcagc

SEQ ID NO: 1296816 - RNA, 16 nt, Mycobacterium tuberculosis H37Rv
acccggucgccgguca

SEQ ID NO: 1296817 - RNA, 14 nt, Mycobacterium tuberculosis H37Rv
acccgguaguccgc

SEQ ID NO: 1296818 - RNA, 20 nt, Mycobacterium tuberculosis H37Rv
acccgguaugcgcgucccca

SEQ ID NO: 1296819 - RNA, 19 nt, Mycobacterium tuberculosis H37Rv
acccgguccauucguccgc

SEQ ID NO: 1296820 - RNA, 16 nt, Mycobacterium tuberculosis H37Rv
acccuggucgaaacgg

SEQ ID NO: 1296821 - RNA, 13 nt, Mycobacterium tuberculosis H37Rv
acccugucgcgca

SEQ ID NO: 1296822 - RNA, 22 nt, Mycobacterium tuberculosis H37Rv
acccuucgccgggcaacgcgaa

SEQ ID NO: 1296823 - RNA, 19 nt, Mycobacterium tuberculosis H37Rv
acccugucgcgcaccggau

SEQ ID NO: 1296824 - RNA, 17 nt, Mycobacterium tuberculosis H37Rv
accgaacccgccaccgc

SEQ ID NO: 1296825 - RNA, 16 nt, Mycobacterium tuberculosis H37Rv
acccgguggcaccaua

SEQ ID NO: 1296826 - RNA, 22 nt, Mycobacterium tuberculosis H37Rv
acccguacccacgacgggccga

SEQ ID NO: 1296827 - RNA, 18 nt, Mycobacterium tuberculosis H37Rv
acccucaagggcaaccgc

SEQ ID NO: 1296828 - RNA, 21 nt, Mycobacterium tuberculosis H37Rv
acccguuggauguuuuccggu

SEQ ID NO: 1296829 - RNA, 19 nt, Mycobacterium tuberculosis H37Rv
acccguucgugagcggcca

SEQ ID NO: 1296830 - RNA, 13 nt, Mycobacterium tuberculosis H37Rv
acccguucucggu

SEQ ID NO: 1296831 - RNA, 19 nt, Mycobacterium tuberculosis H37Rv
acccguaggguggccgacg

SEQ ID NO: 1296832 - RNA, 14 nt, Mycobacterium tuberculosis H37Rv
accagcccagcggc

SEQ ID NO: 1296833 - RNA, 22 nt, Mycobacterium tuberculosis H37Rv
accagccccgcuggucgaccgg

SEQ ID NO: 1296834 - RNA, 15 nt, Mycobacterium tuberculosis H37Rv
accagccagcgagga

SEQ ID NO: 1296835 - RNA, 17 nt, Mycobacterium tuberculosis H37Rv
accagcauucucgccga

SEQ ID NO: 1296836 - RNA, 14 nt, Mycobacterium tuberculosis H37Rv
accagcaucguggc

SEQ ID NO: 1296837 - RNA, 14 nt, Mycobacterium tuberculosis H37Rv
accagcaucucggc

SEQ ID NO: 1296838 - RNA, 18 nt, Mycobacterium tuberculosis H37Rv
accagcacggcgaucggu

SEQ ID NO: 1296839 - RNA, 23 nt, Mycobacterium tuberculosis H37Rv
accagcacgacggcaucgucgac

SEQ ID NO: 1296840 - RNA, 23 nt, Mycobacterium tuberculosis H37Rv
accagcacaccgguugacagcuc

SEQ ID NO: 1296841 - RNA, 18 nt, Mycobacterium tuberculosis H37Rv
accagcgagcccagcugc

SEQ ID NO: 1296842 - RNA, 16 nt, Mycobacterium tuberculosis H37Rv
accagcgaggccagcg

SEQ ID NO: 1296843 - RNA, 16 nt, Mycobacterium tuberculosis H37Rv
accagcgcagccgauc

SEQ ID NO: 1296844 - RNA, 17 nt, Mycobacterium tuberculosis H37Rv
accagcaaccaccccag

SEQ ID NO: 1296845 - RNA, 22 nt, Mycobacterium tuberculosis H37Rv
accagagcacgggcucgcugca

SEQ ID NO: 1296846 - RNA, 20 nt, Mycobacterium tuberculosis H37Rv
accagaggcgugucgacucc

SEQ ID NO: 1296847 - RNA, 18 nt, Mycobacterium tuberculosis H37Rv
accagagcgucgaacacg

SEQ ID NO: 1296848 - RNA, 14 nt, Mycobacterium tuberculosis H37Rv
accagaguucggcc

SEQ ID NO: 1296849 - RNA, 18 nt, Mycobacterium tuberculosis H37Rv
accagaucuucgagcgca

SEQ ID NO: 1296850 - RNA, 23 nt, Mycobacterium tuberculosis H37Rv
accacgguuuuacagcgucaucc

SEQ ID NO: 1296851 - RNA, 13 nt, Mycobacterium tuberculosis H37Rv
accacgucggcga

SEQ ID NO: 1296852 - RNA, 21 nt, Mycobacterium tuberculosis H37Rv
accacgcgucgcuguuggcga

SEQ ID NO: 1296853 - RNA, 17 nt, Mycobacterium tuberculosis H37Rv
accacggucaagccggc

SEQ ID NO: 1296854 - RNA, 20 nt, Mycobacterium tuberculosis H37Rv
accacgccaucgagcagcag

SEQ ID NO: 1296855 - RNA, 14 nt, Mycobacterium tuberculosis H37Rv
accacgaggcuugc

SEQ ID NO: 1296856 - RNA, 20 nt, Mycobacterium tuberculosis H37Rv
accacgacgcgauggccgcc

SEQ ID NO: 1296857 - RNA, 17 nt, Mycobacterium tuberculosis H37Rv
accacgaucaacucgug

SEQ ID NO: 1296858 - RNA, 18 nt, Mycobacterium tuberculosis H37Rv
accacgacguucgacgac

SEQ ID NO: 1296859 - RNA, 15 nt, Mycobacterium tuberculosis H37Rv
accacgacguugcga

SEQ ID NO: 1296860 - RNA, 11 nt, Mycobacterium tuberculosis H37Rv
accaccgccgg

SEQ ID NO: 1296861 - RNA, 17 nt, Mycobacterium tuberculosis H37Rv
accaccgccgccggcac

SEQ ID NO: 1296862 - RNA, 13 nt, Mycobacterium tuberculosis H37Rv
accaccgaccucg

SEQ ID NO: 1296863 - RNA, 15 nt, Mycobacterium tuberculosis H37Rv
accaccgaccucgac

SEQ ID NO: 1296864 - RNA, 15 nt, Mycobacterium tuberculosis H37Rv
accaccgaccuggac

SEQ ID NO: 1296865 - RNA, 16 nt, Mycobacterium tuberculosis H37Rv
accaccgcaccugcga

SEQ ID NO: 1296866 - RNA, 16 nt, Mycobacterium tuberculosis H37Rv
accaccuuggaugccc

SEQ ID NO: 1296867 - RNA, 14 nt, Mycobacterium tuberculosis H37Rv
accaccaccgccgg

SEQ ID NO: 1296868 - RNA, 15 nt, Mycobacterium tuberculosis H37Rv
accacaaccgugagc

SEQ ID NO: 1296869 - RNA, 22 nt, Mycobacterium tuberculosis H37Rv
accacaaccgugagcaccagca

SEQ ID NO: 1296870 - RNA, 23 nt, Mycobacterium tuberculosis H37Rv
accacaaccgugagcaccagcag

SEQ ID NO: 1296871 - RNA, 15 nt, Mycobacterium tuberculosis H37Rv
accaccagggcaacg

SEQ ID NO: 1296872 - RNA, 19 nt, Mycobacterium tuberculosis H37Rv
accaccacuaggucgccgg

SEQ ID NO: 1296873 - RNA, 16 nt, Mycobacterium tuberculosis H37Rv
accaauucgaccgcgc

SEQ ID NO: 1296874 - RNA, 22 nt, Mycobacterium tuberculosis H37Rv
accaucacgcccuguucuccgu

SEQ ID NO: 1296875 - RNA, 15 nt, Mycobacterium tuberculosis H37Rv
accaucacgguggcc

SEQ ID NO: 1296876 - RNA, 18 nt, Mycobacterium tuberculosis H37Rv
accaucaccucgcacgac

SEQ ID NO: 1296877 - RNA, 21 nt, Mycobacterium tuberculosis H37Rv
accaucaccgccuuugccgcc

SEQ ID NO: 1296878 - RNA, 20 nt, Mycobacterium tuberculosis H37Rv
accaucaccacggccgccga

SEQ ID NO: 1296879 - RNA, 23 nt, Mycobacterium tuberculosis H37Rv
accaucaacauugugcucgccga

SEQ ID NO: 1296880 - RNA, 21 nt, Mycobacterium tuberculosis H37Rv
accaucgccgccguugccgcc

SEQ ID NO: 1296881 - RNA, 21 nt, Mycobacterium tuberculosis H37Rv
accaguuauucggugcgcggu

SEQ ID NO: 1296882 - RNA, 19 nt, Mycobacterium tuberculosis H37Rv
accagugcgguggcaggug

SEQ ID NO: 1296883 - RNA, 19 nt, Mycobacterium tuberculosis H37Rv
accaguggauuggcgauga

SEQ ID NO: 1296884 - RNA, 23 nt, Mycobacterium tuberculosis H37Rv
accaguggauuggcgaugacaau

SEQ ID NO: 1296885 - RNA, 22 nt, Mycobacterium tuberculosis H37Rv
accagugcgggguccagcggga

SEQ ID NO: 1296886 - RNA, 16 nt, Mycobacterium tuberculosis H37Rv
accaguguggcgauga

SEQ ID NO: 1296887 - RNA, 13 nt, Mycobacterium tuberculosis H37Rv
accaugucggcca

SEQ ID NO: 1296888 - RNA, 20 nt, Mycobacterium tuberculosis H37Rv
accaugguagcgccccgaug

SEQ ID NO: 1296889 - RNA, 14 nt, Mycobacterium tuberculosis H37Rv
accauggcgcgacc

SEQ ID NO: 1296890 - RNA, 20 nt, Mycobacterium tuberculosis H37Rv
accauuguuccguccccgac

SEQ ID NO: 1296891 - RNA, 12 nt, Mycobacterium tuberculosis H37Rv
accauucggcga

SEQ ID NO: 1296892 - RNA, 23 nt, Mycobacterium tuberculosis H37Rv
accaucuccggugugaucggcgg

SEQ ID NO: 1296893 - RNA, 17 nt, Mycobacterium tuberculosis H37Rv
accaucuucacgaagug

SEQ ID NO: 1296894 - RNA, 14 nt, Mycobacterium tuberculosis H37Rv
accaugaugaccgg

SEQ ID NO: 1296895 - RNA, 23 nt, Mycobacterium tuberculosis H37Rv
accaugauugccaggaccgcgcc

SEQ ID NO: 1296896 - RNA, 20 nt, Mycobacterium tuberculosis H37Rv
accaugcgguuagcagccgc

SEQ ID NO: 1296897 - RNA, 19 nt, Mycobacterium tuberculosis H37Rv
accaguaccgucaucgcgg

SEQ ID NO: 1296898 - RNA, 19 nt, Mycobacterium tuberculosis H37Rv
accaguccucgacguggcc

SEQ ID NO: 1296899 - RNA, 17 nt, Mycobacterium tuberculosis H37Rv
accaguccagcgggcau

SEQ ID NO: 1296900 - RNA, 21 nt, Mycobacterium tuberculosis H37Rv
accaggucggugugcaucgcc

SEQ ID NO: 1296901 - RNA, 17 nt, Mycobacterium tuberculosis H37Rv
accagguacgcgaucag

SEQ ID NO: 1296902 - RNA, 18 nt, Mycobacterium tuberculosis H37Rv
accagggcgcggaucugc

SEQ ID NO: 1296903 - RNA, 19 nt, Mycobacterium tuberculosis H37Rv
accagggccucgaccgcca

SEQ ID NO: 1296904 - RNA, 20 nt, Mycobacterium tuberculosis H37Rv
accagggccucgaccgccag

SEQ ID NO: 1296905 - RNA, 16 nt, Mycobacterium tuberculosis H37Rv
accagggcagccgggu

SEQ ID NO: 1296906 - RNA, 21 nt, Mycobacterium tuberculosis H37Rv
accagggccgccgcugccgcc

SEQ ID NO: 1296907 - RNA, 21 nt, Mycobacterium tuberculosis H37Rv
accagcgcggcacaccccggu

SEQ ID NO: 1296908 - RNA, 17 nt, Mycobacterium tuberculosis H37Rv
accagcggcaccgcggc

SEQ ID NO: 1296909 - RNA, 16 nt, Mycobacterium tuberculosis H37Rv
accaggcccgguucga

SEQ ID NO: 1296910 - RNA, 18 nt, Mycobacterium tuberculosis H37Rv
accaggcguggacgcggu

SEQ ID NO: 1296911 - RNA, 22 nt, Mycobacterium tuberculosis H37Rv
accaggcggcgcgggucggcga

SEQ ID NO: 1296912 - RNA, 20 nt, Mycobacterium tuberculosis H37Rv
accagggcacguucggcgca

SEQ ID NO: 1296913 - RNA, 15 nt, Mycobacterium tuberculosis H37Rv
accaggccggugacg

SEQ ID NO: 1296914 - RNA, 17 nt, Mycobacterium tuberculosis H37Rv
accaggcgagccgccac

SEQ ID NO: 1296915 - RNA, 16 nt, Mycobacterium tuberculosis H37Rv
accaggcggccguaac

SEQ ID NO: 1296916 - RNA, 21 nt, Mycobacterium tuberculosis H37Rv
acaugguccgaccagcggccg

SEQ ID NO: 1296917 - RNA, 14 nt, Mycobacterium tuberculosis H37Rv
acaugccggucauc

SEQ ID NO: 1296918 - RNA, 19 nt, Mycobacterium tuberculosis H37Rv
acaugcucagucgcucucg

SEQ ID NO: 1296919 - RNA, 19 nt, Mycobacterium tuberculosis H37Rv
acaucgcaggcaccccgau

SEQ ID NO: 1296920 - RNA, 21 nt, Mycobacterium tuberculosis H37Rv
acaucgcgaaaccggaccuga

SEQ ID NO: 1296921 - RNA, 15 nt, Mycobacterium tuberculosis H37Rv
acaucaccaccgacc

SEQ ID NO: 1296922 - RNA, 12 nt, Mycobacterium tuberculosis H37Rv
acaggucgcccg

SEQ ID NO: 1296923 - RNA, 20 nt, Mycobacterium tuberculosis H37Rv
acaucaaagucggcgucacg

SEQ ID NO: 1296924 - RNA, 13 nt, Mycobacterium tuberculosis H37Rv
acagguccaccgg

SEQ ID NO: 1296925 - RNA, 17 nt, Mycobacterium tuberculosis H37Rv
acaggcgggacaaccgg

SEQ ID NO: 1296926 - RNA, 15 nt, Mycobacterium tuberculosis H37Rv
acaggcguccaucgc

SEQ ID NO: 1296927 - RNA, 20 nt, Mycobacterium tuberculosis H37Rv
acaggcguccaucgccaccg

SEQ ID NO: 1296928 - RNA, 15 nt, Mycobacterium tuberculosis H37Rv
acaggcuugacugca

SEQ ID NO: 1296929 - RNA, 14 nt, Mycobacterium tuberculosis H37Rv
acagggaggucgcc

SEQ ID NO: 1296930 - RNA, 13 nt, Mycobacterium tuberculosis H37Rv
acagggcgccgac

SEQ ID NO: 1296931 - RNA, 16 nt, Mycobacterium tuberculosis H37Rv
acaggcccggcaccgc

SEQ ID NO: 1296932 - RNA, 19 nt, Mycobacterium tuberculosis H37Rv
acaggccggccaccaccgc

SEQ ID NO: 1296933 - RNA, 19 nt, Mycobacterium tuberculosis H37Rv
acaggccuaggucgacgcc

SEQ ID NO: 1296934 - RNA, 18 nt, Mycobacterium tuberculosis H37Rv
acaggccuaggucgacgc

SEQ ID NO: 1296935 - RNA, 23 nt, Mycobacterium tuberculosis H37Rv
acaggcgaggcucccgcaauggg

SEQ ID NO: 1296936 - RNA, 19 nt, Mycobacterium tuberculosis H37Rv
acagcuucgcgcagccggu

SEQ ID NO: 1296937 - RNA, 14 nt, Mycobacterium tuberculosis H37Rv
acagcugaucccag

SEQ ID NO: 1296938 - RNA, 19 nt, Mycobacterium tuberculosis H37Rv
acaggagacgguacgccag

SEQ ID NO: 1296939 - RNA, 13 nt, Mycobacterium tuberculosis H37Rv
acaggaccgggau

SEQ ID NO: 1296940 - RNA, 15 nt, Mycobacterium tuberculosis H37Rv
acaggaagucgcgga

SEQ ID NO: 1296941 - RNA, 16 nt, Mycobacterium tuberculosis H37Rv
acagcuugcguagcuc

SEQ ID NO: 1296942 - RNA, 14 nt, Mycobacterium tuberculosis H37Rv
acagcuugaucgcc

SEQ ID NO: 1296943 - RNA, 23 nt, Mycobacterium tuberculosis H37Rv
acagcucaucgauccucgcccgc

SEQ ID NO: 1296944 - RNA, 22 nt, Mycobacterium tuberculosis H37Rv
acagcucgcgcucgcucacgcc

SEQ ID NO: 1296945 - RNA, 15 nt, Mycobacterium tuberculosis H37Rv
acagccgcagcggcc

SEQ ID NO: 1296946 - RNA, 21 nt, Mycobacterium tuberculosis H37Rv
acagccgcuuggcgcggccca

SEQ ID NO: 1296947 - RNA, 17 nt, Mycobacterium tuberculosis H37Rv
acagcaucacgaucacg

SEQ ID NO: 1296948 - RNA, 15 nt, Mycobacterium tuberculosis H37Rv
acagcagcgucauca

SEQ ID NO: 1296949 - RNA, 13 nt, Mycobacterium tuberculosis H37Rv
acagcaucacgcc

SEQ ID NO: 1296950 - RNA, 15 nt, Mycobacterium tuberculosis H37Rv
acagcaugucgcgga

SEQ ID NO: 1296951 - RNA, 16 nt, Mycobacterium tuberculosis H37Rv
acagccgcagcggccu

SEQ ID NO: 1296952 - RNA, 19 nt, Mycobacterium tuberculosis H37Rv
acagccgagccagcagcuu

SEQ ID NO: 1296953 - RNA, 18 nt, Mycobacterium tuberculosis H37Rv
acagacggcucagcgugc

SEQ ID NO: 1296954 - RNA, 21 nt, Mycobacterium tuberculosis H37Rv
acagaucgagggggacgcuga

SEQ ID NO: 1296955 - RNA, 13 nt, Mycobacterium tuberculosis H37Rv
acagcaacgccca

SEQ ID NO: 1296956 - RNA, 21 nt, Mycobacterium tuberculosis H37Rv
acagcaauuuuccgucgaugg

SEQ ID NO: 1296957 - RNA, 13 nt, Mycobacterium tuberculosis H37Rv
acacguccggcga

SEQ ID NO: 1296958 - RNA, 15 nt, Mycobacterium tuberculosis H37Rv
acacgucgacaccga

SEQ ID NO: 1296959 - RNA, 16 nt, Mycobacterium tuberculosis H37Rv
acaccuugggcagcuu

SEQ ID NO: 1296960 - RNA, 22 nt, Mycobacterium tuberculosis H37Rv
acaccugcgcggcgugcgcggu

SEQ ID NO: 1296961 - RNA, 13 nt, Mycobacterium tuberculosis H37Rv
acaccuccucgac

SEQ ID NO: 1296962 - RNA, 21 nt, Mycobacterium tuberculosis H37Rv
acaccuccucgaccguggcgg

SEQ ID NO: 1296963 - RNA, 15 nt, Mycobacterium tuberculosis H37Rv
acagaccuagcaccg

SEQ ID NO: 1296964 - RNA, 23 nt, Mycobacterium tuberculosis H37Rv
acagacaucgcgacgaucgucca

SEQ ID NO: 1296965 - RNA, 12 nt, Mycobacterium tuberculosis H37Rv
acaccagcgcgu

SEQ ID NO: 1296966 - RNA, 20 nt, Mycobacterium tuberculosis H37Rv
acaccaucuccgccgucgcc

SEQ ID NO: 1296967 - RNA, 23 nt, Mycobacterium tuberculosis H37Rv
acaccagggggcgagagcgcgga

SEQ ID NO: 1296968 - RNA, 19 nt, Mycobacterium tuberculosis H37Rv
acaccaggucauugccggc

SEQ ID NO: 1296969 - RNA, 17 nt, Mycobacterium tuberculosis H37Rv
acaccaggccgagccgc

SEQ ID NO: 1296970 - RNA, 12 nt, Mycobacterium tuberculosis H37Rv
acaccagcucga

SEQ ID NO: 1296971 - RNA, 18 nt, Mycobacterium tuberculosis H37Rv
acaccggccaacagucgc

SEQ ID NO: 1296972 - RNA, 14 nt, Mycobacterium tuberculosis H37Rv
acaccggcaccgaa

SEQ ID NO: 1296973 - RNA, 21 nt, Mycobacterium tuberculosis H37Rv
acaccggccagcggcccguca

SEQ ID NO: 1296974 - RNA, 14 nt, Mycobacterium tuberculosis H37Rv
acaccggccgcgac

SEQ ID NO: 1296975 - RNA, 15 nt, Mycobacterium tuberculosis H37Rv
acaccggccggucca

SEQ ID NO: 1296976 - RNA, 14 nt, Mycobacterium tuberculosis H37Rv
acacccaucaccgc

SEQ ID NO: 1296977 - RNA, 14 nt, Mycobacterium tuberculosis H37Rv
acaccggcgaucac

SEQ ID NO: 1296978 - RNA, 18 nt, Mycobacterium tuberculosis H37Rv
acacagucacggaccgcu

SEQ ID NO: 1296979 - RNA, 14 nt, Mycobacterium tuberculosis H37Rv
acacauugaccagg

SEQ ID NO: 1296980 - RNA, 18 nt, Mycobacterium tuberculosis H37Rv
acaccaacgacagcgacg

SEQ ID NO: 1296981 - RNA, 21 nt, Mycobacterium tuberculosis H37Rv
acaccacgagcguagcgaccu

SEQ ID NO: 1296982 - RNA, 15 nt, Mycobacterium tuberculosis H37Rv
acgccgggcugggua

SEQ ID NO: 1296983 - RNA, 15 nt, Mycobacterium tuberculosis H37Rv
acgccggcgccgcca

SEQ ID NO: 1296984 - RNA, 14 nt, Mycobacterium tuberculosis H37Rv
acgccggcgggcug

SEQ ID NO: 1296985 - RNA, 19 nt, Mycobacterium tuberculosis H37Rv
acgccgggugccgccacgu

SEQ ID NO: 1296986 - RNA, 14 nt, Mycobacterium tuberculosis H37Rv
acgccggucgcggu

SEQ ID NO: 1296987 - RNA, 16 nt, Mycobacterium tuberculosis H37Rv
acgccgccggccgcca

SEQ ID NO: 1296988 - RNA, 12 nt, Mycobacterium tuberculosis H37Rv
acgccgccggca

SEQ ID NO: 1296989 - RNA, 21 nt, Mycobacterium tuberculosis H37Rv
acgccgccggguccuugcggc

SEQ ID NO: 1296990 - RNA, 14 nt, Mycobacterium tuberculosis H37Rv
acgccgccggcacc

SEQ ID NO: 1296991 - RNA, 19 nt, Mycobacterium tuberculosis H37Rv
acgccgccguugccgauca

SEQ ID NO: 1296992 - RNA, 18 nt, Mycobacterium tuberculosis H37Rv
acgccugaaacgauugcu

SEQ ID NO: 1296993 - RNA, 16 nt, Mycobacterium tuberculosis H37Rv
acgccucugcucagcc

SEQ ID NO: 1296994 - RNA, 17 nt, Mycobacterium tuberculosis H37Rv
acgccugcucgucggcc

SEQ ID NO: 1296995 - RNA, 19 nt, Mycobacterium tuberculosis H37Rv
acgcgaaaucccccgacac

SEQ ID NO: 1296996 - RNA, 15 nt, Mycobacterium tuberculosis H37Rv
acgccugagccacca

SEQ ID NO: 1296997 - RNA, 21 nt, Mycobacterium tuberculosis H37Rv
acgccgucgagcacggugagc

SEQ ID NO: 1296998 - RNA, 13 nt, Mycobacterium tuberculosis H37Rv
acgccgucggcgc

SEQ ID NO: 1296999 - RNA, 12 nt, Mycobacterium tuberculosis H37Rv
acgccgucgucg

SEQ ID NO: 1297000 - RNA, 16 nt, Mycobacterium tuberculosis H37Rv
acgccgucugacagca

SEQ ID NO: 1297001 - RNA, 14 nt, Mycobacterium tuberculosis H37Rv
acgccgucaugccc

SEQ ID NO: 1297002 - RNA, 21 nt, Mycobacterium tuberculosis H37Rv
acgccgucagaacaccggcca

SEQ ID NO: 1297003 - RNA, 14 nt, Mycobacterium tuberculosis H37Rv
acgccguacccgga

SEQ ID NO: 1297004 - RNA, 17 nt, Mycobacterium tuberculosis H37Rv
acgccguagcaucgggc

SEQ ID NO: 1297005 - RNA, 13 nt, Mycobacterium tuberculosis H37Rv
acgccguagcgca

SEQ ID NO: 1297006 - RNA, 13 nt, Mycobacterium tuberculosis H37Rv
acgcggacaccgc

SEQ ID NO: 1297007 - RNA, 23 nt, Mycobacterium tuberculosis H37Rv
acgcggcgaugauggcgcgaucg

SEQ ID NO: 1297008 - RNA, 23 nt, Mycobacterium tuberculosis H37Rv
acgcgggcacugguggcgauccg

SEQ ID NO: 1297009 - RNA, 13 nt, Mycobacterium tuberculosis H37Rv
acgcgggccgacc

SEQ ID NO: 1297010 - RNA, 15 nt, Mycobacterium tuberculosis H37Rv
acgcggcuuugccgg

SEQ ID NO: 1297011 - RNA, 17 nt, Mycobacterium tuberculosis H37Rv
acgcgggaacgaugccg

SEQ ID NO: 1297012 - RNA, 16 nt, Mycobacterium tuberculosis H37Rv
acgcgggugccgggca

SEQ ID NO: 1297013 - RNA, 16 nt, Mycobacterium tuberculosis H37Rv
acgcggguugcgcggc

SEQ ID NO: 1297014 - RNA, 23 nt, Mycobacterium tuberculosis H37Rv
acgcggguugcgcggcuugggca

SEQ ID NO: 1297015 - RNA, 22 nt, Mycobacterium tuberculosis H37Rv
acgcggggaugucgaccgcgag

SEQ ID NO: 1297016 - RNA, 12 nt, Mycobacterium tuberculosis H37Rv
acgcgaccgcga

SEQ ID NO: 1297017 - RNA, 18 nt, Mycobacterium tuberculosis H37Rv
acgcgcgagaacacccgu

SEQ ID NO: 1297018 - RNA, 18 nt, Mycobacterium tuberculosis H37Rv
acgcgcgcagccgggcac

SEQ ID NO: 1297019 - RNA, 19 nt, Mycobacterium tuberculosis H37Rv
acgcgcgcagccgggcacc

SEQ ID NO: 1297020 - RNA, 15 nt, Mycobacterium tuberculosis H37Rv
acgcgcucggcgauc

SEQ ID NO: 1297021 - RNA, 16 nt, Mycobacterium tuberculosis H37Rv
acgcgcugacccgcca

SEQ ID NO: 1297022 - RNA, 19 nt, Mycobacterium tuberculosis H37Rv
acgcgaccaucucgacguc

SEQ ID NO: 1297023 - RNA, 17 nt, Mycobacterium tuberculosis H37Rv
acgcgacgaagcagacg

SEQ ID NO: 1297024 - RNA, 16 nt, Mycobacterium tuberculosis H37Rv
acgcgacucggcgguc

SEQ ID NO: 1297025 - RNA, 13 nt, Mycobacterium tuberculosis H37Rv
acgcguagcuggc

SEQ ID NO: 1297026 - RNA, 15 nt, Mycobacterium tuberculosis H37Rv
acgcguagcacggcg

SEQ ID NO: 1297027 - RNA, 19 nt, Mycobacterium tuberculosis H37Rv
acgcggugccgggaucgcc

SEQ ID NO: 1297028 - RNA, 22 nt, Mycobacterium tuberculosis H37Rv
acgcggugccgggaucgccguc

SEQ ID NO: 1297029 - RNA, 19 nt, Mycobacterium tuberculosis H37Rv
acgcgguggugauugacgg

SEQ ID NO: 1297030 - RNA, 18 nt, Mycobacterium tuberculosis H37Rv
acgcguauucggcaucgc

SEQ ID NO: 1297031 - RNA, 14 nt, Mycobacterium tuberculosis H37Rv
acgcgucagcggcg

SEQ ID NO: 1297032 - RNA, 16 nt, Mycobacterium tuberculosis H37Rv
acgcgucccgccgcac

SEQ ID NO: 1297033 - RNA, 14 nt, Mycobacterium tuberculosis H37Rv
acgcguauucggca

SEQ ID NO: 1297034 - RNA, 20 nt, Mycobacterium tuberculosis H37Rv
acgcguggcauccagcagcg

SEQ ID NO: 1297035 - RNA, 16 nt, Mycobacterium tuberculosis H37Rv
acgcguuccauggccc

SEQ ID NO: 1297036 - RNA, 13 nt, Mycobacterium tuberculosis H37Rv
acgcuaccgccgg

SEQ ID NO: 1297037 - RNA, 13 nt, Mycobacterium tuberculosis H37Rv
acgcguuucgucg

SEQ ID NO: 1297038 - RNA, 14 nt, Mycobacterium tuberculosis H37Rv
acgcucgcugcagc

SEQ ID NO: 1297039 - RNA, 19 nt, Mycobacterium tuberculosis H37Rv
acgcuccaggguccggacg

SEQ ID NO: 1297040 - RNA, 21 nt, Mycobacterium tuberculosis H37Rv
acgcuccaggccuaguccggc

SEQ ID NO: 1297041 - RNA, 22 nt, Mycobacterium tuberculosis H37Rv
acgcugaguccccaggugggca

SEQ ID NO: 1297042 - RNA, 13 nt, Mycobacterium tuberculosis H37Rv
acgcugccgguca

SEQ ID NO: 1297043 - RNA, 14 nt, Mycobacterium tuberculosis H37Rv
acgcugccaagcga

SEQ ID NO: 1297044 - RNA, 19 nt, Mycobacterium tuberculosis H37Rv
acgcucggugaaggucacc

SEQ ID NO: 1297045 - RNA, 23 nt, Mycobacterium tuberculosis H37Rv
acgcucggcuauggguucgcggu

SEQ ID NO: 1297046 - RNA, 17 nt, Mycobacterium tuberculosis H37Rv
acggaaguaucgccggc

SEQ ID NO: 1297047 - RNA, 20 nt, Mycobacterium tuberculosis H37Rv
acggaauguagccgacuucg

SEQ ID NO: 1297048 - RNA, 15 nt, Mycobacterium tuberculosis H37Rv
acggaauguagccga

SEQ ID NO: 1297049 - RNA, 23 nt, Mycobacterium tuberculosis H37Rv
acggacacccugggcuggcugac

SEQ ID NO: 1297050 - RNA, 18 nt, Mycobacterium tuberculosis H37Rv
acggaccaggccuugacc

SEQ ID NO: 1297051 - RNA, 13 nt, Mycobacterium tuberculosis H37Rv
acggaccgucgcc

SEQ ID NO: 1297052 - RNA, 15 nt, Mycobacterium tuberculosis H37Rv
acggaccguuaccgg

SEQ ID NO: 1297053 - RNA, 19 nt, Mycobacterium tuberculosis H37Rv
acggacucccucgaucacg

SEQ ID NO: 1297054 - RNA, 18 nt, Mycobacterium tuberculosis H37Rv
acggacucccucgaucac

SEQ ID NO: 1297055 - RNA, 15 nt, Mycobacterium tuberculosis H37Rv
acgcugggcgguagc

SEQ ID NO: 1297056 - RNA, 22 nt, Mycobacterium tuberculosis H37Rv
acgcugucccgcgggccagcac

SEQ ID NO: 1297057 - RNA, 13 nt, Mycobacterium tuberculosis H37Rv
acgcugucccgcg

SEQ ID NO: 1297058 - RNA, 16 nt, Mycobacterium tuberculosis H37Rv
acgcuguugucgucca

SEQ ID NO: 1297059 - RNA, 16 nt, Mycobacterium tuberculosis H37Rv
acgcugugcucgacga

SEQ ID NO: 1297060 - RNA, 18 nt, Mycobacterium tuberculosis H37Rv
acgcugugcgguaucggu

SEQ ID NO: 1297061 - RNA, 21 nt, Mycobacterium tuberculosis H37Rv
acgcugucgugcucucggcga

SEQ ID NO: 1297062 - RNA, 19 nt, Mycobacterium tuberculosis H37Rv
acggaacaucgucaucgac

SEQ ID NO: 1297063 - RNA, 23 nt, Mycobacterium tuberculosis H37Rv
acggaacaucgucaucgacgagc

SEQ ID NO: 1297064 - RNA, 18 nt, Mycobacterium tuberculosis H37Rv
acgccaaaacggucgacc

SEQ ID NO: 1297065 - RNA, 12 nt, Mycobacterium tuberculosis H37Rv
acgccacgacgu

SEQ ID NO: 1297066 - RNA, 14 nt, Mycobacterium tuberculosis H37Rv
acgccacgacgucg

SEQ ID NO: 1297067 - RNA, 14 nt, Mycobacterium tuberculosis H37Rv
acgccagaccgccg

SEQ ID NO: 1297068 - RNA, 16 nt, Mycobacterium tuberculosis H37Rv
acgccacugccagccg

SEQ ID NO: 1297069 - RNA, 18 nt, Mycobacterium tuberculosis H37Rv
acgcaugcucgaucgcgu

SEQ ID NO: 1297070 - RNA, 21 nt, Mycobacterium tuberculosis H37Rv
acgcagcuugcccgacggcgu

SEQ ID NO: 1297071 - RNA, 19 nt, Mycobacterium tuberculosis H37Rv
acgccagucccggcgcaca

SEQ ID NO: 1297072 - RNA, 20 nt, Mycobacterium tuberculosis H37Rv
acgccagucgagcaccugcc

SEQ ID NO: 1297073 - RNA, 16 nt, Mycobacterium tuberculosis H37Rv
acgccagccaggcgaa

SEQ ID NO: 1297074 - RNA, 16 nt, Mycobacterium tuberculosis H37Rv
acgccaggucaucggc

SEQ ID NO: 1297075 - RNA, 15 nt, Mycobacterium tuberculosis H37Rv
acgccauacgucgcc

SEQ ID NO: 1297076 - RNA, 18 nt, Mycobacterium tuberculosis H37Rv
acgccauccacgacaucg

SEQ ID NO: 1297077 - RNA, 18 nt, Mycobacterium tuberculosis H37Rv
acgcccccauccggucga

SEQ ID NO: 1297078 - RNA, 21 nt, Mycobacterium tuberculosis H37Rv
acgcccaucucaugcaucugc

SEQ ID NO: 1297079 - RNA, 14 nt, Mycobacterium tuberculosis H37Rv
acgcccauggcguc

SEQ ID NO: 1297080 - RNA, 15 nt, Mycobacterium tuberculosis H37Rv
acgaucgcggugacc

SEQ ID NO: 1297081 - RNA, 17 nt, Mycobacterium tuberculosis H37Rv
acgaugcccggcaucgc

SEQ ID NO: 1297082 - RNA, 23 nt, Mycobacterium tuberculosis H37Rv
acgauauagggcuccucgugcac

SEQ ID NO: 1297083 - RNA, 22 nt, Mycobacterium tuberculosis H37Rv
acgauagccgaaaaagaccgac

SEQ ID NO: 1297084 - RNA, 21 nt, Mycobacterium tuberculosis H37Rv
acgauccacggcgaugcagcc

SEQ ID NO: 1297085 - RNA, 22 nt, Mycobacterium tuberculosis H37Rv
acgaucagggaagccugcgggc

SEQ ID NO: 1297086 - RNA, 16 nt, Mycobacterium tuberculosis H37Rv
acgaucaggucgccga

SEQ ID NO: 1297087 - RNA, 19 nt, Mycobacterium tuberculosis H37Rv
acgaucagcgugaucugca

SEQ ID NO: 1297088 - RNA, 11 nt, Mycobacterium tuberculosis H37Rv
acgaucacgau

SEQ ID NO: 1297089 - RNA, 20 nt, Mycobacterium tuberculosis H37Rv
acgcaacggcacccaauuuc

SEQ ID NO: 1297090 - RNA, 23 nt, Mycobacterium tuberculosis H37Rv
acgcaccuauggucaaccgcgcc

SEQ ID NO: 1297091 - RNA, 20 nt, Mycobacterium tuberculosis H37Rv
acgcacgcaguucggucagc

SEQ ID NO: 1297092 - RNA, 16 nt, Mycobacterium tuberculosis H37Rv
acgcacgcgguucacc

SEQ ID NO: 1297093 - RNA, 14 nt, Mycobacterium tuberculosis H37Rv
acgcacgccgcgug

SEQ ID NO: 1297094 - RNA, 22 nt, Mycobacterium tuberculosis H37Rv
acgcagcggcaaggucaacggg

SEQ ID NO: 1297095 - RNA, 20 nt, Mycobacterium tuberculosis H37Rv
acgcacugccccgcaucgcc

SEQ ID NO: 1297096 - RNA, 14 nt, Mycobacterium tuberculosis H37Rv
acgauugucgauga

SEQ ID NO: 1297097 - RNA, 14 nt, Mycobacterium tuberculosis H37Rv
acgcaacaccgcca

SEQ ID NO: 1297098 - RNA, 13 nt, Mycobacterium tuberculosis H37Rv
acgcaaccaaccg

SEQ ID NO: 1297099 - RNA, 13 nt, Mycobacterium tuberculosis H37Rv
acgauuucggccc

SEQ ID NO: 1297100 - RNA, 19 nt, Mycobacterium tuberculosis H37Rv
acgcaaaaucgcccauuuc

SEQ ID NO: 1297101 - RNA, 17 nt, Mycobacterium tuberculosis H37Rv
acgcaaaaucgcccgaa

SEQ ID NO: 1297102 - RNA, 13 nt, Mycobacterium tuberculosis H37Rv
acgaagaucgcgu

SEQ ID NO: 1297103 - RNA, 16 nt, Mycobacterium tuberculosis H37Rv
acgaagaucgcugcga

SEQ ID NO: 1297104 - RNA, 21 nt, Mycobacterium tuberculosis H37Rv
acgaagaucgcgugccacagc

SEQ ID NO: 1297105 - RNA, 21 nt, Mycobacterium tuberculosis H37Rv
acgaagccggcuucggugagc

SEQ ID NO: 1297106 - RNA, 18 nt, Mycobacterium tuberculosis H37Rv
acgaagaucgcugcgaag

SEQ ID NO: 1297107 - RNA, 12 nt, Mycobacterium tuberculosis H37Rv
acgaaccgccgc

SEQ ID NO: 1297108 - RNA, 16 nt, Mycobacterium tuberculosis H37Rv
acgaaccgguugccgu

SEQ ID NO: 1297109 - RNA, 14 nt, Mycobacterium tuberculosis H37Rv
acgaacccucagcc

SEQ ID NO: 1297110 - RNA, 19 nt, Mycobacterium tuberculosis H37Rv
acgaacaccagcgcgccgu

SEQ ID NO: 1297111 - RNA, 18 nt, Mycobacterium tuberculosis H37Rv
acgaaagucaaucgcguc

SEQ ID NO: 1297112 - RNA, 23 nt, Mycobacterium tuberculosis H37Rv
acgaaaucggcggcguccagcag

SEQ ID NO: 1297113 - RNA, 23 nt, Mycobacterium tuberculosis H37Rv
accuugagcacuccgucguaguu

SEQ ID NO: 1297114 - RNA, 17 nt, Mycobacterium tuberculosis H37Rv
accuugaccgucgcgca

SEQ ID NO: 1297115 - RNA, 16 nt, Mycobacterium tuberculosis H37Rv
accuucuuggcgggug

SEQ ID NO: 1297116 - RNA, 14 nt, Mycobacterium tuberculosis H37Rv
accuugaccgggca

SEQ ID NO: 1297117 - RNA, 21 nt, Mycobacterium tuberculosis H37Rv
accuugcccaccaguuccggg

SEQ ID NO: 1297118 - RNA, 19 nt, Mycobacterium tuberculosis H37Rv
accuucggccgaccgggcu

SEQ ID NO: 1297119 - RNA, 14 nt, Mycobacterium tuberculosis H37Rv
accuucccgucgac

SEQ ID NO: 1297120 - RNA, 16 nt, Mycobacterium tuberculosis H37Rv
accguuugguccauca

SEQ ID NO: 1297121 - RNA, 15 nt, Mycobacterium tuberculosis H37Rv
accuggucggccgca

SEQ ID NO: 1297122 - RNA, 17 nt, Mycobacterium tuberculosis H37Rv
accguuugcgcaccggu

SEQ ID NO: 1297123 - RNA, 21 nt, Mycobacterium tuberculosis H37Rv
accguuguugaggaugccgga

SEQ ID NO: 1297124 - RNA, 21 nt, Mycobacterium tuberculosis H37Rv
acgacggcaccgaugcacucc

SEQ ID NO: 1297125 - RNA, 20 nt, Mycobacterium tuberculosis H37Rv
acgacggcacgccauaaaga

SEQ ID NO: 1297126 - RNA, 13 nt, Mycobacterium tuberculosis H37Rv
acgaccaauagca

SEQ ID NO: 1297127 - RNA, 13 nt, Mycobacterium tuberculosis H37Rv
acgacggcugacc

SEQ ID NO: 1297128 - RNA, 22 nt, Mycobacterium tuberculosis H37Rv
acgacgggccgaguucgucagc

SEQ ID NO: 1297129 - RNA, 21 nt, Mycobacterium tuberculosis H37Rv
acgacagguguuggacgccuu

SEQ ID NO: 1297130 - RNA, 17 nt, Mycobacterium tuberculosis H37Rv
acgacaucgucgcgacg

SEQ ID NO: 1297131 - RNA, 15 nt, Mycobacterium tuberculosis H37Rv
acgaagcuggcgugc

SEQ ID NO: 1297132 - RNA, 18 nt, Mycobacterium tuberculosis H37Rv
acgaaggauucgaagccg

SEQ ID NO: 1297133 - RNA, 18 nt, Mycobacterium tuberculosis H37Rv
acgaagcguugaccgcgg

SEQ ID NO: 1297134 - RNA, 20 nt, Mycobacterium tuberculosis H37Rv
acgaagguggcauucgucga

SEQ ID NO: 1297135 - RNA, 16 nt, Mycobacterium tuberculosis H37Rv
acgagauacggccacc

SEQ ID NO: 1297136 - RNA, 17 nt, Mycobacterium tuberculosis H37Rv
acgagauagcauccgcc

SEQ ID NO: 1297137 - RNA, 23 nt, Mycobacterium tuberculosis H37Rv
acgagaugugagcacaccgacag

SEQ ID NO: 1297138 - RNA, 13 nt, Mycobacterium tuberculosis H37Rv
acgagacgacgac

SEQ ID NO: 1297139 - RNA, 17 nt, Mycobacterium tuberculosis H37Rv
acgagaagacaccgcgc

SEQ ID NO: 1297140 - RNA, 19 nt, Mycobacterium tuberculosis H37Rv
acgagcacaugcucgacgc

SEQ ID NO: 1297141 - RNA, 17 nt, Mycobacterium tuberculosis H37Rv
acgagcagaucgcgggc

SEQ ID NO: 1297142 - RNA, 18 nt, Mycobacterium tuberculosis H37Rv
acgagcagauggugaacg

SEQ ID NO: 1297143 - RNA, 23 nt, Mycobacterium tuberculosis H37Rv
acgaggcggucgaucauggcggc

SEQ ID NO: 1297144 - RNA, 24 nt, Mycobacterium tuberculosis H37Rv
acgaggcggucgaucauggcggca

SEQ ID NO: 1297145 - RNA, 23 nt, Mycobacterium tuberculosis H37Rv
acgaggcguucaccacgaucgcg

SEQ ID NO: 1297146 - RNA, 13 nt, Mycobacterium tuberculosis H37Rv
acgagggccagca

SEQ ID NO: 1297147 - RNA, 14 nt, Mycobacterium tuberculosis H37Rv
acgaggucgccgca

SEQ ID NO: 1297148 - RNA, 24 nt, Mycobacterium tuberculosis H37Rv
acgagguugccgcaccagucgcgc

SEQ ID NO: 1297149 - RNA, 16 nt, Mycobacterium tuberculosis H37Rv
acgagguugccgcacc

SEQ ID NO: 1297150 - RNA, 12 nt, Mycobacterium tuberculosis H37Rv
acgagucgccag

SEQ ID NO: 1297151 - RNA, 21 nt, Mycobacterium tuberculosis H37Rv
acgaguugaugcaagcgggca

SEQ ID NO: 1297152 - RNA, 16 nt, Mycobacterium tuberculosis H37Rv
acggugccgaccgcgu

SEQ ID NO: 1297153 - RNA, 13 nt, Mycobacterium tuberculosis H37Rv
acggugccgacga

SEQ ID NO: 1297154 - RNA, 16 nt, Mycobacterium tuberculosis H37Rv
acggugccgacgauga

SEQ ID NO: 1297155 - RNA, 16 nt, Mycobacterium tuberculosis H37Rv
acgguccguucgaugc

SEQ ID NO: 1297156 - RNA, 17 nt, Mycobacterium tuberculosis H37Rv
acgguccacgacgucga

SEQ ID NO: 1297157 - RNA, 19 nt, Mycobacterium tuberculosis H37Rv
acggucgccgaccacucga

SEQ ID NO: 1297158 - RNA, 12 nt, Mycobacterium tuberculosis H37Rv
acggugaucgcc

SEQ ID NO: 1297159 - RNA, 17 nt, Mycobacterium tuberculosis H37Rv
acggugaugacacgcgc

SEQ ID NO: 1297160 - RNA, 19 nt, Mycobacterium tuberculosis H37Rv
acggugaugggggagccgg

SEQ ID NO: 1297161 - RNA, 17 nt, Mycobacterium tuberculosis H37Rv
acggggggcgucgccgu

SEQ ID NO: 1297162 - RNA, 16 nt, Mycobacterium tuberculosis H37Rv
acgggguugaccgcca

SEQ ID NO: 1297163 - RNA, 16 nt, Mycobacterium tuberculosis H37Rv
acggggcugaccgcca

SEQ ID NO: 1297164 - RNA, 19 nt, Mycobacterium tuberculosis H37Rv
acggguacacccgcucgcc

SEQ ID NO: 1297165 - RNA, 23 nt, Mycobacterium tuberculosis H37Rv
acggguaauucuugacgccgaug

SEQ ID NO: 1297166 - RNA, 21 nt, Mycobacterium tuberculosis H37Rv
acggucacgguggugucagcc

SEQ ID NO: 1297167 - RNA, 16 nt, Mycobacterium tuberculosis H37Rv
acggucagauggccac

SEQ ID NO: 1297168 - RNA, 19 nt, Mycobacterium tuberculosis H37Rv
acggucaugccgccgccga

SEQ ID NO: 1297169 - RNA, 13 nt, Mycobacterium tuberculosis H37Rv
acgguggccggca

SEQ ID NO: 1297170 - RNA, 17 nt, Mycobacterium tuberculosis H37Rv
acggugcucuucgauga

SEQ ID NO: 1297171 - RNA, 21 nt, Mycobacterium tuberculosis H37Rv
acggugcugccguugggcacc

SEQ ID NO: 1297172 - RNA, 16 nt, Mycobacterium tuberculosis H37Rv
acgguggccgcacgau

SEQ ID NO: 1297173 - RNA, 15 nt, Mycobacterium tuberculosis H37Rv
acgguggcgcggugc

SEQ ID NO: 1297174 - RNA, 20 nt, Mycobacterium tuberculosis H37Rv
acgguggcgcggugccggcg

SEQ ID NO: 1297175 - RNA, 20 nt, Mycobacterium tuberculosis H37Rv
acggugggugggcgccgcaa

SEQ ID NO: 1297176 - RNA, 22 nt, Mycobacterium tuberculosis H37Rv
acggugggcgccgacaccggcu

SEQ ID NO: 1297177 - RNA, 19 nt, Mycobacterium tuberculosis H37Rv
acgguguacaggucgccgg

SEQ ID NO: 1297178 - RNA, 18 nt, Mycobacterium tuberculosis H37Rv
acggugguaagacgccga

SEQ ID NO: 1297179 - RNA, 17 nt, Mycobacterium tuberculosis H37Rv
acgguguaccccgcgau

SEQ ID NO: 1297180 - RNA, 22 nt, Mycobacterium tuberculosis H37Rv
acgguguagcccaucggcagca

SEQ ID NO: 1297181 - RNA, 13 nt, Mycobacterium tuberculosis H37Rv
acgguuaccgcga

SEQ ID NO: 1297182 - RNA, 22 nt, Mycobacterium tuberculosis H37Rv
acggugucaaaaccguugucgu

SEQ ID NO: 1297183 - RNA, 14 nt, Mycobacterium tuberculosis H37Rv
acggugucucgccc

SEQ ID NO: 1297184 - RNA, 15 nt, Mycobacterium tuberculosis H37Rv
acggugucucgccca

SEQ ID NO: 1297185 - RNA, 20 nt, Mycobacterium tuberculosis H37Rv
acggugucuugccaccacgc

SEQ ID NO: 1297186 - RNA, 13 nt, Mycobacterium tuberculosis H37Rv
acggugugcggca

SEQ ID NO: 1297187 - RNA, 16 nt, Mycobacterium tuberculosis H37Rv
acgguugccgcgaucg

SEQ ID NO: 1297188 - RNA, 21 nt, Mycobacterium tuberculosis H37Rv
acgguugaugaucuuggugaa

SEQ ID NO: 1297189 - RNA, 15 nt, Mycobacterium tuberculosis H37Rv
acgguugaugcaucc

SEQ ID NO: 1297190 - RNA, 14 nt, Mycobacterium tuberculosis H37Rv
acgguuccggucgg

SEQ ID NO: 1297191 - RNA, 14 nt, Mycobacterium tuberculosis H37Rv
acgggaucgacccg

SEQ ID NO: 1297192 - RNA, 17 nt, Mycobacterium tuberculosis H37Rv
acgggaugccggcgaag

SEQ ID NO: 1297193 - RNA, 19 nt, Mycobacterium tuberculosis H37Rv
acgggcacccgagccgcac

SEQ ID NO: 1297194 - RNA, 20 nt, Mycobacterium tuberculosis H37Rv
acggggaacguccgcgccga

SEQ ID NO: 1297195 - RNA, 14 nt, Mycobacterium tuberculosis H37Rv
acgggcaggccgcu

SEQ ID NO: 1297196 - RNA, 12 nt, Mycobacterium tuberculosis H37Rv
acggcucggcgc

SEQ ID NO: 1297197 - RNA, 23 nt, Mycobacterium tuberculosis H37Rv
acggcuccgggcgcucggucucc

SEQ ID NO: 1297198 - RNA, 22 nt, Mycobacterium tuberculosis H37Rv
acggcucuaccgguccgucacc

SEQ ID NO: 1297199 - RNA, 14 nt, Mycobacterium tuberculosis H37Rv
acggcugccgucag

SEQ ID NO: 1297200 - RNA, 13 nt, Mycobacterium tuberculosis H37Rv
acggcugccguca

SEQ ID NO: 1297201 - RNA, 12 nt, Mycobacterium tuberculosis H37Rv
acggcaagcgca

SEQ ID NO: 1297202 - RNA, 16 nt, Mycobacterium tuberculosis H37Rv
acggcaaugcggggca

SEQ ID NO: 1297203 - RNA, 23 nt, Mycobacterium tuberculosis H37Rv
acggcaccagaucuucgagcgca

SEQ ID NO: 1297204 - RNA, 16 nt, Mycobacterium tuberculosis H37Rv
acggaggcggaccagg

SEQ ID NO: 1297205 - RNA, 18 nt, Mycobacterium tuberculosis H37Rv
acggagcucuugcgggca

SEQ ID NO: 1297206 - RNA, 19 nt, Mycobacterium tuberculosis H37Rv
acggagcucuugcgggcag

SEQ ID NO: 1297207 - RNA, 20 nt, Mycobacterium tuberculosis H37Rv
acggcgucgaccucgcgggc

SEQ ID NO: 1297208 - RNA, 14 nt, Mycobacterium tuberculosis H37Rv
acggcgucuucgga

SEQ ID NO: 1297209 - RNA, 19 nt, Mycobacterium tuberculosis H37Rv
acggcgugaccacugaacc

SEQ ID NO: 1297210 - RNA, 13 nt, Mycobacterium tuberculosis H37Rv
acggcaccagcgg

SEQ ID NO: 1297211 - RNA, 14 nt, Mycobacterium tuberculosis H37Rv
acggcggugggucg

SEQ ID NO: 1297212 - RNA, 21 nt, Mycobacterium tuberculosis H37Rv
acggcguacgccggacccggu

SEQ ID NO: 1297213 - RNA, 14 nt, Mycobacterium tuberculosis H37Rv
acggcgucugcggu

SEQ ID NO: 1297214 - RNA, 21 nt, Mycobacterium tuberculosis H37Rv
acgucgcgccaggcgcgaucg

SEQ ID NO: 1297215 - RNA, 18 nt, Mycobacterium tuberculosis H37Rv
acgucgccgacgguuacc

SEQ ID NO: 1297216 - RNA, 19 nt, Mycobacterium tuberculosis H37Rv
acgucgaccgaacccgacg

SEQ ID NO: 1297217 - RNA, 13 nt, Mycobacterium tuberculosis H37Rv
acgucgccaagac

SEQ ID NO: 1297218 - RNA, 18 nt, Mycobacterium tuberculosis H37Rv
acgucuucacucacgacg

SEQ ID NO: 1297219 - RNA, 19 nt, Mycobacterium tuberculosis H37Rv
acgugaaggcgauggcacc

SEQ ID NO: 1297220 - RNA, 21 nt, Mycobacterium tuberculosis H37Rv
acgugaagccaagcgacucgc

SEQ ID NO: 1297221 - RNA, 19 nt, Mycobacterium tuberculosis H37Rv
acguauccacggucgacca

SEQ ID NO: 1297222 - RNA, 22 nt, Mycobacterium tuberculosis H37Rv
acguauaucgguugcugcgcga

SEQ ID NO: 1297223 - RNA, 13 nt, Mycobacterium tuberculosis H37Rv
acguaacggucgg

SEQ ID NO: 1297224 - RNA, 12 nt, Mycobacterium tuberculosis H37Rv
acgucacgucga

SEQ ID NO: 1297225 - RNA, 22 nt, Mycobacterium tuberculosis H37Rv
acguugccggaguugucgacgg

SEQ ID NO: 1297226 - RNA, 22 nt, Mycobacterium tuberculosis H37Rv
acguugcguagcaggucgacgg

SEQ ID NO: 1297227 - RNA, 22 nt, Mycobacterium tuberculosis H37Rv
acguugccaacaccggcgauca

SEQ ID NO: 1297228 - RNA, 20 nt, Mycobacterium tuberculosis H37Rv
acguugaugaugccggcguu

SEQ ID NO: 1297229 - RNA, 19 nt, Mycobacterium tuberculosis H37Rv
acguugccggaguugucga

SEQ ID NO: 1297230 - RNA, 16 nt, Mycobacterium tuberculosis H37Rv
acguugccgaacgucg

SEQ ID NO: 1297231 - RNA, 23 nt, Mycobacterium tuberculosis H37Rv
acguugagguucuucugcgccac

SEQ ID NO: 1297232 - RNA, 17 nt, Mycobacterium tuberculosis H37Rv
acuaccgccgcgaccgc

SEQ ID NO: 1297233 - RNA, 22 nt, Mycobacterium tuberculosis H37Rv
acgugguagccggcgacaccgc

SEQ ID NO: 1297234 - RNA, 20 nt, Mycobacterium tuberculosis H37Rv
acgugugcggaagcaucggc

SEQ ID NO: 1297235 - RNA, 20 nt, Mycobacterium tuberculosis H37Rv
acguguggugugucaccgga

SEQ ID NO: 1297236 - RNA, 15 nt, Mycobacterium tuberculosis H37Rv
acguguugaccgggu

SEQ ID NO: 1297237 - RNA, 19 nt, Mycobacterium tuberculosis H37Rv
acguggcugcguucgccgg

SEQ ID NO: 1297238 - RNA, 21 nt, Mycobacterium tuberculosis H37Rv
acguggcuugaguuucggcgc

SEQ ID NO: 1297239 - RNA, 18 nt, Mycobacterium tuberculosis H37Rv
acguggacugaccucguc

SEQ ID NO: 1297240 - RNA, 17 nt, Mycobacterium tuberculosis H37Rv
acguggccauccucgag

SEQ ID NO: 1297241 - RNA, 20 nt, Mycobacterium tuberculosis H37Rv
acgugaugcggucgcggaca

SEQ ID NO: 1297242 - RNA, 17 nt, Mycobacterium tuberculosis H37Rv
acgugcacggucaacga

SEQ ID NO: 1297243 - RNA, 19 nt, Mycobacterium tuberculosis H37Rv
acgugcaggaacacccaua

SEQ ID NO: 1297244 - RNA, 20 nt, Mycobacterium tuberculosis H37Rv
acugggcgaucgacaccgug

SEQ ID NO: 1297245 - RNA, 23 nt, Mycobacterium tuberculosis H37Rv
acuggugcccgacccgccgauga

SEQ ID NO: 1297246 - RNA, 12 nt, Mycobacterium tuberculosis H37Rv
acuggucgccaa

SEQ ID NO: 1297247 - RNA, 13 nt, Mycobacterium tuberculosis H37Rv
acuggugcagcgc

SEQ ID NO: 1297248 - RNA, 22 nt, Mycobacterium tuberculosis H37Rv
acugggugucggugucgacguu

SEQ ID NO: 1297249 - RNA, 21 nt, Mycobacterium tuberculosis H37Rv
acuggguugcgaacucggccg

SEQ ID NO: 1297250 - RNA, 15 nt, Mycobacterium tuberculosis H37Rv
acuggggugcugcgc

SEQ ID NO: 1297251 - RNA, 17 nt, Mycobacterium tuberculosis H37Rv
acugcacaccaccgccg

SEQ ID NO: 1297252 - RNA, 19 nt, Mycobacterium tuberculosis H37Rv
acugcaguaguagcgcaac

SEQ ID NO: 1297253 - RNA, 13 nt, Mycobacterium tuberculosis H37Rv
acugcagcgcggu

SEQ ID NO: 1297254 - RNA, 18 nt, Mycobacterium tuberculosis H37Rv
acugcaugaacugcucgc

SEQ ID NO: 1297255 - RNA, 18 nt, Mycobacterium tuberculosis H37Rv
acugcgccguucgcuccc

SEQ ID NO: 1297256 - RNA, 21 nt, Mycobacterium tuberculosis H37Rv
acugcguuccaucgccgacgc

SEQ ID NO: 1297257 - RNA, 19 nt, Mycobacterium tuberculosis H37Rv
acugcguuccaucgccgac

SEQ ID NO: 1297258 - RNA, 21 nt, Mycobacterium tuberculosis H37Rv
acugcggcgcugggacggucg

SEQ ID NO: 1297259 - RNA, 17 nt, Mycobacterium tuberculosis H37Rv
acugcgcuacaucagaa

SEQ ID NO: 1297260 - RNA, 16 nt, Mycobacterium tuberculosis H37Rv
acuggcaccgccagcc

SEQ ID NO: 1297261 - RNA, 15 nt, Mycobacterium tuberculosis H37Rv
acuggauggcucgcc

SEQ ID NO: 1297262 - RNA, 14 nt, Mycobacterium tuberculosis H37Rv
acucaccaaccgca

SEQ ID NO: 1297263 - RNA, 17 nt, Mycobacterium tuberculosis H37Rv
acucaccagcaccccga

SEQ ID NO: 1297264 - RNA, 18 nt, Mycobacterium tuberculosis H37Rv
acucggccgacgagaucg

SEQ ID NO: 1297265 - RNA, 21 nt, Mycobacterium tuberculosis H37Rv
acucggcggccagcgagauca

SEQ ID NO: 1297266 - RNA, 15 nt, Mycobacterium tuberculosis H37Rv
acucggcgacugcgu

SEQ ID NO: 1297267 - RNA, 18 nt, Mycobacterium tuberculosis H37Rv
acucggcgaccugccgga

SEQ ID NO: 1297268 - RNA, 16 nt, Mycobacterium tuberculosis H37Rv
acucggugaucgcggu

SEQ ID NO: 1297269 - RNA, 18 nt, Mycobacterium tuberculosis H37Rv
acucggucguugccgcgg

SEQ ID NO: 1297270 - RNA, 18 nt, Mycobacterium tuberculosis H37Rv
acucggguuggugggucg

SEQ ID NO: 1297271 - RNA, 17 nt, Mycobacterium tuberculosis H37Rv
acugaccgucugcgacc

SEQ ID NO: 1297272 - RNA, 20 nt, Mycobacterium tuberculosis H37Rv
acucuguggugucgauuggc

SEQ ID NO: 1297273 - RNA, 19 nt, Mycobacterium tuberculosis H37Rv
acucuguuuuuggugggca

SEQ ID NO: 1297274 - RNA, 21 nt, Mycobacterium tuberculosis H37Rv
acugagccgcgaaaucaccgc

SEQ ID NO: 1297275 - RNA, 14 nt, Mycobacterium tuberculosis H37Rv
acucguaccgauuc

SEQ ID NO: 1297276 - RNA, 22 nt, Mycobacterium tuberculosis H37Rv
acucguccugacgguacagcuc

SEQ ID NO: 1297277 - RNA, 19 nt, Mycobacterium tuberculosis H37Rv
acucguugccgaccaugca

SEQ ID NO: 1297278 - RNA, 15 nt, Mycobacterium tuberculosis H37Rv
acucguuggcgaacu

SEQ ID NO: 1297279 - RNA, 20 nt, Mycobacterium tuberculosis H37Rv
acucuaggguuugcagcgau

SEQ ID NO: 1297280 - RNA, 14 nt, Mycobacterium tuberculosis H37Rv
acucucggugaacg

SEQ ID NO: 1297281 - RNA, 23 nt, Mycobacterium tuberculosis H37Rv
acucuggauucuucagcgcggca

SEQ ID NO: 1297282 - RNA, 19 nt, Mycobacterium tuberculosis H37Rv
acuucgacagcggcgauug

SEQ ID NO: 1297283 - RNA, 16 nt, Mycobacterium tuberculosis H37Rv
acuuccaagccgaccu

SEQ ID NO: 1297284 - RNA, 14 nt, Mycobacterium tuberculosis H37Rv
acuucauagcgccg

SEQ ID NO: 1297285 - RNA, 22 nt, Mycobacterium tuberculosis H37Rv
acugucgauaaugaucucggca

SEQ ID NO: 1297286 - RNA, 18 nt, Mycobacterium tuberculosis H37Rv
acugugaaucucacgacg

SEQ ID NO: 1297287 - RNA, 15 nt, Mycobacterium tuberculosis H37Rv
acuguagggccggug

SEQ ID NO: 1297288 - RNA, 21 nt, Mycobacterium tuberculosis H37Rv
acuguugcguagcgcgcuaca

SEQ ID NO: 1297289 - RNA, 14 nt, Mycobacterium tuberculosis H37Rv
acuguucugcuggc

SEQ ID NO: 1297290 - RNA, 16 nt, Mycobacterium tuberculosis H37Rv
acuguugaagaagccc

SEQ ID NO: 1297291 - RNA, 21 nt, Mycobacterium tuberculosis H37Rv
acugugccgcugcauccgcag

SEQ ID NO: 1297292 - RNA, 19 nt, Mycobacterium tuberculosis H37Rv
acugugaaucucacgacgc

SEQ ID NO: 1297293 - RNA, 20 nt, Mycobacterium tuberculosis H37Rv
acuugcgccaccguggccgc

SEQ ID NO: 1297294 - RNA, 16 nt, Mycobacterium tuberculosis H37Rv
acuuguacgcaucgcc

SEQ ID NO: 1297295 - RNA, 18 nt, Mycobacterium tuberculosis H37Rv
acuuguugacgaacccac

SEQ ID NO: 1297296 - RNA, 15 nt, Mycobacterium tuberculosis H37Rv
acuuguugaagccga

SEQ ID NO: 1297297 - RNA, 16 nt, Mycobacterium tuberculosis H37Rv
acuuguugggcgcgaa

SEQ ID NO: 1297298 - RNA, 19 nt, Mycobacterium tuberculosis H37Rv
uguucagcaacaacgucug

SEQ ID NO: 1297299 - RNA, 18 nt, Mycobacterium tuberculosis H37Rv
uguucagcccgccgacga

SEQ ID NO: 1297300 - RNA, 22 nt, Mycobacterium tuberculosis H37Rv
ugucggcgaccgagacggcguc

SEQ ID NO: 1297301 - RNA, 20 nt, Mycobacterium tuberculosis H37Rv
ugucggcgaugucgaagccc

SEQ ID NO: 1297302 - RNA, 15 nt, Mycobacterium tuberculosis H37Rv
ugucggcgaucaacg

SEQ ID NO: 1297303 - RNA, 15 nt, Mycobacterium tuberculosis H37Rv
ugugguccaucgcgc

SEQ ID NO: 1297304 - RNA, 20 nt, Mycobacterium tuberculosis H37Rv
uguuggccagaccgcgcgca

SEQ ID NO: 1297305 - RNA, 15 nt, Mycobacterium tuberculosis H37Rv
uguucgacacccucg

SEQ ID NO: 1297306 - RNA, 14 nt, Mycobacterium tuberculosis H37Rv
uguugcgcugcggc

SEQ ID NO: 1297307 - RNA, 18 nt, Mycobacterium tuberculosis H37Rv
uguuggccauguccacca

SEQ ID NO: 1297308 - RNA, 17 nt, Mycobacterium tuberculosis H37Rv
uguuggccugcaacgcc

SEQ ID NO: 1297309 - RNA, 12 nt, Mycobacterium tuberculosis H37Rv
uguugucgauca

SEQ ID NO: 1297310 - RNA, 23 nt, Mycobacterium tuberculosis H37Rv
uguugguuugccggcgguggccg

SEQ ID NO: 1297311 - RNA, 19 nt, Mycobacterium tuberculosis H37Rv
uguuggugugcucggccaa

SEQ ID NO: 1297312 - RNA, 17 nt, Mycobacterium tuberculosis H37Rv
uguugugcucggugacg

SEQ ID NO: 1297313 - RNA, 13 nt, Mycobacterium tuberculosis H37Rv
uguuguugaagcc

SEQ ID NO: 1297314 - RNA, 19 nt, Mycobacterium tuberculosis H37Rv
uucaccgcgcugaaccaga

SEQ ID NO: 1297315 - RNA, 14 nt, Mycobacterium tuberculosis H37Rv
uucaccacgaucgc

SEQ ID NO: 1297316 - RNA, 16 nt, Mycobacterium tuberculosis H37Rv
uucaccacgucgucgg

SEQ ID NO: 1297317 - RNA, 20 nt, Mycobacterium tuberculosis H37Rv
uuaucggcagcaggacaccu

SEQ ID NO: 1297318 - RNA, 18 nt, Mycobacterium tuberculosis H37Rv
uucgaccgcgcggaucuc

SEQ ID NO: 1297319 - RNA, 18 nt, Mycobacterium tuberculosis H37Rv
uucgacggugccgucugc

SEQ ID NO: 1297320 - RNA, 15 nt, Mycobacterium tuberculosis H37Rv
uucgaggucggcgau

SEQ ID NO: 1297321 - RNA, 15 nt, Mycobacterium tuberculosis H37Rv
uucgaucagucgugg

SEQ ID NO: 1297322 - RNA, 17 nt, Mycobacterium tuberculosis H37Rv
uucgccgcgcuugcgau

SEQ ID NO: 1297323 - RNA, 13 nt, Mycobacterium tuberculosis H37Rv
uucgccgcccgca

SEQ ID NO: 1297324 - RNA, 14 nt, Mycobacterium tuberculosis H37Rv
uucgccacaccaug

SEQ ID NO: 1297325 - RNA, 23 nt, Mycobacterium tuberculosis H37Rv
uucgccgccaccggcgacgccgg

SEQ ID NO: 1297326 - RNA, 17 nt, Mycobacterium tuberculosis H37Rv
uucgcaagucuccucga

SEQ ID NO: 1297327 - RNA, 20 nt, Mycobacterium tuberculosis H37Rv
uucggcgagucgguugucgg

SEQ ID NO: 1297328 - RNA, 20 nt, Mycobacterium tuberculosis H37Rv
uucggcgaucgucucgguga

SEQ ID NO: 1297329 - RNA, 17 nt, Mycobacterium tuberculosis H37Rv
uucggccgagugcacgc

SEQ ID NO: 1297330 - RNA, 17 nt, Mycobacterium tuberculosis H37Rv
uucggcaggaaugccgc

SEQ ID NO: 1297331 - RNA, 23 nt, Mycobacterium tuberculosis H37Rv
uucgcgagucaccaaaggcgucu

SEQ ID NO: 1297332 - RNA, 13 nt, Mycobacterium tuberculosis H37Rv
uucgcgucgccga

SEQ ID NO: 1297333 - RNA, 22 nt, Mycobacterium tuberculosis H37Rv
uucgcugaccgcuaccagcugg

SEQ ID NO: 1297334 - RNA, 19 nt, Mycobacterium tuberculosis H37Rv
uucgcgguuggcggcgaug

SEQ ID NO: 1297335 - RNA, 18 nt, Mycobacterium tuberculosis H37Rv
uuccggauucggacucgc

SEQ ID NO: 1297336 - RNA, 22 nt, Mycobacterium tuberculosis H37Rv
uucccgcggacagcccggacgc

SEQ ID NO: 1297337 - RNA, 17 nt, Mycobacterium tuberculosis H37Rv
uuccccaccgucgucgu

SEQ ID NO: 1297338 - RNA, 20 nt, Mycobacterium tuberculosis H37Rv
uuccucguaggcguacacca

SEQ ID NO: 1297339 - RNA, 22 nt, Mycobacterium tuberculosis H37Rv
uuccucggauugcagcgcgaug

SEQ ID NO: 1297340 - RNA, 18 nt, Mycobacterium tuberculosis H37Rv
uuccugccgucucgucgg

SEQ ID NO: 1297341 - RNA, 18 nt, Mycobacterium tuberculosis H37Rv
uuccuggguugugccgcc

SEQ ID NO: 1297342 - RNA, 15 nt, Mycobacterium tuberculosis H37Rv
uuccugguagucgcc

SEQ ID NO: 1297343 - RNA, 14 nt, Mycobacterium tuberculosis H37Rv
uuccuccucggcgc

SEQ ID NO: 1297344 - RNA, 22 nt, Mycobacterium tuberculosis H37Rv
uuccguagacggggugagccga

SEQ ID NO: 1297345 - RNA, 17 nt, Mycobacterium tuberculosis H37Rv
uuccggugugcucgaua

SEQ ID NO: 1297346 - RNA, 22 nt, Mycobacterium tuberculosis H37Rv
uuccgggcgaccaacacgucga

SEQ ID NO: 1297347 - RNA, 20 nt, Mycobacterium tuberculosis H37Rv
uucuucggucaccucgaugc

SEQ ID NO: 1297348 - RNA, 22 nt, Mycobacterium tuberculosis H37Rv
uucuugaccagcagcucguuga

SEQ ID NO: 1297349 - RNA, 18 nt, Mycobacterium tuberculosis H37Rv
uucuuggcaggugccuuc

SEQ ID NO: 1297350 - RNA, 19 nt, Mycobacterium tuberculosis H37Rv
uucgggugguuguucggcc

SEQ ID NO: 1297351 - RNA, 23 nt, Mycobacterium tuberculosis H37Rv
uucggugagguauucguggucgg

SEQ ID NO: 1297352 - RNA, 17 nt, Mycobacterium tuberculosis H37Rv
uucggugagguccucgg

SEQ ID NO: 1297353 - RNA, 15 nt, Mycobacterium tuberculosis H37Rv
uucguauaggcgaug

SEQ ID NO: 1297354 - RNA, 18 nt, Mycobacterium tuberculosis H37Rv
uugacucugcguccaccg

SEQ ID NO: 1297355 - RNA, 18 nt, Mycobacterium tuberculosis H37Rv
uugacucugcguccacca

SEQ ID NO: 1297356 - RNA, 16 nt, Mycobacterium tuberculosis H37Rv
uugagucguuggacgg

SEQ ID NO: 1297357 - RNA, 19 nt, Mycobacterium tuberculosis H37Rv
uugaccccgcgugaccgac

SEQ ID NO: 1297358 - RNA, 20 nt, Mycobacterium tuberculosis H37Rv
uugcucgacgaucugcagca

SEQ ID NO: 1297359 - RNA, 18 nt, Mycobacterium tuberculosis H37Rv
uugcgucugcucggcgua

SEQ ID NO: 1297360 - RNA, 21 nt, Mycobacterium tuberculosis H37Rv
uugcggcuggcgccccaggug

SEQ ID NO: 1297361 - RNA, 16 nt, Mycobacterium tuberculosis H37Rv
uugcgcaaccggugga

SEQ ID NO: 1297362 - RNA, 21 nt, Mycobacterium tuberculosis H37Rv
uugcggcccgggaggcguugc

SEQ ID NO: 1297363 - RNA, 23 nt, Mycobacterium tuberculosis H37Rv
uugcgcgcgcagaucguccaccg

SEQ ID NO: 1297364 - RNA, 13 nt, Mycobacterium tuberculosis H37Rv
uugcgcagccgca

SEQ ID NO: 1297365 - RNA, 13 nt, Mycobacterium tuberculosis H37Rv
uugcgcagcagcg

SEQ ID NO: 1297366 - RNA, 13 nt, Mycobacterium tuberculosis H37Rv
uuggccgcgaccg

SEQ ID NO: 1297367 - RNA, 24 nt, Mycobacterium tuberculosis H37Rv
uuggccgauguuguugacgcccga

SEQ ID NO: 1297368 - RNA, 20 nt, Mycobacterium tuberculosis H37Rv
uuggcccggugcagcaguac

SEQ ID NO: 1297369 - RNA, 23 nt, Mycobacterium tuberculosis H37Rv
uuggcggcggcauagugcgacug

SEQ ID NO: 1297370 - RNA, 16 nt, Mycobacterium tuberculosis H37Rv
uuggcggccuuugucg

SEQ ID NO: 1297371 - RNA, 15 nt, Mycobacterium tuberculosis H37Rv
uuggcgaaccgcaga

SEQ ID NO: 1297372 - RNA, 20 nt, Mycobacterium tuberculosis H37Rv
uuggcggccagcgcaccgcc

SEQ ID NO: 1297373 - RNA, 19 nt, Mycobacterium tuberculosis H37Rv
uuggccggcuugucgacca

SEQ ID NO: 1297374 - RNA, 14 nt, Mycobacterium tuberculosis H37Rv
uuggaagacgccgg

SEQ ID NO: 1297375 - RNA, 23 nt, Mycobacterium tuberculosis H37Rv
uuggaacuuguugacgaacccac

SEQ ID NO: 1297376 - RNA, 14 nt, Mycobacterium tuberculosis H37Rv
uuggcuugcgccga

SEQ ID NO: 1297377 - RNA, 16 nt, Mycobacterium tuberculosis H37Rv
uuggcgggaccgugac

SEQ ID NO: 1297378 - RNA, 15 nt, Mycobacterium tuberculosis H37Rv
uuggcgugcaccgca

SEQ ID NO: 1297379 - RNA, 19 nt, Mycobacterium tuberculosis H37Rv
uuggcguaguuccgcaccg

SEQ ID NO: 1297380 - RNA, 13 nt, Mycobacterium tuberculosis H37Rv
uuggcgucgucgg

SEQ ID NO: 1297381 - RNA, 22 nt, Mycobacterium tuberculosis H37Rv
uuguacggcccgcaucgucgcc

SEQ ID NO: 1297382 - RNA, 20 nt, Mycobacterium tuberculosis H37Rv
aauccgugccgaaaaucgca

SEQ ID NO: 1297383 - RNA, 15 nt, Mycobacterium tuberculosis H37Rv
aauccggugcccgca

SEQ ID NO: 1297384 - RNA, 20 nt, Mycobacterium tuberculosis H37Rv
uugggcgauuuugcgucugc

SEQ ID NO: 1297385 - RNA, 20 nt, Mycobacterium tuberculosis H37Rv
uugggcgauucugcgucugc

SEQ ID NO: 1297386 - RNA, 19 nt, Mycobacterium tuberculosis H37Rv
aauccuugacgcgcaacgc

SEQ ID NO: 1297387 - RNA, 15 nt, Mycobacterium tuberculosis H37Rv
aaucgacagcagcgc

SEQ ID NO: 1297388 - RNA, 22 nt, Mycobacterium tuberculosis H37Rv
uuguucccgaguuggucguggc

SEQ ID NO: 1297389 - RNA, 19 nt, Mycobacterium tuberculosis H37Rv
uuucgaagaacguucacgc

SEQ ID NO: 1297390 - RNA, 20 nt, Mycobacterium tuberculosis H37Rv
uuucgauauagccgccggug

SEQ ID NO: 1297391 - RNA, 15 nt, Mycobacterium tuberculosis H37Rv
uuuccgugccgacca

SEQ ID NO: 1297392 - RNA, 17 nt, Mycobacterium tuberculosis H37Rv
uuucguguaacgccgac

SEQ ID NO: 1297393 - RNA, 20 nt, Mycobacterium tuberculosis H37Rv
uuuugcgucugcucggcgca

SEQ ID NO: 1297394 - RNA, 23 nt, Mycobacterium tuberculosis H37Rv
aaucuucucgagccgccggaucg

SEQ ID NO: 1297395 - RNA, 19 nt, Mycobacterium tuberculosis H37Rv
aaucucccgaaucgugcgg

SEQ ID NO: 1297396 - RNA, 18 nt, Mycobacterium tuberculosis H37Rv
aaucgccgucagcaccgc

SEQ ID NO: 1297397 - RNA, 21 nt, Mycobacterium tuberculosis H37Rv
uuuugggaucgugccggcgaa

SEQ ID NO: 1297398 - RNA, 14 nt, Mycobacterium tuberculosis H37Rv
aaucgcccucgucg

SEQ ID NO: 1297399 - RNA, 18 nt, Mycobacterium tuberculosis H37Rv
aaugccgggcccgacguu

SEQ ID NO: 1297400 - RNA, 16 nt, Mycobacterium tuberculosis H37Rv
aauucaacagcaccgc

SEQ ID NO: 1297401 - RNA, 18 nt, Mycobacterium tuberculosis H37Rv
aauucagauagucgccgc

SEQ ID NO: 1297402 - RNA, 21 nt, Mycobacterium tuberculosis H37Rv
aauucacgacgccgagcagau

SEQ ID NO: 1297403 - RNA, 21 nt, Mycobacterium tuberculosis H37Rv
aauucgaccgcgcggaucuca

SEQ ID NO: 1297404 - RNA, 22 nt, Mycobacterium tuberculosis H37Rv
aauuccgcuugcucucgcagca

SEQ ID NO: 1297405 - RNA, 18 nt, Mycobacterium tuberculosis H37Rv
aauuccuacgccgccagc

SEQ ID NO: 1297406 - RNA, 14 nt, Mycobacterium tuberculosis H37Rv
aauucggcgagcgc

SEQ ID NO: 1297407 - RNA, 22 nt, Mycobacterium tuberculosis H37Rv
aauugccgggcgcacgcccgca

SEQ ID NO: 1297408 - RNA, 16 nt, Mycobacterium tuberculosis H37Rv
aauugcaacagagcgc

SEQ ID NO: 1297409 - RNA, 16 nt, Mycobacterium tuberculosis H37Rv
aauugaugaucugcag

SEQ ID NO: 1297410 - RNA, 17 nt, Mycobacterium tuberculosis H37Rv
aauuucacugcgagcgc

SEQ ID NO: 1297411 - RNA, 14 nt, Mycobacterium tuberculosis H37Rv
uggcgacggugcgc

SEQ ID NO: 1297412 - RNA, 17 nt, Mycobacterium tuberculosis H37Rv
uggcgacguauuucgcc

SEQ ID NO: 1297413 - RNA, 18 nt, Mycobacterium tuberculosis H37Rv
uggcgacgucgcggguga

SEQ ID NO: 1297414 - RNA, 17 nt, Mycobacterium tuberculosis H37Rv
uggcgacgaacgccguc

SEQ ID NO: 1297415 - RNA, 18 nt, Mycobacterium tuberculosis H37Rv
uggcgacgacgacaccgc

SEQ ID NO: 1297416 - RNA, 21 nt, Mycobacterium tuberculosis H37Rv
uggcgaacagugacgccacga

SEQ ID NO: 1297417 - RNA, 16 nt, Mycobacterium tuberculosis H37Rv
uggcgacgaacgccgu

SEQ ID NO: 1297418 - RNA, 19 nt, Mycobacterium tuberculosis H37Rv
uggcgcccccgacgacggc

SEQ ID NO: 1297419 - RNA, 18 nt, Mycobacterium tuberculosis H37Rv
uggcgcccgaagccgggc

SEQ ID NO: 1297420 - RNA, 22 nt, Mycobacterium tuberculosis H37Rv
uggcgcccgccggcaaccggga

SEQ ID NO: 1297421 - RNA, 13 nt, Mycobacterium tuberculosis H37Rv
uggcgccgacagg

SEQ ID NO: 1297422 - RNA, 18 nt, Mycobacterium tuberculosis H37Rv
uggcgcccuugccggcga

SEQ ID NO: 1297423 - RNA, 23 nt, Mycobacterium tuberculosis H37Rv
uggcgcccuugccggcgagagcg

SEQ ID NO: 1297424 - RNA, 14 nt, Mycobacterium tuberculosis H37Rv
uggcggcagcagcg

SEQ ID NO: 1297425 - RNA, 12 nt, Mycobacterium tuberculosis H37Rv
uggcggcaggug

SEQ ID NO: 1297426 - RNA, 23 nt, Mycobacterium tuberculosis H37Rv
uggcggcagcgguuuuaggcagc

SEQ ID NO: 1297427 - RNA, 21 nt, Mycobacterium tuberculosis H37Rv
uggcggccacaacagggugac

SEQ ID NO: 1297428 - RNA, 20 nt, Mycobacterium tuberculosis H37Rv
uggcggccaccgucagcgcg

SEQ ID NO: 1297429 - RNA, 16 nt, Mycobacterium tuberculosis H37Rv
uggcgcggcacccggu

SEQ ID NO: 1297430 - RNA, 20 nt, Mycobacterium tuberculosis H37Rv
uggcgcgcccacagcccggg

SEQ ID NO: 1297431 - RNA, 21 nt, Mycobacterium tuberculosis H37Rv
uggcgcgcagguagucgacga

SEQ ID NO: 1297432 - RNA, 16 nt, Mycobacterium tuberculosis H37Rv
uggcgccaggucggcg

SEQ ID NO: 1297433 - RNA, 17 nt, Mycobacterium tuberculosis H37Rv
uggccuuugccgucgag

SEQ ID NO: 1297434 - RNA, 15 nt, Mycobacterium tuberculosis H37Rv
uggcgaaauccgcga

SEQ ID NO: 1297435 - RNA, 19 nt, Mycobacterium tuberculosis H37Rv
uggccucguccagcucggu

SEQ ID NO: 1297436 - RNA, 17 nt, Mycobacterium tuberculosis H37Rv
uggccugcagcgcgacc

SEQ ID NO: 1297437 - RNA, 21 nt, Mycobacterium tuberculosis H37Rv
uggccugcccagcaccaccgc

SEQ ID NO: 1297438 - RNA, 13 nt, Mycobacterium tuberculosis H37Rv
uggccucgaaggg

SEQ ID NO: 1297439 - RNA, 15 nt, Mycobacterium tuberculosis H37Rv
uggccucagcccggc

SEQ ID NO: 1297440 - RNA, 17 nt, Mycobacterium tuberculosis H37Rv
uggcaucgaacgcccug

SEQ ID NO: 1297441 - RNA, 16 nt, Mycobacterium tuberculosis H37Rv
uggcauccaaaaucgc

SEQ ID NO: 1297442 - RNA, 17 nt, Mycobacterium tuberculosis H37Rv
uggcaguccagccgggu

SEQ ID NO: 1297443 - RNA, 17 nt, Mycobacterium tuberculosis H37Rv
uggccggcgccaccgag

SEQ ID NO: 1297444 - RNA, 15 nt, Mycobacterium tuberculosis H37Rv
uggccggccaucgcc

SEQ ID NO: 1297445 - RNA, 21 nt, Mycobacterium tuberculosis H37Rv
uggccgcugucguaccgcucg

SEQ ID NO: 1297446 - RNA, 16 nt, Mycobacterium tuberculosis H37Rv
uggcucgcucugcgcg

SEQ ID NO: 1297447 - RNA, 18 nt, Mycobacterium tuberculosis H37Rv
uggcuccgaaguccacgc

SEQ ID NO: 1297448 - RNA, 19 nt, Mycobacterium tuberculosis H37Rv
uggcuccggugaaccggga

SEQ ID NO: 1297449 - RNA, 13 nt, Mycobacterium tuberculosis H37Rv
uggcucacgcucc

SEQ ID NO: 1297450 - RNA, 18 nt, Mycobacterium tuberculosis H37Rv
uggcguuugccggccgau

SEQ ID NO: 1297451 - RNA, 17 nt, Mycobacterium tuberculosis H37Rv
uggcguugguggucugc

SEQ ID NO: 1297452 - RNA, 15 nt, Mycobacterium tuberculosis H37Rv
uggcguucggugagg

SEQ ID NO: 1297453 - RNA, 20 nt, Mycobacterium tuberculosis H37Rv
uggcguucagcggccagcag

SEQ ID NO: 1297454 - RNA, 23 nt, Mycobacterium tuberculosis H37Rv
uggcguagggcuguccgaccucg

SEQ ID NO: 1297455 - RNA, 19 nt, Mycobacterium tuberculosis H37Rv
uggcguauccuugcgacgu

SEQ ID NO: 1297456 - RNA, 19 nt, Mycobacterium tuberculosis H37Rv
uggcguggcccucggcgau

SEQ ID NO: 1297457 - RNA, 12 nt, Mycobacterium tuberculosis H37Rv
uggcgugcaccg

SEQ ID NO: 1297458 - RNA, 16 nt, Mycobacterium tuberculosis H37Rv
uggcguguucgacggc

SEQ ID NO: 1297459 - RNA, 21 nt, Mycobacterium tuberculosis H37Rv
uggcgguggugccgcggccac

SEQ ID NO: 1297460 - RNA, 14 nt, Mycobacterium tuberculosis H37Rv
uggcggcccggugg

SEQ ID NO: 1297461 - RNA, 20 nt, Mycobacterium tuberculosis H37Rv
uggcggccgggucggugacg

SEQ ID NO: 1297462 - RNA, 17 nt, Mycobacterium tuberculosis H37Rv
uggcggccuaacucgcc

SEQ ID NO: 1297463 - RNA, 15 nt, Mycobacterium tuberculosis H37Rv
uggcggcccggguug

SEQ ID NO: 1297464 - RNA, 13 nt, Mycobacterium tuberculosis H37Rv
ugggagucgucgu

SEQ ID NO: 1297465 - RNA, 21 nt, Mycobacterium tuberculosis H37Rv
ugggcaaacugggcaccggcg

SEQ ID NO: 1297466 - RNA, 23 nt, Mycobacterium tuberculosis H37Rv
ugggacaacgugccgaacgccag

SEQ ID NO: 1297467 - RNA, 20 nt, Mycobacterium tuberculosis H37Rv
ugggacgucuccaccgcgau

SEQ ID NO: 1297468 - RNA, 14 nt, Mycobacterium tuberculosis H37Rv
ugggacgcgcggau

SEQ ID NO: 1297469 - RNA, 15 nt, Mycobacterium tuberculosis H37Rv
ugggagcuacgguac

SEQ ID NO: 1297470 - RNA, 22 nt, Mycobacterium tuberculosis H37Rv
ugggagccaccggcgucgacgu

SEQ ID NO: 1297471 - RNA, 22 nt, Mycobacterium tuberculosis H37Rv
ugggcaucacuucauggggcua

SEQ ID NO: 1297472 - RNA, 12 nt, Mycobacterium tuberculosis H37Rv
ugggcaucaccg

SEQ ID NO: 1297473 - RNA, 22 nt, Mycobacterium tuberculosis H37Rv
ugggcagauauugccugccacc

SEQ ID NO: 1297474 - RNA, 19 nt, Mycobacterium tuberculosis H37Rv
ugggcacggagaccgugga

SEQ ID NO: 1297475 - RNA, 19 nt, Mycobacterium tuberculosis H37Rv
ugggcaagcugaccgccag

SEQ ID NO: 1297476 - RNA, 16 nt, Mycobacterium tuberculosis H37Rv
uggcuggcaugccggc

SEQ ID NO: 1297477 - RNA, 13 nt, Mycobacterium tuberculosis H37Rv
uggcugaucccgg

SEQ ID NO: 1297478 - RNA, 20 nt, Mycobacterium tuberculosis H37Rv
uggcuguaaaaaugcuucgc

SEQ ID NO: 1297479 - RNA, 15 nt, Mycobacterium tuberculosis H37Rv
uggcuggcggcgacc

SEQ ID NO: 1297480 - RNA, 18 nt, Mycobacterium tuberculosis H37Rv
uggcuucgaagcgaucgc

SEQ ID NO: 1297481 - RNA, 17 nt, Mycobacterium tuberculosis H37Rv
uggcuucgaagcgaucg

SEQ ID NO: 1297482 - RNA, 19 nt, Mycobacterium tuberculosis H37Rv
uggcuuuugcgucugcucg

SEQ ID NO: 1297483 - RNA, 16 nt, Mycobacterium tuberculosis H37Rv
uggcuuuugcgccgaa

SEQ ID NO: 1297484 - RNA, 12 nt, Mycobacterium tuberculosis H37Rv
uggcuuucggua

SEQ ID NO: 1297485 - RNA, 14 nt, Mycobacterium tuberculosis H37Rv
uggucagccgguga

SEQ ID NO: 1297486 - RNA, 15 nt, Mycobacterium tuberculosis H37Rv
ugguccggccgcgga

SEQ ID NO: 1297487 - RNA, 20 nt, Mycobacterium tuberculosis H37Rv
uggucgaaacgguacgccgc

SEQ ID NO: 1297488 - RNA, 19 nt, Mycobacterium tuberculosis H37Rv
uggucgauucgucgaaggg

SEQ ID NO: 1297489 - RNA, 23 nt, Mycobacterium tuberculosis H37Rv
uggucgaugaaccaaucgcacgc

SEQ ID NO: 1297490 - RNA, 22 nt, Mycobacterium tuberculosis H37Rv
uggucgagucgaugaccccggu

SEQ ID NO: 1297491 - RNA, 22 nt, Mycobacterium tuberculosis H37Rv
uggucgacgccgagaccgccgc

SEQ ID NO: 1297492 - RNA, 18 nt, Mycobacterium tuberculosis H37Rv
uggucgacgaaucugcgg

SEQ ID NO: 1297493 - RNA, 15 nt, Mycobacterium tuberculosis H37Rv
uggucgacgccgaga

SEQ ID NO: 1297494 - RNA, 15 nt, Mycobacterium tuberculosis H37Rv
uggucaccgucugca

SEQ ID NO: 1297495 - RNA, 23 nt, Mycobacterium tuberculosis H37Rv
ugguacgugaauuaaggugacca

SEQ ID NO: 1297496 - RNA, 17 nt, Mycobacterium tuberculosis H37Rv
ugguacuuucacgcucg

SEQ ID NO: 1297497 - RNA, 15 nt, Mycobacterium tuberculosis H37Rv
ugguacagggugugc

SEQ ID NO: 1297498 - RNA, 20 nt, Mycobacterium tuberculosis H37Rv
ugggucaugccguagguugc

SEQ ID NO: 1297499 - RNA, 20 nt, Mycobacterium tuberculosis H37Rv
ugggucggcuuccggugccg

SEQ ID NO: 1297500 - RNA, 13 nt, Mycobacterium tuberculosis H37Rv
uggguacccgauc

SEQ ID NO: 1297501 - RNA, 14 nt, Mycobacterium tuberculosis H37Rv
uggguauccaccgc

SEQ ID NO: 1297502 - RNA, 15 nt, Mycobacterium tuberculosis H37Rv
ugggccucgaucagc

SEQ ID NO: 1297503 - RNA, 22 nt, Mycobacterium tuberculosis H37Rv
ugggccucgaucagcgccggau

SEQ ID NO: 1297504 - RNA, 18 nt, Mycobacterium tuberculosis H37Rv
ugggccacuugaugcucg

SEQ ID NO: 1297505 - RNA, 16 nt, Mycobacterium tuberculosis H37Rv
uggugaccgacgcgga

SEQ ID NO: 1297506 - RNA, 16 nt, Mycobacterium tuberculosis H37Rv
uggugacggugaagcc

SEQ ID NO: 1297507 - RNA, 17 nt, Mycobacterium tuberculosis H37Rv
uggugagccucggcgag

SEQ ID NO: 1297508 - RNA, 17 nt, Mycobacterium tuberculosis H37Rv
uggugagugcgucucgg

SEQ ID NO: 1297509 - RNA, 15 nt, Mycobacterium tuberculosis H37Rv
uggugagugcgucuc

SEQ ID NO: 1297510 - RNA, 15 nt, Mycobacterium tuberculosis H37Rv
uggugagguggucag

SEQ ID NO: 1297511 - RNA, 22 nt, Mycobacterium tuberculosis H37Rv
uggucgugggccaccaccucgg

SEQ ID NO: 1297512 - RNA, 20 nt, Mycobacterium tuberculosis H37Rv
uggucgucauccuggucacc

SEQ ID NO: 1297513 - RNA, 14 nt, Mycobacterium tuberculosis H37Rv
uggucguaggugac

SEQ ID NO: 1297514 - RNA, 24 nt, Mycobacterium tuberculosis H37Rv
uggucgucggaguaccgcgcguug

SEQ ID NO: 1297515 - RNA, 20 nt, Mycobacterium tuberculosis H37Rv
uggucggugccagcaccacg

SEQ ID NO: 1297516 - RNA, 21 nt, Mycobacterium tuberculosis H37Rv
uggucggcgagcgcccgcagc

SEQ ID NO: 1297517 - RNA, 14 nt, Mycobacterium tuberculosis H37Rv
uggucggccgcaag

SEQ ID NO: 1297518 - RNA, 16 nt, Mycobacterium tuberculosis H37Rv
uggucggccaggucga

SEQ ID NO: 1297519 - RNA, 21 nt, Mycobacterium tuberculosis H37Rv
uggucggagaccagcgucuuc

SEQ ID NO: 1297520 - RNA, 17 nt, Mycobacterium tuberculosis H37Rv
uggucggacagcgucuc

SEQ ID NO: 1297521 - RNA, 22 nt, Mycobacterium tuberculosis H37Rv
uggucgcugcugcgaucgccgc

SEQ ID NO: 1297522 - RNA, 19 nt, Mycobacterium tuberculosis H37Rv
uggucgcgguggcggcggu

SEQ ID NO: 1297523 - RNA, 19 nt, Mycobacterium tuberculosis H37Rv
uggucgcgaccgaccgcau

SEQ ID NO: 1297524 - RNA, 16 nt, Mycobacterium tuberculosis H37Rv
uggucgccgcggcagc

SEQ ID NO: 1297525 - RNA, 16 nt, Mycobacterium tuberculosis H37Rv
uggugauggccgacgu

SEQ ID NO: 1297526 - RNA, 20 nt, Mycobacterium tuberculosis H37Rv
uggugaugccgaugaccgcc

SEQ ID NO: 1297527 - RNA, 13 nt, Mycobacterium tuberculosis H37Rv
aaucaagcagcgu

SEQ ID NO: 1297528 - RNA, 20 nt, Mycobacterium tuberculosis H37Rv
aaucaaggugaucagcagga

SEQ ID NO: 1297529 - RNA, 18 nt, Mycobacterium tuberculosis H37Rv
uggugccuacaccggcaa

SEQ ID NO: 1297530 - RNA, 15 nt, Mycobacterium tuberculosis H37Rv
uggugccuucaccgc

SEQ ID NO: 1297531 - RNA, 14 nt, Mycobacterium tuberculosis H37Rv
uggugugcccgcac

SEQ ID NO: 1297532 - RNA, 15 nt, Mycobacterium tuberculosis H37Rv
uggugugucggguug

SEQ ID NO: 1297533 - RNA, 13 nt, Mycobacterium tuberculosis H37Rv
ugguguccaccgc

SEQ ID NO: 1297534 - RNA, 18 nt, Mycobacterium tuberculosis H37Rv
ugguguugguguagacga

SEQ ID NO: 1297535 - RNA, 12 nt, Mycobacterium tuberculosis H37Rv
ugguguccacca

SEQ ID NO: 1297536 - RNA, 14 nt, Mycobacterium tuberculosis H37Rv
ugucgacggccacc

SEQ ID NO: 1297537 - RNA, 16 nt, Mycobacterium tuberculosis H37Rv
ugucgaucaccugcag

SEQ ID NO: 1297538 - RNA, 23 nt, Mycobacterium tuberculosis H37Rv
uguccuuauuggacugcagcgug

SEQ ID NO: 1297539 - RNA, 17 nt, Mycobacterium tuberculosis H37Rv
uguccuuugccaccucg

SEQ ID NO: 1297540 - RNA, 19 nt, Mycobacterium tuberculosis H37Rv
ugucgaagaauaugccgau

SEQ ID NO: 1297541 - RNA, 18 nt, Mycobacterium tuberculosis H37Rv
ugucgcaacgcaucgaug

SEQ ID NO: 1297542 - RNA, 16 nt, Mycobacterium tuberculosis H37Rv
ugucgccgaucaccgc

SEQ ID NO: 1297543 - RNA, 19 nt, Mycobacterium tuberculosis H37Rv
ugucgcccucgaucgccac

SEQ ID NO: 1297544 - RNA, 14 nt, Mycobacterium tuberculosis H37Rv
ugucgcgcugcugu

SEQ ID NO: 1297545 - RNA, 13 nt, Mycobacterium tuberculosis H37Rv
uguccagcaugcc

SEQ ID NO: 1297546 - RNA, 13 nt, Mycobacterium tuberculosis H37Rv
uguccccgacgga

SEQ ID NO: 1297547 - RNA, 19 nt, Mycobacterium tuberculosis H37Rv
uguccccccgcgcagauac

SEQ ID NO: 1297548 - RNA, 16 nt, Mycobacterium tuberculosis H37Rv
uguccagccaggcgau

SEQ ID NO: 1297549 - RNA, 23 nt, Mycobacterium tuberculosis H37Rv
uguccaggaauuccccaccgucg

SEQ ID NO: 1297550 - RNA, 17 nt, Mycobacterium tuberculosis H37Rv
uguccggucgccaagug

SEQ ID NO: 1297551 - RNA, 20 nt, Mycobacterium tuberculosis H37Rv
uguccggggaccucggcgau

SEQ ID NO: 1297552 - RNA, 19 nt, Mycobacterium tuberculosis H37Rv
uguccgggcugcaugcggu

SEQ ID NO: 1297553 - RNA, 12 nt, Mycobacterium tuberculosis H37Rv
uguccgggaccg

SEQ ID NO: 1297554 - RNA, 21 nt, Mycobacterium tuberculosis H37Rv
uguccgacgccaccgccacca

SEQ ID NO: 1297555 - RNA, 16 nt, Mycobacterium tuberculosis H37Rv
uguccgaccucgccgc

SEQ ID NO: 1297556 - RNA, 21 nt, Mycobacterium tuberculosis H37Rv
uguccggauagacgugcacca

SEQ ID NO: 1297557 - RNA, 17 nt, Mycobacterium tuberculosis H37Rv
uguccgcagcaccgucg

SEQ ID NO: 1297558 - RNA, 12 nt, Mycobacterium tuberculosis H37Rv
uguccgacgcga

SEQ ID NO: 1297559 - RNA, 17 nt, Mycobacterium tuberculosis H37Rv
uguccaccgccaccacg

SEQ ID NO: 1297560 - RNA, 18 nt, Mycobacterium tuberculosis H37Rv
uguccacgaugacgucga

SEQ ID NO: 1297561 - RNA, 19 nt, Mycobacterium tuberculosis H37Rv
uguccaccgcggcgucgcc

SEQ ID NO: 1297562 - RNA, 12 nt, Mycobacterium tuberculosis H37Rv
uguccaccauca

SEQ ID NO: 1297563 - RNA, 19 nt, Mycobacterium tuberculosis H37Rv
ugucagcuaauaccugcgg

SEQ ID NO: 1297564 - RNA, 15 nt, Mycobacterium tuberculosis H37Rv
uguaugcauccacug

SEQ ID NO: 1297565 - RNA, 23 nt, Mycobacterium tuberculosis H37Rv
ugguucgaauuggugcgcaucga

SEQ ID NO: 1297566 - RNA, 22 nt, Mycobacterium tuberculosis H37Rv
ugguucgacucaugccgagcga

SEQ ID NO: 1297567 - RNA, 13 nt, Mycobacterium tuberculosis H37Rv
ugguucaccucgg

SEQ ID NO: 1297568 - RNA, 13 nt, Mycobacterium tuberculosis H37Rv
ugguucaaccgga

SEQ ID NO: 1297569 - RNA, 13 nt, Mycobacterium tuberculosis H37Rv
ugguugaccucgg

SEQ ID NO: 1297570 - RNA, 18 nt, Mycobacterium tuberculosis H37Rv
ugcgcaucgccgacagcg

SEQ ID NO: 1297571 - RNA, 14 nt, Mycobacterium tuberculosis H37Rv
ugcgcauccgucgu

SEQ ID NO: 1297572 - RNA, 15 nt, Mycobacterium tuberculosis H37Rv
ugcgcaucgagcguc

SEQ ID NO: 1297573 - RNA, 14 nt, Mycobacterium tuberculosis H37Rv
ugcgccgcgcagcg

SEQ ID NO: 1297574 - RNA, 21 nt, Mycobacterium tuberculosis H37Rv
ugcgccuugaagcgguggacg

SEQ ID NO: 1297575 - RNA, 18 nt, Mycobacterium tuberculosis H37Rv
ugcgccggaugacaccga

SEQ ID NO: 1297576 - RNA, 16 nt, Mycobacterium tuberculosis H37Rv
ugcgccggaugacacc

SEQ ID NO: 1297577 - RNA, 13 nt, Mycobacterium tuberculosis H37Rv
ugcgccucggcgg

SEQ ID NO: 1297578 - RNA, 23 nt, Mycobacterium tuberculosis H37Rv
ugcgcgccguucacccugguggu

SEQ ID NO: 1297579 - RNA, 16 nt, Mycobacterium tuberculosis H37Rv
ugcgcgauaggugcuc

SEQ ID NO: 1297580 - RNA, 12 nt, Mycobacterium tuberculosis H37Rv
ugcgcgcagacu

SEQ ID NO: 1297581 - RNA, 14 nt, Mycobacterium tuberculosis H37Rv
ugcgcggcaucccg

SEQ ID NO: 1297582 - RNA, 15 nt, Mycobacterium tuberculosis H37Rv
ugcgcggcccgcauc

SEQ ID NO: 1297583 - RNA, 16 nt, Mycobacterium tuberculosis H37Rv
ugcgcggcccgcaucg

SEQ ID NO: 1297584 - RNA, 22 nt, Mycobacterium tuberculosis H37Rv
ugcgcgcgcagaucguccaccg

SEQ ID NO: 1297585 - RNA, 15 nt, Mycobacterium tuberculosis H37Rv
ugcgcgcguugcggu

SEQ ID NO: 1297586 - RNA, 14 nt, Mycobacterium tuberculosis H37Rv
ugcgcgcggcgacc

SEQ ID NO: 1297587 - RNA, 23 nt, Mycobacterium tuberculosis H37Rv
ugcgcggcuugucgcggugcggc

SEQ ID NO: 1297588 - RNA, 23 nt, Mycobacterium tuberculosis H37Rv
ugcgcggcgcgggucacgccguc

SEQ ID NO: 1297589 - RNA, 18 nt, Mycobacterium tuberculosis H37Rv
ugcgcgguagcucgucga

SEQ ID NO: 1297590 - RNA, 13 nt, Mycobacterium tuberculosis H37Rv
ugcgcggugaccg

SEQ ID NO: 1297591 - RNA, 17 nt, Mycobacterium tuberculosis H37Rv
ugcgcggugcgcgugac

SEQ ID NO: 1297592 - RNA, 15 nt, Mycobacterium tuberculosis H37Rv
ugcgcgucagccgca

SEQ ID NO: 1297593 - RNA, 13 nt, Mycobacterium tuberculosis H37Rv
ugcgcuaggugcg

SEQ ID NO: 1297594 - RNA, 15 nt, Mycobacterium tuberculosis H37Rv
ugcgcgugcugcgga

SEQ ID NO: 1297595 - RNA, 16 nt, Mycobacterium tuberculosis H37Rv
ugcggcccaaccgguc

SEQ ID NO: 1297596 - RNA, 20 nt, Mycobacterium tuberculosis H37Rv
ugcggcccacaccagcgcag

SEQ ID NO: 1297597 - RNA, 17 nt, Mycobacterium tuberculosis H37Rv
ugcggcaguaccccucg

SEQ ID NO: 1297598 - RNA, 19 nt, Mycobacterium tuberculosis H37Rv
ugcggcagauacucggcga

SEQ ID NO: 1297599 - RNA, 13 nt, Mycobacterium tuberculosis H37Rv
ugcggauccacca

SEQ ID NO: 1297600 - RNA, 22 nt, Mycobacterium tuberculosis H37Rv
ugcggcagaccaagcccgucgu

SEQ ID NO: 1297601 - RNA, 13 nt, Mycobacterium tuberculosis H37Rv
ugcgcuggucgca

SEQ ID NO: 1297602 - RNA, 21 nt, Mycobacterium tuberculosis H37Rv
ugcgcugguggcggcgacacg

SEQ ID NO: 1297603 - RNA, 14 nt, Mycobacterium tuberculosis H37Rv
ugcggaacggccag

SEQ ID NO: 1297604 - RNA, 17 nt, Mycobacterium tuberculosis H37Rv
ugcgcuguugcuggcgc

SEQ ID NO: 1297605 - RNA, 19 nt, Mycobacterium tuberculosis H37Rv
ugcggacgguguacagguc

SEQ ID NO: 1297606 - RNA, 16 nt, Mycobacterium tuberculosis H37Rv
ugcggacaucaccggc

SEQ ID NO: 1297607 - RNA, 18 nt, Mycobacterium tuberculosis H37Rv
ugccgcgcucgcgcaccg

SEQ ID NO: 1297608 - RNA, 15 nt, Mycobacterium tuberculosis H37Rv
ugccgcggccaccgc

SEQ ID NO: 1297609 - RNA, 19 nt, Mycobacterium tuberculosis H37Rv
ugccgcgguugugcugggu

SEQ ID NO: 1297610 - RNA, 13 nt, Mycobacterium tuberculosis H37Rv
ugccgcggucgua

SEQ ID NO: 1297611 - RNA, 20 nt, Mycobacterium tuberculosis H37Rv
ugccgcggugccaaccgcgg

SEQ ID NO: 1297612 - RNA, 17 nt, Mycobacterium tuberculosis H37Rv
ugccgcggucggcgacg

SEQ ID NO: 1297613 - RNA, 15 nt, Mycobacterium tuberculosis H37Rv
ugccgcggucggcga

SEQ ID NO: 1297614 - RNA, 14 nt, Mycobacterium tuberculosis H37Rv
ugccgcggucggcg

SEQ ID NO: 1297615 - RNA, 19 nt, Mycobacterium tuberculosis H37Rv
ugccgcggcugccaucccg

SEQ ID NO: 1297616 - RNA, 18 nt, Mycobacterium tuberculosis H37Rv
ugccgcgggacaucaccg

SEQ ID NO: 1297617 - RNA, 20 nt, Mycobacterium tuberculosis H37Rv
ugccgcggccaguacgucga

SEQ ID NO: 1297618 - RNA, 16 nt, Mycobacterium tuberculosis H37Rv
ugccguggaagacguc

SEQ ID NO: 1297619 - RNA, 23 nt, Mycobacterium tuberculosis H37Rv
ugccguggaagacgucgagguug

SEQ ID NO: 1297620 - RNA, 13 nt, Mycobacterium tuberculosis H37Rv
ugccgugcccggu

SEQ ID NO: 1297621 - RNA, 22 nt, Mycobacterium tuberculosis H37Rv
ugccucgucgccgcgguagacg

SEQ ID NO: 1297622 - RNA, 18 nt, Mycobacterium tuberculosis H37Rv
ugccucucuccgcgcucg

SEQ ID NO: 1297623 - RNA, 15 nt, Mycobacterium tuberculosis H37Rv
ugccucucagcacgg

SEQ ID NO: 1297624 - RNA, 13 nt, Mycobacterium tuberculosis H37Rv
ugccucgaccugg

SEQ ID NO: 1297625 - RNA, 19 nt, Mycobacterium tuberculosis H37Rv
ugccucgcggggucugucg

SEQ ID NO: 1297626 - RNA, 14 nt, Mycobacterium tuberculosis H37Rv
ugccucaccgccgc

SEQ ID NO: 1297627 - RNA, 21 nt, Mycobacterium tuberculosis H37Rv
ugccgugguggacgaugcggu

SEQ ID NO: 1297628 - RNA, 23 nt, Mycobacterium tuberculosis H37Rv
ugccgugcucaccggcgcccagc

SEQ ID NO: 1297629 - RNA, 19 nt, Mycobacterium tuberculosis H37Rv
ugccguugagugggagcua

SEQ ID NO: 1297630 - RNA, 16 nt, Mycobacterium tuberculosis H37Rv
ugccguugcgaucgcg

SEQ ID NO: 1297631 - RNA, 16 nt, Mycobacterium tuberculosis H37Rv
ugcgagucgucgccaa

SEQ ID NO: 1297632 - RNA, 20 nt, Mycobacterium tuberculosis H37Rv
ugcgaggccgcacgucgacc

SEQ ID NO: 1297633 - RNA, 21 nt, Mycobacterium tuberculosis H37Rv
ugcgaggggauuuugcgucug

SEQ ID NO: 1297634 - RNA, 14 nt, Mycobacterium tuberculosis H37Rv
ugcgacgauaucgg

SEQ ID NO: 1297635 - RNA, 22 nt, Mycobacterium tuberculosis H37Rv
ugcgacgaaguucucuagcucg

SEQ ID NO: 1297636 - RNA, 21 nt, Mycobacterium tuberculosis H37Rv
ugcgacgcagaccguccagca

SEQ ID NO: 1297637 - RNA, 13 nt, Mycobacterium tuberculosis H37Rv
ugcgagcugcggg

SEQ ID NO: 1297638 - RNA, 15 nt, Mycobacterium tuberculosis H37Rv
ugcgacgaaccggau

SEQ ID NO: 1297639 - RNA, 19 nt, Mycobacterium tuberculosis H37Rv
ugcgacccgucgaacgcgc

SEQ ID NO: 1297640 - RNA, 12 nt, Mycobacterium tuberculosis H37Rv
ugccugcgcacg

SEQ ID NO: 1297641 - RNA, 16 nt, Mycobacterium tuberculosis H37Rv
ugcgacagcacgugcc

SEQ ID NO: 1297642 - RNA, 16 nt, Mycobacterium tuberculosis H37Rv
aauaggugucgacgcg

SEQ ID NO: 1297643 - RNA, 21 nt, Mycobacterium tuberculosis H37Rv
ugcgauuuugugucugcucgc

SEQ ID NO: 1297644 - RNA, 14 nt, Mycobacterium tuberculosis H37Rv
ugcgcaaauuugaa

SEQ ID NO: 1297645 - RNA, 14 nt, Mycobacterium tuberculosis H37Rv
ugcgcaacaccgug

SEQ ID NO: 1297646 - RNA, 20 nt, Mycobacterium tuberculosis H37Rv
ugcgauuuugugucugcucg

SEQ ID NO: 1297647 - RNA, 19 nt, Mycobacterium tuberculosis H37Rv
ugcgauuuugugucugcuc

SEQ ID NO: 1297648 - RNA, 18 nt, Mycobacterium tuberculosis H37Rv
ugcgauuuugugucugcu

SEQ ID NO: 1297649 - RNA, 12 nt, Mycobacterium tuberculosis H37Rv
ugcgaucgccgc

SEQ ID NO: 1297650 - RNA, 19 nt, Mycobacterium tuberculosis H37Rv
ugcgauccagggccgacgc

SEQ ID NO: 1297651 - RNA, 17 nt, Mycobacterium tuberculosis H37Rv
ugcgcagguacgccucg

SEQ ID NO: 1297652 - RNA, 19 nt, Mycobacterium tuberculosis H37Rv
ugcgcagguacgccucgac

SEQ ID NO: 1297653 - RNA, 16 nt, Mycobacterium tuberculosis H37Rv
ugcgcagcgccugcgg

SEQ ID NO: 1297654 - RNA, 19 nt, Mycobacterium tuberculosis H37Rv
ugcgcagcggcauccacac

SEQ ID NO: 1297655 - RNA, 17 nt, Mycobacterium tuberculosis H37Rv
ugcgcagcgcaacaucg

SEQ ID NO: 1297656 - RNA, 21 nt, Mycobacterium tuberculosis H37Rv
uggcaccaccccgaggccgac

SEQ ID NO: 1297657 - RNA, 17 nt, Mycobacterium tuberculosis H37Rv
uggcaacgacacgccgc

SEQ ID NO: 1297658 - RNA, 21 nt, Mycobacterium tuberculosis H37Rv
uggcaagcacggcgucgaugu

SEQ ID NO: 1297659 - RNA, 21 nt, Mycobacterium tuberculosis H37Rv
uggcaaucgaggaaggugugc

SEQ ID NO: 1297660 - RNA, 12 nt, Mycobacterium tuberculosis H37Rv
uggcagcgcacc

SEQ ID NO: 1297661 - RNA, 17 nt, Mycobacterium tuberculosis H37Rv
uggcagagccgccguug

SEQ ID NO: 1297662 - RNA, 20 nt, Mycobacterium tuberculosis H37Rv
uggcagcuuugagucccggu

SEQ ID NO: 1297663 - RNA, 17 nt, Mycobacterium tuberculosis H37Rv
uggaugugggcgcucgc

SEQ ID NO: 1297664 - RNA, 16 nt, Mycobacterium tuberculosis H37Rv
uggaucacgucgaugu

SEQ ID NO: 1297665 - RNA, 11 nt, Mycobacterium tuberculosis H37Rv
uggaucagcgu

SEQ ID NO: 1297666 - RNA, 13 nt, Mycobacterium tuberculosis H37Rv
uggaucgcggugg

SEQ ID NO: 1297667 - RNA, 22 nt, Mycobacterium tuberculosis H37Rv
uggauccgggagucgacggugc

SEQ ID NO: 1297668 - RNA, 22 nt, Mycobacterium tuberculosis H37Rv
uggacgcccgcccgcacgacga

SEQ ID NO: 1297669 - RNA, 16 nt, Mycobacterium tuberculosis H37Rv
uggacgcccgaguuga

SEQ ID NO: 1297670 - RNA, 20 nt, Mycobacterium tuberculosis H37Rv
uggacgaugaaccgggcagc

SEQ ID NO: 1297671 - RNA, 16 nt, Mycobacterium tuberculosis H37Rv
uggaccgccgccgaca

SEQ ID NO: 1297672 - RNA, 19 nt, Mycobacterium tuberculosis H37Rv
uggacgauacgcgcaccgu

SEQ ID NO: 1297673 - RNA, 15 nt, Mycobacterium tuberculosis H37Rv
uggaccgaacgacuc

SEQ ID NO: 1297674 - RNA, 14 nt, Mycobacterium tuberculosis H37Rv
uggaccggucgaca

SEQ ID NO: 1297675 - RNA, 16 nt, Mycobacterium tuberculosis H37Rv
uggaagccgaccaccg

SEQ ID NO: 1297676 - RNA, 16 nt, Mycobacterium tuberculosis H37Rv
uggaagacgccggcga

SEQ ID NO: 1297677 - RNA, 19 nt, Mycobacterium tuberculosis H37Rv
uggaagacgucgagguuga

SEQ ID NO: 1297678 - RNA, 14 nt, Mycobacterium tuberculosis H37Rv
uggaagccgucucu

SEQ ID NO: 1297679 - RNA, 16 nt, Mycobacterium tuberculosis H37Rv
uggagccgccaccgag

SEQ ID NO: 1297680 - RNA, 21 nt, Mycobacterium tuberculosis H37Rv
uggagaugucggugaucacgg

SEQ ID NO: 1297681 - RNA, 19 nt, Mycobacterium tuberculosis H37Rv
uggaggccaccaccuucgg

SEQ ID NO: 1297682 - RNA, 15 nt, Mycobacterium tuberculosis H37Rv
uggaguucgcgcugg

SEQ ID NO: 1297683 - RNA, 17 nt, Mycobacterium tuberculosis H37Rv
uggagguucccgaaucu

SEQ ID NO: 1297684 - RNA, 17 nt, Mycobacterium tuberculosis H37Rv
uggacggccuccaucgc

SEQ ID NO: 1297685 - RNA, 23 nt, Mycobacterium tuberculosis H37Rv
ugcuggcgcccccgccauugccg

SEQ ID NO: 1297686 - RNA, 18 nt, Mycobacterium tuberculosis H37Rv
ugcuggcggccagcaucg

SEQ ID NO: 1297687 - RNA, 15 nt, Mycobacterium tuberculosis H37Rv
ugcuggccgcggcug

SEQ ID NO: 1297688 - RNA, 13 nt, Mycobacterium tuberculosis H37Rv
ugcuggcgaucgc

SEQ ID NO: 1297689 - RNA, 20 nt, Mycobacterium tuberculosis H37Rv
ugcuggucaagaucagcggu

SEQ ID NO: 1297690 - RNA, 12 nt, Mycobacterium tuberculosis H37Rv
ugcugggugccg

SEQ ID NO: 1297691 - RNA, 17 nt, Mycobacterium tuberculosis H37Rv
ugcugggugccgcagcu

SEQ ID NO: 1297692 - RNA, 16 nt, Mycobacterium tuberculosis H37Rv
ugcugccauugccgca

SEQ ID NO: 1297693 - RNA, 22 nt, Mycobacterium tuberculosis H37Rv
ugcugcgcaacaccaucagcga

SEQ ID NO: 1297694 - RNA, 18 nt, Mycobacterium tuberculosis H37Rv
ugcuauucgccagcgccg

SEQ ID NO: 1297695 - RNA, 19 nt, Mycobacterium tuberculosis H37Rv
ugcucaagcgcgucgucac

SEQ ID NO: 1297696 - RNA, 16 nt, Mycobacterium tuberculosis H37Rv
ugcucacccgucguca

SEQ ID NO: 1297697 - RNA, 14 nt, Mycobacterium tuberculosis H37Rv
ugcucacgcaucgc

SEQ ID NO: 1297698 - RNA, 16 nt, Mycobacterium tuberculosis H37Rv
ugcucagcggcucgcc

SEQ ID NO: 1297699 - RNA, 12 nt, Mycobacterium tuberculosis H37Rv
ugcucggugacg

SEQ ID NO: 1297700 - RNA, 15 nt, Mycobacterium tuberculosis H37Rv
ugcucguaggugccg

SEQ ID NO: 1297701 - RNA, 16 nt, Mycobacterium tuberculosis H37Rv
ugcucgucggucaccg

SEQ ID NO: 1297702 - RNA, 19 nt, Mycobacterium tuberculosis H37Rv
ugcucgucuuggcggcggu

SEQ ID NO: 1297703 - RNA, 15 nt, Mycobacterium tuberculosis H37Rv
ugcucguggguaccg

SEQ ID NO: 1297704 - RNA, 17 nt, Mycobacterium tuberculosis H37Rv
ugcguagcaggucgacg

SEQ ID NO: 1297705 - RNA, 23 nt, Mycobacterium tuberculosis H37Rv
ugcguagccgugggccacgauga

SEQ ID NO: 1297706 - RNA, 16 nt, Mycobacterium tuberculosis H37Rv
ugcggcgcucccgccg

SEQ ID NO: 1297707 - RNA, 13 nt, Mycobacterium tuberculosis H37Rv
ugcguaugcccac

SEQ ID NO: 1297708 - RNA, 16 nt, Mycobacterium tuberculosis H37Rv
ugcgugaugguugcuc

SEQ ID NO: 1297709 - RNA, 18 nt, Mycobacterium tuberculosis H37Rv
ugcgugcauaggccgcgu

SEQ ID NO: 1297710 - RNA, 17 nt, Mycobacterium tuberculosis H37Rv
ugcgugcggucgauccg

SEQ ID NO: 1297711 - RNA, 21 nt, Mycobacterium tuberculosis H37Rv
ugcuaugcaacaccgcaccgg

SEQ ID NO: 1297712 - RNA, 12 nt, Mycobacterium tuberculosis H37Rv
ugcguggcgaac

SEQ ID NO: 1297713 - RNA, 22 nt, Mycobacterium tuberculosis H37Rv
ugcguggcguugguggucugcc

SEQ ID NO: 1297714 - RNA, 20 nt, Mycobacterium tuberculosis H37Rv
ugcguggcguugguggucug

SEQ ID NO: 1297715 - RNA, 21 nt, Mycobacterium tuberculosis H37Rv
ugcguuggggcacgacgccgg

SEQ ID NO: 1297716 - RNA, 13 nt, Mycobacterium tuberculosis H37Rv
ugcguuccaucgc

SEQ ID NO: 1297717 - RNA, 17 nt, Mycobacterium tuberculosis H37Rv
ugcguuccgcgacagcg

SEQ ID NO: 1297718 - RNA, 21 nt, Mycobacterium tuberculosis H37Rv
guguggcuugcgucgcggacg

SEQ ID NO: 1297719 - RNA, 12 nt, Mycobacterium tuberculosis H37Rv
guguggucacca

SEQ ID NO: 1297720 - RNA, 21 nt, Mycobacterium tuberculosis H37Rv
guguggcccaaccgcauucgg

SEQ ID NO: 1297721 - RNA, 13 nt, Mycobacterium tuberculosis H37Rv
gugucugcucgcg

SEQ ID NO: 1297722 - RNA, 22 nt, Mycobacterium tuberculosis H37Rv
gugucucggcugauagggcugu

SEQ ID NO: 1297723 - RNA, 13 nt, Mycobacterium tuberculosis H37Rv
gugugcucggcca

SEQ ID NO: 1297724 - RNA, 16 nt, Mycobacterium tuberculosis H37Rv
gugucguacccggcaa

SEQ ID NO: 1297725 - RNA, 14 nt, Mycobacterium tuberculosis H37Rv
gugucgucgaccac

SEQ ID NO: 1297726 - RNA, 15 nt, Mycobacterium tuberculosis H37Rv
gugucgccacccgcg

SEQ ID NO: 1297727 - RNA, 16 nt, Mycobacterium tuberculosis H37Rv
gugucgggcugucagg

SEQ ID NO: 1297728 - RNA, 22 nt, Mycobacterium tuberculosis H37Rv
gugucgggaacgaguacgggca

SEQ ID NO: 1297729 - RNA, 22 nt, Mycobacterium tuberculosis H37Rv
gugucgggguacagacacgcgc

SEQ ID NO: 1297730 - RNA, 13 nt, Mycobacterium tuberculosis H37Rv
guguccgccggau

SEQ ID NO: 1297731 - RNA, 13 nt, Mycobacterium tuberculosis H37Rv
guguccucgucga

SEQ ID NO: 1297732 - RNA, 18 nt, Mycobacterium tuberculosis H37Rv
gugucccaagccugccga

SEQ ID NO: 1297733 - RNA, 12 nt, Mycobacterium tuberculosis H37Rv
gugguugccgaa

SEQ ID NO: 1297734 - RNA, 14 nt, Mycobacterium tuberculosis H37Rv
gugguucgucgucg

SEQ ID NO: 1297735 - RNA, 16 nt, Mycobacterium tuberculosis H37Rv
guggugugucaccgga

SEQ ID NO: 1297736 - RNA, 19 nt, Mycobacterium tuberculosis H37Rv
guggugucagccaccggug

SEQ ID NO: 1297737 - RNA, 14 nt, Mycobacterium tuberculosis H37Rv
guggugguagccau

SEQ ID NO: 1297738 - RNA, 19 nt, Mycobacterium tuberculosis H37Rv
gugguggcauaaccgcuga

SEQ ID NO: 1297739 - RNA, 15 nt, Mycobacterium tuberculosis H37Rv
guggugacacgacgu

SEQ ID NO: 1297740 - RNA, 18 nt, Mycobacterium tuberculosis H37Rv
gugguggaguuuccgaag

SEQ ID NO: 1297741 - RNA, 21 nt, Mycobacterium tuberculosis H37Rv
gugguggcgaucugggugccg

SEQ ID NO: 1297742 - RNA, 12 nt, Mycobacterium tuberculosis H37Rv
gugguggcguug

SEQ ID NO: 1297743 - RNA, 18 nt, Mycobacterium tuberculosis H37Rv
gugguggguugaucgcgc

SEQ ID NO: 1297744 - RNA, 16 nt, Mycobacterium tuberculosis H37Rv
guggucugcgcggugc

SEQ ID NO: 1297745 - RNA, 19 nt, Mycobacterium tuberculosis H37Rv
guggucugcgcggugcccg

SEQ ID NO: 1297746 - RNA, 13 nt, Mycobacterium tuberculosis H37Rv
guggucucgacgg

SEQ ID NO: 1297747 - RNA, 18 nt, Mycobacterium tuberculosis H37Rv
guggcagccugcugcaca

SEQ ID NO: 1297748 - RNA, 15 nt, Mycobacterium tuberculosis H37Rv
guggcagcgcacccg

SEQ ID NO: 1297749 - RNA, 18 nt, Mycobacterium tuberculosis H37Rv
guggcacgcugagcgucc

SEQ ID NO: 1297750 - RNA, 23 nt, Mycobacterium tuberculosis H37Rv
guggcacgugaaagccgaccagc

SEQ ID NO: 1297751 - RNA, 12 nt, Mycobacterium tuberculosis H37Rv
guggcaccgguu

SEQ ID NO: 1297752 - RNA, 20 nt, Mycobacterium tuberculosis H37Rv
guggccaacaccgccagcau

SEQ ID NO: 1297753 - RNA, 23 nt, Mycobacterium tuberculosis H37Rv
guggcauccuugccaaucgccgu

SEQ ID NO: 1297754 - RNA, 15 nt, Mycobacterium tuberculosis H37Rv
guggcauccagcagc

SEQ ID NO: 1297755 - RNA, 21 nt, Mycobacterium tuberculosis H37Rv
guggcaucggcggccugcucg

SEQ ID NO: 1297756 - RNA, 16 nt, Mycobacterium tuberculosis H37Rv
guggcauaaccgcuga

SEQ ID NO: 1297757 - RNA, 19 nt, Mycobacterium tuberculosis H37Rv
guggcagucgcacggugcc

SEQ ID NO: 1297758 - RNA, 16 nt, Mycobacterium tuberculosis H37Rv
gugggcgacgucaucg

SEQ ID NO: 1297759 - RNA, 16 nt, Mycobacterium tuberculosis H37Rv
gugggacuggcgugaa

SEQ ID NO: 1297760 - RNA, 21 nt, Mycobacterium tuberculosis H37Rv
gugggccagguuuugccgcgu

SEQ ID NO: 1297761 - RNA, 17 nt, Mycobacterium tuberculosis H37Rv
guggcuggcaugccggc

SEQ ID NO: 1297762 - RNA, 23 nt, Mycobacterium tuberculosis H37Rv
guggcugcgccggaaccccucga

SEQ ID NO: 1297763 - RNA, 17 nt, Mycobacterium tuberculosis H37Rv
guggucggagcgggugc

SEQ ID NO: 1297764 - RNA, 22 nt, Mycobacterium tuberculosis H37Rv
guggucaccccuucgccagcgc

SEQ ID NO: 1297765 - RNA, 21 nt, Mycobacterium tuberculosis H37Rv
guggucaucgccacgccugcu

SEQ ID NO: 1297766 - RNA, 14 nt, Mycobacterium tuberculosis H37Rv
guggucagccggug

SEQ ID NO: 1297767 - RNA, 13 nt, Mycobacterium tuberculosis H37Rv
guggucagcgccg

SEQ ID NO: 1297768 - RNA, 22 nt, Mycobacterium tuberculosis H37Rv
guggucagucaccaaccacaug

SEQ ID NO: 1297769 - RNA, 19 nt, Mycobacterium tuberculosis H37Rv
guggucagcugcugccacc

SEQ ID NO: 1297770 - RNA, 20 nt, Mycobacterium tuberculosis H37Rv
gugguaacaccggcgagugc

SEQ ID NO: 1297771 - RNA, 17 nt, Mycobacterium tuberculosis H37Rv
gugggugagcgaccugg

SEQ ID NO: 1297772 - RNA, 19 nt, Mycobacterium tuberculosis H37Rv
gugggucaagaucggugcc

SEQ ID NO: 1297773 - RNA, 18 nt, Mycobacterium tuberculosis H37Rv
guggguccaacccgcgau

SEQ ID NO: 1297774 - RNA, 13 nt, Mycobacterium tuberculosis H37Rv
gugggcgcuguca

SEQ ID NO: 1297775 - RNA, 20 nt, Mycobacterium tuberculosis H37Rv
gugggcggaacgaugccggc

SEQ ID NO: 1297776 - RNA, 16 nt, Mycobacterium tuberculosis H37Rv
gugggcgccgcaaccg

SEQ ID NO: 1297777 - RNA, 22 nt, Mycobacterium tuberculosis H37Rv
gugggcgccgcaaccgccgcgu

SEQ ID NO: 1297778 - RNA, 18 nt, Mycobacterium tuberculosis H37Rv
gugggcgcaacgacgcua

SEQ ID NO: 1297779 - RNA, 14 nt, Mycobacterium tuberculosis H37Rv
gugggcgaucggcg

SEQ ID NO: 1297780 - RNA, 22 nt, Mycobacterium tuberculosis H37Rv
gugggcgagucgggggccgcgu

SEQ ID NO: 1297781 - RNA, 20 nt, Mycobacterium tuberculosis H37Rv
gugggccucgaucagcgccg

SEQ ID NO: 1297782 - RNA, 20 nt, Mycobacterium tuberculosis H37Rv
guucaugcaaaagccgcgau

SEQ ID NO: 1297783 - RNA, 14 nt, Mycobacterium tuberculosis H37Rv
guucauguccaccg

SEQ ID NO: 1297784 - RNA, 14 nt, Mycobacterium tuberculosis H37Rv
guuccacggccagg

SEQ ID NO: 1297785 - RNA, 20 nt, Mycobacterium tuberculosis H37Rv
guuccagaaggccgcaccgc

SEQ ID NO: 1297786 - RNA, 20 nt, Mycobacterium tuberculosis H37Rv
guucccuuguucccgaaacc

SEQ ID NO: 1297787 - RNA, 17 nt, Mycobacterium tuberculosis H37Rv
guucccgcucgggcaac

SEQ ID NO: 1297788 - RNA, 18 nt, Mycobacterium tuberculosis H37Rv
guuccgcgacaaccacga

SEQ ID NO: 1297789 - RNA, 19 nt, Mycobacterium tuberculosis H37Rv
guuccgggugccgcgccgu

SEQ ID NO: 1297790 - RNA, 16 nt, Mycobacterium tuberculosis H37Rv
guuccgggccggcgag

SEQ ID NO: 1297791 - RNA, 20 nt, Mycobacterium tuberculosis H37Rv
guuccggcuucguccaccgc

SEQ ID NO: 1297792 - RNA, 18 nt, Mycobacterium tuberculosis H37Rv
guuccgggguggacggcg

SEQ ID NO: 1297793 - RNA, 21 nt, Mycobacterium tuberculosis H37Rv
guuccguugaugccgccggag

SEQ ID NO: 1297794 - RNA, 16 nt, Mycobacterium tuberculosis H37Rv
guucgaaagcaccgau

SEQ ID NO: 1297795 - RNA, 15 nt, Mycobacterium tuberculosis H37Rv
guuccuggucgagca

SEQ ID NO: 1297796 - RNA, 22 nt, Mycobacterium tuberculosis H37Rv
guguuguugaagggggcgucgu

SEQ ID NO: 1297797 - RNA, 23 nt, Mycobacterium tuberculosis H37Rv
guguugggagccaccggcgucga

SEQ ID NO: 1297798 - RNA, 13 nt, Mycobacterium tuberculosis H37Rv
guguugcaguggc

SEQ ID NO: 1297799 - RNA, 23 nt, Mycobacterium tuberculosis H37Rv
guguugccagaucagcaccgaca

SEQ ID NO: 1297800 - RNA, 16 nt, Mycobacterium tuberculosis H37Rv
guuacucgcagcgccg

SEQ ID NO: 1297801 - RNA, 22 nt, Mycobacterium tuberculosis H37Rv
guuagccggguuggccggcgcu

SEQ ID NO: 1297802 - RNA, 15 nt, Mycobacterium tuberculosis H37Rv
guuagcggcgggcac

SEQ ID NO: 1297803 - RNA, 19 nt, Mycobacterium tuberculosis H37Rv
guucaccucggcgacgaug

SEQ ID NO: 1297804 - RNA, 18 nt, Mycobacterium tuberculosis H37Rv
guucacgccgccggagau

SEQ ID NO: 1297805 - RNA, 16 nt, Mycobacterium tuberculosis H37Rv
guucacguucagccca

SEQ ID NO: 1297806 - RNA, 15 nt, Mycobacterium tuberculosis H37Rv
guucacucucggcgc

SEQ ID NO: 1297807 - RNA, 16 nt, Mycobacterium tuberculosis H37Rv
guucacgcucgacgac

SEQ ID NO: 1297808 - RNA, 14 nt, Mycobacterium tuberculosis H37Rv
guucacccagcggc

SEQ ID NO: 1297809 - RNA, 17 nt, Mycobacterium tuberculosis H37Rv
guucagcgcuggcaggc

SEQ ID NO: 1297810 - RNA, 20 nt, Mycobacterium tuberculosis H37Rv
guucagccacgcagcacggc

SEQ ID NO: 1297811 - RNA, 19 nt, Mycobacterium tuberculosis H37Rv
guucagcccgccgacgauc

SEQ ID NO: 1297812 - RNA, 22 nt, Mycobacterium tuberculosis H37Rv
gugccaaaugaugacgaucagc

SEQ ID NO: 1297813 - RNA, 18 nt, Mycobacterium tuberculosis H37Rv
gugccaacugcgccguuc

SEQ ID NO: 1297814 - RNA, 17 nt, Mycobacterium tuberculosis H37Rv
gugccaacugcgccguu

SEQ ID NO: 1297815 - RNA, 12 nt, Mycobacterium tuberculosis H37Rv
gugccaaccgcg

SEQ ID NO: 1297816 - RNA, 18 nt, Mycobacterium tuberculosis H37Rv
gugcaucgaucaccgcuu

SEQ ID NO: 1297817 - RNA, 20 nt, Mycobacterium tuberculosis H37Rv
gugcagcucggucagcguca

SEQ ID NO: 1297818 - RNA, 20 nt, Mycobacterium tuberculosis H37Rv
gugcagcgugggcagcgcga

SEQ ID NO: 1297819 - RNA, 16 nt, Mycobacterium tuberculosis H37Rv
gugcagcgugggcagc

SEQ ID NO: 1297820 - RNA, 14 nt, Mycobacterium tuberculosis H37Rv
gugcaggaucggcu

SEQ ID NO: 1297821 - RNA, 22 nt, Mycobacterium tuberculosis H37Rv
gugccauccuuaugcgcgguga

SEQ ID NO: 1297822 - RNA, 16 nt, Mycobacterium tuberculosis H37Rv
gugcccaccaccgaca

SEQ ID NO: 1297823 - RNA, 17 nt, Mycobacterium tuberculosis H37Rv
gugcccgcacugccgcc

SEQ ID NO: 1297824 - RNA, 14 nt, Mycobacterium tuberculosis H37Rv
gugccagccggucg

SEQ ID NO: 1297825 - RNA, 19 nt, Mycobacterium tuberculosis H37Rv
gugccaguacucggccagc

SEQ ID NO: 1297826 - RNA, 21 nt, Mycobacterium tuberculosis H37Rv
gugccagcguggugaagucgg

SEQ ID NO: 1297827 - RNA, 23 nt, Mycobacterium tuberculosis H37Rv
gugauauccgugaauggcagcac

SEQ ID NO: 1297828 - RNA, 13 nt, Mycobacterium tuberculosis H37Rv
gugcacaccgucg

SEQ ID NO: 1297829 - RNA, 20 nt, Mycobacterium tuberculosis H37Rv
gugcacccgggccgccucga

SEQ ID NO: 1297830 - RNA, 20 nt, Mycobacterium tuberculosis H37Rv
gugcaccgcgucguagccac

SEQ ID NO: 1297831 - RNA, 22 nt, Mycobacterium tuberculosis H37Rv
gugcaccgcgucguagccacgc

SEQ ID NO: 1297832 - RNA, 19 nt, Mycobacterium tuberculosis H37Rv
gugcagcgcacgcagccga

SEQ ID NO: 1297833 - RNA, 12 nt, Mycobacterium tuberculosis H37Rv
gugagugccggc

SEQ ID NO: 1297834 - RNA, 15 nt, Mycobacterium tuberculosis H37Rv
gugagucccacgcca

SEQ ID NO: 1297835 - RNA, 22 nt, Mycobacterium tuberculosis H37Rv
gugaggaucagcgugucgccga

SEQ ID NO: 1297836 - RNA, 16 nt, Mycobacterium tuberculosis H37Rv
gugccgagcuggcgac

SEQ ID NO: 1297837 - RNA, 15 nt, Mycobacterium tuberculosis H37Rv
gugcccgggcgucaa

SEQ ID NO: 1297838 - RNA, 19 nt, Mycobacterium tuberculosis H37Rv
gugcccguauaaccggcca

SEQ ID NO: 1297839 - RNA, 14 nt, Mycobacterium tuberculosis H37Rv
gugcccgugugcag

SEQ ID NO: 1297840 - RNA, 15 nt, Mycobacterium tuberculosis H37Rv
gugcccggcggccaa

SEQ ID NO: 1297841 - RNA, 21 nt, Mycobacterium tuberculosis H37Rv
gugcccgcacugccgccgguu

SEQ ID NO: 1297842 - RNA, 13 nt, Mycobacterium tuberculosis H37Rv
gugcccgccccga

SEQ ID NO: 1297843 - RNA, 15 nt, Mycobacterium tuberculosis H37Rv
gugccgccaccaccg

SEQ ID NO: 1297844 - RNA, 22 nt, Mycobacterium tuberculosis H37Rv
gugccgcacagcggauucggcg

SEQ ID NO: 1297845 - RNA, 23 nt, Mycobacterium tuberculosis H37Rv
gugccgcacagcggauucggcgu

SEQ ID NO: 1297846 - RNA, 14 nt, Mycobacterium tuberculosis H37Rv
gugccgaugaccga

SEQ ID NO: 1297847 - RNA, 13 nt, Mycobacterium tuberculosis H37Rv
gugccgccagcaa

SEQ ID NO: 1297848 - RNA, 15 nt, Mycobacterium tuberculosis H37Rv
gugccgccaccggcg

SEQ ID NO: 1297849 - RNA, 20 nt, Mycobacterium tuberculosis H37Rv
gugccgccaccgccaccgcg

SEQ ID NO: 1297850 - RNA, 21 nt, Mycobacterium tuberculosis H37Rv
gugccgcccgcgccgccgcua

SEQ ID NO: 1297851 - RNA, 15 nt, Mycobacterium tuberculosis H37Rv
gugccgccaucgccg

SEQ ID NO: 1297852 - RNA, 17 nt, Mycobacterium tuberculosis H37Rv
gugccuucaccgccguu

SEQ ID NO: 1297853 - RNA, 18 nt, Mycobacterium tuberculosis H37Rv
gugccuucaccgccguuc

SEQ ID NO: 1297854 - RNA, 23 nt, Mycobacterium tuberculosis H37Rv
gugccgguaugcgccaucucgac

SEQ ID NO: 1297855 - RNA, 21 nt, Mycobacterium tuberculosis H37Rv
gugccggggauaucacgacgc

SEQ ID NO: 1297856 - RNA, 16 nt, Mycobacterium tuberculosis H37Rv
gugccggggccccaug

SEQ ID NO: 1297857 - RNA, 19 nt, Mycobacterium tuberculosis H37Rv
gugccgccgauaccgccgg

SEQ ID NO: 1297858 - RNA, 12 nt, Mycobacterium tuberculosis H37Rv
gugccgccgaug

SEQ ID NO: 1297859 - RNA, 14 nt, Mycobacterium tuberculosis H37Rv
gugccgccgucgau

SEQ ID NO: 1297860 - RNA, 20 nt, Mycobacterium tuberculosis H37Rv
gugccgggccauucaccgcg

SEQ ID NO: 1297861 - RNA, 21 nt, Mycobacterium tuberculosis H37Rv
gugccgggccauucaccgcgc

SEQ ID NO: 1297862 - RNA, 20 nt, Mycobacterium tuberculosis H37Rv
gugcgggccacgaucggcug

SEQ ID NO: 1297863 - RNA, 21 nt, Mycobacterium tuberculosis H37Rv
gugcgguuucaccgacgacgc

SEQ ID NO: 1297864 - RNA, 18 nt, Mycobacterium tuberculosis H37Rv
gugcgguuucaccgacga

SEQ ID NO: 1297865 - RNA, 22 nt, Mycobacterium tuberculosis H37Rv
gugcgguucucguagucaacca

SEQ ID NO: 1297866 - RNA, 17 nt, Mycobacterium tuberculosis H37Rv
gugcgguuggaucggcg

SEQ ID NO: 1297867 - RNA, 17 nt, Mycobacterium tuberculosis H37Rv
gugcggugucacaacgc

SEQ ID NO: 1297868 - RNA, 15 nt, Mycobacterium tuberculosis H37Rv
gugcgucacagccgg

SEQ ID NO: 1297869 - RNA, 23 nt, Mycobacterium tuberculosis H37Rv
gugcguccuccccuacugcguug

SEQ ID NO: 1297870 - RNA, 15 nt, Mycobacterium tuberculosis H37Rv
gugcguccaggccag

SEQ ID NO: 1297871 - RNA, 19 nt, Mycobacterium tuberculosis H37Rv
gugcgucgauggcgucggu

SEQ ID NO: 1297872 - RNA, 20 nt, Mycobacterium tuberculosis H37Rv
gugcgucgaugccggugugc

SEQ ID NO: 1297873 - RNA, 14 nt, Mycobacterium tuberculosis H37Rv
gugcgucucggugg

SEQ ID NO: 1297874 - RNA, 14 nt, Mycobacterium tuberculosis H37Rv
gugcgucugcggcg

SEQ ID NO: 1297875 - RNA, 14 nt, Mycobacterium tuberculosis H37Rv
gugcgucuccagcu

SEQ ID NO: 1297876 - RNA, 19 nt, Mycobacterium tuberculosis H37Rv
gugcgucuccagcugggug

SEQ ID NO: 1297877 - RNA, 20 nt, Mycobacterium tuberculosis H37Rv
gugcggcagauacucggcga

SEQ ID NO: 1297878 - RNA, 13 nt, Mycobacterium tuberculosis H37Rv
gugcggcagcccg

SEQ ID NO: 1297879 - RNA, 22 nt, Mycobacterium tuberculosis H37Rv
gugcggccccgacauacgucgg

SEQ ID NO: 1297880 - RNA, 17 nt, Mycobacterium tuberculosis H37Rv
gugcggccacucgcccg

SEQ ID NO: 1297881 - RNA, 20 nt, Mycobacterium tuberculosis H37Rv
gugcggcguauugcggccug

SEQ ID NO: 1297882 - RNA, 20 nt, Mycobacterium tuberculosis H37Rv
gugcgacaacacgaccucuu

SEQ ID NO: 1297883 - RNA, 19 nt, Mycobacterium tuberculosis H37Rv
gugcgacaacacgaccucu

SEQ ID NO: 1297884 - RNA, 12 nt, Mycobacterium tuberculosis H37Rv
gugcgacaucgg

SEQ ID NO: 1297885 - RNA, 21 nt, Mycobacterium tuberculosis H37Rv
gugcgacguaaagggcgucgu

SEQ ID NO: 1297886 - RNA, 15 nt, Mycobacterium tuberculosis H37Rv
gugcgacgcgaccgc

SEQ ID NO: 1297887 - RNA, 17 nt, Mycobacterium tuberculosis H37Rv
gugcgagcgacaccgua

SEQ ID NO: 1297888 - RNA, 21 nt, Mycobacterium tuberculosis H37Rv
gugcgauuuugugucugcucg

SEQ ID NO: 1297889 - RNA, 20 nt, Mycobacterium tuberculosis H37Rv
gugcgauucugugucugcuc

SEQ ID NO: 1297890 - RNA, 19 nt, Mycobacterium tuberculosis H37Rv
gugcgauucugugucugcu

SEQ ID NO: 1297891 - RNA, 20 nt, Mycobacterium tuberculosis H37Rv
gugcgauucugcgucugcuc

SEQ ID NO: 1297892 - RNA, 19 nt, Mycobacterium tuberculosis H37Rv
gugcgauucugcgucugcu

SEQ ID NO: 1297893 - RNA, 20 nt, Mycobacterium tuberculosis H37Rv
gugcgauuccgcgucugcuc

SEQ ID NO: 1297894 - RNA, 19 nt, Mycobacterium tuberculosis H37Rv
gugcgauuccgcgucugcu

SEQ ID NO: 1297895 - RNA, 22 nt, Mycobacterium tuberculosis H37Rv
gugcgacuucgagauugccgag

SEQ ID NO: 1297896 - RNA, 17 nt, Mycobacterium tuberculosis H37Rv
gugcgauccagggccga

SEQ ID NO: 1297897 - RNA, 18 nt, Mycobacterium tuberculosis H37Rv
gugcggaagcaucggcug

SEQ ID NO: 1297898 - RNA, 22 nt, Mycobacterium tuberculosis H37Rv
gugcgccgccaucacgcacuga

SEQ ID NO: 1297899 - RNA, 23 nt, Mycobacterium tuberculosis H37Rv
gugcgcccgacggaguucgacgu

SEQ ID NO: 1297900 - RNA, 17 nt, Mycobacterium tuberculosis H37Rv
gugcgcccaggugaucg

SEQ ID NO: 1297901 - RNA, 22 nt, Mycobacterium tuberculosis H37Rv
gugcgcaacccagccgcgccag

SEQ ID NO: 1297902 - RNA, 18 nt, Mycobacterium tuberculosis H37Rv
guggaggaaucguucggg

SEQ ID NO: 1297903 - RNA, 22 nt, Mycobacterium tuberculosis H37Rv
guggacgugucaucacggucag

SEQ ID NO: 1297904 - RNA, 14 nt, Mycobacterium tuberculosis H37Rv
guggaccgccgauc

SEQ ID NO: 1297905 - RNA, 19 nt, Mycobacterium tuberculosis H37Rv
guggacgcagagucaacga

SEQ ID NO: 1297906 - RNA, 17 nt, Mycobacterium tuberculosis H37Rv
guggacagaaucgaccg

SEQ ID NO: 1297907 - RNA, 17 nt, Mycobacterium tuberculosis H37Rv
guggaugucgcggucga

SEQ ID NO: 1297908 - RNA, 18 nt, Mycobacterium tuberculosis H37Rv
guggaucuggcgcagcau

SEQ ID NO: 1297909 - RNA, 19 nt, Mycobacterium tuberculosis H37Rv
guggaucauguucggccac

SEQ ID NO: 1297910 - RNA, 15 nt, Mycobacterium tuberculosis H37Rv
guggaucauguucgg

SEQ ID NO: 1297911 - RNA, 15 nt, Mycobacterium tuberculosis H37Rv
guggcaaccgcaccg

SEQ ID NO: 1297912 - RNA, 13 nt, Mycobacterium tuberculosis H37Rv
guggcaacgguac

SEQ ID NO: 1297913 - RNA, 18 nt, Mycobacterium tuberculosis H37Rv
guggcacacccgcaccgg

SEQ ID NO: 1297914 - RNA, 12 nt, Mycobacterium tuberculosis H37Rv
guggcaaucccg

SEQ ID NO: 1297915 - RNA, 17 nt, Mycobacterium tuberculosis H37Rv
guggauuggcgaugaca

SEQ ID NO: 1297916 - RNA, 14 nt, Mycobacterium tuberculosis H37Rv
gugcucggugacgu

SEQ ID NO: 1297917 - RNA, 13 nt, Mycobacterium tuberculosis H37Rv
gugcuguggucgg

SEQ ID NO: 1297918 - RNA, 21 nt, Mycobacterium tuberculosis H37Rv
gugcucgcaaucguuggccau

SEQ ID NO: 1297919 - RNA, 16 nt, Mycobacterium tuberculosis H37Rv
gugcucgccgaccagc

SEQ ID NO: 1297920 - RNA, 17 nt, Mycobacterium tuberculosis H37Rv
gugcucgccgaccagcu

SEQ ID NO: 1297921 - RNA, 14 nt, Mycobacterium tuberculosis H37Rv
gugcuuggggucac

SEQ ID NO: 1297922 - RNA, 16 nt, Mycobacterium tuberculosis H37Rv
guggaauccaccagcc

SEQ ID NO: 1297923 - RNA, 20 nt, Mycobacterium tuberculosis H37Rv
guggaauacgcugcuggucu

SEQ ID NO: 1297924 - RNA, 23 nt, Mycobacterium tuberculosis H37Rv
guggacaaaucgaugaccgucgc

SEQ ID NO: 1297925 - RNA, 18 nt, Mycobacterium tuberculosis H37Rv
guggacaccugcugcacc

SEQ ID NO: 1297926 - RNA, 22 nt, Mycobacterium tuberculosis H37Rv
guggacaccugcugcaccguca

SEQ ID NO: 1297927 - RNA, 17 nt, Mycobacterium tuberculosis H37Rv
guugcgcugcggccagc

SEQ ID NO: 1297928 - RNA, 22 nt, Mycobacterium tuberculosis H37Rv
guugccgaacgucgcggccagc

SEQ ID NO: 1297929 - RNA, 23 nt, Mycobacterium tuberculosis H37Rv
guugccgacgaucgacgccgcca

SEQ ID NO: 1297930 - RNA, 23 nt, Mycobacterium tuberculosis H37Rv
guugccgaagccggaugcgcuuc

SEQ ID NO: 1297931 - RNA, 16 nt, Mycobacterium tuberculosis H37Rv
guugcggagcucacgc

SEQ ID NO: 1297932 - RNA, 21 nt, Mycobacterium tuberculosis H37Rv
guugcggcagcuggcgcagcc

SEQ ID NO: 1297933 - RNA, 14 nt, Mycobacterium tuberculosis H37Rv
guugcggcugaccu

SEQ ID NO: 1297934 - RNA, 19 nt, Mycobacterium tuberculosis H37Rv
guugcggcggcgcuggucg

SEQ ID NO: 1297935 - RNA, 19 nt, Mycobacterium tuberculosis H37Rv
guugccagcgacgcgguca

SEQ ID NO: 1297936 - RNA, 16 nt, Mycobacterium tuberculosis H37Rv
guugcaucgccgcgau

SEQ ID NO: 1297937 - RNA, 19 nt, Mycobacterium tuberculosis H37Rv
guugccaacgaaccgcuca

SEQ ID NO: 1297938 - RNA, 19 nt, Mycobacterium tuberculosis H37Rv
guugccagaucagcaccga

SEQ ID NO: 1297939 - RNA, 14 nt, Mycobacterium tuberculosis H37Rv
guugcccgacccgc

SEQ ID NO: 1297940 - RNA, 19 nt, Mycobacterium tuberculosis H37Rv
guugccccggucggcgacg

SEQ ID NO: 1297941 - RNA, 22 nt, Mycobacterium tuberculosis H37Rv
guugccccgcagcaucgccagc

SEQ ID NO: 1297942 - RNA, 14 nt, Mycobacterium tuberculosis H37Rv
guugccccgaccgc

SEQ ID NO: 1297943 - RNA, 22 nt, Mycobacterium tuberculosis H37Rv
guugggcgcgaaacgccgcaau

SEQ ID NO: 1297944 - RNA, 21 nt, Mycobacterium tuberculosis H37Rv
guugggcggagcacuucgucg

SEQ ID NO: 1297945 - RNA, 15 nt, Mycobacterium tuberculosis H37Rv
guuggcuugcgcgca

SEQ ID NO: 1297946 - RNA, 20 nt, Mycobacterium tuberculosis H37Rv
guuggcgccguuaccgccgu

SEQ ID NO: 1297947 - RNA, 17 nt, Mycobacterium tuberculosis H37Rv
guugggcagcuccacca

SEQ ID NO: 1297948 - RNA, 17 nt, Mycobacterium tuberculosis H37Rv
guugggaagugcgguga

SEQ ID NO: 1297949 - RNA, 20 nt, Mycobacterium tuberculosis H37Rv
guugggaaccgacuugguug

SEQ ID NO: 1297950 - RNA, 14 nt, Mycobacterium tuberculosis H37Rv
guuggcgccaccag

SEQ ID NO: 1297951 - RNA, 16 nt, Mycobacterium tuberculosis H37Rv
guuggcgaagcccgag

SEQ ID NO: 1297952 - RNA, 16 nt, Mycobacterium tuberculosis H37Rv
guugcucguugugcag

SEQ ID NO: 1297953 - RNA, 14 nt, Mycobacterium tuberculosis H37Rv
guugcgggcgugga

SEQ ID NO: 1297954 - RNA, 14 nt, Mycobacterium tuberculosis H37Rv
guugaccguggucg

SEQ ID NO: 1297955 - RNA, 21 nt, Mycobacterium tuberculosis H37Rv
guugaagaaagcgaccgucgg

SEQ ID NO: 1297956 - RNA, 21 nt, Mycobacterium tuberculosis H37Rv
guugacgaucuccgccaaccg

SEQ ID NO: 1297957 - RNA, 21 nt, Mycobacterium tuberculosis H37Rv
guugaacucgaccaccgccgg

SEQ ID NO: 1297958 - RNA, 20 nt, Mycobacterium tuberculosis H37Rv
guugacccguacccacgacg

SEQ ID NO: 1297959 - RNA, 14 nt, Mycobacterium tuberculosis H37Rv
guugaccucgcgca

SEQ ID NO: 1297960 - RNA, 14 nt, Mycobacterium tuberculosis H37Rv
guugaccucgguga

SEQ ID NO: 1297961 - RNA, 14 nt, Mycobacterium tuberculosis H37Rv
guugagguagguga

SEQ ID NO: 1297962 - RNA, 22 nt, Mycobacterium tuberculosis H37Rv
guugaggaugacgacggugacc

SEQ ID NO: 1297963 - RNA, 16 nt, Mycobacterium tuberculosis H37Rv
guugaggccggugaac

SEQ ID NO: 1297964 - RNA, 18 nt, Mycobacterium tuberculosis H37Rv
guugaggaugacgacggu

SEQ ID NO: 1297965 - RNA, 15 nt, Mycobacterium tuberculosis H37Rv
guugacgccacgacg

SEQ ID NO: 1297966 - RNA, 16 nt, Mycobacterium tuberculosis H37Rv
guugacgucgagcagc

SEQ ID NO: 1297967 - RNA, 18 nt, Mycobacterium tuberculosis H37Rv
guugacggugguccugau

SEQ ID NO: 1297968 - RNA, 21 nt, Mycobacterium tuberculosis H37Rv
guucgaccgcagggaccgguu

SEQ ID NO: 1297969 - RNA, 14 nt, Mycobacterium tuberculosis H37Rv
guucgaacgcgauc

SEQ ID NO: 1297970 - RNA, 17 nt, Mycobacterium tuberculosis H37Rv
guucgaacgcgaucgac

SEQ ID NO: 1297971 - RNA, 16 nt, Mycobacterium tuberculosis H37Rv
guucuugucgaaguaa

SEQ ID NO: 1297972 - RNA, 18 nt, Mycobacterium tuberculosis H37Rv
guugcaguggcgacgagc

SEQ ID NO: 1297973 - RNA, 15 nt, Mycobacterium tuberculosis H37Rv
guugaucgcggacac

SEQ ID NO: 1297974 - RNA, 21 nt, Mycobacterium tuberculosis H37Rv
guugaucgcggacacugcgaa

SEQ ID NO: 1297975 - RNA, 16 nt, Mycobacterium tuberculosis H37Rv
guugaugaagauggcg

SEQ ID NO: 1297976 - RNA, 16 nt, Mycobacterium tuberculosis H37Rv
guugaucgccggccug

SEQ ID NO: 1297977 - RNA, 23 nt, Mycobacterium tuberculosis H37Rv
guugaucgccggccugcucggcg

SEQ ID NO: 1297978 - RNA, 20 nt, Mycobacterium tuberculosis H37Rv
guugaucguggcgaccacga

SEQ ID NO: 1297979 - RNA, 17 nt, Mycobacterium tuberculosis H37Rv
guuugcgaugcccacgg

SEQ ID NO: 1297980 - RNA, 23 nt, Mycobacterium tuberculosis H37Rv
guuugucgucgucgucuugguug

SEQ ID NO: 1297981 - RNA, 17 nt, Mycobacterium tuberculosis H37Rv
guuucucggcguggucg

SEQ ID NO: 1297982 - RNA, 18 nt, Mycobacterium tuberculosis H37Rv
guuucucggcguggucgg

SEQ ID NO: 1297983 - RNA, 17 nt, Mycobacterium tuberculosis H37Rv
guuugacgcgcucgcgc

SEQ ID NO: 1297984 - RNA, 17 nt, Mycobacterium tuberculosis H37Rv
guuucgaacaccgucca

SEQ ID NO: 1297985 - RNA, 22 nt, Mycobacterium tuberculosis H37Rv
guuucgacaucacucgcgccag

SEQ ID NO: 1297986 - RNA, 16 nt, Mycobacterium tuberculosis H37Rv
guuucgaucucgagca

SEQ ID NO: 1297987 - RNA, 17 nt, Mycobacterium tuberculosis H37Rv
guuguagacggcggcau

SEQ ID NO: 1297988 - RNA, 16 nt, Mycobacterium tuberculosis H37Rv
guugguuggcucgcug

SEQ ID NO: 1297989 - RNA, 22 nt, Mycobacterium tuberculosis H37Rv
guugguauuagggccggcguug

SEQ ID NO: 1297990 - RNA, 22 nt, Mycobacterium tuberculosis H37Rv
guuggucaucaacgccacgaug

SEQ ID NO: 1297991 - RNA, 16 nt, Mycobacterium tuberculosis H37Rv
guuggugacagugugu

SEQ ID NO: 1297992 - RNA, 21 nt, Mycobacterium tuberculosis H37Rv
guuuucggguugggcaucagg

SEQ ID NO: 1297993 - RNA, 21 nt, Mycobacterium tuberculosis H37Rv
guuuugcggccagggcgucga

SEQ ID NO: 1297994 - RNA, 15 nt, Mycobacterium tuberculosis H37Rv
uaacccagcaccaca

SEQ ID NO: 1297995 - RNA, 19 nt, Mycobacterium tuberculosis H37Rv
uaacccggcuccagcaccg

SEQ ID NO: 1297996 - RNA, 17 nt, Mycobacterium tuberculosis H37Rv
uaaccgcuuggugugau

SEQ ID NO: 1297997 - RNA, 20 nt, Mycobacterium tuberculosis H37Rv
uaacgcgacaaggucgucga

SEQ ID NO: 1297998 - RNA, 13 nt, Mycobacterium tuberculosis H37Rv
uaacgguccucga

SEQ ID NO: 1297999 - RNA, 21 nt, Mycobacterium tuberculosis H37Rv
uaaaccaagaaucaccggcaa

SEQ ID NO: 1298000 - RNA, 18 nt, Mycobacterium tuberculosis H37Rv
uaacguguucacggccgc

SEQ ID NO: 1298001 - RNA, 10 nt, Mycobacterium tuberculosis H37Rv
uaagcggaug

SEQ ID NO: 1298002 - RNA, 21 nt, Mycobacterium tuberculosis H37Rv
uaagccuucggugucgccgaa

SEQ ID NO: 1298003 - RNA, 22 nt, Mycobacterium tuberculosis H37Rv
uaauauugccgccuccggugca

SEQ ID NO: 1298004 - RNA, 19 nt, Mycobacterium tuberculosis H37Rv
uaauuggcaacacagcuga

SEQ ID NO: 1298005 - RNA, 13 nt, Mycobacterium tuberculosis H37Rv
uaauugccgaccg

SEQ ID NO: 1298006 - RNA, 16 nt, Mycobacterium tuberculosis H37Rv
uacaccgugcgccgaa

SEQ ID NO: 1298007 - RNA, 14 nt, Mycobacterium tuberculosis H37Rv
uacaccggcaccga

SEQ ID NO: 1298008 - RNA, 18 nt, Mycobacterium tuberculosis H37Rv
uacaccggccgguccacg

SEQ ID NO: 1298009 - RNA, 13 nt, Mycobacterium tuberculosis H37Rv
uacacggcggcga

SEQ ID NO: 1298010 - RNA, 19 nt, Mycobacterium tuberculosis H37Rv
uacacaccagcggucggcg

SEQ ID NO: 1298011 - RNA, 17 nt, Mycobacterium tuberculosis H37Rv
uacacauucauccaccc

SEQ ID NO: 1298012 - RNA, 22 nt, Mycobacterium tuberculosis H37Rv
uacaacacagaacucaccgacg

SEQ ID NO: 1298013 - RNA, 19 nt, Mycobacterium tuberculosis H37Rv
uacaacagcgucuggccgu

SEQ ID NO: 1298014 - RNA, 20 nt, Mycobacterium tuberculosis H37Rv
uacaacacagaacucaccga

SEQ ID NO: 1298015 - RNA, 14 nt, Mycobacterium tuberculosis H37Rv
uaccaccgucaccg

SEQ ID NO: 1298016 - RNA, 16 nt, Mycobacterium tuberculosis H37Rv
uaccaccggcacggug

SEQ ID NO: 1298017 - RNA, 14 nt, Mycobacterium tuberculosis H37Rv
uaccaccggcaccg

SEQ ID NO: 1298018 - RNA, 12 nt, Mycobacterium tuberculosis H37Rv
uaccaccggcac

SEQ ID NO: 1298019 - RNA, 21 nt, Mycobacterium tuberculosis H37Rv
uaccacggcgauccggucggc

SEQ ID NO: 1298020 - RNA, 16 nt, Mycobacterium tuberculosis H37Rv
uacagcgcguuggcga

SEQ ID NO: 1298021 - RNA, 22 nt, Mycobacterium tuberculosis H37Rv
uacagcgcccggauguccgccg

SEQ ID NO: 1298022 - RNA, 17 nt, Mycobacterium tuberculosis H37Rv
uacaggccacgcaccgg

SEQ ID NO: 1298023 - RNA, 22 nt, Mycobacterium tuberculosis H37Rv
uacaggaacaacgcgcaaccag

SEQ ID NO: 1298024 - RNA, 14 nt, Mycobacterium tuberculosis H37Rv
uaggcgaccgccau

SEQ ID NO: 1298025 - RNA, 18 nt, Mycobacterium tuberculosis H37Rv
uaggcgauccagacgguc

SEQ ID NO: 1298026 - RNA, 22 nt, Mycobacterium tuberculosis H37Rv
uaggcgaaaauugcuccaccac

SEQ ID NO: 1298027 - RNA, 22 nt, Mycobacterium tuberculosis H37Rv
uaggccguugaucgucucggcu

SEQ ID NO: 1298028 - RNA, 22 nt, Mycobacterium tuberculosis H37Rv
uaggccggccggaguccgucgg

SEQ ID NO: 1298029 - RNA, 20 nt, Mycobacterium tuberculosis H37Rv
uaggccaccuccgaggccgc

SEQ ID NO: 1298030 - RNA, 23 nt, Mycobacterium tuberculosis H37Rv
uaggccaccuccgaggccgccau

SEQ ID NO: 1298031 - RNA, 14 nt, Mycobacterium tuberculosis H37Rv
uaggccaccuccga

SEQ ID NO: 1298032 - RNA, 20 nt, Mycobacterium tuberculosis H37Rv
uaggccgccggacccgucga

SEQ ID NO: 1298033 - RNA, 16 nt, Mycobacterium tuberculosis H37Rv
uaggccaccggcgacc

SEQ ID NO: 1298034 - RNA, 14 nt, Mycobacterium tuberculosis H37Rv
uaggaguuccucga

SEQ ID NO: 1298035 - RNA, 15 nt, Mycobacterium tuberculosis H37Rv
uaggacucggcggaa

SEQ ID NO: 1298036 - RNA, 13 nt, Mycobacterium tuberculosis H37Rv
uagccgccgcggu

SEQ ID NO: 1298037 - RNA, 14 nt, Mycobacterium tuberculosis H37Rv
uagccgcgacccgc

SEQ ID NO: 1298038 - RNA, 21 nt, Mycobacterium tuberculosis H37Rv
uagccgugggccacgaugauc

SEQ ID NO: 1298039 - RNA, 17 nt, Mycobacterium tuberculosis H37Rv
uagccgucgaucccggu

SEQ ID NO: 1298040 - RNA, 15 nt, Mycobacterium tuberculosis H37Rv
uagcgcggccagcag

SEQ ID NO: 1298041 - RNA, 16 nt, Mycobacterium tuberculosis H37Rv
uagccgugggccacga

SEQ ID NO: 1298042 - RNA, 16 nt, Mycobacterium tuberculosis H37Rv
uagccuuacgcgggug

SEQ ID NO: 1298043 - RNA, 18 nt, Mycobacterium tuberculosis H37Rv
uagccugcgccgacccgc

SEQ ID NO: 1298044 - RNA, 14 nt, Mycobacterium tuberculosis H37Rv
uagccgaccaggac

SEQ ID NO: 1298045 - RNA, 15 nt, Mycobacterium tuberculosis H37Rv
uagccgauccagcag

SEQ ID NO: 1298046 - RNA, 23 nt, Mycobacterium tuberculosis H37Rv
uagccgauccagcaggccgucga

SEQ ID NO: 1298047 - RNA, 22 nt, Mycobacterium tuberculosis H37Rv
uagccgacuaucggccgccgga

SEQ ID NO: 1298048 - RNA, 22 nt, Mycobacterium tuberculosis H37Rv
uagccgaaaaagaccgacagcg

SEQ ID NO: 1298049 - RNA, 13 nt, Mycobacterium tuberculosis H37Rv
uagcaaucggcag

SEQ ID NO: 1298050 - RNA, 21 nt, Mycobacterium tuberculosis H37Rv
uagcacgggcacgaucgucgc

SEQ ID NO: 1298051 - RNA, 22 nt, Mycobacterium tuberculosis H37Rv
uagcacggcgauccccgacguc

SEQ ID NO: 1298052 - RNA, 22 nt, Mycobacterium tuberculosis H37Rv
uagcacguugacguccaacagc

SEQ ID NO: 1298053 - RNA, 16 nt, Mycobacterium tuberculosis H37Rv
uagcggcccgaucacc

SEQ ID NO: 1298054 - RNA, 21 nt, Mycobacterium tuberculosis H37Rv
uagcggcccuucgacgaggac

SEQ ID NO: 1298055 - RNA, 14 nt, Mycobacterium tuberculosis H37Rv
uagcguguggcgca

SEQ ID NO: 1298056 - RNA, 20 nt, Mycobacterium tuberculosis H37Rv
uagcgcuugcgaccccggcu

SEQ ID NO: 1298057 - RNA, 22 nt, Mycobacterium tuberculosis H37Rv
uagcggaccgaugacgaucggc

SEQ ID NO: 1298058 - RNA, 21 nt, Mycobacterium tuberculosis H37Rv
uagcugacaccgaaccgccgc

SEQ ID NO: 1298059 - RNA, 14 nt, Mycobacterium tuberculosis H37Rv
aaguuguagacguc

SEQ ID NO: 1298060 - RNA, 17 nt, Mycobacterium tuberculosis H37Rv
uacgucguccagcacca

SEQ ID NO: 1298061 - RNA, 21 nt, Mycobacterium tuberculosis H37Rv
uacguuacgccgagaugcugc

SEQ ID NO: 1298062 - RNA, 16 nt, Mycobacterium tuberculosis H37Rv
uacgucugcucgcgca

SEQ ID NO: 1298063 - RNA, 21 nt, Mycobacterium tuberculosis H37Rv
uacgucgaccgacgggucgua

SEQ ID NO: 1298064 - RNA, 23 nt, Mycobacterium tuberculosis H37Rv
uagacgacaucgucaucagcgcg

SEQ ID NO: 1298065 - RNA, 16 nt, Mycobacterium tuberculosis H37Rv
uagaccgagcccgaug

SEQ ID NO: 1298066 - RNA, 16 nt, Mycobacterium tuberculosis H37Rv
uagacgaccccgguga

SEQ ID NO: 1298067 - RNA, 19 nt, Mycobacterium tuberculosis H37Rv
uagaccgcuacccgcgcga

SEQ ID NO: 1298068 - RNA, 19 nt, Mycobacterium tuberculosis H37Rv
uagacggcacccccgacga

SEQ ID NO: 1298069 - RNA, 19 nt, Mycobacterium tuberculosis H37Rv
uacgcaucucgagcaugcc

SEQ ID NO: 1298070 - RNA, 19 nt, Mycobacterium tuberculosis H37Rv
uacgguagacguugccaac

SEQ ID NO: 1298071 - RNA, 15 nt, Mycobacterium tuberculosis H37Rv
uacggugaucgccgg

SEQ ID NO: 1298072 - RNA, 19 nt, Mycobacterium tuberculosis H37Rv
uacggccugccgcucgccg

SEQ ID NO: 1298073 - RNA, 18 nt, Mycobacterium tuberculosis H37Rv
uacgaugcucagcugguc

SEQ ID NO: 1298074 - RNA, 15 nt, Mycobacterium tuberculosis H37Rv
uacgcagcaccgcug

SEQ ID NO: 1298075 - RNA, 13 nt, Mycobacterium tuberculosis H37Rv
uacgaacugcuga

SEQ ID NO: 1298076 - RNA, 16 nt, Mycobacterium tuberculosis H37Rv
uacgaccgucgcgcug

SEQ ID NO: 1298077 - RNA, 22 nt, Mycobacterium tuberculosis H37Rv
uaccagccaugcucgucuuggg

SEQ ID NO: 1298078 - RNA, 20 nt, Mycobacterium tuberculosis H37Rv
uaccagaccggccgacguga

SEQ ID NO: 1298079 - RNA, 23 nt, Mycobacterium tuberculosis H37Rv
uauugcaggaaaucguccuugga

SEQ ID NO: 1298080 - RNA, 21 nt, Mycobacterium tuberculosis H37Rv
uauugggauacucgucgucgg

SEQ ID NO: 1298081 - RNA, 23 nt, Mycobacterium tuberculosis H37Rv
ucaacgacaccauaggccgacgg

SEQ ID NO: 1298082 - RNA, 18 nt, Mycobacterium tuberculosis H37Rv
ucaaccucgccacgcucg

SEQ ID NO: 1298083 - RNA, 14 nt, Mycobacterium tuberculosis H37Rv
ucaaccgggucagc

SEQ ID NO: 1298084 - RNA, 15 nt, Mycobacterium tuberculosis H37Rv
ucaagaucggugcca

SEQ ID NO: 1298085 - RNA, 13 nt, Mycobacterium tuberculosis H37Rv
ucaagcagcgugg

SEQ ID NO: 1298086 - RNA, 20 nt, Mycobacterium tuberculosis H37Rv
ucaagcuggcccgcucauac

SEQ ID NO: 1298087 - RNA, 18 nt, Mycobacterium tuberculosis H37Rv
ucaaggacgcaccgccag

SEQ ID NO: 1298088 - RNA, 22 nt, Mycobacterium tuberculosis H37Rv
ucaagccggcgcccgccgcgaa

SEQ ID NO: 1298089 - RNA, 18 nt, Mycobacterium tuberculosis H37Rv
ucaaugaacgcgcuuggu

SEQ ID NO: 1298090 - RNA, 13 nt, Mycobacterium tuberculosis H37Rv
ucaaugacaccgg

SEQ ID NO: 1298091 - RNA, 16 nt, Mycobacterium tuberculosis H37Rv
ucaaugcgcgcuggga

SEQ ID NO: 1298092 - RNA, 18 nt, Mycobacterium tuberculosis H37Rv
uauccagucgauccuuga

SEQ ID NO: 1298093 - RNA, 22 nt, Mycobacterium tuberculosis H37Rv
uaucgggcccccuggaucgcgc

SEQ ID NO: 1298094 - RNA, 19 nt, Mycobacterium tuberculosis H37Rv
uaggcuuccggcgcgaccg

SEQ ID NO: 1298095 - RNA, 18 nt, Mycobacterium tuberculosis H37Rv
uaggggcuuuugcgucug

SEQ ID NO: 1298096 - RNA, 22 nt, Mycobacterium tuberculosis H37Rv
uaggucgcugcccgcggugugc

SEQ ID NO: 1298097 - RNA, 19 nt, Mycobacterium tuberculosis H37Rv
uaggggcuuuugcgucugc

SEQ ID NO: 1298098 - RNA, 21 nt, Mycobacterium tuberculosis H37Rv
uaggguggcgauccacaggcu

SEQ ID NO: 1298099 - RNA, 11 nt, Mycobacterium tuberculosis H37Rv
uaggucaccgg

SEQ ID NO: 1298100 - RNA, 14 nt, Mycobacterium tuberculosis H37Rv
uaggucagcgggcu

SEQ ID NO: 1298101 - RNA, 20 nt, Mycobacterium tuberculosis H37Rv
uaucggcgugcuggcgcaac

SEQ ID NO: 1298102 - RNA, 12 nt, Mycobacterium tuberculosis H37Rv
uaucgucgacgc

SEQ ID NO: 1298103 - RNA, 18 nt, Mycobacterium tuberculosis H37Rv
uaucgucgacgccgaucg

SEQ ID NO: 1298104 - RNA, 15 nt, Mycobacterium tuberculosis H37Rv
uaucugccacguuga

SEQ ID NO: 1298105 - RNA, 21 nt, Mycobacterium tuberculosis H37Rv
uaugccaggacuggcaccgcc

SEQ ID NO: 1298106 - RNA, 13 nt, Mycobacterium tuberculosis H37Rv
uauguucggcaau

SEQ ID NO: 1298107 - RNA, 14 nt, Mycobacterium tuberculosis H37Rv
ucauguucggccac

SEQ ID NO: 1298108 - RNA, 14 nt, Mycobacterium tuberculosis H37Rv
ucaucuggucgacc

SEQ ID NO: 1298109 - RNA, 20 nt, Mycobacterium tuberculosis H37Rv
ucauguggucaacggccgac

SEQ ID NO: 1298110 - RNA, 19 nt, Mycobacterium tuberculosis H37Rv
uccaaggcggucaccaccg

SEQ ID NO: 1298111 - RNA, 16 nt, Mycobacterium tuberculosis H37Rv
uccaauccacgguugc

SEQ ID NO: 1298112 - RNA, 21 nt, Mycobacterium tuberculosis H37Rv
uccaauacucgccaucgcgga

SEQ ID NO: 1298113 - RNA, 16 nt, Mycobacterium tuberculosis H37Rv
uccaaaacaccgccag

SEQ ID NO: 1298114 - RNA, 22 nt, Mycobacterium tuberculosis H37Rv
ucaucgacgagccgcggucggc

SEQ ID NO: 1298115 - RNA, 19 nt, Mycobacterium tuberculosis H37Rv
uccaucaccacaccggcag

SEQ ID NO: 1298116 - RNA, 15 nt, Mycobacterium tuberculosis H37Rv
uccaucagagacagc

SEQ ID NO: 1298117 - RNA, 15 nt, Mycobacterium tuberculosis H37Rv
uccaucgcgcaccgc

SEQ ID NO: 1298118 - RNA, 18 nt, Mycobacterium tuberculosis H37Rv
uccauucauggccgcgau

SEQ ID NO: 1298119 - RNA, 13 nt, Mycobacterium tuberculosis H37Rv
uccaugcgacuuc

SEQ ID NO: 1298120 - RNA, 14 nt, Mycobacterium tuberculosis H37Rv
uccaugauggccgu

SEQ ID NO: 1298121 - RNA, 19 nt, Mycobacterium tuberculosis H37Rv
uccaguaaccguccgcgga

SEQ ID NO: 1298122 - RNA, 22 nt, Mycobacterium tuberculosis H37Rv
uccagguucuucuccaccaccg

SEQ ID NO: 1298123 - RNA, 18 nt, Mycobacterium tuberculosis H37Rv
uccagguucuucuccacc

SEQ ID NO: 1298124 - RNA, 23 nt, Mycobacterium tuberculosis H37Rv
uccagcggcgggggcgucgccgc

SEQ ID NO: 1298125 - RNA, 17 nt, Mycobacterium tuberculosis H37Rv
uccagcgucccgaugua

SEQ ID NO: 1298126 - RNA, 21 nt, Mycobacterium tuberculosis H37Rv
uccagcucggccagugccggu

SEQ ID NO: 1298127 - RNA, 13 nt, Mycobacterium tuberculosis H37Rv
uccagcucggcgg

SEQ ID NO: 1298128 - RNA, 20 nt, Mycobacterium tuberculosis H37Rv
uccagcccguccaggcgcug

SEQ ID NO: 1298129 - RNA, 16 nt, Mycobacterium tuberculosis H37Rv
uccagcccaacucggc

SEQ ID NO: 1298130 - RNA, 13 nt, Mycobacterium tuberculosis H37Rv
uccagcaccaccg

SEQ ID NO: 1298131 - RNA, 22 nt, Mycobacterium tuberculosis H37Rv
uccagauccgggcaugcgccgu

SEQ ID NO: 1298132 - RNA, 20 nt, Mycobacterium tuberculosis H37Rv
uccagacguuccaucacgga

SEQ ID NO: 1298133 - RNA, 21 nt, Mycobacterium tuberculosis H37Rv
uccacugugcgagcugcgggu

SEQ ID NO: 1298134 - RNA, 17 nt, Mycobacterium tuberculosis H37Rv
uccagaaggccgcaccg

SEQ ID NO: 1298135 - RNA, 17 nt, Mycobacterium tuberculosis H37Rv
uccacaugguacggacg

SEQ ID NO: 1298136 - RNA, 12 nt, Mycobacterium tuberculosis H37Rv
uccacgucucga

SEQ ID NO: 1298137 - RNA, 12 nt, Mycobacterium tuberculosis H37Rv
uccacucggucu

SEQ ID NO: 1298138 - RNA, 21 nt, Mycobacterium tuberculosis H37Rv
uccaaugcuguggcccgucau

SEQ ID NO: 1298139 - RNA, 19 nt, Mycobacterium tuberculosis H37Rv
uccaauugcgaaccggccg

SEQ ID NO: 1298140 - RNA, 19 nt, Mycobacterium tuberculosis H37Rv
uccacaucaaaacggcggu

SEQ ID NO: 1298141 - RNA, 17 nt, Mycobacterium tuberculosis H37Rv
ucacucacgacgccguu

SEQ ID NO: 1298142 - RNA, 14 nt, Mycobacterium tuberculosis H37Rv
ucagaacaccggcc

SEQ ID NO: 1298143 - RNA, 17 nt, Mycobacterium tuberculosis H37Rv
ucagaaccgacggccag

SEQ ID NO: 1298144 - RNA, 15 nt, Mycobacterium tuberculosis H37Rv
ucacgggugcuggca

SEQ ID NO: 1298145 - RNA, 17 nt, Mycobacterium tuberculosis H37Rv
ucacgggcgaucgugcc

SEQ ID NO: 1298146 - RNA, 15 nt, Mycobacterium tuberculosis H37Rv
ucacggaccgccacc

SEQ ID NO: 1298147 - RNA, 18 nt, Mycobacterium tuberculosis H37Rv
ucacggacgcugggcggu

SEQ ID NO: 1298148 - RNA, 14 nt, Mycobacterium tuberculosis H37Rv
ucacggaccgccac

SEQ ID NO: 1298149 - RNA, 15 nt, Mycobacterium tuberculosis H37Rv
ucacguucggcgacg

SEQ ID NO: 1298150 - RNA, 18 nt, Mycobacterium tuberculosis H37Rv
ucaccgaugagccgacgg

SEQ ID NO: 1298151 - RNA, 16 nt, Mycobacterium tuberculosis H37Rv
ucaccggauucuucgg

SEQ ID NO: 1298152 - RNA, 16 nt, Mycobacterium tuberculosis H37Rv
ucaccggaacccccag

SEQ ID NO: 1298153 - RNA, 22 nt, Mycobacterium tuberculosis H37Rv
ucaccgcguugaugaccagguc

SEQ ID NO: 1298154 - RNA, 15 nt, Mycobacterium tuberculosis H37Rv
ucaccgacgacgcgc

SEQ ID NO: 1298155 - RNA, 19 nt, Mycobacterium tuberculosis H37Rv
ucaccgagucgacggccag

SEQ ID NO: 1298156 - RNA, 13 nt, Mycobacterium tuberculosis H37Rv
ucaccgacaccgu

SEQ ID NO: 1298157 - RNA, 18 nt, Mycobacterium tuberculosis H37Rv
ucaccgacaugacgcggc

SEQ ID NO: 1298158 - RNA, 12 nt, Mycobacterium tuberculosis H37Rv
ucaccgacaccg

SEQ ID NO: 1298159 - RNA, 22 nt, Mycobacterium tuberculosis H37Rv
ucaccgaaugcgggucugcggu

SEQ ID NO: 1298160 - RNA, 18 nt, Mycobacterium tuberculosis H37Rv
ucacaacgcgugaccagg

SEQ ID NO: 1298161 - RNA, 20 nt, Mycobacterium tuberculosis H37Rv
ucacaagucgacacgccgaa

SEQ ID NO: 1298162 - RNA, 15 nt, Mycobacterium tuberculosis H37Rv
ucacaccacgguugg

SEQ ID NO: 1298163 - RNA, 23 nt, Mycobacterium tuberculosis H37Rv
ucaccuggcgugucgccgccacc

SEQ ID NO: 1298164 - RNA, 18 nt, Mycobacterium tuberculosis H37Rv
ucaccuggcgugucgccg

SEQ ID NO: 1298165 - RNA, 20 nt, Mycobacterium tuberculosis H37Rv
ucaccuugucaaaggugcac

SEQ ID NO: 1298166 - RNA, 15 nt, Mycobacterium tuberculosis H37Rv
ucacgcaccggcgca

SEQ ID NO: 1298167 - RNA, 15 nt, Mycobacterium tuberculosis H37Rv
ucacgcacaagccuc

SEQ ID NO: 1298168 - RNA, 23 nt, Mycobacterium tuberculosis H37Rv
ucacgcaggaaaaccccggccac

SEQ ID NO: 1298169 - RNA, 15 nt, Mycobacterium tuberculosis H37Rv
ucacgcagcagugcg

SEQ ID NO: 1298170 - RNA, 17 nt, Mycobacterium tuberculosis H37Rv
ucagcucgaucacgccg

SEQ ID NO: 1298171 - RNA, 13 nt, Mycobacterium tuberculosis H37Rv
ucagcucgaucac

SEQ ID NO: 1298172 - RNA, 21 nt, Mycobacterium tuberculosis H37Rv
ucagcuagcgcgggcucacau

SEQ ID NO: 1298173 - RNA, 17 nt, Mycobacterium tuberculosis H37Rv
ucagcgugcauggcggu

SEQ ID NO: 1298174 - RNA, 20 nt, Mycobacterium tuberculosis H37Rv
ucagcgucugagcgccggca

SEQ ID NO: 1298175 - RNA, 15 nt, Mycobacterium tuberculosis H37Rv
ucagcgucugagcgc

SEQ ID NO: 1298176 - RNA, 14 nt, Mycobacterium tuberculosis H37Rv
ucagcggucgcagc

SEQ ID NO: 1298177 - RNA, 16 nt, Mycobacterium tuberculosis H37Rv
ucagcgcugagccgcu

SEQ ID NO: 1298178 - RNA, 16 nt, Mycobacterium tuberculosis H37Rv
ucagcgcgguccaucc

SEQ ID NO: 1298179 - RNA, 12 nt, Mycobacterium tuberculosis H37Rv
ucagcgcuggca

SEQ ID NO: 1298180 - RNA, 18 nt, Mycobacterium tuberculosis H37Rv
ucaggacgaacgcuggcg

SEQ ID NO: 1298181 - RNA, 12 nt, Mycobacterium tuberculosis H37Rv
ucaggacggcac

SEQ ID NO: 1298182 - RNA, 14 nt, Mycobacterium tuberculosis H37Rv
ucaggaucccggug

SEQ ID NO: 1298183 - RNA, 20 nt, Mycobacterium tuberculosis H37Rv
ucaggaucccgguggcagca

SEQ ID NO: 1298184 - RNA, 16 nt, Mycobacterium tuberculosis H37Rv
ucaggaucggcgauug

SEQ ID NO: 1298185 - RNA, 22 nt, Mycobacterium tuberculosis H37Rv
ucagcuugugggcgacggcgau

SEQ ID NO: 1298186 - RNA, 20 nt, Mycobacterium tuberculosis H37Rv
ucaggaagcgugcggucguu

SEQ ID NO: 1298187 - RNA, 20 nt, Mycobacterium tuberculosis H37Rv
ucagcugauuaccgacaccg

SEQ ID NO: 1298188 - RNA, 22 nt, Mycobacterium tuberculosis H37Rv
ucagcugcggacuggcauccgc

SEQ ID NO: 1298189 - RNA, 15 nt, Mycobacterium tuberculosis H37Rv
ucagcugcugccacc

SEQ ID NO: 1298190 - RNA, 15 nt, Mycobacterium tuberculosis H37Rv
ucagcgaagccgggu

SEQ ID NO: 1298191 - RNA, 17 nt, Mycobacterium tuberculosis H37Rv
ucagcgaaccaccggcg

SEQ ID NO: 1298192 - RNA, 16 nt, Mycobacterium tuberculosis H37Rv
ucagccguacgccgua

SEQ ID NO: 1298193 - RNA, 18 nt, Mycobacterium tuberculosis H37Rv
ucagccccgacugcgccc

SEQ ID NO: 1298194 - RNA, 14 nt, Mycobacterium tuberculosis H37Rv
ucagcccgccggac

SEQ ID NO: 1298195 - RNA, 18 nt, Mycobacterium tuberculosis H37Rv
ucagcgacuugcuggcgu

SEQ ID NO: 1298196 - RNA, 16 nt, Mycobacterium tuberculosis H37Rv
ucagccaguccagcgc

SEQ ID NO: 1298197 - RNA, 12 nt, Mycobacterium tuberculosis H37Rv
ucagcccaggug

SEQ ID NO: 1298198 - RNA, 20 nt, Mycobacterium tuberculosis H37Rv
ucagauggccacccgcggaa

SEQ ID NO: 1298199 - RNA, 13 nt, Mycobacterium tuberculosis H37Rv
ucagaugcgcggg

SEQ ID NO: 1298200 - RNA, 15 nt, Mycobacterium tuberculosis H37Rv
ugaccaccgccgaca

SEQ ID NO: 1298201 - RNA, 17 nt, Mycobacterium tuberculosis H37Rv
ugaccaccgccgacagg

SEQ ID NO: 1298202 - RNA, 18 nt, Mycobacterium tuberculosis H37Rv
ugaccaccaccgagccgu

SEQ ID NO: 1298203 - RNA, 13 nt, Mycobacterium tuberculosis H37Rv
ugaccaccaccga

SEQ ID NO: 1298204 - RNA, 22 nt, Mycobacterium tuberculosis H37Rv
ugaccaggucggucaggucgag

SEQ ID NO: 1298205 - RNA, 15 nt, Mycobacterium tuberculosis H37Rv
ugaccaggccgacac

SEQ ID NO: 1298206 - RNA, 16 nt, Mycobacterium tuberculosis H37Rv
ugaccagcacgacggc

SEQ ID NO: 1298207 - RNA, 20 nt, Mycobacterium tuberculosis H37Rv
ugacaggucacgguagcguu

SEQ ID NO: 1298208 - RNA, 18 nt, Mycobacterium tuberculosis H37Rv
ugacagacaucgcgacga

SEQ ID NO: 1298209 - RNA, 13 nt, Mycobacterium tuberculosis H37Rv
ugaauggugaccg

SEQ ID NO: 1298210 - RNA, 16 nt, Mycobacterium tuberculosis H37Rv
ugacaaagaagugguc

SEQ ID NO: 1298211 - RNA, 23 nt, Mycobacterium tuberculosis H37Rv
ugacacccacggcgccaccaccg

SEQ ID NO: 1298212 - RNA, 18 nt, Mycobacterium tuberculosis H37Rv
ugacacgaugcccggcau

SEQ ID NO: 1298213 - RNA, 15 nt, Mycobacterium tuberculosis H37Rv
ugacacgcgcugcgu

SEQ ID NO: 1298214 - RNA, 24 nt, Mycobacterium tuberculosis H37Rv
ugacacugccuuaaccgagccgac

SEQ ID NO: 1298215 - RNA, 13 nt, Mycobacterium tuberculosis H37Rv
ugacaccggccac

SEQ ID NO: 1298216 - RNA, 14 nt, Mycobacterium tuberculosis H37Rv
ugaacuggucgacg

SEQ ID NO: 1298217 - RNA, 22 nt, Mycobacterium tuberculosis H37Rv
ugaacucuggugacggugaagc

SEQ ID NO: 1298218 - RNA, 20 nt, Mycobacterium tuberculosis H37Rv
ugaacggcucgggcagcguc

SEQ ID NO: 1298219 - RNA, 15 nt, Mycobacterium tuberculosis H37Rv
ugaacggcaccagcg

SEQ ID NO: 1298220 - RNA, 21 nt, Mycobacterium tuberculosis H37Rv
ugaacgcggacaccgcggcga

SEQ ID NO: 1298221 - RNA, 13 nt, Mycobacterium tuberculosis H37Rv
ugaagccagcgca

SEQ ID NO: 1298222 - RNA, 16 nt, Mycobacterium tuberculosis H37Rv
ugaagaaagcgaccgu

SEQ ID NO: 1298223 - RNA, 21 nt, Mycobacterium tuberculosis H37Rv
ugaaggcggcgauacccaucg

SEQ ID NO: 1298224 - RNA, 18 nt, Mycobacterium tuberculosis H37Rv
ugaaguucgggcaacggc

SEQ ID NO: 1298225 - RNA, 15 nt, Mycobacterium tuberculosis H37Rv
ucuuccccucggccg

SEQ ID NO: 1298226 - RNA, 15 nt, Mycobacterium tuberculosis H37Rv
ucuuccggugcgccg

SEQ ID NO: 1298227 - RNA, 22 nt, Mycobacterium tuberculosis H37Rv
ucuucgaaggcgugggugucgg

SEQ ID NO: 1298228 - RNA, 14 nt, Mycobacterium tuberculosis H37Rv
ucuugccaccgcug

SEQ ID NO: 1298229 - RNA, 13 nt, Mycobacterium tuberculosis H37Rv
ucugggcgaucgc

SEQ ID NO: 1298230 - RNA, 12 nt, Mycobacterium tuberculosis H37Rv
ucugggcuggca

SEQ ID NO: 1298231 - RNA, 21 nt, Mycobacterium tuberculosis H37Rv
ucugcucacgcggucaacgcu

SEQ ID NO: 1298232 - RNA, 22 nt, Mycobacterium tuberculosis H37Rv
ucugcucgccgggcuuaggccg

SEQ ID NO: 1298233 - RNA, 12 nt, Mycobacterium tuberculosis H37Rv
ucuggcgcagca

SEQ ID NO: 1298234 - RNA, 13 nt, Mycobacterium tuberculosis H37Rv
ucucgaccagcgc

SEQ ID NO: 1298235 - RNA, 14 nt, Mycobacterium tuberculosis H37Rv
ucugcggcggucuc

SEQ ID NO: 1298236 - RNA, 15 nt, Mycobacterium tuberculosis H37Rv
ucugguggcagcgca

SEQ ID NO: 1298237 - RNA, 21 nt, Mycobacterium tuberculosis H37Rv
ucugguggcgcugaagccgac

SEQ ID NO: 1298238 - RNA, 15 nt, Mycobacterium tuberculosis H37Rv
ucggugguccagcgc

SEQ ID NO: 1298239 - RNA, 18 nt, Mycobacterium tuberculosis H37Rv
ucggugguaacaccggcg

SEQ ID NO: 1298240 - RNA, 20 nt, Mycobacterium tuberculosis H37Rv
ucgguggcgccgaacgccag

SEQ ID NO: 1298241 - RNA, 17 nt, Mycobacterium tuberculosis H37Rv
ucgguggagggcgagca

SEQ ID NO: 1298242 - RNA, 16 nt, Mycobacterium tuberculosis H37Rv
ucgguggagcgcggga

SEQ ID NO: 1298243 - RNA, 24 nt, Mycobacterium tuberculosis H37Rv
ucggugcggaacacgaugcgcggu

SEQ ID NO: 1298244 - RNA, 18 nt, Mycobacterium tuberculosis H37Rv
ucggugcggaacacgaug

SEQ ID NO: 1298245 - RNA, 14 nt, Mycobacterium tuberculosis H37Rv
ucggugcgcuggcg

SEQ ID NO: 1298246 - RNA, 12 nt, Mycobacterium tuberculosis H37Rv
ucggugcgcggu

SEQ ID NO: 1298247 - RNA, 19 nt, Mycobacterium tuberculosis H37Rv
ucggugccgcccaggagca

SEQ ID NO: 1298248 - RNA, 20 nt, Mycobacterium tuberculosis H37Rv
ucggugccgaacagcggguu

SEQ ID NO: 1298249 - RNA, 18 nt, Mycobacterium tuberculosis H37Rv
ucggugauuucggcgucg

SEQ ID NO: 1298250 - RNA, 21 nt, Mycobacterium tuberculosis H37Rv
ucggugauuucggcgucgagu

SEQ ID NO: 1298251 - RNA, 15 nt, Mycobacterium tuberculosis H37Rv
ucggugagcgggcaa

SEQ ID NO: 1298252 - RNA, 22 nt, Mycobacterium tuberculosis H37Rv
ucggugagccgugccgccagca

SEQ ID NO: 1298253 - RNA, 22 nt, Mycobacterium tuberculosis H37Rv
ucggugaucucguacuccccgc

SEQ ID NO: 1298254 - RNA, 21 nt, Mycobacterium tuberculosis H37Rv
ucggugccagcacuccaccgc

SEQ ID NO: 1298255 - RNA, 18 nt, Mycobacterium tuberculosis H37Rv
ucggcugccgcgcgcugc

SEQ ID NO: 1298256 - RNA, 19 nt, Mycobacterium tuberculosis H37Rv
ucggcugccaccgcagacg

SEQ ID NO: 1298257 - RNA, 16 nt, Mycobacterium tuberculosis H37Rv
ucggcugccaccgcag

SEQ ID NO: 1298258 - RNA, 12 nt, Mycobacterium tuberculosis H37Rv
ucggcuggcguc

SEQ ID NO: 1298259 - RNA, 22 nt, Mycobacterium tuberculosis H37Rv
ucggcugcgacaggacgucggc

SEQ ID NO: 1298260 - RNA, 14 nt, Mycobacterium tuberculosis H37Rv
ucggguguggucac

SEQ ID NO: 1298261 - RNA, 18 nt, Mycobacterium tuberculosis H37Rv
ucggcuguugcguucggu

SEQ ID NO: 1298262 - RNA, 18 nt, Mycobacterium tuberculosis H37Rv
ucggguuccacgaucacc

SEQ ID NO: 1298263 - RNA, 17 nt, Mycobacterium tuberculosis H37Rv
ucggguuccgaucucaa

SEQ ID NO: 1298264 - RNA, 14 nt, Mycobacterium tuberculosis H37Rv
ucggguugcgacga

SEQ ID NO: 1298265 - RNA, 16 nt, Mycobacterium tuberculosis H37Rv
ucgguaaagccgcgga

SEQ ID NO: 1298266 - RNA, 16 nt, Mycobacterium tuberculosis H37Rv
ucggguuugucgucgu

SEQ ID NO: 1298267 - RNA, 18 nt, Mycobacterium tuberculosis H37Rv
ucgguaaacguugggaaa

SEQ ID NO: 1298268 - RNA, 21 nt, Mycobacterium tuberculosis H37Rv
ucggucugguggucggcgacg

SEQ ID NO: 1298269 - RNA, 12 nt, Mycobacterium tuberculosis H37Rv
ucggucucggcg

SEQ ID NO: 1298270 - RNA, 17 nt, Mycobacterium tuberculosis H37Rv
ucgguaggcggugucca

SEQ ID NO: 1298271 - RNA, 19 nt, Mycobacterium tuberculosis H37Rv
ucggucguuggugcagacc

SEQ ID NO: 1298272 - RNA, 15 nt, Mycobacterium tuberculosis H37Rv
ucgguagcugaccgu

SEQ ID NO: 1298273 - RNA, 13 nt, Mycobacterium tuberculosis H37Rv
ucgguaagugccu

SEQ ID NO: 1298274 - RNA, 18 nt, Mycobacterium tuberculosis H37Rv
ucggugaaugccgucgcc

SEQ ID NO: 1298275 - RNA, 22 nt, Mycobacterium tuberculosis H37Rv
ucggugaaggucaccgucgagu

SEQ ID NO: 1298276 - RNA, 19 nt, Mycobacterium tuberculosis H37Rv
ucggugacccccgagaucc

SEQ ID NO: 1298277 - RNA, 21 nt, Mycobacterium tuberculosis H37Rv
ucggugaaucgucugacgaaa

SEQ ID NO: 1298278 - RNA, 20 nt, Mycobacterium tuberculosis H37Rv
ucggugaccguggcggggaa

SEQ ID NO: 1298279 - RNA, 15 nt, Mycobacterium tuberculosis H37Rv
ucggugacuccggcu

SEQ ID NO: 1298280 - RNA, 22 nt, Mycobacterium tuberculosis H37Rv
ucgucgaggucacgcgaggcga

SEQ ID NO: 1298281 - RNA, 14 nt, Mycobacterium tuberculosis H37Rv
ucgucgagucgaca

SEQ ID NO: 1298282 - RNA, 22 nt, Mycobacterium tuberculosis H37Rv
ucgucgccgaccgucacugaug

SEQ ID NO: 1298283 - RNA, 15 nt, Mycobacterium tuberculosis H37Rv
ucgucgaggucacgc

SEQ ID NO: 1298284 - RNA, 16 nt, Mycobacterium tuberculosis H37Rv
ucgucgagccgaucgc

SEQ ID NO: 1298285 - RNA, 17 nt, Mycobacterium tuberculosis H37Rv
ucgucgcggguguucca

SEQ ID NO: 1298286 - RNA, 21 nt, Mycobacterium tuberculosis H37Rv
ucgucgccggcggcggugcgc

SEQ ID NO: 1298287 - RNA, 19 nt, Mycobacterium tuberculosis H37Rv
ucgucgccgucggugccgc

SEQ ID NO: 1298288 - RNA, 13 nt, Mycobacterium tuberculosis H37Rv
ucgucgcugagca

SEQ ID NO: 1298289 - RNA, 20 nt, Mycobacterium tuberculosis H37Rv
ucgucgcgugcaucgccugc

SEQ ID NO: 1298290 - RNA, 22 nt, Mycobacterium tuberculosis H37Rv
ucgucacggacccuuccgccgc

SEQ ID NO: 1298291 - RNA, 16 nt, Mycobacterium tuberculosis H37Rv
ucguccccagaccggc

SEQ ID NO: 1298292 - RNA, 14 nt, Mycobacterium tuberculosis H37Rv
ucguccggugcgau

SEQ ID NO: 1298293 - RNA, 14 nt, Mycobacterium tuberculosis H37Rv
ucguaccgggcgag

SEQ ID NO: 1298294 - RNA, 19 nt, Mycobacterium tuberculosis H37Rv
ucguaccgguugacgggcu

SEQ ID NO: 1298295 - RNA, 14 nt, Mycobacterium tuberculosis H37Rv
ucguaccguucggg

SEQ ID NO: 1298296 - RNA, 16 nt, Mycobacterium tuberculosis H37Rv
ucgucacauugccacc

SEQ ID NO: 1298297 - RNA, 18 nt, Mycobacterium tuberculosis H37Rv
ucgucaccguacgggacg

SEQ ID NO: 1298298 - RNA, 19 nt, Mycobacterium tuberculosis H37Rv
ucguacgggucggcgacga

SEQ ID NO: 1298299 - RNA, 13 nt, Mycobacterium tuberculosis H37Rv
ucguacucggcgg

SEQ ID NO: 1298300 - RNA, 16 nt, Mycobacterium tuberculosis H37Rv
ucgucggccgacaccg

SEQ ID NO: 1298301 - RNA, 14 nt, Mycobacterium tuberculosis H37Rv
ucgugcaccgucgg

SEQ ID NO: 1298302 - RNA, 12 nt, Mycobacterium tuberculosis H37Rv
ucgugcaaucgc

SEQ ID NO: 1298303 - RNA, 20 nt, Mycobacterium tuberculosis H37Rv
ucgugcacgacgacaucgag

SEQ ID NO: 1298304 - RNA, 14 nt, Mycobacterium tuberculosis H37Rv
ucgugcaaucgcgu

SEQ ID NO: 1298305 - RNA, 19 nt, Mycobacterium tuberculosis H37Rv
ucgugccagcagcaaucag

SEQ ID NO: 1298306 - RNA, 22 nt, Mycobacterium tuberculosis H37Rv
ucgugccgggccauucaccgcg

SEQ ID NO: 1298307 - RNA, 16 nt, Mycobacterium tuberculosis H37Rv
ucgugcucucggcgaa

SEQ ID NO: 1298308 - RNA, 15 nt, Mycobacterium tuberculosis H37Rv
ucgugcugaagcugu

SEQ ID NO: 1298309 - RNA, 21 nt, Mycobacterium tuberculosis H37Rv
ucgugcgcuuggucgaccgcc

SEQ ID NO: 1298310 - RNA, 20 nt, Mycobacterium tuberculosis H37Rv
ucgugcgcuuggucgaccgc

SEQ ID NO: 1298311 - RNA, 21 nt, Mycobacterium tuberculosis H37Rv
ucgugcgacgcaggaucacac

SEQ ID NO: 1298312 - RNA, 20 nt, Mycobacterium tuberculosis H37Rv
ucgugcgauuuugugucugc

SEQ ID NO: 1298313 - RNA, 15 nt, Mycobacterium tuberculosis H37Rv
ucgugcuugcccggu

SEQ ID NO: 1298314 - RNA, 19 nt, Mycobacterium tuberculosis H37Rv
ucguuccgcuggacggauc

SEQ ID NO: 1298315 - RNA, 17 nt, Mycobacterium tuberculosis H37Rv
ucguuccgcuggacgga

SEQ ID NO: 1298316 - RNA, 14 nt, Mycobacterium tuberculosis H37Rv
ucguucagcgucga

SEQ ID NO: 1298317 - RNA, 13 nt, Mycobacterium tuberculosis H37Rv
ucguucaccgauc

SEQ ID NO: 1298318 - RNA, 23 nt, Mycobacterium tuberculosis H37Rv
ucguucaccgcagcggguggugc

SEQ ID NO: 1298319 - RNA, 16 nt, Mycobacterium tuberculosis H37Rv
ucguuucgaagugccg

SEQ ID NO: 1298320 - RNA, 13 nt, Mycobacterium tuberculosis H37Rv
ucguuucgccagc

SEQ ID NO: 1298321 - RNA, 13 nt, Mycobacterium tuberculosis H37Rv
ucguugucgucgc

SEQ ID NO: 1298322 - RNA, 23 nt, Mycobacterium tuberculosis H37Rv
ucguugugcggacaucaccggca

SEQ ID NO: 1298323 - RNA, 19 nt, Mycobacterium tuberculosis H37Rv
ucguugugccggucgauga

SEQ ID NO: 1298324 - RNA, 19 nt, Mycobacterium tuberculosis H37Rv
ucguugccgcggucggcga

SEQ ID NO: 1298325 - RNA, 17 nt, Mycobacterium tuberculosis H37Rv
ucguugccguccaccga

SEQ ID NO: 1298326 - RNA, 20 nt, Mycobacterium tuberculosis H37Rv
ucuccaucaugugcgcgacc

SEQ ID NO: 1298327 - RNA, 21 nt, Mycobacterium tuberculosis H37Rv
ucuacgccgggaauuucgaca

SEQ ID NO: 1298328 - RNA, 20 nt, Mycobacterium tuberculosis H37Rv
ucguuuucgccgaucccggc

SEQ ID NO: 1298329 - RNA, 19 nt, Mycobacterium tuberculosis H37Rv
ucguuuuccagccgacgua

SEQ ID NO: 1298330 - RNA, 17 nt, Mycobacterium tuberculosis H37Rv
ugccgccgaugucgacg

SEQ ID NO: 1298331 - RNA, 17 nt, Mycobacterium tuberculosis H37Rv
ugccgccgagcuggcgc

SEQ ID NO: 1298332 - RNA, 12 nt, Mycobacterium tuberculosis H37Rv
ugccgccgacgg

SEQ ID NO: 1298333 - RNA, 13 nt, Mycobacterium tuberculosis H37Rv
ugccgccgccugc

SEQ ID NO: 1298334 - RNA, 19 nt, Mycobacterium tuberculosis H37Rv
ugccgccgccggcggucgc

SEQ ID NO: 1298335 - RNA, 14 nt, Mycobacterium tuberculosis H37Rv
ugccgccggcagcg

SEQ ID NO: 1298336 - RNA, 20 nt, Mycobacterium tuberculosis H37Rv
ugccgccggcuccgccagcg

SEQ ID NO: 1298337 - RNA, 14 nt, Mycobacterium tuberculosis H37Rv
ugccgcgaucgggc

SEQ ID NO: 1298338 - RNA, 20 nt, Mycobacterium tuberculosis H37Rv
ugccgcgcaccaacaccagc

SEQ ID NO: 1298339 - RNA, 16 nt, Mycobacterium tuberculosis H37Rv
ugccgccuccgccugc

SEQ ID NO: 1298340 - RNA, 17 nt, Mycobacterium tuberculosis H37Rv
ugccgccgguggugccg

SEQ ID NO: 1298341 - RNA, 18 nt, Mycobacterium tuberculosis H37Rv
ugccgccgguguugccgu

SEQ ID NO: 1298342 - RNA, 12 nt, Mycobacterium tuberculosis H37Rv
ugccgccgucac

SEQ ID NO: 1298343 - RNA, 15 nt, Mycobacterium tuberculosis H37Rv
ugccgccgucaccgc

SEQ ID NO: 1298344 - RNA, 21 nt, Mycobacterium tuberculosis H37Rv
ugccgccgucaccgccgacca

SEQ ID NO: 1298345 - RNA, 15 nt, Mycobacterium tuberculosis H37Rv
ugccgccgucgccac

SEQ ID NO: 1298346 - RNA, 15 nt, Mycobacterium tuberculosis H37Rv
ugccgccguugccgu

SEQ ID NO: 1298347 - RNA, 14 nt, Mycobacterium tuberculosis H37Rv
ugccgccguugcca

SEQ ID NO: 1298348 - RNA, 20 nt, Mycobacterium tuberculosis H37Rv
ugccgccguuaccgccguug

SEQ ID NO: 1298349 - RNA, 23 nt, Mycobacterium tuberculosis H37Rv
ugccgccguucccaccaccaccg

SEQ ID NO: 1298350 - RNA, 23 nt, Mycobacterium tuberculosis H37Rv
ugccgccgucgucgucggcagcg

SEQ ID NO: 1298351 - RNA, 16 nt, Mycobacterium tuberculosis H37Rv
ugccgccgucgccgau

SEQ ID NO: 1298352 - RNA, 16 nt, Mycobacterium tuberculosis H37Rv
ugccgcagcggcggca

SEQ ID NO: 1298353 - RNA, 20 nt, Mycobacterium tuberculosis H37Rv
ugccgcacgauggccgucga

SEQ ID NO: 1298354 - RNA, 19 nt, Mycobacterium tuberculosis H37Rv
ugccgcaugcgcuccggcg

SEQ ID NO: 1298355 - RNA, 21 nt, Mycobacterium tuberculosis H37Rv
ugccgccagcaacccugcggu

SEQ ID NO: 1298356 - RNA, 20 nt, Mycobacterium tuberculosis H37Rv
ugccgccacgggcggccacc

SEQ ID NO: 1298357 - RNA, 16 nt, Mycobacterium tuberculosis H37Rv
ugccgccgaagccgac

SEQ ID NO: 1298358 - RNA, 18 nt, Mycobacterium tuberculosis H37Rv
ugccgccgaagccgacga

SEQ ID NO: 1298359 - RNA, 21 nt, Mycobacterium tuberculosis H37Rv
ugccgccgaagccgcgcaucu

SEQ ID NO: 1298360 - RNA, 15 nt, Mycobacterium tuberculosis H37Rv
ugccgccgaagccga

SEQ ID NO: 1298361 - RNA, 17 nt, Mycobacterium tuberculosis H37Rv
ugccgccgacaccaccg

SEQ ID NO: 1298362 - RNA, 19 nt, Mycobacterium tuberculosis H37Rv
ugccgcccgcgccgccgga

SEQ ID NO: 1298363 - RNA, 21 nt, Mycobacterium tuberculosis H37Rv
ugccgcccaggagcaccucga

SEQ ID NO: 1298364 - RNA, 14 nt, Mycobacterium tuberculosis H37Rv
ugccgcccaugccg

SEQ ID NO: 1298365 - RNA, 14 nt, Mycobacterium tuberculosis H37Rv
ugccgccaucaccg

SEQ ID NO: 1298366 - RNA, 18 nt, Mycobacterium tuberculosis H37Rv
ugccgccagcgccaccgu

SEQ ID NO: 1298367 - RNA, 20 nt, Mycobacterium tuberculosis H37Rv
ugccgccauugacgccguug

SEQ ID NO: 1298368 - RNA, 19 nt, Mycobacterium tuberculosis H37Rv
ugccgccauuccagccggu

SEQ ID NO: 1298369 - RNA, 15 nt, Mycobacterium tuberculosis H37Rv
ugccgccaucaccgc

SEQ ID NO: 1298370 - RNA, 13 nt, Mycobacterium tuberculosis H37Rv
ugccgccauucca

SEQ ID NO: 1298371 - RNA, 19 nt, Mycobacterium tuberculosis H37Rv
ugccgcccacgcugcccac

SEQ ID NO: 1298372 - RNA, 18 nt, Mycobacterium tuberculosis H37Rv
ugccgaccagcaucucgg

SEQ ID NO: 1298373 - RNA, 16 nt, Mycobacterium tuberculosis H37Rv
ugccgacucggccaca

SEQ ID NO: 1298374 - RNA, 18 nt, Mycobacterium tuberculosis H37Rv
ugccgaauaccgguggca

SEQ ID NO: 1298375 - RNA, 18 nt, Mycobacterium tuberculosis H37Rv
ugccgaagcggccaccgc

SEQ ID NO: 1298376 - RNA, 20 nt, Mycobacterium tuberculosis H37Rv
ugccgagcgcaaggucgacg

SEQ ID NO: 1298377 - RNA, 14 nt, Mycobacterium tuberculosis H37Rv
ugccgcacccgguc

SEQ ID NO: 1298378 - RNA, 21 nt, Mycobacterium tuberculosis H37Rv
ugccgcacagcggauucggcg

SEQ ID NO: 1298379 - RNA, 15 nt, Mycobacterium tuberculosis H37Rv
ugccgaugccggcga

SEQ ID NO: 1298380 - RNA, 17 nt, Mycobacterium tuberculosis H37Rv
ugccgaugcccaucacg

SEQ ID NO: 1298381 - RNA, 20 nt, Mycobacterium tuberculosis H37Rv
ugccgaucggccaacagguc

SEQ ID NO: 1298382 - RNA, 16 nt, Mycobacterium tuberculosis H37Rv
ugccgaagcggccacc

SEQ ID NO: 1298383 - RNA, 22 nt, Mycobacterium tuberculosis H37Rv
ugccgaagcccccgacguugcu

SEQ ID NO: 1298384 - RNA, 22 nt, Mycobacterium tuberculosis H37Rv
ugccgaagcugcccaaccgguc

SEQ ID NO: 1298385 - RNA, 21 nt, Mycobacterium tuberculosis H37Rv
ugcccuccggguauggcggcg

SEQ ID NO: 1298386 - RNA, 16 nt, Mycobacterium tuberculosis H37Rv
ugcccucaacgaucgc

SEQ ID NO: 1298387 - RNA, 14 nt, Mycobacterium tuberculosis H37Rv
ugcccuagcccgau

SEQ ID NO: 1298388 - RNA, 20 nt, Mycobacterium tuberculosis H37Rv
ugcccgacugaacgucaccg

SEQ ID NO: 1298389 - RNA, 13 nt, Mycobacterium tuberculosis H37Rv
ugcccgacugaac

SEQ ID NO: 1298390 - RNA, 20 nt, Mycobacterium tuberculosis H37Rv
ugcccguguuaaagaagccu

SEQ ID NO: 1298391 - RNA, 14 nt, Mycobacterium tuberculosis H37Rv
ugccccggucggcg

SEQ ID NO: 1298392 - RNA, 21 nt, Mycobacterium tuberculosis H37Rv
ugccccgucguucuccauccg

SEQ ID NO: 1298393 - RNA, 17 nt, Mycobacterium tuberculosis H37Rv
ugccccggucggcgacg

SEQ ID NO: 1298394 - RNA, 12 nt, Mycobacterium tuberculosis H37Rv
ugccccgcaucg

SEQ ID NO: 1298395 - RNA, 14 nt, Mycobacterium tuberculosis H37Rv
ugccccgcaucgcc

SEQ ID NO: 1298396 - RNA, 15 nt, Mycobacterium tuberculosis H37Rv
ugccagucgaucgcg

SEQ ID NO: 1298397 - RNA, 14 nt, Mycobacterium tuberculosis H37Rv
ugccaguacucggc

SEQ ID NO: 1298398 - RNA, 20 nt, Mycobacterium tuberculosis H37Rv
ugccaaugauucggcacgcc

SEQ ID NO: 1298399 - RNA, 16 nt, Mycobacterium tuberculosis H37Rv
ugccacaacgccucga

SEQ ID NO: 1298400 - RNA, 13 nt, Mycobacterium tuberculosis H37Rv
ugccacagcgaca

SEQ ID NO: 1298401 - RNA, 22 nt, Mycobacterium tuberculosis H37Rv
ugccacccagcacgcgcgcgac

SEQ ID NO: 1298402 - RNA, 18 nt, Mycobacterium tuberculosis H37Rv
ugccaccucgacgcaccu

SEQ ID NO: 1298403 - RNA, 22 nt, Mycobacterium tuberculosis H37Rv
ugccaccgcggccgcggucgau

SEQ ID NO: 1298404 - RNA, 18 nt, Mycobacterium tuberculosis H37Rv
ugccaggagcacggguug

SEQ ID NO: 1298405 - RNA, 18 nt, Mycobacterium tuberculosis H37Rv
ugcccaagcucagggugg

SEQ ID NO: 1298406 - RNA, 14 nt, Mycobacterium tuberculosis H37Rv
ugcccaagcgcguu

SEQ ID NO: 1298407 - RNA, 21 nt, Mycobacterium tuberculosis H37Rv
ugcccacaaccgcaccaggug

SEQ ID NO: 1298408 - RNA, 14 nt, Mycobacterium tuberculosis H37Rv
ugccccaugcgcag

SEQ ID NO: 1298409 - RNA, 16 nt, Mycobacterium tuberculosis H37Rv
ugccccgagcugccgu

SEQ ID NO: 1298410 - RNA, 14 nt, Mycobacterium tuberculosis H37Rv
ugcccacgaaccgu

SEQ ID NO: 1298411 - RNA, 16 nt, Mycobacterium tuberculosis H37Rv
ugcaccuucuccaccg

SEQ ID NO: 1298412 - RNA, 16 nt, Mycobacterium tuberculosis H37Rv
ugcaucagcacgucgc

SEQ ID NO: 1298413 - RNA, 15 nt, Mycobacterium tuberculosis H37Rv
ugcagucgauuucgg

SEQ ID NO: 1298414 - RNA, 20 nt, Mycobacterium tuberculosis H37Rv
ugcaguaacuucaccggcuc

SEQ ID NO: 1298415 - RNA, 12 nt, Mycobacterium tuberculosis H37Rv
ugcauuggcggu

SEQ ID NO: 1298416 - RNA, 15 nt, Mycobacterium tuberculosis H37Rv
ugccaacugcgccgu

SEQ ID NO: 1298417 - RNA, 18 nt, Mycobacterium tuberculosis H37Rv
ugccaacgcccguguuga

SEQ ID NO: 1298418 - RNA, 16 nt, Mycobacterium tuberculosis H37Rv
ugccaacaccggcgau

SEQ ID NO: 1298419 - RNA, 23 nt, Mycobacterium tuberculosis H37Rv
ugcaugcccagaaaaccgccgca

SEQ ID NO: 1298420 - RNA, 21 nt, Mycobacterium tuberculosis H37Rv
ugacucugcguccaccggacg

SEQ ID NO: 1298421 - RNA, 19 nt, Mycobacterium tuberculosis H37Rv
ugacugcacaccaccgccg

SEQ ID NO: 1298422 - RNA, 21 nt, Mycobacterium tuberculosis H37Rv
ugacgguuccggucggguugg

SEQ ID NO: 1298423 - RNA, 19 nt, Mycobacterium tuberculosis H37Rv
ugacguagaagucgaucgc

SEQ ID NO: 1298424 - RNA, 20 nt, Mycobacterium tuberculosis H37Rv
ugacgguugccccggcgacc

SEQ ID NO: 1298425 - RNA, 18 nt, Mycobacterium tuberculosis H37Rv
ugacgucaccacgaucgc

SEQ ID NO: 1298426 - RNA, 23 nt, Mycobacterium tuberculosis H37Rv
ugacgucaagagugcucagcgcg

SEQ ID NO: 1298427 - RNA, 19 nt, Mycobacterium tuberculosis H37Rv
ugacgucacguucggcgca

SEQ ID NO: 1298428 - RNA, 17 nt, Mycobacterium tuberculosis H37Rv
ugaccccggcagcgccc

SEQ ID NO: 1298429 - RNA, 24 nt, Mycobacterium tuberculosis H37Rv
ugacccgacaugguccgaccagcg

SEQ ID NO: 1298430 - RNA, 15 nt, Mycobacterium tuberculosis H37Rv
ugacccgcaagucga

SEQ ID NO: 1298431 - RNA, 19 nt, Mycobacterium tuberculosis H37Rv
ugacccauggcuccgccca

SEQ ID NO: 1298432 - RNA, 16 nt, Mycobacterium tuberculosis H37Rv
ugacccauggucacca

SEQ ID NO: 1298433 - RNA, 13 nt, Mycobacterium tuberculosis H37Rv
ugacccccagcag

SEQ ID NO: 1298434 - RNA, 22 nt, Mycobacterium tuberculosis H37Rv
ugaccccgcgugaccgacugcg

SEQ ID NO: 1298435 - RNA, 15 nt, Mycobacterium tuberculosis H37Rv
ugagcagcacgucau

SEQ ID NO: 1298436 - RNA, 12 nt, Mycobacterium tuberculosis H37Rv
ugagcaucaccg

SEQ ID NO: 1298437 - RNA, 14 nt, Mycobacterium tuberculosis H37Rv
ugagcaugcgacgu

SEQ ID NO: 1298438 - RNA, 22 nt, Mycobacterium tuberculosis H37Rv
ugagcaauggcgcgaccgauga

SEQ ID NO: 1298439 - RNA, 17 nt, Mycobacterium tuberculosis H37Rv
ugagcacaccgacagca

SEQ ID NO: 1298440 - RNA, 20 nt, Mycobacterium tuberculosis H37Rv
ugagcacaccgacagcaccc

SEQ ID NO: 1298441 - RNA, 13 nt, Mycobacterium tuberculosis H37Rv
ugagacucgcucg

SEQ ID NO: 1298442 - RNA, 14 nt, Mycobacterium tuberculosis H37Rv
ugacugcgaccggu

SEQ ID NO: 1298443 - RNA, 17 nt, Mycobacterium tuberculosis H37Rv
ugagugaccacgcugcu

SEQ ID NO: 1298444 - RNA, 13 nt, Mycobacterium tuberculosis H37Rv
ugagucacccggc

SEQ ID NO: 1298445 - RNA, 16 nt, Mycobacterium tuberculosis H37Rv
ugaguaccauccgggc

SEQ ID NO: 1298446 - RNA, 15 nt, Mycobacterium tuberculosis H37Rv
ugaguaacacguggg

SEQ ID NO: 1298447 - RNA, 13 nt, Mycobacterium tuberculosis H37Rv
ugaggucccggcu

SEQ ID NO: 1298448 - RNA, 17 nt, Mycobacterium tuberculosis H37Rv
ugagguucaucgccggc

SEQ ID NO: 1298449 - RNA, 14 nt, Mycobacterium tuberculosis H37Rv
ugagcggccggcau

SEQ ID NO: 1298450 - RNA, 19 nt, Mycobacterium tuberculosis H37Rv
ugagccggucuugcaucgc

SEQ ID NO: 1298451 - RNA, 23 nt, Mycobacterium tuberculosis H37Rv
ugagccgggugcgagcgacaccg

SEQ ID NO: 1298452 - RNA, 18 nt, Mycobacterium tuberculosis H37Rv
ugagccauacgcgcugac

SEQ ID NO: 1298453 - RNA, 22 nt, Mycobacterium tuberculosis H37Rv
ugagccauacgcgcugacccgc

SEQ ID NO: 1298454 - RNA, 18 nt, Mycobacterium tuberculosis H37Rv
ugagccgcgaaaucaccg

SEQ ID NO: 1298455 - RNA, 21 nt, Mycobacterium tuberculosis H37Rv
ugagccgcagaugcaccugcg

SEQ ID NO: 1298456 - RNA, 15 nt, Mycobacterium tuberculosis H37Rv
ugagccgcagcaccu

SEQ ID NO: 1298457 - RNA, 20 nt, Mycobacterium tuberculosis H37Rv
ugagcccgcgaucaccauag

SEQ ID NO: 1298458 - RNA, 16 nt, Mycobacterium tuberculosis H37Rv
ugagcgugccgcagcg

SEQ ID NO: 1298459 - RNA, 17 nt, Mycobacterium tuberculosis H37Rv
ugagcguaguaggcagc

SEQ ID NO: 1298460 - RNA, 21 nt, Mycobacterium tuberculosis H37Rv
ugauguugaucguugugcacc

SEQ ID NO: 1298461 - RNA, 14 nt, Mycobacterium tuberculosis H37Rv
ugaugucggugcgu

SEQ ID NO: 1298462 - RNA, 17 nt, Mycobacterium tuberculosis H37Rv
ugauguccgcacaacga

SEQ ID NO: 1298463 - RNA, 21 nt, Mycobacterium tuberculosis H37Rv
ugaucgaacacggcacaaucg

SEQ ID NO: 1298464 - RNA, 17 nt, Mycobacterium tuberculosis H37Rv
ugaugcaacucggcaga

SEQ ID NO: 1298465 - RNA, 13 nt, Mycobacterium tuberculosis H37Rv
ugaucaucccggc

SEQ ID NO: 1298466 - RNA, 21 nt, Mycobacterium tuberculosis H37Rv
ugaucagcucgcgcacgucga

SEQ ID NO: 1298467 - RNA, 19 nt, Mycobacterium tuberculosis H37Rv
ugaucagggucagcgccgc

SEQ ID NO: 1298468 - RNA, 19 nt, Mycobacterium tuberculosis H37Rv
ugaucccggccaggccgac

SEQ ID NO: 1298469 - RNA, 18 nt, Mycobacterium tuberculosis H37Rv
ugauccgccggcaacgcg

SEQ ID NO: 1298470 - RNA, 18 nt, Mycobacterium tuberculosis H37Rv
ugauccgccugccgacgg

SEQ ID NO: 1298471 - RNA, 15 nt, Mycobacterium tuberculosis H37Rv
ugcaccuccgacggc

SEQ ID NO: 1298472 - RNA, 16 nt, Mycobacterium tuberculosis H37Rv
ugcaccgccaggucga

SEQ ID NO: 1298473 - RNA, 13 nt, Mycobacterium tuberculosis H37Rv
ugcacaggucagc

SEQ ID NO: 1298474 - RNA, 16 nt, Mycobacterium tuberculosis H37Rv
ugcacacugguggugc

SEQ ID NO: 1298475 - RNA, 15 nt, Mycobacterium tuberculosis H37Rv
ugcacagcagcguca

SEQ ID NO: 1298476 - RNA, 16 nt, Mycobacterium tuberculosis H37Rv
ugcacaccgucgcacc

SEQ ID NO: 1298477 - RNA, 21 nt, Mycobacterium tuberculosis H37Rv
ugcacagccgggcucucggua

SEQ ID NO: 1298478 - RNA, 19 nt, Mycobacterium tuberculosis H37Rv
ugcacacagaggucgguca

SEQ ID NO: 1298479 - RNA, 21 nt, Mycobacterium tuberculosis H37Rv
ugcacacagaggucggucagc

SEQ ID NO: 1298480 - RNA, 23 nt, Mycobacterium tuberculosis H37Rv
ugcacacccgcaaugaccgcgga

SEQ ID NO: 1298481 - RNA, 17 nt, Mycobacterium tuberculosis H37Rv
ugcacaaccgcugcugc

SEQ ID NO: 1298482 - RNA, 23 nt, Mycobacterium tuberculosis H37Rv
ugcaaagucgggggucgcacccu

SEQ ID NO: 1298483 - RNA, 18 nt, Mycobacterium tuberculosis H37Rv
ugcaaggaauuccggcug

SEQ ID NO: 1298484 - RNA, 22 nt, Mycobacterium tuberculosis H37Rv
ugcaagacaaagccgucgacgc

SEQ ID NO: 1298485 - RNA, 21 nt, Mycobacterium tuberculosis H37Rv
ucccaacggcagcgccaccga

SEQ ID NO: 1298486 - RNA, 22 nt, Mycobacterium tuberculosis H37Rv
ucccaccagguacgcgaucagc

SEQ ID NO: 1298487 - RNA, 14 nt, Mycobacterium tuberculosis H37Rv
uccccucgcaaccg

SEQ ID NO: 1298488 - RNA, 17 nt, Mycobacterium tuberculosis H37Rv
uccccugauggacccga

SEQ ID NO: 1298489 - RNA, 16 nt, Mycobacterium tuberculosis H37Rv
uccccucgacacgccg

SEQ ID NO: 1298490 - RNA, 13 nt, Mycobacterium tuberculosis H37Rv
uccccucgcaacc

SEQ ID NO: 1298491 - RNA, 18 nt, Mycobacterium tuberculosis H37Rv
ucccgagcuccgcggcga

SEQ ID NO: 1298492 - RNA, 22 nt, Mycobacterium tuberculosis H37Rv
ucccgaccaccucagcugcgga

SEQ ID NO: 1298493 - RNA, 16 nt, Mycobacterium tuberculosis H37Rv
ucccgaugcuggcaaa

SEQ ID NO: 1298494 - RNA, 21 nt, Mycobacterium tuberculosis H37Rv
ucccgaugguggccgcgcggu

SEQ ID NO: 1298495 - RNA, 14 nt, Mycobacterium tuberculosis H37Rv
ucccgaaacgccgg

SEQ ID NO: 1298496 - RNA, 19 nt, Mycobacterium tuberculosis H37Rv
uccccuggccaaccggguc

SEQ ID NO: 1298497 - RNA, 17 nt, Mycobacterium tuberculosis H37Rv
ucccgaaauucucgccc

SEQ ID NO: 1298498 - RNA, 14 nt, Mycobacterium tuberculosis H37Rv
ucccgaaucgugcg

SEQ ID NO: 1298499 - RNA, 24 nt, Mycobacterium tuberculosis H37Rv
ucccggcgagcacccgcuggucga

SEQ ID NO: 1298500 - RNA, 16 nt, Mycobacterium tuberculosis H37Rv
ucccggcgaccggguc

SEQ ID NO: 1298501 - RNA, 21 nt, Mycobacterium tuberculosis H37Rv
ucccgggccgccgcgauggcc

SEQ ID NO: 1298502 - RNA, 16 nt, Mycobacterium tuberculosis H37Rv
ucccgcauugacgaaa

SEQ ID NO: 1298503 - RNA, 18 nt, Mycobacterium tuberculosis H37Rv
ucccgcaggcucaccgag

SEQ ID NO: 1298504 - RNA, 14 nt, Mycobacterium tuberculosis H37Rv
ucccgcagccgggc

SEQ ID NO: 1298505 - RNA, 17 nt, Mycobacterium tuberculosis H37Rv
ucccgcaauucgcgguc

SEQ ID NO: 1298506 - RNA, 14 nt, Mycobacterium tuberculosis H37Rv
ucccgcaaugcgag

SEQ ID NO: 1298507 - RNA, 20 nt, Mycobacterium tuberculosis H37Rv
ucccgcacaagcccagcccg

SEQ ID NO: 1298508 - RNA, 22 nt, Mycobacterium tuberculosis H37Rv
uccgcaaaacgagcuuccacgc

SEQ ID NO: 1298509 - RNA, 21 nt, Mycobacterium tuberculosis H37Rv
uccgcaaccccuggggugcuc

SEQ ID NO: 1298510 - RNA, 17 nt, Mycobacterium tuberculosis H37Rv
uccgcaaccucgccguc

SEQ ID NO: 1298511 - RNA, 19 nt, Mycobacterium tuberculosis H37Rv
uccgcaccccauacucggc

SEQ ID NO: 1298512 - RNA, 15 nt, Mycobacterium tuberculosis H37Rv
uccgcacagcgacga

SEQ ID NO: 1298513 - RNA, 14 nt, Mycobacterium tuberculosis H37Rv
uccgcacagcaaca

SEQ ID NO: 1298514 - RNA, 13 nt, Mycobacterium tuberculosis H37Rv
uccgcaccgaaac

SEQ ID NO: 1298515 - RNA, 15 nt, Mycobacterium tuberculosis H37Rv
uccgcacgaucgccc

SEQ ID NO: 1298516 - RNA, 14 nt, Mycobacterium tuberculosis H37Rv
uccgcacgaucgcc

SEQ ID NO: 1298517 - RNA, 20 nt, Mycobacterium tuberculosis H37Rv
uccgcacgguucuuggcguc

SEQ ID NO: 1298518 - RNA, 20 nt, Mycobacterium tuberculosis H37Rv
uccgcagaaugucguaggcg

SEQ ID NO: 1298519 - RNA, 17 nt, Mycobacterium tuberculosis H37Rv
uccgcaguucggucguc

SEQ ID NO: 1298520 - RNA, 16 nt, Mycobacterium tuberculosis H37Rv
uccgccagaucucgcg

SEQ ID NO: 1298521 - RNA, 14 nt, Mycobacterium tuberculosis H37Rv
uccgcccagccgca

SEQ ID NO: 1298522 - RNA, 22 nt, Mycobacterium tuberculosis H37Rv
uccgcccagcgaggugggcguc

SEQ ID NO: 1298523 - RNA, 18 nt, Mycobacterium tuberculosis H37Rv
uccgcaucaugucgaaga

SEQ ID NO: 1298524 - RNA, 15 nt, Mycobacterium tuberculosis H37Rv
uccgacuugucgccg

SEQ ID NO: 1298525 - RNA, 19 nt, Mycobacterium tuberculosis H37Rv
uccgagcgcggcggcggag

SEQ ID NO: 1298526 - RNA, 18 nt, Mycobacterium tuberculosis H37Rv
uccgagccgcgauugugc

SEQ ID NO: 1298527 - RNA, 14 nt, Mycobacterium tuberculosis H37Rv
uccgaggccgccau

SEQ ID NO: 1298528 - RNA, 19 nt, Mycobacterium tuberculosis H37Rv
uccgaggaauacagcuuga

SEQ ID NO: 1298529 - RNA, 13 nt, Mycobacterium tuberculosis H37Rv
uccgagcuuggcc

SEQ ID NO: 1298530 - RNA, 22 nt, Mycobacterium tuberculosis H37Rv
uccgaugaccagggucugcuca

SEQ ID NO: 1298531 - RNA, 21 nt, Mycobacterium tuberculosis H37Rv
uccgaugaccagggucugcuc

SEQ ID NO: 1298532 - RNA, 14 nt, Mycobacterium tuberculosis H37Rv
uccgaugccgacgg

SEQ ID NO: 1298533 - RNA, 17 nt, Mycobacterium tuberculosis H37Rv
ucccggucuacgacguc

SEQ ID NO: 1298534 - RNA, 21 nt, Mycobacterium tuberculosis H37Rv
uccgacaagcugucggcgacc

SEQ ID NO: 1298535 - RNA, 19 nt, Mycobacterium tuberculosis H37Rv
uccgacaguggcucacccu

SEQ ID NO: 1298536 - RNA, 20 nt, Mycobacterium tuberculosis H37Rv
ucccggugagggguugcggu

SEQ ID NO: 1298537 - RNA, 17 nt, Mycobacterium tuberculosis H37Rv
uccgacgaaccgggaca

SEQ ID NO: 1298538 - RNA, 23 nt, Mycobacterium tuberculosis H37Rv
uccgacauuggccgucaucgccg

SEQ ID NO: 1298539 - RNA, 13 nt, Mycobacterium tuberculosis H37Rv
uccgacggcggau

SEQ ID NO: 1298540 - RNA, 15 nt, Mycobacterium tuberculosis H37Rv
uccggcucauccgac

SEQ ID NO: 1298541 - RNA, 12 nt, Mycobacterium tuberculosis H37Rv
uccggcuccacc

SEQ ID NO: 1298542 - RNA, 17 nt, Mycobacterium tuberculosis H37Rv
uccggcuucguccaccg

SEQ ID NO: 1298543 - RNA, 12 nt, Mycobacterium tuberculosis H37Rv
uccggcugcggu

SEQ ID NO: 1298544 - RNA, 18 nt, Mycobacterium tuberculosis H37Rv
uccggcuucguccaccgc

SEQ ID NO: 1298545 - RNA, 13 nt, Mycobacterium tuberculosis H37Rv
uccggcgccagca

SEQ ID NO: 1298546 - RNA, 15 nt, Mycobacterium tuberculosis H37Rv
uccggcgccagcagu

SEQ ID NO: 1298547 - RNA, 16 nt, Mycobacterium tuberculosis H37Rv
uccggcgccaccgccg

SEQ ID NO: 1298548 - RNA, 20 nt, Mycobacterium tuberculosis H37Rv
uccggcgcacgaaaccgcag

SEQ ID NO: 1298549 - RNA, 17 nt, Mycobacterium tuberculosis H37Rv
uccggcgcacgaaaccg

SEQ ID NO: 1298550 - RNA, 18 nt, Mycobacterium tuberculosis H37Rv
uccggccacacucgccag

SEQ ID NO: 1298551 - RNA, 17 nt, Mycobacterium tuberculosis H37Rv
uccggcgaucucgaccg

SEQ ID NO: 1298552 - RNA, 23 nt, Mycobacterium tuberculosis H37Rv
uccggcgacucugugacgggcac

SEQ ID NO: 1298553 - RNA, 18 nt, Mycobacterium tuberculosis H37Rv
uccgcgcccgagccggua

SEQ ID NO: 1298554 - RNA, 22 nt, Mycobacterium tuberculosis H37Rv
uccgcuugggcggugucgucga

SEQ ID NO: 1298555 - RNA, 17 nt, Mycobacterium tuberculosis H37Rv
uccgcuugcucucgcag

SEQ ID NO: 1298556 - RNA, 17 nt, Mycobacterium tuberculosis H37Rv
uccgcgacagcggcguc

SEQ ID NO: 1298557 - RNA, 14 nt, Mycobacterium tuberculosis H37Rv
uccgcgagcccggc

SEQ ID NO: 1298558 - RNA, 19 nt, Mycobacterium tuberculosis H37Rv
uccgcgaguagaucaucga

SEQ ID NO: 1298559 - RNA, 16 nt, Mycobacterium tuberculosis H37Rv
uccgcgaucaccgacg

SEQ ID NO: 1298560 - RNA, 12 nt, Mycobacterium tuberculosis H37Rv
uccgcgaugugg

SEQ ID NO: 1298561 - RNA, 22 nt, Mycobacterium tuberculosis H37Rv
uccgccgggccaggccgaugcc

SEQ ID NO: 1298562 - RNA, 20 nt, Mycobacterium tuberculosis H37Rv
uccgccgggccaggccgaug

SEQ ID NO: 1298563 - RNA, 18 nt, Mycobacterium tuberculosis H37Rv
uccgccgggcucagcugg

SEQ ID NO: 1298564 - RNA, 22 nt, Mycobacterium tuberculosis H37Rv
uccgccggcaccuccggcaccg

SEQ ID NO: 1298565 - RNA, 14 nt, Mycobacterium tuberculosis H37Rv
uccguuuuaccucg

SEQ ID NO: 1298566 - RNA, 21 nt, Mycobacterium tuberculosis H37Rv
uccuccggguuggcgacgauc

SEQ ID NO: 1298567 - RNA, 16 nt, Mycobacterium tuberculosis H37Rv
uccuccggguuggcga

SEQ ID NO: 1298568 - RNA, 18 nt, Mycobacterium tuberculosis H37Rv
uccuccggguuggcgacg

SEQ ID NO: 1298569 - RNA, 18 nt, Mycobacterium tuberculosis H37Rv
uccuccgguaucggcgac

SEQ ID NO: 1298570 - RNA, 22 nt, Mycobacterium tuberculosis H37Rv
uccuccggcaccaacgccaccg

SEQ ID NO: 1298571 - RNA, 17 nt, Mycobacterium tuberculosis H37Rv
uccucgacgucggcgag

SEQ ID NO: 1298572 - RNA, 23 nt, Mycobacterium tuberculosis H37Rv
uccucgacacccauccucgcggu

SEQ ID NO: 1298573 - RNA, 22 nt, Mycobacterium tuberculosis H37Rv
uccucgaucacuguuccgggug

SEQ ID NO: 1298574 - RNA, 20 nt, Mycobacterium tuberculosis H37Rv
uccucgaugaggcgcagcgc

SEQ ID NO: 1298575 - RNA, 14 nt, Mycobacterium tuberculosis H37Rv
uccguucgaugcca

SEQ ID NO: 1298576 - RNA, 14 nt, Mycobacterium tuberculosis H37Rv
uccgugccgaugcc

SEQ ID NO: 1298577 - RNA, 13 nt, Mycobacterium tuberculosis H37Rv
uccgugacaccgg

SEQ ID NO: 1298578 - RNA, 11 nt, Mycobacterium tuberculosis H37Rv
uccgucgucgg

SEQ ID NO: 1298579 - RNA, 15 nt, Mycobacterium tuberculosis H37Rv
uccgucgucggcguc

SEQ ID NO: 1298580 - RNA, 13 nt, Mycobacterium tuberculosis H37Rv
uccguccucgucc

SEQ ID NO: 1298581 - RNA, 19 nt, Mycobacterium tuberculosis H37Rv
uccgucgaaccuaccgugu

SEQ ID NO: 1298582 - RNA, 17 nt, Mycobacterium tuberculosis H37Rv
uccgucgauggaccgca

SEQ ID NO: 1298583 - RNA, 18 nt, Mycobacterium tuberculosis H37Rv
uccgggaugucgaagucg

SEQ ID NO: 1298584 - RNA, 14 nt, Mycobacterium tuberculosis H37Rv
uccgggacggugaa

SEQ ID NO: 1298585 - RNA, 23 nt, Mycobacterium tuberculosis H37Rv
uccgggccgaucaccccggugga

SEQ ID NO: 1298586 - RNA, 17 nt, Mycobacterium tuberculosis H37Rv
uccgggcaaccgaaccg

SEQ ID NO: 1298587 - RNA, 15 nt, Mycobacterium tuberculosis H37Rv
uccgggccgaucacc

SEQ ID NO: 1298588 - RNA, 15 nt, Mycobacterium tuberculosis H37Rv
uccgggcugcaugcg

SEQ ID NO: 1298589 - RNA, 18 nt, Mycobacterium tuberculosis H37Rv
uccgggcgaccaccaccg

SEQ ID NO: 1298590 - RNA, 23 nt, Mycobacterium tuberculosis H37Rv
ucgacggcggccgccacuccgug

SEQ ID NO: 1298591 - RNA, 19 nt, Mycobacterium tuberculosis H37Rv
ucgagcaccuugcgauugc

SEQ ID NO: 1298592 - RNA, 18 nt, Mycobacterium tuberculosis H37Rv
ucgacggucaccggcgca

SEQ ID NO: 1298593 - RNA, 17 nt, Mycobacterium tuberculosis H37Rv
ucgacggugccgucugc

SEQ ID NO: 1298594 - RNA, 17 nt, Mycobacterium tuberculosis H37Rv
ucgagcagcgccacccg

SEQ ID NO: 1298595 - RNA, 12 nt, Mycobacterium tuberculosis H37Rv
ucgagcacgaug

SEQ ID NO: 1298596 - RNA, 15 nt, Mycobacterium tuberculosis H37Rv
ucgagcaggcgcacc

SEQ ID NO: 1298597 - RNA, 18 nt, Mycobacterium tuberculosis H37Rv
ucgagccggugccgcggu

SEQ ID NO: 1298598 - RNA, 15 nt, Mycobacterium tuberculosis H37Rv
ucgagcgacccccag

SEQ ID NO: 1298599 - RNA, 19 nt, Mycobacterium tuberculosis H37Rv
ucgagcgcgccgcgcucgc

SEQ ID NO: 1298600 - RNA, 16 nt, Mycobacterium tuberculosis H37Rv
ucgagcgcgcgacgga

SEQ ID NO: 1298601 - RNA, 20 nt, Mycobacterium tuberculosis H37Rv
ucgagcgcgccgcgcucgcc

SEQ ID NO: 1298602 - RNA, 23 nt, Mycobacterium tuberculosis H37Rv
ucgaucaacaccaacgacagcga

SEQ ID NO: 1298603 - RNA, 15 nt, Mycobacterium tuberculosis H37Rv
ucgaggccagcagcu

SEQ ID NO: 1298604 - RNA, 18 nt, Mycobacterium tuberculosis H37Rv
ucgaggcugaccguggcg

SEQ ID NO: 1298605 - RNA, 17 nt, Mycobacterium tuberculosis H37Rv
ucgaggcgaucaccgcg

SEQ ID NO: 1298606 - RNA, 16 nt, Mycobacterium tuberculosis H37Rv
ucgaugcgaucgacga

SEQ ID NO: 1298607 - RNA, 18 nt, Mycobacterium tuberculosis H37Rv
ucgaugccgcguagcugg

SEQ ID NO: 1298608 - RNA, 23 nt, Mycobacterium tuberculosis H37Rv
ucgaugagcgcgaaguacgacga

SEQ ID NO: 1298609 - RNA, 22 nt, Mycobacterium tuberculosis H37Rv
ucgaugagugacgguccguucg

SEQ ID NO: 1298610 - RNA, 15 nt, Mycobacterium tuberculosis H37Rv
ucgaucaggucguca

SEQ ID NO: 1298611 - RNA, 12 nt, Mycobacterium tuberculosis H37Rv
ucgaucaccgcu

SEQ ID NO: 1298612 - RNA, 18 nt, Mycobacterium tuberculosis H37Rv
ucgcaccccggcggcguc

SEQ ID NO: 1298613 - RNA, 17 nt, Mycobacterium tuberculosis H37Rv
ucgcaaggcccgcaccg

SEQ ID NO: 1298614 - RNA, 15 nt, Mycobacterium tuberculosis H37Rv
ucgcaagcgcggcga

SEQ ID NO: 1298615 - RNA, 22 nt, Mycobacterium tuberculosis H37Rv
ucgcaacggucacaugugucac

SEQ ID NO: 1298616 - RNA, 20 nt, Mycobacterium tuberculosis H37Rv
ucgcaacguguccgcagucc

SEQ ID NO: 1298617 - RNA, 18 nt, Mycobacterium tuberculosis H37Rv
ucgauguccucgacaccc

SEQ ID NO: 1298618 - RNA, 22 nt, Mycobacterium tuberculosis H37Rv
ucgauggugcggcccaaccggu

SEQ ID NO: 1298619 - RNA, 15 nt, Mycobacterium tuberculosis H37Rv
ucgauguacaccgug

SEQ ID NO: 1298620 - RNA, 17 nt, Mycobacterium tuberculosis H37Rv
ucgauucccggcgcggu

SEQ ID NO: 1298621 - RNA, 17 nt, Mycobacterium tuberculosis H37Rv
ucgaccgugucaccgcc

SEQ ID NO: 1298622 - RNA, 18 nt, Mycobacterium tuberculosis H37Rv
ucgaccguauugaccagc

SEQ ID NO: 1298623 - RNA, 24 nt, Mycobacterium tuberculosis H37Rv
ucgaccgcggcccggacgucggcg

SEQ ID NO: 1298624 - RNA, 17 nt, Mycobacterium tuberculosis H37Rv
ucgaccgccagccgcga

SEQ ID NO: 1298625 - RNA, 21 nt, Mycobacterium tuberculosis H37Rv
ucgaccggacaaagcugcucg

SEQ ID NO: 1298626 - RNA, 15 nt, Mycobacterium tuberculosis H37Rv
ucgaccuucgggaca

SEQ ID NO: 1298627 - RNA, 15 nt, Mycobacterium tuberculosis H37Rv
ucgaccuucaccgcg

SEQ ID NO: 1298628 - RNA, 19 nt, Mycobacterium tuberculosis H37Rv
ucgaccucgucggccgaca

SEQ ID NO: 1298629 - RNA, 16 nt, Mycobacterium tuberculosis H37Rv
ucgaccuccaccaaug

SEQ ID NO: 1298630 - RNA, 16 nt, Mycobacterium tuberculosis H37Rv
ucgaccucgcgggcga

SEQ ID NO: 1298631 - RNA, 12 nt, Mycobacterium tuberculosis H37Rv
ucgacgaacucc

SEQ ID NO: 1298632 - RNA, 23 nt, Mycobacterium tuberculosis H37Rv
ucgacgaagaucuucaccggccg

SEQ ID NO: 1298633 - RNA, 15 nt, Mycobacterium tuberculosis H37Rv
ucgacgaagguggcg

SEQ ID NO: 1298634 - RNA, 18 nt, Mycobacterium tuberculosis H37Rv
ucgacgaauaacgcgguc

SEQ ID NO: 1298635 - RNA, 15 nt, Mycobacterium tuberculosis H37Rv
ucgacgacaacgaug

SEQ ID NO: 1298636 - RNA, 17 nt, Mycobacterium tuberculosis H37Rv
ucgacgacaacgauguc

SEQ ID NO: 1298637 - RNA, 20 nt, Mycobacterium tuberculosis H37Rv
ucgacgcagugcccgaucgc

SEQ ID NO: 1298638 - RNA, 16 nt, Mycobacterium tuberculosis H37Rv
ucgacauccucgaugg

SEQ ID NO: 1298639 - RNA, 15 nt, Mycobacterium tuberculosis H37Rv
ucgaccgaacgccag

SEQ ID NO: 1298640 - RNA, 16 nt, Mycobacterium tuberculosis H37Rv
ucgaccgcgacggcaa

SEQ ID NO: 1298641 - RNA, 17 nt, Mycobacterium tuberculosis H37Rv
ucgacagcagcgcgaca

SEQ ID NO: 1298642 - RNA, 21 nt, Mycobacterium tuberculosis H37Rv
ucgacagcaucacgcccacga

SEQ ID NO: 1298643 - RNA, 17 nt, Mycobacterium tuberculosis H37Rv
ucgacaacugcccgaug

SEQ ID NO: 1298644 - RNA, 16 nt, Mycobacterium tuberculosis H37Rv
ucgaagccccucaccu

SEQ ID NO: 1298645 - RNA, 12 nt, Mycobacterium tuberculosis H37Rv
ucgaagcccgga

SEQ ID NO: 1298646 - RNA, 20 nt, Mycobacterium tuberculosis H37Rv
ucgaagccccucaccucggc

SEQ ID NO: 1298647 - RNA, 21 nt, Mycobacterium tuberculosis H37Rv
ucgaagaccucgucgcgucgc

SEQ ID NO: 1298648 - RNA, 18 nt, Mycobacterium tuberculosis H37Rv
ucgaagacgaacgugucg

SEQ ID NO: 1298649 - RNA, 18 nt, Mycobacterium tuberculosis H37Rv
ucgaauaguugaccaggc

SEQ ID NO: 1298650 - RNA, 20 nt, Mycobacterium tuberculosis H37Rv
ucgaaguccgcuugggcggu

SEQ ID NO: 1298651 - RNA, 21 nt, Mycobacterium tuberculosis H37Rv
ucgaacugguuucgcaccgug

SEQ ID NO: 1298652 - RNA, 13 nt, Mycobacterium tuberculosis H37Rv
ucgaacucggcgg

SEQ ID NO: 1298653 - RNA, 15 nt, Mycobacterium tuberculosis H37Rv
ucgaagaaccgccac

SEQ ID NO: 1298654 - RNA, 15 nt, Mycobacterium tuberculosis H37Rv
ucgaagaaccggccg

SEQ ID NO: 1298655 - RNA, 22 nt, Mycobacterium tuberculosis H37Rv
ucgaaccugucgaucacggccg

SEQ ID NO: 1298656 - RNA, 17 nt, Mycobacterium tuberculosis H37Rv
ucgaaaucgcacagcgc

SEQ ID NO: 1298657 - RNA, 16 nt, Mycobacterium tuberculosis H37Rv
uccuugaccucguccc

SEQ ID NO: 1298658 - RNA, 13 nt, Mycobacterium tuberculosis H37Rv
ucgaaaacagcga

SEQ ID NO: 1298659 - RNA, 14 nt, Mycobacterium tuberculosis H37Rv
uccuuaugcgcggu

SEQ ID NO: 1298660 - RNA, 14 nt, Mycobacterium tuberculosis H37Rv
ucgcgcugaucagc

SEQ ID NO: 1298661 - RNA, 22 nt, Mycobacterium tuberculosis H37Rv
ucgcgcugcugucgauuucgcc

SEQ ID NO: 1298662 - RNA, 13 nt, Mycobacterium tuberculosis H37Rv
ucgcgcucgcacc

SEQ ID NO: 1298663 - RNA, 18 nt, Mycobacterium tuberculosis H37Rv
ucgcgcuaaggugggcac

SEQ ID NO: 1298664 - RNA, 23 nt, Mycobacterium tuberculosis H37Rv
ucgcgcuaaggugggcacagcga

SEQ ID NO: 1298665 - RNA, 18 nt, Mycobacterium tuberculosis H37Rv
ucgcgcgguagucgucgc

SEQ ID NO: 1298666 - RNA, 22 nt, Mycobacterium tuberculosis H37Rv
ucgcggacucguagcaccgguc

SEQ ID NO: 1298667 - RNA, 14 nt, Mycobacterium tuberculosis H37Rv
ucgcggacgucgcc

SEQ ID NO: 1298668 - RNA, 17 nt, Mycobacterium tuberculosis H37Rv
ucgcggaccucggcgac

SEQ ID NO: 1298669 - RNA, 23 nt, Mycobacterium tuberculosis H37Rv
ucgcggagccaggacgacgccga

SEQ ID NO: 1298670 - RNA, 17 nt, Mycobacterium tuberculosis H37Rv
ucgcggagccgucgcau

SEQ ID NO: 1298671 - RNA, 21 nt, Mycobacterium tuberculosis H37Rv
ucgcggagccaggacgacgcc

SEQ ID NO: 1298672 - RNA, 22 nt, Mycobacterium tuberculosis H37Rv
ucgcggauccgggcguggugga

SEQ ID NO: 1298673 - RNA, 18 nt, Mycobacterium tuberculosis H37Rv
ucgcggaagugucgucgg

SEQ ID NO: 1298674 - RNA, 16 nt, Mycobacterium tuberculosis H37Rv
ucgcggcaucgucgcc

SEQ ID NO: 1298675 - RNA, 17 nt, Mycobacterium tuberculosis H37Rv
ucgcggacccgcgcguc

SEQ ID NO: 1298676 - RNA, 21 nt, Mycobacterium tuberculosis H37Rv
ucgcggauuggcacugucgau

SEQ ID NO: 1298677 - RNA, 21 nt, Mycobacterium tuberculosis H37Rv
ucgcggcacgaucaaccgggu

SEQ ID NO: 1298678 - RNA, 20 nt, Mycobacterium tuberculosis H37Rv
ucgcggccggcgucggcguc

SEQ ID NO: 1298679 - RNA, 13 nt, Mycobacterium tuberculosis H37Rv
ucgcggcgaucgc

SEQ ID NO: 1298680 - RNA, 22 nt, Mycobacterium tuberculosis H37Rv
ucgcggcgguuaucgucggguc

SEQ ID NO: 1298681 - RNA, 17 nt, Mycobacterium tuberculosis H37Rv
ucgcggcguucggcuuc

SEQ ID NO: 1298682 - RNA, 23 nt, Mycobacterium tuberculosis H37Rv
ucgcggcguugugaccgccgaug

SEQ ID NO: 1298683 - RNA, 22 nt, Mycobacterium tuberculosis H37Rv
ucgcggccguggaugucgcggu

SEQ ID NO: 1298684 - RNA, 19 nt, Mycobacterium tuberculosis H37Rv
ucgcgaguagcugacccgc

SEQ ID NO: 1298685 - RNA, 21 nt, Mycobacterium tuberculosis H37Rv
ucgcgaguugagaaccggcuc

SEQ ID NO: 1298686 - RNA, 20 nt, Mycobacterium tuberculosis H37Rv
ucgcgcacauaggcgaucgc

SEQ ID NO: 1298687 - RNA, 19 nt, Mycobacterium tuberculosis H37Rv
ucgcgacgucugccaggcg

SEQ ID NO: 1298688 - RNA, 18 nt, Mycobacterium tuberculosis H37Rv
ucgcgacggcccgauccc

SEQ ID NO: 1298689 - RNA, 22 nt, Mycobacterium tuberculosis H37Rv
ucgcgagccagcugcuccaccc

SEQ ID NO: 1298690 - RNA, 21 nt, Mycobacterium tuberculosis H37Rv
ucgcgagcucccuaacaucgu

SEQ ID NO: 1298691 - RNA, 19 nt, Mycobacterium tuberculosis H37Rv
ucgccgucaacgccucugc

SEQ ID NO: 1298692 - RNA, 20 nt, Mycobacterium tuberculosis H37Rv
ucgccgucacgcacgccgcg

SEQ ID NO: 1298693 - RNA, 19 nt, Mycobacterium tuberculosis H37Rv
ucgccggugcgcgcugacc

SEQ ID NO: 1298694 - RNA, 15 nt, Mycobacterium tuberculosis H37Rv
ucgcgacgcgacggu

SEQ ID NO: 1298695 - RNA, 13 nt, Mycobacterium tuberculosis H37Rv
ucgcgacgacgua

SEQ ID NO: 1298696 - RNA, 14 nt, Mycobacterium tuberculosis H37Rv
ucgcgacgaucguc

SEQ ID NO: 1298697 - RNA, 18 nt, Mycobacterium tuberculosis H37Rv
ucgccggugacgggguug

SEQ ID NO: 1298698 - RNA, 20 nt, Mycobacterium tuberculosis H37Rv
ucgccggugacgggguugac

SEQ ID NO: 1298699 - RNA, 20 nt, Mycobacterium tuberculosis H37Rv
ucgcgccgcgugguuccggc

SEQ ID NO: 1298700 - RNA, 20 nt, Mycobacterium tuberculosis H37Rv
ucgcgcaucgccuccucgac

SEQ ID NO: 1298701 - RNA, 15 nt, Mycobacterium tuberculosis H37Rv
ucgcgccgucgucga

SEQ ID NO: 1298702 - RNA, 12 nt, Mycobacterium tuberculosis H37Rv
ucgcgccgguga

SEQ ID NO: 1298703 - RNA, 20 nt, Mycobacterium tuberculosis H37Rv
ucgcgcggggcggcugcggg

SEQ ID NO: 1298704 - RNA, 22 nt, Mycobacterium tuberculosis H37Rv
ucgcgcaggucuucaagcucuu

SEQ ID NO: 1298705 - RNA, 20 nt, Mycobacterium tuberculosis H37Rv
ucgcgcaguacuugaccguc

SEQ ID NO: 1298706 - RNA, 15 nt, Mycobacterium tuberculosis H37Rv
ucgcgcagcuccacc

SEQ ID NO: 1298707 - RNA, 21 nt, Mycobacterium tuberculosis H37Rv
ucgcgcagggaucgcagggau

SEQ ID NO: 1298708 - RNA, 13 nt, Mycobacterium tuberculosis H37Rv
ucgccgcgcaccg

SEQ ID NO: 1298709 - RNA, 22 nt, Mycobacterium tuberculosis H37Rv
ucgccgcgcagccuucucgcug

SEQ ID NO: 1298710 - RNA, 18 nt, Mycobacterium tuberculosis H37Rv
ucgccgccgucggguugc

SEQ ID NO: 1298711 - RNA, 24 nt, Mycobacterium tuberculosis H37Rv
ucgccgccguugccgccaucaccg

SEQ ID NO: 1298712 - RNA, 19 nt, Mycobacterium tuberculosis H37Rv
ucgccgccuuacgcaccga

SEQ ID NO: 1298713 - RNA, 21 nt, Mycobacterium tuberculosis H37Rv
ucgccgccuuacgcaccgaug

SEQ ID NO: 1298714 - RNA, 22 nt, Mycobacterium tuberculosis H37Rv
ucgccgccggcgccaucggguc

SEQ ID NO: 1298715 - RNA, 23 nt, Mycobacterium tuberculosis H37Rv
ucgccgccggugaggaucagcgu

SEQ ID NO: 1298716 - RNA, 20 nt, Mycobacterium tuberculosis H37Rv
ucgccgccaccggcgacgcc

SEQ ID NO: 1298717 - RNA, 23 nt, Mycobacterium tuberculosis H37Rv
ucgccgccaccagcgcacgcucg

SEQ ID NO: 1298718 - RNA, 18 nt, Mycobacterium tuberculosis H37Rv
ucgccgccaaagccggga

SEQ ID NO: 1298719 - RNA, 20 nt, Mycobacterium tuberculosis H37Rv
ucgccgagcugugcgcagac

SEQ ID NO: 1298720 - RNA, 17 nt, Mycobacterium tuberculosis H37Rv
ucgccgaggcagcgucg

SEQ ID NO: 1298721 - RNA, 16 nt, Mycobacterium tuberculosis H37Rv
ucgccgaggacgccgg

SEQ ID NO: 1298722 - RNA, 21 nt, Mycobacterium tuberculosis H37Rv
ucgccgauaucugccacguug

SEQ ID NO: 1298723 - RNA, 18 nt, Mycobacterium tuberculosis H37Rv
ucgccgauaucugccacg

SEQ ID NO: 1298724 - RNA, 15 nt, Mycobacterium tuberculosis H37Rv
ucgccgaguccggcg

SEQ ID NO: 1298725 - RNA, 14 nt, Mycobacterium tuberculosis H37Rv
ucgccgaguugacc

SEQ ID NO: 1298726 - RNA, 20 nt, Mycobacterium tuberculosis H37Rv
ucgccgaucagcugcgcauc

SEQ ID NO: 1298727 - RNA, 23 nt, Mycobacterium tuberculosis H37Rv
ucgccgaucagcugcgcaucgcc

SEQ ID NO: 1298728 - RNA, 16 nt, Mycobacterium tuberculosis H37Rv
ucgccgggugcaggcg

SEQ ID NO: 1298729 - RNA, 19 nt, Mycobacterium tuberculosis H37Rv
ucgccggggccgcuggcgg

SEQ ID NO: 1298730 - RNA, 13 nt, Mycobacterium tuberculosis H37Rv
ucgccgggucagc

SEQ ID NO: 1298731 - RNA, 17 nt, Mycobacterium tuberculosis H37Rv
ucgccggcaccggaugc

SEQ ID NO: 1298732 - RNA, 19 nt, Mycobacterium tuberculosis H37Rv
ucgccgcgcuugcgaucgc

SEQ ID NO: 1298733 - RNA, 12 nt, Mycobacterium tuberculosis H37Rv
ucgccgcgccgu

SEQ ID NO: 1298734 - RNA, 15 nt, Mycobacterium tuberculosis H37Rv
ucgccgaaucggcag

SEQ ID NO: 1298735 - RNA, 21 nt, Mycobacterium tuberculosis H37Rv
ucgccgaagcgccgcuuggcg

SEQ ID NO: 1298736 - RNA, 22 nt, Mycobacterium tuberculosis H37Rv
ucgccgaaguuccagccgacgg

SEQ ID NO: 1298737 - RNA, 17 nt, Mycobacterium tuberculosis H37Rv
ucgccgaaucgcugacc

SEQ ID NO: 1298738 - RNA, 14 nt, Mycobacterium tuberculosis H37Rv
ucgccgagcagguc

SEQ ID NO: 1298739 - RNA, 16 nt, Mycobacterium tuberculosis H37Rv
ucgccgaaaucggcca

SEQ ID NO: 1298740 - RNA, 20 nt, Mycobacterium tuberculosis H37Rv
ucgccgaaaagggcgacagc

SEQ ID NO: 1298741 - RNA, 23 nt, Mycobacterium tuberculosis H37Rv
ucgccgaaagccuugccgucgag

SEQ ID NO: 1298742 - RNA, 18 nt, Mycobacterium tuberculosis H37Rv
ucgccgaaagggucgacg

SEQ ID NO: 1298743 - RNA, 19 nt, Mycobacterium tuberculosis H37Rv
ucgcccagugugcgccgug

SEQ ID NO: 1298744 - RNA, 14 nt, Mycobacterium tuberculosis H37Rv
ucgcccggaugauc

SEQ ID NO: 1298745 - RNA, 21 nt, Mycobacterium tuberculosis H37Rv
ucgcccggguggcgucgaucu

SEQ ID NO: 1298746 - RNA, 16 nt, Mycobacterium tuberculosis H37Rv
ucgcccggcgcgguuu

SEQ ID NO: 1298747 - RNA, 20 nt, Mycobacterium tuberculosis H37Rv
ucgcccagccgagcguggcg

SEQ ID NO: 1298748 - RNA, 19 nt, Mycobacterium tuberculosis H37Rv
ucgcagaucaggacgcgau

SEQ ID NO: 1298749 - RNA, 20 nt, Mycobacterium tuberculosis H37Rv
ucgccagggccaucuggcug

SEQ ID NO: 1298750 - RNA, 17 nt, Mycobacterium tuberculosis H37Rv
ucgcacgagccaacaag

SEQ ID NO: 1298751 - RNA, 21 nt, Mycobacterium tuberculosis H37Rv
ucgcacgacgcgacacgccgg

SEQ ID NO: 1298752 - RNA, 19 nt, Mycobacterium tuberculosis H37Rv
ucgcaccgugucuacgccg

SEQ ID NO: 1298753 - RNA, 17 nt, Mycobacterium tuberculosis H37Rv
ucgcagacggcugccac

SEQ ID NO: 1298754 - RNA, 23 nt, Mycobacterium tuberculosis H37Rv
ucggccucgagacggucgaucac

SEQ ID NO: 1298755 - RNA, 17 nt, Mycobacterium tuberculosis H37Rv
ucggccguuuccaccgu

SEQ ID NO: 1298756 - RNA, 12 nt, Mycobacterium tuberculosis H37Rv
ucggccgugugc

SEQ ID NO: 1298757 - RNA, 21 nt, Mycobacterium tuberculosis H37Rv
ucggccgguauuucggcgacu

SEQ ID NO: 1298758 - RNA, 21 nt, Mycobacterium tuberculosis H37Rv
ucggccgggccguguccgccg

SEQ ID NO: 1298759 - RNA, 23 nt, Mycobacterium tuberculosis H37Rv
ucggccggggccacccgcagacc

SEQ ID NO: 1298760 - RNA, 18 nt, Mycobacterium tuberculosis H37Rv
ucggccgguauuucggcg

SEQ ID NO: 1298761 - RNA, 15 nt, Mycobacterium tuberculosis H37Rv
ucggccugcagcgau

SEQ ID NO: 1298762 - RNA, 13 nt, Mycobacterium tuberculosis H37Rv
ucggccugccggc

SEQ ID NO: 1298763 - RNA, 21 nt, Mycobacterium tuberculosis H37Rv
ucggccugcgaacacgcgaug

SEQ ID NO: 1298764 - RNA, 20 nt, Mycobacterium tuberculosis H37Rv
ucggccugcgccggcgcugc

SEQ ID NO: 1298765 - RNA, 17 nt, Mycobacterium tuberculosis H37Rv
ucggcgaucaacgcgca

SEQ ID NO: 1298766 - RNA, 16 nt, Mycobacterium tuberculosis H37Rv
ucggcgauaccgagga

SEQ ID NO: 1298767 - RNA, 19 nt, Mycobacterium tuberculosis H37Rv
ucggcgaguagaccucgag

SEQ ID NO: 1298768 - RNA, 20 nt, Mycobacterium tuberculosis H37Rv
ucggcgagcgcccgcagcgc

SEQ ID NO: 1298769 - RNA, 13 nt, Mycobacterium tuberculosis H37Rv
ucggcggaagacc

SEQ ID NO: 1298770 - RNA, 20 nt, Mycobacterium tuberculosis H37Rv
ucggcggaagaccggaucgc

SEQ ID NO: 1298771 - RNA, 14 nt, Mycobacterium tuberculosis H37Rv
ucggcggacccggu

SEQ ID NO: 1298772 - RNA, 15 nt, Mycobacterium tuberculosis H37Rv
ucggcgcugcgcacc

SEQ ID NO: 1298773 - RNA, 19 nt, Mycobacterium tuberculosis H37Rv
ucggcgcugcgcaccgccg

SEQ ID NO: 1298774 - RNA, 19 nt, Mycobacterium tuberculosis H37Rv
ucggcggcauguucaucgc

SEQ ID NO: 1298775 - RNA, 20 nt, Mycobacterium tuberculosis H37Rv
ucggcggccgagcgcaccgc

SEQ ID NO: 1298776 - RNA, 19 nt, Mycobacterium tuberculosis H37Rv
ucggcggccagcgcgucgc

SEQ ID NO: 1298777 - RNA, 23 nt, Mycobacterium tuberculosis H37Rv
ucggcggccgcgaccagcgccgc

SEQ ID NO: 1298778 - RNA, 14 nt, Mycobacterium tuberculosis H37Rv
ucggcggccgcgac

SEQ ID NO: 1298779 - RNA, 20 nt, Mycobacterium tuberculosis H37Rv
ucggcgucguauucgaugcc

SEQ ID NO: 1298780 - RNA, 15 nt, Mycobacterium tuberculosis H37Rv
ucggcgucgagcucg

SEQ ID NO: 1298781 - RNA, 19 nt, Mycobacterium tuberculosis H37Rv
ucggcguccuugcgcagca

SEQ ID NO: 1298782 - RNA, 21 nt, Mycobacterium tuberculosis H37Rv
ucggcguccuugcgcagcacc

SEQ ID NO: 1298783 - RNA, 19 nt, Mycobacterium tuberculosis H37Rv
ucggcgucacgguggacga

SEQ ID NO: 1298784 - RNA, 12 nt, Mycobacterium tuberculosis H37Rv
ucggcuccaccc

SEQ ID NO: 1298785 - RNA, 18 nt, Mycobacterium tuberculosis H37Rv
ucggcuaccuuguccggc

SEQ ID NO: 1298786 - RNA, 23 nt, Mycobacterium tuberculosis H37Rv
ucggcuaggccggccggaguccg

SEQ ID NO: 1298787 - RNA, 19 nt, Mycobacterium tuberculosis H37Rv
ucggcgugguguccaccgc

SEQ ID NO: 1298788 - RNA, 15 nt, Mycobacterium tuberculosis H37Rv
ucggcgugucgcguc

SEQ ID NO: 1298789 - RNA, 21 nt, Mycobacterium tuberculosis H37Rv
ucggcgucuguaccacgggcu

SEQ ID NO: 1298790 - RNA, 19 nt, Mycobacterium tuberculosis H37Rv
ucggcgugcggacugacgu

SEQ ID NO: 1298791 - RNA, 23 nt, Mycobacterium tuberculosis H37Rv
ucggcgguaaaugccugcccacc

SEQ ID NO: 1298792 - RNA, 23 nt, Mycobacterium tuberculosis H37Rv
ucggcgggucaggccagggugac

SEQ ID NO: 1298793 - RNA, 24 nt, Mycobacterium tuberculosis H37Rv
ucggcggugaacuucuccaccagc

SEQ ID NO: 1298794 - RNA, 21 nt, Mycobacterium tuberculosis H37Rv
ucggcggugaacuucuccacc

SEQ ID NO: 1298795 - RNA, 20 nt, Mycobacterium tuberculosis H37Rv
ucggcggugaacgacggguc

SEQ ID NO: 1298796 - RNA, 16 nt, Mycobacterium tuberculosis H37Rv
ucggcggugcagaucg

SEQ ID NO: 1298797 - RNA, 20 nt, Mycobacterium tuberculosis H37Rv
ucggcggugcagaucggcuc

SEQ ID NO: 1298798 - RNA, 20 nt, Mycobacterium tuberculosis H37Rv
ucggcggugcccagcagcgc

SEQ ID NO: 1298799 - RNA, 15 nt, Mycobacterium tuberculosis H37Rv
ucggcgguucgaucc

SEQ ID NO: 1298800 - RNA, 17 nt, Mycobacterium tuberculosis H37Rv
ucggcggugcgcugaug

SEQ ID NO: 1298801 - RNA, 17 nt, Mycobacterium tuberculosis H37Rv
ucggcggccucgcugcu

SEQ ID NO: 1298802 - RNA, 22 nt, Mycobacterium tuberculosis H37Rv
ucggcggccugcucgcagaucg

SEQ ID NO: 1298803 - RNA, 14 nt, Mycobacterium tuberculosis H37Rv
ucggcggcgucuuc

SEQ ID NO: 1298804 - RNA, 19 nt, Mycobacterium tuberculosis H37Rv
ucggcggcucuagaucgcc

SEQ ID NO: 1298805 - RNA, 18 nt, Mycobacterium tuberculosis H37Rv
ucggcggcucuagaucgc

SEQ ID NO: 1298806 - RNA, 22 nt, Mycobacterium tuberculosis H37Rv
ucggcggcuucgauugcgcugc

SEQ ID NO: 1298807 - RNA, 14 nt, Mycobacterium tuberculosis H37Rv
ucggcggcugccag

SEQ ID NO: 1298808 - RNA, 15 nt, Mycobacterium tuberculosis H37Rv
ucggcgggauccucg

SEQ ID NO: 1298809 - RNA, 17 nt, Mycobacterium tuberculosis H37Rv
ucggcggcuucguggcg

SEQ ID NO: 1298810 - RNA, 15 nt, Mycobacterium tuberculosis H37Rv
ucgcgggcgauggcc

SEQ ID NO: 1298811 - RNA, 20 nt, Mycobacterium tuberculosis H37Rv
ucgcgggcugaccaacucgu

SEQ ID NO: 1298812 - RNA, 20 nt, Mycobacterium tuberculosis H37Rv
ucgcugaaugcgccguggau

SEQ ID NO: 1298813 - RNA, 14 nt, Mycobacterium tuberculosis H37Rv
ucgcugacggccau

SEQ ID NO: 1298814 - RNA, 18 nt, Mycobacterium tuberculosis H37Rv
ucgcuguaggccagcccg

SEQ ID NO: 1298815 - RNA, 15 nt, Mycobacterium tuberculosis H37Rv
ucgcugggacgggcg

SEQ ID NO: 1298816 - RNA, 19 nt, Mycobacterium tuberculosis H37Rv
ucgcugggacgggcgcguc

SEQ ID NO: 1298817 - RNA, 16 nt, Mycobacterium tuberculosis H37Rv
ucgcuggugcacggcu

SEQ ID NO: 1298818 - RNA, 13 nt, Mycobacterium tuberculosis H37Rv
ucgcugccgccga

SEQ ID NO: 1298819 - RNA, 14 nt, Mycobacterium tuberculosis H37Rv
ucgcugaugcaucc

SEQ ID NO: 1298820 - RNA, 20 nt, Mycobacterium tuberculosis H37Rv
ucgcugaccuuguugaccac

SEQ ID NO: 1298821 - RNA, 21 nt, Mycobacterium tuberculosis H37Rv
ucgcugcccaucacacccggu

SEQ ID NO: 1298822 - RNA, 14 nt, Mycobacterium tuberculosis H37Rv
ucggagagcaugcg

SEQ ID NO: 1298823 - RNA, 20 nt, Mycobacterium tuberculosis H37Rv
ucggagaugaacucggcgau

SEQ ID NO: 1298824 - RNA, 21 nt, Mycobacterium tuberculosis H37Rv
ucggaggcgaccacgucggcg

SEQ ID NO: 1298825 - RNA, 21 nt, Mycobacterium tuberculosis H37Rv
ucggacaugccgagguaacgc

SEQ ID NO: 1298826 - RNA, 21 nt, Mycobacterium tuberculosis H37Rv
ucggacagcgccuggccggaa

SEQ ID NO: 1298827 - RNA, 20 nt, Mycobacterium tuberculosis H37Rv
ucggagauacucgaguggcg

SEQ ID NO: 1298828 - RNA, 23 nt, Mycobacterium tuberculosis H37Rv
ucggagauacucgaguggcgaac

SEQ ID NO: 1298829 - RNA, 22 nt, Mycobacterium tuberculosis H37Rv
ucggagccgacaacgacgucgc

SEQ ID NO: 1298830 - RNA, 22 nt, Mycobacterium tuberculosis H37Rv
ucggauacccagccggccuguc

SEQ ID NO: 1298831 - RNA, 22 nt, Mycobacterium tuberculosis H37Rv
ucggagucgacggucacggugg

SEQ ID NO: 1298832 - RNA, 12 nt, Mycobacterium tuberculosis H37Rv
ucggaggcgauc

SEQ ID NO: 1298833 - RNA, 15 nt, Mycobacterium tuberculosis H37Rv
ucggagucgacgguc

SEQ ID NO: 1298834 - RNA, 15 nt, Mycobacterium tuberculosis H37Rv
ucggaaucggcggau

SEQ ID NO: 1298835 - RNA, 16 nt, Mycobacterium tuberculosis H37Rv
ucggaagagucgacgc

SEQ ID NO: 1298836 - RNA, 19 nt, Mycobacterium tuberculosis H37Rv
ucggaagagucgacgcugu

SEQ ID NO: 1298837 - RNA, 15 nt, Mycobacterium tuberculosis H37Rv
ucgcugucggcaugc

SEQ ID NO: 1298838 - RNA, 18 nt, Mycobacterium tuberculosis H37Rv
ucgcuguccacugccacc

SEQ ID NO: 1298839 - RNA, 23 nt, Mycobacterium tuberculosis H37Rv
ucggccagcagcgacuccagcgc

SEQ ID NO: 1298840 - RNA, 20 nt, Mycobacterium tuberculosis H37Rv
ucggcaggguggccagcagg

SEQ ID NO: 1298841 - RNA, 19 nt, Mycobacterium tuberculosis H37Rv
ucggcagucccagcgccgc

SEQ ID NO: 1298842 - RNA, 22 nt, Mycobacterium tuberculosis H37Rv
ucggcagcucccgccacgucgc

SEQ ID NO: 1298843 - RNA, 12 nt, Mycobacterium tuberculosis H37Rv
ucggcaggcagc

SEQ ID NO: 1298844 - RNA, 15 nt, Mycobacterium tuberculosis H37Rv
ucggaugucucggca

SEQ ID NO: 1298845 - RNA, 20 nt, Mycobacterium tuberculosis H37Rv
ucggauugcagcgcgauggc

SEQ ID NO: 1298846 - RNA, 21 nt, Mycobacterium tuberculosis H37Rv
ucggauccggacggugucagc

SEQ ID NO: 1298847 - RNA, 17 nt, Mycobacterium tuberculosis H37Rv
ucggcagcccggugugc

SEQ ID NO: 1298848 - RNA, 17 nt, Mycobacterium tuberculosis H37Rv
ucggcccacgguguccc

SEQ ID NO: 1298849 - RNA, 19 nt, Mycobacterium tuberculosis H37Rv
ucggccggcggucgccagu

SEQ ID NO: 1298850 - RNA, 18 nt, Mycobacterium tuberculosis H37Rv
ucggcccccaagcucugc

SEQ ID NO: 1298851 - RNA, 18 nt, Mycobacterium tuberculosis H37Rv
agcgcauccacaaucaca

SEQ ID NO: 1298852 - RNA, 12 nt, Mycobacterium tuberculosis H37Rv
agcgcaucgcca

SEQ ID NO: 1298853 - RNA, 24 nt, Mycobacterium tuberculosis H37Rv
agcgcaucgccgcuggccagcaca

SEQ ID NO: 1298854 - RNA, 21 nt, Mycobacterium tuberculosis H37Rv
agcgcaucgccgcuggccagc

SEQ ID NO: 1298855 - RNA, 17 nt, Mycobacterium tuberculosis H37Rv
agcgcaucggccagcag

SEQ ID NO: 1298856 - RNA, 20 nt, Mycobacterium tuberculosis H37Rv
agcgccaagacgucggcgug

SEQ ID NO: 1298857 - RNA, 15 nt, Mycobacterium tuberculosis H37Rv
agcgccaagacgucg

SEQ ID NO: 1298858 - RNA, 15 nt, Mycobacterium tuberculosis H37Rv
agcgccaacucgaga

SEQ ID NO: 1298859 - RNA, 13 nt, Mycobacterium tuberculosis H37Rv
agcgccaacccgg

SEQ ID NO: 1298860 - RNA, 16 nt, Mycobacterium tuberculosis H37Rv
agcgcauguugcaggc

SEQ ID NO: 1298861 - RNA, 18 nt, Mycobacterium tuberculosis H37Rv
agcgcauggacgaacgcg

SEQ ID NO: 1298862 - RNA, 18 nt, Mycobacterium tuberculosis H37Rv
agcgccacccgguccggc

SEQ ID NO: 1298863 - RNA, 19 nt, Mycobacterium tuberculosis H37Rv
agcgccacccgcgucaguc

SEQ ID NO: 1298864 - RNA, 15 nt, Mycobacterium tuberculosis H37Rv
agcgccgcuuggcga

SEQ ID NO: 1298865 - RNA, 23 nt, Mycobacterium tuberculosis H37Rv
agcgccgcggcuacaucggcggc

SEQ ID NO: 1298866 - RNA, 16 nt, Mycobacterium tuberculosis H37Rv
agcgccggcaccgaca

SEQ ID NO: 1298867 - RNA, 17 nt, Mycobacterium tuberculosis H37Rv
agcgccauuccaagacg

SEQ ID NO: 1298868 - RNA, 17 nt, Mycobacterium tuberculosis H37Rv
agcgcccaccguagacg

SEQ ID NO: 1298869 - RNA, 21 nt, Mycobacterium tuberculosis H37Rv
agcgcccccggacugcggaac

SEQ ID NO: 1298870 - RNA, 17 nt, Mycobacterium tuberculosis H37Rv
agcgcccccagcagcug

SEQ ID NO: 1298871 - RNA, 13 nt, Mycobacterium tuberculosis H37Rv
agcgccagcagcc

SEQ ID NO: 1298872 - RNA, 21 nt, Mycobacterium tuberculosis H37Rv
agcgaccucacugcggcgcca

SEQ ID NO: 1298873 - RNA, 18 nt, Mycobacterium tuberculosis H37Rv
agcgacccccagcgcccg

SEQ ID NO: 1298874 - RNA, 19 nt, Mycobacterium tuberculosis H37Rv
agcgaccaaugcagugcga

SEQ ID NO: 1298875 - RNA, 13 nt, Mycobacterium tuberculosis H37Rv
agcgaagcaacgg

SEQ ID NO: 1298876 - RNA, 15 nt, Mycobacterium tuberculosis H37Rv
agcgaagaacugggc

SEQ ID NO: 1298877 - RNA, 15 nt, Mycobacterium tuberculosis H37Rv
agcgaacggcgcagu

SEQ ID NO: 1298878 - RNA, 21 nt, Mycobacterium tuberculosis H37Rv
agcgaacgggcuuccgacaug

SEQ ID NO: 1298879 - RNA, 19 nt, Mycobacterium tuberculosis H37Rv
agcgaccagugguggccga

SEQ ID NO: 1298880 - RNA, 15 nt, Mycobacterium tuberculosis H37Rv
agcgacuugcggugc

SEQ ID NO: 1298881 - RNA, 18 nt, Mycobacterium tuberculosis H37Rv
agcgacugcagcggcgca

SEQ ID NO: 1298882 - RNA, 15 nt, Mycobacterium tuberculosis H37Rv
agcgacgagcagcaa

SEQ ID NO: 1298883 - RNA, 22 nt, Mycobacterium tuberculosis H37Rv
agcgaccgucccagcgccgcag

SEQ ID NO: 1298884 - RNA, 15 nt, Mycobacterium tuberculosis H37Rv
agcgagacuucgacg

SEQ ID NO: 1298885 - RNA, 21 nt, Mycobacterium tuberculosis H37Rv
agcgagacuucgacgcggcga

SEQ ID NO: 1298886 - RNA, 19 nt, Mycobacterium tuberculosis H37Rv
agcgagacuucgacgcggc

SEQ ID NO: 1298887 - RNA, 15 nt, Mycobacterium tuberculosis H37Rv
agcgagcaccgcggu

SEQ ID NO: 1298888 - RNA, 24 nt, Mycobacterium tuberculosis H37Rv
agcgauucugggcuucaucggcga

SEQ ID NO: 1298889 - RNA, 15 nt, Mycobacterium tuberculosis H37Rv
agcgauuccacggca

SEQ ID NO: 1298890 - RNA, 21 nt, Mycobacterium tuberculosis H37Rv
agcgauuccaggauggccauc

SEQ ID NO: 1298891 - RNA, 16 nt, Mycobacterium tuberculosis H37Rv
agcgaugcaccccaug

SEQ ID NO: 1298892 - RNA, 20 nt, Mycobacterium tuberculosis H37Rv
agcgaucgugcugcccgcaa

SEQ ID NO: 1298893 - RNA, 19 nt, Mycobacterium tuberculosis H37Rv
agcgaucgugcugcccgca

SEQ ID NO: 1298894 - RNA, 21 nt, Mycobacterium tuberculosis H37Rv
agcgcacgauagccaccgacg

SEQ ID NO: 1298895 - RNA, 22 nt, Mycobacterium tuberculosis H37Rv
agcgcagacacgaccccgucga

SEQ ID NO: 1298896 - RNA, 12 nt, Mycobacterium tuberculosis H37Rv
agcgcagcagcg

SEQ ID NO: 1298897 - RNA, 18 nt, Mycobacterium tuberculosis H37Rv
agcgcagcaucgucgcca

SEQ ID NO: 1298898 - RNA, 23 nt, Mycobacterium tuberculosis H37Rv
agcgcagcaucgucgccacgaug

SEQ ID NO: 1298899 - RNA, 13 nt, Mycobacterium tuberculosis H37Rv
agcgcaaccgcgc

SEQ ID NO: 1298900 - RNA, 15 nt, Mycobacterium tuberculosis H37Rv
agcgcaaccgaccgg

SEQ ID NO: 1298901 - RNA, 16 nt, Mycobacterium tuberculosis H37Rv
agcgcacgcagccgau

SEQ ID NO: 1298902 - RNA, 15 nt, Mycobacterium tuberculosis H37Rv
agcgcaacggccagc

SEQ ID NO: 1298903 - RNA, 14 nt, Mycobacterium tuberculosis H37Rv
agcgcaacggccag

SEQ ID NO: 1298904 - RNA, 16 nt, Mycobacterium tuberculosis H37Rv
agcgcaacggccagcg

SEQ ID NO: 1298905 - RNA, 18 nt, Mycobacterium tuberculosis H37Rv
agcgcaccggcguucacc

SEQ ID NO: 1298906 - RNA, 13 nt, Mycobacterium tuberculosis H37Rv
agccgcggucggc

SEQ ID NO: 1298907 - RNA, 14 nt, Mycobacterium tuberculosis H37Rv
agccgcucggcgua

SEQ ID NO: 1298908 - RNA, 24 nt, Mycobacterium tuberculosis H37Rv
agccgcggcuaggccagcacggcg

SEQ ID NO: 1298909 - RNA, 15 nt, Mycobacterium tuberculosis H37Rv
agccgcugcggcacc

SEQ ID NO: 1298910 - RNA, 21 nt, Mycobacterium tuberculosis H37Rv
agccgcugauguacccggcga

SEQ ID NO: 1298911 - RNA, 18 nt, Mycobacterium tuberculosis H37Rv
agccgcugaucgccgaca

SEQ ID NO: 1298912 - RNA, 19 nt, Mycobacterium tuberculosis H37Rv
agccgcugauguacccggc

SEQ ID NO: 1298913 - RNA, 21 nt, Mycobacterium tuberculosis H37Rv
agccgcuggaagucggucugc

SEQ ID NO: 1298914 - RNA, 22 nt, Mycobacterium tuberculosis H37Rv
agccggauucggcugccaccgc

SEQ ID NO: 1298915 - RNA, 15 nt, Mycobacterium tuberculosis H37Rv
agccggcagcagcgg

SEQ ID NO: 1298916 - RNA, 22 nt, Mycobacterium tuberculosis H37Rv
agccggacagaucaacgcgaac

SEQ ID NO: 1298917 - RNA, 13 nt, Mycobacterium tuberculosis H37Rv
agccggaaccgga

SEQ ID NO: 1298918 - RNA, 17 nt, Mycobacterium tuberculosis H37Rv
agccggaaccggacagc

SEQ ID NO: 1298919 - RNA, 13 nt, Mycobacterium tuberculosis H37Rv
agccgggcaaggc

SEQ ID NO: 1298920 - RNA, 22 nt, Mycobacterium tuberculosis H37Rv
agccggcugcauccuccucguc

SEQ ID NO: 1298921 - RNA, 15 nt, Mycobacterium tuberculosis H37Rv
agccgggauugccgc

SEQ ID NO: 1298922 - RNA, 20 nt, Mycobacterium tuberculosis H37Rv
agccggcugcauccuccucg

SEQ ID NO: 1298923 - RNA, 17 nt, Mycobacterium tuberculosis H37Rv
agccggcucaucgcagc

SEQ ID NO: 1298924 - RNA, 23 nt, Mycobacterium tuberculosis H37Rv
agccggcucaucgcagccggucc

SEQ ID NO: 1298925 - RNA, 21 nt, Mycobacterium tuberculosis H37Rv
agccggcgcccgccgcgaacu

SEQ ID NO: 1298926 - RNA, 22 nt, Mycobacterium tuberculosis H37Rv
agccggcgaagugcuccaccuc

SEQ ID NO: 1298927 - RNA, 12 nt, Mycobacterium tuberculosis H37Rv
agccggccgcuu

SEQ ID NO: 1298928 - RNA, 21 nt, Mycobacterium tuberculosis H37Rv
agccggccacuacggccuggc

SEQ ID NO: 1298929 - RNA, 17 nt, Mycobacterium tuberculosis H37Rv
agccgucgcgacgucgg

SEQ ID NO: 1298930 - RNA, 14 nt, Mycobacterium tuberculosis H37Rv
agccgucgauguug

SEQ ID NO: 1298931 - RNA, 18 nt, Mycobacterium tuberculosis H37Rv
agccgggcgcgccggcca

SEQ ID NO: 1298932 - RNA, 17 nt, Mycobacterium tuberculosis H37Rv
agccgggauugccgcca

SEQ ID NO: 1298933 - RNA, 19 nt, Mycobacterium tuberculosis H37Rv
agccgggcggccucguuga

SEQ ID NO: 1298934 - RNA, 19 nt, Mycobacterium tuberculosis H37Rv
agccuaguacgccgagcag

SEQ ID NO: 1298935 - RNA, 14 nt, Mycobacterium tuberculosis H37Rv
agccucagccgcuc

SEQ ID NO: 1298936 - RNA, 18 nt, Mycobacterium tuberculosis H37Rv
agccgugcagcucgguca

SEQ ID NO: 1298937 - RNA, 12 nt, Mycobacterium tuberculosis H37Rv
agccgucgucga

SEQ ID NO: 1298938 - RNA, 20 nt, Mycobacterium tuberculosis H37Rv
agccgugcagcucggucagc

SEQ ID NO: 1298939 - RNA, 21 nt, Mycobacterium tuberculosis H37Rv
agccguuguccaagcccucgg

SEQ ID NO: 1298940 - RNA, 17 nt, Mycobacterium tuberculosis H37Rv
agcgaacccgcguugaa

SEQ ID NO: 1298941 - RNA, 16 nt, Mycobacterium tuberculosis H37Rv
agcgaaccgaagccgu

SEQ ID NO: 1298942 - RNA, 20 nt, Mycobacterium tuberculosis H37Rv
agcgaaaugcccaucaccag

SEQ ID NO: 1298943 - RNA, 14 nt, Mycobacterium tuberculosis H37Rv
agccuugaucucgu

SEQ ID NO: 1298944 - RNA, 19 nt, Mycobacterium tuberculosis H37Rv
agccuucaacgcgaguccg

SEQ ID NO: 1298945 - RNA, 17 nt, Mycobacterium tuberculosis H37Rv
agccucuuggucaacgg

SEQ ID NO: 1298946 - RNA, 16 nt, Mycobacterium tuberculosis H37Rv
agccucguggugagau

SEQ ID NO: 1298947 - RNA, 21 nt, Mycobacterium tuberculosis H37Rv
agccugcgccgcgcgagaucc

SEQ ID NO: 1298948 - RNA, 17 nt, Mycobacterium tuberculosis H37Rv
agccugcgccgacccgc

SEQ ID NO: 1298949 - RNA, 17 nt, Mycobacterium tuberculosis H37Rv
agccgaacccgccguca

SEQ ID NO: 1298950 - RNA, 23 nt, Mycobacterium tuberculosis H37Rv
agccgaagaugcacaggccgacg

SEQ ID NO: 1298951 - RNA, 17 nt, Mycobacterium tuberculosis H37Rv
agccgaacaccgucagc

SEQ ID NO: 1298952 - RNA, 22 nt, Mycobacterium tuberculosis H37Rv
agccgaucacgggcuaccggca

SEQ ID NO: 1298953 - RNA, 19 nt, Mycobacterium tuberculosis H37Rv
agccgauauuggcaucgug

SEQ ID NO: 1298954 - RNA, 13 nt, Mycobacterium tuberculosis H37Rv
agccgagcguggc

SEQ ID NO: 1298955 - RNA, 21 nt, Mycobacterium tuberculosis H37Rv
agccgagguucaaagcagcgc

SEQ ID NO: 1298956 - RNA, 20 nt, Mycobacterium tuberculosis H37Rv
agccgccaggugcucgucga

SEQ ID NO: 1298957 - RNA, 18 nt, Mycobacterium tuberculosis H37Rv
agccgccaccgaggccgc

SEQ ID NO: 1298958 - RNA, 20 nt, Mycobacterium tuberculosis H37Rv
agccgcauaggccccgccag

SEQ ID NO: 1298959 - RNA, 21 nt, Mycobacterium tuberculosis H37Rv
agccgcagcuuggccucagcc

SEQ ID NO: 1298960 - RNA, 22 nt, Mycobacterium tuberculosis H37Rv
agccgcauaggccccgccagcg

SEQ ID NO: 1298961 - RNA, 16 nt, Mycobacterium tuberculosis H37Rv
agccgauccgaucgca

SEQ ID NO: 1298962 - RNA, 17 nt, Mycobacterium tuberculosis H37Rv
agccgauccagcaggcc

SEQ ID NO: 1298963 - RNA, 14 nt, Mycobacterium tuberculosis H37Rv
agccgauccagcag

SEQ ID NO: 1298964 - RNA, 18 nt, Mycobacterium tuberculosis H37Rv
agccgaucaucaccggca

SEQ ID NO: 1298965 - RNA, 23 nt, Mycobacterium tuberculosis H37Rv
agccgcagcaccucgucgaucgc

SEQ ID NO: 1298966 - RNA, 23 nt, Mycobacterium tuberculosis H37Rv
agccgaucggugccagaaugccg

SEQ ID NO: 1298967 - RNA, 16 nt, Mycobacterium tuberculosis H37Rv
agccgcgcgccggcca

SEQ ID NO: 1298968 - RNA, 15 nt, Mycobacterium tuberculosis H37Rv
agccgcggcccgcgu

SEQ ID NO: 1298969 - RNA, 22 nt, Mycobacterium tuberculosis H37Rv
agccgcggaucauccuucgccg

SEQ ID NO: 1298970 - RNA, 19 nt, Mycobacterium tuberculosis H37Rv
agccgcgcguccgggcagc

SEQ ID NO: 1298971 - RNA, 22 nt, Mycobacterium tuberculosis H37Rv
agccgcgcgggucacgaccugc

SEQ ID NO: 1298972 - RNA, 16 nt, Mycobacterium tuberculosis H37Rv
agccgccagcccguca

SEQ ID NO: 1298973 - RNA, 17 nt, Mycobacterium tuberculosis H37Rv
agccgcccaagccgccg

SEQ ID NO: 1298974 - RNA, 15 nt, Mycobacterium tuberculosis H37Rv
agccgcgacauccgc

SEQ ID NO: 1298975 - RNA, 17 nt, Mycobacterium tuberculosis H37Rv
agccgcgacgcggcguc

SEQ ID NO: 1298976 - RNA, 21 nt, Mycobacterium tuberculosis H37Rv
agcccgagcgcuugaccccgc

SEQ ID NO: 1298977 - RNA, 15 nt, Mycobacterium tuberculosis H37Rv
agcccggagcgguca

SEQ ID NO: 1298978 - RNA, 14 nt, Mycobacterium tuberculosis H37Rv
agcccugcgcagcc

SEQ ID NO: 1298979 - RNA, 23 nt, Mycobacterium tuberculosis H37Rv
agcccugcgccucggcggccagc

SEQ ID NO: 1298980 - RNA, 15 nt, Mycobacterium tuberculosis H37Rv
agcccgucgggcagu

SEQ ID NO: 1298981 - RNA, 16 nt, Mycobacterium tuberculosis H37Rv
agcccguucgugccgu

SEQ ID NO: 1298982 - RNA, 17 nt, Mycobacterium tuberculosis H37Rv
agcccguugaccugcgc

SEQ ID NO: 1298983 - RNA, 19 nt, Mycobacterium tuberculosis H37Rv
agcccguugguagccggug

SEQ ID NO: 1298984 - RNA, 20 nt, Mycobacterium tuberculosis H37Rv
agcccguugguagccgguga

SEQ ID NO: 1298985 - RNA, 13 nt, Mycobacterium tuberculosis H37Rv
agcccgucgauca

SEQ ID NO: 1298986 - RNA, 14 nt, Mycobacterium tuberculosis H37Rv
agccccgaagccgg

SEQ ID NO: 1298987 - RNA, 18 nt, Mycobacterium tuberculosis H37Rv
agcccgacuggucacugc

SEQ ID NO: 1298988 - RNA, 15 nt, Mycobacterium tuberculosis H37Rv
agccccgaagccggu

SEQ ID NO: 1298989 - RNA, 17 nt, Mycobacterium tuberculosis H37Rv
agcccgaccgguccagc

SEQ ID NO: 1298990 - RNA, 20 nt, Mycobacterium tuberculosis H37Rv
agcccgacaccguccagcag

SEQ ID NO: 1298991 - RNA, 14 nt, Mycobacterium tuberculosis H37Rv
agcccccgacguug

SEQ ID NO: 1298992 - RNA, 14 nt, Mycobacterium tuberculosis H37Rv
agccccccggcgac

SEQ ID NO: 1298993 - RNA, 16 nt, Mycobacterium tuberculosis H37Rv
agccaucacgacuccc

SEQ ID NO: 1298994 - RNA, 19 nt, Mycobacterium tuberculosis H37Rv
agccaugccgcucggcaac

SEQ ID NO: 1298995 - RNA, 19 nt, Mycobacterium tuberculosis H37Rv
agccauucaaguucgccga

SEQ ID NO: 1298996 - RNA, 18 nt, Mycobacterium tuberculosis H37Rv
agccauguggcgucgcuc

SEQ ID NO: 1298997 - RNA, 15 nt, Mycobacterium tuberculosis H37Rv
agcauggcuccgaag

SEQ ID NO: 1298998 - RNA, 19 nt, Mycobacterium tuberculosis H37Rv
agcauauccgccggcgaca

SEQ ID NO: 1298999 - RNA, 15 nt, Mycobacterium tuberculosis H37Rv
agccaagcgacucgc

SEQ ID NO: 1299000 - RNA, 14 nt, Mycobacterium tuberculosis H37Rv
agccaagcgagcgg

SEQ ID NO: 1299001 - RNA, 13 nt, Mycobacterium tuberculosis H37Rv
agccaacgagcgc

SEQ ID NO: 1299002 - RNA, 22 nt, Mycobacterium tuberculosis H37Rv
agccaccugccgacucaucggc

SEQ ID NO: 1299003 - RNA, 21 nt, Mycobacterium tuberculosis H37Rv
agccacgaacugaucgaccgc

SEQ ID NO: 1299004 - RNA, 16 nt, Mycobacterium tuberculosis H37Rv
agccaccgcgcgucau

SEQ ID NO: 1299005 - RNA, 22 nt, Mycobacterium tuberculosis H37Rv
agccaccgcgcgucauaacgcu

SEQ ID NO: 1299006 - RNA, 16 nt, Mycobacterium tuberculosis H37Rv
agcauggcccuggcga

SEQ ID NO: 1299007 - RNA, 22 nt, Mycobacterium tuberculosis H37Rv
agccaguguugcaguggcgacg

SEQ ID NO: 1299008 - RNA, 18 nt, Mycobacterium tuberculosis H37Rv
agccaggagccgaucacg

SEQ ID NO: 1299009 - RNA, 16 nt, Mycobacterium tuberculosis H37Rv
agccaguccagcgcgc

SEQ ID NO: 1299010 - RNA, 13 nt, Mycobacterium tuberculosis H37Rv
agccagcgggcga

SEQ ID NO: 1299011 - RNA, 16 nt, Mycobacterium tuberculosis H37Rv
agccaggagccgauca

SEQ ID NO: 1299012 - RNA, 22 nt, Mycobacterium tuberculosis H37Rv
agccacgcacaauacggucagc

SEQ ID NO: 1299013 - RNA, 23 nt, Mycobacterium tuberculosis H37Rv
agccacgcaaaguucgucaccac

SEQ ID NO: 1299014 - RNA, 18 nt, Mycobacterium tuberculosis H37Rv
agccaacaagucgauggc

SEQ ID NO: 1299015 - RNA, 18 nt, Mycobacterium tuberculosis H37Rv
agccacgccagcgucgac

SEQ ID NO: 1299016 - RNA, 21 nt, Mycobacterium tuberculosis H37Rv
agccacgcaugggccagguca

SEQ ID NO: 1299017 - RNA, 13 nt, Mycobacterium tuberculosis H37Rv
agcaguuggccga

SEQ ID NO: 1299018 - RNA, 17 nt, Mycobacterium tuberculosis H37Rv
agcagggugugcgucug

SEQ ID NO: 1299019 - RNA, 15 nt, Mycobacterium tuberculosis H37Rv
agcagggcggcgaac

SEQ ID NO: 1299020 - RNA, 21 nt, Mycobacterium tuberculosis H37Rv
agcagggcggcguuaccaccg

SEQ ID NO: 1299021 - RNA, 19 nt, Mycobacterium tuberculosis H37Rv
agcagcugggcaucaccgc

SEQ ID NO: 1299022 - RNA, 21 nt, Mycobacterium tuberculosis H37Rv
agcaggcgggggaucucgagc

SEQ ID NO: 1299023 - RNA, 19 nt, Mycobacterium tuberculosis H37Rv
agcagggccaccaccacgg

SEQ ID NO: 1299024 - RNA, 12 nt, Mycobacterium tuberculosis H37Rv
agauuucgucgc

SEQ ID NO: 1299025 - RNA, 18 nt, Mycobacterium tuberculosis H37Rv
agcagcucggccgaggcg

SEQ ID NO: 1299026 - RNA, 21 nt, Mycobacterium tuberculosis H37Rv
agcagcugcgauauggucacc

SEQ ID NO: 1299027 - RNA, 18 nt, Mycobacterium tuberculosis H37Rv
agcagcucgccggcacgc

SEQ ID NO: 1299028 - RNA, 15 nt, Mycobacterium tuberculosis H37Rv
agcagcucggggcga

SEQ ID NO: 1299029 - RNA, 20 nt, Mycobacterium tuberculosis H37Rv
agauucgcucaccaccgacc

SEQ ID NO: 1299030 - RNA, 11 nt, Mycobacterium tuberculosis H37Rv
agauucccggc

SEQ ID NO: 1299031 - RNA, 16 nt, Mycobacterium tuberculosis H37Rv
agauuggguccagcga

SEQ ID NO: 1299032 - RNA, 13 nt, Mycobacterium tuberculosis H37Rv
agauuguccggcc

SEQ ID NO: 1299033 - RNA, 13 nt, Mycobacterium tuberculosis H37Rv
aggccagucgugc

SEQ ID NO: 1299034 - RNA, 14 nt, Mycobacterium tuberculosis H37Rv
aggccagggugacc

SEQ ID NO: 1299035 - RNA, 21 nt, Mycobacterium tuberculosis H37Rv
aggccaccacugcgcccgcca

SEQ ID NO: 1299036 - RNA, 13 nt, Mycobacterium tuberculosis H37Rv
aggccaaccgguu

SEQ ID NO: 1299037 - RNA, 18 nt, Mycobacterium tuberculosis H37Rv
aggcccagcacggucaac

SEQ ID NO: 1299038 - RNA, 14 nt, Mycobacterium tuberculosis H37Rv
aggcccagcacggu

SEQ ID NO: 1299039 - RNA, 18 nt, Mycobacterium tuberculosis H37Rv
aggcccagcaaccgcucg

SEQ ID NO: 1299040 - RNA, 19 nt, Mycobacterium tuberculosis H37Rv
aggcccgguugcggucaga

SEQ ID NO: 1299041 - RNA, 21 nt, Mycobacterium tuberculosis H37Rv
aggccgacaaugucggcgaug

SEQ ID NO: 1299042 - RNA, 15 nt, Mycobacterium tuberculosis H37Rv
aggcauucucccggu

SEQ ID NO: 1299043 - RNA, 22 nt, Mycobacterium tuberculosis H37Rv
aggcacucccggaguggccagu

SEQ ID NO: 1299044 - RNA, 21 nt, Mycobacterium tuberculosis H37Rv
aggcaccuauagggacgugcc

SEQ ID NO: 1299045 - RNA, 18 nt, Mycobacterium tuberculosis H37Rv
aggcacccgugccgccga

SEQ ID NO: 1299046 - RNA, 17 nt, Mycobacterium tuberculosis H37Rv
aggcacccuguacgaag

SEQ ID NO: 1299047 - RNA, 18 nt, Mycobacterium tuberculosis H37Rv
aggcacaaucaccgccgc

SEQ ID NO: 1299048 - RNA, 17 nt, Mycobacterium tuberculosis H37Rv
aggcacaacaucgccgc

SEQ ID NO: 1299049 - RNA, 16 nt, Mycobacterium tuberculosis H37Rv
aggcaaccggucagcc

SEQ ID NO: 1299050 - RNA, 23 nt, Mycobacterium tuberculosis H37Rv
aggauucagccgguggucugcgc

SEQ ID NO: 1299051 - RNA, 14 nt, Mycobacterium tuberculosis H37Rv
aggauggccaucag

SEQ ID NO: 1299052 - RNA, 23 nt, Mycobacterium tuberculosis H37Rv
aggauggacucgacaauucgcag

SEQ ID NO: 1299053 - RNA, 16 nt, Mycobacterium tuberculosis H37Rv
aggauggucagcagcu

SEQ ID NO: 1299054 - RNA, 15 nt, Mycobacterium tuberculosis H37Rv
aggaucgcguggcgc

SEQ ID NO: 1299055 - RNA, 20 nt, Mycobacterium tuberculosis H37Rv
aggaucggcgauugcaccau

SEQ ID NO: 1299056 - RNA, 19 nt, Mycobacterium tuberculosis H37Rv
aaacuaacggcagccaccg

SEQ ID NO: 1299057 - RNA, 16 nt, Mycobacterium tuberculosis H37Rv
aggagugauucggcga

SEQ ID NO: 1299058 - RNA, 20 nt, Mycobacterium tuberculosis H37Rv
aggaucauguccaucgcgcg

SEQ ID NO: 1299059 - RNA, 16 nt, Mycobacterium tuberculosis H37Rv
aggaucauggcgucga

SEQ ID NO: 1299060 - RNA, 16 nt, Mycobacterium tuberculosis H37Rv
aggagcuccaugcgga

SEQ ID NO: 1299061 - RNA, 19 nt, Mycobacterium tuberculosis H37Rv
aggagggccgcgaucgacg

SEQ ID NO: 1299062 - RNA, 12 nt, Mycobacterium tuberculosis H37Rv
aaacgucaccgc

SEQ ID NO: 1299063 - RNA, 18 nt, Mycobacterium tuberculosis H37Rv
aaacggugucucgcccac

SEQ ID NO: 1299064 - RNA, 19 nt, Mycobacterium tuberculosis H37Rv
aaacguaccgucauggcga

SEQ ID NO: 1299065 - RNA, 12 nt, Mycobacterium tuberculosis H37Rv
aggagaugccga

SEQ ID NO: 1299066 - RNA, 15 nt, Mycobacterium tuberculosis H37Rv
aggagaucagcaccg

SEQ ID NO: 1299067 - RNA, 16 nt, Mycobacterium tuberculosis H37Rv
aggagaucagcaccgu

SEQ ID NO: 1299068 - RNA, 17 nt, Mycobacterium tuberculosis H37Rv
aggagaucaacauccug

SEQ ID NO: 1299069 - RNA, 18 nt, Mycobacterium tuberculosis H37Rv
aggacucacgcagcgcca

SEQ ID NO: 1299070 - RNA, 20 nt, Mycobacterium tuberculosis H37Rv
aggacggcguagacguccgc

SEQ ID NO: 1299071 - RNA, 23 nt, Mycobacterium tuberculosis H37Rv
aggacgguugagauggucaccgg

SEQ ID NO: 1299072 - RNA, 22 nt, Mycobacterium tuberculosis H37Rv
aggacgguugguccgccgucga

SEQ ID NO: 1299073 - RNA, 16 nt, Mycobacterium tuberculosis H37Rv
aggacgucaccgucag

SEQ ID NO: 1299074 - RNA, 17 nt, Mycobacterium tuberculosis H37Rv
aggacggaucgucgugc

SEQ ID NO: 1299075 - RNA, 22 nt, Mycobacterium tuberculosis H37Rv
aggaagccgcggccacgguaga

SEQ ID NO: 1299076 - RNA, 20 nt, Mycobacterium tuberculosis H37Rv
aggaagcccacgaucgcguc

SEQ ID NO: 1299077 - RNA, 22 nt, Mycobacterium tuberculosis H37Rv
aggaagcccgaugcgccaccgg

SEQ ID NO: 1299078 - RNA, 18 nt, Mycobacterium tuberculosis H37Rv
aggaacgccggcaucgcg

SEQ ID NO: 1299079 - RNA, 23 nt, Mycobacterium tuberculosis H37Rv
aggaacuggaccggugccagcag

SEQ ID NO: 1299080 - RNA, 19 nt, Mycobacterium tuberculosis H37Rv
aggaacuacccgccagcaa

SEQ ID NO: 1299081 - RNA, 20 nt, Mycobacterium tuberculosis H37Rv
aggaaaaccccggccaccag

SEQ ID NO: 1299082 - RNA, 23 nt, Mycobacterium tuberculosis H37Rv
aggaaccacccaccggccaccag

SEQ ID NO: 1299083 - RNA, 16 nt, Mycobacterium tuberculosis H37Rv
aggaaccccgcgcggu

SEQ ID NO: 1299084 - RNA, 14 nt, Mycobacterium tuberculosis H37Rv
aggaaccgggcaaa

SEQ ID NO: 1299085 - RNA, 18 nt, Mycobacterium tuberculosis H37Rv
aggaaugauggccagcac

SEQ ID NO: 1299086 - RNA, 13 nt, Mycobacterium tuberculosis H37Rv
aggacaccaccgu

SEQ ID NO: 1299087 - RNA, 18 nt, Mycobacterium tuberculosis H37Rv
aggacaccgucaugccgu

SEQ ID NO: 1299088 - RNA, 22 nt, Mycobacterium tuberculosis H37Rv
aggaauacagcuugaucgccga

SEQ ID NO: 1299089 - RNA, 16 nt, Mycobacterium tuberculosis H37Rv
aggacgaacaacgcga

SEQ ID NO: 1299090 - RNA, 14 nt, Mycobacterium tuberculosis H37Rv
aggaccucgucacc

SEQ ID NO: 1299091 - RNA, 21 nt, Mycobacterium tuberculosis H37Rv
aggaccucgucaccggucagc

SEQ ID NO: 1299092 - RNA, 19 nt, Mycobacterium tuberculosis H37Rv
aggaccgggaucgucaggc

SEQ ID NO: 1299093 - RNA, 20 nt, Mycobacterium tuberculosis H37Rv
aggaccgggaucgucaggcc

SEQ ID NO: 1299094 - RNA, 11 nt, Mycobacterium tuberculosis H37Rv
aggaccgcucu

SEQ ID NO: 1299095 - RNA, 19 nt, Mycobacterium tuberculosis H37Rv
agcugcgggucucgccgac

SEQ ID NO: 1299096 - RNA, 14 nt, Mycobacterium tuberculosis H37Rv
agcugcgcgggcga

SEQ ID NO: 1299097 - RNA, 18 nt, Mycobacterium tuberculosis H37Rv
agcugcgcgaagccacca

SEQ ID NO: 1299098 - RNA, 22 nt, Mycobacterium tuberculosis H37Rv
agcugggugaccucgucgaccg

SEQ ID NO: 1299099 - RNA, 22 nt, Mycobacterium tuberculosis H37Rv
agcuggugaucagcucagugau

SEQ ID NO: 1299100 - RNA, 18 nt, Mycobacterium tuberculosis H37Rv
agcuggugcgcccgacgg

SEQ ID NO: 1299101 - RNA, 23 nt, Mycobacterium tuberculosis H37Rv
agcugguccuccaaggcggucac

SEQ ID NO: 1299102 - RNA, 23 nt, Mycobacterium tuberculosis H37Rv
agcuggucccacaccuccucgag

SEQ ID NO: 1299103 - RNA, 21 nt, Mycobacterium tuberculosis H37Rv
agcugguaggucaccggucac

SEQ ID NO: 1299104 - RNA, 23 nt, Mycobacterium tuberculosis H37Rv
agcuguugcggggugcucagcga

SEQ ID NO: 1299105 - RNA, 13 nt, Mycobacterium tuberculosis H37Rv
agcuguggucacc

SEQ ID NO: 1299106 - RNA, 21 nt, Mycobacterium tuberculosis H37Rv
agcuggugcagaauucggcgc

SEQ ID NO: 1299107 - RNA, 15 nt, Mycobacterium tuberculosis H37Rv
agcugucgucgcccc

SEQ ID NO: 1299108 - RNA, 22 nt, Mycobacterium tuberculosis H37Rv
agcuguacuugggauugcgggc

SEQ ID NO: 1299109 - RNA, 18 nt, Mycobacterium tuberculosis H37Rv
agcuugacaucggucagc

SEQ ID NO: 1299110 - RNA, 19 nt, Mycobacterium tuberculosis H37Rv
agcuugaccgaccacgcga

SEQ ID NO: 1299111 - RNA, 19 nt, Mycobacterium tuberculosis H37Rv
agcuugagcacacguccgg

SEQ ID NO: 1299112 - RNA, 23 nt, Mycobacterium tuberculosis H37Rv
agcuugacccacgagagcgcugu

SEQ ID NO: 1299113 - RNA, 16 nt, Mycobacterium tuberculosis H37Rv
agcuuccaaacccggu

SEQ ID NO: 1299114 - RNA, 23 nt, Mycobacterium tuberculosis H37Rv
agcuucccuccagauaccaccgc

SEQ ID NO: 1299115 - RNA, 12 nt, Mycobacterium tuberculosis H37Rv
agcuucggccuu

SEQ ID NO: 1299116 - RNA, 14 nt, Mycobacterium tuberculosis H37Rv
agcuuggucgccgg

SEQ ID NO: 1299117 - RNA, 18 nt, Mycobacterium tuberculosis H37Rv
agcuugguggccaccacg

SEQ ID NO: 1299118 - RNA, 19 nt, Mycobacterium tuberculosis H37Rv
agcgcuggcaggccgggca

SEQ ID NO: 1299119 - RNA, 20 nt, Mycobacterium tuberculosis H37Rv
agcgcuggcaggccgggcac

SEQ ID NO: 1299120 - RNA, 15 nt, Mycobacterium tuberculosis H37Rv
agcgcgucucguuga

SEQ ID NO: 1299121 - RNA, 12 nt, Mycobacterium tuberculosis H37Rv
agcgcucgcguc

SEQ ID NO: 1299122 - RNA, 16 nt, Mycobacterium tuberculosis H37Rv
agcgcucgcgucaugc

SEQ ID NO: 1299123 - RNA, 18 nt, Mycobacterium tuberculosis H37Rv
agcggaauuagucgccgc

SEQ ID NO: 1299124 - RNA, 15 nt, Mycobacterium tuberculosis H37Rv
agcggcaaagccggg

SEQ ID NO: 1299125 - RNA, 19 nt, Mycobacterium tuberculosis H37Rv
agcggauucagcgucgcca

SEQ ID NO: 1299126 - RNA, 23 nt, Mycobacterium tuberculosis H37Rv
agcggaugggcugaggaacgccg

SEQ ID NO: 1299127 - RNA, 15 nt, Mycobacterium tuberculosis H37Rv
agcggauguccccga

SEQ ID NO: 1299128 - RNA, 18 nt, Mycobacterium tuberculosis H37Rv
agcggaacgucacugcga

SEQ ID NO: 1299129 - RNA, 20 nt, Mycobacterium tuberculosis H37Rv
agcggaacgucacugcgaaa

SEQ ID NO: 1299130 - RNA, 22 nt, Mycobacterium tuberculosis H37Rv
agcgccggccgaucggccggua

SEQ ID NO: 1299131 - RNA, 21 nt, Mycobacterium tuberculosis H37Rv
agcgccggcgggcucgguccc

SEQ ID NO: 1299132 - RNA, 18 nt, Mycobacterium tuberculosis H37Rv
agcgccgucaucgcagca

SEQ ID NO: 1299133 - RNA, 18 nt, Mycobacterium tuberculosis H37Rv
agcgcggcgaagccgggu

SEQ ID NO: 1299134 - RNA, 13 nt, Mycobacterium tuberculosis H37Rv
agcgccgucagca

SEQ ID NO: 1299135 - RNA, 13 nt, Mycobacterium tuberculosis H37Rv
agcgcggcgcaca

SEQ ID NO: 1299136 - RNA, 19 nt, Mycobacterium tuberculosis H37Rv
agcgcggcgacggcgguca

SEQ ID NO: 1299137 - RNA, 14 nt, Mycobacterium tuberculosis H37Rv
agcgcgucgucacg

SEQ ID NO: 1299138 - RNA, 17 nt, Mycobacterium tuberculosis H37Rv
agcgcgucggucaccga

SEQ ID NO: 1299139 - RNA, 13 nt, Mycobacterium tuberculosis H37Rv
agcgcgucgccga

SEQ ID NO: 1299140 - RNA, 14 nt, Mycobacterium tuberculosis H37Rv
agcgcgucgccguc

SEQ ID NO: 1299141 - RNA, 16 nt, Mycobacterium tuberculosis H37Rv
agcgcgucgccgucga

SEQ ID NO: 1299142 - RNA, 17 nt, Mycobacterium tuberculosis H37Rv
agcggcaauggccagca

SEQ ID NO: 1299143 - RNA, 18 nt, Mycobacterium tuberculosis H37Rv
agcggcaacgaucgacac

SEQ ID NO: 1299144 - RNA, 17 nt, Mycobacterium tuberculosis H37Rv
agcggcaacaugucacc

SEQ ID NO: 1299145 - RNA, 15 nt, Mycobacterium tuberculosis H37Rv
agcggccauaucgcc

SEQ ID NO: 1299146 - RNA, 22 nt, Mycobacterium tuberculosis H37Rv
agcggccauaucgcccaccacg

SEQ ID NO: 1299147 - RNA, 17 nt, Mycobacterium tuberculosis H37Rv
agcggcacacccaucac

SEQ ID NO: 1299148 - RNA, 23 nt, Mycobacterium tuberculosis H37Rv
agcggcacacccaucaccgccag

SEQ ID NO: 1299149 - RNA, 15 nt, Mycobacterium tuberculosis H37Rv
agcggcaaucggguc

SEQ ID NO: 1299150 - RNA, 19 nt, Mycobacterium tuberculosis H37Rv
agcggcccuucgacgagga

SEQ ID NO: 1299151 - RNA, 16 nt, Mycobacterium tuberculosis H37Rv
agcggccgccgcggcu

SEQ ID NO: 1299152 - RNA, 21 nt, Mycobacterium tuberculosis H37Rv
agcggcccgucaccgcgggca

SEQ ID NO: 1299153 - RNA, 15 nt, Mycobacterium tuberculosis H37Rv
agcggcccgaucacc

SEQ ID NO: 1299154 - RNA, 18 nt, Mycobacterium tuberculosis H37Rv
agcggcgaccgcggucgc

SEQ ID NO: 1299155 - RNA, 22 nt, Mycobacterium tuberculosis H37Rv
agcggcgaguuggccguggcga

SEQ ID NO: 1299156 - RNA, 22 nt, Mycobacterium tuberculosis H37Rv
agcggcgaucggaggcccgcca

SEQ ID NO: 1299157 - RNA, 19 nt, Mycobacterium tuberculosis H37Rv
agcggcgccacguggucga

SEQ ID NO: 1299158 - RNA, 22 nt, Mycobacterium tuberculosis H37Rv
agcggcgaaaacaacaccaccg

SEQ ID NO: 1299159 - RNA, 20 nt, Mycobacterium tuberculosis H37Rv
agcgggcaagaugaucgcgu

SEQ ID NO: 1299160 - RNA, 16 nt, Mycobacterium tuberculosis H37Rv
agcgggcaaacgaacg

SEQ ID NO: 1299161 - RNA, 13 nt, Mycobacterium tuberculosis H37Rv
agcgggcaacugc

SEQ ID NO: 1299162 - RNA, 19 nt, Mycobacterium tuberculosis H37Rv
agcgggcaacugcagcaug

SEQ ID NO: 1299163 - RNA, 15 nt, Mycobacterium tuberculosis H37Rv
agcgggcacgccgcc

SEQ ID NO: 1299164 - RNA, 19 nt, Mycobacterium tuberculosis H37Rv
agcgggcauaacccgcacc

SEQ ID NO: 1299165 - RNA, 20 nt, Mycobacterium tuberculosis H37Rv
agcgggccacugagccacag

SEQ ID NO: 1299166 - RNA, 15 nt, Mycobacterium tuberculosis H37Rv
agcgggccagcaccc

SEQ ID NO: 1299167 - RNA, 21 nt, Mycobacterium tuberculosis H37Rv
agcgggcgaugagcgcgaucu

SEQ ID NO: 1299168 - RNA, 14 nt, Mycobacterium tuberculosis H37Rv
agcgggcgucgcgg

SEQ ID NO: 1299169 - RNA, 16 nt, Mycobacterium tuberculosis H37Rv
agcgggaacacaccgc

SEQ ID NO: 1299170 - RNA, 12 nt, Mycobacterium tuberculosis H37Rv
agcggcgggcac

SEQ ID NO: 1299171 - RNA, 18 nt, Mycobacterium tuberculosis H37Rv
agcggcguuccgggccga

SEQ ID NO: 1299172 - RNA, 23 nt, Mycobacterium tuberculosis H37Rv
agcgggaucaugaccaucgaggc

SEQ ID NO: 1299173 - RNA, 23 nt, Mycobacterium tuberculosis H37Rv
agcgggauugccgagaacaccgg

SEQ ID NO: 1299174 - RNA, 13 nt, Mycobacterium tuberculosis H37Rv
agcgggauugccg

SEQ ID NO: 1299175 - RNA, 20 nt, Mycobacterium tuberculosis H37Rv
agcgggaucugacccagcag

SEQ ID NO: 1299176 - RNA, 12 nt, Mycobacterium tuberculosis H37Rv
agcggcguuccg

SEQ ID NO: 1299177 - RNA, 20 nt, Mycobacterium tuberculosis H37Rv
agcggcggggggugaucgcc

SEQ ID NO: 1299178 - RNA, 24 nt, Mycobacterium tuberculosis H37Rv
agcggcggguagauccgccgggua

SEQ ID NO: 1299179 - RNA, 15 nt, Mycobacterium tuberculosis H37Rv
agcggcgggcgauga

SEQ ID NO: 1299180 - RNA, 19 nt, Mycobacterium tuberculosis H37Rv
agcgucaccucaccgaacg

SEQ ID NO: 1299181 - RNA, 22 nt, Mycobacterium tuberculosis H37Rv
agcguacucccccgaaccugcg

SEQ ID NO: 1299182 - RNA, 23 nt, Mycobacterium tuberculosis H37Rv
agcgguguugccggagacgucgc

SEQ ID NO: 1299183 - RNA, 21 nt, Mycobacterium tuberculosis H37Rv
agcgguuguagaccucuucgg

SEQ ID NO: 1299184 - RNA, 23 nt, Mycobacterium tuberculosis H37Rv
agcgguuuagccgcuugggccug

SEQ ID NO: 1299185 - RNA, 20 nt, Mycobacterium tuberculosis H37Rv
agcgguggugagugcgucuc

SEQ ID NO: 1299186 - RNA, 16 nt, Mycobacterium tuberculosis H37Rv
agcgguggucggcgcg

SEQ ID NO: 1299187 - RNA, 19 nt, Mycobacterium tuberculosis H37Rv
agcgguguugccggagacg

SEQ ID NO: 1299188 - RNA, 22 nt, Mycobacterium tuberculosis H37Rv
agcgguuuccgcacgaucgccc

SEQ ID NO: 1299189 - RNA, 17 nt, Mycobacterium tuberculosis H37Rv
agcguaaugcugcugca

SEQ ID NO: 1299190 - RNA, 14 nt, Mycobacterium tuberculosis H37Rv
agcgucgucgccgg

SEQ ID NO: 1299191 - RNA, 23 nt, Mycobacterium tuberculosis H37Rv
agcgucgucgccggcgcucaucg

SEQ ID NO: 1299192 - RNA, 17 nt, Mycobacterium tuberculosis H37Rv
agcgucgcugaccgcgu

SEQ ID NO: 1299193 - RNA, 16 nt, Mycobacterium tuberculosis H37Rv
agcgucgcugaccgcg

SEQ ID NO: 1299194 - RNA, 13 nt, Mycobacterium tuberculosis H37Rv
agcguguggcgca

SEQ ID NO: 1299195 - RNA, 15 nt, Mycobacterium tuberculosis H37Rv
agcgucucgaucacc

SEQ ID NO: 1299196 - RNA, 16 nt, Mycobacterium tuberculosis H37Rv
agcguggugauccggu

SEQ ID NO: 1299197 - RNA, 22 nt, Mycobacterium tuberculosis H37Rv
agcguguggagcucgcggcgca

SEQ ID NO: 1299198 - RNA, 23 nt, Mycobacterium tuberculosis H37Rv
agcugcaaugacuggaccgcggu

SEQ ID NO: 1299199 - RNA, 19 nt, Mycobacterium tuberculosis H37Rv
agcucggccagcacgccgc

SEQ ID NO: 1299200 - RNA, 21 nt, Mycobacterium tuberculosis H37Rv
agcugccgcacccccuccgcg

SEQ ID NO: 1299201 - RNA, 16 nt, Mycobacterium tuberculosis H37Rv
agcugccgagcgguca

SEQ ID NO: 1299202 - RNA, 14 nt, Mycobacterium tuberculosis H37Rv
agcugcccgacguu

SEQ ID NO: 1299203 - RNA, 20 nt, Mycobacterium tuberculosis H37Rv
agcugccggcccaccaggcc

SEQ ID NO: 1299204 - RNA, 23 nt, Mycobacterium tuberculosis H37Rv
agcugccggcgaccaaggccgac

SEQ ID NO: 1299205 - RNA, 17 nt, Mycobacterium tuberculosis H37Rv
agcugcccaaccgguca

SEQ ID NO: 1299206 - RNA, 11 nt, Mycobacterium tuberculosis H37Rv
agcucgaccug

SEQ ID NO: 1299207 - RNA, 24 nt, Mycobacterium tuberculosis H37Rv
agcucgacgaauaccgggaugcga

SEQ ID NO: 1299208 - RNA, 12 nt, Mycobacterium tuberculosis H37Rv
agcuagaccgcu

SEQ ID NO: 1299209 - RNA, 14 nt, Mycobacterium tuberculosis H37Rv
agcucagcugcgga

SEQ ID NO: 1299210 - RNA, 14 nt, Mycobacterium tuberculosis H37Rv
agggcggccgcggu

SEQ ID NO: 1299211 - RNA, 21 nt, Mycobacterium tuberculosis H37Rv
agggccuggaacacaugcauc

SEQ ID NO: 1299212 - RNA, 13 nt, Mycobacterium tuberculosis H37Rv
agggcaucgucgc

SEQ ID NO: 1299213 - RNA, 15 nt, Mycobacterium tuberculosis H37Rv
agggcacuccaccgg

SEQ ID NO: 1299214 - RNA, 20 nt, Mycobacterium tuberculosis H37Rv
aggguuuccaagucggagcg

SEQ ID NO: 1299215 - RNA, 13 nt, Mycobacterium tuberculosis H37Rv
aggguguugcggc

SEQ ID NO: 1299216 - RNA, 14 nt, Mycobacterium tuberculosis H37Rv
aggguguccgucga

SEQ ID NO: 1299217 - RNA, 16 nt, Mycobacterium tuberculosis H37Rv
agggugggcucguugu

SEQ ID NO: 1299218 - RNA, 18 nt, Mycobacterium tuberculosis H37Rv
aggguggaccggucgaca

SEQ ID NO: 1299219 - RNA, 12 nt, Mycobacterium tuberculosis H37Rv
aggguggccgac

SEQ ID NO: 1299220 - RNA, 15 nt, Mycobacterium tuberculosis H37Rv
agggugcucgucacc

SEQ ID NO: 1299221 - RNA, 13 nt, Mycobacterium tuberculosis H37Rv
agggugcugaucu

SEQ ID NO: 1299222 - RNA, 13 nt, Mycobacterium tuberculosis H37Rv
agggugccgguca

SEQ ID NO: 1299223 - RNA, 19 nt, Mycobacterium tuberculosis H37Rv
agggcggcgucgauggcca

SEQ ID NO: 1299224 - RNA, 22 nt, Mycobacterium tuberculosis H37Rv
aggggcuuuugcgucugcucgc

SEQ ID NO: 1299225 - RNA, 19 nt, Mycobacterium tuberculosis H37Rv
aggggcuuuugcgucugcu

SEQ ID NO: 1299226 - RNA, 16 nt, Mycobacterium tuberculosis H37Rv
agggucaugucgauca

SEQ ID NO: 1299227 - RNA, 14 nt, Mycobacterium tuberculosis H37Rv
agggcaccggcgau

SEQ ID NO: 1299228 - RNA, 18 nt, Mycobacterium tuberculosis H37Rv
agggauguagugcugcuc

SEQ ID NO: 1299229 - RNA, 17 nt, Mycobacterium tuberculosis H37Rv
aggcuugcggcacccag

SEQ ID NO: 1299230 - RNA, 16 nt, Mycobacterium tuberculosis H37Rv
aggcuuggcaugcgga

SEQ ID NO: 1299231 - RNA, 12 nt, Mycobacterium tuberculosis H37Rv
aggcuuccagcc

SEQ ID NO: 1299232 - RNA, 21 nt, Mycobacterium tuberculosis H37Rv
aggcugcagugccgcacccag

SEQ ID NO: 1299233 - RNA, 15 nt, Mycobacterium tuberculosis H37Rv
aggcugaucccgaug

SEQ ID NO: 1299234 - RNA, 19 nt, Mycobacterium tuberculosis H37Rv
aggcgugcacugaccgcgg

SEQ ID NO: 1299235 - RNA, 19 nt, Mycobacterium tuberculosis H37Rv
aggcgugacgcuaacgucg

SEQ ID NO: 1299236 - RNA, 24 nt, Mycobacterium tuberculosis H37Rv
aggcgugucgucgcggccgguuca

SEQ ID NO: 1299237 - RNA, 14 nt, Mycobacterium tuberculosis H37Rv
aggccgcacagcac

SEQ ID NO: 1299238 - RNA, 16 nt, Mycobacterium tuberculosis H37Rv
aggccgcacagcacca

SEQ ID NO: 1299239 - RNA, 15 nt, Mycobacterium tuberculosis H37Rv
aggccgcacgggcga

SEQ ID NO: 1299240 - RNA, 13 nt, Mycobacterium tuberculosis H37Rv
aggccgcacgucg

SEQ ID NO: 1299241 - RNA, 19 nt, Mycobacterium tuberculosis H37Rv
aggccgcaaugcguugacc

SEQ ID NO: 1299242 - RNA, 20 nt, Mycobacterium tuberculosis H37Rv
aggccgacaaugucggcgau

SEQ ID NO: 1299243 - RNA, 13 nt, Mycobacterium tuberculosis H37Rv
aggccgaugccga

SEQ ID NO: 1299244 - RNA, 17 nt, Mycobacterium tuberculosis H37Rv
aggccgccaccgucacc

SEQ ID NO: 1299245 - RNA, 24 nt, Mycobacterium tuberculosis H37Rv
agguggcguaauugucgauguccg

SEQ ID NO: 1299246 - RNA, 17 nt, Mycobacterium tuberculosis H37Rv
agguggccggcuugcag

SEQ ID NO: 1299247 - RNA, 13 nt, Mycobacterium tuberculosis H37Rv
agguggcgagcgc

SEQ ID NO: 1299248 - RNA, 16 nt, Mycobacterium tuberculosis H37Rv
agguggccgucgccga

SEQ ID NO: 1299249 - RNA, 16 nt, Mycobacterium tuberculosis H37Rv
agguggccgcaucgcc

SEQ ID NO: 1299250 - RNA, 21 nt, Mycobacterium tuberculosis H37Rv
aggugggauugaagcuggcca

SEQ ID NO: 1299251 - RNA, 23 nt, Mycobacterium tuberculosis H37Rv
agguggucaucgccacgccugcu

SEQ ID NO: 1299252 - RNA, 22 nt, Mycobacterium tuberculosis H37Rv
aggucgucacgccccucacgug

SEQ ID NO: 1299253 - RNA, 19 nt, Mycobacterium tuberculosis H37Rv
aggugcggugaucgauccg

SEQ ID NO: 1299254 - RNA, 20 nt, Mycobacterium tuberculosis H37Rv
aggucuuucgaugaugggcg

SEQ ID NO: 1299255 - RNA, 23 nt, Mycobacterium tuberculosis H37Rv
aggucucugucauugcugcccaa

SEQ ID NO: 1299256 - RNA, 21 nt, Mycobacterium tuberculosis H37Rv
aggucugggcaagaccgcguu

SEQ ID NO: 1299257 - RNA, 17 nt, Mycobacterium tuberculosis H37Rv
aggugcuuggggucacc

SEQ ID NO: 1299258 - RNA, 20 nt, Mycobacterium tuberculosis H37Rv
aggucggccagcagcagugc

SEQ ID NO: 1299259 - RNA, 15 nt, Mycobacterium tuberculosis H37Rv
aggucgcggucgagc

SEQ ID NO: 1299260 - RNA, 21 nt, Mycobacterium tuberculosis H37Rv
aggucgccuucccagccgacg

SEQ ID NO: 1299261 - RNA, 13 nt, Mycobacterium tuberculosis H37Rv
agguagucgacga

SEQ ID NO: 1299262 - RNA, 15 nt, Mycobacterium tuberculosis H37Rv
agguaggacucacgc

SEQ ID NO: 1299263 - RNA, 14 nt, Mycobacterium tuberculosis H37Rv
agguaauucgucca

SEQ ID NO: 1299264 - RNA, 21 nt, Mycobacterium tuberculosis H37Rv
agguaauugccgaccgccuga

SEQ ID NO: 1299265 - RNA, 22 nt, Mycobacterium tuberculosis H37Rv
agguacgucuuggaucacgcga

SEQ ID NO: 1299266 - RNA, 15 nt, Mycobacterium tuberculosis H37Rv
aguagcccgcgucga

SEQ ID NO: 1299267 - RNA, 18 nt, Mycobacterium tuberculosis H37Rv
agguucgugcguugucgg

SEQ ID NO: 1299268 - RNA, 20 nt, Mycobacterium tuberculosis H37Rv
agucaggcgccgcuaucgag

SEQ ID NO: 1299269 - RNA, 15 nt, Mycobacterium tuberculosis H37Rv
aguagcugcggucga

SEQ ID NO: 1299270 - RNA, 16 nt, Mycobacterium tuberculosis H37Rv
aguccgaaagccgccg

SEQ ID NO: 1299271 - RNA, 15 nt, Mycobacterium tuberculosis H37Rv
aguccgaagcugcug

SEQ ID NO: 1299272 - RNA, 18 nt, Mycobacterium tuberculosis H37Rv
aguccaacucggccaacg

SEQ ID NO: 1299273 - RNA, 20 nt, Mycobacterium tuberculosis H37Rv
aguccaccgcgcggcgcagc

SEQ ID NO: 1299274 - RNA, 23 nt, Mycobacterium tuberculosis H37Rv
aguccagcagcgacgcugccgcc

SEQ ID NO: 1299275 - RNA, 16 nt, Mycobacterium tuberculosis H37Rv
aguccaggccggcagc

SEQ ID NO: 1299276 - RNA, 22 nt, Mycobacterium tuberculosis H37Rv
agucgagcaccugccgaucggg

SEQ ID NO: 1299277 - RNA, 18 nt, Mycobacterium tuberculosis H37Rv
agucgaacaagaccgcgg

SEQ ID NO: 1299278 - RNA, 12 nt, Mycobacterium tuberculosis H37Rv
aguccuugcgcc

SEQ ID NO: 1299279 - RNA, 19 nt, Mycobacterium tuberculosis H37Rv
agucgaaaacagcgauccg

SEQ ID NO: 1299280 - RNA, 19 nt, Mycobacterium tuberculosis H37Rv
aguccucgacguggccgac

SEQ ID NO: 1299281 - RNA, 14 nt, Mycobacterium tuberculosis H37Rv
aguccgucggucgc

SEQ ID NO: 1299282 - RNA, 24 nt, Mycobacterium tuberculosis H37Rv
aguccggcuuaccggcgggcgaac

SEQ ID NO: 1299283 - RNA, 23 nt, Mycobacterium tuberculosis H37Rv
aguccgcugcuucuccgagauca

SEQ ID NO: 1299284 - RNA, 18 nt, Mycobacterium tuberculosis H37Rv
aguccggccgacccggau

SEQ ID NO: 1299285 - RNA, 22 nt, Mycobacterium tuberculosis H37Rv
aguccggccucagcccgucagc

SEQ ID NO: 1299286 - RNA, 20 nt, Mycobacterium tuberculosis H37Rv
aguccggucgcggagaacgc

SEQ ID NO: 1299287 - RNA, 17 nt, Mycobacterium tuberculosis H37Rv
aguccgcauccgcgacg

SEQ ID NO: 1299288 - RNA, 22 nt, Mycobacterium tuberculosis H37Rv
aguccgacaccacggaccagcg

SEQ ID NO: 1299289 - RNA, 14 nt, Mycobacterium tuberculosis H37Rv
aguccgcgcucagc

SEQ ID NO: 1299290 - RNA, 13 nt, Mycobacterium tuberculosis H37Rv
agucgaucgcggc

SEQ ID NO: 1299291 - RNA, 14 nt, Mycobacterium tuberculosis H37Rv
agucgccggucagg

SEQ ID NO: 1299292 - RNA, 15 nt, Mycobacterium tuberculosis H37Rv
agucgcggacgucgc

SEQ ID NO: 1299293 - RNA, 22 nt, Mycobacterium tuberculosis H37Rv
agucgcgaacucaugcccgacg

SEQ ID NO: 1299294 - RNA, 19 nt, Mycobacterium tuberculosis H37Rv
agucgcgggugcggacacc

SEQ ID NO: 1299295 - RNA, 18 nt, Mycobacterium tuberculosis H37Rv
agucgcgguaccaucacc

SEQ ID NO: 1299296 - RNA, 21 nt, Mycobacterium tuberculosis H37Rv
agucggcauugcugguugcgc

SEQ ID NO: 1299297 - RNA, 16 nt, Mycobacterium tuberculosis H37Rv
agucgcugucggcaug

SEQ ID NO: 1299298 - RNA, 16 nt, Mycobacterium tuberculosis H37Rv
aguggcccgcgggcaa

SEQ ID NO: 1299299 - RNA, 22 nt, Mycobacterium tuberculosis H37Rv
aguggcguuacgcucggcgaac

SEQ ID NO: 1299300 - RNA, 14 nt, Mycobacterium tuberculosis H37Rv
agugccgccggcca

SEQ ID NO: 1299301 - RNA, 20 nt, Mycobacterium tuberculosis H37Rv
agugggcuuuugcgucugcu

SEQ ID NO: 1299302 - RNA, 17 nt, Mycobacterium tuberculosis H37Rv
agucguagacggcgaaa

SEQ ID NO: 1299303 - RNA, 19 nt, Mycobacterium tuberculosis H37Rv
agucgucgacuugcaggcg

SEQ ID NO: 1299304 - RNA, 18 nt, Mycobacterium tuberculosis H37Rv
agucgucgacuugcaggc

SEQ ID NO: 1299305 - RNA, 14 nt, Mycobacterium tuberculosis H37Rv
agucgucggcaugg

SEQ ID NO: 1299306 - RNA, 13 nt, Mycobacterium tuberculosis H37Rv
agucgugggcugu

SEQ ID NO: 1299307 - RNA, 19 nt, Mycobacterium tuberculosis H37Rv
agucggcgcuggccgucga

SEQ ID NO: 1299308 - RNA, 19 nt, Mycobacterium tuberculosis H37Rv
agucggugcagcgcacgca

SEQ ID NO: 1299309 - RNA, 19 nt, Mycobacterium tuberculosis H37Rv
agucgguaucggcagaugg

SEQ ID NO: 1299310 - RNA, 19 nt, Mycobacterium tuberculosis H37Rv
agugccaggugggugaacg

SEQ ID NO: 1299311 - RNA, 14 nt, Mycobacterium tuberculosis H37Rv
aguucacgguugau

SEQ ID NO: 1299312 - RNA, 20 nt, Mycobacterium tuberculosis H37Rv
aguuggccaguaugcggugc

SEQ ID NO: 1299313 - RNA, 23 nt, Mycobacterium tuberculosis H37Rv
aguuggcugagcagcgcggccag

SEQ ID NO: 1299314 - RNA, 17 nt, Mycobacterium tuberculosis H37Rv
auaagguucgugcguug

SEQ ID NO: 1299315 - RNA, 20 nt, Mycobacterium tuberculosis H37Rv
auacaccugcuggaagccgu

SEQ ID NO: 1299316 - RNA, 22 nt, Mycobacterium tuberculosis H37Rv
auacagcggaauuagucgccgc

SEQ ID NO: 1299317 - RNA, 20 nt, Mycobacterium tuberculosis H37Rv
auaccagaccggccgacgug

SEQ ID NO: 1299318 - RNA, 22 nt, Mycobacterium tuberculosis H37Rv
auaguccuugcgccagcgggcu

SEQ ID NO: 1299319 - RNA, 18 nt, Mycobacterium tuberculosis H37Rv
aucaaccgcugucaccgu

SEQ ID NO: 1299320 - RNA, 21 nt, Mycobacterium tuberculosis H37Rv
aucaacggaaugaaggcaccg

SEQ ID NO: 1299321 - RNA, 18 nt, Mycobacterium tuberculosis H37Rv
aucaacaggaccgggauc

SEQ ID NO: 1299322 - RNA, 14 nt, Mycobacterium tuberculosis H37Rv
aucacuguuccggg

SEQ ID NO: 1299323 - RNA, 17 nt, Mycobacterium tuberculosis H37Rv
aucacggcaccgaagug

SEQ ID NO: 1299324 - RNA, 14 nt, Mycobacterium tuberculosis H37Rv
aucacggcaccgaa

SEQ ID NO: 1299325 - RNA, 19 nt, Mycobacterium tuberculosis H37Rv
aucagcggcagcaccgcac

SEQ ID NO: 1299326 - RNA, 21 nt, Mycobacterium tuberculosis H37Rv
aucagccguggcagucgcacg

SEQ ID NO: 1299327 - RNA, 15 nt, Mycobacterium tuberculosis H37Rv
aucagcgaaccaccg

SEQ ID NO: 1299328 - RNA, 20 nt, Mycobacterium tuberculosis H37Rv
aucagaccaaugaccgccag

SEQ ID NO: 1299329 - RNA, 21 nt, Mycobacterium tuberculosis H37Rv
aucaccgggguugcccgcgac

SEQ ID NO: 1299330 - RNA, 23 nt, Mycobacterium tuberculosis H37Rv
aucaccgccuuugccgccggcac

SEQ ID NO: 1299331 - RNA, 18 nt, Mycobacterium tuberculosis H37Rv
aucacgauguccucgaug

SEQ ID NO: 1299332 - RNA, 19 nt, Mycobacterium tuberculosis H37Rv
aucacgauguccucgaugc

SEQ ID NO: 1299333 - RNA, 16 nt, Mycobacterium tuberculosis H37Rv
aucacgcacucgcguc

SEQ ID NO: 1299334 - RNA, 19 nt, Mycobacterium tuberculosis H37Rv
aucaaggugaucagcagga

SEQ ID NO: 1299335 - RNA, 18 nt, Mycobacterium tuberculosis H37Rv
aucaagggggucgagcgc

SEQ ID NO: 1299336 - RNA, 17 nt, Mycobacterium tuberculosis H37Rv
aucaagugcgguccggc

SEQ ID NO: 1299337 - RNA, 21 nt, Mycobacterium tuberculosis H37Rv
aucagcgugucgccgauaucg

SEQ ID NO: 1299338 - RNA, 21 nt, Mycobacterium tuberculosis H37Rv
aucagcgguacguaaucgagc

SEQ ID NO: 1299339 - RNA, 13 nt, Mycobacterium tuberculosis H37Rv
aucagcucgaugc

SEQ ID NO: 1299340 - RNA, 16 nt, Mycobacterium tuberculosis H37Rv
aucagggcucgcucgc

SEQ ID NO: 1299341 - RNA, 17 nt, Mycobacterium tuberculosis H37Rv
aucaggcugggcagacc

SEQ ID NO: 1299342 - RNA, 21 nt, Mycobacterium tuberculosis H37Rv
aucaggcugggcagaccgauc

SEQ ID NO: 1299343 - RNA, 19 nt, Mycobacterium tuberculosis H37Rv
aucagcugcgcaucgccac

SEQ ID NO: 1299344 - RNA, 15 nt, Mycobacterium tuberculosis H37Rv
aucaggucgucacgc

SEQ ID NO: 1299345 - RNA, 16 nt, Mycobacterium tuberculosis H37Rv
aucagugcgccggcga

SEQ ID NO: 1299346 - RNA, 15 nt, Mycobacterium tuberculosis H37Rv
aucaugagcagcacg

SEQ ID NO: 1299347 - RNA, 23 nt, Mycobacterium tuberculosis H37Rv
aucaucuuugcguacaacgccgg

SEQ ID NO: 1299348 - RNA, 22 nt, Mycobacterium tuberculosis H37Rv
auccgcguggugcugaccgcgc

SEQ ID NO: 1299349 - RNA, 16 nt, Mycobacterium tuberculosis H37Rv
auccgcggcgaucacc

SEQ ID NO: 1299350 - RNA, 19 nt, Mycobacterium tuberculosis H37Rv
auccgcgguuggcaguggc

SEQ ID NO: 1299351 - RNA, 17 nt, Mycobacterium tuberculosis H37Rv
auccggaucggccuguc

SEQ ID NO: 1299352 - RNA, 14 nt, Mycobacterium tuberculosis H37Rv
auccggaucggccu

SEQ ID NO: 1299353 - RNA, 13 nt, Mycobacterium tuberculosis H37Rv
auccggaaccggu

SEQ ID NO: 1299354 - RNA, 15 nt, Mycobacterium tuberculosis H37Rv
auccggcccaccggu

SEQ ID NO: 1299355 - RNA, 19 nt, Mycobacterium tuberculosis H37Rv
auccggcgggugccgagcu

SEQ ID NO: 1299356 - RNA, 17 nt, Mycobacterium tuberculosis H37Rv
auccggacggugucagc

SEQ ID NO: 1299357 - RNA, 15 nt, Mycobacterium tuberculosis H37Rv
auccggcagaccggu

SEQ ID NO: 1299358 - RNA, 20 nt, Mycobacterium tuberculosis H37Rv
auccgcgcgcauauccgcag

SEQ ID NO: 1299359 - RNA, 18 nt, Mycobacterium tuberculosis H37Rv
auccgccccagcugcggu

SEQ ID NO: 1299360 - RNA, 13 nt, Mycobacterium tuberculosis H37Rv
auccgaucgccgc

SEQ ID NO: 1299361 - RNA, 16 nt, Mycobacterium tuberculosis H37Rv
auccgcacagcgacga

SEQ ID NO: 1299362 - RNA, 18 nt, Mycobacterium tuberculosis H37Rv
auccgcagugagcaaugc

SEQ ID NO: 1299363 - RNA, 20 nt, Mycobacterium tuberculosis H37Rv
auccgcaccacgcccgacga

SEQ ID NO: 1299364 - RNA, 17 nt, Mycobacterium tuberculosis H37Rv
auccgcaccagccgcca

SEQ ID NO: 1299365 - RNA, 22 nt, Mycobacterium tuberculosis H37Rv
auccgcaccccauacucggcgg

SEQ ID NO: 1299366 - RNA, 19 nt, Mycobacterium tuberculosis H37Rv
auccgacgucggugaccuc

SEQ ID NO: 1299367 - RNA, 14 nt, Mycobacterium tuberculosis H37Rv
auccgacgaccgca

SEQ ID NO: 1299368 - RNA, 12 nt, Mycobacterium tuberculosis H37Rv
auccgacgaacc

SEQ ID NO: 1299369 - RNA, 16 nt, Mycobacterium tuberculosis H37Rv
auccgagugaucgggu

SEQ ID NO: 1299370 - RNA, 17 nt, Mycobacterium tuberculosis H37Rv
auccgaagagccagcaa

SEQ ID NO: 1299371 - RNA, 19 nt, Mycobacterium tuberculosis H37Rv
auccgacacugcggccgau

SEQ ID NO: 1299372 - RNA, 17 nt, Mycobacterium tuberculosis H37Rv
auccgacagcagccggu

SEQ ID NO: 1299373 - RNA, 22 nt, Mycobacterium tuberculosis H37Rv
auccgggcaaccgaugacgcgu

SEQ ID NO: 1299374 - RNA, 15 nt, Mycobacterium tuberculosis H37Rv
auccgggcaaccgau

SEQ ID NO: 1299375 - RNA, 22 nt, Mycobacterium tuberculosis H37Rv
auccgggagugcgccggcuggc

SEQ ID NO: 1299376 - RNA, 17 nt, Mycobacterium tuberculosis H37Rv
auccgggacgugucggu

SEQ ID NO: 1299377 - RNA, 17 nt, Mycobacterium tuberculosis H37Rv
auccgggucaguaggcg

SEQ ID NO: 1299378 - RNA, 17 nt, Mycobacterium tuberculosis H37Rv
auccggucgcucgaugg

SEQ ID NO: 1299379 - RNA, 20 nt, Mycobacterium tuberculosis H37Rv
auccggucgaugaccucguc

SEQ ID NO: 1299380 - RNA, 19 nt, Mycobacterium tuberculosis H37Rv
auccggucgaugaccucgu

SEQ ID NO: 1299381 - RNA, 19 nt, Mycobacterium tuberculosis H37Rv
auccggucuccgcugauga

SEQ ID NO: 1299382 - RNA, 19 nt, Mycobacterium tuberculosis H37Rv
auccggucggucucggcga

SEQ ID NO: 1299383 - RNA, 21 nt, Mycobacterium tuberculosis H37Rv
auccggucguagcuucggguc

SEQ ID NO: 1299384 - RNA, 20 nt, Mycobacterium tuberculosis H37Rv
auccgugccgaaaaucgcag

SEQ ID NO: 1299385 - RNA, 20 nt, Mycobacterium tuberculosis H37Rv
auccguguuucgaacaccgu

SEQ ID NO: 1299386 - RNA, 22 nt, Mycobacterium tuberculosis H37Rv
auccgugccgaaaaucgcagcc

SEQ ID NO: 1299387 - RNA, 23 nt, Mycobacterium tuberculosis H37Rv
auccguguuucgaacaccgucca

SEQ ID NO: 1299388 - RNA, 20 nt, Mycobacterium tuberculosis H37Rv
auccgguguugagaucgccc

SEQ ID NO: 1299389 - RNA, 18 nt, Mycobacterium tuberculosis H37Rv
auccgguggugcucgucg

SEQ ID NO: 1299390 - RNA, 18 nt, Mycobacterium tuberculosis H37Rv
auccggugucgcgaucgc

SEQ ID NO: 1299391 - RNA, 18 nt, Mycobacterium tuberculosis H37Rv
auccggugaugaccgcgu

SEQ ID NO: 1299392 - RNA, 14 nt, Mycobacterium tuberculosis H37Rv
auccgguccaccgc

SEQ ID NO: 1299393 - RNA, 17 nt, Mycobacterium tuberculosis H37Rv
auccgugaauggcagca

SEQ ID NO: 1299394 - RNA, 16 nt, Mycobacterium tuberculosis H37Rv
auccguaggaacccga

SEQ ID NO: 1299395 - RNA, 17 nt, Mycobacterium tuberculosis H37Rv
auccuccucgucgacgu

SEQ ID NO: 1299396 - RNA, 18 nt, Mycobacterium tuberculosis H37Rv
auccuugccaaucgccgu

SEQ ID NO: 1299397 - RNA, 13 nt, Mycobacterium tuberculosis H37Rv
auccuucggcgug

SEQ ID NO: 1299398 - RNA, 16 nt, Mycobacterium tuberculosis H37Rv
auccagccgucggcgc

SEQ ID NO: 1299399 - RNA, 23 nt, Mycobacterium tuberculosis H37Rv
auccagcgaggugauggucguca

SEQ ID NO: 1299400 - RNA, 18 nt, Mycobacterium tuberculosis H37Rv
auccaggagugauucggc

SEQ ID NO: 1299401 - RNA, 15 nt, Mycobacterium tuberculosis H37Rv
auccacucggcgauc

SEQ ID NO: 1299402 - RNA, 13 nt, Mycobacterium tuberculosis H37Rv
auccacggagacc

SEQ ID NO: 1299403 - RNA, 15 nt, Mycobacterium tuberculosis H37Rv
auccacgucgcccag

SEQ ID NO: 1299404 - RNA, 15 nt, Mycobacterium tuberculosis H37Rv
auccagcaacgcggu

SEQ ID NO: 1299405 - RNA, 13 nt, Mycobacterium tuberculosis H37Rv
auccagccagcaa

SEQ ID NO: 1299406 - RNA, 18 nt, Mycobacterium tuberculosis H37Rv
auccagccagcaagcggu

SEQ ID NO: 1299407 - RNA, 19 nt, Mycobacterium tuberculosis H37Rv
auccagaugcccagcagga

SEQ ID NO: 1299408 - RNA, 13 nt, Mycobacterium tuberculosis H37Rv
auccaccgcagau

SEQ ID NO: 1299409 - RNA, 18 nt, Mycobacterium tuberculosis H37Rv
auccaccgauucggcgac

SEQ ID NO: 1299410 - RNA, 17 nt, Mycobacterium tuberculosis H37Rv
auccacaccgaccgcgg

SEQ ID NO: 1299411 - RNA, 16 nt, Mycobacterium tuberculosis H37Rv
auccaacuggccgcgu

SEQ ID NO: 1299412 - RNA, 14 nt, Mycobacterium tuberculosis H37Rv
aucaugugcgcgac

SEQ ID NO: 1299413 - RNA, 12 nt, Mycobacterium tuberculosis H37Rv
aucauguucggc

SEQ ID NO: 1299414 - RNA, 14 nt, Mycobacterium tuberculosis H37Rv
aucaugucggcgca

SEQ ID NO: 1299415 - RNA, 20 nt, Mycobacterium tuberculosis H37Rv
aucccgcggccgggccgcug

SEQ ID NO: 1299416 - RNA, 13 nt, Mycobacterium tuberculosis H37Rv
aucccgauacgca

SEQ ID NO: 1299417 - RNA, 17 nt, Mycobacterium tuberculosis H37Rv
aucccgccgaucgaacc

SEQ ID NO: 1299418 - RNA, 19 nt, Mycobacterium tuberculosis H37Rv
aucccgccgaucgaaccgc

SEQ ID NO: 1299419 - RNA, 22 nt, Mycobacterium tuberculosis H37Rv
aucccgccgcccgcaucgcggc

SEQ ID NO: 1299420 - RNA, 20 nt, Mycobacterium tuberculosis H37Rv
aucccgccaccgaacagucg

SEQ ID NO: 1299421 - RNA, 20 nt, Mycobacterium tuberculosis H37Rv
aucccgaaucucacccacau

SEQ ID NO: 1299422 - RNA, 17 nt, Mycobacterium tuberculosis H37Rv
aucccgggccguccggc

SEQ ID NO: 1299423 - RNA, 16 nt, Mycobacterium tuberculosis H37Rv
aucccggccgcucagc

SEQ ID NO: 1299424 - RNA, 22 nt, Mycobacterium tuberculosis H37Rv
aucccugugccagcagcagcgc

SEQ ID NO: 1299425 - RNA, 16 nt, Mycobacterium tuberculosis H37Rv
aucccugugccagcag

SEQ ID NO: 1299426 - RNA, 21 nt, Mycobacterium tuberculosis H37Rv
aucccuccgccaaggaggcca

SEQ ID NO: 1299427 - RNA, 15 nt, Mycobacterium tuberculosis H37Rv
auccccgguacgucg

SEQ ID NO: 1299428 - RNA, 13 nt, Mycobacterium tuberculosis H37Rv
auccccgcagcgu

SEQ ID NO: 1299429 - RNA, 14 nt, Mycobacterium tuberculosis H37Rv
aucccccaggcgaa

SEQ ID NO: 1299430 - RNA, 12 nt, Mycobacterium tuberculosis H37Rv
aucccagcggga

SEQ ID NO: 1299431 - RNA, 12 nt, Mycobacterium tuberculosis H37Rv
auccccgacguc

SEQ ID NO: 1299432 - RNA, 24 nt, Mycobacterium tuberculosis H37Rv
aucccccggcuggucacccguauc

SEQ ID NO: 1299433 - RNA, 14 nt, Mycobacterium tuberculosis H37Rv
auccaguucaccgc

SEQ ID NO: 1299434 - RNA, 20 nt, Mycobacterium tuberculosis H37Rv
auccaugauggccgucagcc

SEQ ID NO: 1299435 - RNA, 14 nt, Mycobacterium tuberculosis H37Rv
caccguagccagca

SEQ ID NO: 1299436 - RNA, 16 nt, Mycobacterium tuberculosis H37Rv
caccgguucggugagc

SEQ ID NO: 1299437 - RNA, 16 nt, Mycobacterium tuberculosis H37Rv
caccgguuucgucggu

SEQ ID NO: 1299438 - RNA, 18 nt, Mycobacterium tuberculosis H37Rv
caccggugccggcgacgc

SEQ ID NO: 1299439 - RNA, 14 nt, Mycobacterium tuberculosis H37Rv
caccguacgggacg

SEQ ID NO: 1299440 - RNA, 14 nt, Mycobacterium tuberculosis H37Rv
caccgucaccgccg

SEQ ID NO: 1299441 - RNA, 23 nt, Mycobacterium tuberculosis H37Rv
caccgucgcccggguggcgucga

SEQ ID NO: 1299442 - RNA, 18 nt, Mycobacterium tuberculosis H37Rv
caccgucaccgccgucac

SEQ ID NO: 1299443 - RNA, 13 nt, Mycobacterium tuberculosis H37Rv
caccggucaccgc

SEQ ID NO: 1299444 - RNA, 16 nt, Mycobacterium tuberculosis H37Rv
caccggucgccgcgaa

SEQ ID NO: 1299445 - RNA, 14 nt, Mycobacterium tuberculosis H37Rv
caccggugccgccg

SEQ ID NO: 1299446 - RNA, 21 nt, Mycobacterium tuberculosis H37Rv
caccggugauggugaccagca

SEQ ID NO: 1299447 - RNA, 13 nt, Mycobacterium tuberculosis H37Rv
caccggucagcga

SEQ ID NO: 1299448 - RNA, 20 nt, Mycobacterium tuberculosis H37Rv
caccgguaccggcgacgaau

SEQ ID NO: 1299449 - RNA, 15 nt, Mycobacterium tuberculosis H37Rv
caccgggcaccaguc

SEQ ID NO: 1299450 - RNA, 14 nt, Mycobacterium tuberculosis H37Rv
caccgggcaccagu

SEQ ID NO: 1299451 - RNA, 15 nt, Mycobacterium tuberculosis H37Rv
caccggcgucgacgu

SEQ ID NO: 1299452 - RNA, 12 nt, Mycobacterium tuberculosis H37Rv
caccggcgucga

SEQ ID NO: 1299453 - RNA, 17 nt, Mycobacterium tuberculosis H37Rv
caccggcggcgccgaaa

SEQ ID NO: 1299454 - RNA, 15 nt, Mycobacterium tuberculosis H37Rv
caccggaauacagcc

SEQ ID NO: 1299455 - RNA, 15 nt, Mycobacterium tuberculosis H37Rv
caccggaccgaccac

SEQ ID NO: 1299456 - RNA, 23 nt, Mycobacterium tuberculosis H37Rv
caccggaauuugcgucgugggga

SEQ ID NO: 1299457 - RNA, 17 nt, Mycobacterium tuberculosis H37Rv
caccggcgcgaccgcgg

SEQ ID NO: 1299458 - RNA, 17 nt, Mycobacterium tuberculosis H37Rv
caccggagcgccgagcu

SEQ ID NO: 1299459 - RNA, 18 nt, Mycobacterium tuberculosis H37Rv
caccggagaacgggucga

SEQ ID NO: 1299460 - RNA, 14 nt, Mycobacterium tuberculosis H37Rv
caccggagccgaac

SEQ ID NO: 1299461 - RNA, 14 nt, Mycobacterium tuberculosis H37Rv
caccggagcgccga

SEQ ID NO: 1299462 - RNA, 17 nt, Mycobacterium tuberculosis H37Rv
caccggcuggugccaac

SEQ ID NO: 1299463 - RNA, 21 nt, Mycobacterium tuberculosis H37Rv
caccggcguucaccugcgucg

SEQ ID NO: 1299464 - RNA, 19 nt, Mycobacterium tuberculosis H37Rv
caccggcugcaaccagcgg

SEQ ID NO: 1299465 - RNA, 18 nt, Mycobacterium tuberculosis H37Rv
caccguggcggaucgcga

SEQ ID NO: 1299466 - RNA, 16 nt, Mycobacterium tuberculosis H37Rv
caccgugggcggaacg

SEQ ID NO: 1299467 - RNA, 18 nt, Mycobacterium tuberculosis H37Rv
caccguggacaccuggcu

SEQ ID NO: 1299468 - RNA, 14 nt, Mycobacterium tuberculosis H37Rv
caccuccgccggca

SEQ ID NO: 1299469 - RNA, 15 nt, Mycobacterium tuberculosis H37Rv
caccuccugguugac

SEQ ID NO: 1299470 - RNA, 16 nt, Mycobacterium tuberculosis H37Rv
caccuccgucagcgcc

SEQ ID NO: 1299471 - RNA, 11 nt, Mycobacterium tuberculosis H37Rv
caccucgacgc

SEQ ID NO: 1299472 - RNA, 16 nt, Mycobacterium tuberculosis H37Rv
caccucgcccucccgg

SEQ ID NO: 1299473 - RNA, 16 nt, Mycobacterium tuberculosis H37Rv
caccgugcggaucgcg

SEQ ID NO: 1299474 - RNA, 16 nt, Mycobacterium tuberculosis H37Rv
caccgucucgcaccgc

SEQ ID NO: 1299475 - RNA, 23 nt, Mycobacterium tuberculosis H37Rv
caccguggaagauguugccgccg

SEQ ID NO: 1299476 - RNA, 13 nt, Mycobacterium tuberculosis H37Rv
caccgugcggucg

SEQ ID NO: 1299477 - RNA, 21 nt, Mycobacterium tuberculosis H37Rv
caccgucgcuaugcgccgcau

SEQ ID NO: 1299478 - RNA, 22 nt, Mycobacterium tuberculosis H37Rv
caccgucgcggcggcacuacgc

SEQ ID NO: 1299479 - RNA, 14 nt, Mycobacterium tuberculosis H37Rv
caccgucggcagca

SEQ ID NO: 1299480 - RNA, 23 nt, Mycobacterium tuberculosis H37Rv
caccgucgggauggacggcagcc

SEQ ID NO: 1299481 - RNA, 21 nt, Mycobacterium tuberculosis H37Rv
caccgucguacucggcggcca

SEQ ID NO: 1299482 - RNA, 22 nt, Mycobacterium tuberculosis H37Rv
caccgucgucguuucgccagcc

SEQ ID NO: 1299483 - RNA, 14 nt, Mycobacterium tuberculosis H37Rv
caccgucugcggac

SEQ ID NO: 1299484 - RNA, 16 nt, Mycobacterium tuberculosis H37Rv
caccugcaucgucgcc

SEQ ID NO: 1299485 - RNA, 23 nt, Mycobacterium tuberculosis H37Rv
caccugacgugcggcgcggcgac

SEQ ID NO: 1299486 - RNA, 17 nt, Mycobacterium tuberculosis H37Rv
caccugacgugcggcgc

SEQ ID NO: 1299487 - RNA, 15 nt, Mycobacterium tuberculosis H37Rv
caccucgugcggcgc

SEQ ID NO: 1299488 - RNA, 20 nt, Mycobacterium tuberculosis H37Rv
caccucggguguggucacca

SEQ ID NO: 1299489 - RNA, 18 nt, Mycobacterium tuberculosis H37Rv
caccucggugaccaggcc

SEQ ID NO: 1299490 - RNA, 12 nt, Mycobacterium tuberculosis H37Rv
caccucggcguu

SEQ ID NO: 1299491 - RNA, 11 nt, Mycobacterium tuberculosis H37Rv
caccucggcga

SEQ ID NO: 1299492 - RNA, 14 nt, Mycobacterium tuberculosis H37Rv
caccgcgcggcgca

SEQ ID NO: 1299493 - RNA, 19 nt, Mycobacterium tuberculosis H37Rv
caccgcggaccggcgucgg

SEQ ID NO: 1299494 - RNA, 15 nt, Mycobacterium tuberculosis H37Rv
caccgcggaaggcca

SEQ ID NO: 1299495 - RNA, 12 nt, Mycobacterium tuberculosis H37Rv
caccgcggcgau

SEQ ID NO: 1299496 - RNA, 17 nt, Mycobacterium tuberculosis H37Rv
caccgcgccgucgucgc

SEQ ID NO: 1299497 - RNA, 17 nt, Mycobacterium tuberculosis H37Rv
caccgcgcuggucagcc

SEQ ID NO: 1299498 - RNA, 14 nt, Mycobacterium tuberculosis H37Rv
caccgcggcgucgc

SEQ ID NO: 1299499 - RNA, 15 nt, Mycobacterium tuberculosis H37Rv
caccgcggcgucgcc

SEQ ID NO: 1299500 - RNA, 23 nt, Mycobacterium tuberculosis H37Rv
caccgcgggaucgguggcggcac

SEQ ID NO: 1299501 - RNA, 15 nt, Mycobacterium tuberculosis H37Rv
caccgcggucaccga

SEQ ID NO: 1299502 - RNA, 18 nt, Mycobacterium tuberculosis H37Rv
caccgcggcggcggccau

SEQ ID NO: 1299503 - RNA, 15 nt, Mycobacterium tuberculosis H37Rv
caccgcuucaggcgc

SEQ ID NO: 1299504 - RNA, 13 nt, Mycobacterium tuberculosis H37Rv
caccgcggucagc

SEQ ID NO: 1299505 - RNA, 19 nt, Mycobacterium tuberculosis H37Rv
caccgccagcugggcagcc

SEQ ID NO: 1299506 - RNA, 16 nt, Mycobacterium tuberculosis H37Rv
caccgccagcggcaau

SEQ ID NO: 1299507 - RNA, 20 nt, Mycobacterium tuberculosis H37Rv
caccgccgccgccaccggcg

SEQ ID NO: 1299508 - RNA, 22 nt, Mycobacterium tuberculosis H37Rv
caccgccgccgccgacgccgcc

SEQ ID NO: 1299509 - RNA, 15 nt, Mycobacterium tuberculosis H37Rv
caccgccgccggcac

SEQ ID NO: 1299510 - RNA, 13 nt, Mycobacterium tuberculosis H37Rv
caccgccgccgga

SEQ ID NO: 1299511 - RNA, 19 nt, Mycobacterium tuberculosis H37Rv
caccgccgcgaccgccucg

SEQ ID NO: 1299512 - RNA, 13 nt, Mycobacterium tuberculosis H37Rv
caccgccgccugc

SEQ ID NO: 1299513 - RNA, 14 nt, Mycobacterium tuberculosis H37Rv
caccgccgcgucga

SEQ ID NO: 1299514 - RNA, 17 nt, Mycobacterium tuberculosis H37Rv
caccgccgcugccggua

SEQ ID NO: 1299515 - RNA, 14 nt, Mycobacterium tuberculosis H37Rv
caccgcgccgagca

SEQ ID NO: 1299516 - RNA, 19 nt, Mycobacterium tuberculosis H37Rv
caccgcgccgagcagacgc

SEQ ID NO: 1299517 - RNA, 14 nt, Mycobacterium tuberculosis H37Rv
caccgcgccgacga

SEQ ID NO: 1299518 - RNA, 21 nt, Mycobacterium tuberculosis H37Rv
caccgcgccggagaucgucgc

SEQ ID NO: 1299519 - RNA, 13 nt, Mycobacterium tuberculosis H37Rv
caccgcgccgaac

SEQ ID NO: 1299520 - RNA, 14 nt, Mycobacterium tuberculosis H37Rv
caccgcgccagccu

SEQ ID NO: 1299521 - RNA, 12 nt, Mycobacterium tuberculosis H37Rv
caccgcgcauca

SEQ ID NO: 1299522 - RNA, 17 nt, Mycobacterium tuberculosis H37Rv
caccgcgcaucaucgcc

SEQ ID NO: 1299523 - RNA, 19 nt, Mycobacterium tuberculosis H37Rv
caccgccggcagcaucggc

SEQ ID NO: 1299524 - RNA, 15 nt, Mycobacterium tuberculosis H37Rv
caccgccggcaccgc

SEQ ID NO: 1299525 - RNA, 14 nt, Mycobacterium tuberculosis H37Rv
caccgccggccuug

SEQ ID NO: 1299526 - RNA, 19 nt, Mycobacterium tuberculosis H37Rv
caccgcgaucaccaccgga

SEQ ID NO: 1299527 - RNA, 20 nt, Mycobacterium tuberculosis H37Rv
caccgccggcgccgccgucg

SEQ ID NO: 1299528 - RNA, 18 nt, Mycobacterium tuberculosis H37Rv
caccgcagacgccgucug

SEQ ID NO: 1299529 - RNA, 18 nt, Mycobacterium tuberculosis H37Rv
caccgcaacucgccgaaa

SEQ ID NO: 1299530 - RNA, 20 nt, Mycobacterium tuberculosis H37Rv
caccgcaacgcuucggcagc

SEQ ID NO: 1299531 - RNA, 23 nt, Mycobacterium tuberculosis H37Rv
caccgcaaccaaagcgacgagca

SEQ ID NO: 1299532 - RNA, 18 nt, Mycobacterium tuberculosis H37Rv
caccgcaaccaaagcgac

SEQ ID NO: 1299533 - RNA, 19 nt, Mycobacterium tuberculosis H37Rv
caccgcauaacgccagucc

SEQ ID NO: 1299534 - RNA, 20 nt, Mycobacterium tuberculosis H37Rv
caccgagcgcaaucgaccac

SEQ ID NO: 1299535 - RNA, 22 nt, Mycobacterium tuberculosis H37Rv
caccgagcggugaauucggcga

SEQ ID NO: 1299536 - RNA, 14 nt, Mycobacterium tuberculosis H37Rv
caccgagcggugaa

SEQ ID NO: 1299537 - RNA, 13 nt, Mycobacterium tuberculosis H37Rv
caccgagcugagc

SEQ ID NO: 1299538 - RNA, 21 nt, Mycobacterium tuberculosis H37Rv
caccgagcaaacacgccucgc

SEQ ID NO: 1299539 - RNA, 13 nt, Mycobacterium tuberculosis H37Rv
caccgagccgucg

SEQ ID NO: 1299540 - RNA, 15 nt, Mycobacterium tuberculosis H37Rv
caccgagccgucguc

SEQ ID NO: 1299541 - RNA, 16 nt, Mycobacterium tuberculosis H37Rv
caccgagggcaaggac

SEQ ID NO: 1299542 - RNA, 17 nt, Mycobacterium tuberculosis H37Rv
caccgagucgacggcca

SEQ ID NO: 1299543 - RNA, 19 nt, Mycobacterium tuberculosis H37Rv
caccccaaaaccgccgguu

SEQ ID NO: 1299544 - RNA, 22 nt, Mycobacterium tuberculosis H37Rv
cacccccaccgaagcggugacc

SEQ ID NO: 1299545 - RNA, 15 nt, Mycobacterium tuberculosis H37Rv
caccccggcggcguc

SEQ ID NO: 1299546 - RNA, 12 nt, Mycobacterium tuberculosis H37Rv
caccgacaccgg

SEQ ID NO: 1299547 - RNA, 14 nt, Mycobacterium tuberculosis H37Rv
caccccggguacgc

SEQ ID NO: 1299548 - RNA, 23 nt, Mycobacterium tuberculosis H37Rv
caccccggugcccgcggugacga

SEQ ID NO: 1299549 - RNA, 19 nt, Mycobacterium tuberculosis H37Rv
caccgagaucaugccggcg

SEQ ID NO: 1299550 - RNA, 23 nt, Mycobacterium tuberculosis H37Rv
caccgagaucggacagguaacgc

SEQ ID NO: 1299551 - RNA, 12 nt, Mycobacterium tuberculosis H37Rv
caccgacgucgc

SEQ ID NO: 1299552 - RNA, 19 nt, Mycobacterium tuberculosis H37Rv
caccgacugcugucaccgc

SEQ ID NO: 1299553 - RNA, 21 nt, Mycobacterium tuberculosis H37Rv
caccgacagcacccaaugcca

SEQ ID NO: 1299554 - RNA, 14 nt, Mycobacterium tuberculosis H37Rv
caccgacaccggcc

SEQ ID NO: 1299555 - RNA, 12 nt, Mycobacterium tuberculosis H37Rv
caccgacaccgu

SEQ ID NO: 1299556 - RNA, 13 nt, Mycobacterium tuberculosis H37Rv
cacgccgaccagc

SEQ ID NO: 1299557 - RNA, 14 nt, Mycobacterium tuberculosis H37Rv
cacgccgaccagca

SEQ ID NO: 1299558 - RNA, 13 nt, Mycobacterium tuberculosis H37Rv
cacgccgaccaau

SEQ ID NO: 1299559 - RNA, 18 nt, Mycobacterium tuberculosis H37Rv
cacgcccucgucgaucgc

SEQ ID NO: 1299560 - RNA, 14 nt, Mycobacterium tuberculosis H37Rv
cacgcccggcgugg

SEQ ID NO: 1299561 - RNA, 19 nt, Mycobacterium tuberculosis H37Rv
cacgcccucgacgcgcucg

SEQ ID NO: 1299562 - RNA, 13 nt, Mycobacterium tuberculosis H37Rv
cacgcccggcgug

SEQ ID NO: 1299563 - RNA, 22 nt, Mycobacterium tuberculosis H37Rv
cacgccccgaucggugacgcgc

SEQ ID NO: 1299564 - RNA, 12 nt, Mycobacterium tuberculosis H37Rv
cacgcccgccug

SEQ ID NO: 1299565 - RNA, 15 nt, Mycobacterium tuberculosis H37Rv
cacgccgauucgccg

SEQ ID NO: 1299566 - RNA, 22 nt, Mycobacterium tuberculosis H37Rv
cacgccgaugcggugcggauca

SEQ ID NO: 1299567 - RNA, 13 nt, Mycobacterium tuberculosis H37Rv
cacgccgaucugg

SEQ ID NO: 1299568 - RNA, 13 nt, Mycobacterium tuberculosis H37Rv
cacgccgaugcgg

SEQ ID NO: 1299569 - RNA, 14 nt, Mycobacterium tuberculosis H37Rv
cacgccgccgacgu

SEQ ID NO: 1299570 - RNA, 13 nt, Mycobacterium tuberculosis H37Rv
cacgccgccguug

SEQ ID NO: 1299571 - RNA, 18 nt, Mycobacterium tuberculosis H37Rv
cacgccgccggugaacgu

SEQ ID NO: 1299572 - RNA, 16 nt, Mycobacterium tuberculosis H37Rv
cacgccgucaccgcug

SEQ ID NO: 1299573 - RNA, 16 nt, Mycobacterium tuberculosis H37Rv
cacgccgucgacaaca

SEQ ID NO: 1299574 - RNA, 14 nt, Mycobacterium tuberculosis H37Rv
cacgccucgccgaa

SEQ ID NO: 1299575 - RNA, 15 nt, Mycobacterium tuberculosis H37Rv
cacgccugggcgacg

SEQ ID NO: 1299576 - RNA, 14 nt, Mycobacterium tuberculosis H37Rv
cacgccugggcgac

SEQ ID NO: 1299577 - RNA, 15 nt, Mycobacterium tuberculosis H37Rv
cacgccuugagccga

SEQ ID NO: 1299578 - RNA, 19 nt, Mycobacterium tuberculosis H37Rv
cacgccugcucggagagca

SEQ ID NO: 1299579 - RNA, 22 nt, Mycobacterium tuberculosis H37Rv
cacgccugccgaaacgccgacc

SEQ ID NO: 1299580 - RNA, 19 nt, Mycobacterium tuberculosis H37Rv
cacgccugaacgacccgcu

SEQ ID NO: 1299581 - RNA, 13 nt, Mycobacterium tuberculosis H37Rv
cacgccggcaucg

SEQ ID NO: 1299582 - RNA, 14 nt, Mycobacterium tuberculosis H37Rv
cacgccggccagcg

SEQ ID NO: 1299583 - RNA, 16 nt, Mycobacterium tuberculosis H37Rv
cacgccggcccgguga

SEQ ID NO: 1299584 - RNA, 19 nt, Mycobacterium tuberculosis H37Rv
cacgccgggcaucggcggu

SEQ ID NO: 1299585 - RNA, 17 nt, Mycobacterium tuberculosis H37Rv
cacgccgggugccgcca

SEQ ID NO: 1299586 - RNA, 21 nt, Mycobacterium tuberculosis H37Rv
cacgccgggcaaggccaccgu

SEQ ID NO: 1299587 - RNA, 15 nt, Mycobacterium tuberculosis H37Rv
cacgccgggcaaggc

SEQ ID NO: 1299588 - RNA, 13 nt, Mycobacterium tuberculosis H37Rv
cacgccggcgcug

SEQ ID NO: 1299589 - RNA, 15 nt, Mycobacterium tuberculosis H37Rv
cacgcaaugucggca

SEQ ID NO: 1299590 - RNA, 13 nt, Mycobacterium tuberculosis H37Rv
cacgcacccggcg

SEQ ID NO: 1299591 - RNA, 16 nt, Mycobacterium tuberculosis H37Rv
cacgcacucgucgggg

SEQ ID NO: 1299592 - RNA, 19 nt, Mycobacterium tuberculosis H37Rv
cacgcaaccggcggacacc

SEQ ID NO: 1299593 - RNA, 18 nt, Mycobacterium tuberculosis H37Rv
cacgcaaaguucgucacc

SEQ ID NO: 1299594 - RNA, 20 nt, Mycobacterium tuberculosis H37Rv
cacgcaacaccgccaacucc

SEQ ID NO: 1299595 - RNA, 18 nt, Mycobacterium tuberculosis H37Rv
cacgcaaugucggcaggg

SEQ ID NO: 1299596 - RNA, 19 nt, Mycobacterium tuberculosis H37Rv
cacgcagccccucgucguc

SEQ ID NO: 1299597 - RNA, 12 nt, Mycobacterium tuberculosis H37Rv
cacgcagcacgg

SEQ ID NO: 1299598 - RNA, 14 nt, Mycobacterium tuberculosis H37Rv
cacgcacugccgcg

SEQ ID NO: 1299599 - RNA, 21 nt, Mycobacterium tuberculosis H37Rv
cacgcagcccgucggcgccga

SEQ ID NO: 1299600 - RNA, 17 nt, Mycobacterium tuberculosis H37Rv
cacgauguccucgaugc

SEQ ID NO: 1299601 - RNA, 19 nt, Mycobacterium tuberculosis H37Rv
cacgauguccucgaugcgg

SEQ ID NO: 1299602 - RNA, 23 nt, Mycobacterium tuberculosis H37Rv
cacgaugcccaagcccucgacgu

SEQ ID NO: 1299603 - RNA, 14 nt, Mycobacterium tuberculosis H37Rv
cacgaugaucccaa

SEQ ID NO: 1299604 - RNA, 22 nt, Mycobacterium tuberculosis H37Rv
cacgccaccgcggucaccgacg

SEQ ID NO: 1299605 - RNA, 21 nt, Mycobacterium tuberculosis H37Rv
cacgccacguccaacucggcc

SEQ ID NO: 1299606 - RNA, 15 nt, Mycobacterium tuberculosis H37Rv
cacgccaccgcaacu

SEQ ID NO: 1299607 - RNA, 21 nt, Mycobacterium tuberculosis H37Rv
cacgcaucgcgaagucgucca

SEQ ID NO: 1299608 - RNA, 14 nt, Mycobacterium tuberculosis H37Rv
cacgcagucgggca

SEQ ID NO: 1299609 - RNA, 19 nt, Mycobacterium tuberculosis H37Rv
cacgccauggaaacccucg

SEQ ID NO: 1299610 - RNA, 15 nt, Mycobacterium tuberculosis H37Rv
cacgcccgacgagga

SEQ ID NO: 1299611 - RNA, 17 nt, Mycobacterium tuberculosis H37Rv
cacgcccgacgccagcu

SEQ ID NO: 1299612 - RNA, 15 nt, Mycobacterium tuberculosis H37Rv
cacgccccgaucggu

SEQ ID NO: 1299613 - RNA, 14 nt, Mycobacterium tuberculosis H37Rv
cacgacgucaucgu

SEQ ID NO: 1299614 - RNA, 17 nt, Mycobacterium tuberculosis H37Rv
cacgacguccgaucggu

SEQ ID NO: 1299615 - RNA, 23 nt, Mycobacterium tuberculosis H37Rv
cacgacgugcgucggcccggugc

SEQ ID NO: 1299616 - RNA, 13 nt, Mycobacterium tuberculosis H37Rv
cacgacgcgacac

SEQ ID NO: 1299617 - RNA, 13 nt, Mycobacterium tuberculosis H37Rv
cacgacgggccga

SEQ ID NO: 1299618 - RNA, 21 nt, Mycobacterium tuberculosis H37Rv
cacgacgacuggacaggucgc

SEQ ID NO: 1299619 - RNA, 21 nt, Mycobacterium tuberculosis H37Rv
cacgacgccuugucggcgugu

SEQ ID NO: 1299620 - RNA, 13 nt, Mycobacterium tuberculosis H37Rv
cacgacgacgaca

SEQ ID NO: 1299621 - RNA, 19 nt, Mycobacterium tuberculosis H37Rv
cacgacgaauccccgacac

SEQ ID NO: 1299622 - RNA, 13 nt, Mycobacterium tuberculosis H37Rv
cacgaauccggcc

SEQ ID NO: 1299623 - RNA, 14 nt, Mycobacterium tuberculosis H37Rv
cacgaaggucgcgg

SEQ ID NO: 1299624 - RNA, 16 nt, Mycobacterium tuberculosis H37Rv
cacgacaacuucgccg

SEQ ID NO: 1299625 - RNA, 18 nt, Mycobacterium tuberculosis H37Rv
cacgacaacuucgccgga

SEQ ID NO: 1299626 - RNA, 21 nt, Mycobacterium tuberculosis H37Rv
cacgacagcagaguggugauc

SEQ ID NO: 1299627 - RNA, 19 nt, Mycobacterium tuberculosis H37Rv
cacgacaucgucgcgacga

SEQ ID NO: 1299628 - RNA, 22 nt, Mycobacterium tuberculosis H37Rv
cacgacccgggaaggaaccggg

SEQ ID NO: 1299629 - RNA, 13 nt, Mycobacterium tuberculosis H37Rv
cacgaccucggga

SEQ ID NO: 1299630 - RNA, 14 nt, Mycobacterium tuberculosis H37Rv
cacgaucacccgga

SEQ ID NO: 1299631 - RNA, 19 nt, Mycobacterium tuberculosis H37Rv
cacgaucacgucgucucgg

SEQ ID NO: 1299632 - RNA, 19 nt, Mycobacterium tuberculosis H37Rv
cacgauaucgaugcggcga

SEQ ID NO: 1299633 - RNA, 22 nt, Mycobacterium tuberculosis H37Rv
cacgaucaucgggguggccacc

SEQ ID NO: 1299634 - RNA, 14 nt, Mycobacterium tuberculosis H37Rv
cacgaucgcaccga

SEQ ID NO: 1299635 - RNA, 14 nt, Mycobacterium tuberculosis H37Rv
cacgaucgcgucgg

SEQ ID NO: 1299636 - RNA, 17 nt, Mycobacterium tuberculosis H37Rv
cacgaucgcggugaugg

SEQ ID NO: 1299637 - RNA, 23 nt, Mycobacterium tuberculosis H37Rv
cacgaucggcggggguggaauca

SEQ ID NO: 1299638 - RNA, 15 nt, Mycobacterium tuberculosis H37Rv
cacgaucgugccggg

SEQ ID NO: 1299639 - RNA, 16 nt, Mycobacterium tuberculosis H37Rv
cacgaucugcgcguca

SEQ ID NO: 1299640 - RNA, 21 nt, Mycobacterium tuberculosis H37Rv
cacgaucgugccgggaccggu

SEQ ID NO: 1299641 - RNA, 19 nt, Mycobacterium tuberculosis H37Rv
cacgaucucguggaucugc

SEQ ID NO: 1299642 - RNA, 21 nt, Mycobacterium tuberculosis H37Rv
cacgagggccacguagcagca

SEQ ID NO: 1299643 - RNA, 19 nt, Mycobacterium tuberculosis H37Rv
cacgaggcuugcggcacaa

SEQ ID NO: 1299644 - RNA, 21 nt, Mycobacterium tuberculosis H37Rv
cacgagucgccagaccgcacc

SEQ ID NO: 1299645 - RNA, 18 nt, Mycobacterium tuberculosis H37Rv
cacgagccaacaagucga

SEQ ID NO: 1299646 - RNA, 21 nt, Mycobacterium tuberculosis H37Rv
cacgagcaugcuggaccucgc

SEQ ID NO: 1299647 - RNA, 15 nt, Mycobacterium tuberculosis H37Rv
cacgagcggcggugg

SEQ ID NO: 1299648 - RNA, 13 nt, Mycobacterium tuberculosis H37Rv
cacgaggcguuca

SEQ ID NO: 1299649 - RNA, 16 nt, Mycobacterium tuberculosis H37Rv
cacgaggcuugcggca

SEQ ID NO: 1299650 - RNA, 17 nt, Mycobacterium tuberculosis H37Rv
cacgacguucgacgaca

SEQ ID NO: 1299651 - RNA, 15 nt, Mycobacterium tuberculosis H37Rv
cacgacgucggugaa

SEQ ID NO: 1299652 - RNA, 22 nt, Mycobacterium tuberculosis H37Rv
cacgacugcggcaaacgugauc

SEQ ID NO: 1299653 - RNA, 16 nt, Mycobacterium tuberculosis H37Rv
cacgagagcgcugucc

SEQ ID NO: 1299654 - RNA, 14 nt, Mycobacterium tuberculosis H37Rv
cacgagcagccgau

SEQ ID NO: 1299655 - RNA, 18 nt, Mycobacterium tuberculosis H37Rv
caccuugucaaaggugca

SEQ ID NO: 1299656 - RNA, 13 nt, Mycobacterium tuberculosis H37Rv
caccuuggccggg

SEQ ID NO: 1299657 - RNA, 19 nt, Mycobacterium tuberculosis H37Rv
caccuugccgaacacucgc

SEQ ID NO: 1299658 - RNA, 16 nt, Mycobacterium tuberculosis H37Rv
cacgaacgcgcgcagc

SEQ ID NO: 1299659 - RNA, 18 nt, Mycobacterium tuberculosis H37Rv
cacgaagaccaggccggu

SEQ ID NO: 1299660 - RNA, 19 nt, Mycobacterium tuberculosis H37Rv
cacgaacaucagaucgccg

SEQ ID NO: 1299661 - RNA, 20 nt, Mycobacterium tuberculosis H37Rv
cacgaaccgugcugggcauc

SEQ ID NO: 1299662 - RNA, 14 nt, Mycobacterium tuberculosis H37Rv
caccuucaccgggu

SEQ ID NO: 1299663 - RNA, 16 nt, Mycobacterium tuberculosis H37Rv
caccuggcgugucgcc

SEQ ID NO: 1299664 - RNA, 23 nt, Mycobacterium tuberculosis H37Rv
caccuggucggccgcaaggcgcc

SEQ ID NO: 1299665 - RNA, 22 nt, Mycobacterium tuberculosis H37Rv
caccugcgaugaugugcgacca

SEQ ID NO: 1299666 - RNA, 21 nt, Mycobacterium tuberculosis H37Rv
caccugcggcugcuuggucgc

SEQ ID NO: 1299667 - RNA, 16 nt, Mycobacterium tuberculosis H37Rv
caccugcgggcccacg

SEQ ID NO: 1299668 - RNA, 22 nt, Mycobacterium tuberculosis H37Rv
caccuggaguccagcucgggca

SEQ ID NO: 1299669 - RNA, 13 nt, Mycobacterium tuberculosis H37Rv
caccuggaucagc

SEQ ID NO: 1299670 - RNA, 16 nt, Mycobacterium tuberculosis H37Rv
caccuggaaggucagc

SEQ ID NO: 1299671 - RNA, 18 nt, Mycobacterium tuberculosis H37Rv
caccugcucgucggucac

SEQ ID NO: 1299672 - RNA, 16 nt, Mycobacterium tuberculosis H37Rv
cacccauaccuucggc

SEQ ID NO: 1299673 - RNA, 20 nt, Mycobacterium tuberculosis H37Rv
cacccaucaacgccggcgac

SEQ ID NO: 1299674 - RNA, 21 nt, Mycobacterium tuberculosis H37Rv
cacccauaccuucggcgaucu

SEQ ID NO: 1299675 - RNA, 15 nt, Mycobacterium tuberculosis H37Rv
cacccaucaacgccg

SEQ ID NO: 1299676 - RNA, 17 nt, Mycobacterium tuberculosis H37Rv
cacccaucgaccgcccg

SEQ ID NO: 1299677 - RNA, 14 nt, Mycobacterium tuberculosis H37Rv
cacccagaccgccg

SEQ ID NO: 1299678 - RNA, 22 nt, Mycobacterium tuberculosis H37Rv
cacccagcggcgugacgucguc

SEQ ID NO: 1299679 - RNA, 21 nt, Mycobacterium tuberculosis H37Rv
cacccagccggaaccggacag

SEQ ID NO: 1299680 - RNA, 20 nt, Mycobacterium tuberculosis H37Rv
cacccaggccauaccgcaau

SEQ ID NO: 1299681 - RNA, 20 nt, Mycobacterium tuberculosis H37Rv
caccaugaucacaccgagcg

SEQ ID NO: 1299682 - RNA, 17 nt, Mycobacterium tuberculosis H37Rv
cacccaacuccaucagc

SEQ ID NO: 1299683 - RNA, 14 nt, Mycobacterium tuberculosis H37Rv
cacccaacccggcg

SEQ ID NO: 1299684 - RNA, 14 nt, Mycobacterium tuberculosis H37Rv
cacccaaugccacc

SEQ ID NO: 1299685 - RNA, 17 nt, Mycobacterium tuberculosis H37Rv
cacccaauggagccgcg

SEQ ID NO: 1299686 - RNA, 16 nt, Mycobacterium tuberculosis H37Rv
cacccaauggagccgc

SEQ ID NO: 1299687 - RNA, 16 nt, Mycobacterium tuberculosis H37Rv
cacccacauggugauc

SEQ ID NO: 1299688 - RNA, 21 nt, Mycobacterium tuberculosis H37Rv
cacccacccguucggcugcgc

SEQ ID NO: 1299689 - RNA, 15 nt, Mycobacterium tuberculosis H37Rv
cacccacccgcggua

SEQ ID NO: 1299690 - RNA, 14 nt, Mycobacterium tuberculosis H37Rv
cacccaccggccac

SEQ ID NO: 1299691 - RNA, 13 nt, Mycobacterium tuberculosis H37Rv
cacccacgccgac

SEQ ID NO: 1299692 - RNA, 15 nt, Mycobacterium tuberculosis H37Rv
cacccacgugcugcc

SEQ ID NO: 1299693 - RNA, 12 nt, Mycobacterium tuberculosis H37Rv
caccaucaucac

SEQ ID NO: 1299694 - RNA, 15 nt, Mycobacterium tuberculosis H37Rv
caccaguccagcggg

SEQ ID NO: 1299695 - RNA, 15 nt, Mycobacterium tuberculosis H37Rv
caccagucgcgcagc

SEQ ID NO: 1299696 - RNA, 14 nt, Mycobacterium tuberculosis H37Rv
caccaguaccaccg

SEQ ID NO: 1299697 - RNA, 17 nt, Mycobacterium tuberculosis H37Rv
caccaucgccucggcgc

SEQ ID NO: 1299698 - RNA, 23 nt, Mycobacterium tuberculosis H37Rv
caccaucguugccggugccgccg

SEQ ID NO: 1299699 - RNA, 14 nt, Mycobacterium tuberculosis H37Rv
caccaccgcccgca

SEQ ID NO: 1299700 - RNA, 21 nt, Mycobacterium tuberculosis H37Rv
caccaccgucgagccggacag

SEQ ID NO: 1299701 - RNA, 13 nt, Mycobacterium tuberculosis H37Rv
caccaccucguca

SEQ ID NO: 1299702 - RNA, 19 nt, Mycobacterium tuberculosis H37Rv
caccaccuccccgaucugc

SEQ ID NO: 1299703 - RNA, 18 nt, Mycobacterium tuberculosis H37Rv
caccacgaacacguucgg

SEQ ID NO: 1299704 - RNA, 18 nt, Mycobacterium tuberculosis H37Rv
caccagaucuucgagcgc

SEQ ID NO: 1299705 - RNA, 13 nt, Mycobacterium tuberculosis H37Rv
caccagaucaaca

SEQ ID NO: 1299706 - RNA, 23 nt, Mycobacterium tuberculosis H37Rv
caccagaucguuccaggccgcgu

SEQ ID NO: 1299707 - RNA, 18 nt, Mycobacterium tuberculosis H37Rv
caccagaaccagcgaccu

SEQ ID NO: 1299708 - RNA, 17 nt, Mycobacterium tuberculosis H37Rv
caccagaaacaccgacg

SEQ ID NO: 1299709 - RNA, 14 nt, Mycobacterium tuberculosis H37Rv
caccacuucggcgc

SEQ ID NO: 1299710 - RNA, 22 nt, Mycobacterium tuberculosis H37Rv
caccacuuggguggcgccguug

SEQ ID NO: 1299711 - RNA, 15 nt, Mycobacterium tuberculosis H37Rv
caccagacaacgccg

SEQ ID NO: 1299712 - RNA, 23 nt, Mycobacterium tuberculosis H37Rv
caccagcgcgccguagaccagca

SEQ ID NO: 1299713 - RNA, 15 nt, Mycobacterium tuberculosis H37Rv
caccagcgcuccagc

SEQ ID NO: 1299714 - RNA, 20 nt, Mycobacterium tuberculosis H37Rv
caccagcggcaccgcggcca

SEQ ID NO: 1299715 - RNA, 16 nt, Mycobacterium tuberculosis H37Rv
caccagcugcucgucg

SEQ ID NO: 1299716 - RNA, 17 nt, Mycobacterium tuberculosis H37Rv
caccagcuggaacggca

SEQ ID NO: 1299717 - RNA, 14 nt, Mycobacterium tuberculosis H37Rv
caccaacgccaccg

SEQ ID NO: 1299718 - RNA, 17 nt, Mycobacterium tuberculosis H37Rv
caccaagguuggucggu

SEQ ID NO: 1299719 - RNA, 17 nt, Mycobacterium tuberculosis H37Rv
caccacaccggagccga

SEQ ID NO: 1299720 - RNA, 12 nt, Mycobacterium tuberculosis H37Rv
caccacccgauu

SEQ ID NO: 1299721 - RNA, 18 nt, Mycobacterium tuberculosis H37Rv
caccaccccgaggccgac

SEQ ID NO: 1299722 - RNA, 14 nt, Mycobacterium tuberculosis H37Rv
caccacccaggcca

SEQ ID NO: 1299723 - RNA, 20 nt, Mycobacterium tuberculosis H37Rv
caccacccgggccucggcgc

SEQ ID NO: 1299724 - RNA, 14 nt, Mycobacterium tuberculosis H37Rv
caccacccgucggc

SEQ ID NO: 1299725 - RNA, 21 nt, Mycobacterium tuberculosis H37Rv
caccacccggcgaacccagcg

SEQ ID NO: 1299726 - RNA, 19 nt, Mycobacterium tuberculosis H37Rv
caccacauuggcgaucagc

SEQ ID NO: 1299727 - RNA, 21 nt, Mycobacterium tuberculosis H37Rv
caccacauuggcgaucagcag

SEQ ID NO: 1299728 - RNA, 22 nt, Mycobacterium tuberculosis H37Rv
caccacaucggugccacguucg

SEQ ID NO: 1299729 - RNA, 12 nt, Mycobacterium tuberculosis H37Rv
cacaucgcacgg

SEQ ID NO: 1299730 - RNA, 23 nt, Mycobacterium tuberculosis H37Rv
cacauccuggcggcugcagccga

SEQ ID NO: 1299731 - RNA, 22 nt, Mycobacterium tuberculosis H37Rv
cacaucggugguuagguggcug

SEQ ID NO: 1299732 - RNA, 20 nt, Mycobacterium tuberculosis H37Rv
cacaucggugccacguucgc

SEQ ID NO: 1299733 - RNA, 17 nt, Mycobacterium tuberculosis H37Rv
caccaacgucgaugucc

SEQ ID NO: 1299734 - RNA, 16 nt, Mycobacterium tuberculosis H37Rv
cacaugacgaucgcgg

SEQ ID NO: 1299735 - RNA, 15 nt, Mycobacterium tuberculosis H37Rv
caccaaccucaucgc

SEQ ID NO: 1299736 - RNA, 14 nt, Mycobacterium tuberculosis H37Rv
caccaacgacagcg

SEQ ID NO: 1299737 - RNA, 15 nt, Mycobacterium tuberculosis H37Rv
cacaugacgaucgcg

SEQ ID NO: 1299738 - RNA, 17 nt, Mycobacterium tuberculosis H37Rv
cacaugaacgaccaccg

SEQ ID NO: 1299739 - RNA, 12 nt, Mycobacterium tuberculosis H37Rv
cacaucgucggc

SEQ ID NO: 1299740 - RNA, 13 nt, Mycobacterium tuberculosis H37Rv
cacagucgcucgc

SEQ ID NO: 1299741 - RNA, 17 nt, Mycobacterium tuberculosis H37Rv
cacagucggugcagcgc

SEQ ID NO: 1299742 - RNA, 23 nt, Mycobacterium tuberculosis H37Rv
cacagguacuuugcgcccggcac

SEQ ID NO: 1299743 - RNA, 21 nt, Mycobacterium tuberculosis H37Rv
cacagcggccauaucgcccac

SEQ ID NO: 1299744 - RNA, 12 nt, Mycobacterium tuberculosis H37Rv
cacagcggcgau

SEQ ID NO: 1299745 - RNA, 16 nt, Mycobacterium tuberculosis H37Rv
cacagcggcgauuggc

SEQ ID NO: 1299746 - RNA, 21 nt, Mycobacterium tuberculosis H37Rv
cacaggggcagcgcggccacc

SEQ ID NO: 1299747 - RNA, 17 nt, Mycobacterium tuberculosis H37Rv
cacaggcuuuuccggcg

SEQ ID NO: 1299748 - RNA, 16 nt, Mycobacterium tuberculosis H37Rv
cacacgcccucgacgc

SEQ ID NO: 1299749 - RNA, 19 nt, Mycobacterium tuberculosis H37Rv
cacacgcucacgggcucca

SEQ ID NO: 1299750 - RNA, 16 nt, Mycobacterium tuberculosis H37Rv
cacaccgugaccagcc

SEQ ID NO: 1299751 - RNA, 20 nt, Mycobacterium tuberculosis H37Rv
cacaccgugaccagccggug

SEQ ID NO: 1299752 - RNA, 23 nt, Mycobacterium tuberculosis H37Rv
cacaccgucgucguacggcucau

SEQ ID NO: 1299753 - RNA, 21 nt, Mycobacterium tuberculosis H37Rv
cacaccgucgcgcucgcacca

SEQ ID NO: 1299754 - RNA, 16 nt, Mycobacterium tuberculosis H37Rv
cacaccgucgcaccca

SEQ ID NO: 1299755 - RNA, 19 nt, Mycobacterium tuberculosis H37Rv
cacaccguccgucggcgcu

SEQ ID NO: 1299756 - RNA, 19 nt, Mycobacterium tuberculosis H37Rv
cacaccgguugacagcucc

SEQ ID NO: 1299757 - RNA, 19 nt, Mycobacterium tuberculosis H37Rv
cacaccgggcaccagucgc

SEQ ID NO: 1299758 - RNA, 15 nt, Mycobacterium tuberculosis H37Rv
cacacccccgucugc

SEQ ID NO: 1299759 - RNA, 13 nt, Mycobacterium tuberculosis H37Rv
cacacccugcagc

SEQ ID NO: 1299760 - RNA, 15 nt, Mycobacterium tuberculosis H37Rv
cacaccgaucggcaa

SEQ ID NO: 1299761 - RNA, 21 nt, Mycobacterium tuberculosis H37Rv
cacaccgccagcggcaauggc

SEQ ID NO: 1299762 - RNA, 13 nt, Mycobacterium tuberculosis H37Rv
cacacccagcgug

SEQ ID NO: 1299763 - RNA, 21 nt, Mycobacterium tuberculosis H37Rv
cacaccgagcgcaaucgacca

SEQ ID NO: 1299764 - RNA, 14 nt, Mycobacterium tuberculosis H37Rv
cacaccgagcgcaa

SEQ ID NO: 1299765 - RNA, 16 nt, Mycobacterium tuberculosis H37Rv
cacacggucgucgcga

SEQ ID NO: 1299766 - RNA, 17 nt, Mycobacterium tuberculosis H37Rv
cacacucccgcgcccga

SEQ ID NO: 1299767 - RNA, 23 nt, Mycobacterium tuberculosis H37Rv
cacagaaucgcccauuucggcac

SEQ ID NO: 1299768 - RNA, 16 nt, Mycobacterium tuberculosis H37Rv
cacacuugcaacucgc

SEQ ID NO: 1299769 - RNA, 16 nt, Mycobacterium tuberculosis H37Rv
cacagaacucaccgac

SEQ ID NO: 1299770 - RNA, 17 nt, Mycobacterium tuberculosis H37Rv
cacacugccgcgcucgc

SEQ ID NO: 1299771 - RNA, 18 nt, Mycobacterium tuberculosis H37Rv
cacacugccgcgcucgcg

SEQ ID NO: 1299772 - RNA, 20 nt, Mycobacterium tuberculosis H37Rv
cacacuguuacuccgacggc

SEQ ID NO: 1299773 - RNA, 14 nt, Mycobacterium tuberculosis H37Rv
cacagcgaacagac

SEQ ID NO: 1299774 - RNA, 18 nt, Mycobacterium tuberculosis H37Rv
cacagcgaccaucgccga

SEQ ID NO: 1299775 - RNA, 14 nt, Mycobacterium tuberculosis H37Rv
cacagcggagacga

SEQ ID NO: 1299776 - RNA, 16 nt, Mycobacterium tuberculosis H37Rv
cacagcaacgcccaac

SEQ ID NO: 1299777 - RNA, 12 nt, Mycobacterium tuberculosis H37Rv
cacagcaccacg

SEQ ID NO: 1299778 - RNA, 20 nt, Mycobacterium tuberculosis H37Rv
cacagcaccacaucgaaggu

SEQ ID NO: 1299779 - RNA, 20 nt, Mycobacterium tuberculosis H37Rv
cacagcaccguccucgguca

SEQ ID NO: 1299780 - RNA, 22 nt, Mycobacterium tuberculosis H37Rv
caaugccggaucgggaccggga

SEQ ID NO: 1299781 - RNA, 18 nt, Mycobacterium tuberculosis H37Rv
caaugcccuuggccagca

SEQ ID NO: 1299782 - RNA, 21 nt, Mycobacterium tuberculosis H37Rv
caaugcccuuggccagcaggg

SEQ ID NO: 1299783 - RNA, 20 nt, Mycobacterium tuberculosis H37Rv
caaugcgcgcgauggcgcgu

SEQ ID NO: 1299784 - RNA, 12 nt, Mycobacterium tuberculosis H37Rv
caaugacaccgg

SEQ ID NO: 1299785 - RNA, 23 nt, Mycobacterium tuberculosis H37Rv
caaucgguggucguaggugacga

SEQ ID NO: 1299786 - RNA, 22 nt, Mycobacterium tuberculosis H37Rv
caaugagaucgggaccgacuuc

SEQ ID NO: 1299787 - RNA, 22 nt, Mycobacterium tuberculosis H37Rv
caaucggauagguggcgccacu

SEQ ID NO: 1299788 - RNA, 20 nt, Mycobacterium tuberculosis H37Rv
caauaccgccagcgccaccg

SEQ ID NO: 1299789 - RNA, 23 nt, Mycobacterium tuberculosis H37Rv
caauacccgagcguccggugguc

SEQ ID NO: 1299790 - RNA, 19 nt, Mycobacterium tuberculosis H37Rv
caauccaaggcucagcagc

SEQ ID NO: 1299791 - RNA, 14 nt, Mycobacterium tuberculosis H37Rv
caaucgcgacgggg

SEQ ID NO: 1299792 - RNA, 16 nt, Mycobacterium tuberculosis H37Rv
caaucgcgugcuggaa

SEQ ID NO: 1299793 - RNA, 19 nt, Mycobacterium tuberculosis H37Rv
caauccacgcacucgucgg

SEQ ID NO: 1299794 - RNA, 21 nt, Mycobacterium tuberculosis H37Rv
caauguccaggcgcgcaccac

SEQ ID NO: 1299795 - RNA, 20 nt, Mycobacterium tuberculosis H37Rv
caauguccaggcgcgcacca

SEQ ID NO: 1299796 - RNA, 20 nt, Mycobacterium tuberculosis H37Rv
caaugucggcagggccccca

SEQ ID NO: 1299797 - RNA, 21 nt, Mycobacterium tuberculosis H37Rv
caauugcgguucgaacgcgau

SEQ ID NO: 1299798 - RNA, 13 nt, Mycobacterium tuberculosis H37Rv
caauuucacugcg

SEQ ID NO: 1299799 - RNA, 16 nt, Mycobacterium tuberculosis H37Rv
cacaaccgugagcacc

SEQ ID NO: 1299800 - RNA, 22 nt, Mycobacterium tuberculosis H37Rv
cacaacgaucugcuggccgaac

SEQ ID NO: 1299801 - RNA, 19 nt, Mycobacterium tuberculosis H37Rv
cacaauggcggcgccgucg

SEQ ID NO: 1299802 - RNA, 23 nt, Mycobacterium tuberculosis H37Rv
cacaauggcucugaggucaccgg

SEQ ID NO: 1299803 - RNA, 13 nt, Mycobacterium tuberculosis H37Rv
cacaccaggccga

SEQ ID NO: 1299804 - RNA, 21 nt, Mycobacterium tuberculosis H37Rv
cacaccagcuuguagcgcucg

SEQ ID NO: 1299805 - RNA, 15 nt, Mycobacterium tuberculosis H37Rv
cacaccagcggucgg

SEQ ID NO: 1299806 - RNA, 23 nt, Mycobacterium tuberculosis H37Rv
cacacaauucgggcgugaguggc

SEQ ID NO: 1299807 - RNA, 22 nt, Mycobacterium tuberculosis H37Rv
cacaccaacaccgcggcgcuga

SEQ ID NO: 1299808 - RNA, 17 nt, Mycobacterium tuberculosis H37Rv
cacacagucacggaccg

SEQ ID NO: 1299809 - RNA, 15 nt, Mycobacterium tuberculosis H37Rv
cacaccacgauggcg

SEQ ID NO: 1299810 - RNA, 14 nt, Mycobacterium tuberculosis H37Rv
cacaccacgauggc

SEQ ID NO: 1299811 - RNA, 13 nt, Mycobacterium tuberculosis H37Rv
cacaagucgacac

SEQ ID NO: 1299812 - RNA, 20 nt, Mycobacterium tuberculosis H37Rv
cacaauccacgucgcggcgu

SEQ ID NO: 1299813 - RNA, 22 nt, Mycobacterium tuberculosis H37Rv
cacaacugauggcgcgcaacga

SEQ ID NO: 1299814 - RNA, 13 nt, Mycobacterium tuberculosis H37Rv
cacaacgucggca

SEQ ID NO: 1299815 - RNA, 13 nt, Mycobacterium tuberculosis H37Rv
cacaacgcgacgc

SEQ ID NO: 1299816 - RNA, 20 nt, Mycobacterium tuberculosis H37Rv
cacaacgccucgccauccau

SEQ ID NO: 1299817 - RNA, 20 nt, Mycobacterium tuberculosis H37Rv
cacaagcugacacgacgaac

SEQ ID NO: 1299818 - RNA, 20 nt, Mycobacterium tuberculosis H37Rv
caacucguccagcagugcga

SEQ ID NO: 1299819 - RNA, 21 nt, Mycobacterium tuberculosis H37Rv
caacuggugggccaucgucag

SEQ ID NO: 1299820 - RNA, 16 nt, Mycobacterium tuberculosis H37Rv
caacuguccugccaga

SEQ ID NO: 1299821 - RNA, 15 nt, Mycobacterium tuberculosis H37Rv
caacuggugggccau

SEQ ID NO: 1299822 - RNA, 20 nt, Mycobacterium tuberculosis H37Rv
caacuggucgccaacgccag

SEQ ID NO: 1299823 - RNA, 13 nt, Mycobacterium tuberculosis H37Rv
caacuggucgcca

SEQ ID NO: 1299824 - RNA, 15 nt, Mycobacterium tuberculosis H37Rv
caacagaugccaccc

SEQ ID NO: 1299825 - RNA, 22 nt, Mycobacterium tuberculosis H37Rv
caacagauccgacgaccgcauu

SEQ ID NO: 1299826 - RNA, 17 nt, Mycobacterium tuberculosis H37Rv
caacagcaccgcgacga

SEQ ID NO: 1299827 - RNA, 23 nt, Mycobacterium tuberculosis H37Rv
caacagcacccgggccacgucga

SEQ ID NO: 1299828 - RNA, 16 nt, Mycobacterium tuberculosis H37Rv
caacagcacguacugc

SEQ ID NO: 1299829 - RNA, 20 nt, Mycobacterium tuberculosis H37Rv
caacucgagaguggccucgu

SEQ ID NO: 1299830 - RNA, 23 nt, Mycobacterium tuberculosis H37Rv
caacucgccacggucgccgacca

SEQ ID NO: 1299831 - RNA, 23 nt, Mycobacterium tuberculosis H37Rv
caacucggccacggcgucggcca

SEQ ID NO: 1299832 - RNA, 23 nt, Mycobacterium tuberculosis H37Rv
caacucggugacguuggcaggca

SEQ ID NO: 1299833 - RNA, 20 nt, Mycobacterium tuberculosis H37Rv
caagcagacgcagaaucgca

SEQ ID NO: 1299834 - RNA, 17 nt, Mycobacterium tuberculosis H37Rv
caagcagucgguauagc

SEQ ID NO: 1299835 - RNA, 16 nt, Mycobacterium tuberculosis H37Rv
caagcaguccacgagc

SEQ ID NO: 1299836 - RNA, 23 nt, Mycobacterium tuberculosis H37Rv
caagcccgccggacccgccgggu

SEQ ID NO: 1299837 - RNA, 23 nt, Mycobacterium tuberculosis H37Rv
caagcccaaaaagaccgccgcug

SEQ ID NO: 1299838 - RNA, 17 nt, Mycobacterium tuberculosis H37Rv
caagauccgccacgcuc

SEQ ID NO: 1299839 - RNA, 20 nt, Mycobacterium tuberculosis H37Rv
caagauggcccgucgugacc

SEQ ID NO: 1299840 - RNA, 16 nt, Mycobacterium tuberculosis H37Rv
caagcaaugggcggac

SEQ ID NO: 1299841 - RNA, 14 nt, Mycobacterium tuberculosis H37Rv
caagcaaccggugc

SEQ ID NO: 1299842 - RNA, 21 nt, Mycobacterium tuberculosis H37Rv
caacuuggggucguucgccga

SEQ ID NO: 1299843 - RNA, 15 nt, Mycobacterium tuberculosis H37Rv
caagaaccacgacgu

SEQ ID NO: 1299844 - RNA, 18 nt, Mycobacterium tuberculosis H37Rv
caagcccuuaucuccggc

SEQ ID NO: 1299845 - RNA, 13 nt, Mycobacterium tuberculosis H37Rv
caagcggacccga

SEQ ID NO: 1299846 - RNA, 23 nt, Mycobacterium tuberculosis H37Rv
caagcggacccgaccgucgucgu

SEQ ID NO: 1299847 - RNA, 22 nt, Mycobacterium tuberculosis H37Rv
caagcggguuguggcacccggc

SEQ ID NO: 1299848 - RNA, 17 nt, Mycobacterium tuberculosis H37Rv
caagcggguuguggcac

SEQ ID NO: 1299849 - RNA, 16 nt, Mycobacterium tuberculosis H37Rv
caaggucggccaggcu

SEQ ID NO: 1299850 - RNA, 15 nt, Mycobacterium tuberculosis H37Rv
caagguggcaugcga

SEQ ID NO: 1299851 - RNA, 22 nt, Mycobacterium tuberculosis H37Rv
caaggucugccgggcgcgcgua

SEQ ID NO: 1299852 - RNA, 14 nt, Mycobacterium tuberculosis H37Rv
caagguggccacca

SEQ ID NO: 1299853 - RNA, 24 nt, Mycobacterium tuberculosis H37Rv
caagguggcaugcgacagaugccg

SEQ ID NO: 1299854 - RNA, 20 nt, Mycobacterium tuberculosis H37Rv
caaguucgccgauaucgcag

SEQ ID NO: 1299855 - RNA, 17 nt, Mycobacterium tuberculosis H37Rv
caaguugagcagcuugg

SEQ ID NO: 1299856 - RNA, 19 nt, Mycobacterium tuberculosis H37Rv
augcgggcgaucucgaugu

SEQ ID NO: 1299857 - RNA, 14 nt, Mycobacterium tuberculosis H37Rv
augcgggcagcgau

SEQ ID NO: 1299858 - RNA, 23 nt, Mycobacterium tuberculosis H37Rv
augcggcggcgcucgucgaucuc

SEQ ID NO: 1299859 - RNA, 13 nt, Mycobacterium tuberculosis H37Rv
augcggccggaug

SEQ ID NO: 1299860 - RNA, 19 nt, Mycobacterium tuberculosis H37Rv
augcgacgaaccucggcgg

SEQ ID NO: 1299861 - RNA, 12 nt, Mycobacterium tuberculosis H37Rv
augcgccccgga

SEQ ID NO: 1299862 - RNA, 12 nt, Mycobacterium tuberculosis H37Rv
augccggcaagc

SEQ ID NO: 1299863 - RNA, 16 nt, Mycobacterium tuberculosis H37Rv
augccuugaaacggug

SEQ ID NO: 1299864 - RNA, 14 nt, Mycobacterium tuberculosis H37Rv
augccgccggcacc

SEQ ID NO: 1299865 - RNA, 16 nt, Mycobacterium tuberculosis H37Rv
augccgccggcaccgc

SEQ ID NO: 1299866 - RNA, 19 nt, Mycobacterium tuberculosis H37Rv
augccgcccgcagcgucag

SEQ ID NO: 1299867 - RNA, 20 nt, Mycobacterium tuberculosis H37Rv
augccgcccgcagcgucagc

SEQ ID NO: 1299868 - RNA, 13 nt, Mycobacterium tuberculosis H37Rv
augccgccgaaga

SEQ ID NO: 1299869 - RNA, 17 nt, Mycobacterium tuberculosis H37Rv
augccgccgacgggaac

SEQ ID NO: 1299870 - RNA, 19 nt, Mycobacterium tuberculosis H37Rv
augccgcccagcgaccgcu

SEQ ID NO: 1299871 - RNA, 15 nt, Mycobacterium tuberculosis H37Rv
augccgcccaucacc

SEQ ID NO: 1299872 - RNA, 15 nt, Mycobacterium tuberculosis H37Rv
augcccgcggugacc

SEQ ID NO: 1299873 - RNA, 15 nt, Mycobacterium tuberculosis H37Rv
augcccgcaccgcgu

SEQ ID NO: 1299874 - RNA, 19 nt, Mycobacterium tuberculosis H37Rv
augcccgacgagucgccgc

SEQ ID NO: 1299875 - RNA, 22 nt, Mycobacterium tuberculosis H37Rv
augcccgacugaacgucaccgu

SEQ ID NO: 1299876 - RNA, 15 nt, Mycobacterium tuberculosis H37Rv
augcccuuggcgaug

SEQ ID NO: 1299877 - RNA, 18 nt, Mycobacterium tuberculosis H37Rv
augcccuuguaggccauc

SEQ ID NO: 1299878 - RNA, 19 nt, Mycobacterium tuberculosis H37Rv
augcccgccaauccgcguc

SEQ ID NO: 1299879 - RNA, 16 nt, Mycobacterium tuberculosis H37Rv
augccauuucgucguc

SEQ ID NO: 1299880 - RNA, 15 nt, Mycobacterium tuberculosis H37Rv
augccagugacaacc

SEQ ID NO: 1299881 - RNA, 21 nt, Mycobacterium tuberculosis H37Rv
augccauagaugcccgcgauc

SEQ ID NO: 1299882 - RNA, 13 nt, Mycobacterium tuberculosis H37Rv
augccagcggcac

SEQ ID NO: 1299883 - RNA, 15 nt, Mycobacterium tuberculosis H37Rv
augccagaucggcca

SEQ ID NO: 1299884 - RNA, 17 nt, Mycobacterium tuberculosis H37Rv
augcauggcuugcucug

SEQ ID NO: 1299885 - RNA, 16 nt, Mycobacterium tuberculosis H37Rv
augccacagcggcgau

SEQ ID NO: 1299886 - RNA, 18 nt, Mycobacterium tuberculosis H37Rv
auggcaagggccgacguc

SEQ ID NO: 1299887 - RNA, 13 nt, Mycobacterium tuberculosis H37Rv
auggcaagccguu

SEQ ID NO: 1299888 - RNA, 19 nt, Mycobacterium tuberculosis H37Rv
auggccgaguccggcaaga

SEQ ID NO: 1299889 - RNA, 21 nt, Mycobacterium tuberculosis H37Rv
auggccgaaccguucggcgac

SEQ ID NO: 1299890 - RNA, 19 nt, Mycobacterium tuberculosis H37Rv
auggcccggcucacagcac

SEQ ID NO: 1299891 - RNA, 16 nt, Mycobacterium tuberculosis H37Rv
auggcccgucgugacc

SEQ ID NO: 1299892 - RNA, 14 nt, Mycobacterium tuberculosis H37Rv
auggcaucggccug

SEQ ID NO: 1299893 - RNA, 23 nt, Mycobacterium tuberculosis H37Rv
auggcauuccguuuuuguugacc

SEQ ID NO: 1299894 - RNA, 22 nt, Mycobacterium tuberculosis H37Rv
auggcauugcgcccaccgaaac

SEQ ID NO: 1299895 - RNA, 13 nt, Mycobacterium tuberculosis H37Rv
auggccgcgauga

SEQ ID NO: 1299896 - RNA, 16 nt, Mycobacterium tuberculosis H37Rv
auggccgccaccgcga

SEQ ID NO: 1299897 - RNA, 14 nt, Mycobacterium tuberculosis H37Rv
auggccgccgacaa

SEQ ID NO: 1299898 - RNA, 23 nt, Mycobacterium tuberculosis H37Rv
auggccgcgcccgccucgaccgc

SEQ ID NO: 1299899 - RNA, 18 nt, Mycobacterium tuberculosis H37Rv
auggcgcaccggcgucgg

SEQ ID NO: 1299900 - RNA, 16 nt, Mycobacterium tuberculosis H37Rv
auggcgcgaacgucag

SEQ ID NO: 1299901 - RNA, 15 nt, Mycobacterium tuberculosis H37Rv
auggaucucggcguc

SEQ ID NO: 1299902 - RNA, 18 nt, Mycobacterium tuberculosis H37Rv
auggaugggucgaccgga

SEQ ID NO: 1299903 - RNA, 15 nt, Mycobacterium tuberculosis H37Rv
augcuggcagcucgg

SEQ ID NO: 1299904 - RNA, 17 nt, Mycobacterium tuberculosis H37Rv
augcuggcggcgcgaca

SEQ ID NO: 1299905 - RNA, 19 nt, Mycobacterium tuberculosis H37Rv
augcuggcgaucgcgacga

SEQ ID NO: 1299906 - RNA, 22 nt, Mycobacterium tuberculosis H37Rv
auggacgccauggugaacgcga

SEQ ID NO: 1299907 - RNA, 14 nt, Mycobacterium tuberculosis H37Rv
augcucgaucgcgu

SEQ ID NO: 1299908 - RNA, 22 nt, Mycobacterium tuberculosis H37Rv
augcucgucuugggccgggaug

SEQ ID NO: 1299909 - RNA, 18 nt, Mycobacterium tuberculosis H37Rv
augcucggaaacagcgau

SEQ ID NO: 1299910 - RNA, 23 nt, Mycobacterium tuberculosis H37Rv
augcuggcagcggccuccgggcc

SEQ ID NO: 1299911 - RNA, 20 nt, Mycobacterium tuberculosis H37Rv
augcuggcaaaguaucgcag

SEQ ID NO: 1299912 - RNA, 14 nt, Mycobacterium tuberculosis H37Rv
auggcggugagcac

SEQ ID NO: 1299913 - RNA, 24 nt, Mycobacterium tuberculosis H37Rv
auggcgucaugaacgaucggacca

SEQ ID NO: 1299914 - RNA, 19 nt, Mycobacterium tuberculosis H37Rv
augggcucacacauagcga

SEQ ID NO: 1299915 - RNA, 19 nt, Mycobacterium tuberculosis H37Rv
augggcgauuuugcgucug

SEQ ID NO: 1299916 - RNA, 22 nt, Mycobacterium tuberculosis H37Rv
augggcgguuccacgcugccca

SEQ ID NO: 1299917 - RNA, 18 nt, Mycobacterium tuberculosis H37Rv
augggugagcacgauauu

SEQ ID NO: 1299918 - RNA, 14 nt, Mycobacterium tuberculosis H37Rv
augggucaggccga

SEQ ID NO: 1299919 - RNA, 20 nt, Mycobacterium tuberculosis H37Rv
augguccgccagaucucgcg

SEQ ID NO: 1299920 - RNA, 13 nt, Mycobacterium tuberculosis H37Rv
auggucagcagaa

SEQ ID NO: 1299921 - RNA, 13 nt, Mycobacterium tuberculosis H37Rv
auggucaaccgcg

SEQ ID NO: 1299922 - RNA, 12 nt, Mycobacterium tuberculosis H37Rv
auggucaccgga

SEQ ID NO: 1299923 - RNA, 16 nt, Mycobacterium tuberculosis H37Rv
auggucacggcgucga

SEQ ID NO: 1299924 - RNA, 16 nt, Mycobacterium tuberculosis H37Rv
augguugcgacggcgu

SEQ ID NO: 1299925 - RNA, 16 nt, Mycobacterium tuberculosis H37Rv
augguccgggccuauc

SEQ ID NO: 1299926 - RNA, 21 nt, Mycobacterium tuberculosis H37Rv
augucaaccaagugaccggcc

SEQ ID NO: 1299927 - RNA, 14 nt, Mycobacterium tuberculosis H37Rv
aucugcgccaucac

SEQ ID NO: 1299928 - RNA, 15 nt, Mycobacterium tuberculosis H37Rv
aucugcccggugauc

SEQ ID NO: 1299929 - RNA, 16 nt, Mycobacterium tuberculosis H37Rv
aucugccacguugauc

SEQ ID NO: 1299930 - RNA, 19 nt, Mycobacterium tuberculosis H37Rv
aucugcagcacucgguguc

SEQ ID NO: 1299931 - RNA, 16 nt, Mycobacterium tuberculosis H37Rv
aucuccgcgucgguca

SEQ ID NO: 1299932 - RNA, 12 nt, Mycobacterium tuberculosis H37Rv
aucucggcaagg

SEQ ID NO: 1299933 - RNA, 16 nt, Mycobacterium tuberculosis H37Rv
aucucccgaaucgugc

SEQ ID NO: 1299934 - RNA, 13 nt, Mycobacterium tuberculosis H37Rv
aucucguccagau

SEQ ID NO: 1299935 - RNA, 17 nt, Mycobacterium tuberculosis H37Rv
aucucggcggccgcgug

SEQ ID NO: 1299936 - RNA, 23 nt, Mycobacterium tuberculosis H37Rv
aucucggcggccgcgugcucgcc

SEQ ID NO: 1299937 - RNA, 13 nt, Mycobacterium tuberculosis H37Rv
aucgugguaacca

SEQ ID NO: 1299938 - RNA, 13 nt, Mycobacterium tuberculosis H37Rv
aucgugguucggc

SEQ ID NO: 1299939 - RNA, 16 nt, Mycobacterium tuberculosis H37Rv
aucgugccggcgaacc

SEQ ID NO: 1299940 - RNA, 15 nt, Mycobacterium tuberculosis H37Rv
aucgugccggcgaac

SEQ ID NO: 1299941 - RNA, 20 nt, Mycobacterium tuberculosis H37Rv
aucucaccgggcccgacgac

SEQ ID NO: 1299942 - RNA, 23 nt, Mycobacterium tuberculosis H37Rv
aucgguguggacuucagcaggcc

SEQ ID NO: 1299943 - RNA, 17 nt, Mycobacterium tuberculosis H37Rv
aucgguucgggacgcga

SEQ ID NO: 1299944 - RNA, 16 nt, Mycobacterium tuberculosis H37Rv
aucgguugaucggcca

SEQ ID NO: 1299945 - RNA, 14 nt, Mycobacterium tuberculosis H37Rv
aucgguugaccggu

SEQ ID NO: 1299946 - RNA, 18 nt, Mycobacterium tuberculosis H37Rv
aucguacgggucggcgac

SEQ ID NO: 1299947 - RNA, 16 nt, Mycobacterium tuberculosis H37Rv
aucgguggcgccgaac

SEQ ID NO: 1299948 - RNA, 21 nt, Mycobacterium tuberculosis H37Rv
aucgguggucguaggugacga

SEQ ID NO: 1299949 - RNA, 15 nt, Mycobacterium tuberculosis H37Rv
aucgguggucgaugg

SEQ ID NO: 1299950 - RNA, 23 nt, Mycobacterium tuberculosis H37Rv
aucgguggcgccgaacgccagca

SEQ ID NO: 1299951 - RNA, 16 nt, Mycobacterium tuberculosis H37Rv
aucggugggcgggcaa

SEQ ID NO: 1299952 - RNA, 17 nt, Mycobacterium tuberculosis H37Rv
aucgguucagcugcgcc

SEQ ID NO: 1299953 - RNA, 22 nt, Mycobacterium tuberculosis H37Rv
aucggugucuuccuccucgacc

SEQ ID NO: 1299954 - RNA, 20 nt, Mycobacterium tuberculosis H37Rv
aucgucgagccgaucgcccg

SEQ ID NO: 1299955 - RNA, 19 nt, Mycobacterium tuberculosis H37Rv
aucgucgccacgaugccgg

SEQ ID NO: 1299956 - RNA, 16 nt, Mycobacterium tuberculosis H37Rv
aucgucgccgaccguc

SEQ ID NO: 1299957 - RNA, 17 nt, Mycobacterium tuberculosis H37Rv
aucgucgccgaccguca

SEQ ID NO: 1299958 - RNA, 17 nt, Mycobacterium tuberculosis H37Rv
aucgucggccagcagau

SEQ ID NO: 1299959 - RNA, 14 nt, Mycobacterium tuberculosis H37Rv
aucgucggccagca

SEQ ID NO: 1299960 - RNA, 13 nt, Mycobacterium tuberculosis H37Rv
aucgugccggcga

SEQ ID NO: 1299961 - RNA, 24 nt, Mycobacterium tuberculosis H37Rv
aucgucgcggccgucgcgggacaa

SEQ ID NO: 1299962 - RNA, 13 nt, Mycobacterium tuberculosis H37Rv
aucgggcccagca

SEQ ID NO: 1299963 - RNA, 22 nt, Mycobacterium tuberculosis H37Rv
aucgggcccccuggaucgcgcc

SEQ ID NO: 1299964 - RNA, 19 nt, Mycobacterium tuberculosis H37Rv
aucgggcccccuggaucgc

SEQ ID NO: 1299965 - RNA, 15 nt, Mycobacterium tuberculosis H37Rv
aucgggccgccgagc

SEQ ID NO: 1299966 - RNA, 19 nt, Mycobacterium tuberculosis H37Rv
aucgggcaaagucgguguc

SEQ ID NO: 1299967 - RNA, 20 nt, Mycobacterium tuberculosis H37Rv
aucgggagcggcugcggcaa

SEQ ID NO: 1299968 - RNA, 14 nt, Mycobacterium tuberculosis H37Rv
aucgggcgagcucg

SEQ ID NO: 1299969 - RNA, 22 nt, Mycobacterium tuberculosis H37Rv
aucgggcgagcucgucgagcgc

SEQ ID NO: 1299970 - RNA, 17 nt, Mycobacterium tuberculosis H37Rv
aucgggcgcgguaacca

SEQ ID NO: 1299971 - RNA, 12 nt, Mycobacterium tuberculosis H37Rv
aucggucgaucg

SEQ ID NO: 1299972 - RNA, 12 nt, Mycobacterium tuberculosis H37Rv
aucggucgacga

SEQ ID NO: 1299973 - RNA, 21 nt, Mycobacterium tuberculosis H37Rv
aucggucggcaccagguugcc

SEQ ID NO: 1299974 - RNA, 19 nt, Mycobacterium tuberculosis H37Rv
aucggugaucgagguugac

SEQ ID NO: 1299975 - RNA, 20 nt, Mycobacterium tuberculosis H37Rv
aucggugaaucgucugacga

SEQ ID NO: 1299976 - RNA, 11 nt, Mycobacterium tuberculosis H37Rv
aucgacaccga

SEQ ID NO: 1299977 - RNA, 18 nt, Mycobacterium tuberculosis H37Rv
aucgggacgccuugaucg

SEQ ID NO: 1299978 - RNA, 19 nt, Mycobacterium tuberculosis H37Rv
aucgacaccgugaccgccg

SEQ ID NO: 1299979 - RNA, 17 nt, Mycobacterium tuberculosis H37Rv
aucgacaccgugaccgc

SEQ ID NO: 1299980 - RNA, 15 nt, Mycobacterium tuberculosis H37Rv
aucgaaccgcugcuc

SEQ ID NO: 1299981 - RNA, 14 nt, Mycobacterium tuberculosis H37Rv
aucgaaccgcugcu

SEQ ID NO: 1299982 - RNA, 15 nt, Mycobacterium tuberculosis H37Rv
aucgaagcggcugcu

SEQ ID NO: 1299983 - RNA, 16 nt, Mycobacterium tuberculosis H37Rv
augcagugacagugcg

SEQ ID NO: 1299984 - RNA, 12 nt, Mycobacterium tuberculosis H37Rv
augcacgccggg

SEQ ID NO: 1299985 - RNA, 14 nt, Mycobacterium tuberculosis H37Rv
augcacgaucgcca

SEQ ID NO: 1299986 - RNA, 12 nt, Mycobacterium tuberculosis H37Rv
augcacccggua

SEQ ID NO: 1299987 - RNA, 15 nt, Mycobacterium tuberculosis H37Rv
augcaccgaugccga

SEQ ID NO: 1299988 - RNA, 22 nt, Mycobacterium tuberculosis H37Rv
augcaagucaaacgccgucacg

SEQ ID NO: 1299989 - RNA, 21 nt, Mycobacterium tuberculosis H37Rv
augcacaaaaaccgaccgcgc

SEQ ID NO: 1299990 - RNA, 20 nt, Mycobacterium tuberculosis H37Rv
augagauggucguaugcgca

SEQ ID NO: 1299991 - RNA, 23 nt, Mycobacterium tuberculosis H37Rv
augagcaugcccagcgcacggac

SEQ ID NO: 1299992 - RNA, 21 nt, Mycobacterium tuberculosis H37Rv
augagcgcucgggcaaccgga

SEQ ID NO: 1299993 - RNA, 14 nt, Mycobacterium tuberculosis H37Rv
augagcucggccau

SEQ ID NO: 1299994 - RNA, 21 nt, Mycobacterium tuberculosis H37Rv
augagcgcgaaguacgacgac

SEQ ID NO: 1299995 - RNA, 23 nt, Mycobacterium tuberculosis H37Rv
augauguggugugccugcgucuc

SEQ ID NO: 1299996 - RNA, 20 nt, Mycobacterium tuberculosis H37Rv
augauugccaggaccgcgcc

SEQ ID NO: 1299997 - RNA, 16 nt, Mycobacterium tuberculosis H37Rv
augcaacucggcagau

SEQ ID NO: 1299998 - RNA, 20 nt, Mycobacterium tuberculosis H37Rv
aucuucuucagguagcggcc

SEQ ID NO: 1299999 - RNA, 13 nt, Mycobacterium tuberculosis H37Rv
aucuuggccagca

SEQ ID NO: 1300000 - RNA, 19 nt, Mycobacterium tuberculosis H37Rv
aucuuggcgcccgccggca

SEQ ID NO: 1300001 - RNA, 21 nt, Mycobacterium tuberculosis H37Rv
aucuuggucuugaacccgauc

SEQ ID NO: 1300002 - RNA, 23 nt, Mycobacterium tuberculosis H37Rv
aucugguaagucagcucgaucac

SEQ ID NO: 1300003 - RNA, 21 nt, Mycobacterium tuberculosis H37Rv
aucuggcgcugcuggcagacc

SEQ ID NO: 1300004 - RNA, 19 nt, Mycobacterium tuberculosis H37Rv
aucuggccgaacgacgggu

SEQ ID NO: 1300005 - RNA, 13 nt, Mycobacterium tuberculosis H37Rv
aucuugucgaucu

SEQ ID NO: 1300006 - RNA, 14 nt, Mycobacterium tuberculosis H37Rv
augaacagcgacgc

SEQ ID NO: 1300007 - RNA, 16 nt, Mycobacterium tuberculosis H37Rv
augacaccgaccgggu

SEQ ID NO: 1300008 - RNA, 16 nt, Mycobacterium tuberculosis H37Rv
augacgacgaaccggu

SEQ ID NO: 1300009 - RNA, 18 nt, Mycobacterium tuberculosis H37Rv
augacgagccgagccucg

SEQ ID NO: 1300010 - RNA, 19 nt, Mycobacterium tuberculosis H37Rv
augacgagccgagccucgc

SEQ ID NO: 1300011 - RNA, 21 nt, Mycobacterium tuberculosis H37Rv
augaccuguagaucagcagcg

SEQ ID NO: 1300012 - RNA, 14 nt, Mycobacterium tuberculosis H37Rv
augaccuggccgcc

SEQ ID NO: 1300013 - RNA, 22 nt, Mycobacterium tuberculosis H37Rv
augacaaaccugcaugcccaga

SEQ ID NO: 1300014 - RNA, 14 nt, Mycobacterium tuberculosis H37Rv
augacaaaccugca

SEQ ID NO: 1300015 - RNA, 15 nt, Mycobacterium tuberculosis H37Rv
augacaaaccugcau

SEQ ID NO: 1300016 - RNA, 14 nt, Mycobacterium tuberculosis H37Rv
augaacgccagcag

SEQ ID NO: 1300017 - RNA, 20 nt, Mycobacterium tuberculosis H37Rv
augaacgccagcagcgcgau

SEQ ID NO: 1300018 - RNA, 12 nt, Mycobacterium tuberculosis H37Rv
augaagccaccc

SEQ ID NO: 1300019 - RNA, 21 nt, Mycobacterium tuberculosis H37Rv
auucacgagccgcucuagcgu

SEQ ID NO: 1300020 - RNA, 12 nt, Mycobacterium tuberculosis H37Rv
auuacggugauc

SEQ ID NO: 1300021 - RNA, 14 nt, Mycobacterium tuberculosis H37Rv
augucgauguccac

SEQ ID NO: 1300022 - RNA, 17 nt, Mycobacterium tuberculosis H37Rv
augucgauguccacgcc

SEQ ID NO: 1300023 - RNA, 13 nt, Mycobacterium tuberculosis H37Rv
augucgacgacaa

SEQ ID NO: 1300024 - RNA, 20 nt, Mycobacterium tuberculosis H37Rv
auguccaccgcggcgucgcc

SEQ ID NO: 1300025 - RNA, 19 nt, Mycobacterium tuberculosis H37Rv
augucgagcgcgaucgggc

SEQ ID NO: 1300026 - RNA, 12 nt, Mycobacterium tuberculosis H37Rv
augucgaugccg

SEQ ID NO: 1300027 - RNA, 13 nt, Mycobacterium tuberculosis H37Rv
augucgaugccgu

SEQ ID NO: 1300028 - RNA, 21 nt, Mycobacterium tuberculosis H37Rv
auuccgcgcguccgucggcga

SEQ ID NO: 1300029 - RNA, 22 nt, Mycobacterium tuberculosis H37Rv
auuccgcucacgaagaccgcgu

SEQ ID NO: 1300030 - RNA, 20 nt, Mycobacterium tuberculosis H37Rv
auuccgcccacaugcgcucg

SEQ ID NO: 1300031 - RNA, 19 nt, Mycobacterium tuberculosis H37Rv
auucgaugccguaggcggc

SEQ ID NO: 1300032 - RNA, 20 nt, Mycobacterium tuberculosis H37Rv
auucgauguccucgacaccc

SEQ ID NO: 1300033 - RNA, 16 nt, Mycobacterium tuberculosis H37Rv
auucgcaaucggcguu

SEQ ID NO: 1300034 - RNA, 16 nt, Mycobacterium tuberculosis H37Rv
aaacucaccagcaccc

SEQ ID NO: 1300035 - RNA, 19 nt, Mycobacterium tuberculosis H37Rv
aaacucaccagcaccccga

SEQ ID NO: 1300036 - RNA, 15 nt, Mycobacterium tuberculosis H37Rv
auuccagaucaacgc

SEQ ID NO: 1300037 - RNA, 17 nt, Mycobacterium tuberculosis H37Rv
auuccaucgcgcaccgc

SEQ ID NO: 1300038 - RNA, 20 nt, Mycobacterium tuberculosis H37Rv
auugcggcgcgggugcggau

SEQ ID NO: 1300039 - RNA, 23 nt, Mycobacterium tuberculosis H37Rv
auugcggccuguugacccaucau

SEQ ID NO: 1300040 - RNA, 13 nt, Mycobacterium tuberculosis H37Rv
auugcgcgggcau

SEQ ID NO: 1300041 - RNA, 23 nt, Mycobacterium tuberculosis H37Rv
auuggccaaccccauggccagcg

SEQ ID NO: 1300042 - RNA, 23 nt, Mycobacterium tuberculosis H37Rv
auuggcccgaguuggcgaagccc

SEQ ID NO: 1300043 - RNA, 13 nt, Mycobacterium tuberculosis H37Rv
auuggcgccgaug

SEQ ID NO: 1300044 - RNA, 16 nt, Mycobacterium tuberculosis H37Rv
auuggcugggucguca

SEQ ID NO: 1300045 - RNA, 21 nt, Mycobacterium tuberculosis H37Rv
auuggcgccgucaccgaucga

SEQ ID NO: 1300046 - RNA, 14 nt, Mycobacterium tuberculosis H37Rv
auuggcgucgucgc

SEQ ID NO: 1300047 - RNA, 18 nt, Mycobacterium tuberculosis H37Rv
auuggcgucgucggcggc

SEQ ID NO: 1300048 - RNA, 16 nt, Mycobacterium tuberculosis H37Rv
auuggcgccgccgauc

SEQ ID NO: 1300049 - RNA, 21 nt, Mycobacterium tuberculosis H37Rv
auugugcggccccgucgccga

SEQ ID NO: 1300050 - RNA, 23 nt, Mycobacterium tuberculosis H37Rv
auugccaccagaaacaccgacga

SEQ ID NO: 1300051 - RNA, 21 nt, Mycobacterium tuberculosis H37Rv
auugccgccguugccgccaug

SEQ ID NO: 1300052 - RNA, 13 nt, Mycobacterium tuberculosis H37Rv
auugcccgagccc

SEQ ID NO: 1300053 - RNA, 22 nt, Mycobacterium tuberculosis H37Rv
auugcccgacgaugcgggcgau

SEQ ID NO: 1300054 - RNA, 21 nt, Mycobacterium tuberculosis H37Rv
auucguacagugucugccaug

SEQ ID NO: 1300055 - RNA, 17 nt, Mycobacterium tuberculosis H37Rv
auucgcggcagccggcg

SEQ ID NO: 1300056 - RNA, 14 nt, Mycobacterium tuberculosis H37Rv
auugugcucgccga

SEQ ID NO: 1300057 - RNA, 13 nt, Mycobacterium tuberculosis H37Rv
auuucgucgaucg

SEQ ID NO: 1300058 - RNA, 16 nt, Mycobacterium tuberculosis H37Rv
auuucggcggcgauga

SEQ ID NO: 1300059 - RNA, 17 nt, Mycobacterium tuberculosis H37Rv
auuucgaucacaucguu

SEQ ID NO: 1300060 - RNA, 21 nt, Mycobacterium tuberculosis H37Rv
auuucgcgucugcucgccagc

SEQ ID NO: 1300061 - RNA, 15 nt, Mycobacterium tuberculosis H37Rv
auuucggaucucgac

SEQ ID NO: 1300062 - RNA, 20 nt, Mycobacterium tuberculosis H37Rv
caaaauggugccguccggcg

SEQ ID NO: 1300063 - RNA, 15 nt, Mycobacterium tuberculosis H37Rv
caaaaucgcggccac

SEQ ID NO: 1300064 - RNA, 22 nt, Mycobacterium tuberculosis H37Rv
caaaaucgcacgguuugcgguu

SEQ ID NO: 1300065 - RNA, 16 nt, Mycobacterium tuberculosis H37Rv
caaaauucgcuggcga

SEQ ID NO: 1300066 - RNA, 16 nt, Mycobacterium tuberculosis H37Rv
caaacauacgccaccc

SEQ ID NO: 1300067 - RNA, 15 nt, Mycobacterium tuberculosis H37Rv
caaacaucgcaccca

SEQ ID NO: 1300068 - RNA, 21 nt, Mycobacterium tuberculosis H37Rv
caaaccgaucaauccgcccuu

SEQ ID NO: 1300069 - RNA, 23 nt, Mycobacterium tuberculosis H37Rv
caaaccuucaacaacgauguggc

SEQ ID NO: 1300070 - RNA, 18 nt, Mycobacterium tuberculosis H37Rv
caaaccauugcgccugaa

SEQ ID NO: 1300071 - RNA, 21 nt, Mycobacterium tuberculosis H37Rv
caaacauggguuucgaguagc

SEQ ID NO: 1300072 - RNA, 15 nt, Mycobacterium tuberculosis H37Rv
caaacccagcgacgc

SEQ ID NO: 1300073 - RNA, 17 nt, Mycobacterium tuberculosis H37Rv
caaaccccugcacggug

SEQ ID NO: 1300074 - RNA, 22 nt, Mycobacterium tuberculosis H37Rv
caaacuacccgcccacggcacc

SEQ ID NO: 1300075 - RNA, 22 nt, Mycobacterium tuberculosis H37Rv
caaacggcuuggcugccuccau

SEQ ID NO: 1300076 - RNA, 18 nt, Mycobacterium tuberculosis H37Rv
caaacggaauguagccga

SEQ ID NO: 1300077 - RNA, 16 nt, Mycobacterium tuberculosis H37Rv
caaauauccugcgguu

SEQ ID NO: 1300078 - RNA, 16 nt, Mycobacterium tuberculosis H37Rv
caaaggugcacugccg

SEQ ID NO: 1300079 - RNA, 14 nt, Mycobacterium tuberculosis H37Rv
caaauccuucggcg

SEQ ID NO: 1300080 - RNA, 13 nt, Mycobacterium tuberculosis H37Rv
caaaggccuugac

SEQ ID NO: 1300081 - RNA, 16 nt, Mycobacterium tuberculosis H37Rv
caaaggauucgcgcga

SEQ ID NO: 1300082 - RNA, 20 nt, Mycobacterium tuberculosis H37Rv
caacaccagccggucgucgc

SEQ ID NO: 1300083 - RNA, 16 nt, Mycobacterium tuberculosis H37Rv
caacacagccgucgca

SEQ ID NO: 1300084 - RNA, 17 nt, Mycobacterium tuberculosis H37Rv
caacaccaacgacagcg

SEQ ID NO: 1300085 - RNA, 21 nt, Mycobacterium tuberculosis H37Rv
caacaccaggucauugccggc

SEQ ID NO: 1300086 - RNA, 19 nt, Mycobacterium tuberculosis H37Rv
caacacugaguucggugcu

SEQ ID NO: 1300087 - RNA, 13 nt, Mycobacterium tuberculosis H37Rv
caacacgucgagc

SEQ ID NO: 1300088 - RNA, 12 nt, Mycobacterium tuberculosis H37Rv
caacaccgcacc

SEQ ID NO: 1300089 - RNA, 13 nt, Mycobacterium tuberculosis H37Rv
auuugaugagcaa

SEQ ID NO: 1300090 - RNA, 16 nt, Mycobacterium tuberculosis H37Rv
auuugauaggcgcgca

SEQ ID NO: 1300091 - RNA, 12 nt, Mycobacterium tuberculosis H37Rv
auuuugcgucug

SEQ ID NO: 1300092 - RNA, 19 nt, Mycobacterium tuberculosis H37Rv
auuuugcgucugcucggca

SEQ ID NO: 1300093 - RNA, 20 nt, Mycobacterium tuberculosis H37Rv
auuuugcgucugcucggcgg

SEQ ID NO: 1300094 - RNA, 17 nt, Mycobacterium tuberculosis H37Rv
cagccgcccgcccaccu

SEQ ID NO: 1300095 - RNA, 16 nt, Mycobacterium tuberculosis H37Rv
cagccgcagcaccucg

SEQ ID NO: 1300096 - RNA, 17 nt, Mycobacterium tuberculosis H37Rv
cagccgcagcaccucgg

SEQ ID NO: 1300097 - RNA, 22 nt, Mycobacterium tuberculosis H37Rv
cagccgcaccaguggcgcccau

SEQ ID NO: 1300098 - RNA, 21 nt, Mycobacterium tuberculosis H37Rv
cagccgcacgguugccgucag

SEQ ID NO: 1300099 - RNA, 23 nt, Mycobacterium tuberculosis H37Rv
cagccgcauaggccccgccagcg

SEQ ID NO: 1300100 - RNA, 20 nt, Mycobacterium tuberculosis H37Rv
cagccgccaugcgacuucgc

SEQ ID NO: 1300101 - RNA, 15 nt, Mycobacterium tuberculosis H37Rv
cagccguacgccgua

SEQ ID NO: 1300102 - RNA, 17 nt, Mycobacterium tuberculosis H37Rv
cagccguagcugggcac

SEQ ID NO: 1300103 - RNA, 23 nt, Mycobacterium tuberculosis H37Rv
cagccgguggugggcgggaucga

SEQ ID NO: 1300104 - RNA, 16 nt, Mycobacterium tuberculosis H37Rv
cagccgucaccgcgac

SEQ ID NO: 1300105 - RNA, 20 nt, Mycobacterium tuberculosis H37Rv
cagccgguggucugcgcggu

SEQ ID NO: 1300106 - RNA, 22 nt, Mycobacterium tuberculosis H37Rv
cagccggguuuggugcagccgc

SEQ ID NO: 1300107 - RNA, 14 nt, Mycobacterium tuberculosis H37Rv
cagccggugccgcc

SEQ ID NO: 1300108 - RNA, 13 nt, Mycobacterium tuberculosis H37Rv
cagccgggcacca

SEQ ID NO: 1300109 - RNA, 21 nt, Mycobacterium tuberculosis H37Rv
cagccgggugccacaacccgc

SEQ ID NO: 1300110 - RNA, 22 nt, Mycobacterium tuberculosis H37Rv
cagccggcggagagggcgacca

SEQ ID NO: 1300111 - RNA, 12 nt, Mycobacterium tuberculosis H37Rv
cagccaccgggc

SEQ ID NO: 1300112 - RNA, 22 nt, Mycobacterium tuberculosis H37Rv
cagccaccugccgacucaucgg

SEQ ID NO: 1300113 - RNA, 19 nt, Mycobacterium tuberculosis H37Rv
cagccaccagcgacgacca

SEQ ID NO: 1300114 - RNA, 12 nt, Mycobacterium tuberculosis H37Rv
cagccaccagcc

SEQ ID NO: 1300115 - RNA, 21 nt, Mycobacterium tuberculosis H37Rv
cagcccggcgaugagcaugcc

SEQ ID NO: 1300116 - RNA, 16 nt, Mycobacterium tuberculosis H37Rv
cagcccggcgacgacc

SEQ ID NO: 1300117 - RNA, 16 nt, Mycobacterium tuberculosis H37Rv
cagcccgacgcccgac

SEQ ID NO: 1300118 - RNA, 16 nt, Mycobacterium tuberculosis H37Rv
cagcccgagcagaaac

SEQ ID NO: 1300119 - RNA, 23 nt, Mycobacterium tuberculosis H37Rv
cagcccgacaccguccagcagcu

SEQ ID NO: 1300120 - RNA, 14 nt, Mycobacterium tuberculosis H37Rv
cagcccgacaccgu

SEQ ID NO: 1300121 - RNA, 15 nt, Mycobacterium tuberculosis H37Rv
cagcccgacgcccga

SEQ ID NO: 1300122 - RNA, 16 nt, Mycobacterium tuberculosis H37Rv
cagccgaagaaccggu

SEQ ID NO: 1300123 - RNA, 14 nt, Mycobacterium tuberculosis H37Rv
cagccgaagccgaa

SEQ ID NO: 1300124 - RNA, 19 nt, Mycobacterium tuberculosis H37Rv
cagccgauccgaucgcaga

SEQ ID NO: 1300125 - RNA, 20 nt, Mycobacterium tuberculosis H37Rv
cagccgaucgucucggccac

SEQ ID NO: 1300126 - RNA, 22 nt, Mycobacterium tuberculosis H37Rv
cagccgaucgucucggccacga

SEQ ID NO: 1300127 - RNA, 19 nt, Mycobacterium tuberculosis H37Rv
cagcccuguuugacugcga

SEQ ID NO: 1300128 - RNA, 14 nt, Mycobacterium tuberculosis H37Rv
cagcccugcgcagc

SEQ ID NO: 1300129 - RNA, 23 nt, Mycobacterium tuberculosis H37Rv
cagcccucugguggcgcugaagc

SEQ ID NO: 1300130 - RNA, 14 nt, Mycobacterium tuberculosis H37Rv
cagcccgucggcgc

SEQ ID NO: 1300131 - RNA, 15 nt, Mycobacterium tuberculosis H37Rv
cagcccgucggaccc

SEQ ID NO: 1300132 - RNA, 18 nt, Mycobacterium tuberculosis H37Rv
cagcccgucggcgccgaa

SEQ ID NO: 1300133 - RNA, 13 nt, Mycobacterium tuberculosis H37Rv
cagcccggcguug

SEQ ID NO: 1300134 - RNA, 18 nt, Mycobacterium tuberculosis H37Rv
cagcccgggcagcaccag

SEQ ID NO: 1300135 - RNA, 19 nt, Mycobacterium tuberculosis H37Rv
cagcccggucauggucagc

SEQ ID NO: 1300136 - RNA, 13 nt, Mycobacterium tuberculosis H37Rv
cagcccguccggc

SEQ ID NO: 1300137 - RNA, 22 nt, Mycobacterium tuberculosis H37Rv
cagcccguccaggcgcugcagc

SEQ ID NO: 1300138 - RNA, 20 nt, Mycobacterium tuberculosis H37Rv
cagcccguccaggcgcugca

SEQ ID NO: 1300139 - RNA, 13 nt, Mycobacterium tuberculosis H37Rv
cagcgacuccacc

SEQ ID NO: 1300140 - RNA, 13 nt, Mycobacterium tuberculosis H37Rv
cagcgacggucag

SEQ ID NO: 1300141 - RNA, 18 nt, Mycobacterium tuberculosis H37Rv
cagcgacgcggucaucga

SEQ ID NO: 1300142 - RNA, 21 nt, Mycobacterium tuberculosis H37Rv
cagcgacgcggucaucgagcu

SEQ ID NO: 1300143 - RNA, 20 nt, Mycobacterium tuberculosis H37Rv
cagcgaaggcgccgaacacc

SEQ ID NO: 1300144 - RNA, 18 nt, Mycobacterium tuberculosis H37Rv
cagccgucguccgcugac

SEQ ID NO: 1300145 - RNA, 17 nt, Mycobacterium tuberculosis H37Rv
cagccgugcgggccggu

SEQ ID NO: 1300146 - RNA, 13 nt, Mycobacterium tuberculosis H37Rv
cagcgaagccggg

SEQ ID NO: 1300147 - RNA, 16 nt, Mycobacterium tuberculosis H37Rv
cagcgaaggcgccgaa

SEQ ID NO: 1300148 - RNA, 14 nt, Mycobacterium tuberculosis H37Rv
cagcgaacggccag

SEQ ID NO: 1300149 - RNA, 13 nt, Mycobacterium tuberculosis H37Rv
cagcgaaccggcu

SEQ ID NO: 1300150 - RNA, 16 nt, Mycobacterium tuberculosis H37Rv
cagccguggcagucgc

SEQ ID NO: 1300151 - RNA, 15 nt, Mycobacterium tuberculosis H37Rv
cagccguucgcagcu

SEQ ID NO: 1300152 - RNA, 21 nt, Mycobacterium tuberculosis H37Rv
cagccguggugguugaucagc

SEQ ID NO: 1300153 - RNA, 23 nt, Mycobacterium tuberculosis H37Rv
cagcgauauccacaauccgcucg

SEQ ID NO: 1300154 - RNA, 17 nt, Mycobacterium tuberculosis H37Rv
cagcgagucgacgucga

SEQ ID NO: 1300155 - RNA, 14 nt, Mycobacterium tuberculosis H37Rv
cagcgagucgacgu

SEQ ID NO: 1300156 - RNA, 19 nt, Mycobacterium tuberculosis H37Rv
cagcgauccucgccgggua

SEQ ID NO: 1300157 - RNA, 13 nt, Mycobacterium tuberculosis H37Rv
cagcgcacccggu

SEQ ID NO: 1300158 - RNA, 21 nt, Mycobacterium tuberculosis H37Rv
cagcgcacggaccaucgccag

SEQ ID NO: 1300159 - RNA, 16 nt, Mycobacterium tuberculosis H37Rv
cagcgcacgcagccga

SEQ ID NO: 1300160 - RNA, 17 nt, Mycobacterium tuberculosis H37Rv
cagcgcacuacucgaac

SEQ ID NO: 1300161 - RNA, 21 nt, Mycobacterium tuberculosis H37Rv
cagcgcaccggugauggugac

SEQ ID NO: 1300162 - RNA, 21 nt, Mycobacterium tuberculosis H37Rv
cagcgcacgauuucgagcgcu

SEQ ID NO: 1300163 - RNA, 15 nt, Mycobacterium tuberculosis H37Rv
cagcgcacgauuucg

SEQ ID NO: 1300164 - RNA, 16 nt, Mycobacterium tuberculosis H37Rv
cagcgcaccggcguuc

SEQ ID NO: 1300165 - RNA, 17 nt, Mycobacterium tuberculosis H37Rv
cagcgcaccggugaugg

SEQ ID NO: 1300166 - RNA, 12 nt, Mycobacterium tuberculosis H37Rv
cagcgcaccggu

SEQ ID NO: 1300167 - RNA, 14 nt, Mycobacterium tuberculosis H37Rv
cagcgccagcagcu

SEQ ID NO: 1300168 - RNA, 20 nt, Mycobacterium tuberculosis H37Rv
cagcgcacuacucgaacaac

SEQ ID NO: 1300169 - RNA, 19 nt, Mycobacterium tuberculosis H37Rv
cagcgcacuacucgaacaa

SEQ ID NO: 1300170 - RNA, 15 nt, Mycobacterium tuberculosis H37Rv
cagcgcacuggccgc

SEQ ID NO: 1300171 - RNA, 17 nt, Mycobacterium tuberculosis H37Rv
cagcgccagcgccugcg

SEQ ID NO: 1300172 - RNA, 15 nt, Mycobacterium tuberculosis H37Rv
cagcgcccgccggca

SEQ ID NO: 1300173 - RNA, 20 nt, Mycobacterium tuberculosis H37Rv
cagcgcccccagcagcugcg

SEQ ID NO: 1300174 - RNA, 14 nt, Mycobacterium tuberculosis H37Rv
cagcgccaggccgu

SEQ ID NO: 1300175 - RNA, 17 nt, Mycobacterium tuberculosis H37Rv
cagcgccgacagccgau

SEQ ID NO: 1300176 - RNA, 22 nt, Mycobacterium tuberculosis H37Rv
cagcgccgacccaacccgaucu

SEQ ID NO: 1300177 - RNA, 14 nt, Mycobacterium tuberculosis H37Rv
cagcgccgcacccg

SEQ ID NO: 1300178 - RNA, 21 nt, Mycobacterium tuberculosis H37Rv
cagcgccucgauccgcaucau

SEQ ID NO: 1300179 - RNA, 21 nt, Mycobacterium tuberculosis H37Rv
cagcgccgagagcaccgcucg

SEQ ID NO: 1300180 - RNA, 15 nt, Mycobacterium tuberculosis H37Rv
cagcgccuggccgga

SEQ ID NO: 1300181 - RNA, 15 nt, Mycobacterium tuberculosis H37Rv
cagcgccugcgccca

SEQ ID NO: 1300182 - RNA, 16 nt, Mycobacterium tuberculosis H37Rv
cagcgggcuccccgga

SEQ ID NO: 1300183 - RNA, 16 nt, Mycobacterium tuberculosis H37Rv
cagcgguagccgagcu

SEQ ID NO: 1300184 - RNA, 21 nt, Mycobacterium tuberculosis H37Rv
cagcgguagcugcccagcguc

SEQ ID NO: 1300185 - RNA, 15 nt, Mycobacterium tuberculosis H37Rv
cagcgggcaucgcga

SEQ ID NO: 1300186 - RNA, 17 nt, Mycobacterium tuberculosis H37Rv
cagcgggcaucgcgaau

SEQ ID NO: 1300187 - RNA, 19 nt, Mycobacterium tuberculosis H37Rv
cagcgggcgaugagcgcga

SEQ ID NO: 1300188 - RNA, 12 nt, Mycobacterium tuberculosis H37Rv
cagcgggcgaug

SEQ ID NO: 1300189 - RNA, 19 nt, Mycobacterium tuberculosis H37Rv
cagcgggcagcaggcgaug

SEQ ID NO: 1300190 - RNA, 14 nt, Mycobacterium tuberculosis H37Rv
cagcgggacugcgg

SEQ ID NO: 1300191 - RNA, 17 nt, Mycobacterium tuberculosis H37Rv
cagcgggcagcaggcga

SEQ ID NO: 1300192 - RNA, 22 nt, Mycobacterium tuberculosis H37Rv
cagcggcugguugcgccacugc

SEQ ID NO: 1300193 - RNA, 20 nt, Mycobacterium tuberculosis H37Rv
cagcgucgguggcagcggug

SEQ ID NO: 1300194 - RNA, 18 nt, Mycobacterium tuberculosis H37Rv
cagcgucgucgacgacaa

SEQ ID NO: 1300195 - RNA, 18 nt, Mycobacterium tuberculosis H37Rv
cagcgugcccgccaccgg

SEQ ID NO: 1300196 - RNA, 21 nt, Mycobacterium tuberculosis H37Rv
cagcgugagugcagcacgauc

SEQ ID NO: 1300197 - RNA, 17 nt, Mycobacterium tuberculosis H37Rv
cagcgguggucggcgcg

SEQ ID NO: 1300198 - RNA, 15 nt, Mycobacterium tuberculosis H37Rv
cagcgguggaccacc

SEQ ID NO: 1300199 - RNA, 15 nt, Mycobacterium tuberculosis H37Rv
cagcggugcagcccg

SEQ ID NO: 1300200 - RNA, 20 nt, Mycobacterium tuberculosis H37Rv
cagcgguuuuaggcagccca

SEQ ID NO: 1300201 - RNA, 22 nt, Mycobacterium tuberculosis H37Rv
cagcggaauuagucgccgcagu

SEQ ID NO: 1300202 - RNA, 15 nt, Mycobacterium tuberculosis H37Rv
cagcggaucgcauuu

SEQ ID NO: 1300203 - RNA, 18 nt, Mycobacterium tuberculosis H37Rv
cagcggagccacucggcc

SEQ ID NO: 1300204 - RNA, 16 nt, Mycobacterium tuberculosis H37Rv
cagcggaaucaccgaa

SEQ ID NO: 1300205 - RNA, 14 nt, Mycobacterium tuberculosis H37Rv
cagcggaagcgaau

SEQ ID NO: 1300206 - RNA, 21 nt, Mycobacterium tuberculosis H37Rv
cagcggaacugggcccccaau

SEQ ID NO: 1300207 - RNA, 21 nt, Mycobacterium tuberculosis H37Rv
cagcggcaauggccagcacca

SEQ ID NO: 1300208 - RNA, 16 nt, Mycobacterium tuberculosis H37Rv
cagcggcaacgaucga

SEQ ID NO: 1300209 - RNA, 19 nt, Mycobacterium tuberculosis H37Rv
cagcggaucgucguuguca

SEQ ID NO: 1300210 - RNA, 15 nt, Mycobacterium tuberculosis H37Rv
cagcggcaccgcgcc

SEQ ID NO: 1300211 - RNA, 14 nt, Mycobacterium tuberculosis H37Rv
cagcggcacgaucg

SEQ ID NO: 1300212 - RNA, 11 nt, Mycobacterium tuberculosis H37Rv
cagcggcaaga

SEQ ID NO: 1300213 - RNA, 17 nt, Mycobacterium tuberculosis H37Rv
cagcggcacacccauca

SEQ ID NO: 1300214 - RNA, 21 nt, Mycobacterium tuberculosis H37Rv
cagcggcacugaucugcguug

SEQ ID NO: 1300215 - RNA, 16 nt, Mycobacterium tuberculosis H37Rv
cagcggcagcgagugg

SEQ ID NO: 1300216 - RNA, 22 nt, Mycobacterium tuberculosis H37Rv
cagcggcaggaagaaaccgcag

SEQ ID NO: 1300217 - RNA, 13 nt, Mycobacterium tuberculosis H37Rv
cagcggccaccga

SEQ ID NO: 1300218 - RNA, 14 nt, Mycobacterium tuberculosis H37Rv
cagcggccagccca

SEQ ID NO: 1300219 - RNA, 16 nt, Mycobacterium tuberculosis H37Rv
cagcggccauaucgcc

SEQ ID NO: 1300220 - RNA, 23 nt, Mycobacterium tuberculosis H37Rv
cagcggccauaucgcccaccacg

SEQ ID NO: 1300221 - RNA, 22 nt, Mycobacterium tuberculosis H37Rv
cagcggccgaccgcgacccggc

SEQ ID NO: 1300222 - RNA, 12 nt, Mycobacterium tuberculosis H37Rv
cagcggccgacc

SEQ ID NO: 1300223 - RNA, 14 nt, Mycobacterium tuberculosis H37Rv
cagcggcgccagua

SEQ ID NO: 1300224 - RNA, 20 nt, Mycobacterium tuberculosis H37Rv
cagcggcgcgaccgucugga

SEQ ID NO: 1300225 - RNA, 18 nt, Mycobacterium tuberculosis H37Rv
cagcggcgaguuggccgu

SEQ ID NO: 1300226 - RNA, 15 nt, Mycobacterium tuberculosis H37Rv
cagcggcgaucaggc

SEQ ID NO: 1300227 - RNA, 18 nt, Mycobacterium tuberculosis H37Rv
cagcggcgauugauccgg

SEQ ID NO: 1300228 - RNA, 19 nt, Mycobacterium tuberculosis H37Rv
cagcggccugaccggcucg

SEQ ID NO: 1300229 - RNA, 13 nt, Mycobacterium tuberculosis H37Rv
cagcggccgaccg

SEQ ID NO: 1300230 - RNA, 19 nt, Mycobacterium tuberculosis H37Rv
cagcgcgugguaccgcuug

SEQ ID NO: 1300231 - RNA, 15 nt, Mycobacterium tuberculosis H37Rv
cagcgcgucguccag

SEQ ID NO: 1300232 - RNA, 17 nt, Mycobacterium tuberculosis H37Rv
cagcgcuccagcacccg

SEQ ID NO: 1300233 - RNA, 17 nt, Mycobacterium tuberculosis H37Rv
cagcgcguucggcaccu

SEQ ID NO: 1300234 - RNA, 15 nt, Mycobacterium tuberculosis H37Rv
cagcgcuccagccgc

SEQ ID NO: 1300235 - RNA, 16 nt, Mycobacterium tuberculosis H37Rv
cagcgcuucgucggcc

SEQ ID NO: 1300236 - RNA, 22 nt, Mycobacterium tuberculosis H37Rv
cagcggaaccgagggccgucac

SEQ ID NO: 1300237 - RNA, 18 nt, Mycobacterium tuberculosis H37Rv
cagcgcugccaccgcggu

SEQ ID NO: 1300238 - RNA, 15 nt, Mycobacterium tuberculosis H37Rv
cagcgcugccaccgc

SEQ ID NO: 1300239 - RNA, 22 nt, Mycobacterium tuberculosis H37Rv
cagcgcugucguaccgcggauc

SEQ ID NO: 1300240 - RNA, 18 nt, Mycobacterium tuberculosis H37Rv
cagcgcuucacgggccgu

SEQ ID NO: 1300241 - RNA, 18 nt, Mycobacterium tuberculosis H37Rv
cagcgcggcgucgccuug

SEQ ID NO: 1300242 - RNA, 19 nt, Mycobacterium tuberculosis H37Rv
cagcgcguagccaaugccc

SEQ ID NO: 1300243 - RNA, 23 nt, Mycobacterium tuberculosis H37Rv
cagcgcguauggcucaccccguu

SEQ ID NO: 1300244 - RNA, 23 nt, Mycobacterium tuberculosis H37Rv
cagcgcgguggucagcaccggcg

SEQ ID NO: 1300245 - RNA, 19 nt, Mycobacterium tuberculosis H37Rv
cagcgcgguguagagcgca

SEQ ID NO: 1300246 - RNA, 22 nt, Mycobacterium tuberculosis H37Rv
cagcgcgaucaccgagucgacg

SEQ ID NO: 1300247 - RNA, 13 nt, Mycobacterium tuberculosis H37Rv
cagcgcgaucacc

SEQ ID NO: 1300248 - RNA, 13 nt, Mycobacterium tuberculosis H37Rv
cagcgcgaucgau

SEQ ID NO: 1300249 - RNA, 16 nt, Mycobacterium tuberculosis H37Rv
cagcgcgccacccagc

SEQ ID NO: 1300250 - RNA, 16 nt, Mycobacterium tuberculosis H37Rv
cagcgcgcacgacagg

SEQ ID NO: 1300251 - RNA, 11 nt, Mycobacterium tuberculosis H37Rv
cagcgcgacgu

SEQ ID NO: 1300252 - RNA, 20 nt, Mycobacterium tuberculosis H37Rv
cagcgcgacguccaccagcc

SEQ ID NO: 1300253 - RNA, 16 nt, Mycobacterium tuberculosis H37Rv
cagcgcgagaucagcc

SEQ ID NO: 1300254 - RNA, 23 nt, Mycobacterium tuberculosis H37Rv
cagcgcgacccguagcuuggcga

SEQ ID NO: 1300255 - RNA, 15 nt, Mycobacterium tuberculosis H37Rv
cagcgcgaacaccau

SEQ ID NO: 1300256 - RNA, 16 nt, Mycobacterium tuberculosis H37Rv
cagcgcgaacgccugc

SEQ ID NO: 1300257 - RNA, 14 nt, Mycobacterium tuberculosis H37Rv
cagcgcgcugcagu

SEQ ID NO: 1300258 - RNA, 21 nt, Mycobacterium tuberculosis H37Rv
cagcgcggaugucggcaucga

SEQ ID NO: 1300259 - RNA, 23 nt, Mycobacterium tuberculosis H37Rv
cagcgcggcacggugugcggcau

SEQ ID NO: 1300260 - RNA, 22 nt, Mycobacterium tuberculosis H37Rv
cagcgcggauucgguuagcgcg

SEQ ID NO: 1300261 - RNA, 20 nt, Mycobacterium tuberculosis H37Rv
cagcgcggcaaaguuggccg

SEQ ID NO: 1300262 - RNA, 20 nt, Mycobacterium tuberculosis H37Rv
cagcgcggccauuagcagca

SEQ ID NO: 1300263 - RNA, 20 nt, Mycobacterium tuberculosis H37Rv
cagcgcgcgccgcuggguga

SEQ ID NO: 1300264 - RNA, 23 nt, Mycobacterium tuberculosis H37Rv
cagcgcgcgcgggugcaaccgga

SEQ ID NO: 1300265 - RNA, 12 nt, Mycobacterium tuberculosis H37Rv
cagcgcgcccga

SEQ ID NO: 1300266 - RNA, 14 nt, Mycobacterium tuberculosis H37Rv
cagcgcgcgccgca

SEQ ID NO: 1300267 - RNA, 15 nt, Mycobacterium tuberculosis H37Rv
cacugaugggccggu

SEQ ID NO: 1300268 - RNA, 18 nt, Mycobacterium tuberculosis H37Rv
cacugcggccugcucgac

SEQ ID NO: 1300269 - RNA, 12 nt, Mycobacterium tuberculosis H37Rv
cacugcggccag

SEQ ID NO: 1300270 - RNA, 22 nt, Mycobacterium tuberculosis H37Rv
cacugcguuccaucgccgacgc

SEQ ID NO: 1300271 - RNA, 11 nt, Mycobacterium tuberculosis H37Rv
cacugcugcgg

SEQ ID NO: 1300272 - RNA, 13 nt, Mycobacterium tuberculosis H37Rv
cacuccugcacac

SEQ ID NO: 1300273 - RNA, 17 nt, Mycobacterium tuberculosis H37Rv
cacuccugagaugcggc

SEQ ID NO: 1300274 - RNA, 18 nt, Mycobacterium tuberculosis H37Rv
cacuccugagaugcggcc

SEQ ID NO: 1300275 - RNA, 23 nt, Mycobacterium tuberculosis H37Rv
cacuccuagccaacgagcgcgcu

SEQ ID NO: 1300276 - RNA, 17 nt, Mycobacterium tuberculosis H37Rv
cacuccagcagcucgcc

SEQ ID NO: 1300277 - RNA, 21 nt, Mycobacterium tuberculosis H37Rv
cacuccagcagcucgccggca

SEQ ID NO: 1300278 - RNA, 19 nt, Mycobacterium tuberculosis H37Rv
cacucaucggugugcaucg

SEQ ID NO: 1300279 - RNA, 15 nt, Mycobacterium tuberculosis H37Rv
cacuccacgaucggc

SEQ ID NO: 1300280 - RNA, 21 nt, Mycobacterium tuberculosis H37Rv
cacgcgaaugacgauccagcc

SEQ ID NO: 1300281 - RNA, 17 nt, Mycobacterium tuberculosis H37Rv
cacgcgaaaugccugcg

SEQ ID NO: 1300282 - RNA, 14 nt, Mycobacterium tuberculosis H37Rv
cacgcgcaacucgc

SEQ ID NO: 1300283 - RNA, 15 nt, Mycobacterium tuberculosis H37Rv
cacgcgauggccauc

SEQ ID NO: 1300284 - RNA, 17 nt, Mycobacterium tuberculosis H37Rv
cacgcgauggccaucau

SEQ ID NO: 1300285 - RNA, 15 nt, Mycobacterium tuberculosis H37Rv
cacgcgaugcacgcc

SEQ ID NO: 1300286 - RNA, 14 nt, Mycobacterium tuberculosis H37Rv
cacguugacgucca

SEQ ID NO: 1300287 - RNA, 17 nt, Mycobacterium tuberculosis H37Rv
cacguugauucgggagg

SEQ ID NO: 1300288 - RNA, 19 nt, Mycobacterium tuberculosis H37Rv
cacguugcagcucgauccg

SEQ ID NO: 1300289 - RNA, 20 nt, Mycobacterium tuberculosis H37Rv
cacguuguucaccgacgcga

SEQ ID NO: 1300290 - RNA, 17 nt, Mycobacterium tuberculosis H37Rv
cacuaggaagguggccc

SEQ ID NO: 1300291 - RNA, 17 nt, Mycobacterium tuberculosis H37Rv
cacguuggcggccagcg

SEQ ID NO: 1300292 - RNA, 22 nt, Mycobacterium tuberculosis H37Rv
cacguuggcggccagcgcaccg

SEQ ID NO: 1300293 - RNA, 14 nt, Mycobacterium tuberculosis H37Rv
cacguugugagcca

SEQ ID NO: 1300294 - RNA, 23 nt, Mycobacterium tuberculosis H37Rv
cacucagcaggggaucguccggc

SEQ ID NO: 1300295 - RNA, 18 nt, Mycobacterium tuberculosis H37Rv
cacuggaccacucggcgg

SEQ ID NO: 1300296 - RNA, 19 nt, Mycobacterium tuberculosis H37Rv
cacuggauccgggagucga

SEQ ID NO: 1300297 - RNA, 19 nt, Mycobacterium tuberculosis H37Rv
cacuucacgaguagcgguu

SEQ ID NO: 1300298 - RNA, 18 nt, Mycobacterium tuberculosis H37Rv
cacuucauggggcuaugg

SEQ ID NO: 1300299 - RNA, 14 nt, Mycobacterium tuberculosis H37Rv
cacuuccggcgugg

SEQ ID NO: 1300300 - RNA, 18 nt, Mycobacterium tuberculosis H37Rv
cacuuccggauucggacu

SEQ ID NO: 1300301 - RNA, 20 nt, Mycobacterium tuberculosis H37Rv
cacuugcucggcgagccucu

SEQ ID NO: 1300302 - RNA, 20 nt, Mycobacterium tuberculosis H37Rv
cacuugcagcacaacgucuu

SEQ ID NO: 1300303 - RNA, 16 nt, Mycobacterium tuberculosis H37Rv
cacuugcagcacaacg

SEQ ID NO: 1300304 - RNA, 15 nt, Mycobacterium tuberculosis H37Rv
cacuugcgccaccgu

SEQ ID NO: 1300305 - RNA, 20 nt, Mycobacterium tuberculosis H37Rv
cacuugcgccaccguggccg

SEQ ID NO: 1300306 - RNA, 18 nt, Mycobacterium tuberculosis H37Rv
cacuugaucgacggccau

SEQ ID NO: 1300307 - RNA, 14 nt, Mycobacterium tuberculosis H37Rv
cacuucggcgucca

SEQ ID NO: 1300308 - RNA, 22 nt, Mycobacterium tuberculosis H37Rv
cagaacgcaucggucccacugc

SEQ ID NO: 1300309 - RNA, 12 nt, Mycobacterium tuberculosis H37Rv
cagaacguggcc

SEQ ID NO: 1300310 - RNA, 22 nt, Mycobacterium tuberculosis H37Rv
cagaaucgcacaaaaucagcga

SEQ ID NO: 1300311 - RNA, 18 nt, Mycobacterium tuberculosis H37Rv
cagaagaagaugaucgcg

SEQ ID NO: 1300312 - RNA, 21 nt, Mycobacterium tuberculosis H37Rv
cacuuuguagcccgcgaucuc

SEQ ID NO: 1300313 - RNA, 14 nt, Mycobacterium tuberculosis H37Rv
cagaacaccaccgc

SEQ ID NO: 1300314 - RNA, 19 nt, Mycobacterium tuberculosis H37Rv
cagaaccgccaacauuggu

SEQ ID NO: 1300315 - RNA, 14 nt, Mycobacterium tuberculosis H37Rv
cagaacaugccgga

SEQ ID NO: 1300316 - RNA, 17 nt, Mycobacterium tuberculosis H37Rv
cagaucgucacucccga

SEQ ID NO: 1300317 - RNA, 17 nt, Mycobacterium tuberculosis H37Rv
cagaucuggguucccga

SEQ ID NO: 1300318 - RNA, 16 nt, Mycobacterium tuberculosis H37Rv
cagaugaaggugacga

SEQ ID NO: 1300319 - RNA, 19 nt, Mycobacterium tuberculosis H37Rv
cagaucaggguggcgcggu

SEQ ID NO: 1300320 - RNA, 21 nt, Mycobacterium tuberculosis H37Rv
cagauccgggcaugcgccgua

SEQ ID NO: 1300321 - RNA, 16 nt, Mycobacterium tuberculosis H37Rv
cagaucgaaaucagcc

SEQ ID NO: 1300322 - RNA, 21 nt, Mycobacterium tuberculosis H37Rv
cagagcguuccgcucgaaucg

SEQ ID NO: 1300323 - RNA, 20 nt, Mycobacterium tuberculosis H37Rv
cagagcgucgaacacgucgg

SEQ ID NO: 1300324 - RNA, 14 nt, Mycobacterium tuberculosis H37Rv
cagaggacccgugc

SEQ ID NO: 1300325 - RNA, 13 nt, Mycobacterium tuberculosis H37Rv
cagaggucgccgg

SEQ ID NO: 1300326 - RNA, 19 nt, Mycobacterium tuberculosis H37Rv
cagaguucccugaugggcg

SEQ ID NO: 1300327 - RNA, 22 nt, Mycobacterium tuberculosis H37Rv
cagagugguggcgaucugggug

SEQ ID NO: 1300328 - RNA, 16 nt, Mycobacterium tuberculosis H37Rv
cagagucgcacugcgc

SEQ ID NO: 1300329 - RNA, 17 nt, Mycobacterium tuberculosis H37Rv
cagaggucgagcgccuu

SEQ ID NO: 1300330 - RNA, 19 nt, Mycobacterium tuberculosis H37Rv
cagaguagacaacagucga

SEQ ID NO: 1300331 - RNA, 23 nt, Mycobacterium tuberculosis H37Rv
cagaguagacaacagucgacaau

SEQ ID NO: 1300332 - RNA, 14 nt, Mycobacterium tuberculosis H37Rv
cagaucaccgccag

SEQ ID NO: 1300333 - RNA, 15 nt, Mycobacterium tuberculosis H37Rv
cagaucaggacgcga

SEQ ID NO: 1300334 - RNA, 14 nt, Mycobacterium tuberculosis H37Rv
cagauagucgccgc

SEQ ID NO: 1300335 - RNA, 19 nt, Mycobacterium tuberculosis H37Rv
cagauagucgccgccgucg

SEQ ID NO: 1300336 - RNA, 20 nt, Mycobacterium tuberculosis H37Rv
cagaguuugcgaugcccacg

SEQ ID NO: 1300337 - RNA, 14 nt, Mycobacterium tuberculosis H37Rv
cagacucgauaugc

SEQ ID NO: 1300338 - RNA, 20 nt, Mycobacterium tuberculosis H37Rv
cagacgcagagucgcacugc

SEQ ID NO: 1300339 - RNA, 18 nt, Mycobacterium tuberculosis H37Rv
cagacguccugggcccga

SEQ ID NO: 1300340 - RNA, 19 nt, Mycobacterium tuberculosis H37Rv
cagacguccuucgcuggua

SEQ ID NO: 1300341 - RNA, 22 nt, Mycobacterium tuberculosis H37Rv
cagacgcauaagcccccgacac

SEQ ID NO: 1300342 - RNA, 15 nt, Mycobacterium tuberculosis H37Rv
aaagagccagcggca

SEQ ID NO: 1300343 - RNA, 16 nt, Mycobacterium tuberculosis H37Rv
cagagacaugccggcg

SEQ ID NO: 1300344 - RNA, 20 nt, Mycobacterium tuberculosis H37Rv
cagacgcagaaucgcccaau

SEQ ID NO: 1300345 - RNA, 19 nt, Mycobacterium tuberculosis H37Rv
cagacgcagaaucgcccaa

SEQ ID NO: 1300346 - RNA, 15 nt, Mycobacterium tuberculosis H37Rv
cagacgcagagucgc

SEQ ID NO: 1300347 - RNA, 19 nt, Mycobacterium tuberculosis H37Rv
cagacgcagaaucgcacgc

SEQ ID NO: 1300348 - RNA, 20 nt, Mycobacterium tuberculosis H37Rv
cagacgcaacggcacccaau

SEQ ID NO: 1300349 - RNA, 15 nt, Mycobacterium tuberculosis H37Rv
cagacgcagaaucgc

SEQ ID NO: 1300350 - RNA, 16 nt, Mycobacterium tuberculosis H37Rv
cagacgcagaaucgca

SEQ ID NO: 1300351 - RNA, 19 nt, Mycobacterium tuberculosis H37Rv
cagacgcaaaaucgcccaa

SEQ ID NO: 1300352 - RNA, 19 nt, Mycobacterium tuberculosis H37Rv
cagacgcaaaaucgcccga

SEQ ID NO: 1300353 - RNA, 15 nt, Mycobacterium tuberculosis H37Rv
cagacgauucggcgg

SEQ ID NO: 1300354 - RNA, 21 nt, Mycobacterium tuberculosis H37Rv
cagacgcaaaauccccucgca

SEQ ID NO: 1300355 - RNA, 15 nt, Mycobacterium tuberculosis H37Rv
cagacaucgcgacga

SEQ ID NO: 1300356 - RNA, 20 nt, Mycobacterium tuberculosis H37Rv
cagacacagaaucgcccauu

SEQ ID NO: 1300357 - RNA, 19 nt, Mycobacterium tuberculosis H37Rv
cagacacagaaucgcccau

SEQ ID NO: 1300358 - RNA, 16 nt, Mycobacterium tuberculosis H37Rv
cagacacugcugcggc

SEQ ID NO: 1300359 - RNA, 14 nt, Mycobacterium tuberculosis H37Rv
cagacacaaccgcu

SEQ ID NO: 1300360 - RNA, 20 nt, Mycobacterium tuberculosis H37Rv
cagacacagaaucgcacgaa

SEQ ID NO: 1300361 - RNA, 12 nt, Mycobacterium tuberculosis H37Rv
cagaaugagcac

SEQ ID NO: 1300362 - RNA, 17 nt, Mycobacterium tuberculosis H37Rv
cagaaugccuggcccgu

SEQ ID NO: 1300363 - RNA, 14 nt, Mycobacterium tuberculosis H37Rv
cagcacccccucgg

SEQ ID NO: 1300364 - RNA, 13 nt, Mycobacterium tuberculosis H37Rv
cagcaccccgauc

SEQ ID NO: 1300365 - RNA, 18 nt, Mycobacterium tuberculosis H37Rv
cagcacccagacgauggc

SEQ ID NO: 1300366 - RNA, 22 nt, Mycobacterium tuberculosis H37Rv
cagcaauuuuccgucgauggac

SEQ ID NO: 1300367 - RNA, 23 nt, Mycobacterium tuberculosis H37Rv
cagcaaugcgguaccaaccugcg

SEQ ID NO: 1300368 - RNA, 18 nt, Mycobacterium tuberculosis H37Rv
cagcaccccgccgccugc

SEQ ID NO: 1300369 - RNA, 23 nt, Mycobacterium tuberculosis H37Rv
cagcacccgcuccagcucggcgg

SEQ ID NO: 1300370 - RNA, 14 nt, Mycobacterium tuberculosis H37Rv
cagcacccgcucca

SEQ ID NO: 1300371 - RNA, 17 nt, Mycobacterium tuberculosis H37Rv
cagcacccgcucggccg

SEQ ID NO: 1300372 - RNA, 18 nt, Mycobacterium tuberculosis H37Rv
cagcacccgggccuggga

SEQ ID NO: 1300373 - RNA, 13 nt, Mycobacterium tuberculosis H37Rv
cagcaccgacggc

SEQ ID NO: 1300374 - RNA, 23 nt, Mycobacterium tuberculosis H37Rv
cagcacccucaggcaaucgcggg

SEQ ID NO: 1300375 - RNA, 16 nt, Mycobacterium tuberculosis H37Rv
cagcaccgcuggcagc

SEQ ID NO: 1300376 - RNA, 14 nt, Mycobacterium tuberculosis H37Rv
cagcaccgccggug

SEQ ID NO: 1300377 - RNA, 20 nt, Mycobacterium tuberculosis H37Rv
cagcaccucgucgaucgccg

SEQ ID NO: 1300378 - RNA, 16 nt, Mycobacterium tuberculosis H37Rv
cagcacgaccucgcgc

SEQ ID NO: 1300379 - RNA, 14 nt, Mycobacterium tuberculosis H37Rv
cagcacugcggcag

SEQ ID NO: 1300380 - RNA, 22 nt, Mycobacterium tuberculosis H37Rv
cagcacucuucgaugaagcugg

SEQ ID NO: 1300381 - RNA, 14 nt, Mycobacterium tuberculosis H37Rv
cagcacgcugacca

SEQ ID NO: 1300382 - RNA, 22 nt, Mycobacterium tuberculosis H37Rv
cagcacgcucgugacgaucagc

SEQ ID NO: 1300383 - RNA, 19 nt, Mycobacterium tuberculosis H37Rv
cagcacgccguccagguuc

SEQ ID NO: 1300384 - RNA, 15 nt, Mycobacterium tuberculosis H37Rv
cagcacgccguccag

SEQ ID NO: 1300385 - RNA, 19 nt, Mycobacterium tuberculosis H37Rv
cagaugcgaaagugguggc

SEQ ID NO: 1300386 - RNA, 15 nt, Mycobacterium tuberculosis H37Rv
cagaugcauccagcu

SEQ ID NO: 1300387 - RNA, 19 nt, Mycobacterium tuberculosis H37Rv
cagaugaaggugacgacga

SEQ ID NO: 1300388 - RNA, 23 nt, Mycobacterium tuberculosis H37Rv
cagaugaauugccgggcgcacgc

SEQ ID NO: 1300389 - RNA, 23 nt, Mycobacterium tuberculosis H37Rv
cagauggcgaggucggugagguc

SEQ ID NO: 1300390 - RNA, 18 nt, Mycobacterium tuberculosis H37Rv
cagauggcauugcgccca

SEQ ID NO: 1300391 - RNA, 23 nt, Mycobacterium tuberculosis H37Rv
cagauugccugacaacucccgaa

SEQ ID NO: 1300392 - RNA, 18 nt, Mycobacterium tuberculosis H37Rv
cagauuucugggagccgg

SEQ ID NO: 1300393 - RNA, 21 nt, Mycobacterium tuberculosis H37Rv
cagauguccgacgcaccaacg

SEQ ID NO: 1300394 - RNA, 22 nt, Mycobacterium tuberculosis H37Rv
cagaugguuggaucgccaccgg

SEQ ID NO: 1300395 - RNA, 22 nt, Mycobacterium tuberculosis H37Rv
cagauggucggucgcuucagcg

SEQ ID NO: 1300396 - RNA, 14 nt, Mycobacterium tuberculosis H37Rv
cagaugggcgucgg

SEQ ID NO: 1300397 - RNA, 13 nt, Mycobacterium tuberculosis H37Rv
cagauggccaccc

SEQ ID NO: 1300398 - RNA, 14 nt, Mycobacterium tuberculosis H37Rv
cagcaaggccagca

SEQ ID NO: 1300399 - RNA, 16 nt, Mycobacterium tuberculosis H37Rv
cagcaaguucgucggg

SEQ ID NO: 1300400 - RNA, 16 nt, Mycobacterium tuberculosis H37Rv
cagcaaaaaccagcgu

SEQ ID NO: 1300401 - RNA, 12 nt, Mycobacterium tuberculosis H37Rv
cagcaacucgac

SEQ ID NO: 1300402 - RNA, 14 nt, Mycobacterium tuberculosis H37Rv
cagcaacgucggua

SEQ ID NO: 1300403 - RNA, 17 nt, Mycobacterium tuberculosis H37Rv
cagcaacaacgucugca

SEQ ID NO: 1300404 - RNA, 23 nt, Mycobacterium tuberculosis H37Rv
cagcaggaaguagccgagccagu

SEQ ID NO: 1300405 - RNA, 21 nt, Mycobacterium tuberculosis H37Rv
cagcagcuugacccacauucc

SEQ ID NO: 1300406 - RNA, 22 nt, Mycobacterium tuberculosis H37Rv
cagcagcuugacccacauuccg

SEQ ID NO: 1300407 - RNA, 20 nt, Mycobacterium tuberculosis H37Rv
cagcagcuugacaucgguca

SEQ ID NO: 1300408 - RNA, 17 nt, Mycobacterium tuberculosis H37Rv
cagcaggaucggcagca

SEQ ID NO: 1300409 - RNA, 22 nt, Mycobacterium tuberculosis H37Rv
cagcagcgggccgaagccccga

SEQ ID NO: 1300410 - RNA, 15 nt, Mycobacterium tuberculosis H37Rv
cagcagcgucaucag

SEQ ID NO: 1300411 - RNA, 19 nt, Mycobacterium tuberculosis H37Rv
cagcagcucguugaugcgg

SEQ ID NO: 1300412 - RNA, 13 nt, Mycobacterium tuberculosis H37Rv
cagcagcugcgau

SEQ ID NO: 1300413 - RNA, 14 nt, Mycobacterium tuberculosis H37Rv
cagcagcugcucca

SEQ ID NO: 1300414 - RNA, 16 nt, Mycobacterium tuberculosis H37Rv
cagcagcucgccggca

SEQ ID NO: 1300415 - RNA, 15 nt, Mycobacterium tuberculosis H37Rv
cagcagcuucggacu

SEQ ID NO: 1300416 - RNA, 18 nt, Mycobacterium tuberculosis H37Rv
cagcagcuucggacuggg

SEQ ID NO: 1300417 - RNA, 21 nt, Mycobacterium tuberculosis H37Rv
cagcagcggcggcgacgagcg

SEQ ID NO: 1300418 - RNA, 13 nt, Mycobacterium tuberculosis H37Rv
cagcagcggcgac

SEQ ID NO: 1300419 - RNA, 17 nt, Mycobacterium tuberculosis H37Rv
cagcagagccaacgcgc

SEQ ID NO: 1300420 - RNA, 15 nt, Mycobacterium tuberculosis H37Rv
cagcagcagauccca

SEQ ID NO: 1300421 - RNA, 20 nt, Mycobacterium tuberculosis H37Rv
cagcagagcggcacgcacgc

SEQ ID NO: 1300422 - RNA, 18 nt, Mycobacterium tuberculosis H37Rv
cagcacuuccaagccgac

SEQ ID NO: 1300423 - RNA, 15 nt, Mycobacterium tuberculosis H37Rv
cagcagaaacaucga

SEQ ID NO: 1300424 - RNA, 23 nt, Mycobacterium tuberculosis H37Rv
cagcagaauccugcgcugcacca

SEQ ID NO: 1300425 - RNA, 15 nt, Mycobacterium tuberculosis H37Rv
cagcaguucggcgau

SEQ ID NO: 1300426 - RNA, 18 nt, Mycobacterium tuberculosis H37Rv
cagcagggccagaccgaa

SEQ ID NO: 1300427 - RNA, 19 nt, Mycobacterium tuberculosis H37Rv
cagcagggccaccaccacg

SEQ ID NO: 1300428 - RNA, 16 nt, Mycobacterium tuberculosis H37Rv
cagcaggggacgggcg

SEQ ID NO: 1300429 - RNA, 22 nt, Mycobacterium tuberculosis H37Rv
cagcagggcuucgugcaccaca

SEQ ID NO: 1300430 - RNA, 13 nt, Mycobacterium tuberculosis H37Rv
cagcauccuucgc

SEQ ID NO: 1300431 - RNA, 14 nt, Mycobacterium tuberculosis H37Rv
cagcauccuucgcg

SEQ ID NO: 1300432 - RNA, 16 nt, Mycobacterium tuberculosis H37Rv
cagcaugccuucggcc

SEQ ID NO: 1300433 - RNA, 20 nt, Mycobacterium tuberculosis H37Rv
cagcaugcccucgcuguugg

SEQ ID NO: 1300434 - RNA, 13 nt, Mycobacterium tuberculosis H37Rv
cagcaucgcggug

SEQ ID NO: 1300435 - RNA, 17 nt, Mycobacterium tuberculosis H37Rv
cagcaugggcgagaagu

SEQ ID NO: 1300436 - RNA, 15 nt, Mycobacterium tuberculosis H37Rv
cagcauggggucagc

SEQ ID NO: 1300437 - RNA, 19 nt, Mycobacterium tuberculosis H37Rv
cagcauggggucagcucgc

SEQ ID NO: 1300438 - RNA, 14 nt, Mycobacterium tuberculosis H37Rv
cagggcgaucugcg

SEQ ID NO: 1300439 - RNA, 20 nt, Mycobacterium tuberculosis H37Rv
cagggcgcaaaccacccgca

SEQ ID NO: 1300440 - RNA, 15 nt, Mycobacterium tuberculosis H37Rv
cagggcgacggccac

SEQ ID NO: 1300441 - RNA, 22 nt, Mycobacterium tuberculosis H37Rv
cagggccuguucgagaucgccg

SEQ ID NO: 1300442 - RNA, 18 nt, Mycobacterium tuberculosis H37Rv
cagggcgcgucgacgcgg

SEQ ID NO: 1300443 - RNA, 20 nt, Mycobacterium tuberculosis H37Rv
cagggcgguggccacccggc

SEQ ID NO: 1300444 - RNA, 16 nt, Mycobacterium tuberculosis H37Rv
cagggucaccugcggg

SEQ ID NO: 1300445 - RNA, 14 nt, Mycobacterium tuberculosis H37Rv
caggggcagcgcgg

SEQ ID NO: 1300446 - RNA, 20 nt, Mycobacterium tuberculosis H37Rv
caggggacgaccaugccgau

SEQ ID NO: 1300447 - RNA, 13 nt, Mycobacterium tuberculosis H37Rv
caggggacgacca

SEQ ID NO: 1300448 - RNA, 17 nt, Mycobacterium tuberculosis H37Rv
cagggcuucgugcacca

SEQ ID NO: 1300449 - RNA, 16 nt, Mycobacterium tuberculosis H37Rv
caggggaucaccggcu

SEQ ID NO: 1300450 - RNA, 19 nt, Mycobacterium tuberculosis H37Rv
caggggaucaccggcugcu

SEQ ID NO: 1300451 - RNA, 15 nt, Mycobacterium tuberculosis H37Rv
cagggcucgcucgcc

SEQ ID NO: 1300452 - RNA, 22 nt, Mycobacterium tuberculosis H37Rv
caggucgagcgcccacugguga

SEQ ID NO: 1300453 - RNA, 16 nt, Mycobacterium tuberculosis H37Rv
caggucgagcaccggc

SEQ ID NO: 1300454 - RNA, 16 nt, Mycobacterium tuberculosis H37Rv
caggucgacgggcacg

SEQ ID NO: 1300455 - RNA, 23 nt, Mycobacterium tuberculosis H37Rv
cagguccaguaccuuggcgucga

SEQ ID NO: 1300456 - RNA, 12 nt, Mycobacterium tuberculosis H37Rv
caggucgaaugg

SEQ ID NO: 1300457 - RNA, 20 nt, Mycobacterium tuberculosis H37Rv
caggucgacauaggccaccu

SEQ ID NO: 1300458 - RNA, 20 nt, Mycobacterium tuberculosis H37Rv
caggucggaacuagccaguu

SEQ ID NO: 1300459 - RNA, 23 nt, Mycobacterium tuberculosis H37Rv
caggucggccaccugcucgucgg

SEQ ID NO: 1300460 - RNA, 20 nt, Mycobacterium tuberculosis H37Rv
cagguccaccgcugccggca

SEQ ID NO: 1300461 - RNA, 20 nt, Mycobacterium tuberculosis H37Rv
cagguccggguuggccaccu

SEQ ID NO: 1300462 - RNA, 23 nt, Mycobacterium tuberculosis H37Rv
cagguccgccaacggcaccucga

SEQ ID NO: 1300463 - RNA, 21 nt, Mycobacterium tuberculosis H37Rv
cagggucgaguucgcagucga

SEQ ID NO: 1300464 - RNA, 20 nt, Mycobacterium tuberculosis H37Rv
cagggucugcucauccgggu

SEQ ID NO: 1300465 - RNA, 18 nt, Mycobacterium tuberculosis H37Rv
cagguacuccccguugcc

SEQ ID NO: 1300466 - RNA, 21 nt, Mycobacterium tuberculosis H37Rv
caggguucgucgggacgccgc

SEQ ID NO: 1300467 - RNA, 20 nt, Mycobacterium tuberculosis H37Rv
cagggugugcgaacaagugg

SEQ ID NO: 1300468 - RNA, 21 nt, Mycobacterium tuberculosis H37Rv
caggguggcccggggacgggu

SEQ ID NO: 1300469 - RNA, 19 nt, Mycobacterium tuberculosis H37Rv
caggguggggcgguggccg

SEQ ID NO: 1300470 - RNA, 13 nt, Mycobacterium tuberculosis H37Rv
caggugggcagca

SEQ ID NO: 1300471 - RNA, 22 nt, Mycobacterium tuberculosis H37Rv
caggugcuguuugguugcgcca

SEQ ID NO: 1300472 - RNA, 14 nt, Mycobacterium tuberculosis H37Rv
caggucgggcagca

SEQ ID NO: 1300473 - RNA, 17 nt, Mycobacterium tuberculosis H37Rv
caggucggccgccucgu

SEQ ID NO: 1300474 - RNA, 17 nt, Mycobacterium tuberculosis H37Rv
cagguucuugaccagca

SEQ ID NO: 1300475 - RNA, 21 nt, Mycobacterium tuberculosis H37Rv
cagguucuucuccaccaccgu

SEQ ID NO: 1300476 - RNA, 16 nt, Mycobacterium tuberculosis H37Rv
cagguuccgcugucga

SEQ ID NO: 1300477 - RNA, 21 nt, Mycobacterium tuberculosis H37Rv
cagguucaugcaaaagccgcg

SEQ ID NO: 1300478 - RNA, 22 nt, Mycobacterium tuberculosis H37Rv
caggugggcguuggcgacgaag

SEQ ID NO: 1300479 - RNA, 22 nt, Mycobacterium tuberculosis H37Rv
caguacggugguaagacgccga

SEQ ID NO: 1300480 - RNA, 21 nt, Mycobacterium tuberculosis H37Rv
caguagaucgccucgacgcgg

SEQ ID NO: 1300481 - RNA, 21 nt, Mycobacterium tuberculosis H37Rv
caguaguagcgcaaccgcgcu

SEQ ID NO: 1300482 - RNA, 22 nt, Mycobacterium tuberculosis H37Rv
caguagcuguggcccgcgguga

SEQ ID NO: 1300483 - RNA, 16 nt, Mycobacterium tuberculosis H37Rv
cagguuggcacgcugu

SEQ ID NO: 1300484 - RNA, 14 nt, Mycobacterium tuberculosis H37Rv
cagguuggcaagca

SEQ ID NO: 1300485 - RNA, 18 nt, Mycobacterium tuberculosis H37Rv
cagguuggcggcugcacg

SEQ ID NO: 1300486 - RNA, 11 nt, Mycobacterium tuberculosis H37Rv
cagucggugca

SEQ ID NO: 1300487 - RNA, 14 nt, Mycobacterium tuberculosis H37Rv
cagucgcagccagg

SEQ ID NO: 1300488 - RNA, 20 nt, Mycobacterium tuberculosis H37Rv
cagucgagugaagccgacau

SEQ ID NO: 1300489 - RNA, 19 nt, Mycobacterium tuberculosis H37Rv
cagucgaucgcggcccgca

SEQ ID NO: 1300490 - RNA, 19 nt, Mycobacterium tuberculosis H37Rv
cagucgagcaucucgucgg

SEQ ID NO: 1300491 - RNA, 19 nt, Mycobacterium tuberculosis H37Rv
cagucgaacaagaccgcgg

SEQ ID NO: 1300492 - RNA, 17 nt, Mycobacterium tuberculosis H37Rv
cagucaggaaaccggcg

SEQ ID NO: 1300493 - RNA, 16 nt, Mycobacterium tuberculosis H37Rv
cagucacggaccgcuu

SEQ ID NO: 1300494 - RNA, 21 nt, Mycobacterium tuberculosis H37Rv
cagucaacagggccaggacaa

SEQ ID NO: 1300495 - RNA, 17 nt, Mycobacterium tuberculosis H37Rv
cagugcagcgaucccgg

SEQ ID NO: 1300496 - RNA, 18 nt, Mycobacterium tuberculosis H37Rv
cagugcaucgaucaccgc

SEQ ID NO: 1300497 - RNA, 23 nt, Mycobacterium tuberculosis H37Rv
cagugcggccuuggcgacgucgc

SEQ ID NO: 1300498 - RNA, 16 nt, Mycobacterium tuberculosis H37Rv
cagugcggucucgacc

SEQ ID NO: 1300499 - RNA, 23 nt, Mycobacterium tuberculosis H37Rv
cagugcgcggaucaacaggccgg

SEQ ID NO: 1300500 - RNA, 20 nt, Mycobacterium tuberculosis H37Rv
cagugcgcggaucaacaggc

SEQ ID NO: 1300501 - RNA, 14 nt, Mycobacterium tuberculosis H37Rv
cagugaaaccaccg

SEQ ID NO: 1300502 - RNA, 22 nt, Mycobacterium tuberculosis H37Rv
cagucuuguugcuuugcuggcg

SEQ ID NO: 1300503 - RNA, 12 nt, Mycobacterium tuberculosis H37Rv
cagugauucggc

SEQ ID NO: 1300504 - RNA, 22 nt, Mycobacterium tuberculosis H37Rv
cagucugggcgaucgcuucgca

SEQ ID NO: 1300505 - RNA, 14 nt, Mycobacterium tuberculosis H37Rv
caggcggacgccgc

SEQ ID NO: 1300506 - RNA, 21 nt, Mycobacterium tuberculosis H37Rv
caggcgccgucucgcggugcg

SEQ ID NO: 1300507 - RNA, 21 nt, Mycobacterium tuberculosis H37Rv
caggccuccaagcccgccgga

SEQ ID NO: 1300508 - RNA, 17 nt, Mycobacterium tuberculosis H37Rv
caggccgucggcgucga

SEQ ID NO: 1300509 - RNA, 14 nt, Mycobacterium tuberculosis H37Rv
caggccggccacca

SEQ ID NO: 1300510 - RNA, 13 nt, Mycobacterium tuberculosis H37Rv
caggccgcgucga

SEQ ID NO: 1300511 - RNA, 14 nt, Mycobacterium tuberculosis H37Rv
caggccucggcgcc

SEQ ID NO: 1300512 - RNA, 17 nt, Mycobacterium tuberculosis H37Rv
caggccuaggucgacgc

SEQ ID NO: 1300513 - RNA, 22 nt, Mycobacterium tuberculosis H37Rv
caggccucgcaccggauccacg

SEQ ID NO: 1300514 - RNA, 17 nt, Mycobacterium tuberculosis H37Rv
caggccucgcaccggau

SEQ ID NO: 1300515 - RNA, 23 nt, Mycobacterium tuberculosis H37Rv
caggcgauugcagcuucggccag

SEQ ID NO: 1300516 - RNA, 20 nt, Mycobacterium tuberculosis H37Rv
caggcgcaagguggcaugcg

SEQ ID NO: 1300517 - RNA, 14 nt, Mycobacterium tuberculosis H37Rv
caggcgcaccaggc

SEQ ID NO: 1300518 - RNA, 17 nt, Mycobacterium tuberculosis H37Rv
caggcuguccagcagcg

SEQ ID NO: 1300519 - RNA, 21 nt, Mycobacterium tuberculosis H37Rv
caggcugucaauccgcccuaa

SEQ ID NO: 1300520 - RNA, 22 nt, Mycobacterium tuberculosis H37Rv
caggcuugacugcacaccaccg

SEQ ID NO: 1300521 - RNA, 15 nt, Mycobacterium tuberculosis H37Rv
cagggagugccgcac

SEQ ID NO: 1300522 - RNA, 15 nt, Mycobacterium tuberculosis H37Rv
caggcuucccugauc

SEQ ID NO: 1300523 - RNA, 15 nt, Mycobacterium tuberculosis H37Rv
cagggcacguucggc

SEQ ID NO: 1300524 - RNA, 19 nt, Mycobacterium tuberculosis H37Rv
cagggccgcucgccucgau

SEQ ID NO: 1300525 - RNA, 20 nt, Mycobacterium tuberculosis H37Rv
caggcgggaacgaucgauga

SEQ ID NO: 1300526 - RNA, 17 nt, Mycobacterium tuberculosis H37Rv
caggcgucccgcccgga

SEQ ID NO: 1300527 - RNA, 19 nt, Mycobacterium tuberculosis H37Rv
caggcguccaucgccaccg

SEQ ID NO: 1300528 - RNA, 23 nt, Mycobacterium tuberculosis H37Rv
caggcgucccagccgaucacggg

SEQ ID NO: 1300529 - RNA, 22 nt, Mycobacterium tuberculosis H37Rv
caggcguccaucgccaccgcgu

SEQ ID NO: 1300530 - RNA, 19 nt, Mycobacterium tuberculosis H37Rv
caggcgucggugaccuucg

SEQ ID NO: 1300531 - RNA, 15 nt, Mycobacterium tuberculosis H37Rv
caggcaaccggucag

SEQ ID NO: 1300532 - RNA, 16 nt, Mycobacterium tuberculosis H37Rv
caggauccgaccccgc

SEQ ID NO: 1300533 - RNA, 16 nt, Mycobacterium tuberculosis H37Rv
caggaucagcgacuug

SEQ ID NO: 1300534 - RNA, 19 nt, Mycobacterium tuberculosis H37Rv
caggauugccgccguugcc

SEQ ID NO: 1300535 - RNA, 16 nt, Mycobacterium tuberculosis H37Rv
caggagcggauagcgg

SEQ ID NO: 1300536 - RNA, 15 nt, Mycobacterium tuberculosis H37Rv
caggacgcugccggu

SEQ ID NO: 1300537 - RNA, 16 nt, Mycobacterium tuberculosis H37Rv
caggacggaucgucgu

SEQ ID NO: 1300538 - RNA, 17 nt, Mycobacterium tuberculosis H37Rv
caggacggcuaccaccg

SEQ ID NO: 1300539 - RNA, 17 nt, Mycobacterium tuberculosis H37Rv
caggaccgggaucguca

SEQ ID NO: 1300540 - RNA, 15 nt, Mycobacterium tuberculosis H37Rv
caggacgcgaucggc

SEQ ID NO: 1300541 - RNA, 22 nt, Mycobacterium tuberculosis H37Rv
caggacgacgccgacgaugacg

SEQ ID NO: 1300542 - RNA, 21 nt, Mycobacterium tuberculosis H37Rv
caggacgaacgcgucggucga

SEQ ID NO: 1300543 - RNA, 20 nt, Mycobacterium tuberculosis H37Rv
cagcguggagcgcaaguuga

SEQ ID NO: 1300544 - RNA, 19 nt, Mycobacterium tuberculosis H37Rv
cagcgugcgcuggcugaca

SEQ ID NO: 1300545 - RNA, 19 nt, Mycobacterium tuberculosis H37Rv
cagcgugggcagcgcgauc

SEQ ID NO: 1300546 - RNA, 16 nt, Mycobacterium tuberculosis H37Rv
cagcgugggcauuccc

SEQ ID NO: 1300547 - RNA, 22 nt, Mycobacterium tuberculosis H37Rv
cagcguguugcguucggugauc

SEQ ID NO: 1300548 - RNA, 14 nt, Mycobacterium tuberculosis H37Rv
caggcaucaccgga

SEQ ID NO: 1300549 - RNA, 16 nt, Mycobacterium tuberculosis H37Rv
caggccagugccaccu

SEQ ID NO: 1300550 - RNA, 18 nt, Mycobacterium tuberculosis H37Rv
caggcaguccaccgcgcg

SEQ ID NO: 1300551 - RNA, 23 nt, Mycobacterium tuberculosis H37Rv
caggcaucggugagcccguugac

SEQ ID NO: 1300552 - RNA, 16 nt, Mycobacterium tuberculosis H37Rv
caggcagcucggcaac

SEQ ID NO: 1300553 - RNA, 20 nt, Mycobacterium tuberculosis H37Rv
caggcagcggcgacacaucg

SEQ ID NO: 1300554 - RNA, 22 nt, Mycobacterium tuberculosis H37Rv
caggccgccaccgucaccgccg

SEQ ID NO: 1300555 - RNA, 18 nt, Mycobacterium tuberculosis H37Rv
caggccgcgcgcaccggu

SEQ ID NO: 1300556 - RNA, 19 nt, Mycobacterium tuberculosis H37Rv
caggccgcgcgcaccggua

SEQ ID NO: 1300557 - RNA, 14 nt, Mycobacterium tuberculosis H37Rv
caggccgacgucga

SEQ ID NO: 1300558 - RNA, 11 nt, Mycobacterium tuberculosis H37Rv
caggccgacac

SEQ ID NO: 1300559 - RNA, 20 nt, Mycobacterium tuberculosis H37Rv
caggccccacuggugcagcg

SEQ ID NO: 1300560 - RNA, 15 nt, Mycobacterium tuberculosis H37Rv
caucgacgcggccaa

SEQ ID NO: 1300561 - RNA, 13 nt, Mycobacterium tuberculosis H37Rv
caucgacgagcga

SEQ ID NO: 1300562 - RNA, 15 nt, Mycobacterium tuberculosis H37Rv
cauccuccucgucga

SEQ ID NO: 1300563 - RNA, 15 nt, Mycobacterium tuberculosis H37Rv
caucgaccuggccac

SEQ ID NO: 1300564 - RNA, 13 nt, Mycobacterium tuberculosis H37Rv
caucgaccguccg

SEQ ID NO: 1300565 - RNA, 18 nt, Mycobacterium tuberculosis H37Rv
caucgacugccagcgccg

SEQ ID NO: 1300566 - RNA, 19 nt, Mycobacterium tuberculosis H37Rv
caucgccggcacggugaac

SEQ ID NO: 1300567 - RNA, 15 nt, Mycobacterium tuberculosis H37Rv
caucgccgcuggcca

SEQ ID NO: 1300568 - RNA, 20 nt, Mycobacterium tuberculosis H37Rv
caucgccuccucgacgucgg

SEQ ID NO: 1300569 - RNA, 17 nt, Mycobacterium tuberculosis H37Rv
caucgccauaccggccg

SEQ ID NO: 1300570 - RNA, 23 nt, Mycobacterium tuberculosis H37Rv
caucgccauaggagaacuccggg

SEQ ID NO: 1300571 - RNA, 17 nt, Mycobacterium tuberculosis H37Rv
caucgccaugauggaca

SEQ ID NO: 1300572 - RNA, 13 nt, Mycobacterium tuberculosis H37Rv
caucgccagcggc

SEQ ID NO: 1300573 - RNA, 21 nt, Mycobacterium tuberculosis H37Rv
caucgccagcgccggccaggc

SEQ ID NO: 1300574 - RNA, 22 nt, Mycobacterium tuberculosis H37Rv
caucgcgggcgugccgaccagc

SEQ ID NO: 1300575 - RNA, 17 nt, Mycobacterium tuberculosis H37Rv
caucgcggcgacgucgu

SEQ ID NO: 1300576 - RNA, 19 nt, Mycobacterium tuberculosis H37Rv
caucgcggcgacgucguug

SEQ ID NO: 1300577 - RNA, 16 nt, Mycobacterium tuberculosis H37Rv
caucgcgucggcgaug

SEQ ID NO: 1300578 - RNA, 15 nt, Mycobacterium tuberculosis H37Rv
caucgcguuguaggc

SEQ ID NO: 1300579 - RNA, 21 nt, Mycobacterium tuberculosis H37Rv
caucgcgagaaggugcugcgc

SEQ ID NO: 1300580 - RNA, 19 nt, Mycobacterium tuberculosis H37Rv
caucgcgacuagacgccgc

SEQ ID NO: 1300581 - RNA, 23 nt, Mycobacterium tuberculosis H37Rv
caucgcgaaaccggaccugaccg

SEQ ID NO: 1300582 - RNA, 18 nt, Mycobacterium tuberculosis H37Rv
caucgccgcuggccagca

SEQ ID NO: 1300583 - RNA, 15 nt, Mycobacterium tuberculosis H37Rv
caucgccggcgucga

SEQ ID NO: 1300584 - RNA, 14 nt, Mycobacterium tuberculosis H37Rv
caucgccucgagga

SEQ ID NO: 1300585 - RNA, 23 nt, Mycobacterium tuberculosis H37Rv
caucgccucggcgcugcgcaccg

SEQ ID NO: 1300586 - RNA, 20 nt, Mycobacterium tuberculosis H37Rv
cauccgagcgggaacgagcc

SEQ ID NO: 1300587 - RNA, 15 nt, Mycobacterium tuberculosis H37Rv
caucccgggcagucc

SEQ ID NO: 1300588 - RNA, 21 nt, Mycobacterium tuberculosis H37Rv
cauccgccccgcccgcaccca

SEQ ID NO: 1300589 - RNA, 20 nt, Mycobacterium tuberculosis H37Rv
cauccgggccgagcgcacca

SEQ ID NO: 1300590 - RNA, 14 nt, Mycobacterium tuberculosis H37Rv
cauccgggcucgca

SEQ ID NO: 1300591 - RNA, 17 nt, Mycobacterium tuberculosis H37Rv
cauccgggcucgcaugu

SEQ ID NO: 1300592 - RNA, 18 nt, Mycobacterium tuberculosis H37Rv
cauccgggcugccacggc

SEQ ID NO: 1300593 - RNA, 18 nt, Mycobacterium tuberculosis H37Rv
cauccggucgcucgaugg

SEQ ID NO: 1300594 - RNA, 20 nt, Mycobacterium tuberculosis H37Rv
cauccgugaaucgagcaccg

SEQ ID NO: 1300595 - RNA, 19 nt, Mycobacterium tuberculosis H37Rv
cauccgucaaguggcaacc

SEQ ID NO: 1300596 - RNA, 22 nt, Mycobacterium tuberculosis H37Rv
cauccgguuuggucgccgcguc

SEQ ID NO: 1300597 - RNA, 21 nt, Mycobacterium tuberculosis H37Rv
cauccgguggugcucgucggu

SEQ ID NO: 1300598 - RNA, 21 nt, Mycobacterium tuberculosis H37Rv
cauccagcugcugccgauaca

SEQ ID NO: 1300599 - RNA, 16 nt, Mycobacterium tuberculosis H37Rv
cauccagcgcuucggc

SEQ ID NO: 1300600 - RNA, 14 nt, Mycobacterium tuberculosis H37Rv
cauccagcugcugc

SEQ ID NO: 1300601 - RNA, 23 nt, Mycobacterium tuberculosis H37Rv
caucaggucgguggucucgacgg

SEQ ID NO: 1300602 - RNA, 18 nt, Mycobacterium tuberculosis H37Rv
caucagcucgaugccgug

SEQ ID NO: 1300603 - RNA, 21 nt, Mycobacterium tuberculosis H37Rv
caucagggccuuggcgggauc

SEQ ID NO: 1300604 - RNA, 17 nt, Mycobacterium tuberculosis H37Rv
caucagauucgcgcugg

SEQ ID NO: 1300605 - RNA, 19 nt, Mycobacterium tuberculosis H37Rv
caucagaccaaugaccgcc

SEQ ID NO: 1300606 - RNA, 19 nt, Mycobacterium tuberculosis H37Rv
caucacgguggccgcacga

SEQ ID NO: 1300607 - RNA, 15 nt, Mycobacterium tuberculosis H37Rv
caucacggaccaggc

SEQ ID NO: 1300608 - RNA, 20 nt, Mycobacterium tuberculosis H37Rv
caucacggucagccguacgc

SEQ ID NO: 1300609 - RNA, 13 nt, Mycobacterium tuberculosis H37Rv
caucaccaccggc

SEQ ID NO: 1300610 - RNA, 15 nt, Mycobacterium tuberculosis H37Rv
caucaccaccggcac

SEQ ID NO: 1300611 - RNA, 17 nt, Mycobacterium tuberculosis H37Rv
caucaccaccggcaccg

SEQ ID NO: 1300612 - RNA, 17 nt, Mycobacterium tuberculosis H37Rv
cauagauacagucgacc

SEQ ID NO: 1300613 - RNA, 17 nt, Mycobacterium tuberculosis H37Rv
caguguugcaguggcga

SEQ ID NO: 1300614 - RNA, 22 nt, Mycobacterium tuberculosis H37Rv
caguguugcgcugcggccagcg

SEQ ID NO: 1300615 - RNA, 22 nt, Mycobacterium tuberculosis H37Rv
cagugugcgguuggaucggcgg

SEQ ID NO: 1300616 - RNA, 19 nt, Mycobacterium tuberculosis H37Rv
caguguggcgaugaccacg

SEQ ID NO: 1300617 - RNA, 20 nt, Mycobacterium tuberculosis H37Rv
cagugcugcaccgauucggg

SEQ ID NO: 1300618 - RNA, 12 nt, Mycobacterium tuberculosis H37Rv
cauaacagcugg

SEQ ID NO: 1300619 - RNA, 15 nt, Mycobacterium tuberculosis H37Rv
cauaacccgcaccgg

SEQ ID NO: 1300620 - RNA, 18 nt, Mycobacterium tuberculosis H37Rv
cauaacgcgaacccgcga

SEQ ID NO: 1300621 - RNA, 12 nt, Mycobacterium tuberculosis H37Rv
cauacucggcgg

SEQ ID NO: 1300622 - RNA, 15 nt, Mycobacterium tuberculosis H37Rv
cauacucgacaccga

SEQ ID NO: 1300623 - RNA, 17 nt, Mycobacterium tuberculosis H37Rv
cauagaacucgccgcug

SEQ ID NO: 1300624 - RNA, 21 nt, Mycobacterium tuberculosis H37Rv
cauacgucggggccgcacugu

SEQ ID NO: 1300625 - RNA, 16 nt, Mycobacterium tuberculosis H37Rv
cauacgauuucgacga

SEQ ID NO: 1300626 - RNA, 17 nt, Mycobacterium tuberculosis H37Rv
cauacgauuucgacgac

SEQ ID NO: 1300627 - RNA, 18 nt, Mycobacterium tuberculosis H37Rv
cauaccggccgccaucau

SEQ ID NO: 1300628 - RNA, 23 nt, Mycobacterium tuberculosis H37Rv
cauacaacuggugggccaucguc

SEQ ID NO: 1300629 - RNA, 15 nt, Mycobacterium tuberculosis H37Rv
caucgucgccgagcg

SEQ ID NO: 1300630 - RNA, 19 nt, Mycobacterium tuberculosis H37Rv
caucgucgccgaccgucac

SEQ ID NO: 1300631 - RNA, 14 nt, Mycobacterium tuberculosis H37Rv
caucgucgaagacc

SEQ ID NO: 1300632 - RNA, 22 nt, Mycobacterium tuberculosis H37Rv
caucgucgccacgaugccggcu

SEQ ID NO: 1300633 - RNA, 15 nt, Mycobacterium tuberculosis H37Rv
caucgucagcgacca

SEQ ID NO: 1300634 - RNA, 14 nt, Mycobacterium tuberculosis H37Rv
caucgucaucgacg

SEQ ID NO: 1300635 - RNA, 18 nt, Mycobacterium tuberculosis H37Rv
caucgucaucgacgagcg

SEQ ID NO: 1300636 - RNA, 21 nt, Mycobacterium tuberculosis H37Rv
caucguuggccgggcacgcga

SEQ ID NO: 1300637 - RNA, 18 nt, Mycobacterium tuberculosis H37Rv
caucguucaugaucggca

SEQ ID NO: 1300638 - RNA, 17 nt, Mycobacterium tuberculosis H37Rv
caucguugccggugccg

SEQ ID NO: 1300639 - RNA, 18 nt, Mycobacterium tuberculosis H37Rv
caucguucugacggcuug

SEQ ID NO: 1300640 - RNA, 20 nt, Mycobacterium tuberculosis H37Rv
caucguugacccggcgaugc

SEQ ID NO: 1300641 - RNA, 14 nt, Mycobacterium tuberculosis H37Rv
caucguugccgacc

SEQ ID NO: 1300642 - RNA, 16 nt, Mycobacterium tuberculosis H37Rv
caucguugccgaccgu

SEQ ID NO: 1300643 - RNA, 21 nt, Mycobacterium tuberculosis H37Rv
caucguugccgaccgucacug

SEQ ID NO: 1300644 - RNA, 13 nt, Mycobacterium tuberculosis H37Rv
caucguggccgca

SEQ ID NO: 1300645 - RNA, 24 nt, Mycobacterium tuberculosis H37Rv
caucugccaaucugcacgcgcucg

SEQ ID NO: 1300646 - RNA, 17 nt, Mycobacterium tuberculosis H37Rv
caucugccacaggcguu

SEQ ID NO: 1300647 - RNA, 18 nt, Mycobacterium tuberculosis H37Rv
caucugaucaggccacac

SEQ ID NO: 1300648 - RNA, 19 nt, Mycobacterium tuberculosis H37Rv
caucugauccggugucgcg

SEQ ID NO: 1300649 - RNA, 16 nt, Mycobacterium tuberculosis H37Rv
caucugccugccugcg

SEQ ID NO: 1300650 - RNA, 22 nt, Mycobacterium tuberculosis H37Rv
caucugcgggacgucgucguug

SEQ ID NO: 1300651 - RNA, 20 nt, Mycobacterium tuberculosis H37Rv
caucucggcgcagccgguga

SEQ ID NO: 1300652 - RNA, 14 nt, Mycobacterium tuberculosis H37Rv
caucucgucgguga

SEQ ID NO: 1300653 - RNA, 19 nt, Mycobacterium tuberculosis H37Rv
caucucggcuacgccucgg

SEQ ID NO: 1300654 - RNA, 16 nt, Mycobacterium tuberculosis H37Rv
caucuccgacucgaua

SEQ ID NO: 1300655 - RNA, 16 nt, Mycobacterium tuberculosis H37Rv
caucuccgucggccag

SEQ ID NO: 1300656 - RNA, 19 nt, Mycobacterium tuberculosis H37Rv
caucucgagcaugcccagc

SEQ ID NO: 1300657 - RNA, 14 nt, Mycobacterium tuberculosis H37Rv
caucucgacgguga

SEQ ID NO: 1300658 - RNA, 20 nt, Mycobacterium tuberculosis H37Rv
caucgggaccggggacgcgc

SEQ ID NO: 1300659 - RNA, 14 nt, Mycobacterium tuberculosis H37Rv
caucggcggcgucg

SEQ ID NO: 1300660 - RNA, 18 nt, Mycobacterium tuberculosis H37Rv
caucggcggggcccacac

SEQ ID NO: 1300661 - RNA, 19 nt, Mycobacterium tuberculosis H37Rv
caucggcggccugcucgca

SEQ ID NO: 1300662 - RNA, 16 nt, Mycobacterium tuberculosis H37Rv
caucgggauggacacc

SEQ ID NO: 1300663 - RNA, 19 nt, Mycobacterium tuberculosis H37Rv
caucgggaugcggacucag

SEQ ID NO: 1300664 - RNA, 14 nt, Mycobacterium tuberculosis H37Rv
caucgggagccgca

SEQ ID NO: 1300665 - RNA, 12 nt, Mycobacterium tuberculosis H37Rv
caucgggccaca

SEQ ID NO: 1300666 - RNA, 22 nt, Mycobacterium tuberculosis H37Rv
caucggggccugcguccgacgc

SEQ ID NO: 1300667 - RNA, 17 nt, Mycobacterium tuberculosis H37Rv
caucgggguggccacca

SEQ ID NO: 1300668 - RNA, 13 nt, Mycobacterium tuberculosis H37Rv
caucgggcgccca

SEQ ID NO: 1300669 - RNA, 18 nt, Mycobacterium tuberculosis H37Rv
caucggucagcgccgacu

SEQ ID NO: 1300670 - RNA, 19 nt, Mycobacterium tuberculosis H37Rv
caucggguggcgaggcagc

SEQ ID NO: 1300671 - RNA, 20 nt, Mycobacterium tuberculosis H37Rv
caucggugcgguucgcugcg

SEQ ID NO: 1300672 - RNA, 13 nt, Mycobacterium tuberculosis H37Rv
caucggugcgcac

SEQ ID NO: 1300673 - RNA, 20 nt, Mycobacterium tuberculosis H37Rv
caucgguggcgccgaacgcc

SEQ ID NO: 1300674 - RNA, 16 nt, Mycobacterium tuberculosis H37Rv
caucgguugacccggc

SEQ ID NO: 1300675 - RNA, 12 nt, Mycobacterium tuberculosis H37Rv
caucgguugacc

SEQ ID NO: 1300676 - RNA, 18 nt, Mycobacterium tuberculosis H37Rv
caucggcaccgucucgca

SEQ ID NO: 1300677 - RNA, 11 nt, Mycobacterium tuberculosis H37Rv
caucggcaccc

SEQ ID NO: 1300678 - RNA, 14 nt, Mycobacterium tuberculosis H37Rv
caucggauggcccc

SEQ ID NO: 1300679 - RNA, 20 nt, Mycobacterium tuberculosis H37Rv
caucggccucugaccagccg

SEQ ID NO: 1300680 - RNA, 22 nt, Mycobacterium tuberculosis H37Rv
caucggccgcggucggccacca

SEQ ID NO: 1300681 - RNA, 12 nt, Mycobacterium tuberculosis H37Rv
caucggccagcg

SEQ ID NO: 1300682 - RNA, 14 nt, Mycobacterium tuberculosis H37Rv
caucggcaucgacu

SEQ ID NO: 1300683 - RNA, 20 nt, Mycobacterium tuberculosis H37Rv
caucggccaccuguuggcau

SEQ ID NO: 1300684 - RNA, 18 nt, Mycobacterium tuberculosis H37Rv
caucggcgacaggagacg

SEQ ID NO: 1300685 - RNA, 15 nt, Mycobacterium tuberculosis H37Rv
caucggcgaacaacc

SEQ ID NO: 1300686 - RNA, 21 nt, Mycobacterium tuberculosis H37Rv
caugauucaucaacacgacgu

SEQ ID NO: 1300687 - RNA, 19 nt, Mycobacterium tuberculosis H37Rv
caugauguagcggcguucc

SEQ ID NO: 1300688 - RNA, 16 nt, Mycobacterium tuberculosis H37Rv
caugaugucgacaucg

SEQ ID NO: 1300689 - RNA, 13 nt, Mycobacterium tuberculosis H37Rv
caugauggucacg

SEQ ID NO: 1300690 - RNA, 14 nt, Mycobacterium tuberculosis H37Rv
caugaucacaccga

SEQ ID NO: 1300691 - RNA, 17 nt, Mycobacterium tuberculosis H37Rv
caugaucccaugaaguc

SEQ ID NO: 1300692 - RNA, 14 nt, Mycobacterium tuberculosis H37Rv
caugcaacacaccg

SEQ ID NO: 1300693 - RNA, 21 nt, Mycobacterium tuberculosis H37Rv
caugcaaaagccgcgaucggu

SEQ ID NO: 1300694 - RNA, 22 nt, Mycobacterium tuberculosis H37Rv
caugccaagcuccaaccaugcg

SEQ ID NO: 1300695 - RNA, 16 nt, Mycobacterium tuberculosis H37Rv
caugccgagguaacgc

SEQ ID NO: 1300696 - RNA, 19 nt, Mycobacterium tuberculosis H37Rv
caugcccgcacgcucggcg

SEQ ID NO: 1300697 - RNA, 18 nt, Mycobacterium tuberculosis H37Rv
caugcccagcgcacggac

SEQ ID NO: 1300698 - RNA, 17 nt, Mycobacterium tuberculosis H37Rv
caugcccgacgagucgc

SEQ ID NO: 1300699 - RNA, 17 nt, Mycobacterium tuberculosis H37Rv
caugcccaugauggccg

SEQ ID NO: 1300700 - RNA, 21 nt, Mycobacterium tuberculosis H37Rv
caugccgcccagugcggccac

SEQ ID NO: 1300701 - RNA, 21 nt, Mycobacterium tuberculosis H37Rv
caugccgcccaucaccccgaa

SEQ ID NO: 1300702 - RNA, 15 nt, Mycobacterium tuberculosis H37Rv
caugccggcgcacca

SEQ ID NO: 1300703 - RNA, 19 nt, Mycobacterium tuberculosis H37Rv
caugccgggauugccgucg

SEQ ID NO: 1300704 - RNA, 12 nt, Mycobacterium tuberculosis H37Rv
caucugcucgcg

SEQ ID NO: 1300705 - RNA, 15 nt, Mycobacterium tuberculosis H37Rv
caucuggcgcgccac

SEQ ID NO: 1300706 - RNA, 20 nt, Mycobacterium tuberculosis H37Rv
caucugugagauaccgacgc

SEQ ID NO: 1300707 - RNA, 18 nt, Mycobacterium tuberculosis H37Rv
caucuguaaccuccucga

SEQ ID NO: 1300708 - RNA, 15 nt, Mycobacterium tuberculosis H37Rv
caucuggucgaccau

SEQ ID NO: 1300709 - RNA, 19 nt, Mycobacterium tuberculosis H37Rv
caucuucggacgccagcuc

SEQ ID NO: 1300710 - RNA, 13 nt, Mycobacterium tuberculosis H37Rv
caucuucaucgcc

SEQ ID NO: 1300711 - RNA, 21 nt, Mycobacterium tuberculosis H37Rv
caucuuguugucgacaucggc

SEQ ID NO: 1300712 - RNA, 13 nt, Mycobacterium tuberculosis H37Rv
caucuugcggcag

SEQ ID NO: 1300713 - RNA, 18 nt, Mycobacterium tuberculosis H37Rv
caugaacgaucggaccac

SEQ ID NO: 1300714 - RNA, 18 nt, Mycobacterium tuberculosis H37Rv
caugagggcaucgagacg

SEQ ID NO: 1300715 - RNA, 14 nt, Mycobacterium tuberculosis H37Rv
caugacgaucgcgg

SEQ ID NO: 1300716 - RNA, 17 nt, Mycobacterium tuberculosis H37Rv
caugacaccggccacca

SEQ ID NO: 1300717 - RNA, 18 nt, Mycobacterium tuberculosis H37Rv
caugaacgccagcagcgc

SEQ ID NO: 1300718 - RNA, 18 nt, Mycobacterium tuberculosis H37Rv
ccaaucgucggccagcag

SEQ ID NO: 1300719 - RNA, 17 nt, Mycobacterium tuberculosis H37Rv
ccaaucgucggccagca

SEQ ID NO: 1300720 - RNA, 15 nt, Mycobacterium tuberculosis H37Rv
ccaaucgucggccag

SEQ ID NO: 1300721 - RNA, 17 nt, Mycobacterium tuberculosis H37Rv
ccaaucgggaucgcugc

SEQ ID NO: 1300722 - RNA, 19 nt, Mycobacterium tuberculosis H37Rv
ccaauccaccgauucggcg

SEQ ID NO: 1300723 - RNA, 19 nt, Mycobacterium tuberculosis H37Rv
ccaagugaccggccugcga

SEQ ID NO: 1300724 - RNA, 23 nt, Mycobacterium tuberculosis H37Rv
ccaagucgacgguggcgccgucg

SEQ ID NO: 1300725 - RNA, 18 nt, Mycobacterium tuberculosis H37Rv
ccaaguccuccacggcgg

SEQ ID NO: 1300726 - RNA, 15 nt, Mycobacterium tuberculosis H37Rv
ccaagucggagcggg

SEQ ID NO: 1300727 - RNA, 17 nt, Mycobacterium tuberculosis H37Rv
ccaaguacgcgaccgcg

SEQ ID NO: 1300728 - RNA, 18 nt, Mycobacterium tuberculosis H37Rv
ccaaggucuucaggccgc

SEQ ID NO: 1300729 - RNA, 22 nt, Mycobacterium tuberculosis H37Rv
ccaagguggcggccaguucggc

SEQ ID NO: 1300730 - RNA, 22 nt, Mycobacterium tuberculosis H37Rv
ccaagcagcugggcaucaccgc

SEQ ID NO: 1300731 - RNA, 19 nt, Mycobacterium tuberculosis H37Rv
ccaagcagacgcagaaucg

SEQ ID NO: 1300732 - RNA, 22 nt, Mycobacterium tuberculosis H37Rv
ccaagcaauuccaccgccgaga

SEQ ID NO: 1300733 - RNA, 15 nt, Mycobacterium tuberculosis H37Rv
ccaagcccaggcgau

SEQ ID NO: 1300734 - RNA, 19 nt, Mycobacterium tuberculosis H37Rv
ccaaggccgagcgcgauga

SEQ ID NO: 1300735 - RNA, 19 nt, Mycobacterium tuberculosis H37Rv
ccaaucuucucgagccgcc

SEQ ID NO: 1300736 - RNA, 23 nt, Mycobacterium tuberculosis H37Rv
ccaaugcaccguuguaugcugcg

SEQ ID NO: 1300737 - RNA, 13 nt, Mycobacterium tuberculosis H37Rv
ccaaugacgucgg

SEQ ID NO: 1300738 - RNA, 20 nt, Mycobacterium tuberculosis H37Rv
aaagcgccgaaacagcaccc

SEQ ID NO: 1300739 - RNA, 20 nt, Mycobacterium tuberculosis H37Rv
ccaauccggcgccagcagug

SEQ ID NO: 1300740 - RNA, 14 nt, Mycobacterium tuberculosis H37Rv
aaagcgagcaccgc

SEQ ID NO: 1300741 - RNA, 15 nt, Mycobacterium tuberculosis H37Rv
ccacaaacccgauga

SEQ ID NO: 1300742 - RNA, 18 nt, Mycobacterium tuberculosis H37Rv
ccaaugccguugaucgca

SEQ ID NO: 1300743 - RNA, 12 nt, Mycobacterium tuberculosis H37Rv
ccaaugccgcgg

SEQ ID NO: 1300744 - RNA, 13 nt, Mycobacterium tuberculosis H37Rv
ccacaaucgcaga

SEQ ID NO: 1300745 - RNA, 15 nt, Mycobacterium tuberculosis H37Rv
ccacaauccgcucgg

SEQ ID NO: 1300746 - RNA, 15 nt, Mycobacterium tuberculosis H37Rv
ccacaaguagccgac

SEQ ID NO: 1300747 - RNA, 17 nt, Mycobacterium tuberculosis H37Rv
ccaacagcccaccggug

SEQ ID NO: 1300748 - RNA, 18 nt, Mycobacterium tuberculosis H37Rv
ccaaccagugcagcucga

SEQ ID NO: 1300749 - RNA, 20 nt, Mycobacterium tuberculosis H37Rv
ccaacccaggguggcgacgu

SEQ ID NO: 1300750 - RNA, 22 nt, Mycobacterium tuberculosis H37Rv
ccaaccaugcgguuagcagccg

SEQ ID NO: 1300751 - RNA, 21 nt, Mycobacterium tuberculosis H37Rv
ccaacauguugucgucgccgc

SEQ ID NO: 1300752 - RNA, 16 nt, Mycobacterium tuberculosis H37Rv
ccaaaggacgacaccg

SEQ ID NO: 1300753 - RNA, 20 nt, Mycobacterium tuberculosis H37Rv
caugccgugugugcgaucca

SEQ ID NO: 1300754 - RNA, 19 nt, Mycobacterium tuberculosis H37Rv
caugccgugugugcgaucc

SEQ ID NO: 1300755 - RNA, 13 nt, Mycobacterium tuberculosis H37Rv
caugccgguguug

SEQ ID NO: 1300756 - RNA, 15 nt, Mycobacterium tuberculosis H37Rv
ccaacgcgcgaccgc

SEQ ID NO: 1300757 - RNA, 13 nt, Mycobacterium tuberculosis H37Rv
ccaagaugccgcc

SEQ ID NO: 1300758 - RNA, 21 nt, Mycobacterium tuberculosis H37Rv
ccaagaaagacgcuguccagg

SEQ ID NO: 1300759 - RNA, 12 nt, Mycobacterium tuberculosis H37Rv
ccaacgaccucc

SEQ ID NO: 1300760 - RNA, 16 nt, Mycobacterium tuberculosis H37Rv
ccaaccugggccauca

SEQ ID NO: 1300761 - RNA, 23 nt, Mycobacterium tuberculosis H37Rv
ccaaccucggaucgccaggccgu

SEQ ID NO: 1300762 - RNA, 22 nt, Mycobacterium tuberculosis H37Rv
ccaacgcaauaagggagaccgc

SEQ ID NO: 1300763 - RNA, 18 nt, Mycobacterium tuberculosis H37Rv
ccaacgcgcaggccgaca

SEQ ID NO: 1300764 - RNA, 19 nt, Mycobacterium tuberculosis H37Rv
ccaacgcggugggcacagc

SEQ ID NO: 1300765 - RNA, 20 nt, Mycobacterium tuberculosis H37Rv
ccaacgcucccuacgagccc

SEQ ID NO: 1300766 - RNA, 13 nt, Mycobacterium tuberculosis H37Rv
ccaacgccuugac

SEQ ID NO: 1300767 - RNA, 18 nt, Mycobacterium tuberculosis H37Rv
ccaccgcggucagcucgg

SEQ ID NO: 1300768 - RNA, 13 nt, Mycobacterium tuberculosis H37Rv
ccaccgcugucga

SEQ ID NO: 1300769 - RNA, 13 nt, Mycobacterium tuberculosis H37Rv
ccaccgcgguggc

SEQ ID NO: 1300770 - RNA, 14 nt, Mycobacterium tuberculosis H37Rv
ccaccgcguccagg

SEQ ID NO: 1300771 - RNA, 15 nt, Mycobacterium tuberculosis H37Rv
ccaccgcggucaccg

SEQ ID NO: 1300772 - RNA, 24 nt, Mycobacterium tuberculosis H37Rv
ccaccgcgaugccccacggugcgg

SEQ ID NO: 1300773 - RNA, 17 nt, Mycobacterium tuberculosis H37Rv
ccaccgcgacgagcggc

SEQ ID NO: 1300774 - RNA, 14 nt, Mycobacterium tuberculosis H37Rv
ccaccgcgagcaga

SEQ ID NO: 1300775 - RNA, 22 nt, Mycobacterium tuberculosis H37Rv
ccaccgccgccgccgacgccgc

SEQ ID NO: 1300776 - RNA, 14 nt, Mycobacterium tuberculosis H37Rv
ccaccgccgccgaa

SEQ ID NO: 1300777 - RNA, 21 nt, Mycobacterium tuberculosis H37Rv
ccaccgccgacaggccggcca

SEQ ID NO: 1300778 - RNA, 21 nt, Mycobacterium tuberculosis H37Rv
ccaccgccgaacagugucgau

SEQ ID NO: 1300779 - RNA, 14 nt, Mycobacterium tuberculosis H37Rv
aaagcugucgaccg

SEQ ID NO: 1300780 - RNA, 15 nt, Mycobacterium tuberculosis H37Rv
ccaccgcaucgccga

SEQ ID NO: 1300781 - RNA, 14 nt, Mycobacterium tuberculosis H37Rv
ccaccgcaucggug

SEQ ID NO: 1300782 - RNA, 17 nt, Mycobacterium tuberculosis H37Rv
ccaccgcacgcuggcgg

SEQ ID NO: 1300783 - RNA, 15 nt, Mycobacterium tuberculosis H37Rv
ccaccgcaccugcga

SEQ ID NO: 1300784 - RNA, 15 nt, Mycobacterium tuberculosis H37Rv
ccaccgauucggcga

SEQ ID NO: 1300785 - RNA, 22 nt, Mycobacterium tuberculosis H37Rv
ccaccgaguagaacuucgccag

SEQ ID NO: 1300786 - RNA, 19 nt, Mycobacterium tuberculosis H37Rv
ccaccaagcucgcaaccga

SEQ ID NO: 1300787 - RNA, 13 nt, Mycobacterium tuberculosis H37Rv
ccaccaacucggc

SEQ ID NO: 1300788 - RNA, 13 nt, Mycobacterium tuberculosis H37Rv
ccaccaagcucgc

SEQ ID NO: 1300789 - RNA, 15 nt, Mycobacterium tuberculosis H37Rv
ccaccaaacgcugcu

SEQ ID NO: 1300790 - RNA, 22 nt, Mycobacterium tuberculosis H37Rv
ccacauuggcgaucagcagccg

SEQ ID NO: 1300791 - RNA, 23 nt, Mycobacterium tuberculosis H37Rv
ccacacgcccucgacgccgcgca

SEQ ID NO: 1300792 - RNA, 15 nt, Mycobacterium tuberculosis H37Rv
ccacaccuuggccgc

SEQ ID NO: 1300793 - RNA, 22 nt, Mycobacterium tuberculosis H37Rv
ccacacggugcgauuccgcguc

SEQ ID NO: 1300794 - RNA, 14 nt, Mycobacterium tuberculosis H37Rv
ccacacggugcgau

SEQ ID NO: 1300795 - RNA, 22 nt, Mycobacterium tuberculosis H37Rv
ccaccaagcucggccagcacgc

SEQ ID NO: 1300796 - RNA, 18 nt, Mycobacterium tuberculosis H37Rv
ccaccacaugcgagucgc

SEQ ID NO: 1300797 - RNA, 15 nt, Mycobacterium tuberculosis H37Rv
ccaccagcgcccguc

SEQ ID NO: 1300798 - RNA, 23 nt, Mycobacterium tuberculosis H37Rv
ccaccacaggacaauggacacca

SEQ ID NO: 1300799 - RNA, 14 nt, Mycobacterium tuberculosis H37Rv
ccaccagcggcaua

SEQ ID NO: 1300800 - RNA, 12 nt, Mycobacterium tuberculosis H37Rv
ccaccaggucgg

SEQ ID NO: 1300801 - RNA, 16 nt, Mycobacterium tuberculosis H37Rv
ccaccaucaccgccuu

SEQ ID NO: 1300802 - RNA, 15 nt, Mycobacterium tuberculosis H37Rv
ccacuggugcagcgc

SEQ ID NO: 1300803 - RNA, 20 nt, Mycobacterium tuberculosis H37Rv
ccacugcguuccaucgccga

SEQ ID NO: 1300804 - RNA, 18 nt, Mycobacterium tuberculosis H37Rv
ccacuguuggugccgcca

SEQ ID NO: 1300805 - RNA, 16 nt, Mycobacterium tuberculosis H37Rv
ccagaaauggcgccau

SEQ ID NO: 1300806 - RNA, 23 nt, Mycobacterium tuberculosis H37Rv
ccacuccugaguuccggucgacu

SEQ ID NO: 1300807 - RNA, 18 nt, Mycobacterium tuberculosis H37Rv
ccacugccguugccgccg

SEQ ID NO: 1300808 - RNA, 13 nt, Mycobacterium tuberculosis H37Rv
ccacgugcgccac

SEQ ID NO: 1300809 - RNA, 16 nt, Mycobacterium tuberculosis H37Rv
ccacuccaggagccga

SEQ ID NO: 1300810 - RNA, 22 nt, Mycobacterium tuberculosis H37Rv
ccacuccgguggccaacaccgc

SEQ ID NO: 1300811 - RNA, 12 nt, Mycobacterium tuberculosis H37Rv
ccacgucgguga

SEQ ID NO: 1300812 - RNA, 14 nt, Mycobacterium tuberculosis H37Rv
ccacgucucgauca

SEQ ID NO: 1300813 - RNA, 20 nt, Mycobacterium tuberculosis H37Rv
ccacgugagugccggcgugc

SEQ ID NO: 1300814 - RNA, 15 nt, Mycobacterium tuberculosis H37Rv
ccacggucagcacgc

SEQ ID NO: 1300815 - RNA, 18 nt, Mycobacterium tuberculosis H37Rv
ccacggucauuggguguc

SEQ ID NO: 1300816 - RNA, 21 nt, Mycobacterium tuberculosis H37Rv
ccacggucauugggugucaau

SEQ ID NO: 1300817 - RNA, 21 nt, Mycobacterium tuberculosis H37Rv
ccacggucgccgaccacucga

SEQ ID NO: 1300818 - RNA, 17 nt, Mycobacterium tuberculosis H37Rv
ccacgggcggccaccgc

SEQ ID NO: 1300819 - RNA, 16 nt, Mycobacterium tuberculosis H37Rv
ccacggggcuuggcga

SEQ ID NO: 1300820 - RNA, 21 nt, Mycobacterium tuberculosis H37Rv
ccacggggcuuggcgacgucg

SEQ ID NO: 1300821 - RNA, 12 nt, Mycobacterium tuberculosis H37Rv
ccagacgauggc

SEQ ID NO: 1300822 - RNA, 17 nt, Mycobacterium tuberculosis H37Rv
ccagaacggcgucgaau

SEQ ID NO: 1300823 - RNA, 21 nt, Mycobacterium tuberculosis H37Rv
ccagaucgguugaucggccac

SEQ ID NO: 1300824 - RNA, 19 nt, Mycobacterium tuberculosis H37Rv
ccagaucguuccaggccgc

SEQ ID NO: 1300825 - RNA, 12 nt, Mycobacterium tuberculosis H37Rv
ccagaucgcggu

SEQ ID NO: 1300826 - RNA, 15 nt, Mycobacterium tuberculosis H37Rv
ccagauuugacgaca

SEQ ID NO: 1300827 - RNA, 15 nt, Mycobacterium tuberculosis H37Rv
ccagauggcucucgg

SEQ ID NO: 1300828 - RNA, 18 nt, Mycobacterium tuberculosis H37Rv
ccagcaccagcgucgcgg

SEQ ID NO: 1300829 - RNA, 13 nt, Mycobacterium tuberculosis H37Rv
ccagcaccagggc

SEQ ID NO: 1300830 - RNA, 13 nt, Mycobacterium tuberculosis H37Rv
ccaccgucaccgc

SEQ ID NO: 1300831 - RNA, 17 nt, Mycobacterium tuberculosis H37Rv
ccaccggcgccguguca

SEQ ID NO: 1300832 - RNA, 18 nt, Mycobacterium tuberculosis H37Rv
ccaccggcgccgccggca

SEQ ID NO: 1300833 - RNA, 18 nt, Mycobacterium tuberculosis H37Rv
aaaggcuuccgcgugcga

SEQ ID NO: 1300834 - RNA, 14 nt, Mycobacterium tuberculosis H37Rv
aaaggucggccugc

SEQ ID NO: 1300835 - RNA, 19 nt, Mycobacterium tuberculosis H37Rv
aaaggccgcggugaugggc

SEQ ID NO: 1300836 - RNA, 21 nt, Mycobacterium tuberculosis H37Rv
ccaccggccgucccgcgagca

SEQ ID NO: 1300837 - RNA, 14 nt, Mycobacterium tuberculosis H37Rv
ccaccggccgcgca

SEQ ID NO: 1300838 - RNA, 15 nt, Mycobacterium tuberculosis H37Rv
ccaccggcccucgcc

SEQ ID NO: 1300839 - RNA, 21 nt, Mycobacterium tuberculosis H37Rv
ccaccggaucgucgaacagca

SEQ ID NO: 1300840 - RNA, 21 nt, Mycobacterium tuberculosis H37Rv
ccaccggacgaaacgaucgcg

SEQ ID NO: 1300841 - RNA, 21 nt, Mycobacterium tuberculosis H37Rv
ccaccggcacccccgucgcca

SEQ ID NO: 1300842 - RNA, 19 nt, Mycobacterium tuberculosis H37Rv
ccaccggcagaugagucaa

SEQ ID NO: 1300843 - RNA, 22 nt, Mycobacterium tuberculosis H37Rv
ccaccgcggcaugugacaucgg

SEQ ID NO: 1300844 - RNA, 21 nt, Mycobacterium tuberculosis H37Rv
ccaccggcaccgccugcgccg

SEQ ID NO: 1300845 - RNA, 14 nt, Mycobacterium tuberculosis H37Rv
ccaccggcacccgc

SEQ ID NO: 1300846 - RNA, 21 nt, Mycobacterium tuberculosis H37Rv
ccacgacguucgacgacagca

SEQ ID NO: 1300847 - RNA, 14 nt, Mycobacterium tuberculosis H37Rv
ccacgacagcagag

SEQ ID NO: 1300848 - RNA, 17 nt, Mycobacterium tuberculosis H37Rv
ccacgaacacguucggg

SEQ ID NO: 1300849 - RNA, 22 nt, Mycobacterium tuberculosis H37Rv
ccaccucgaucgcgccgucggc

SEQ ID NO: 1300850 - RNA, 20 nt, Mycobacterium tuberculosis H37Rv
ccaccucuucucggacacgc

SEQ ID NO: 1300851 - RNA, 13 nt, Mycobacterium tuberculosis H37Rv
ccaccucgauggc

SEQ ID NO: 1300852 - RNA, 19 nt, Mycobacterium tuberculosis H37Rv
ccaccucgauggcguccau

SEQ ID NO: 1300853 - RNA, 22 nt, Mycobacterium tuberculosis H37Rv
ccaccgucuccggcgccaccgc

SEQ ID NO: 1300854 - RNA, 20 nt, Mycobacterium tuberculosis H37Rv
ccaccgucaugccgacgaca

SEQ ID NO: 1300855 - RNA, 18 nt, Mycobacterium tuberculosis H37Rv
ccaccgucgcaccagcga

SEQ ID NO: 1300856 - RNA, 18 nt, Mycobacterium tuberculosis H37Rv
ccacgcuuaacgacggga

SEQ ID NO: 1300857 - RNA, 18 nt, Mycobacterium tuberculosis H37Rv
ccacggcaucggccaccu

SEQ ID NO: 1300858 - RNA, 16 nt, Mycobacterium tuberculosis H37Rv
ccacggcaccgaucaa

SEQ ID NO: 1300859 - RNA, 15 nt, Mycobacterium tuberculosis H37Rv
ccacgcgccgcacau

SEQ ID NO: 1300860 - RNA, 15 nt, Mycobacterium tuberculosis H37Rv
ccacgcgcucggugc

SEQ ID NO: 1300861 - RNA, 19 nt, Mycobacterium tuberculosis H37Rv
ccacgcuccccagcgaauc

SEQ ID NO: 1300862 - RNA, 20 nt, Mycobacterium tuberculosis H37Rv
ccacgcaaaguucgucacca

SEQ ID NO: 1300863 - RNA, 17 nt, Mycobacterium tuberculosis H37Rv
ccacgcacucgucgggg

SEQ ID NO: 1300864 - RNA, 15 nt, Mycobacterium tuberculosis H37Rv
ccacgccaccgcggu

SEQ ID NO: 1300865 - RNA, 14 nt, Mycobacterium tuberculosis H37Rv
ccacgccagcucgc

SEQ ID NO: 1300866 - RNA, 18 nt, Mycobacterium tuberculosis H37Rv
ccacgaugaucccaagcg

SEQ ID NO: 1300867 - RNA, 14 nt, Mycobacterium tuberculosis H37Rv
ccacgaugucgucg

SEQ ID NO: 1300868 - RNA, 18 nt, Mycobacterium tuberculosis H37Rv
aaaguaucgcagcaucug

SEQ ID NO: 1300869 - RNA, 18 nt, Mycobacterium tuberculosis H37Rv
ccagggcggcauccccag

SEQ ID NO: 1300870 - RNA, 17 nt, Mycobacterium tuberculosis H37Rv
ccagggccgcaguggca

SEQ ID NO: 1300871 - RNA, 12 nt, Mycobacterium tuberculosis H37Rv
ccagggcgccac

SEQ ID NO: 1300872 - RNA, 18 nt, Mycobacterium tuberculosis H37Rv
ccagggcgccacggguga

SEQ ID NO: 1300873 - RNA, 15 nt, Mycobacterium tuberculosis H37Rv
ccagggccuucgggc

SEQ ID NO: 1300874 - RNA, 14 nt, Mycobacterium tuberculosis H37Rv
ccagggcagugcga

SEQ ID NO: 1300875 - RNA, 13 nt, Mycobacterium tuberculosis H37Rv
ccagggccaccgc

SEQ ID NO: 1300876 - RNA, 16 nt, Mycobacterium tuberculosis H37Rv
ccagguauguccgcca

SEQ ID NO: 1300877 - RNA, 23 nt, Mycobacterium tuberculosis H37Rv
ccagguacucaguguuccgccac

SEQ ID NO: 1300878 - RNA, 17 nt, Mycobacterium tuberculosis H37Rv
ccagguaauugccgacc

SEQ ID NO: 1300879 - RNA, 18 nt, Mycobacterium tuberculosis H37Rv
ccaguaccgucaucgcgg

SEQ ID NO: 1300880 - RNA, 22 nt, Mycobacterium tuberculosis H37Rv
ccaguaccacuguuacggccac

SEQ ID NO: 1300881 - RNA, 17 nt, Mycobacterium tuberculosis H37Rv
ccaggugguucaaccgg

SEQ ID NO: 1300882 - RNA, 16 nt, Mycobacterium tuberculosis H37Rv
ccagguuccaggucug

SEQ ID NO: 1300883 - RNA, 12 nt, Mycobacterium tuberculosis H37Rv
ccaggucggcga

SEQ ID NO: 1300884 - RNA, 21 nt, Mycobacterium tuberculosis H37Rv
ccaggucggcguugaucgaca

SEQ ID NO: 1300885 - RNA, 13 nt, Mycobacterium tuberculosis H37Rv
ccaggucggccac

SEQ ID NO: 1300886 - RNA, 16 nt, Mycobacterium tuberculosis H37Rv
ccaggucggccaccgu

SEQ ID NO: 1300887 - RNA, 19 nt, Mycobacterium tuberculosis H37Rv
ccaggucgcgauagccgcc

SEQ ID NO: 1300888 - RNA, 22 nt, Mycobacterium tuberculosis H37Rv
ccaggucgccuuucauagcuga

SEQ ID NO: 1300889 - RNA, 22 nt, Mycobacterium tuberculosis H37Rv
ccaggcaugccgcccagugcgg

SEQ ID NO: 1300890 - RNA, 13 nt, Mycobacterium tuberculosis H37Rv
ccaggccguugcc

SEQ ID NO: 1300891 - RNA, 15 nt, Mycobacterium tuberculosis H37Rv
ccaggccggugacgg

SEQ ID NO: 1300892 - RNA, 20 nt, Mycobacterium tuberculosis H37Rv
ccagggcacguucggcgcac

SEQ ID NO: 1300893 - RNA, 17 nt, Mycobacterium tuberculosis H37Rv
ccaggcgcucagcgcgg

SEQ ID NO: 1300894 - RNA, 21 nt, Mycobacterium tuberculosis H37Rv
ccaggcgcucagcgcggccac

SEQ ID NO: 1300895 - RNA, 13 nt, Mycobacterium tuberculosis H37Rv
ccaggcguucgac

SEQ ID NO: 1300896 - RNA, 19 nt, Mycobacterium tuberculosis H37Rv
ccagcuccacaaguagccg

SEQ ID NO: 1300897 - RNA, 14 nt, Mycobacterium tuberculosis H37Rv
ccagcucacccugc

SEQ ID NO: 1300898 - RNA, 23 nt, Mycobacterium tuberculosis H37Rv
ccagcucacccggagcacccggg

SEQ ID NO: 1300899 - RNA, 16 nt, Mycobacterium tuberculosis H37Rv
ccagcucacgaugucg

SEQ ID NO: 1300900 - RNA, 13 nt, Mycobacterium tuberculosis H37Rv
ccagcucggccag

SEQ ID NO: 1300901 - RNA, 12 nt, Mycobacterium tuberculosis H37Rv
ccagcucggcca

SEQ ID NO: 1300902 - RNA, 12 nt, Mycobacterium tuberculosis H37Rv
ccagcucggcac

SEQ ID NO: 1300903 - RNA, 18 nt, Mycobacterium tuberculosis H37Rv
ccagcucgcgggccgcgu

SEQ ID NO: 1300904 - RNA, 16 nt, Mycobacterium tuberculosis H37Rv
ccagcucccgcgagcg

SEQ ID NO: 1300905 - RNA, 13 nt, Mycobacterium tuberculosis H37Rv
ccagcuccgccug

SEQ ID NO: 1300906 - RNA, 19 nt, Mycobacterium tuberculosis H37Rv
ccagcucuucggggaugac

SEQ ID NO: 1300907 - RNA, 14 nt, Mycobacterium tuberculosis H37Rv
ccagcugaccagcg

SEQ ID NO: 1300908 - RNA, 20 nt, Mycobacterium tuberculosis H37Rv
ccagcugcguggcgaaccag

SEQ ID NO: 1300909 - RNA, 18 nt, Mycobacterium tuberculosis H37Rv
ccagcuggaacggcagca

SEQ ID NO: 1300910 - RNA, 15 nt, Mycobacterium tuberculosis H37Rv
ccagcugggcgacca

SEQ ID NO: 1300911 - RNA, 19 nt, Mycobacterium tuberculosis H37Rv
ccaggacggcuaccaccgc

SEQ ID NO: 1300912 - RNA, 16 nt, Mycobacterium tuberculosis H37Rv
ccaggacuggcaccgc

SEQ ID NO: 1300913 - RNA, 16 nt, Mycobacterium tuberculosis H37Rv
ccaggagcacggguug

SEQ ID NO: 1300914 - RNA, 19 nt, Mycobacterium tuberculosis H37Rv
ccaggacgacgccgacgau

SEQ ID NO: 1300915 - RNA, 14 nt, Mycobacterium tuberculosis H37Rv
ccaggacggucgcc

SEQ ID NO: 1300916 - RNA, 12 nt, Mycobacterium tuberculosis H37Rv
ccaggaccgcgc

SEQ ID NO: 1300917 - RNA, 21 nt, Mycobacterium tuberculosis H37Rv
ccaggaugccugccacccguu

SEQ ID NO: 1300918 - RNA, 12 nt, Mycobacterium tuberculosis H37Rv
ccaggaucgcgu

SEQ ID NO: 1300919 - RNA, 19 nt, Mycobacterium tuberculosis H37Rv
ccaggaucgcuacgucgac

SEQ ID NO: 1300920 - RNA, 21 nt, Mycobacterium tuberculosis H37Rv
ccaggcaaccggucagccugc

SEQ ID NO: 1300921 - RNA, 19 nt, Mycobacterium tuberculosis H37Rv
ccaggcaagccagcacugc

SEQ ID NO: 1300922 - RNA, 21 nt, Mycobacterium tuberculosis H37Rv
ccaggauggccaucagcucgc

SEQ ID NO: 1300923 - RNA, 16 nt, Mycobacterium tuberculosis H37Rv
ccagcuucucagcacc

SEQ ID NO: 1300924 - RNA, 21 nt, Mycobacterium tuberculosis H37Rv
ccagcuugaccgaccacgcga

SEQ ID NO: 1300925 - RNA, 16 nt, Mycobacterium tuberculosis H37Rv
ccaggaacucggccca

SEQ ID NO: 1300926 - RNA, 20 nt, Mycobacterium tuberculosis H37Rv
ccaggaaguagaugagcaga

SEQ ID NO: 1300927 - RNA, 14 nt, Mycobacterium tuberculosis H37Rv
ccaggaagucccgg

SEQ ID NO: 1300928 - RNA, 15 nt, Mycobacterium tuberculosis H37Rv
ccagcgaaucacccg

SEQ ID NO: 1300929 - RNA, 22 nt, Mycobacterium tuberculosis H37Rv
ccagcgaacgcugccgagccca

SEQ ID NO: 1300930 - RNA, 22 nt, Mycobacterium tuberculosis H37Rv
ccagcgcacggaccaucgccag

SEQ ID NO: 1300931 - RNA, 12 nt, Mycobacterium tuberculosis H37Rv
ccagcgcaccgc

SEQ ID NO: 1300932 - RNA, 12 nt, Mycobacterium tuberculosis H37Rv
ccagccgaucau

SEQ ID NO: 1300933 - RNA, 17 nt, Mycobacterium tuberculosis H37Rv
ccagccgaucaucaccg

SEQ ID NO: 1300934 - RNA, 16 nt, Mycobacterium tuberculosis H37Rv
ccagccgcagcaccuc

SEQ ID NO: 1300935 - RNA, 15 nt, Mycobacterium tuberculosis H37Rv
ccagcccggcccagu

SEQ ID NO: 1300936 - RNA, 19 nt, Mycobacterium tuberculosis H37Rv
ccagcccgacagcagguug

SEQ ID NO: 1300937 - RNA, 17 nt, Mycobacterium tuberculosis H37Rv
ccagccccgcuggucga

SEQ ID NO: 1300938 - RNA, 19 nt, Mycobacterium tuberculosis H37Rv
ccagcaucaguuugacgcc

SEQ ID NO: 1300939 - RNA, 19 nt, Mycobacterium tuberculosis H37Rv
ccagcagguccgccaccgc

SEQ ID NO: 1300940 - RNA, 21 nt, Mycobacterium tuberculosis H37Rv
ccagcagguauuugccgugcu

SEQ ID NO: 1300941 - RNA, 16 nt, Mycobacterium tuberculosis H37Rv
ccagcaggucgccugc

SEQ ID NO: 1300942 - RNA, 15 nt, Mycobacterium tuberculosis H37Rv
ccagccacagccgac

SEQ ID NO: 1300943 - RNA, 20 nt, Mycobacterium tuberculosis H37Rv
ccagcauucucgccgacggc

SEQ ID NO: 1300944 - RNA, 18 nt, Mycobacterium tuberculosis H37Rv
ccagcauugaagaagccc

SEQ ID NO: 1300945 - RNA, 13 nt, Mycobacterium tuberculosis H37Rv
ccagccauggcag

SEQ ID NO: 1300946 - RNA, 13 nt, Mycobacterium tuberculosis H37Rv
ccagccaugcucg

SEQ ID NO: 1300947 - RNA, 21 nt, Mycobacterium tuberculosis H37Rv
ccagccauagugcggcagcgg

SEQ ID NO: 1300948 - RNA, 23 nt, Mycobacterium tuberculosis H37Rv
ccagccauagugcggcagcggug

SEQ ID NO: 1300949 - RNA, 14 nt, Mycobacterium tuberculosis H37Rv
ccagcccaggccuu

SEQ ID NO: 1300950 - RNA, 17 nt, Mycobacterium tuberculosis H37Rv
ccagcgguggaccaccg

SEQ ID NO: 1300951 - RNA, 15 nt, Mycobacterium tuberculosis H37Rv
ccagcguccagccgc

SEQ ID NO: 1300952 - RNA, 14 nt, Mycobacterium tuberculosis H37Rv
ccagcgucgccgcc

SEQ ID NO: 1300953 - RNA, 16 nt, Mycobacterium tuberculosis H37Rv
ccagcgggacaaaauc

SEQ ID NO: 1300954 - RNA, 23 nt, Mycobacterium tuberculosis H37Rv
ccagcgggaucugacccagcagc

SEQ ID NO: 1300955 - RNA, 14 nt, Mycobacterium tuberculosis H37Rv
ccagcgggcaucgc

SEQ ID NO: 1300956 - RNA, 20 nt, Mycobacterium tuberculosis H37Rv
ccagcggcugguugcgccac

SEQ ID NO: 1300957 - RNA, 24 nt, Mycobacterium tuberculosis H37Rv
ccagcgguaaugccagcggcacac

SEQ ID NO: 1300958 - RNA, 17 nt, Mycobacterium tuberculosis H37Rv
ccagcgguagccgagcu

SEQ ID NO: 1300959 - RNA, 13 nt, Mycobacterium tuberculosis H37Rv
ccagcggggucuu

SEQ ID NO: 1300960 - RNA, 15 nt, Mycobacterium tuberculosis H37Rv
ccagcggguggccau

SEQ ID NO: 1300961 - RNA, 13 nt, Mycobacterium tuberculosis H37Rv
aaauccagcagcc

SEQ ID NO: 1300962 - RNA, 15 nt, Mycobacterium tuberculosis H37Rv
ccagcgucgcggcca

SEQ ID NO: 1300963 - RNA, 17 nt, Mycobacterium tuberculosis H37Rv
ccagcguguggagcucg

SEQ ID NO: 1300964 - RNA, 14 nt, Mycobacterium tuberculosis H37Rv
ccagcgucucgauc

SEQ ID NO: 1300965 - RNA, 21 nt, Mycobacterium tuberculosis H37Rv
ccagcggcacacccaucaccg

SEQ ID NO: 1300966 - RNA, 17 nt, Mycobacterium tuberculosis H37Rv
ccagcggcaauggccag

SEQ ID NO: 1300967 - RNA, 22 nt, Mycobacterium tuberculosis H37Rv
ccagcgcguaguccgcauccgc

SEQ ID NO: 1300968 - RNA, 13 nt, Mycobacterium tuberculosis H37Rv
ccagcggccaccg

SEQ ID NO: 1300969 - RNA, 13 nt, Mycobacterium tuberculosis H37Rv
ccagcggcaccgc

SEQ ID NO: 1300970 - RNA, 17 nt, Mycobacterium tuberculosis H37Rv
ccagcggcgugacgucg

SEQ ID NO: 1300971 - RNA, 13 nt, Mycobacterium tuberculosis H37Rv
ccagcggcgccac

SEQ ID NO: 1300972 - RNA, 18 nt, Mycobacterium tuberculosis H37Rv
ccagcggcccgucaccgc

SEQ ID NO: 1300973 - RNA, 17 nt, Mycobacterium tuberculosis H37Rv
ccagcgccgacccguac

SEQ ID NO: 1300974 - RNA, 19 nt, Mycobacterium tuberculosis H37Rv
ccagcgccgacccaacccg

SEQ ID NO: 1300975 - RNA, 18 nt, Mycobacterium tuberculosis H37Rv
ccagcgccccggcgcguu

SEQ ID NO: 1300976 - RNA, 17 nt, Mycobacterium tuberculosis H37Rv
ccagcgcaucgagcccg

SEQ ID NO: 1300977 - RNA, 21 nt, Mycobacterium tuberculosis H37Rv
ccagcgcgccgaucacggugg

SEQ ID NO: 1300978 - RNA, 20 nt, Mycobacterium tuberculosis H37Rv
ccagcgcgguguagagcgca

SEQ ID NO: 1300979 - RNA, 12 nt, Mycobacterium tuberculosis H37Rv
ccagcgcggugu

SEQ ID NO: 1300980 - RNA, 16 nt, Mycobacterium tuberculosis H37Rv
cccgcaucgcggcauc

SEQ ID NO: 1300981 - RNA, 13 nt, Mycobacterium tuberculosis H37Rv
cccgcaucgccuc

SEQ ID NO: 1300982 - RNA, 13 nt, Mycobacterium tuberculosis H37Rv
cccgcagaauccg

SEQ ID NO: 1300983 - RNA, 19 nt, Mycobacterium tuberculosis H37Rv
cccgcauugacgaaacccg

SEQ ID NO: 1300984 - RNA, 22 nt, Mycobacterium tuberculosis H37Rv
cccgcaucgucgccgaccguca

SEQ ID NO: 1300985 - RNA, 19 nt, Mycobacterium tuberculosis H37Rv
cccgcacccccgacaccgc

SEQ ID NO: 1300986 - RNA, 13 nt, Mycobacterium tuberculosis H37Rv
cccgcacgcucgg

SEQ ID NO: 1300987 - RNA, 14 nt, Mycobacterium tuberculosis H37Rv
cccgcacgaagccg

SEQ ID NO: 1300988 - RNA, 20 nt, Mycobacterium tuberculosis H37Rv
cccgauggugccgacccgcc

SEQ ID NO: 1300989 - RNA, 16 nt, Mycobacterium tuberculosis H37Rv
cccgauaacaaggccg

SEQ ID NO: 1300990 - RNA, 22 nt, Mycobacterium tuberculosis H37Rv
cccgaguuugcgauacccaccg

SEQ ID NO: 1300991 - RNA, 18 nt, Mycobacterium tuberculosis H37Rv
cccgaucgucgagccgau

SEQ ID NO: 1300992 - RNA, 21 nt, Mycobacterium tuberculosis H37Rv
cccgaucugcuccucggucag

SEQ ID NO: 1300993 - RNA, 20 nt, Mycobacterium tuberculosis H37Rv
cccgaucggccaccaucgcc

SEQ ID NO: 1300994 - RNA, 14 nt, Mycobacterium tuberculosis H37Rv
cccgaucgcgccag

SEQ ID NO: 1300995 - RNA, 13 nt, Mycobacterium tuberculosis H37Rv
cccgaucggccac

SEQ ID NO: 1300996 - RNA, 19 nt, Mycobacterium tuberculosis H37Rv
cccgcccuugccgccagcc

SEQ ID NO: 1300997 - RNA, 15 nt, Mycobacterium tuberculosis H37Rv
cccgccgcugaacgg

SEQ ID NO: 1300998 - RNA, 22 nt, Mycobacterium tuberculosis H37Rv
cccgccggccccgccgucaccg

SEQ ID NO: 1300999 - RNA, 16 nt, Mycobacterium tuberculosis H37Rv
cccgccggauccgcca

SEQ ID NO: 1301000 - RNA, 22 nt, Mycobacterium tuberculosis H37Rv
cccgcgaauacgaggacgacga

SEQ ID NO: 1301001 - RNA, 22 nt, Mycobacterium tuberculosis H37Rv
cccgcccggaacggguuggcga

SEQ ID NO: 1301002 - RNA, 16 nt, Mycobacterium tuberculosis H37Rv
cccgcccugaccgccc

SEQ ID NO: 1301003 - RNA, 14 nt, Mycobacterium tuberculosis H37Rv
cccgcccuugccgc

SEQ ID NO: 1301004 - RNA, 18 nt, Mycobacterium tuberculosis H37Rv
cccgccaccgaacgcacc

SEQ ID NO: 1301005 - RNA, 13 nt, Mycobacterium tuberculosis H37Rv
cccgccacgccga

SEQ ID NO: 1301006 - RNA, 21 nt, Mycobacterium tuberculosis H37Rv
cccgccaaccccaacaucccg

SEQ ID NO: 1301007 - RNA, 14 nt, Mycobacterium tuberculosis H37Rv
cccgcauugccguc

SEQ ID NO: 1301008 - RNA, 22 nt, Mycobacterium tuberculosis H37Rv
cccgcauugccaacgcccacgu

SEQ ID NO: 1301009 - RNA, 23 nt, Mycobacterium tuberculosis H37Rv
cccggacaagguauccaacgcgc

SEQ ID NO: 1301010 - RNA, 21 nt, Mycobacterium tuberculosis H37Rv
cccggacagggugggggcauc

SEQ ID NO: 1301011 - RNA, 14 nt, Mycobacterium tuberculosis H37Rv
cccggaccaucgcc

SEQ ID NO: 1301012 - RNA, 22 nt, Mycobacterium tuberculosis H37Rv
cccggaaaaauuucuucgccga

SEQ ID NO: 1301013 - RNA, 17 nt, Mycobacterium tuberculosis H37Rv
cccggaaccagccgcgg

SEQ ID NO: 1301014 - RNA, 23 nt, Mycobacterium tuberculosis H37Rv
cccgcugccauugccugggcgac

SEQ ID NO: 1301015 - RNA, 13 nt, Mycobacterium tuberculosis H37Rv
cccgcugaucucg

SEQ ID NO: 1301016 - RNA, 17 nt, Mycobacterium tuberculosis H37Rv
cccgcugaucucggucu

SEQ ID NO: 1301017 - RNA, 14 nt, Mycobacterium tuberculosis H37Rv
cccgcucgucggua

SEQ ID NO: 1301018 - RNA, 15 nt, Mycobacterium tuberculosis H37Rv
cccgcucgcggcgac

SEQ ID NO: 1301019 - RNA, 12 nt, Mycobacterium tuberculosis H37Rv
cccgcucgaugu

SEQ ID NO: 1301020 - RNA, 12 nt, Mycobacterium tuberculosis H37Rv
cccgcgcgcuga

SEQ ID NO: 1301021 - RNA, 22 nt, Mycobacterium tuberculosis H37Rv
cccgcgccaccucccacgccgc

SEQ ID NO: 1301022 - RNA, 16 nt, Mycobacterium tuberculosis H37Rv
cccgcgcgggcggauc

SEQ ID NO: 1301023 - RNA, 14 nt, Mycobacterium tuberculosis H37Rv
cccgcgcucggcau

SEQ ID NO: 1301024 - RNA, 17 nt, Mycobacterium tuberculosis H37Rv
cccgcgcguacccgauc

SEQ ID NO: 1301025 - RNA, 14 nt, Mycobacterium tuberculosis H37Rv
cccgcgcucgcacc

SEQ ID NO: 1301026 - RNA, 18 nt, Mycobacterium tuberculosis H37Rv
cccgcgccaccgauaccg

SEQ ID NO: 1301027 - RNA, 23 nt, Mycobacterium tuberculosis H37Rv
cccgcgagguugaccaccagcgu

SEQ ID NO: 1301028 - RNA, 19 nt, Mycobacterium tuberculosis H37Rv
cccgcgggcgguaaucgcg

SEQ ID NO: 1301029 - RNA, 19 nt, Mycobacterium tuberculosis H37Rv
cccgcggucgaucaggccg

SEQ ID NO: 1301030 - RNA, 13 nt, Mycobacterium tuberculosis H37Rv
cccgcggugacgc

SEQ ID NO: 1301031 - RNA, 14 nt, Mycobacterium tuberculosis H37Rv
cccgcgcugagcac

SEQ ID NO: 1301032 - RNA, 19 nt, Mycobacterium tuberculosis H37Rv
cccgaaugccuucgaugaa

SEQ ID NO: 1301033 - RNA, 13 nt, Mycobacterium tuberculosis H37Rv
cccgacaccgccg

SEQ ID NO: 1301034 - RNA, 22 nt, Mycobacterium tuberculosis H37Rv
cccgacagauggucacccacgu

SEQ ID NO: 1301035 - RNA, 21 nt, Mycobacterium tuberculosis H37Rv
cccgacacgccgugcgugcgg

SEQ ID NO: 1301036 - RNA, 18 nt, Mycobacterium tuberculosis H37Rv
cccgaccacugaucggca

SEQ ID NO: 1301037 - RNA, 18 nt, Mycobacterium tuberculosis H37Rv
cccgagaucaccgguacg

SEQ ID NO: 1301038 - RNA, 13 nt, Mycobacterium tuberculosis H37Rv
cccgagaccaacg

SEQ ID NO: 1301039 - RNA, 16 nt, Mycobacterium tuberculosis H37Rv
cccgagaccaacgcgc

SEQ ID NO: 1301040 - RNA, 13 nt, Mycobacterium tuberculosis H37Rv
cccgagaucaccg

SEQ ID NO: 1301041 - RNA, 18 nt, Mycobacterium tuberculosis H37Rv
cccgaguugaagaagccg

SEQ ID NO: 1301042 - RNA, 22 nt, Mycobacterium tuberculosis H37Rv
cccgagggcagagcggcaguca

SEQ ID NO: 1301043 - RNA, 18 nt, Mycobacterium tuberculosis H37Rv
cccgaggcgagacgcucc

SEQ ID NO: 1301044 - RNA, 13 nt, Mycobacterium tuberculosis H37Rv
cccgagcccgcca

SEQ ID NO: 1301045 - RNA, 13 nt, Mycobacterium tuberculosis H37Rv
ccccggucggcga

SEQ ID NO: 1301046 - RNA, 14 nt, Mycobacterium tuberculosis H37Rv
ccccggucggcgac

SEQ ID NO: 1301047 - RNA, 20 nt, Mycobacterium tuberculosis H37Rv
ccccgguaccgcccgcaccg

SEQ ID NO: 1301048 - RNA, 22 nt, Mycobacterium tuberculosis H37Rv
ccccgguacgucgagggugacc

SEQ ID NO: 1301049 - RNA, 14 nt, Mycobacterium tuberculosis H37Rv
ccccgucgccaccg

SEQ ID NO: 1301050 - RNA, 12 nt, Mycobacterium tuberculosis H37Rv
ccccgucgggac

SEQ ID NO: 1301051 - RNA, 14 nt, Mycobacterium tuberculosis H37Rv
ccccgucgaucagc

SEQ ID NO: 1301052 - RNA, 16 nt, Mycobacterium tuberculosis H37Rv
ccccguccucgaucgc

SEQ ID NO: 1301053 - RNA, 18 nt, Mycobacterium tuberculosis H37Rv
ccccgucagcgggcagca

SEQ ID NO: 1301054 - RNA, 14 nt, Mycobacterium tuberculosis H37Rv
ccccgucaggauga

SEQ ID NO: 1301055 - RNA, 16 nt, Mycobacterium tuberculosis H37Rv
ccccgucaggaugauc

SEQ ID NO: 1301056 - RNA, 16 nt, Mycobacterium tuberculosis H37Rv
ccccugucaacgccgc

SEQ ID NO: 1301057 - RNA, 21 nt, Mycobacterium tuberculosis H37Rv
ccccuggccagcagagcggca

SEQ ID NO: 1301058 - RNA, 13 nt, Mycobacterium tuberculosis H37Rv
ccccuugaccgcu

SEQ ID NO: 1301059 - RNA, 19 nt, Mycobacterium tuberculosis H37Rv
ccccuuugacgccgagcac

SEQ ID NO: 1301060 - RNA, 13 nt, Mycobacterium tuberculosis H37Rv
cccccagcgccgc

SEQ ID NO: 1301061 - RNA, 14 nt, Mycobacterium tuberculosis H37Rv
ccccgaucaggccg

SEQ ID NO: 1301062 - RNA, 18 nt, Mycobacterium tuberculosis H37Rv
cccccaccagggacgaug

SEQ ID NO: 1301063 - RNA, 14 nt, Mycobacterium tuberculosis H37Rv
cccccagauccgca

SEQ ID NO: 1301064 - RNA, 15 nt, Mycobacterium tuberculosis H37Rv
ccccgaucaucgacg

SEQ ID NO: 1301065 - RNA, 13 nt, Mycobacterium tuberculosis H37Rv
ccccgccaggauc

SEQ ID NO: 1301066 - RNA, 15 nt, Mycobacterium tuberculosis H37Rv
ccccgccgagcaccg

SEQ ID NO: 1301067 - RNA, 13 nt, Mycobacterium tuberculosis H37Rv
ccccgcaucggcg

SEQ ID NO: 1301068 - RNA, 19 nt, Mycobacterium tuberculosis H37Rv
ccccgcauugccgucgggg

SEQ ID NO: 1301069 - RNA, 20 nt, Mycobacterium tuberculosis H37Rv
ccccgcacggaaggucgaca

SEQ ID NO: 1301070 - RNA, 18 nt, Mycobacterium tuberculosis H37Rv
ccccgcacggaaggucga

SEQ ID NO: 1301071 - RNA, 14 nt, Mycobacterium tuberculosis H37Rv
ccccgcagcaucgc

SEQ ID NO: 1301072 - RNA, 13 nt, Mycobacterium tuberculosis H37Rv
ccccgcagcucac

SEQ ID NO: 1301073 - RNA, 13 nt, Mycobacterium tuberculosis H37Rv
ccccgcagcucga

SEQ ID NO: 1301074 - RNA, 13 nt, Mycobacterium tuberculosis H37Rv
ccccgcugcgacg

SEQ ID NO: 1301075 - RNA, 23 nt, Mycobacterium tuberculosis H37Rv
ccccggaaagccuaguacgccga

SEQ ID NO: 1301076 - RNA, 17 nt, Mycobacterium tuberculosis H37Rv
ccccggagccucgaaca

SEQ ID NO: 1301077 - RNA, 18 nt, Mycobacterium tuberculosis H37Rv
ccccggcucucuucgcgc

SEQ ID NO: 1301078 - RNA, 18 nt, Mycobacterium tuberculosis H37Rv
ccccaagcgugcugccgc

SEQ ID NO: 1301079 - RNA, 12 nt, Mycobacterium tuberculosis H37Rv
ccccagcgacgg

SEQ ID NO: 1301080 - RNA, 15 nt, Mycobacterium tuberculosis H37Rv
ccccagcguucccgc

SEQ ID NO: 1301081 - RNA, 18 nt, Mycobacterium tuberculosis H37Rv
ccccaugccgaccggcac

SEQ ID NO: 1301082 - RNA, 12 nt, Mycobacterium tuberculosis H37Rv
ccccaugcaaca

SEQ ID NO: 1301083 - RNA, 12 nt, Mycobacterium tuberculosis H37Rv
ccccauugccgc

SEQ ID NO: 1301084 - RNA, 19 nt, Mycobacterium tuberculosis H37Rv
cccaacgcccgggcgaauc

SEQ ID NO: 1301085 - RNA, 14 nt, Mycobacterium tuberculosis H37Rv
cccaacgucgccag

SEQ ID NO: 1301086 - RNA, 13 nt, Mycobacterium tuberculosis H37Rv
cccaaccgaaccg

SEQ ID NO: 1301087 - RNA, 19 nt, Mycobacterium tuberculosis H37Rv
cccaacgagaugugagcac

SEQ ID NO: 1301088 - RNA, 13 nt, Mycobacterium tuberculosis H37Rv
cccaacgaccacc

SEQ ID NO: 1301089 - RNA, 14 nt, Mycobacterium tuberculosis H37Rv
cccaacgaccggca

SEQ ID NO: 1301090 - RNA, 15 nt, Mycobacterium tuberculosis H37Rv
cccaacgaccggcac

SEQ ID NO: 1301091 - RNA, 14 nt, Mycobacterium tuberculosis H37Rv
cccaacucggccag

SEQ ID NO: 1301092 - RNA, 18 nt, Mycobacterium tuberculosis H37Rv
cccacaugacgaucgcgg

SEQ ID NO: 1301093 - RNA, 23 nt, Mycobacterium tuberculosis H37Rv
cccaacggugggugggcgccgca

SEQ ID NO: 1301094 - RNA, 13 nt, Mycobacterium tuberculosis H37Rv
cccaaaaacggca

SEQ ID NO: 1301095 - RNA, 17 nt, Mycobacterium tuberculosis H37Rv
cccaacaucccggaccg

SEQ ID NO: 1301096 - RNA, 16 nt, Mycobacterium tuberculosis H37Rv
cccacccauggccucc

SEQ ID NO: 1301097 - RNA, 15 nt, Mycobacterium tuberculosis H37Rv
cccaccagcgcagcc

SEQ ID NO: 1301098 - RNA, 22 nt, Mycobacterium tuberculosis H37Rv
cccaccagugcaucgaucaccg

SEQ ID NO: 1301099 - RNA, 16 nt, Mycobacterium tuberculosis H37Rv
cccaccgcugcggcac

SEQ ID NO: 1301100 - RNA, 13 nt, Mycobacterium tuberculosis H37Rv
cccaccgacagcc

SEQ ID NO: 1301101 - RNA, 13 nt, Mycobacterium tuberculosis H37Rv
cccaccgaaaccg

SEQ ID NO: 1301102 - RNA, 16 nt, Mycobacterium tuberculosis H37Rv
cccacgccgguggcac

SEQ ID NO: 1301103 - RNA, 21 nt, Mycobacterium tuberculosis H37Rv
cccacgccgguggcacggccc

SEQ ID NO: 1301104 - RNA, 19 nt, Mycobacterium tuberculosis H37Rv
cccacgggccggccgagcg

SEQ ID NO: 1301105 - RNA, 22 nt, Mycobacterium tuberculosis H37Rv
cccagaaguagguuuucggcgg

SEQ ID NO: 1301106 - RNA, 12 nt, Mycobacterium tuberculosis H37Rv
cccagaccgccg

SEQ ID NO: 1301107 - RNA, 18 nt, Mycobacterium tuberculosis H37Rv
ccagucgaagaagacccg

SEQ ID NO: 1301108 - RNA, 15 nt, Mycobacterium tuberculosis H37Rv
ccagucgaagaagac

SEQ ID NO: 1301109 - RNA, 15 nt, Mycobacterium tuberculosis H37Rv
ccagucgaucgcggc

SEQ ID NO: 1301110 - RNA, 12 nt, Mycobacterium tuberculosis H37Rv
ccaguccgcugg

SEQ ID NO: 1301111 - RNA, 14 nt, Mycobacterium tuberculosis H37Rv
ccaguagaucgcga

SEQ ID NO: 1301112 - RNA, 14 nt, Mycobacterium tuberculosis H37Rv
ccaguacucggcca

SEQ ID NO: 1301113 - RNA, 21 nt, Mycobacterium tuberculosis H37Rv
ccaugcgccaacccggccaaa

SEQ ID NO: 1301114 - RNA, 21 nt, Mycobacterium tuberculosis H37Rv
ccaugcgggugucgggcagca

SEQ ID NO: 1301115 - RNA, 22 nt, Mycobacterium tuberculosis H37Rv
ccauugcgggagccucgccugu

SEQ ID NO: 1301116 - RNA, 20 nt, Mycobacterium tuberculosis H37Rv
ccauucgcgguccaucagca

SEQ ID NO: 1301117 - RNA, 16 nt, Mycobacterium tuberculosis H37Rv
ccauucggcgagaaca

SEQ ID NO: 1301118 - RNA, 11 nt, Mycobacterium tuberculosis H37Rv
ccauucgcggu

SEQ ID NO: 1301119 - RNA, 14 nt, Mycobacterium tuberculosis H37Rv
ccauugacgccguu

SEQ ID NO: 1301120 - RNA, 16 nt, Mycobacterium tuberculosis H37Rv
aaaucgacagcagcgc

SEQ ID NO: 1301121 - RNA, 21 nt, Mycobacterium tuberculosis H37Rv
aaaucgaucguguacugcucc

SEQ ID NO: 1301122 - RNA, 18 nt, Mycobacterium tuberculosis H37Rv
cccaggugggcagcaggc

SEQ ID NO: 1301123 - RNA, 19 nt, Mycobacterium tuberculosis H37Rv
cccaggucaacgacguuga

SEQ ID NO: 1301124 - RNA, 22 nt, Mycobacterium tuberculosis H37Rv
cccagcgugucuugucgcgcag

SEQ ID NO: 1301125 - RNA, 15 nt, Mycobacterium tuberculosis H37Rv
cccagcucgcgcacc

SEQ ID NO: 1301126 - RNA, 16 nt, Mycobacterium tuberculosis H37Rv
cccagcucgucgagcu

SEQ ID NO: 1301127 - RNA, 16 nt, Mycobacterium tuberculosis H37Rv
cccagcucgucgacgu

SEQ ID NO: 1301128 - RNA, 17 nt, Mycobacterium tuberculosis H37Rv
cccagcugcggucgcgg

SEQ ID NO: 1301129 - RNA, 15 nt, Mycobacterium tuberculosis H37Rv
cccaggcucgcaccg

SEQ ID NO: 1301130 - RNA, 19 nt, Mycobacterium tuberculosis H37Rv
cccagagccgcugcggcac

SEQ ID NO: 1301131 - RNA, 18 nt, Mycobacterium tuberculosis H37Rv
cccagaccgccgacgccg

SEQ ID NO: 1301132 - RNA, 15 nt, Mycobacterium tuberculosis H37Rv
cccagcagcggcacg

SEQ ID NO: 1301133 - RNA, 15 nt, Mycobacterium tuberculosis H37Rv
cccagcaggcccuug

SEQ ID NO: 1301134 - RNA, 14 nt, Mycobacterium tuberculosis H37Rv
cccagcgcggcaac

SEQ ID NO: 1301135 - RNA, 20 nt, Mycobacterium tuberculosis H37Rv
cccagcgguagccgagcucg

SEQ ID NO: 1301136 - RNA, 23 nt, Mycobacterium tuberculosis H37Rv
cccagcgucugugucccgucgau

SEQ ID NO: 1301137 - RNA, 16 nt, Mycobacterium tuberculosis H37Rv
cccaugcaacacaccg

SEQ ID NO: 1301138 - RNA, 19 nt, Mycobacterium tuberculosis H37Rv
cccaugcgguuuggaucac

SEQ ID NO: 1301139 - RNA, 13 nt, Mycobacterium tuberculosis H37Rv
cccaugcugcgca

SEQ ID NO: 1301140 - RNA, 21 nt, Mycobacterium tuberculosis H37Rv
cccauuggguaaccagcgcca

SEQ ID NO: 1301141 - RNA, 19 nt, Mycobacterium tuberculosis H37Rv
cccauuggccagguggcga

SEQ ID NO: 1301142 - RNA, 22 nt, Mycobacterium tuberculosis H37Rv
cccaucgaccgcccgccagcga

SEQ ID NO: 1301143 - RNA, 17 nt, Mycobacterium tuberculosis H37Rv
cccaucgucgagccgcc

SEQ ID NO: 1301144 - RNA, 13 nt, Mycobacterium tuberculosis H37Rv
cccaugaucuggu

SEQ ID NO: 1301145 - RNA, 21 nt, Mycobacterium tuberculosis H37Rv
cccagucccaacacggcgaca

SEQ ID NO: 1301146 - RNA, 21 nt, Mycobacterium tuberculosis H37Rv
cccagugaacucgugacagcg

SEQ ID NO: 1301147 - RNA, 14 nt, Mycobacterium tuberculosis H37Rv
cccaguagaucgcc

SEQ ID NO: 1301148 - RNA, 16 nt, Mycobacterium tuberculosis H37Rv
cccaguagaucgccuc

SEQ ID NO: 1301149 - RNA, 19 nt, Mycobacterium tuberculosis H37Rv
cccagugcacgcucggcgc

SEQ ID NO: 1301150 - RNA, 15 nt, Mycobacterium tuberculosis H37Rv
cccaguguucgacga

SEQ ID NO: 1301151 - RNA, 16 nt, Mycobacterium tuberculosis H37Rv
cccaguucgacggcgu

SEQ ID NO: 1301152 - RNA, 16 nt, Mycobacterium tuberculosis H37Rv
cccauaccuucggcga

SEQ ID NO: 1301153 - RNA, 12 nt, Mycobacterium tuberculosis H37Rv
cccauacgccgg

SEQ ID NO: 1301154 - RNA, 18 nt, Mycobacterium tuberculosis H37Rv
cccauacucggcggcuuc

SEQ ID NO: 1301155 - RNA, 14 nt, Mycobacterium tuberculosis H37Rv
cccauagcaccucg

SEQ ID NO: 1301156 - RNA, 21 nt, Mycobacterium tuberculosis H37Rv
cccaucaguugcacaccgauc

SEQ ID NO: 1301157 - RNA, 22 nt, Mycobacterium tuberculosis H37Rv
cccaucacacccgguaugcgcg

SEQ ID NO: 1301158 - RNA, 18 nt, Mycobacterium tuberculosis H37Rv
cccaucaccaccggcacc

SEQ ID NO: 1301159 - RNA, 22 nt, Mycobacterium tuberculosis H37Rv
cccauaucgaucggaucggcac

SEQ ID NO: 1301160 - RNA, 14 nt, Mycobacterium tuberculosis H37Rv
ccgacgucgaccac

SEQ ID NO: 1301161 - RNA, 15 nt, Mycobacterium tuberculosis H37Rv
ccgacgucggugacc

SEQ ID NO: 1301162 - RNA, 24 nt, Mycobacterium tuberculosis H37Rv
ccgacucaggucggugcggucauc

SEQ ID NO: 1301163 - RNA, 16 nt, Mycobacterium tuberculosis H37Rv
ccgacucaucggccgc

SEQ ID NO: 1301164 - RNA, 16 nt, Mycobacterium tuberculosis H37Rv
ccgacuccugggccaa

SEQ ID NO: 1301165 - RNA, 14 nt, Mycobacterium tuberculosis H37Rv
ccgacgucgcccau

SEQ ID NO: 1301166 - RNA, 21 nt, Mycobacterium tuberculosis H37Rv
ccgacuaucggccgccggauc

SEQ ID NO: 1301167 - RNA, 15 nt, Mycobacterium tuberculosis H37Rv
ccgacuaucggccgc

SEQ ID NO: 1301168 - RNA, 20 nt, Mycobacterium tuberculosis H37Rv
ccgacguuguagauucccga

SEQ ID NO: 1301169 - RNA, 16 nt, Mycobacterium tuberculosis H37Rv
ccgacuugucgccguu

SEQ ID NO: 1301170 - RNA, 14 nt, Mycobacterium tuberculosis H37Rv
ccgacuuggugacc

SEQ ID NO: 1301171 - RNA, 19 nt, Mycobacterium tuberculosis H37Rv
ccgacuguagaaaacccgu

SEQ ID NO: 1301172 - RNA, 12 nt, Mycobacterium tuberculosis H37Rv
ccgacuucggaa

SEQ ID NO: 1301173 - RNA, 21 nt, Mycobacterium tuberculosis H37Rv
ccgacuguccccguugagaua

SEQ ID NO: 1301174 - RNA, 17 nt, Mycobacterium tuberculosis H37Rv
ccgacuguccccguuga

SEQ ID NO: 1301175 - RNA, 20 nt, Mycobacterium tuberculosis H37Rv
ccgacuguagaaaacccgua

SEQ ID NO: 1301176 - RNA, 15 nt, Mycobacterium tuberculosis H37Rv
ccgacuguccccguu

SEQ ID NO: 1301177 - RNA, 15 nt, Mycobacterium tuberculosis H37Rv
ccgacugcugaauca

SEQ ID NO: 1301178 - RNA, 13 nt, Mycobacterium tuberculosis H37Rv
ccgacucggcacc

SEQ ID NO: 1301179 - RNA, 20 nt, Mycobacterium tuberculosis H37Rv
ccgacucgucggccugguac

SEQ ID NO: 1301180 - RNA, 23 nt, Mycobacterium tuberculosis H37Rv
ccgacugacagaagcgguucgca

SEQ ID NO: 1301181 - RNA, 20 nt, Mycobacterium tuberculosis H37Rv
ccgacucggccgugaccgag

SEQ ID NO: 1301182 - RNA, 17 nt, Mycobacterium tuberculosis H37Rv
ccgagaccgggcaacgg

SEQ ID NO: 1301183 - RNA, 21 nt, Mycobacterium tuberculosis H37Rv
ccgagacgaccuccucgauga

SEQ ID NO: 1301184 - RNA, 22 nt, Mycobacterium tuberculosis H37Rv
ccgagaccgcgugcucgagcac

SEQ ID NO: 1301185 - RNA, 22 nt, Mycobacterium tuberculosis H37Rv
ccgagaccgccgcugccgccga

SEQ ID NO: 1301186 - RNA, 20 nt, Mycobacterium tuberculosis H37Rv
ccgagaauuccccagccgca

SEQ ID NO: 1301187 - RNA, 21 nt, Mycobacterium tuberculosis H37Rv
ccgagaauuccccagccgcau

SEQ ID NO: 1301188 - RNA, 20 nt, Mycobacterium tuberculosis H37Rv
ccgagaacgcccgagugacc

SEQ ID NO: 1301189 - RNA, 16 nt, Mycobacterium tuberculosis H37Rv
ccgagagcagccagcc

SEQ ID NO: 1301190 - RNA, 15 nt, Mycobacterium tuberculosis H37Rv
ccgagagcaccgcuc

SEQ ID NO: 1301191 - RNA, 13 nt, Mycobacterium tuberculosis H37Rv
ccgagagcaccgc

SEQ ID NO: 1301192 - RNA, 23 nt, Mycobacterium tuberculosis H37Rv
ccgagacgaccuccucgaugacc

SEQ ID NO: 1301193 - RNA, 13 nt, Mycobacterium tuberculosis H37Rv
ccgagacggcguu

SEQ ID NO: 1301194 - RNA, 23 nt, Mycobacterium tuberculosis H37Rv
ccgagaugcuggucggcgaugau

SEQ ID NO: 1301195 - RNA, 15 nt, Mycobacterium tuberculosis H37Rv
ccgagauggcgauca

SEQ ID NO: 1301196 - RNA, 22 nt, Mycobacterium tuberculosis H37Rv
ccgagcaacaccccuggguuga

SEQ ID NO: 1301197 - RNA, 15 nt, Mycobacterium tuberculosis H37Rv
ccgagcaacaccguc

SEQ ID NO: 1301198 - RNA, 15 nt, Mycobacterium tuberculosis H37Rv
ccgagcaaggggauc

SEQ ID NO: 1301199 - RNA, 16 nt, Mycobacterium tuberculosis H37Rv
ccgagaucaccgguac

SEQ ID NO: 1301200 - RNA, 18 nt, Mycobacterium tuberculosis H37Rv
ccgagaucaugccggcga

SEQ ID NO: 1301201 - RNA, 14 nt, Mycobacterium tuberculosis H37Rv
ccgagaucgacauc

SEQ ID NO: 1301202 - RNA, 16 nt, Mycobacterium tuberculosis H37Rv
ccgagaucgucgcgac

SEQ ID NO: 1301203 - RNA, 20 nt, Mycobacterium tuberculosis H37Rv
ccgagaucaugccggcgaac

SEQ ID NO: 1301204 - RNA, 16 nt, Mycobacterium tuberculosis H37Rv
ccgagaugcguuccgc

SEQ ID NO: 1301205 - RNA, 18 nt, Mycobacterium tuberculosis H37Rv
ccgagaugcguuccgcga

SEQ ID NO: 1301206 - RNA, 16 nt, Mycobacterium tuberculosis H37Rv
ccgagaugcugcaccc

SEQ ID NO: 1301207 - RNA, 16 nt, Mycobacterium tuberculosis H37Rv
ccgacggccgcggcgu

SEQ ID NO: 1301208 - RNA, 17 nt, Mycobacterium tuberculosis H37Rv
ccgacgggacaacccgu

SEQ ID NO: 1301209 - RNA, 20 nt, Mycobacterium tuberculosis H37Rv
ccgacgggccacgaugcgca

SEQ ID NO: 1301210 - RNA, 18 nt, Mycobacterium tuberculosis H37Rv
ccgacguauagaccaggu

SEQ ID NO: 1301211 - RNA, 16 nt, Mycobacterium tuberculosis H37Rv
ccgacgucaggcagcu

SEQ ID NO: 1301212 - RNA, 20 nt, Mycobacterium tuberculosis H37Rv
ccgacgucaggcagcuccgc

SEQ ID NO: 1301213 - RNA, 20 nt, Mycobacterium tuberculosis H37Rv
ccgacguacaggacgguuga

SEQ ID NO: 1301214 - RNA, 22 nt, Mycobacterium tuberculosis H37Rv
ccgacggguaucccgucccagc

SEQ ID NO: 1301215 - RNA, 16 nt, Mycobacterium tuberculosis H37Rv
ccgacggaucgcccug

SEQ ID NO: 1301216 - RNA, 22 nt, Mycobacterium tuberculosis H37Rv
ccgacgcgucggcgacgcggag

SEQ ID NO: 1301217 - RNA, 15 nt, Mycobacterium tuberculosis H37Rv
ccgacggacuccggc

SEQ ID NO: 1301218 - RNA, 17 nt, Mycobacterium tuberculosis H37Rv
ccgacggccagcaagac

SEQ ID NO: 1301219 - RNA, 13 nt, Mycobacterium tuberculosis H37Rv
ccgacggccagca

SEQ ID NO: 1301220 - RNA, 11 nt, Mycobacterium tuberculosis H37Rv
ccgacggccag

SEQ ID NO: 1301221 - RNA, 16 nt, Mycobacterium tuberculosis H37Rv
ccgacgcgucggcgac

SEQ ID NO: 1301222 - RNA, 16 nt, Mycobacterium tuberculosis H37Rv
ccgacgccauuggccu

SEQ ID NO: 1301223 - RNA, 21 nt, Mycobacterium tuberculosis H37Rv
ccgacgccagcugcccgacgu

SEQ ID NO: 1301224 - RNA, 19 nt, Mycobacterium tuberculosis H37Rv
ccgacgccagaacguggcc

SEQ ID NO: 1301225 - RNA, 18 nt, Mycobacterium tuberculosis H37Rv
ccgacgccagcugcccga

SEQ ID NO: 1301226 - RNA, 14 nt, Mycobacterium tuberculosis H37Rv
ccgacgccgguguc

SEQ ID NO: 1301227 - RNA, 16 nt, Mycobacterium tuberculosis H37Rv
ccgacgccgucgagca

SEQ ID NO: 1301228 - RNA, 14 nt, Mycobacterium tuberculosis H37Rv
ccgacgcgaacgcg

SEQ ID NO: 1301229 - RNA, 15 nt, Mycobacterium tuberculosis H37Rv
ccgacgccgccggca

SEQ ID NO: 1301230 - RNA, 17 nt, Mycobacterium tuberculosis H37Rv
ccgacgaucgacgccgc

SEQ ID NO: 1301231 - RNA, 14 nt, Mycobacterium tuberculosis H37Rv
ccgacgaucgacgc

SEQ ID NO: 1301232 - RNA, 18 nt, Mycobacterium tuberculosis H37Rv
ccgacgagauacggccac

SEQ ID NO: 1301233 - RNA, 18 nt, Mycobacterium tuberculosis H37Rv
ccgacgcagcuugcccga

SEQ ID NO: 1301234 - RNA, 20 nt, Mycobacterium tuberculosis H37Rv
ccgacgaucgacgccgccac

SEQ ID NO: 1301235 - RNA, 18 nt, Mycobacterium tuberculosis H37Rv
ccgacgaucgacgccgcc

SEQ ID NO: 1301236 - RNA, 15 nt, Mycobacterium tuberculosis H37Rv
ccgacgaugugccag

SEQ ID NO: 1301237 - RNA, 14 nt, Mycobacterium tuberculosis H37Rv
ccgaccgacaccac

SEQ ID NO: 1301238 - RNA, 22 nt, Mycobacterium tuberculosis H37Rv
ccgacccgggcgagcgcggccu

SEQ ID NO: 1301239 - RNA, 16 nt, Mycobacterium tuberculosis H37Rv
ccgaccccgccgagcg

SEQ ID NO: 1301240 - RNA, 23 nt, Mycobacterium tuberculosis H37Rv
ccgacccgccgcgcccggcgcaa

SEQ ID NO: 1301241 - RNA, 13 nt, Mycobacterium tuberculosis H37Rv
ccgacccgccgau

SEQ ID NO: 1301242 - RNA, 22 nt, Mycobacterium tuberculosis H37Rv
ccgaccaucgggacgccuugau

SEQ ID NO: 1301243 - RNA, 17 nt, Mycobacterium tuberculosis H37Rv
ccgaccaucucaccggg

SEQ ID NO: 1301244 - RNA, 22 nt, Mycobacterium tuberculosis H37Rv
ccgaccagcgcgcugcgcgacu

SEQ ID NO: 1301245 - RNA, 16 nt, Mycobacterium tuberculosis H37Rv
ccgaccagcgcggcac

SEQ ID NO: 1301246 - RNA, 19 nt, Mycobacterium tuberculosis H37Rv
ccgaccaggccagagccgc

SEQ ID NO: 1301247 - RNA, 12 nt, Mycobacterium tuberculosis H37Rv
ccgaccagccgu

SEQ ID NO: 1301248 - RNA, 13 nt, Mycobacterium tuberculosis H37Rv
ccgaccagccgau

SEQ ID NO: 1301249 - RNA, 13 nt, Mycobacterium tuberculosis H37Rv
ccgaccagcagau

SEQ ID NO: 1301250 - RNA, 13 nt, Mycobacterium tuberculosis H37Rv
ccgaccacgcgag

SEQ ID NO: 1301251 - RNA, 16 nt, Mycobacterium tuberculosis H37Rv
ccgaccaccucagcug

SEQ ID NO: 1301252 - RNA, 17 nt, Mycobacterium tuberculosis H37Rv
ccgacgaccgccugcaa

SEQ ID NO: 1301253 - RNA, 16 nt, Mycobacterium tuberculosis H37Rv
ccgacgacggcaccga

SEQ ID NO: 1301254 - RNA, 16 nt, Mycobacterium tuberculosis H37Rv
ccgacgacggcgacgg

SEQ ID NO: 1301255 - RNA, 20 nt, Mycobacterium tuberculosis H37Rv
ccgaccucgccgcgcgugac

SEQ ID NO: 1301256 - RNA, 22 nt, Mycobacterium tuberculosis H37Rv
ccgaccuccuccuugaaccggg

SEQ ID NO: 1301257 - RNA, 19 nt, Mycobacterium tuberculosis H37Rv
ccgaccucguucgucacca

SEQ ID NO: 1301258 - RNA, 20 nt, Mycobacterium tuberculosis H37Rv
ccgaccuaccgucgaccacu

SEQ ID NO: 1301259 - RNA, 15 nt, Mycobacterium tuberculosis H37Rv
ccgaccuaccgucga

SEQ ID NO: 1301260 - RNA, 17 nt, Mycobacterium tuberculosis H37Rv
ccgaccgucgucgugca

SEQ ID NO: 1301261 - RNA, 13 nt, Mycobacterium tuberculosis H37Rv
ccgaccggcaccc

SEQ ID NO: 1301262 - RNA, 15 nt, Mycobacterium tuberculosis H37Rv
ccgaccggcagcgau

SEQ ID NO: 1301263 - RNA, 23 nt, Mycobacterium tuberculosis H37Rv
ccgaccggcagcgaugcgguguc

SEQ ID NO: 1301264 - RNA, 16 nt, Mycobacterium tuberculosis H37Rv
ccgaccgcgccgcauc

SEQ ID NO: 1301265 - RNA, 11 nt, Mycobacterium tuberculosis H37Rv
ccgaccgcguu

SEQ ID NO: 1301266 - RNA, 13 nt, Mycobacterium tuberculosis H37Rv
ccgaccgcaccgu

SEQ ID NO: 1301267 - RNA, 17 nt, Mycobacterium tuberculosis H37Rv
ccgaccgcacgaucgca

SEQ ID NO: 1301268 - RNA, 17 nt, Mycobacterium tuberculosis H37Rv
ccgaccgccaccgccag

SEQ ID NO: 1301269 - RNA, 21 nt, Mycobacterium tuberculosis H37Rv
ccgacaauggcagcgagacgu

SEQ ID NO: 1301270 - RNA, 15 nt, Mycobacterium tuberculosis H37Rv
ccgacaccaggucgg

SEQ ID NO: 1301271 - RNA, 12 nt, Mycobacterium tuberculosis H37Rv
ccgacacccgua

SEQ ID NO: 1301272 - RNA, 23 nt, Mycobacterium tuberculosis H37Rv
ccgacaccgccccgccgcgacgg

SEQ ID NO: 1301273 - RNA, 13 nt, Mycobacterium tuberculosis H37Rv
ccgacaccgccga

SEQ ID NO: 1301274 - RNA, 14 nt, Mycobacterium tuberculosis H37Rv
ccgacaccggcuga

SEQ ID NO: 1301275 - RNA, 15 nt, Mycobacterium tuberculosis H37Rv
ccgacaccgugccgc

SEQ ID NO: 1301276 - RNA, 13 nt, Mycobacterium tuberculosis H37Rv
ccgacaccgucca

SEQ ID NO: 1301277 - RNA, 23 nt, Mycobacterium tuberculosis H37Rv
ccgaaucguuugaacuucgccgu

SEQ ID NO: 1301278 - RNA, 22 nt, Mycobacterium tuberculosis H37Rv
ccgaaucgugcggcgaccguca

SEQ ID NO: 1301279 - RNA, 15 nt, Mycobacterium tuberculosis H37Rv
ccgaagucucgguga

SEQ ID NO: 1301280 - RNA, 19 nt, Mycobacterium tuberculosis H37Rv
ccgacaacgacgucgccga

SEQ ID NO: 1301281 - RNA, 18 nt, Mycobacterium tuberculosis H37Rv
ccgaauuugucggcgaag

SEQ ID NO: 1301282 - RNA, 17 nt, Mycobacterium tuberculosis H37Rv
ccgaauuugucggcgaa

SEQ ID NO: 1301283 - RNA, 20 nt, Mycobacterium tuberculosis H37Rv
ccgacaaccuuggcgacugu

SEQ ID NO: 1301284 - RNA, 18 nt, Mycobacterium tuberculosis H37Rv
ccgaauuccucaaggucg

SEQ ID NO: 1301285 - RNA, 21 nt, Mycobacterium tuberculosis H37Rv
ccgaaugugaaaugcgcgauc

SEQ ID NO: 1301286 - RNA, 23 nt, Mycobacterium tuberculosis H37Rv
ccgacaucgcugcgacuggccgu

SEQ ID NO: 1301287 - RNA, 18 nt, Mycobacterium tuberculosis H37Rv
ccgacaguuuaccgugcc

SEQ ID NO: 1301288 - RNA, 19 nt, Mycobacterium tuberculosis H37Rv
ccgacaguggucccgguga

SEQ ID NO: 1301289 - RNA, 18 nt, Mycobacterium tuberculosis H37Rv
ccgacaugaaccggucga

SEQ ID NO: 1301290 - RNA, 13 nt, Mycobacterium tuberculosis H37Rv
ccgaccaccgcga

SEQ ID NO: 1301291 - RNA, 19 nt, Mycobacterium tuberculosis H37Rv
ccgaccaaaccgacgcggg

SEQ ID NO: 1301292 - RNA, 13 nt, Mycobacterium tuberculosis H37Rv
ccgaccacauucc

SEQ ID NO: 1301293 - RNA, 18 nt, Mycobacterium tuberculosis H37Rv
ccgacacugggaucccga

SEQ ID NO: 1301294 - RNA, 19 nt, Mycobacterium tuberculosis H37Rv
ccgacagcagguugccgaa

SEQ ID NO: 1301295 - RNA, 15 nt, Mycobacterium tuberculosis H37Rv
ccgacagcgccuugu

SEQ ID NO: 1301296 - RNA, 18 nt, Mycobacterium tuberculosis H37Rv
ccgacacuuaaccugaac

SEQ ID NO: 1301297 - RNA, 21 nt, Mycobacterium tuberculosis H37Rv
ccgacacuuaaccugaaccgg

SEQ ID NO: 1301298 - RNA, 21 nt, Mycobacterium tuberculosis H37Rv
ccgacacucgauccggauuca

SEQ ID NO: 1301299 - RNA, 18 nt, Mycobacterium tuberculosis H37Rv
cccguacccacgacgggc

SEQ ID NO: 1301300 - RNA, 14 nt, Mycobacterium tuberculosis H37Rv
cccguagcugcgca

SEQ ID NO: 1301301 - RNA, 23 nt, Mycobacterium tuberculosis H37Rv
cccgguguccagccacgcugucc

SEQ ID NO: 1301302 - RNA, 20 nt, Mycobacterium tuberculosis H37Rv
cccgguggcguuugaugcgg

SEQ ID NO: 1301303 - RNA, 19 nt, Mycobacterium tuberculosis H37Rv
cccgguguugccgugacga

SEQ ID NO: 1301304 - RNA, 16 nt, Mycobacterium tuberculosis H37Rv
cccgguguguucggcc

SEQ ID NO: 1301305 - RNA, 16 nt, Mycobacterium tuberculosis H37Rv
cccgucacgcccgcga

SEQ ID NO: 1301306 - RNA, 20 nt, Mycobacterium tuberculosis H37Rv
cccguccaggcgcugcagca

SEQ ID NO: 1301307 - RNA, 20 nt, Mycobacterium tuberculosis H37Rv
cccgucauacucgacaccga

SEQ ID NO: 1301308 - RNA, 19 nt, Mycobacterium tuberculosis H37Rv
cccguuuugggugaucgca

SEQ ID NO: 1301309 - RNA, 22 nt, Mycobacterium tuberculosis H37Rv
cccguuguccagaacggcgauc

SEQ ID NO: 1301310 - RNA, 22 nt, Mycobacterium tuberculosis H37Rv
cccguugagauaccccgagacc

SEQ ID NO: 1301311 - RNA, 23 nt, Mycobacterium tuberculosis H37Rv
cccguugaucgcggacacugcga

SEQ ID NO: 1301312 - RNA, 14 nt, Mycobacterium tuberculosis H37Rv
cccguucgaacugg

SEQ ID NO: 1301313 - RNA, 12 nt, Mycobacterium tuberculosis H37Rv
cccguugacguu

SEQ ID NO: 1301314 - RNA, 12 nt, Mycobacterium tuberculosis H37Rv
cccgucgagcag

SEQ ID NO: 1301315 - RNA, 12 nt, Mycobacterium tuberculosis H37Rv
cccgucgaccuc

SEQ ID NO: 1301316 - RNA, 19 nt, Mycobacterium tuberculosis H37Rv
cccgucgaucagcggcagc

SEQ ID NO: 1301317 - RNA, 19 nt, Mycobacterium tuberculosis H37Rv
cccguuccacgccggcauc

SEQ ID NO: 1301318 - RNA, 13 nt, Mycobacterium tuberculosis H37Rv
cccguuccacgau

SEQ ID NO: 1301319 - RNA, 14 nt, Mycobacterium tuberculosis H37Rv
cccguuccacgauc

SEQ ID NO: 1301320 - RNA, 15 nt, Mycobacterium tuberculosis H37Rv
cccguucacgcucgu

SEQ ID NO: 1301321 - RNA, 14 nt, Mycobacterium tuberculosis H37Rv
cccgucgccaccga

SEQ ID NO: 1301322 - RNA, 16 nt, Mycobacterium tuberculosis H37Rv
cccggugcccaucggc

SEQ ID NO: 1301323 - RNA, 19 nt, Mycobacterium tuberculosis H37Rv
cccggugauccacgcucgg

SEQ ID NO: 1301324 - RNA, 17 nt, Mycobacterium tuberculosis H37Rv
cccggucgacgggucgg

SEQ ID NO: 1301325 - RNA, 24 nt, Mycobacterium tuberculosis H37Rv
cccggugcaaccccaaguccagca

SEQ ID NO: 1301326 - RNA, 18 nt, Mycobacterium tuberculosis H37Rv
cccgguccugcucgcaca

SEQ ID NO: 1301327 - RNA, 19 nt, Mycobacterium tuberculosis H37Rv
cccgguccgccauuggcgc

SEQ ID NO: 1301328 - RNA, 20 nt, Mycobacterium tuberculosis H37Rv
cccggugagcucuucggaca

SEQ ID NO: 1301329 - RNA, 12 nt, Mycobacterium tuberculosis H37Rv
cccggucgacgg

SEQ ID NO: 1301330 - RNA, 20 nt, Mycobacterium tuberculosis H37Rv
cccgguaugcgcguccccag

SEQ ID NO: 1301331 - RNA, 12 nt, Mycobacterium tuberculosis H37Rv
cccggguggccc

SEQ ID NO: 1301332 - RNA, 19 nt, Mycobacterium tuberculosis H37Rv
cccgggucuccggcgcacc

SEQ ID NO: 1301333 - RNA, 16 nt, Mycobacterium tuberculosis H37Rv
cccggguagacaccgc

SEQ ID NO: 1301334 - RNA, 19 nt, Mycobacterium tuberculosis H37Rv
cccggguagaccaccugca

SEQ ID NO: 1301335 - RNA, 13 nt, Mycobacterium tuberculosis H37Rv
cccggggugccga

SEQ ID NO: 1301336 - RNA, 18 nt, Mycobacterium tuberculosis H37Rv
cccgggcgucccaaucgg

SEQ ID NO: 1301337 - RNA, 23 nt, Mycobacterium tuberculosis H37Rv
cccgggcggugaggcagcgaccg

SEQ ID NO: 1301338 - RNA, 20 nt, Mycobacterium tuberculosis H37Rv
cccgggcggucgagaugucg

SEQ ID NO: 1301339 - RNA, 14 nt, Mycobacterium tuberculosis H37Rv
cccgggcugccgcc

SEQ ID NO: 1301340 - RNA, 18 nt, Mycobacterium tuberculosis H37Rv
cccggggagacgagcaca

SEQ ID NO: 1301341 - RNA, 14 nt, Mycobacterium tuberculosis H37Rv
cccggcaagcgcag

SEQ ID NO: 1301342 - RNA, 19 nt, Mycobacterium tuberculosis H37Rv
cccggauuccucgucaccg

SEQ ID NO: 1301343 - RNA, 16 nt, Mycobacterium tuberculosis H37Rv
cccggaugucgugcgg

SEQ ID NO: 1301344 - RNA, 23 nt, Mycobacterium tuberculosis H37Rv
cccggcggcccgauagaucgcgu

SEQ ID NO: 1301345 - RNA, 17 nt, Mycobacterium tuberculosis H37Rv
cccggcguccgaccggu

SEQ ID NO: 1301346 - RNA, 19 nt, Mycobacterium tuberculosis H37Rv
cccggcgguaaagcucacc

SEQ ID NO: 1301347 - RNA, 20 nt, Mycobacterium tuberculosis H37Rv
cccggcucucuucgcgcgcu

SEQ ID NO: 1301348 - RNA, 15 nt, Mycobacterium tuberculosis H37Rv
cccggcuggucaccc

SEQ ID NO: 1301349 - RNA, 21 nt, Mycobacterium tuberculosis H37Rv
cccggcuucuugaccacgaac

SEQ ID NO: 1301350 - RNA, 17 nt, Mycobacterium tuberculosis H37Rv
ccgaaguggugaccgac

SEQ ID NO: 1301351 - RNA, 19 nt, Mycobacterium tuberculosis H37Rv
ccgaaguuuuggaagcccg

SEQ ID NO: 1301352 - RNA, 19 nt, Mycobacterium tuberculosis H37Rv
ccgaaggugggauugaagc

SEQ ID NO: 1301353 - RNA, 12 nt, Mycobacterium tuberculosis H37Rv
ccgaagcggcca

SEQ ID NO: 1301354 - RNA, 17 nt, Mycobacterium tuberculosis H37Rv
ccgaagcucaucgccgc

SEQ ID NO: 1301355 - RNA, 14 nt, Mycobacterium tuberculosis H37Rv
ccgaagcggugacc

SEQ ID NO: 1301356 - RNA, 19 nt, Mycobacterium tuberculosis H37Rv
ccgaagacucgucaacgga

SEQ ID NO: 1301357 - RNA, 16 nt, Mycobacterium tuberculosis H37Rv
ccgaagaaggugacga

SEQ ID NO: 1301358 - RNA, 19 nt, Mycobacterium tuberculosis H37Rv
ccgaacuccuuaucgucga

SEQ ID NO: 1301359 - RNA, 20 nt, Mycobacterium tuberculosis H37Rv
ccgaacuccgcggaacccag

SEQ ID NO: 1301360 - RNA, 14 nt, Mycobacterium tuberculosis H37Rv
ccgaagaagcccga

SEQ ID NO: 1301361 - RNA, 15 nt, Mycobacterium tuberculosis H37Rv
ccgaagcgcgcgcgu

SEQ ID NO: 1301362 - RNA, 17 nt, Mycobacterium tuberculosis H37Rv
ccgaagcgaacggcaca

SEQ ID NO: 1301363 - RNA, 16 nt, Mycobacterium tuberculosis H37Rv
ccgaagccaucggguc

SEQ ID NO: 1301364 - RNA, 14 nt, Mycobacterium tuberculosis H37Rv
ccgaagauggccag

SEQ ID NO: 1301365 - RNA, 18 nt, Mycobacterium tuberculosis H37Rv
ccgaagauggccagcgcg

SEQ ID NO: 1301366 - RNA, 20 nt, Mycobacterium tuberculosis H37Rv
ccgaagauuucgggcgccga

SEQ ID NO: 1301367 - RNA, 16 nt, Mycobacterium tuberculosis H37Rv
ccgaacgaggcgccca

SEQ ID NO: 1301368 - RNA, 15 nt, Mycobacterium tuberculosis H37Rv
ccgaacgacccuggc

SEQ ID NO: 1301369 - RNA, 19 nt, Mycobacterium tuberculosis H37Rv
ccgaaccugcggcagcgga

SEQ ID NO: 1301370 - RNA, 15 nt, Mycobacterium tuberculosis H37Rv
ccgaacgccagaccg

SEQ ID NO: 1301371 - RNA, 16 nt, Mycobacterium tuberculosis H37Rv
ccgaacuggucgacgc

SEQ ID NO: 1301372 - RNA, 18 nt, Mycobacterium tuberculosis H37Rv
ccgaacggguagacccac

SEQ ID NO: 1301373 - RNA, 17 nt, Mycobacterium tuberculosis H37Rv
ccgaacagucgcagcca

SEQ ID NO: 1301374 - RNA, 21 nt, Mycobacterium tuberculosis H37Rv
ccgaacaguucggcgagcaca

SEQ ID NO: 1301375 - RNA, 16 nt, Mycobacterium tuberculosis H37Rv
ccgaacauggccagca

SEQ ID NO: 1301376 - RNA, 17 nt, Mycobacterium tuberculosis H37Rv
cccuuggacgcgaugau

SEQ ID NO: 1301377 - RNA, 19 nt, Mycobacterium tuberculosis H37Rv
ccgaaccgcguuaugccag

SEQ ID NO: 1301378 - RNA, 14 nt, Mycobacterium tuberculosis H37Rv
ccgaaccgcugcgg

SEQ ID NO: 1301379 - RNA, 13 nt, Mycobacterium tuberculosis H37Rv
ccgaaccgcgcgu

SEQ ID NO: 1301380 - RNA, 16 nt, Mycobacterium tuberculosis H37Rv
cccuccucgaccgcgg

SEQ ID NO: 1301381 - RNA, 13 nt, Mycobacterium tuberculosis H37Rv
cccuccgagcaca

SEQ ID NO: 1301382 - RNA, 22 nt, Mycobacterium tuberculosis H37Rv
cccuccgagcacaggaucaccc

SEQ ID NO: 1301383 - RNA, 12 nt, Mycobacterium tuberculosis H37Rv
cccucgaucacg

SEQ ID NO: 1301384 - RNA, 19 nt, Mycobacterium tuberculosis H37Rv
cccucgcgcgcgucgaguu

SEQ ID NO: 1301385 - RNA, 16 nt, Mycobacterium tuberculosis H37Rv
cccugcuugcaggcga

SEQ ID NO: 1301386 - RNA, 14 nt, Mycobacterium tuberculosis H37Rv
cccuugucggucga

SEQ ID NO: 1301387 - RNA, 14 nt, Mycobacterium tuberculosis H37Rv
cccuuugacgccga

SEQ ID NO: 1301388 - RNA, 18 nt, Mycobacterium tuberculosis H37Rv
cccuugacggugagaucg

SEQ ID NO: 1301389 - RNA, 18 nt, Mycobacterium tuberculosis H37Rv
cccuugggacugcggaca

SEQ ID NO: 1301390 - RNA, 16 nt, Mycobacterium tuberculosis H37Rv
cccuggcccccgguac

SEQ ID NO: 1301391 - RNA, 15 nt, Mycobacterium tuberculosis H37Rv
cccuggccagcccga

SEQ ID NO: 1301392 - RNA, 14 nt, Mycobacterium tuberculosis H37Rv
cccuucgccagcgc

SEQ ID NO: 1301393 - RNA, 14 nt, Mycobacterium tuberculosis H37Rv
cgagcaugcccagc

SEQ ID NO: 1301394 - RNA, 15 nt, Mycobacterium tuberculosis H37Rv
cgagccacccaccga

SEQ ID NO: 1301395 - RNA, 15 nt, Mycobacterium tuberculosis H37Rv
cgagcaucgacgaac

SEQ ID NO: 1301396 - RNA, 16 nt, Mycobacterium tuberculosis H37Rv
cgagcaucucgucguc

SEQ ID NO: 1301397 - RNA, 15 nt, Mycobacterium tuberculosis H37Rv
cgagcaucucgucgg

SEQ ID NO: 1301398 - RNA, 16 nt, Mycobacterium tuberculosis H37Rv
cgagcaucagauucgc

SEQ ID NO: 1301399 - RNA, 23 nt, Mycobacterium tuberculosis H37Rv
cgagcaguuccagcucgcggugg

SEQ ID NO: 1301400 - RNA, 18 nt, Mycobacterium tuberculosis H37Rv
cgagcagugccucggcga

SEQ ID NO: 1301401 - RNA, 22 nt, Mycobacterium tuberculosis H37Rv
cgagcagguguugcacgagcau

SEQ ID NO: 1301402 - RNA, 20 nt, Mycobacterium tuberculosis H37Rv
cgagcagguguugcacgagc

SEQ ID NO: 1301403 - RNA, 21 nt, Mycobacterium tuberculosis H37Rv
cgagcagguuccgcacgauca

SEQ ID NO: 1301404 - RNA, 17 nt, Mycobacterium tuberculosis H37Rv
cgagcagggccggcacc

SEQ ID NO: 1301405 - RNA, 18 nt, Mycobacterium tuberculosis H37Rv
cgagcaggcuggcugcca

SEQ ID NO: 1301406 - RNA, 23 nt, Mycobacterium tuberculosis H37Rv
cgagcagcuccuugaggucaccc

SEQ ID NO: 1301407 - RNA, 18 nt, Mycobacterium tuberculosis H37Rv
cgagccagcuccggcgcu

SEQ ID NO: 1301408 - RNA, 16 nt, Mycobacterium tuberculosis H37Rv
cgagccagcuccggua

SEQ ID NO: 1301409 - RNA, 15 nt, Mycobacterium tuberculosis H37Rv
cgagccagcacccgc

SEQ ID NO: 1301410 - RNA, 19 nt, Mycobacterium tuberculosis H37Rv
cgagccacgccagcgucga

SEQ ID NO: 1301411 - RNA, 15 nt, Mycobacterium tuberculosis H37Rv
cgagccacgccagcg

SEQ ID NO: 1301412 - RNA, 18 nt, Mycobacterium tuberculosis H37Rv
cgagcccagccgggcacc

SEQ ID NO: 1301413 - RNA, 16 nt, Mycobacterium tuberculosis H37Rv
cgagcccaccgucgca

SEQ ID NO: 1301414 - RNA, 20 nt, Mycobacterium tuberculosis H37Rv
cgagcccacgcgccaccgag

SEQ ID NO: 1301415 - RNA, 22 nt, Mycobacterium tuberculosis H37Rv
cgagcccgaugguggugccgac

SEQ ID NO: 1301416 - RNA, 15 nt, Mycobacterium tuberculosis H37Rv
cgagcccgcaucgca

SEQ ID NO: 1301417 - RNA, 13 nt, Mycobacterium tuberculosis H37Rv
cgagcccgccagc

SEQ ID NO: 1301418 - RNA, 14 nt, Mycobacterium tuberculosis H37Rv
cgagcccgaaccac

SEQ ID NO: 1301419 - RNA, 13 nt, Mycobacterium tuberculosis H37Rv
cgagccgcacagc

SEQ ID NO: 1301420 - RNA, 23 nt, Mycobacterium tuberculosis H37Rv
cgagccgacccgacgcuggucgg

SEQ ID NO: 1301421 - RNA, 14 nt, Mycobacterium tuberculosis H37Rv
cgagccgaccgcgg

SEQ ID NO: 1301422 - RNA, 15 nt, Mycobacterium tuberculosis H37Rv
cgagcccgucgauca

SEQ ID NO: 1301423 - RNA, 13 nt, Mycobacterium tuberculosis H37Rv
cgagcccggugcu

SEQ ID NO: 1301424 - RNA, 14 nt, Mycobacterium tuberculosis H37Rv
cgagcccuccaggg

SEQ ID NO: 1301425 - RNA, 16 nt, Mycobacterium tuberculosis H37Rv
cgagccgacaucgaug

SEQ ID NO: 1301426 - RNA, 18 nt, Mycobacterium tuberculosis H37Rv
cgagcccgccagcgccgc

SEQ ID NO: 1301427 - RNA, 18 nt, Mycobacterium tuberculosis H37Rv
cgagcccgaaggcggcuc

SEQ ID NO: 1301428 - RNA, 13 nt, Mycobacterium tuberculosis H37Rv
cgagcccgauggu

SEQ ID NO: 1301429 - RNA, 21 nt, Mycobacterium tuberculosis H37Rv
cgagauucuccugaguugcgg

SEQ ID NO: 1301430 - RNA, 14 nt, Mycobacterium tuberculosis H37Rv
cgagcaacgggcga

SEQ ID NO: 1301431 - RNA, 21 nt, Mycobacterium tuberculosis H37Rv
cgagcaacucguccagcagug

SEQ ID NO: 1301432 - RNA, 19 nt, Mycobacterium tuberculosis H37Rv
cgagcaacgccacccgaau

SEQ ID NO: 1301433 - RNA, 21 nt, Mycobacterium tuberculosis H37Rv
cgagcaccucggccucgucgu

SEQ ID NO: 1301434 - RNA, 16 nt, Mycobacterium tuberculosis H37Rv
cgagcacgcugcugcg

SEQ ID NO: 1301435 - RNA, 22 nt, Mycobacterium tuberculosis H37Rv
cgagcacgcgggcacugguggc

SEQ ID NO: 1301436 - RNA, 14 nt, Mycobacterium tuberculosis H37Rv
cgagcacgucacgc

SEQ ID NO: 1301437 - RNA, 14 nt, Mycobacterium tuberculosis H37Rv
cgagcacucggcca

SEQ ID NO: 1301438 - RNA, 18 nt, Mycobacterium tuberculosis H37Rv
cgagcagacgcagaaucg

SEQ ID NO: 1301439 - RNA, 20 nt, Mycobacterium tuberculosis H37Rv
cgagcagacacagaaucgcc

SEQ ID NO: 1301440 - RNA, 20 nt, Mycobacterium tuberculosis H37Rv
cgagcagacacagaaucgca

SEQ ID NO: 1301441 - RNA, 20 nt, Mycobacterium tuberculosis H37Rv
cgagcagacgcagaaucgcc

SEQ ID NO: 1301442 - RNA, 20 nt, Mycobacterium tuberculosis H37Rv
cgagcagacgcagaaucgca

SEQ ID NO: 1301443 - RNA, 22 nt, Mycobacterium tuberculosis H37Rv
cgagcacucggccacgacgacu

SEQ ID NO: 1301444 - RNA, 20 nt, Mycobacterium tuberculosis H37Rv
cgagcacucggccacgacga

SEQ ID NO: 1301445 - RNA, 19 nt, Mycobacterium tuberculosis H37Rv
cgagcagacgcaaaaucgc

SEQ ID NO: 1301446 - RNA, 20 nt, Mycobacterium tuberculosis H37Rv
aacacaugcaagucgaacgg

SEQ ID NO: 1301447 - RNA, 14 nt, Mycobacterium tuberculosis H37Rv
cgagcagauacucc

SEQ ID NO: 1301448 - RNA, 20 nt, Mycobacterium tuberculosis H37Rv
cgagcagacgcagagucgca

SEQ ID NO: 1301449 - RNA, 21 nt, Mycobacterium tuberculosis H37Rv
aacacauccaguaaccguccg

SEQ ID NO: 1301450 - RNA, 20 nt, Mycobacterium tuberculosis H37Rv
aacaccagcgcgccguagac

SEQ ID NO: 1301451 - RNA, 22 nt, Mycobacterium tuberculosis H37Rv
aacacccuugcccacggcgacc

SEQ ID NO: 1301452 - RNA, 13 nt, Mycobacterium tuberculosis H37Rv
cgagcagcacagc

SEQ ID NO: 1301453 - RNA, 16 nt, Mycobacterium tuberculosis H37Rv
cgagcagauacuccgc

SEQ ID NO: 1301454 - RNA, 15 nt, Mycobacterium tuberculosis H37Rv
cgagcagccgaugcu

SEQ ID NO: 1301455 - RNA, 20 nt, Mycobacterium tuberculosis H37Rv
cgagcagccgaugcugcggg

SEQ ID NO: 1301456 - RNA, 22 nt, Mycobacterium tuberculosis H37Rv
cgagcagcuccuugaggucacc

SEQ ID NO: 1301457 - RNA, 19 nt, Mycobacterium tuberculosis H37Rv
cgacuuggugacaccgagg

SEQ ID NO: 1301458 - RNA, 12 nt, Mycobacterium tuberculosis H37Rv
cgacuugucgcc

SEQ ID NO: 1301459 - RNA, 14 nt, Mycobacterium tuberculosis H37Rv
cgacuugucgccgu

SEQ ID NO: 1301460 - RNA, 16 nt, Mycobacterium tuberculosis H37Rv
cgacuugucgccguug

SEQ ID NO: 1301461 - RNA, 12 nt, Mycobacterium tuberculosis H37Rv
cgacuugccgcc

SEQ ID NO: 1301462 - RNA, 16 nt, Mycobacterium tuberculosis H37Rv
cgacuucgggaacgcu

SEQ ID NO: 1301463 - RNA, 18 nt, Mycobacterium tuberculosis H37Rv
cgacuugcggugcucacc

SEQ ID NO: 1301464 - RNA, 23 nt, Mycobacterium tuberculosis H37Rv
cgagaaaaugacccacacaccga

SEQ ID NO: 1301465 - RNA, 18 nt, Mycobacterium tuberculosis H37Rv
cgacuuucaucgcgagaa

SEQ ID NO: 1301466 - RNA, 23 nt, Mycobacterium tuberculosis H37Rv
cgagaacaccggccaacagucgc

SEQ ID NO: 1301467 - RNA, 14 nt, Mycobacterium tuberculosis H37Rv
cgagaacaccggcc

SEQ ID NO: 1301468 - RNA, 13 nt, Mycobacterium tuberculosis H37Rv
cgacucacggauc

SEQ ID NO: 1301469 - RNA, 15 nt, Mycobacterium tuberculosis H37Rv
cgacuucggcgucgg

SEQ ID NO: 1301470 - RNA, 23 nt, Mycobacterium tuberculosis H37Rv
cgacuccggcaggcccgacggcg

SEQ ID NO: 1301471 - RNA, 21 nt, Mycobacterium tuberculosis H37Rv
cgacucaucggccgcggucgg

SEQ ID NO: 1301472 - RNA, 14 nt, Mycobacterium tuberculosis H37Rv
cgacucaucggccg

SEQ ID NO: 1301473 - RNA, 12 nt, Mycobacterium tuberculosis H37Rv
cgagacgcucca

SEQ ID NO: 1301474 - RNA, 15 nt, Mycobacterium tuberculosis H37Rv
cgagagcgcuguccc

SEQ ID NO: 1301475 - RNA, 21 nt, Mycobacterium tuberculosis H37Rv
cgagaccgaaacuugcucacc

SEQ ID NO: 1301476 - RNA, 21 nt, Mycobacterium tuberculosis H37Rv
cgagaccucucugcgccaggc

SEQ ID NO: 1301477 - RNA, 22 nt, Mycobacterium tuberculosis H37Rv
cgagacgaccuccucgaugacc

SEQ ID NO: 1301478 - RNA, 18 nt, Mycobacterium tuberculosis H37Rv
cgagacgcacggccaccg

SEQ ID NO: 1301479 - RNA, 14 nt, Mycobacterium tuberculosis H37Rv
cgagaccggcaccg

SEQ ID NO: 1301480 - RNA, 15 nt, Mycobacterium tuberculosis H37Rv
cgagaccggcaccgg

SEQ ID NO: 1301481 - RNA, 16 nt, Mycobacterium tuberculosis H37Rv
cgagaccggcaccggc

SEQ ID NO: 1301482 - RNA, 16 nt, Mycobacterium tuberculosis H37Rv
cgagauacggccacca

SEQ ID NO: 1301483 - RNA, 16 nt, Mycobacterium tuberculosis H37Rv
cgagaucugcgauggg

SEQ ID NO: 1301484 - RNA, 14 nt, Mycobacterium tuberculosis H37Rv
cgagaugccaucgg

SEQ ID NO: 1301485 - RNA, 20 nt, Mycobacterium tuberculosis H37Rv
cgagaugccaucggugauga

SEQ ID NO: 1301486 - RNA, 15 nt, Mycobacterium tuberculosis H37Rv
cgagaugccgcgauc

SEQ ID NO: 1301487 - RNA, 16 nt, Mycobacterium tuberculosis H37Rv
cgacgucgcgcaucgc

SEQ ID NO: 1301488 - RNA, 22 nt, Mycobacterium tuberculosis H37Rv
cgacgucgcggcgccugaggug

SEQ ID NO: 1301489 - RNA, 22 nt, Mycobacterium tuberculosis H37Rv
cgacgucguagaccuccagugc

SEQ ID NO: 1301490 - RNA, 14 nt, Mycobacterium tuberculosis H37Rv
cgacgucggcggug

SEQ ID NO: 1301491 - RNA, 20 nt, Mycobacterium tuberculosis H37Rv
cgacgucguagaccuccagu

SEQ ID NO: 1301492 - RNA, 14 nt, Mycobacterium tuberculosis H37Rv
cgacgucggugacc

SEQ ID NO: 1301493 - RNA, 15 nt, Mycobacterium tuberculosis H37Rv
cgacgucggcgagca

SEQ ID NO: 1301494 - RNA, 17 nt, Mycobacterium tuberculosis H37Rv
cgacgucggccguuucc

SEQ ID NO: 1301495 - RNA, 19 nt, Mycobacterium tuberculosis H37Rv
cgacgucgcuagaucccag

SEQ ID NO: 1301496 - RNA, 18 nt, Mycobacterium tuberculosis H37Rv
cgacgucggccgcaucgc

SEQ ID NO: 1301497 - RNA, 19 nt, Mycobacterium tuberculosis H37Rv
cgacgucggccgcaucgcc

SEQ ID NO: 1301498 - RNA, 21 nt, Mycobacterium tuberculosis H37Rv
cgacgucggccgcaucgccca

SEQ ID NO: 1301499 - RNA, 16 nt, Mycobacterium tuberculosis H37Rv
cgacgcguagcacggc

SEQ ID NO: 1301500 - RNA, 22 nt, Mycobacterium tuberculosis H37Rv
cgacgcgguggugauugacggu

SEQ ID NO: 1301501 - RNA, 15 nt, Mycobacterium tuberculosis H37Rv
cgacgcgucggcgac

SEQ ID NO: 1301502 - RNA, 17 nt, Mycobacterium tuberculosis H37Rv
cgacgcgugucugggac

SEQ ID NO: 1301503 - RNA, 15 nt, Mycobacterium tuberculosis H37Rv
cgacgcguggcaucc

SEQ ID NO: 1301504 - RNA, 14 nt, Mycobacterium tuberculosis H37Rv
cgacgcuaccgccg

SEQ ID NO: 1301505 - RNA, 14 nt, Mycobacterium tuberculosis H37Rv
cgacgcggcgucgg

SEQ ID NO: 1301506 - RNA, 19 nt, Mycobacterium tuberculosis H37Rv
cgacguguugcacguacgg

SEQ ID NO: 1301507 - RNA, 13 nt, Mycobacterium tuberculosis H37Rv
cgacguuaacugc

SEQ ID NO: 1301508 - RNA, 17 nt, Mycobacterium tuberculosis H37Rv
cgacguuaccgaccgcg

SEQ ID NO: 1301509 - RNA, 15 nt, Mycobacterium tuberculosis H37Rv
cgacgugugccgucc

SEQ ID NO: 1301510 - RNA, 23 nt, Mycobacterium tuberculosis H37Rv
cgacguggcugcguucgccggaa

SEQ ID NO: 1301511 - RNA, 24 nt, Mycobacterium tuberculosis H37Rv
cgacguggcugcguucgccggaau

SEQ ID NO: 1301512 - RNA, 18 nt, Mycobacterium tuberculosis H37Rv
cgacguucgacgacagca

SEQ ID NO: 1301513 - RNA, 14 nt, Mycobacterium tuberculosis H37Rv
cgacguucgguggc

SEQ ID NO: 1301514 - RNA, 13 nt, Mycobacterium tuberculosis H37Rv
cgacguucggguc

SEQ ID NO: 1301515 - RNA, 23 nt, Mycobacterium tuberculosis H37Rv
cgacucaggucggugcggucauc

SEQ ID NO: 1301516 - RNA, 13 nt, Mycobacterium tuberculosis H37Rv
cgacucaggucgg

SEQ ID NO: 1301517 - RNA, 14 nt, Mycobacterium tuberculosis H37Rv
cgacgucugccauc

SEQ ID NO: 1301518 - RNA, 14 nt, Mycobacterium tuberculosis H37Rv
cgacgucguuacug

SEQ ID NO: 1301519 - RNA, 17 nt, Mycobacterium tuberculosis H37Rv
cgacgucuuugacgaac

SEQ ID NO: 1301520 - RNA, 13 nt, Mycobacterium tuberculosis H37Rv
cgacgugaucgcg

SEQ ID NO: 1301521 - RNA, 23 nt, Mycobacterium tuberculosis H37Rv
cgacgugagggucaugucgauca

SEQ ID NO: 1301522 - RNA, 23 nt, Mycobacterium tuberculosis H37Rv
cgagguguagcccuccgagcaca

SEQ ID NO: 1301523 - RNA, 22 nt, Mycobacterium tuberculosis H37Rv
cgagguucaaagcagcgcacca

SEQ ID NO: 1301524 - RNA, 17 nt, Mycobacterium tuberculosis H37Rv
cgagguuccacuugguc

SEQ ID NO: 1301525 - RNA, 18 nt, Mycobacterium tuberculosis H37Rv
cgagguucaaagcagcgc

SEQ ID NO: 1301526 - RNA, 19 nt, Mycobacterium tuberculosis H37Rv
cgagguggcgggcgaugcg

SEQ ID NO: 1301527 - RNA, 15 nt, Mycobacterium tuberculosis H37Rv
cgagguggcgggcga

SEQ ID NO: 1301528 - RNA, 20 nt, Mycobacterium tuberculosis H37Rv
cgagguggcgcacaucgcga

SEQ ID NO: 1301529 - RNA, 23 nt, Mycobacterium tuberculosis H37Rv
cgaggucgcggucuuugagccgg

SEQ ID NO: 1301530 - RNA, 12 nt, Mycobacterium tuberculosis H37Rv
cgaggucagcuc

SEQ ID NO: 1301531 - RNA, 17 nt, Mycobacterium tuberculosis H37Rv
cgagguccucgucgucg

SEQ ID NO: 1301532 - RNA, 16 nt, Mycobacterium tuberculosis H37Rv
cgaggucgaaccgccg

SEQ ID NO: 1301533 - RNA, 14 nt, Mycobacterium tuberculosis H37Rv
cgaggucgaaccgc

SEQ ID NO: 1301534 - RNA, 20 nt, Mycobacterium tuberculosis H37Rv
cgagguuccacuuggucacc

SEQ ID NO: 1301535 - RNA, 15 nt, Mycobacterium tuberculosis H37Rv
cgagguugccgcacc

SEQ ID NO: 1301536 - RNA, 24 nt, Mycobacterium tuberculosis H37Rv
cgagguugccgcaccagucgcgca

SEQ ID NO: 1301537 - RNA, 20 nt, Mycobacterium tuberculosis H37Rv
cgagucgccgaggacgccgg

SEQ ID NO: 1301538 - RNA, 14 nt, Mycobacterium tuberculosis H37Rv
cgagucgcacgugg

SEQ ID NO: 1301539 - RNA, 19 nt, Mycobacterium tuberculosis H37Rv
cgagucgacaagccgucgg

SEQ ID NO: 1301540 - RNA, 19 nt, Mycobacterium tuberculosis H37Rv
cgaguccguacuugccacc

SEQ ID NO: 1301541 - RNA, 22 nt, Mycobacterium tuberculosis H37Rv
cgaggcguucaccacgaucgcg

SEQ ID NO: 1301542 - RNA, 20 nt, Mycobacterium tuberculosis H37Rv
cgaggccacgccagcucgcc

SEQ ID NO: 1301543 - RNA, 19 nt, Mycobacterium tuberculosis H37Rv
cgaggcuguccgaaccgac

SEQ ID NO: 1301544 - RNA, 13 nt, Mycobacterium tuberculosis H37Rv
cgaggcuugcggc

SEQ ID NO: 1301545 - RNA, 13 nt, Mycobacterium tuberculosis H37Rv
cgaggcuguccga

SEQ ID NO: 1301546 - RNA, 15 nt, Mycobacterium tuberculosis H37Rv
cgaggcagcgucguc

SEQ ID NO: 1301547 - RNA, 17 nt, Mycobacterium tuberculosis H37Rv
cgaggcagcgucgucga

SEQ ID NO: 1301548 - RNA, 15 nt, Mycobacterium tuberculosis H37Rv
cgaggcagcacccgc

SEQ ID NO: 1301549 - RNA, 18 nt, Mycobacterium tuberculosis H37Rv
cgaggccaaguugcagcg

SEQ ID NO: 1301550 - RNA, 20 nt, Mycobacterium tuberculosis H37Rv
cgaggauucauggcggcaua

SEQ ID NO: 1301551 - RNA, 22 nt, Mycobacterium tuberculosis H37Rv
cgaggauguugugccgaucggc

SEQ ID NO: 1301552 - RNA, 18 nt, Mycobacterium tuberculosis H37Rv
cgaggcaaugcgagcacc

SEQ ID NO: 1301553 - RNA, 19 nt, Mycobacterium tuberculosis H37Rv
cgagguccucgucggcguc

SEQ ID NO: 1301554 - RNA, 17 nt, Mycobacterium tuberculosis H37Rv
cgaggcuugcggcacaa

SEQ ID NO: 1301555 - RNA, 16 nt, Mycobacterium tuberculosis H37Rv
cgauaucgaugcggcg

SEQ ID NO: 1301556 - RNA, 12 nt, Mycobacterium tuberculosis H37Rv
cgauaucugcca

SEQ ID NO: 1301557 - RNA, 22 nt, Mycobacterium tuberculosis H37Rv
cgauaugcgugagcugcucgag

SEQ ID NO: 1301558 - RNA, 18 nt, Mycobacterium tuberculosis H37Rv
cgauauggccuugcugcg

SEQ ID NO: 1301559 - RNA, 22 nt, Mycobacterium tuberculosis H37Rv
cgauauagccgccggugccgcc

SEQ ID NO: 1301560 - RNA, 22 nt, Mycobacterium tuberculosis H37Rv
cgauacccaggauguguugcca

SEQ ID NO: 1301561 - RNA, 14 nt, Mycobacterium tuberculosis H37Rv
cgauacccaggaug

SEQ ID NO: 1301562 - RNA, 14 nt, Mycobacterium tuberculosis H37Rv
cgauacgcgcaccg

SEQ ID NO: 1301563 - RNA, 21 nt, Mycobacterium tuberculosis H37Rv
cgauaccgugcaccuccaggu

SEQ ID NO: 1301564 - RNA, 20 nt, Mycobacterium tuberculosis H37Rv
cgauaccgucagcgccgcug

SEQ ID NO: 1301565 - RNA, 20 nt, Mycobacterium tuberculosis H37Rv
cgauaccggcggcgagcggc

SEQ ID NO: 1301566 - RNA, 16 nt, Mycobacterium tuberculosis H37Rv
cgauaccgucagcgcc

SEQ ID NO: 1301567 - RNA, 16 nt, Mycobacterium tuberculosis H37Rv
cgaguuguugcugccc

SEQ ID NO: 1301568 - RNA, 20 nt, Mycobacterium tuberculosis H37Rv
cgaguugcucggccgaugcg

SEQ ID NO: 1301569 - RNA, 13 nt, Mycobacterium tuberculosis H37Rv
cgaguuaccggug

SEQ ID NO: 1301570 - RNA, 12 nt, Mycobacterium tuberculosis H37Rv
cgaguugcccgg

SEQ ID NO: 1301571 - RNA, 17 nt, Mycobacterium tuberculosis H37Rv
cgaguuggcgaagcccg

SEQ ID NO: 1301572 - RNA, 14 nt, Mycobacterium tuberculosis H37Rv
cgaguuaccgguga

SEQ ID NO: 1301573 - RNA, 19 nt, Mycobacterium tuberculosis H37Rv
cgaguucgcagucgaugag

SEQ ID NO: 1301574 - RNA, 18 nt, Mycobacterium tuberculosis H37Rv
cgaguucgcagucgauga

SEQ ID NO: 1301575 - RNA, 16 nt, Mycobacterium tuberculosis H37Rv
cgaguucggcccgcaa

SEQ ID NO: 1301576 - RNA, 19 nt, Mycobacterium tuberculosis H37Rv
cgagugcggcacgaucgcc

SEQ ID NO: 1301577 - RNA, 17 nt, Mycobacterium tuberculosis H37Rv
cgaguggcugacacugc

SEQ ID NO: 1301578 - RNA, 20 nt, Mycobacterium tuberculosis H37Rv
cgagucgccgcgggcagcga

SEQ ID NO: 1301579 - RNA, 18 nt, Mycobacterium tuberculosis H37Rv
cgaguggaucauguucgg

SEQ ID NO: 1301580 - RNA, 19 nt, Mycobacterium tuberculosis H37Rv
cgagcgcauguugcaggcg

SEQ ID NO: 1301581 - RNA, 16 nt, Mycobacterium tuberculosis H37Rv
cgagcgcaucggccaa

SEQ ID NO: 1301582 - RNA, 15 nt, Mycobacterium tuberculosis H37Rv
cgagcgcaucggcca

SEQ ID NO: 1301583 - RNA, 15 nt, Mycobacterium tuberculosis H37Rv
cgagcgcaucagggu

SEQ ID NO: 1301584 - RNA, 21 nt, Mycobacterium tuberculosis H37Rv
cgagcgccaguucgcggcugc

SEQ ID NO: 1301585 - RNA, 14 nt, Mycobacterium tuberculosis H37Rv
cgagcgcaucaggg

SEQ ID NO: 1301586 - RNA, 14 nt, Mycobacterium tuberculosis H37Rv
cgagcgcagcgugu

SEQ ID NO: 1301587 - RNA, 21 nt, Mycobacterium tuberculosis H37Rv
cgagcgccuugucgaucucgu

SEQ ID NO: 1301588 - RNA, 20 nt, Mycobacterium tuberculosis H37Rv
cgagcgccuugucgaucucg

SEQ ID NO: 1301589 - RNA, 19 nt, Mycobacterium tuberculosis H37Rv
cgagcgccgcuaugaggca

SEQ ID NO: 1301590 - RNA, 17 nt, Mycobacterium tuberculosis H37Rv
cgagcgacccccagcgc

SEQ ID NO: 1301591 - RNA, 13 nt, Mycobacterium tuberculosis H37Rv
cgagcgaaccgaa

SEQ ID NO: 1301592 - RNA, 20 nt, Mycobacterium tuberculosis H37Rv
cgagcgaaccgaagccgucg

SEQ ID NO: 1301593 - RNA, 21 nt, Mycobacterium tuberculosis H37Rv
cgagccucgcgcgccacggug

SEQ ID NO: 1301594 - RNA, 20 nt, Mycobacterium tuberculosis H37Rv
cgagccuguucgccgcgaau

SEQ ID NO: 1301595 - RNA, 21 nt, Mycobacterium tuberculosis H37Rv
cgagcgauacgucgucagcca

SEQ ID NO: 1301596 - RNA, 16 nt, Mycobacterium tuberculosis H37Rv
cgagcgauacgucguc

SEQ ID NO: 1301597 - RNA, 16 nt, Mycobacterium tuberculosis H37Rv
cgagcgaugcgaccga

SEQ ID NO: 1301598 - RNA, 18 nt, Mycobacterium tuberculosis H37Rv
cgagcgcaagagccgucc

SEQ ID NO: 1301599 - RNA, 16 nt, Mycobacterium tuberculosis H37Rv
cgagcgcaaucgacca

SEQ ID NO: 1301600 - RNA, 14 nt, Mycobacterium tuberculosis H37Rv
cgagccgccaccgu

SEQ ID NO: 1301601 - RNA, 19 nt, Mycobacterium tuberculosis H37Rv
cgagccgccaccguacgac

SEQ ID NO: 1301602 - RNA, 24 nt, Mycobacterium tuberculosis H37Rv
cgagccgccaccguacgacagucg

SEQ ID NO: 1301603 - RNA, 19 nt, Mycobacterium tuberculosis H37Rv
cgagccggaacagugccac

SEQ ID NO: 1301604 - RNA, 15 nt, Mycobacterium tuberculosis H37Rv
cgagccgcuaggacg

SEQ ID NO: 1301605 - RNA, 21 nt, Mycobacterium tuberculosis H37Rv
cgagccguccaagccagcguu

SEQ ID NO: 1301606 - RNA, 17 nt, Mycobacterium tuberculosis H37Rv
cgagccgucgucgagcc

SEQ ID NO: 1301607 - RNA, 14 nt, Mycobacterium tuberculosis H37Rv
cgagccguagacca

SEQ ID NO: 1301608 - RNA, 21 nt, Mycobacterium tuberculosis H37Rv
cgagccgguauacucggcccc

SEQ ID NO: 1301609 - RNA, 17 nt, Mycobacterium tuberculosis H37Rv
cgaggacccgucgagcg

SEQ ID NO: 1301610 - RNA, 22 nt, Mycobacterium tuberculosis H37Rv
cgaggacaagcccgcugccauc

SEQ ID NO: 1301611 - RNA, 22 nt, Mycobacterium tuberculosis H37Rv
cgaggaauacucucgcgacauc

SEQ ID NO: 1301612 - RNA, 21 nt, Mycobacterium tuberculosis H37Rv
cgaggacggcuugagccgcag

SEQ ID NO: 1301613 - RNA, 19 nt, Mycobacterium tuberculosis H37Rv
cgaggaugccgaaccgcgc

SEQ ID NO: 1301614 - RNA, 14 nt, Mycobacterium tuberculosis H37Rv
cgagcuggcguucc

SEQ ID NO: 1301615 - RNA, 17 nt, Mycobacterium tuberculosis H37Rv
cgagcuggcaacgccgc

SEQ ID NO: 1301616 - RNA, 22 nt, Mycobacterium tuberculosis H37Rv
cgagcuccuccaccaacucgac

SEQ ID NO: 1301617 - RNA, 13 nt, Mycobacterium tuberculosis H37Rv
cgagcuccgcggc

SEQ ID NO: 1301618 - RNA, 19 nt, Mycobacterium tuberculosis H37Rv
cgagcucccgggcgcucac

SEQ ID NO: 1301619 - RNA, 15 nt, Mycobacterium tuberculosis H37Rv
cgagcucgaagcccg

SEQ ID NO: 1301620 - RNA, 23 nt, Mycobacterium tuberculosis H37Rv
cgagcggccuccagcacccgguc

SEQ ID NO: 1301621 - RNA, 16 nt, Mycobacterium tuberculosis H37Rv
cgagcggccgcgcgca

SEQ ID NO: 1301622 - RNA, 18 nt, Mycobacterium tuberculosis H37Rv
cgagcguuggcuucuucg

SEQ ID NO: 1301623 - RNA, 23 nt, Mycobacterium tuberculosis H37Rv
cgagcguuggcuucuucggucac

SEQ ID NO: 1301624 - RNA, 21 nt, Mycobacterium tuberculosis H37Rv
cgagcucaccaaggucggcga

SEQ ID NO: 1301625 - RNA, 23 nt, Mycobacterium tuberculosis H37Rv
cgagcgugcgcugguggcggcga

SEQ ID NO: 1301626 - RNA, 20 nt, Mycobacterium tuberculosis H37Rv
cgagcgugaagucacggcgg

SEQ ID NO: 1301627 - RNA, 20 nt, Mycobacterium tuberculosis H37Rv
cgagcgugcaaucacugcga

SEQ ID NO: 1301628 - RNA, 17 nt, Mycobacterium tuberculosis H37Rv
cgagcggagccgccgac

SEQ ID NO: 1301629 - RNA, 20 nt, Mycobacterium tuberculosis H37Rv
cgagcgcuucgucgccgaac

SEQ ID NO: 1301630 - RNA, 17 nt, Mycobacterium tuberculosis H37Rv
cgagcgcuugaccccgc

SEQ ID NO: 1301631 - RNA, 20 nt, Mycobacterium tuberculosis H37Rv
cgagcggaacgucacugcga

SEQ ID NO: 1301632 - RNA, 14 nt, Mycobacterium tuberculosis H37Rv
cgagcgcucgauca

SEQ ID NO: 1301633 - RNA, 16 nt, Mycobacterium tuberculosis H37Rv
cgagcgcggugccgcc

SEQ ID NO: 1301634 - RNA, 19 nt, Mycobacterium tuberculosis H37Rv
cgagcgcgucggucaccga

SEQ ID NO: 1301635 - RNA, 18 nt, Mycobacterium tuberculosis H37Rv
cgagcgcgucggucaccg

SEQ ID NO: 1301636 - RNA, 14 nt, Mycobacterium tuberculosis H37Rv
cgagcgcgccguug

SEQ ID NO: 1301637 - RNA, 19 nt, Mycobacterium tuberculosis H37Rv
cgagcgcgccguugccgcc

SEQ ID NO: 1301638 - RNA, 19 nt, Mycobacterium tuberculosis H37Rv
cgagcgcgaugcagugcga

SEQ ID NO: 1301639 - RNA, 13 nt, Mycobacterium tuberculosis H37Rv
cgagcgcgccaau

SEQ ID NO: 1301640 - RNA, 17 nt, Mycobacterium tuberculosis H37Rv
cgaccagccgaucauca

SEQ ID NO: 1301641 - RNA, 19 nt, Mycobacterium tuberculosis H37Rv
cgaccagccgaucaucacc

SEQ ID NO: 1301642 - RNA, 13 nt, Mycobacterium tuberculosis H37Rv
cgaccagcagauc

SEQ ID NO: 1301643 - RNA, 12 nt, Mycobacterium tuberculosis H37Rv
cgaccagcagau

SEQ ID NO: 1301644 - RNA, 22 nt, Mycobacterium tuberculosis H37Rv
cgacaguugcgccagcguuagg

SEQ ID NO: 1301645 - RNA, 18 nt, Mycobacterium tuberculosis H37Rv
cgacagugugaagaccac

SEQ ID NO: 1301646 - RNA, 18 nt, Mycobacterium tuberculosis H37Rv
cgaccagggccgccgcug

SEQ ID NO: 1301647 - RNA, 16 nt, Mycobacterium tuberculosis H37Rv
cgaccagggcggugcu

SEQ ID NO: 1301648 - RNA, 21 nt, Mycobacterium tuberculosis H37Rv
cgaccauacccgcgcgcacca

SEQ ID NO: 1301649 - RNA, 18 nt, Mycobacterium tuberculosis H37Rv
cgaccauauucagcucgg

SEQ ID NO: 1301650 - RNA, 13 nt, Mycobacterium tuberculosis H37Rv
cgacccagcggua

SEQ ID NO: 1301651 - RNA, 13 nt, Mycobacterium tuberculosis H37Rv
cgacccagcgguu

SEQ ID NO: 1301652 - RNA, 17 nt, Mycobacterium tuberculosis H37Rv
cgacccaucaccagcgg

SEQ ID NO: 1301653 - RNA, 15 nt, Mycobacterium tuberculosis H37Rv
cgaccccgccgagcg

SEQ ID NO: 1301654 - RNA, 19 nt, Mycobacterium tuberculosis H37Rv
cgacccggaccugggcgac

SEQ ID NO: 1301655 - RNA, 20 nt, Mycobacterium tuberculosis H37Rv
cgacccgcgcgccggcgacc

SEQ ID NO: 1301656 - RNA, 17 nt, Mycobacterium tuberculosis H37Rv
cgaccccgcgccgacac

SEQ ID NO: 1301657 - RNA, 22 nt, Mycobacterium tuberculosis H37Rv
cgaccccggaaugcccgagcag

SEQ ID NO: 1301658 - RNA, 18 nt, Mycobacterium tuberculosis H37Rv
cgaccuccaccaaugcuc

SEQ ID NO: 1301659 - RNA, 15 nt, Mycobacterium tuberculosis H37Rv
cgaccucacugcggc

SEQ ID NO: 1301660 - RNA, 16 nt, Mycobacterium tuberculosis H37Rv
cgaccucacugcggcg

SEQ ID NO: 1301661 - RNA, 17 nt, Mycobacterium tuberculosis H37Rv
cgaccucacccacccgc

SEQ ID NO: 1301662 - RNA, 16 nt, Mycobacterium tuberculosis H37Rv
cgaccucacgaaucgc

SEQ ID NO: 1301663 - RNA, 14 nt, Mycobacterium tuberculosis H37Rv
cgaccuagcucgcg

SEQ ID NO: 1301664 - RNA, 13 nt, Mycobacterium tuberculosis H37Rv
cgaccgugucacc

SEQ ID NO: 1301665 - RNA, 15 nt, Mycobacterium tuberculosis H37Rv
cgaccuaccgucgac

SEQ ID NO: 1301666 - RNA, 21 nt, Mycobacterium tuberculosis H37Rv
cgaccgugguggucgggcgca

SEQ ID NO: 1301667 - RNA, 19 nt, Mycobacterium tuberculosis H37Rv
cgaccgggucgcaaccgcc

SEQ ID NO: 1301668 - RNA, 20 nt, Mycobacterium tuberculosis H37Rv
cgaccgggucgcaaccgccg

SEQ ID NO: 1301669 - RNA, 17 nt, Mycobacterium tuberculosis H37Rv
cgaccgguacccguagc

SEQ ID NO: 1301670 - RNA, 21 nt, Mycobacterium tuberculosis H37Rv
cgaccgggaaccacggucagc

SEQ ID NO: 1301671 - RNA, 16 nt, Mycobacterium tuberculosis H37Rv
cgaccgggccgcacgg

SEQ ID NO: 1301672 - RNA, 18 nt, Mycobacterium tuberculosis H37Rv
cgaccgggaacagggugg

SEQ ID NO: 1301673 - RNA, 12 nt, Mycobacterium tuberculosis H37Rv
cgaccggcguug

SEQ ID NO: 1301674 - RNA, 19 nt, Mycobacterium tuberculosis H37Rv
cgaccgcgggccgacgcag

SEQ ID NO: 1301675 - RNA, 21 nt, Mycobacterium tuberculosis H37Rv
cgaccggcgggacgucgccgc

SEQ ID NO: 1301676 - RNA, 18 nt, Mycobacterium tuberculosis H37Rv
cgaccgcgggccgacgca

SEQ ID NO: 1301677 - RNA, 22 nt, Mycobacterium tuberculosis H37Rv
cgaccgcgcucaccggggccgu

SEQ ID NO: 1301678 - RNA, 14 nt, Mycobacterium tuberculosis H37Rv
cgaccgcgcucacc

SEQ ID NO: 1301679 - RNA, 20 nt, Mycobacterium tuberculosis H37Rv
cgaccgcggccccgccguug

SEQ ID NO: 1301680 - RNA, 15 nt, Mycobacterium tuberculosis H37Rv
cgaccgcggccgggu

SEQ ID NO: 1301681 - RNA, 15 nt, Mycobacterium tuberculosis H37Rv
cgaccgcacgaucgc

SEQ ID NO: 1301682 - RNA, 16 nt, Mycobacterium tuberculosis H37Rv
cgaccgcacgaucgca

SEQ ID NO: 1301683 - RNA, 21 nt, Mycobacterium tuberculosis H37Rv
cgaccgcacgaucgcaccgag

SEQ ID NO: 1301684 - RNA, 20 nt, Mycobacterium tuberculosis H37Rv
cgaccgaucggcgcgucgau

SEQ ID NO: 1301685 - RNA, 15 nt, Mycobacterium tuberculosis H37Rv
cgaccgaucggcgcg

SEQ ID NO: 1301686 - RNA, 16 nt, Mycobacterium tuberculosis H37Rv
cgaccgccaccgccag

SEQ ID NO: 1301687 - RNA, 17 nt, Mycobacterium tuberculosis H37Rv
cgaccgccaccgccagc

SEQ ID NO: 1301688 - RNA, 16 nt, Mycobacterium tuberculosis H37Rv
cgaccgccgagcgggu

SEQ ID NO: 1301689 - RNA, 16 nt, Mycobacterium tuberculosis H37Rv
cgaccgacaccaccag

SEQ ID NO: 1301690 - RNA, 21 nt, Mycobacterium tuberculosis H37Rv
cgaccgaaucagcacggugug

SEQ ID NO: 1301691 - RNA, 12 nt, Mycobacterium tuberculosis H37Rv
cgaccgaccagc

SEQ ID NO: 1301692 - RNA, 17 nt, Mycobacterium tuberculosis H37Rv
cgaccgaaagccgcacc

SEQ ID NO: 1301693 - RNA, 15 nt, Mycobacterium tuberculosis H37Rv
cgaccgaaccgucag

SEQ ID NO: 1301694 - RNA, 23 nt, Mycobacterium tuberculosis H37Rv
cgaccgaacgccaggucaucggc

SEQ ID NO: 1301695 - RNA, 23 nt, Mycobacterium tuberculosis H37Rv
cgaccgacggacuucccgcgcga

SEQ ID NO: 1301696 - RNA, 15 nt, Mycobacterium tuberculosis H37Rv
cgaccgagucgacgu

SEQ ID NO: 1301697 - RNA, 17 nt, Mycobacterium tuberculosis H37Rv
cgaccgagucgacgugu

SEQ ID NO: 1301698 - RNA, 19 nt, Mycobacterium tuberculosis H37Rv
cgaccgauaacacccgggc

SEQ ID NO: 1301699 - RNA, 17 nt, Mycobacterium tuberculosis H37Rv
cgacgaaccgccagaau

SEQ ID NO: 1301700 - RNA, 23 nt, Mycobacterium tuberculosis H37Rv
cgacgaagaagaacucggcgucg

SEQ ID NO: 1301701 - RNA, 19 nt, Mycobacterium tuberculosis H37Rv
cgacgaacucacgcaggaa

SEQ ID NO: 1301702 - RNA, 14 nt, Mycobacterium tuberculosis H37Rv
cgacgaacaccagc

SEQ ID NO: 1301703 - RNA, 23 nt, Mycobacterium tuberculosis H37Rv
cgaccugaggcaccucggccuug

SEQ ID NO: 1301704 - RNA, 20 nt, Mycobacterium tuberculosis H37Rv
cgaccugagucggcauugcu

SEQ ID NO: 1301705 - RNA, 16 nt, Mycobacterium tuberculosis H37Rv
cgaccugaaugcggcc

SEQ ID NO: 1301706 - RNA, 20 nt, Mycobacterium tuberculosis H37Rv
cgaccucugcacggccguca

SEQ ID NO: 1301707 - RNA, 21 nt, Mycobacterium tuberculosis H37Rv
cgacgacccgggucggcacga

SEQ ID NO: 1301708 - RNA, 13 nt, Mycobacterium tuberculosis H37Rv
cgacgaccgccug

SEQ ID NO: 1301709 - RNA, 14 nt, Mycobacterium tuberculosis H37Rv
cgacgaccgccugc

SEQ ID NO: 1301710 - RNA, 15 nt, Mycobacterium tuberculosis H37Rv
cgacgacgacaccgc

SEQ ID NO: 1301711 - RNA, 12 nt, Mycobacterium tuberculosis H37Rv
cgacgacgacgu

SEQ ID NO: 1301712 - RNA, 16 nt, Mycobacterium tuberculosis H37Rv
cgacgacccgacguag

SEQ ID NO: 1301713 - RNA, 19 nt, Mycobacterium tuberculosis H37Rv
cgacgacccgggucggcac

SEQ ID NO: 1301714 - RNA, 17 nt, Mycobacterium tuberculosis H37Rv
cgacgaagaucgcgugc

SEQ ID NO: 1301715 - RNA, 21 nt, Mycobacterium tuberculosis H37Rv
cgacgaacucgcccagggugg

SEQ ID NO: 1301716 - RNA, 13 nt, Mycobacterium tuberculosis H37Rv
cgacgaagaucgc

SEQ ID NO: 1301717 - RNA, 14 nt, Mycobacterium tuberculosis H37Rv
cgacgaagaucgcg

SEQ ID NO: 1301718 - RNA, 17 nt, Mycobacterium tuberculosis H37Rv
cgacgcagaccguccag

SEQ ID NO: 1301719 - RNA, 21 nt, Mycobacterium tuberculosis H37Rv
cgacgcacugccccgcaucgc

SEQ ID NO: 1301720 - RNA, 20 nt, Mycobacterium tuberculosis H37Rv
cgacgcacugccccgcaucg

SEQ ID NO: 1301721 - RNA, 20 nt, Mycobacterium tuberculosis H37Rv
cgacgcaccaacgcgaucag

SEQ ID NO: 1301722 - RNA, 19 nt, Mycobacterium tuberculosis H37Rv
cgacgcaccaacgcgauca

SEQ ID NO: 1301723 - RNA, 23 nt, Mycobacterium tuberculosis H37Rv
cgacgaucucgccggcgaagacc

SEQ ID NO: 1301724 - RNA, 18 nt, Mycobacterium tuberculosis H37Rv
cgacgaugccccgguuga

SEQ ID NO: 1301725 - RNA, 12 nt, Mycobacterium tuberculosis H37Rv
cgacgaucucuc

SEQ ID NO: 1301726 - RNA, 14 nt, Mycobacterium tuberculosis H37Rv
cgacgaugccgcgg

SEQ ID NO: 1301727 - RNA, 16 nt, Mycobacterium tuberculosis H37Rv
cgacgaugccgcggga

SEQ ID NO: 1301728 - RNA, 16 nt, Mycobacterium tuberculosis H37Rv
cgacgaugacgcgcga

SEQ ID NO: 1301729 - RNA, 21 nt, Mycobacterium tuberculosis H37Rv
cgacgaucgucuugucgccga

SEQ ID NO: 1301730 - RNA, 16 nt, Mycobacterium tuberculosis H37Rv
cgacgaggacggcuug

SEQ ID NO: 1301731 - RNA, 17 nt, Mycobacterium tuberculosis H37Rv
cgacgacgccaaugccg

SEQ ID NO: 1301732 - RNA, 15 nt, Mycobacterium tuberculosis H37Rv
cgacgagcgccucaa

SEQ ID NO: 1301733 - RNA, 22 nt, Mycobacterium tuberculosis H37Rv
cgacgagcggcuucagcacguu

SEQ ID NO: 1301734 - RNA, 13 nt, Mycobacterium tuberculosis H37Rv
cgacgacggcacc

SEQ ID NO: 1301735 - RNA, 13 nt, Mycobacterium tuberculosis H37Rv
cgacgagcaccgc

SEQ ID NO: 1301736 - RNA, 13 nt, Mycobacterium tuberculosis H37Rv
cgacgagcagcaa

SEQ ID NO: 1301737 - RNA, 19 nt, Mycobacterium tuberculosis H37Rv
cgacgcgaugacacaccgc

SEQ ID NO: 1301738 - RNA, 21 nt, Mycobacterium tuberculosis H37Rv
cgacgcgcgagaacacccgug

SEQ ID NO: 1301739 - RNA, 12 nt, Mycobacterium tuberculosis H37Rv
cgacgcgauggc

SEQ ID NO: 1301740 - RNA, 14 nt, Mycobacterium tuberculosis H37Rv
cgacgcgauggccg

SEQ ID NO: 1301741 - RNA, 15 nt, Mycobacterium tuberculosis H37Rv
cgacgcgaccgcgau

SEQ ID NO: 1301742 - RNA, 23 nt, Mycobacterium tuberculosis H37Rv
cgacgcggaguccgucgacaccg

SEQ ID NO: 1301743 - RNA, 15 nt, Mycobacterium tuberculosis H37Rv
cgacgcgcucggcga

SEQ ID NO: 1301744 - RNA, 22 nt, Mycobacterium tuberculosis H37Rv
cgacgccugggcacggccgucg

SEQ ID NO: 1301745 - RNA, 15 nt, Mycobacterium tuberculosis H37Rv
cgacgcgacacacgc

SEQ ID NO: 1301746 - RNA, 22 nt, Mycobacterium tuberculosis H37Rv
cgacgccggugucggcuggucg

SEQ ID NO: 1301747 - RNA, 15 nt, Mycobacterium tuberculosis H37Rv
cgacgccggauugcu

SEQ ID NO: 1301748 - RNA, 14 nt, Mycobacterium tuberculosis H37Rv
cgacgccgguggca

SEQ ID NO: 1301749 - RNA, 21 nt, Mycobacterium tuberculosis H37Rv
cgacgccgguggcagagccgc

SEQ ID NO: 1301750 - RNA, 15 nt, Mycobacterium tuberculosis H37Rv
cgacgccgcuggaga

SEQ ID NO: 1301751 - RNA, 21 nt, Mycobacterium tuberculosis H37Rv
cgacgccgcucccgcacaagc

SEQ ID NO: 1301752 - RNA, 16 nt, Mycobacterium tuberculosis H37Rv
cgacgccgcagcgucc

SEQ ID NO: 1301753 - RNA, 14 nt, Mycobacterium tuberculosis H37Rv
cgacgccgccaccc

SEQ ID NO: 1301754 - RNA, 23 nt, Mycobacterium tuberculosis H37Rv
cgacgccgccggcgccaccguug

SEQ ID NO: 1301755 - RNA, 21 nt, Mycobacterium tuberculosis H37Rv
cgacgccgaaaaugccgccca

SEQ ID NO: 1301756 - RNA, 18 nt, Mycobacterium tuberculosis H37Rv
cgacgccgaaaaugccgc

SEQ ID NO: 1301757 - RNA, 20 nt, Mycobacterium tuberculosis H37Rv
cgacgccgagaccgccgcug

SEQ ID NO: 1301758 - RNA, 13 nt, Mycobacterium tuberculosis H37Rv
cgacgccgaucgc

SEQ ID NO: 1301759 - RNA, 15 nt, Mycobacterium tuberculosis H37Rv
cgacgcccgcccugg

SEQ ID NO: 1301760 - RNA, 17 nt, Mycobacterium tuberculosis H37Rv
cgacgcccgcccuggca

SEQ ID NO: 1301761 - RNA, 18 nt, Mycobacterium tuberculosis H37Rv
cgacgcccgacgaugugc

SEQ ID NO: 1301762 - RNA, 16 nt, Mycobacterium tuberculosis H37Rv
cgacgccccgaucggc

SEQ ID NO: 1301763 - RNA, 21 nt, Mycobacterium tuberculosis H37Rv
cgacgcaggugaacgccggug

SEQ ID NO: 1301764 - RNA, 20 nt, Mycobacterium tuberculosis H37Rv
cgacgcagugcccgaucgcu

SEQ ID NO: 1301765 - RNA, 22 nt, Mycobacterium tuberculosis H37Rv
cgacgcagcuugcccgacggcg

SEQ ID NO: 1301766 - RNA, 19 nt, Mycobacterium tuberculosis H37Rv
cgacgcagcuugcccgacg

SEQ ID NO: 1301767 - RNA, 17 nt, Mycobacterium tuberculosis H37Rv
cgacgcauaaccggcgc

SEQ ID NO: 1301768 - RNA, 18 nt, Mycobacterium tuberculosis H37Rv
cgacgccaugucgauguc

SEQ ID NO: 1301769 - RNA, 15 nt, Mycobacterium tuberculosis H37Rv
cgacgcccaccguug

SEQ ID NO: 1301770 - RNA, 16 nt, Mycobacterium tuberculosis H37Rv
cgacagacagcaccgc

SEQ ID NO: 1301771 - RNA, 20 nt, Mycobacterium tuberculosis H37Rv
cgacacucacgggugcuggc

SEQ ID NO: 1301772 - RNA, 20 nt, Mycobacterium tuberculosis H37Rv
cgacagaugccgggcugagg

SEQ ID NO: 1301773 - RNA, 22 nt, Mycobacterium tuberculosis H37Rv
cgacacgccaggugaugccgcc

SEQ ID NO: 1301774 - RNA, 17 nt, Mycobacterium tuberculosis H37Rv
cgacacgaaggucgcgg

SEQ ID NO: 1301775 - RNA, 17 nt, Mycobacterium tuberculosis H37Rv
cgacacguugacgaugu

SEQ ID NO: 1301776 - RNA, 15 nt, Mycobacterium tuberculosis H37Rv
cgacacggugcugcc

SEQ ID NO: 1301777 - RNA, 14 nt, Mycobacterium tuberculosis H37Rv
cgacagcaccgaau

SEQ ID NO: 1301778 - RNA, 14 nt, Mycobacterium tuberculosis H37Rv
cgacagcagcgcga

SEQ ID NO: 1301779 - RNA, 16 nt, Mycobacterium tuberculosis H37Rv
cgacagccaccgcgaa

SEQ ID NO: 1301780 - RNA, 17 nt, Mycobacterium tuberculosis H37Rv
cgacaggugcucgucau

SEQ ID NO: 1301781 - RNA, 17 nt, Mycobacterium tuberculosis H37Rv
cgacaggccggccacca

SEQ ID NO: 1301782 - RNA, 19 nt, Mycobacterium tuberculosis H37Rv
cgacaggacgucggcgaau

SEQ ID NO: 1301783 - RNA, 22 nt, Mycobacterium tuberculosis H37Rv
cgacagcucaucgauccucgcc

SEQ ID NO: 1301784 - RNA, 15 nt, Mycobacterium tuberculosis H37Rv
cgacagcggcgucgg

SEQ ID NO: 1301785 - RNA, 18 nt, Mycobacterium tuberculosis H37Rv
cgacagcgcggcggucga

SEQ ID NO: 1301786 - RNA, 15 nt, Mycobacterium tuberculosis H37Rv
cgacaccgacucgca

SEQ ID NO: 1301787 - RNA, 23 nt, Mycobacterium tuberculosis H37Rv
cgacacccugggugccggcagcg

SEQ ID NO: 1301788 - RNA, 17 nt, Mycobacterium tuberculosis H37Rv
cgacaccuccgucagcg

SEQ ID NO: 1301789 - RNA, 23 nt, Mycobacterium tuberculosis H37Rv
cgacaccguaggcgaucucacgc

SEQ ID NO: 1301790 - RNA, 15 nt, Mycobacterium tuberculosis H37Rv
cgacaccgcggaccc

SEQ ID NO: 1301791 - RNA, 13 nt, Mycobacterium tuberculosis H37Rv
aacaaaggcuugc

SEQ ID NO: 1301792 - RNA, 14 nt, Mycobacterium tuberculosis H37Rv
aacaacaccaccag

SEQ ID NO: 1301793 - RNA, 22 nt, Mycobacterium tuberculosis H37Rv
cgacacccaccaacacccgggc

SEQ ID NO: 1301794 - RNA, 23 nt, Mycobacterium tuberculosis H37Rv
cgacacccccggugccggcggug

SEQ ID NO: 1301795 - RNA, 17 nt, Mycobacterium tuberculosis H37Rv
cgacaccacggaccagc

SEQ ID NO: 1301796 - RNA, 14 nt, Mycobacterium tuberculosis H37Rv
cgacaccaccuugg

SEQ ID NO: 1301797 - RNA, 19 nt, Mycobacterium tuberculosis H37Rv
cgacacauagugcggcacc

SEQ ID NO: 1301798 - RNA, 18 nt, Mycobacterium tuberculosis H37Rv
cgacacacgccgccggug

SEQ ID NO: 1301799 - RNA, 17 nt, Mycobacterium tuberculosis H37Rv
cgacacaccccagcaac

SEQ ID NO: 1301800 - RNA, 19 nt, Mycobacterium tuberculosis H37Rv
cgacaacgacugcguuccg

SEQ ID NO: 1301801 - RNA, 23 nt, Mycobacterium tuberculosis H37Rv
cgaauccgcucgagguggucucg

SEQ ID NO: 1301802 - RNA, 18 nt, Mycobacterium tuberculosis H37Rv
cgaagucuugaccgcacc

SEQ ID NO: 1301803 - RNA, 21 nt, Mycobacterium tuberculosis H37Rv
cgaauggggcagcucaucgcg

SEQ ID NO: 1301804 - RNA, 15 nt, Mycobacterium tuberculosis H37Rv
cgaaugucacaccgg

SEQ ID NO: 1301805 - RNA, 17 nt, Mycobacterium tuberculosis H37Rv
cgaaugucugcgcaggu

SEQ ID NO: 1301806 - RNA, 18 nt, Mycobacterium tuberculosis H37Rv
cgaaugucgcucaaaccc

SEQ ID NO: 1301807 - RNA, 17 nt, Mycobacterium tuberculosis H37Rv
cgaaucccccggacggc

SEQ ID NO: 1301808 - RNA, 14 nt, Mycobacterium tuberculosis H37Rv
cgaagugacccgaa

SEQ ID NO: 1301809 - RNA, 21 nt, Mycobacterium tuberculosis H37Rv
cgaagucuugaccgcaccggc

SEQ ID NO: 1301810 - RNA, 24 nt, Mycobacterium tuberculosis H37Rv
cgaaguccaccacgacgucgguga

SEQ ID NO: 1301811 - RNA, 14 nt, Mycobacterium tuberculosis H37Rv
cgaagucgacgaac

SEQ ID NO: 1301812 - RNA, 14 nt, Mycobacterium tuberculosis H37Rv
cgaagucucgguga

SEQ ID NO: 1301813 - RNA, 21 nt, Mycobacterium tuberculosis H37Rv
cgaaggcaaagcgagcaccgc

SEQ ID NO: 1301814 - RNA, 22 nt, Mycobacterium tuberculosis H37Rv
cgaagcuugacguugccgggcu

SEQ ID NO: 1301815 - RNA, 21 nt, Mycobacterium tuberculosis H37Rv
cgaaggucaucaugucgaggu

SEQ ID NO: 1301816 - RNA, 21 nt, Mycobacterium tuberculosis H37Rv
cgaaggcgacaucaccaccga

SEQ ID NO: 1301817 - RNA, 17 nt, Mycobacterium tuberculosis H37Rv
cgaaggcguucgacucg

SEQ ID NO: 1301818 - RNA, 22 nt, Mycobacterium tuberculosis H37Rv
cgaaggcguucgacucgaccgc

SEQ ID NO: 1301819 - RNA, 15 nt, Mycobacterium tuberculosis H37Rv
cgaacuccaugccgc

SEQ ID NO: 1301820 - RNA, 19 nt, Mycobacterium tuberculosis H37Rv
cgaacuggucgacgccgag

SEQ ID NO: 1301821 - RNA, 23 nt, Mycobacterium tuberculosis H37Rv
cgaacugccgcgccgacgccgcg

SEQ ID NO: 1301822 - RNA, 13 nt, Mycobacterium tuberculosis H37Rv
cgaacgucaaccg

SEQ ID NO: 1301823 - RNA, 23 nt, Mycobacterium tuberculosis H37Rv
cgaacgucaaccgggcggcguuu

SEQ ID NO: 1301824 - RNA, 14 nt, Mycobacterium tuberculosis H37Rv
cgaagaggagaacg

SEQ ID NO: 1301825 - RNA, 15 nt, Mycobacterium tuberculosis H37Rv
cgaagagcaccgcgc

SEQ ID NO: 1301826 - RNA, 18 nt, Mycobacterium tuberculosis H37Rv
cgaagagcuccgucgcgg

SEQ ID NO: 1301827 - RNA, 15 nt, Mycobacterium tuberculosis H37Rv
cgaagagcgcacuga

SEQ ID NO: 1301828 - RNA, 14 nt, Mycobacterium tuberculosis H37Rv
cgaacuuugucgcg

SEQ ID NO: 1301829 - RNA, 17 nt, Mycobacterium tuberculosis H37Rv
cgaacuuaacuacggug

SEQ ID NO: 1301830 - RNA, 15 nt, Mycobacterium tuberculosis H37Rv
cgaacuugaucaccg

SEQ ID NO: 1301831 - RNA, 20 nt, Mycobacterium tuberculosis H37Rv
cgaacuuccauucauggccg

SEQ ID NO: 1301832 - RNA, 17 nt, Mycobacterium tuberculosis H37Rv
cgaagaccucgucgcgu

SEQ ID NO: 1301833 - RNA, 15 nt, Mycobacterium tuberculosis H37Rv
cgaagcaucgcguug

SEQ ID NO: 1301834 - RNA, 15 nt, Mycobacterium tuberculosis H37Rv
cgaagaucgccuggg

SEQ ID NO: 1301835 - RNA, 20 nt, Mycobacterium tuberculosis H37Rv
cgccagugcccgcacugccg

SEQ ID NO: 1301836 - RNA, 16 nt, Mycobacterium tuberculosis H37Rv
cgccaguggugcaccg

SEQ ID NO: 1301837 - RNA, 21 nt, Mycobacterium tuberculosis H37Rv
cgccagugcggucucgaccgu

SEQ ID NO: 1301838 - RNA, 14 nt, Mycobacterium tuberculosis H37Rv
cgccaguuccggug

SEQ ID NO: 1301839 - RNA, 17 nt, Mycobacterium tuberculosis H37Rv
cgccaguucggauccgg

SEQ ID NO: 1301840 - RNA, 22 nt, Mycobacterium tuberculosis H37Rv
cgccaguucgcgccacgcaccc

SEQ ID NO: 1301841 - RNA, 17 nt, Mycobacterium tuberculosis H37Rv
cgccaguucgcggcugc

SEQ ID NO: 1301842 - RNA, 14 nt, Mycobacterium tuberculosis H37Rv
cgccaguucggcgg

SEQ ID NO: 1301843 - RNA, 16 nt, Mycobacterium tuberculosis H37Rv
cgccaguucggcggga

SEQ ID NO: 1301844 - RNA, 22 nt, Mycobacterium tuberculosis H37Rv
cgccagguguucgccggagacc

SEQ ID NO: 1301845 - RNA, 14 nt, Mycobacterium tuberculosis H37Rv
cgccaguauggccg

SEQ ID NO: 1301846 - RNA, 14 nt, Mycobacterium tuberculosis H37Rv
cgccaguagcacgu

SEQ ID NO: 1301847 - RNA, 20 nt, Mycobacterium tuberculosis H37Rv
cgccagucgcaggaucggcg

SEQ ID NO: 1301848 - RNA, 19 nt, Mycobacterium tuberculosis H37Rv
cgccaggcgcuuggccgga

SEQ ID NO: 1301849 - RNA, 15 nt, Mycobacterium tuberculosis H37Rv
cgccaggccgaccgc

SEQ ID NO: 1301850 - RNA, 14 nt, Mycobacterium tuberculosis H37Rv
cgccaggccgcaca

SEQ ID NO: 1301851 - RNA, 14 nt, Mycobacterium tuberculosis H37Rv
cgccaggggaacgc

SEQ ID NO: 1301852 - RNA, 15 nt, Mycobacterium tuberculosis H37Rv
cgccaggcuugcggc

SEQ ID NO: 1301853 - RNA, 15 nt, Mycobacterium tuberculosis H37Rv
cgccagggccgccga

SEQ ID NO: 1301854 - RNA, 11 nt, Mycobacterium tuberculosis H37Rv
cgccagggcgg

SEQ ID NO: 1301855 - RNA, 20 nt, Mycobacterium tuberculosis H37Rv
cgccagcgccgccggcaccu

SEQ ID NO: 1301856 - RNA, 20 nt, Mycobacterium tuberculosis H37Rv
cgccagcgccaccguuaccg

SEQ ID NO: 1301857 - RNA, 23 nt, Mycobacterium tuberculosis H37Rv
cgccagcgccgcugaagccagga

SEQ ID NO: 1301858 - RNA, 15 nt, Mycobacterium tuberculosis H37Rv
cgccagcgcgccgau

SEQ ID NO: 1301859 - RNA, 17 nt, Mycobacterium tuberculosis H37Rv
cgccagcggcagcggcg

SEQ ID NO: 1301860 - RNA, 13 nt, Mycobacterium tuberculosis H37Rv
cgccagcggcagc

SEQ ID NO: 1301861 - RNA, 20 nt, Mycobacterium tuberculosis H37Rv
cgccagcguaaauagcgccc

SEQ ID NO: 1301862 - RNA, 15 nt, Mycobacterium tuberculosis H37Rv
cgccagcgucgacca

SEQ ID NO: 1301863 - RNA, 18 nt, Mycobacterium tuberculosis H37Rv
cgccagcgggcuguaggc

SEQ ID NO: 1301864 - RNA, 19 nt, Mycobacterium tuberculosis H37Rv
cgccagcguuaggucgccg

SEQ ID NO: 1301865 - RNA, 17 nt, Mycobacterium tuberculosis H37Rv
cgccagcuugucgggca

SEQ ID NO: 1301866 - RNA, 19 nt, Mycobacterium tuberculosis H37Rv
cgccagcugggcagccaga

SEQ ID NO: 1301867 - RNA, 16 nt, Mycobacterium tuberculosis H37Rv
cgccagcugcuuucgg

SEQ ID NO: 1301868 - RNA, 21 nt, Mycobacterium tuberculosis H37Rv
cgccagcugcgcagcgcaaca

SEQ ID NO: 1301869 - RNA, 23 nt, Mycobacterium tuberculosis H37Rv
cgccagcugcgcagcgcaacauc

SEQ ID NO: 1301870 - RNA, 19 nt, Mycobacterium tuberculosis H37Rv
cgccaggcaagccagcacu

SEQ ID NO: 1301871 - RNA, 15 nt, Mycobacterium tuberculosis H37Rv
cgccaggcaugccgc

SEQ ID NO: 1301872 - RNA, 16 nt, Mycobacterium tuberculosis H37Rv
cgcccaacgucgccag

SEQ ID NO: 1301873 - RNA, 17 nt, Mycobacterium tuberculosis H37Rv
cgcccaagcgcagccug

SEQ ID NO: 1301874 - RNA, 23 nt, Mycobacterium tuberculosis H37Rv
cgcccaacaggcgggacaaccgg

SEQ ID NO: 1301875 - RNA, 14 nt, Mycobacterium tuberculosis H37Rv
cgcccacaggggca

SEQ ID NO: 1301876 - RNA, 15 nt, Mycobacterium tuberculosis H37Rv
cgccauugccgccgu

SEQ ID NO: 1301877 - RNA, 19 nt, Mycobacterium tuberculosis H37Rv
cgccauugccgccgucgcc

SEQ ID NO: 1301878 - RNA, 13 nt, Mycobacterium tuberculosis H37Rv
cgccauugcggga

SEQ ID NO: 1301879 - RNA, 19 nt, Mycobacterium tuberculosis H37Rv
cgccauuggcgccgccgau

SEQ ID NO: 1301880 - RNA, 13 nt, Mycobacterium tuberculosis H37Rv
cgccauuggcggu

SEQ ID NO: 1301881 - RNA, 22 nt, Mycobacterium tuberculosis H37Rv
cgccauuucgagggcaacggca

SEQ ID NO: 1301882 - RNA, 16 nt, Mycobacterium tuberculosis H37Rv
cgcccaaaacgucacc

SEQ ID NO: 1301883 - RNA, 20 nt, Mycobacterium tuberculosis H37Rv
cgcccaaaacgucaccgccg

SEQ ID NO: 1301884 - RNA, 23 nt, Mycobacterium tuberculosis H37Rv
cgcccaauguccaggcgcgcacc

SEQ ID NO: 1301885 - RNA, 22 nt, Mycobacterium tuberculosis H37Rv
cgcccaccacgaacacguucgg

SEQ ID NO: 1301886 - RNA, 13 nt, Mycobacterium tuberculosis H37Rv
cgcccaccgcaac

SEQ ID NO: 1301887 - RNA, 23 nt, Mycobacterium tuberculosis H37Rv
cgcccacggcaccaccaagcucg

SEQ ID NO: 1301888 - RNA, 12 nt, Mycobacterium tuberculosis H37Rv
cgccaugcgcac

SEQ ID NO: 1301889 - RNA, 15 nt, Mycobacterium tuberculosis H37Rv
cgccauggccgccgu

SEQ ID NO: 1301890 - RNA, 17 nt, Mycobacterium tuberculosis H37Rv
cgccauugacgccguug

SEQ ID NO: 1301891 - RNA, 22 nt, Mycobacterium tuberculosis H37Rv
cgccauugccgccggugccgcc

SEQ ID NO: 1301892 - RNA, 14 nt, Mycobacterium tuberculosis H37Rv
cgccauugccacca

SEQ ID NO: 1301893 - RNA, 15 nt, Mycobacterium tuberculosis H37Rv
cgccauugacgccgu

SEQ ID NO: 1301894 - RNA, 15 nt, Mycobacterium tuberculosis H37Rv
cgccauucaucggca

SEQ ID NO: 1301895 - RNA, 15 nt, Mycobacterium tuberculosis H37Rv
cgccauggcguucug

SEQ ID NO: 1301896 - RNA, 14 nt, Mycobacterium tuberculosis H37Rv
cgccauggcguucu

SEQ ID NO: 1301897 - RNA, 12 nt, Mycobacterium tuberculosis H37Rv
cgccauggugaa

SEQ ID NO: 1301898 - RNA, 14 nt, Mycobacterium tuberculosis H37Rv
cgccaugucggcca

SEQ ID NO: 1301899 - RNA, 15 nt, Mycobacterium tuberculosis H37Rv
cgccaucaccgccgu

SEQ ID NO: 1301900 - RNA, 20 nt, Mycobacterium tuberculosis H37Rv
cgccaucaccgccguuaccg

SEQ ID NO: 1301901 - RNA, 13 nt, Mycobacterium tuberculosis H37Rv
cgccaucaucgcu

SEQ ID NO: 1301902 - RNA, 13 nt, Mycobacterium tuberculosis H37Rv
cgccauacgucgc

SEQ ID NO: 1301903 - RNA, 18 nt, Mycobacterium tuberculosis H37Rv
cgccauacgucgccucga

SEQ ID NO: 1301904 - RNA, 22 nt, Mycobacterium tuberculosis H37Rv
cgccauaccggcuggccaggug

SEQ ID NO: 1301905 - RNA, 17 nt, Mycobacterium tuberculosis H37Rv
cgccauagcgggcggua

SEQ ID NO: 1301906 - RNA, 15 nt, Mycobacterium tuberculosis H37Rv
cgccauaccagcguu

SEQ ID NO: 1301907 - RNA, 16 nt, Mycobacterium tuberculosis H37Rv
cgccaguucuucgggc

SEQ ID NO: 1301908 - RNA, 21 nt, Mycobacterium tuberculosis H37Rv
cgccaguugcguuguccacca

SEQ ID NO: 1301909 - RNA, 23 nt, Mycobacterium tuberculosis H37Rv
cgccaucgguugacccggcagcc

SEQ ID NO: 1301910 - RNA, 22 nt, Mycobacterium tuberculosis H37Rv
cgccauccgauggcccggcuca

SEQ ID NO: 1301911 - RNA, 17 nt, Mycobacterium tuberculosis H37Rv
cgccagaauugccggcg

SEQ ID NO: 1301912 - RNA, 19 nt, Mycobacterium tuberculosis H37Rv
cgccagaauugccggcgau

SEQ ID NO: 1301913 - RNA, 18 nt, Mycobacterium tuberculosis H37Rv
cgccagcaaaccuucgau

SEQ ID NO: 1301914 - RNA, 15 nt, Mycobacterium tuberculosis H37Rv
cgccagauggccacg

SEQ ID NO: 1301915 - RNA, 17 nt, Mycobacterium tuberculosis H37Rv
cgccagcaccagcgucg

SEQ ID NO: 1301916 - RNA, 16 nt, Mycobacterium tuberculosis H37Rv
cgccagcaccagcguc

SEQ ID NO: 1301917 - RNA, 21 nt, Mycobacterium tuberculosis H37Rv
cgccacugcugggcuucgagu

SEQ ID NO: 1301918 - RNA, 18 nt, Mycobacterium tuberculosis H37Rv
cgccacugcuuccggaac

SEQ ID NO: 1301919 - RNA, 14 nt, Mycobacterium tuberculosis H37Rv
cgccacugaccgcg

SEQ ID NO: 1301920 - RNA, 21 nt, Mycobacterium tuberculosis H37Rv
cgccacguacuuggacgaccc

SEQ ID NO: 1301921 - RNA, 19 nt, Mycobacterium tuberculosis H37Rv
cgccacguaauuccccagg

SEQ ID NO: 1301922 - RNA, 18 nt, Mycobacterium tuberculosis H37Rv
cgccacgucgccggcuac

SEQ ID NO: 1301923 - RNA, 19 nt, Mycobacterium tuberculosis H37Rv
cgccagccuccaccagguc

SEQ ID NO: 1301924 - RNA, 14 nt, Mycobacterium tuberculosis H37Rv
cgccagccuccacc

SEQ ID NO: 1301925 - RNA, 19 nt, Mycobacterium tuberculosis H37Rv
cgccagcgagcauaccgcc

SEQ ID NO: 1301926 - RNA, 13 nt, Mycobacterium tuberculosis H37Rv
cgccagcgccacc

SEQ ID NO: 1301927 - RNA, 14 nt, Mycobacterium tuberculosis H37Rv
cgccagccggagcg

SEQ ID NO: 1301928 - RNA, 14 nt, Mycobacterium tuberculosis H37Rv
cgccagccggcgca

SEQ ID NO: 1301929 - RNA, 13 nt, Mycobacterium tuberculosis H37Rv
cgccagccgugcc

SEQ ID NO: 1301930 - RNA, 14 nt, Mycobacterium tuberculosis H37Rv
cgccagcccgguga

SEQ ID NO: 1301931 - RNA, 15 nt, Mycobacterium tuberculosis H37Rv
cgccagcccggugau

SEQ ID NO: 1301932 - RNA, 20 nt, Mycobacterium tuberculosis H37Rv
cgccagccaccacaucgcgg

SEQ ID NO: 1301933 - RNA, 21 nt, Mycobacterium tuberculosis H37Rv
cgccagcauugaagaagcccg

SEQ ID NO: 1301934 - RNA, 19 nt, Mycobacterium tuberculosis H37Rv
cgccacgccgaggcguucg

SEQ ID NO: 1301935 - RNA, 15 nt, Mycobacterium tuberculosis H37Rv
cgccacgcccgacgc

SEQ ID NO: 1301936 - RNA, 13 nt, Mycobacterium tuberculosis H37Rv
cgccacgccaccg

SEQ ID NO: 1301937 - RNA, 13 nt, Mycobacterium tuberculosis H37Rv
cgccacgcccgac

SEQ ID NO: 1301938 - RNA, 14 nt, Mycobacterium tuberculosis H37Rv
cgccacgacgucgu

SEQ ID NO: 1301939 - RNA, 24 nt, Mycobacterium tuberculosis H37Rv
cgccacgagcguccgggucgacgc

SEQ ID NO: 1301940 - RNA, 17 nt, Mycobacterium tuberculosis H37Rv
cgccacgaugucgucga

SEQ ID NO: 1301941 - RNA, 16 nt, Mycobacterium tuberculosis H37Rv
cgccaccuuggcuggg

SEQ ID NO: 1301942 - RNA, 18 nt, Mycobacterium tuberculosis H37Rv
cgccaccuuggcguugac

SEQ ID NO: 1301943 - RNA, 15 nt, Mycobacterium tuberculosis H37Rv
cgccacggaucgcgg

SEQ ID NO: 1301944 - RNA, 18 nt, Mycobacterium tuberculosis H37Rv
cgccaccacgccgucgac

SEQ ID NO: 1301945 - RNA, 21 nt, Mycobacterium tuberculosis H37Rv
cgccaccagagucaacaucag

SEQ ID NO: 1301946 - RNA, 14 nt, Mycobacterium tuberculosis H37Rv
cgccaccagcgcga

SEQ ID NO: 1301947 - RNA, 23 nt, Mycobacterium tuberculosis H37Rv
cgccaccaucaccgccuuugccg

SEQ ID NO: 1301948 - RNA, 17 nt, Mycobacterium tuberculosis H37Rv
cgccaccaucguugccg

SEQ ID NO: 1301949 - RNA, 13 nt, Mycobacterium tuberculosis H37Rv
cgccaccaucggg

SEQ ID NO: 1301950 - RNA, 19 nt, Mycobacterium tuberculosis H37Rv
cgccaccgucgcugcccgc

SEQ ID NO: 1301951 - RNA, 17 nt, Mycobacterium tuberculosis H37Rv
cgccaccguuugcgcac

SEQ ID NO: 1301952 - RNA, 14 nt, Mycobacterium tuberculosis H37Rv
cgccaccguugccg

SEQ ID NO: 1301953 - RNA, 21 nt, Mycobacterium tuberculosis H37Rv
cgccaccucggaggugccggu

SEQ ID NO: 1301954 - RNA, 22 nt, Mycobacterium tuberculosis H37Rv
cgccaccggcgccgccgucgcc

SEQ ID NO: 1301955 - RNA, 20 nt, Mycobacterium tuberculosis H37Rv
cgccaccgguaccgaucagc

SEQ ID NO: 1301956 - RNA, 19 nt, Mycobacterium tuberculosis H37Rv
cgcauuggggacgcccgaa

SEQ ID NO: 1301957 - RNA, 14 nt, Mycobacterium tuberculosis H37Rv
cgcauugaacagcg

SEQ ID NO: 1301958 - RNA, 19 nt, Mycobacterium tuberculosis H37Rv
cgcauucggacgccacgga

SEQ ID NO: 1301959 - RNA, 14 nt, Mycobacterium tuberculosis H37Rv
cgcauugcagcguc

SEQ ID NO: 1301960 - RNA, 16 nt, Mycobacterium tuberculosis H37Rv
cgcauuccccacggug

SEQ ID NO: 1301961 - RNA, 20 nt, Mycobacterium tuberculosis H37Rv
cgcauuuguugcugcugccg

SEQ ID NO: 1301962 - RNA, 23 nt, Mycobacterium tuberculosis H37Rv
cgccaaaaaggaucccgccgcug

SEQ ID NO: 1301963 - RNA, 15 nt, Mycobacterium tuberculosis H37Rv
cgcauuccggcgcca

SEQ ID NO: 1301964 - RNA, 15 nt, Mycobacterium tuberculosis H37Rv
cgcaggucgaucugc

SEQ ID NO: 1301965 - RNA, 16 nt, Mycobacterium tuberculosis H37Rv
cgcaggucgaucugcg

SEQ ID NO: 1301966 - RNA, 22 nt, Mycobacterium tuberculosis H37Rv
cgcaggucgccuucuucgcggc

SEQ ID NO: 1301967 - RNA, 16 nt, Mycobacterium tuberculosis H37Rv
cgcaggucgcaccaca

SEQ ID NO: 1301968 - RNA, 13 nt, Mycobacterium tuberculosis H37Rv
cgccaacguugcg

SEQ ID NO: 1301969 - RNA, 11 nt, Mycobacterium tuberculosis H37Rv
cgccaacucgu

SEQ ID NO: 1301970 - RNA, 19 nt, Mycobacterium tuberculosis H37Rv
cgccaagccgugccgcaca

SEQ ID NO: 1301971 - RNA, 13 nt, Mycobacterium tuberculosis H37Rv
cgccaagucucgg

SEQ ID NO: 1301972 - RNA, 13 nt, Mycobacterium tuberculosis H37Rv
cgccaaggcgaug

SEQ ID NO: 1301973 - RNA, 14 nt, Mycobacterium tuberculosis H37Rv
cgccaaggcgaugg

SEQ ID NO: 1301974 - RNA, 17 nt, Mycobacterium tuberculosis H37Rv
cgccaauagcaacucga

SEQ ID NO: 1301975 - RNA, 23 nt, Mycobacterium tuberculosis H37Rv
cgccaaucgaguagcugaccgag

SEQ ID NO: 1301976 - RNA, 15 nt, Mycobacterium tuberculosis H37Rv
cgccaccacccaggc

SEQ ID NO: 1301977 - RNA, 14 nt, Mycobacterium tuberculosis H37Rv
cgccaccacccagg

SEQ ID NO: 1301978 - RNA, 20 nt, Mycobacterium tuberculosis H37Rv
cgccaccaccuccgcgucgg

SEQ ID NO: 1301979 - RNA, 18 nt, Mycobacterium tuberculosis H37Rv
cgccaauucagcggcaac

SEQ ID NO: 1301980 - RNA, 13 nt, Mycobacterium tuberculosis H37Rv
cgcacccgcucgu

SEQ ID NO: 1301981 - RNA, 21 nt, Mycobacterium tuberculosis H37Rv
cgcacccgcgggucguccggc

SEQ ID NO: 1301982 - RNA, 18 nt, Mycobacterium tuberculosis H37Rv
cgcacccaacuccaucag

SEQ ID NO: 1301983 - RNA, 17 nt, Mycobacterium tuberculosis H37Rv
cgcaccaugucggugag

SEQ ID NO: 1301984 - RNA, 19 nt, Mycobacterium tuberculosis H37Rv
cgcaccccauacucggcgg

SEQ ID NO: 1301985 - RNA, 18 nt, Mycobacterium tuberculosis H37Rv
cgcacccccgacaccgcc

SEQ ID NO: 1301986 - RNA, 20 nt, Mycobacterium tuberculosis H37Rv
cgcacccccgacaccgccga

SEQ ID NO: 1301987 - RNA, 20 nt, Mycobacterium tuberculosis H37Rv
cgcacccccgucgaucagcg

SEQ ID NO: 1301988 - RNA, 14 nt, Mycobacterium tuberculosis H37Rv
cgcacccccgucga

SEQ ID NO: 1301989 - RNA, 23 nt, Mycobacterium tuberculosis H37Rv
cgcacccaacuccaucagcgcga

SEQ ID NO: 1301990 - RNA, 20 nt, Mycobacterium tuberculosis H37Rv
cgcaccgaccugagucggca

SEQ ID NO: 1301991 - RNA, 16 nt, Mycobacterium tuberculosis H37Rv
cgcaccgagcgagacc

SEQ ID NO: 1301992 - RNA, 21 nt, Mycobacterium tuberculosis H37Rv
cgcaccgcaaacucgguauau

SEQ ID NO: 1301993 - RNA, 15 nt, Mycobacterium tuberculosis H37Rv
cgcaccgccacccug

SEQ ID NO: 1301994 - RNA, 21 nt, Mycobacterium tuberculosis H37Rv
cgcaccgccaguuccggugac

SEQ ID NO: 1301995 - RNA, 19 nt, Mycobacterium tuberculosis H37Rv
cgcaaccgagggcauuccg

SEQ ID NO: 1301996 - RNA, 13 nt, Mycobacterium tuberculosis H37Rv
cgcaacccggacg

SEQ ID NO: 1301997 - RNA, 21 nt, Mycobacterium tuberculosis H37Rv
cgcaaccauguuaacgcgcgu

SEQ ID NO: 1301998 - RNA, 17 nt, Mycobacterium tuberculosis H37Rv
cgcaaccauguuaacgc

SEQ ID NO: 1301999 - RNA, 16 nt, Mycobacterium tuberculosis H37Rv
cgcaaccggcgaucgg

SEQ ID NO: 1302000 - RNA, 17 nt, Mycobacterium tuberculosis H37Rv
cgcaaccucgccgucgu

SEQ ID NO: 1302001 - RNA, 14 nt, Mycobacterium tuberculosis H37Rv
cgcaccaagacgcc

SEQ ID NO: 1302002 - RNA, 18 nt, Mycobacterium tuberculosis H37Rv
cgcaccacaccacggugg

SEQ ID NO: 1302003 - RNA, 16 nt, Mycobacterium tuberculosis H37Rv
cgcaccaaggccguga

SEQ ID NO: 1302004 - RNA, 16 nt, Mycobacterium tuberculosis H37Rv
cgcaccacggcgguca

SEQ ID NO: 1302005 - RNA, 15 nt, Mycobacterium tuberculosis H37Rv
cgcaccacgagcagc

SEQ ID NO: 1302006 - RNA, 15 nt, Mycobacterium tuberculosis H37Rv
cgcacgaguuaccgg

SEQ ID NO: 1302007 - RNA, 19 nt, Mycobacterium tuberculosis H37Rv
cgcacgacgaauccccgac

SEQ ID NO: 1302008 - RNA, 18 nt, Mycobacterium tuberculosis H37Rv
cgcacgacaggaucgggg

SEQ ID NO: 1302009 - RNA, 12 nt, Mycobacterium tuberculosis H37Rv
cgcacgacaccu

SEQ ID NO: 1302010 - RNA, 14 nt, Mycobacterium tuberculosis H37Rv
cgcaccggagucgc

SEQ ID NO: 1302011 - RNA, 18 nt, Mycobacterium tuberculosis H37Rv
cgcaccggauccacggag

SEQ ID NO: 1302012 - RNA, 14 nt, Mycobacterium tuberculosis H37Rv
cgcaccggaucgcc

SEQ ID NO: 1302013 - RNA, 21 nt, Mycobacterium tuberculosis H37Rv
cgcaccgcuguugcaucgccg

SEQ ID NO: 1302014 - RNA, 17 nt, Mycobacterium tuberculosis H37Rv
cgcaccgcgguacgccg

SEQ ID NO: 1302015 - RNA, 22 nt, Mycobacterium tuberculosis H37Rv
cgcaccgcgguggggucgacgc

SEQ ID NO: 1302016 - RNA, 15 nt, Mycobacterium tuberculosis H37Rv
cgcaccgcugaccgc

SEQ ID NO: 1302017 - RNA, 21 nt, Mycobacterium tuberculosis H37Rv
cgcacgcgggagguaccccca

SEQ ID NO: 1302018 - RNA, 16 nt, Mycobacterium tuberculosis H37Rv
cgcacgcggcaauggu

SEQ ID NO: 1302019 - RNA, 20 nt, Mycobacterium tuberculosis H37Rv
cgcacgccgaccagcacccg

SEQ ID NO: 1302020 - RNA, 16 nt, Mycobacterium tuberculosis H37Rv
cgcacgccgaccagca

SEQ ID NO: 1302021 - RNA, 14 nt, Mycobacterium tuberculosis H37Rv
cgcacgcacggcgu

SEQ ID NO: 1302022 - RNA, 16 nt, Mycobacterium tuberculosis H37Rv
cgcacgcagccgauac

SEQ ID NO: 1302023 - RNA, 23 nt, Mycobacterium tuberculosis H37Rv
cgcacgcaguucggucagcgccu

SEQ ID NO: 1302024 - RNA, 16 nt, Mycobacterium tuberculosis H37Rv
cgcacgauggccgucg

SEQ ID NO: 1302025 - RNA, 18 nt, Mycobacterium tuberculosis H37Rv
cgcacgauggccgucgau

SEQ ID NO: 1302026 - RNA, 20 nt, Mycobacterium tuberculosis H37Rv
cgcacgaucgcccgugagcg

SEQ ID NO: 1302027 - RNA, 18 nt, Mycobacterium tuberculosis H37Rv
cgcacgaucagggaagcc

SEQ ID NO: 1302028 - RNA, 12 nt, Mycobacterium tuberculosis H37Rv
cgcacgaucugc

SEQ ID NO: 1302029 - RNA, 17 nt, Mycobacterium tuberculosis H37Rv
cgcacgguugccgucag

SEQ ID NO: 1302030 - RNA, 20 nt, Mycobacterium tuberculosis H37Rv
cgcacgguguauccgacugg

SEQ ID NO: 1302031 - RNA, 16 nt, Mycobacterium tuberculosis H37Rv
cgcacgguugccguca

SEQ ID NO: 1302032 - RNA, 14 nt, Mycobacterium tuberculosis H37Rv
cgcacggccaccgc

SEQ ID NO: 1302033 - RNA, 15 nt, Mycobacterium tuberculosis H37Rv
cgcacggccgcagcc

SEQ ID NO: 1302034 - RNA, 19 nt, Mycobacterium tuberculosis H37Rv
cgcacggcagacacgcugc

SEQ ID NO: 1302035 - RNA, 18 nt, Mycobacterium tuberculosis H37Rv
cgcacggaaggucgacau

SEQ ID NO: 1302036 - RNA, 16 nt, Mycobacterium tuberculosis H37Rv
cgcacgcuggcgggca

SEQ ID NO: 1302037 - RNA, 14 nt, Mycobacterium tuberculosis H37Rv
cgcacggaaggucg

SEQ ID NO: 1302038 - RNA, 20 nt, Mycobacterium tuberculosis H37Rv
cgcacugguugggcgagacc

SEQ ID NO: 1302039 - RNA, 19 nt, Mycobacterium tuberculosis H37Rv
cgcacuggucaacacgacu

SEQ ID NO: 1302040 - RNA, 16 nt, Mycobacterium tuberculosis H37Rv
cgcacugggugcgucg

SEQ ID NO: 1302041 - RNA, 23 nt, Mycobacterium tuberculosis H37Rv
cgcagcugaucuuggcaagccaa

SEQ ID NO: 1302042 - RNA, 13 nt, Mycobacterium tuberculosis H37Rv
cgcagcugcgggu

SEQ ID NO: 1302043 - RNA, 15 nt, Mycobacterium tuberculosis H37Rv
cgcagcugagccgug

SEQ ID NO: 1302044 - RNA, 15 nt, Mycobacterium tuberculosis H37Rv
cgcagcugacgucac

SEQ ID NO: 1302045 - RNA, 16 nt, Mycobacterium tuberculosis H37Rv
cgcagcucgcugauag

SEQ ID NO: 1302046 - RNA, 22 nt, Mycobacterium tuberculosis H37Rv
cgcagcucgcugauaguggcgc

SEQ ID NO: 1302047 - RNA, 20 nt, Mycobacterium tuberculosis H37Rv
cgcagcuaucuccaugcucg

SEQ ID NO: 1302048 - RNA, 17 nt, Mycobacterium tuberculosis H37Rv
cgcagcuccccgaccga

SEQ ID NO: 1302049 - RNA, 16 nt, Mycobacterium tuberculosis H37Rv
cgcagcgucaucgcgu

SEQ ID NO: 1302050 - RNA, 23 nt, Mycobacterium tuberculosis H37Rv
cgcagcgggcggugucgucaucg

SEQ ID NO: 1302051 - RNA, 13 nt, Mycobacterium tuberculosis H37Rv
cgcagcggugagg

SEQ ID NO: 1302052 - RNA, 22 nt, Mycobacterium tuberculosis H37Rv
cgcagcggccugaccggcucgc

SEQ ID NO: 1302053 - RNA, 22 nt, Mycobacterium tuberculosis H37Rv
cgcaggaaaaccccggccacca

SEQ ID NO: 1302054 - RNA, 21 nt, Mycobacterium tuberculosis H37Rv
cgcaggaaaaccccggccacc

SEQ ID NO: 1302055 - RNA, 17 nt, Mycobacterium tuberculosis H37Rv
cgcagcuguggcccacu

SEQ ID NO: 1302056 - RNA, 14 nt, Mycobacterium tuberculosis H37Rv
cgcagcuuguccgg

SEQ ID NO: 1302057 - RNA, 19 nt, Mycobacterium tuberculosis H37Rv
cgcaggaagcccacgaucg

SEQ ID NO: 1302058 - RNA, 14 nt, Mycobacterium tuberculosis H37Rv
cgcaggcucaccga

SEQ ID NO: 1302059 - RNA, 16 nt, Mycobacterium tuberculosis H37Rv
cgcagccgcucgacgg

SEQ ID NO: 1302060 - RNA, 18 nt, Mycobacterium tuberculosis H37Rv
cgcagcgacacguuggcg

SEQ ID NO: 1302061 - RNA, 16 nt, Mycobacterium tuberculosis H37Rv
cgcagcgccagcggga

SEQ ID NO: 1302062 - RNA, 13 nt, Mycobacterium tuberculosis H37Rv
cgcagcgccaccc

SEQ ID NO: 1302063 - RNA, 16 nt, Mycobacterium tuberculosis H37Rv
cgcagcgcgaucgcgg

SEQ ID NO: 1302064 - RNA, 17 nt, Mycobacterium tuberculosis H37Rv
cgcagcgcgaucgcggu

SEQ ID NO: 1302065 - RNA, 19 nt, Mycobacterium tuberculosis H37Rv
cgcagcgcgaucgcgguca

SEQ ID NO: 1302066 - RNA, 11 nt, Mycobacterium tuberculosis H37Rv
cgcagcggcca

SEQ ID NO: 1302067 - RNA, 12 nt, Mycobacterium tuberculosis H37Rv
cgcagcggcauc

SEQ ID NO: 1302068 - RNA, 20 nt, Mycobacterium tuberculosis H37Rv
cgcagccacguuacgcucgc

SEQ ID NO: 1302069 - RNA, 21 nt, Mycobacterium tuberculosis H37Rv
cgcagcauguccgcagcggug

SEQ ID NO: 1302070 - RNA, 21 nt, Mycobacterium tuberculosis H37Rv
cgcagccgaucgucucggcca

SEQ ID NO: 1302071 - RNA, 20 nt, Mycobacterium tuberculosis H37Rv
cgcagccgaucgucucggcc

SEQ ID NO: 1302072 - RNA, 12 nt, Mycobacterium tuberculosis H37Rv
cgcagccagcaa

SEQ ID NO: 1302073 - RNA, 16 nt, Mycobacterium tuberculosis H37Rv
cgcagccgaucgagca

SEQ ID NO: 1302074 - RNA, 16 nt, Mycobacterium tuberculosis H37Rv
cgcagccgcgcgguga

SEQ ID NO: 1302075 - RNA, 14 nt, Mycobacterium tuberculosis H37Rv
cgcagaaucgcaca

SEQ ID NO: 1302076 - RNA, 17 nt, Mycobacterium tuberculosis H37Rv
cgcagaaucgcacgcga

SEQ ID NO: 1302077 - RNA, 15 nt, Mycobacterium tuberculosis H37Rv
cgcagaacgaucgcg

SEQ ID NO: 1302078 - RNA, 18 nt, Mycobacterium tuberculosis H37Rv
cgcagaacggcguugcgg

SEQ ID NO: 1302079 - RNA, 22 nt, Mycobacterium tuberculosis H37Rv
cgauggcgaugagguggccgcg

SEQ ID NO: 1302080 - RNA, 19 nt, Mycobacterium tuberculosis H37Rv
cgauggcgcaccggcgucg

SEQ ID NO: 1302081 - RNA, 23 nt, Mycobacterium tuberculosis H37Rv
cgauggauuggcgucagcagcaa

SEQ ID NO: 1302082 - RNA, 19 nt, Mycobacterium tuberculosis H37Rv
cgaugcuucccggaugccg

SEQ ID NO: 1302083 - RNA, 15 nt, Mycobacterium tuberculosis H37Rv
cgauggaccgccagg

SEQ ID NO: 1302084 - RNA, 22 nt, Mycobacterium tuberculosis H37Rv
cgauggacgcccaguugccggu

SEQ ID NO: 1302085 - RNA, 15 nt, Mycobacterium tuberculosis H37Rv
cgauggcuaccccag

SEQ ID NO: 1302086 - RNA, 21 nt, Mycobacterium tuberculosis H37Rv
cgauggcggccaccgucagcg

SEQ ID NO: 1302087 - RNA, 16 nt, Mycobacterium tuberculosis H37Rv
cgauggcggccaccgu

SEQ ID NO: 1302088 - RNA, 15 nt, Mycobacterium tuberculosis H37Rv
cgauggcggccacca

SEQ ID NO: 1302089 - RNA, 21 nt, Mycobacterium tuberculosis H37Rv
cgauggcgcgcaacguagcca

SEQ ID NO: 1302090 - RNA, 14 nt, Mycobacterium tuberculosis H37Rv
cgauggcgcgcuca

SEQ ID NO: 1302091 - RNA, 21 nt, Mycobacterium tuberculosis H37Rv
cgaugcuggcaaaguaucgca

SEQ ID NO: 1302092 - RNA, 13 nt, Mycobacterium tuberculosis H37Rv
cgaugccgaccuu

SEQ ID NO: 1302093 - RNA, 20 nt, Mycobacterium tuberculosis H37Rv
cgaugccgaacuccgcggaa

SEQ ID NO: 1302094 - RNA, 22 nt, Mycobacterium tuberculosis H37Rv
cgaugcccuuggcgauguagcc

SEQ ID NO: 1302095 - RNA, 20 nt, Mycobacterium tuberculosis H37Rv
cgaugccgccccgcagcugc

SEQ ID NO: 1302096 - RNA, 21 nt, Mycobacterium tuberculosis H37Rv
cgaugagggcuuguggugagc

SEQ ID NO: 1302097 - RNA, 20 nt, Mycobacterium tuberculosis H37Rv
cgaugauaauuccagcaccg

SEQ ID NO: 1302098 - RNA, 20 nt, Mycobacterium tuberculosis H37Rv
cgaugaucagggucagcgcc

SEQ ID NO: 1302099 - RNA, 16 nt, Mycobacterium tuberculosis H37Rv
cgaugacgaucggcgg

SEQ ID NO: 1302100 - RNA, 13 nt, Mycobacterium tuberculosis H37Rv
cgaugacgaucgc

SEQ ID NO: 1302101 - RNA, 21 nt, Mycobacterium tuberculosis H37Rv
cgaugacgaguucgcgcauca

SEQ ID NO: 1302102 - RNA, 18 nt, Mycobacterium tuberculosis H37Rv
cgaugacgaugccgccga

SEQ ID NO: 1302103 - RNA, 14 nt, Mycobacterium tuberculosis H37Rv
cgaugaccgucgca

SEQ ID NO: 1302104 - RNA, 14 nt, Mycobacterium tuberculosis H37Rv
cgaugaugugcggu

SEQ ID NO: 1302105 - RNA, 16 nt, Mycobacterium tuberculosis H37Rv
cgaugaugucggccgc

SEQ ID NO: 1302106 - RNA, 18 nt, Mycobacterium tuberculosis H37Rv
cgaugaucccgccaccga

SEQ ID NO: 1302107 - RNA, 19 nt, Mycobacterium tuberculosis H37Rv
cgaugaucgaacacggcac

SEQ ID NO: 1302108 - RNA, 20 nt, Mycobacterium tuberculosis H37Rv
cgaugaucgaacacggcaca

SEQ ID NO: 1302109 - RNA, 20 nt, Mycobacterium tuberculosis H37Rv
cgaugauuucgucgaucggc

SEQ ID NO: 1302110 - RNA, 20 nt, Mycobacterium tuberculosis H37Rv
cgaugcacuccaugaaucgc

SEQ ID NO: 1302111 - RNA, 14 nt, Mycobacterium tuberculosis H37Rv
cgaugccacaucgu

SEQ ID NO: 1302112 - RNA, 13 nt, Mycobacterium tuberculosis H37Rv
cgaucuuggccac

SEQ ID NO: 1302113 - RNA, 20 nt, Mycobacterium tuberculosis H37Rv
cgaugaacaucuggcgacga

SEQ ID NO: 1302114 - RNA, 15 nt, Mycobacterium tuberculosis H37Rv
cgaugaaccgggcag

SEQ ID NO: 1302115 - RNA, 19 nt, Mycobacterium tuberculosis H37Rv
cgaugaacgcguagucgcg

SEQ ID NO: 1302116 - RNA, 14 nt, Mycobacterium tuberculosis H37Rv
cgaugaacgcguag

SEQ ID NO: 1302117 - RNA, 19 nt, Mycobacterium tuberculosis H37Rv
cgaucuggucaagacccgc

SEQ ID NO: 1302118 - RNA, 20 nt, Mycobacterium tuberculosis H37Rv
cgauauuggacgcgcaugcc

SEQ ID NO: 1302119 - RNA, 14 nt, Mycobacterium tuberculosis H37Rv
cgauauucggccau

SEQ ID NO: 1302120 - RNA, 21 nt, Mycobacterium tuberculosis H37Rv
cgaucaacaccaacgacagcg

SEQ ID NO: 1302121 - RNA, 22 nt, Mycobacterium tuberculosis H37Rv
cgaucaacaacagccgcagcca

SEQ ID NO: 1302122 - RNA, 17 nt, Mycobacterium tuberculosis H37Rv
cgauuggcugcgccgau

SEQ ID NO: 1302123 - RNA, 13 nt, Mycobacterium tuberculosis H37Rv
cgauuggcucgcc

SEQ ID NO: 1302124 - RNA, 15 nt, Mycobacterium tuberculosis H37Rv
cgauugcuucuucgg

SEQ ID NO: 1302125 - RNA, 16 nt, Mycobacterium tuberculosis H37Rv
cgauuggggugugcgc

SEQ ID NO: 1302126 - RNA, 15 nt, Mycobacterium tuberculosis H37Rv
cgcaaacagauucgg

SEQ ID NO: 1302127 - RNA, 20 nt, Mycobacterium tuberculosis H37Rv
cgauuuugcgucugcucgcc

SEQ ID NO: 1302128 - RNA, 16 nt, Mycobacterium tuberculosis H37Rv
cgcaaccaaccgucgg

SEQ ID NO: 1302129 - RNA, 19 nt, Mycobacterium tuberculosis H37Rv
cgcaaccaaccgucgguga

SEQ ID NO: 1302130 - RNA, 22 nt, Mycobacterium tuberculosis H37Rv
cgcaaccaaagcgacgagcagc

SEQ ID NO: 1302131 - RNA, 22 nt, Mycobacterium tuberculosis H37Rv
cgcaacaugggugaugcaacgc

SEQ ID NO: 1302132 - RNA, 20 nt, Mycobacterium tuberculosis H37Rv
cgauucugcgucugcucgcc

SEQ ID NO: 1302133 - RNA, 15 nt, Mycobacterium tuberculosis H37Rv
cgauucucgaucugg

SEQ ID NO: 1302134 - RNA, 15 nt, Mycobacterium tuberculosis H37Rv
cgauucgugucggug

SEQ ID NO: 1302135 - RNA, 12 nt, Mycobacterium tuberculosis H37Rv
cgauucggccca

SEQ ID NO: 1302136 - RNA, 19 nt, Mycobacterium tuberculosis H37Rv
cgauucugugucugcucgc

SEQ ID NO: 1302137 - RNA, 19 nt, Mycobacterium tuberculosis H37Rv
cgauucugcgucugcucgg

SEQ ID NO: 1302138 - RNA, 23 nt, Mycobacterium tuberculosis H37Rv
cgauucugggcuucaucggcgau

SEQ ID NO: 1302139 - RNA, 23 nt, Mycobacterium tuberculosis H37Rv
cgauucugugucugcucggcgag

SEQ ID NO: 1302140 - RNA, 19 nt, Mycobacterium tuberculosis H37Rv
cgauucugugucugcucgg

SEQ ID NO: 1302141 - RNA, 22 nt, Mycobacterium tuberculosis H37Rv
cgauucgagcaacugcucgacg

SEQ ID NO: 1302142 - RNA, 16 nt, Mycobacterium tuberculosis H37Rv
cgauuccgcucguucg

SEQ ID NO: 1302143 - RNA, 20 nt, Mycobacterium tuberculosis H37Rv
cgauuccgcgucugcucggc

SEQ ID NO: 1302144 - RNA, 22 nt, Mycobacterium tuberculosis H37Rv
cgauucgccuagcgagcgcaca

SEQ ID NO: 1302145 - RNA, 19 nt, Mycobacterium tuberculosis H37Rv
cgauuccgcgucugcucgg

SEQ ID NO: 1302146 - RNA, 20 nt, Mycobacterium tuberculosis H37Rv
cgauuccgcgucugcucgcg

SEQ ID NO: 1302147 - RNA, 17 nt, Mycobacterium tuberculosis H37Rv
cgauuccgcgcgggaaa

SEQ ID NO: 1302148 - RNA, 21 nt, Mycobacterium tuberculosis H37Rv
cgauuccgcccacaugcgcuc

SEQ ID NO: 1302149 - RNA, 20 nt, Mycobacterium tuberculosis H37Rv
cgauguuguugacgcccgag

SEQ ID NO: 1302150 - RNA, 20 nt, Mycobacterium tuberculosis H37Rv
cgauguggcgcuccggcgug

SEQ ID NO: 1302151 - RNA, 22 nt, Mycobacterium tuberculosis H37Rv
cgaugugcgcccaauccaccga

SEQ ID NO: 1302152 - RNA, 13 nt, Mycobacterium tuberculosis H37Rv
cgaugugcgccca

SEQ ID NO: 1302153 - RNA, 16 nt, Mycobacterium tuberculosis H37Rv
cgaugucguuggccac

SEQ ID NO: 1302154 - RNA, 18 nt, Mycobacterium tuberculosis H37Rv
cgaugucguuggccaccu

SEQ ID NO: 1302155 - RNA, 15 nt, Mycobacterium tuberculosis H37Rv
cgaugucggucgggu

SEQ ID NO: 1302156 - RNA, 19 nt, Mycobacterium tuberculosis H37Rv
cgaugucgguaaucuccuc

SEQ ID NO: 1302157 - RNA, 16 nt, Mycobacterium tuberculosis H37Rv
cgaugucggcgaacca

SEQ ID NO: 1302158 - RNA, 13 nt, Mycobacterium tuberculosis H37Rv
cgaugucgaugcc

SEQ ID NO: 1302159 - RNA, 14 nt, Mycobacterium tuberculosis H37Rv
cgaugucgacgucg

SEQ ID NO: 1302160 - RNA, 16 nt, Mycobacterium tuberculosis H37Rv
cgauguccucgauccg

SEQ ID NO: 1302161 - RNA, 15 nt, Mycobacterium tuberculosis H37Rv
cgauguccgcgcgaa

SEQ ID NO: 1302162 - RNA, 13 nt, Mycobacterium tuberculosis H37Rv
cgauggcucacau

SEQ ID NO: 1302163 - RNA, 17 nt, Mycobacterium tuberculosis H37Rv
cgauggcucucacgagc

SEQ ID NO: 1302164 - RNA, 15 nt, Mycobacterium tuberculosis H37Rv
cgaugggauaccgcg

SEQ ID NO: 1302165 - RNA, 16 nt, Mycobacterium tuberculosis H37Rv
cgaugggauaccgcgu

SEQ ID NO: 1302166 - RNA, 19 nt, Mycobacterium tuberculosis H37Rv
cgauggucaaugcgcuggc

SEQ ID NO: 1302167 - RNA, 20 nt, Mycobacterium tuberculosis H37Rv
cgaugguaugcccgccguag

SEQ ID NO: 1302168 - RNA, 17 nt, Mycobacterium tuberculosis H37Rv
cgaugguaucgccgcua

SEQ ID NO: 1302169 - RNA, 20 nt, Mycobacterium tuberculosis H37Rv
cgaugguugccuuguucgcc

SEQ ID NO: 1302170 - RNA, 20 nt, Mycobacterium tuberculosis H37Rv
cgauguccaaugcaccguug

SEQ ID NO: 1302171 - RNA, 11 nt, Mycobacterium tuberculosis H37Rv
cgaugucagcc

SEQ ID NO: 1302172 - RNA, 20 nt, Mycobacterium tuberculosis H37Rv
cgauggugugcacggcuucg

SEQ ID NO: 1302173 - RNA, 18 nt, Mycobacterium tuberculosis H37Rv
cgaugguggccgcgcggu

SEQ ID NO: 1302174 - RNA, 20 nt, Mycobacterium tuberculosis H37Rv
cgaugguggcgaucaucggc

SEQ ID NO: 1302175 - RNA, 20 nt, Mycobacterium tuberculosis H37Rv
cgauggugcucaaggcuucg

SEQ ID NO: 1302176 - RNA, 15 nt, Mycobacterium tuberculosis H37Rv
ccggauguugaccgg

SEQ ID NO: 1302177 - RNA, 19 nt, Mycobacterium tuberculosis H37Rv
ccggaugucgacgagcacc

SEQ ID NO: 1302178 - RNA, 14 nt, Mycobacterium tuberculosis H37Rv
ccggaugucgacga

SEQ ID NO: 1302179 - RNA, 23 nt, Mycobacterium tuberculosis H37Rv
ccggauguugaccggcucgaucu

SEQ ID NO: 1302180 - RNA, 16 nt, Mycobacterium tuberculosis H37Rv
ccggauuauucgcggu

SEQ ID NO: 1302181 - RNA, 15 nt, Mycobacterium tuberculosis H37Rv
ccggauugacgccga

SEQ ID NO: 1302182 - RNA, 16 nt, Mycobacterium tuberculosis H37Rv
ccggauugacgccgaa

SEQ ID NO: 1302183 - RNA, 15 nt, Mycobacterium tuberculosis H37Rv
ccggauuggcgauga

SEQ ID NO: 1302184 - RNA, 23 nt, Mycobacterium tuberculosis H37Rv
ccggaucuggugggugcggccag

SEQ ID NO: 1302185 - RNA, 23 nt, Mycobacterium tuberculosis H37Rv
ccggaucggucggcaccagguug

SEQ ID NO: 1302186 - RNA, 19 nt, Mycobacterium tuberculosis H37Rv
ccggaugcggccgaacucg

SEQ ID NO: 1302187 - RNA, 12 nt, Mycobacterium tuberculosis H37Rv
ccggaugccgac

SEQ ID NO: 1302188 - RNA, 19 nt, Mycobacterium tuberculosis H37Rv
ccggaugcggucccugauc

SEQ ID NO: 1302189 - RNA, 16 nt, Mycobacterium tuberculosis H37Rv
ccggcaccaccguugc

SEQ ID NO: 1302190 - RNA, 14 nt, Mycobacterium tuberculosis H37Rv
ccggcaccacgauc

SEQ ID NO: 1302191 - RNA, 23 nt, Mycobacterium tuberculosis H37Rv
ccggcacauugaucgacggccag

SEQ ID NO: 1302192 - RNA, 19 nt, Mycobacterium tuberculosis H37Rv
ccggcaaucucccgaaucg

SEQ ID NO: 1302193 - RNA, 18 nt, Mycobacterium tuberculosis H37Rv
ccggcaauuccguuaggc

SEQ ID NO: 1302194 - RNA, 14 nt, Mycobacterium tuberculosis H37Rv
ccggcaacgcggcc

SEQ ID NO: 1302195 - RNA, 12 nt, Mycobacterium tuberculosis H37Rv
ccggcaagcgca

SEQ ID NO: 1302196 - RNA, 17 nt, Mycobacterium tuberculosis H37Rv
ccggcaagcgcagacac

SEQ ID NO: 1302197 - RNA, 23 nt, Mycobacterium tuberculosis H37Rv
ccggcaauaccgccagcgccacc

SEQ ID NO: 1302198 - RNA, 13 nt, Mycobacterium tuberculosis H37Rv
ccggcaauaccgg

SEQ ID NO: 1302199 - RNA, 21 nt, Mycobacterium tuberculosis H37Rv
ccggcagcgcggaugucggca

SEQ ID NO: 1302200 - RNA, 16 nt, Mycobacterium tuberculosis H37Rv
ccggcacugcggccag

SEQ ID NO: 1302201 - RNA, 16 nt, Mycobacterium tuberculosis H37Rv
ccggcacugaccgcga

SEQ ID NO: 1302202 - RNA, 17 nt, Mycobacterium tuberculosis H37Rv
ccggcacgcaugccggu

SEQ ID NO: 1302203 - RNA, 19 nt, Mycobacterium tuberculosis H37Rv
ccggcagaugcagcggguc

SEQ ID NO: 1302204 - RNA, 22 nt, Mycobacterium tuberculosis H37Rv
ccggcacggugaacaauccgag

SEQ ID NO: 1302205 - RNA, 16 nt, Mycobacterium tuberculosis H37Rv
ccggcaccgccggcac

SEQ ID NO: 1302206 - RNA, 17 nt, Mycobacterium tuberculosis H37Rv
ccggcaccgcccuugcc

SEQ ID NO: 1302207 - RNA, 18 nt, Mycobacterium tuberculosis H37Rv
ccggcaccccacggccag

SEQ ID NO: 1302208 - RNA, 21 nt, Mycobacterium tuberculosis H37Rv
ccggcaccccuuugacgccga

SEQ ID NO: 1302209 - RNA, 18 nt, Mycobacterium tuberculosis H37Rv
ccggcaccuccgccggca

SEQ ID NO: 1302210 - RNA, 19 nt, Mycobacterium tuberculosis H37Rv
ccggcaccuccgccggcac

SEQ ID NO: 1302211 - RNA, 20 nt, Mycobacterium tuberculosis H37Rv
ccggcaccuccagcaccacc

SEQ ID NO: 1302212 - RNA, 22 nt, Mycobacterium tuberculosis H37Rv
ccggcaccugguccaaucgcga

SEQ ID NO: 1302213 - RNA, 20 nt, Mycobacterium tuberculosis H37Rv
ccggccgugaugucccgcaa

SEQ ID NO: 1302214 - RNA, 17 nt, Mycobacterium tuberculosis H37Rv
ccggccugcucggcgag

SEQ ID NO: 1302215 - RNA, 19 nt, Mycobacterium tuberculosis H37Rv
ccggccugucccgcacccg

SEQ ID NO: 1302216 - RNA, 22 nt, Mycobacterium tuberculosis H37Rv
ccggccuuauucacccgguagg

SEQ ID NO: 1302217 - RNA, 14 nt, Mycobacterium tuberculosis H37Rv
ccggccgguucuug

SEQ ID NO: 1302218 - RNA, 17 nt, Mycobacterium tuberculosis H37Rv
ccggccgguucuuggcg

SEQ ID NO: 1302219 - RNA, 12 nt, Mycobacterium tuberculosis H37Rv
ccggccgguugg

SEQ ID NO: 1302220 - RNA, 19 nt, Mycobacterium tuberculosis H37Rv
ccggccgguuggccagcca

SEQ ID NO: 1302221 - RNA, 18 nt, Mycobacterium tuberculosis H37Rv
ccggcgaaguuggugaca

SEQ ID NO: 1302222 - RNA, 21 nt, Mycobacterium tuberculosis H37Rv
ccggcgaccggcgagcccgca

SEQ ID NO: 1302223 - RNA, 19 nt, Mycobacterium tuberculosis H37Rv
ccggcgaccggcgagcccg

SEQ ID NO: 1302224 - RNA, 14 nt, Mycobacterium tuberculosis H37Rv
ccggcgacgacccg

SEQ ID NO: 1302225 - RNA, 13 nt, Mycobacterium tuberculosis H37Rv
ccggcgaucaccg

SEQ ID NO: 1302226 - RNA, 14 nt, Mycobacterium tuberculosis H37Rv
ccggcgaucagcag

SEQ ID NO: 1302227 - RNA, 16 nt, Mycobacterium tuberculosis H37Rv
ccggcgagcagacgca

SEQ ID NO: 1302228 - RNA, 16 nt, Mycobacterium tuberculosis H37Rv
ccggcgacgggucggg

SEQ ID NO: 1302229 - RNA, 15 nt, Mycobacterium tuberculosis H37Rv
ccggccaggauuucg

SEQ ID NO: 1302230 - RNA, 17 nt, Mycobacterium tuberculosis H37Rv
ccggccaggauuucgca

SEQ ID NO: 1302231 - RNA, 16 nt, Mycobacterium tuberculosis H37Rv
ccggccaggccgacaa

SEQ ID NO: 1302232 - RNA, 21 nt, Mycobacterium tuberculosis H37Rv
ccggcaucgucgacgcccgau

SEQ ID NO: 1302233 - RNA, 14 nt, Mycobacterium tuberculosis H37Rv
ccggccaggggauc

SEQ ID NO: 1302234 - RNA, 20 nt, Mycobacterium tuberculosis H37Rv
ccggccaggcuauggugccg

SEQ ID NO: 1302235 - RNA, 12 nt, Mycobacterium tuberculosis H37Rv
ccggcaucgcgc

SEQ ID NO: 1302236 - RNA, 16 nt, Mycobacterium tuberculosis H37Rv
ccggcaucgagacgca

SEQ ID NO: 1302237 - RNA, 15 nt, Mycobacterium tuberculosis H37Rv
ccggcauagaugccg

SEQ ID NO: 1302238 - RNA, 17 nt, Mycobacterium tuberculosis H37Rv
ccggcauagaucggguc

SEQ ID NO: 1302239 - RNA, 22 nt, Mycobacterium tuberculosis H37Rv
ccggcauaccgaacagcaccuc

SEQ ID NO: 1302240 - RNA, 14 nt, Mycobacterium tuberculosis H37Rv
ccggcauaacgauc

SEQ ID NO: 1302241 - RNA, 15 nt, Mycobacterium tuberculosis H37Rv
ccggcagugagucgg

SEQ ID NO: 1302242 - RNA, 18 nt, Mycobacterium tuberculosis H37Rv
ccggcagugagucgguga

SEQ ID NO: 1302243 - RNA, 13 nt, Mycobacterium tuberculosis H37Rv
ccggcccagaucg

SEQ ID NO: 1302244 - RNA, 18 nt, Mycobacterium tuberculosis H37Rv
ccggcccagaucgguuga

SEQ ID NO: 1302245 - RNA, 22 nt, Mycobacterium tuberculosis H37Rv
ccggcccauucaucuugcggca

SEQ ID NO: 1302246 - RNA, 15 nt, Mycobacterium tuberculosis H37Rv
ccggccgcacgccga

SEQ ID NO: 1302247 - RNA, 13 nt, Mycobacterium tuberculosis H37Rv
ccggccgcacccg

SEQ ID NO: 1302248 - RNA, 14 nt, Mycobacterium tuberculosis H37Rv
ccggcccggugaug

SEQ ID NO: 1302249 - RNA, 21 nt, Mycobacterium tuberculosis H37Rv
ccggcccauugucgaucaccu

SEQ ID NO: 1302250 - RNA, 22 nt, Mycobacterium tuberculosis H37Rv
ccggcccccgaggcuggcaucc

SEQ ID NO: 1302251 - RNA, 22 nt, Mycobacterium tuberculosis H37Rv
ccggacgcacgauccgcacccg

SEQ ID NO: 1302252 - RNA, 21 nt, Mycobacterium tuberculosis H37Rv
ccggacgauggcgucggccag

SEQ ID NO: 1302253 - RNA, 18 nt, Mycobacterium tuberculosis H37Rv
ccggacgcaacacccggg

SEQ ID NO: 1302254 - RNA, 23 nt, Mycobacterium tuberculosis H37Rv
ccggacgaucagggugucgaaga

SEQ ID NO: 1302255 - RNA, 12 nt, Mycobacterium tuberculosis H37Rv
ccggacuaccgc

SEQ ID NO: 1302256 - RNA, 19 nt, Mycobacterium tuberculosis H37Rv
ccggacgggugcgggccga

SEQ ID NO: 1302257 - RNA, 17 nt, Mycobacterium tuberculosis H37Rv
ccggacggugucagccg

SEQ ID NO: 1302258 - RNA, 19 nt, Mycobacterium tuberculosis H37Rv
ccggagccgcuacguuacg

SEQ ID NO: 1302259 - RNA, 21 nt, Mycobacterium tuberculosis H37Rv
ccggagaugacaaucucggcg

SEQ ID NO: 1302260 - RNA, 14 nt, Mycobacterium tuberculosis H37Rv
ccggagcacccggg

SEQ ID NO: 1302261 - RNA, 18 nt, Mycobacterium tuberculosis H37Rv
ccggacuugaccagagca

SEQ ID NO: 1302262 - RNA, 19 nt, Mycobacterium tuberculosis H37Rv
ccggaucgccgaaucggca

SEQ ID NO: 1302263 - RNA, 14 nt, Mycobacterium tuberculosis H37Rv
ccggauccucggcc

SEQ ID NO: 1302264 - RNA, 19 nt, Mycobacterium tuberculosis H37Rv
ccggaucccugugccagca

SEQ ID NO: 1302265 - RNA, 13 nt, Mycobacterium tuberculosis H37Rv
ccggauagcgucg

SEQ ID NO: 1302266 - RNA, 14 nt, Mycobacterium tuberculosis H37Rv
ccggaucaggaucg

SEQ ID NO: 1302267 - RNA, 23 nt, Mycobacterium tuberculosis H37Rv
ccggauacgucagcccgauacgg

SEQ ID NO: 1302268 - RNA, 16 nt, Mycobacterium tuberculosis H37Rv
ccggauacaccggcac

SEQ ID NO: 1302269 - RNA, 17 nt, Mycobacterium tuberculosis H37Rv
ccggaggcaauccgauc

SEQ ID NO: 1302270 - RNA, 19 nt, Mycobacterium tuberculosis H37Rv
ccggagcggucagcggauc

SEQ ID NO: 1302271 - RNA, 19 nt, Mycobacterium tuberculosis H37Rv
ccggaggcaagcaaccggu

SEQ ID NO: 1302272 - RNA, 23 nt, Mycobacterium tuberculosis H37Rv
ccggaggcauuagcacgcuguca

SEQ ID NO: 1302273 - RNA, 22 nt, Mycobacterium tuberculosis H37Rv
ccggagcgguguggucgcagga

SEQ ID NO: 1302274 - RNA, 16 nt, Mycobacterium tuberculosis H37Rv
ccggagccggugccga

SEQ ID NO: 1302275 - RNA, 15 nt, Mycobacterium tuberculosis H37Rv
ccggagucgacgacg

SEQ ID NO: 1302276 - RNA, 13 nt, Mycobacterium tuberculosis H37Rv
ccggagucgacga

SEQ ID NO: 1302277 - RNA, 18 nt, Mycobacterium tuberculosis H37Rv
ccggauaacccagcggcg

SEQ ID NO: 1302278 - RNA, 13 nt, Mycobacterium tuberculosis H37Rv
ccggagucaccga

SEQ ID NO: 1302279 - RNA, 22 nt, Mycobacterium tuberculosis H37Rv
ccggacaagguauccaacgcgc

SEQ ID NO: 1302280 - RNA, 13 nt, Mycobacterium tuberculosis H37Rv
ccggaaucggcgg

SEQ ID NO: 1302281 - RNA, 16 nt, Mycobacterium tuberculosis H37Rv
ccggaaucgucgcggc

SEQ ID NO: 1302282 - RNA, 14 nt, Mycobacterium tuberculosis H37Rv
ccggaaucgcgaaa

SEQ ID NO: 1302283 - RNA, 18 nt, Mycobacterium tuberculosis H37Rv
ccggaauccccaagcccg

SEQ ID NO: 1302284 - RNA, 22 nt, Mycobacterium tuberculosis H37Rv
ccggacagaucaacgcgaaccg

SEQ ID NO: 1302285 - RNA, 13 nt, Mycobacterium tuberculosis H37Rv
ccggacagcucgc

SEQ ID NO: 1302286 - RNA, 17 nt, Mycobacterium tuberculosis H37Rv
ccggacacuccugcaca

SEQ ID NO: 1302287 - RNA, 13 nt, Mycobacterium tuberculosis H37Rv
ccggaccagagcc

SEQ ID NO: 1302288 - RNA, 16 nt, Mycobacterium tuberculosis H37Rv
ccggacauccgaugcg

SEQ ID NO: 1302289 - RNA, 15 nt, Mycobacterium tuberculosis H37Rv
ccggacaugcgggca

SEQ ID NO: 1302290 - RNA, 16 nt, Mycobacterium tuberculosis H37Rv
ccggaccaucgacaac

SEQ ID NO: 1302291 - RNA, 18 nt, Mycobacterium tuberculosis H37Rv
ccggacccauuggaccga

SEQ ID NO: 1302292 - RNA, 23 nt, Mycobacterium tuberculosis H37Rv
ccggacgaacgccgucgacgcgg

SEQ ID NO: 1302293 - RNA, 15 nt, Mycobacterium tuberculosis H37Rv
ccggaccgcggccac

SEQ ID NO: 1302294 - RNA, 16 nt, Mycobacterium tuberculosis H37Rv
ccggaaccagccgcgg

SEQ ID NO: 1302295 - RNA, 18 nt, Mycobacterium tuberculosis H37Rv
ccggaaccggucagccgg

SEQ ID NO: 1302296 - RNA, 23 nt, Mycobacterium tuberculosis H37Rv
ccggaacugcgcaacaccgugca

SEQ ID NO: 1302297 - RNA, 17 nt, Mycobacterium tuberculosis H37Rv
ccggaagaacucguuga

SEQ ID NO: 1302298 - RNA, 16 nt, Mycobacterium tuberculosis H37Rv
ccggaaggcucgccag

SEQ ID NO: 1302299 - RNA, 23 nt, Mycobacterium tuberculosis H37Rv
ccgcuggcauaucccuugccguc

SEQ ID NO: 1302300 - RNA, 15 nt, Mycobacterium tuberculosis H37Rv
ccgcuggaucgcgua

SEQ ID NO: 1302301 - RNA, 15 nt, Mycobacterium tuberculosis H37Rv
ccgcuggaucgacuu

SEQ ID NO: 1302302 - RNA, 20 nt, Mycobacterium tuberculosis H37Rv
ccgcugcggcaccacccggc

SEQ ID NO: 1302303 - RNA, 22 nt, Mycobacterium tuberculosis H37Rv
ccgcugcggcggcuuuggccgc

SEQ ID NO: 1302304 - RNA, 15 nt, Mycobacterium tuberculosis H37Rv
ccgcugccaucgccu

SEQ ID NO: 1302305 - RNA, 19 nt, Mycobacterium tuberculosis H37Rv
ccgcugccgcccuugccgc

SEQ ID NO: 1302306 - RNA, 22 nt, Mycobacterium tuberculosis H37Rv
ccgcucgaccagacgcugccca

SEQ ID NO: 1302307 - RNA, 23 nt, Mycobacterium tuberculosis H37Rv
ccgcucgagcuacgacgaguggu

SEQ ID NO: 1302308 - RNA, 16 nt, Mycobacterium tuberculosis H37Rv
ccgcucgcaggccggc

SEQ ID NO: 1302309 - RNA, 23 nt, Mycobacterium tuberculosis H37Rv
ccgcugaacucaacgggaccgau

SEQ ID NO: 1302310 - RNA, 22 nt, Mycobacterium tuberculosis H37Rv
ccgcugaagccaggauugccgc

SEQ ID NO: 1302311 - RNA, 16 nt, Mycobacterium tuberculosis H37Rv
ccgcucggccgcagcc

SEQ ID NO: 1302312 - RNA, 16 nt, Mycobacterium tuberculosis H37Rv
ccgcucgcugaaccgg

SEQ ID NO: 1302313 - RNA, 23 nt, Mycobacterium tuberculosis H37Rv
ccgcugcauccgcagcaccaagg

SEQ ID NO: 1302314 - RNA, 24 nt, Mycobacterium tuberculosis H37Rv
ccgcugccacccaucgcacggaug

SEQ ID NO: 1302315 - RNA, 19 nt, Mycobacterium tuberculosis H37Rv
ccgcugaccgcaacgcgua

SEQ ID NO: 1302316 - RNA, 12 nt, Mycobacterium tuberculosis H37Rv
ccgcugaccgca

SEQ ID NO: 1302317 - RNA, 15 nt, Mycobacterium tuberculosis H37Rv
ccgcugagcgggcaa

SEQ ID NO: 1302318 - RNA, 21 nt, Mycobacterium tuberculosis H37Rv
ccgcugagccccccgagcccg

SEQ ID NO: 1302319 - RNA, 14 nt, Mycobacterium tuberculosis H37Rv
ccgcugaucgccga

SEQ ID NO: 1302320 - RNA, 15 nt, Mycobacterium tuberculosis H37Rv
ccgcugaucucgguc

SEQ ID NO: 1302321 - RNA, 18 nt, Mycobacterium tuberculosis H37Rv
ccgcuaccagcugggcga

SEQ ID NO: 1302322 - RNA, 20 nt, Mycobacterium tuberculosis H37Rv
ccgcuacguuacgccgagau

SEQ ID NO: 1302323 - RNA, 14 nt, Mycobacterium tuberculosis H37Rv
ccgcuccuccggca

SEQ ID NO: 1302324 - RNA, 21 nt, Mycobacterium tuberculosis H37Rv
ccgcucgagcuacgacgagug

SEQ ID NO: 1302325 - RNA, 14 nt, Mycobacterium tuberculosis H37Rv
ccgcuccgagcacc

SEQ ID NO: 1302326 - RNA, 18 nt, Mycobacterium tuberculosis H37Rv
ccgcgucucggugcagca

SEQ ID NO: 1302327 - RNA, 19 nt, Mycobacterium tuberculosis H37Rv
ccgcgucuacgucguccag

SEQ ID NO: 1302328 - RNA, 15 nt, Mycobacterium tuberculosis H37Rv
ccgcgucgggccgca

SEQ ID NO: 1302329 - RNA, 23 nt, Mycobacterium tuberculosis H37Rv
ccgcgucuuggugcgcgucagcc

SEQ ID NO: 1302330 - RNA, 22 nt, Mycobacterium tuberculosis H37Rv
ccgcgucuuggugcgcgucagc

SEQ ID NO: 1302331 - RNA, 13 nt, Mycobacterium tuberculosis H37Rv
ccgcguuugcgaa

SEQ ID NO: 1302332 - RNA, 21 nt, Mycobacterium tuberculosis H37Rv
ccgcgcuggugauucgcagcc

SEQ ID NO: 1302333 - RNA, 15 nt, Mycobacterium tuberculosis H37Rv
ccgcggggcaucggu

SEQ ID NO: 1302334 - RNA, 15 nt, Mycobacterium tuberculosis H37Rv
ccgcgggggaccgcc

SEQ ID NO: 1302335 - RNA, 20 nt, Mycobacterium tuberculosis H37Rv
ccgcgggcggcaucgccgag

SEQ ID NO: 1302336 - RNA, 20 nt, Mycobacterium tuberculosis H37Rv
ccgcgcuggugauucgcagc

SEQ ID NO: 1302337 - RNA, 14 nt, Mycobacterium tuberculosis H37Rv
ccgcgcugcugacc

SEQ ID NO: 1302338 - RNA, 12 nt, Mycobacterium tuberculosis H37Rv
ccgcggucgcca

SEQ ID NO: 1302339 - RNA, 14 nt, Mycobacterium tuberculosis H37Rv
ccgcggucgcagca

SEQ ID NO: 1302340 - RNA, 13 nt, Mycobacterium tuberculosis H37Rv
ccgcggucgauca

SEQ ID NO: 1302341 - RNA, 16 nt, Mycobacterium tuberculosis H37Rv
ccgcggucggccacca

SEQ ID NO: 1302342 - RNA, 12 nt, Mycobacterium tuberculosis H37Rv
ccgcgggucccg

SEQ ID NO: 1302343 - RNA, 18 nt, Mycobacterium tuberculosis H37Rv
ccgcguaaaccggcugac

SEQ ID NO: 1302344 - RNA, 15 nt, Mycobacterium tuberculosis H37Rv
ccgcguagaccagug

SEQ ID NO: 1302345 - RNA, 16 nt, Mycobacterium tuberculosis H37Rv
ccgcguagaccaguga

SEQ ID NO: 1302346 - RNA, 23 nt, Mycobacterium tuberculosis H37Rv
ccgcguagaccagugaccgcagu

SEQ ID NO: 1302347 - RNA, 22 nt, Mycobacterium tuberculosis H37Rv
ccgcgguugugcugggugccgc

SEQ ID NO: 1302348 - RNA, 17 nt, Mycobacterium tuberculosis H37Rv
ccgcgguguauccgacg

SEQ ID NO: 1302349 - RNA, 21 nt, Mycobacterium tuberculosis H37Rv
ccgcggugugcacgucacgcg

SEQ ID NO: 1302350 - RNA, 19 nt, Mycobacterium tuberculosis H37Rv
ccgcgguguggcuugcguc

SEQ ID NO: 1302351 - RNA, 18 nt, Mycobacterium tuberculosis H37Rv
ccgcgguggaccgggcaa

SEQ ID NO: 1302352 - RNA, 18 nt, Mycobacterium tuberculosis H37Rv
ccgcgucaaccgaucggu

SEQ ID NO: 1302353 - RNA, 19 nt, Mycobacterium tuberculosis H37Rv
ccgcgucaaccgaucgguc

SEQ ID NO: 1302354 - RNA, 16 nt, Mycobacterium tuberculosis H37Rv
ccgcguagguggccag

SEQ ID NO: 1302355 - RNA, 15 nt, Mycobacterium tuberculosis H37Rv
ccgcguagagcagca

SEQ ID NO: 1302356 - RNA, 14 nt, Mycobacterium tuberculosis H37Rv
ccgcauccggucuc

SEQ ID NO: 1302357 - RNA, 14 nt, Mycobacterium tuberculosis H37Rv
ccgcaucgccucac

SEQ ID NO: 1302358 - RNA, 15 nt, Mycobacterium tuberculosis H37Rv
ccgccaccagggcac

SEQ ID NO: 1302359 - RNA, 15 nt, Mycobacterium tuberculosis H37Rv
ccgcaucggcgaaca

SEQ ID NO: 1302360 - RNA, 15 nt, Mycobacterium tuberculosis H37Rv
ccgcaucgcggcauc

SEQ ID NO: 1302361 - RNA, 13 nt, Mycobacterium tuberculosis H37Rv
ccgcaucggcacg

SEQ ID NO: 1302362 - RNA, 17 nt, Mycobacterium tuberculosis H37Rv
ccgcaucgcggcgacgu

SEQ ID NO: 1302363 - RNA, 20 nt, Mycobacterium tuberculosis H37Rv
ccgccagauuggcgcugccc

SEQ ID NO: 1302364 - RNA, 21 nt, Mycobacterium tuberculosis H37Rv
ccgccacccuuggcccggugc

SEQ ID NO: 1302365 - RNA, 14 nt, Mycobacterium tuberculosis H37Rv
ccgccaccgccagc

SEQ ID NO: 1302366 - RNA, 15 nt, Mycobacterium tuberculosis H37Rv
ccgccaccagcgcac

SEQ ID NO: 1302367 - RNA, 12 nt, Mycobacterium tuberculosis H37Rv
ccgccagaaucc

SEQ ID NO: 1302368 - RNA, 12 nt, Mycobacterium tuberculosis H37Rv
ccgccaccgcga

SEQ ID NO: 1302369 - RNA, 15 nt, Mycobacterium tuberculosis H37Rv
ccgccagcaccaccg

SEQ ID NO: 1302370 - RNA, 17 nt, Mycobacterium tuberculosis H37Rv
ccgccagauaggcacca

SEQ ID NO: 1302371 - RNA, 13 nt, Mycobacterium tuberculosis H37Rv
ccgccagcgccac

SEQ ID NO: 1302372 - RNA, 16 nt, Mycobacterium tuberculosis H37Rv
ccgccagcgccaccgu

SEQ ID NO: 1302373 - RNA, 23 nt, Mycobacterium tuberculosis H37Rv
ccgccagcgcgccgaucacggug

SEQ ID NO: 1302374 - RNA, 15 nt, Mycobacterium tuberculosis H37Rv
ccgccagcggcagcg

SEQ ID NO: 1302375 - RNA, 13 nt, Mycobacterium tuberculosis H37Rv
ccgccaguucggc

SEQ ID NO: 1302376 - RNA, 19 nt, Mycobacterium tuberculosis H37Rv
ccgccaguccgaucgccga

SEQ ID NO: 1302377 - RNA, 23 nt, Mycobacterium tuberculosis H37Rv
ccgccagucccccgcucgaccag

SEQ ID NO: 1302378 - RNA, 14 nt, Mycobacterium tuberculosis H37Rv
ccgcaggucgcacc

SEQ ID NO: 1302379 - RNA, 19 nt, Mycobacterium tuberculosis H37Rv
ccgcagggccgccgcgaac

SEQ ID NO: 1302380 - RNA, 16 nt, Mycobacterium tuberculosis H37Rv
ccgcagggaccgguua

SEQ ID NO: 1302381 - RNA, 15 nt, Mycobacterium tuberculosis H37Rv
ccgcaggucgcacca

SEQ ID NO: 1302382 - RNA, 20 nt, Mycobacterium tuberculosis H37Rv
ccgcagcuuggccucagcca

SEQ ID NO: 1302383 - RNA, 14 nt, Mycobacterium tuberculosis H37Rv
ccgcaggcucaccg

SEQ ID NO: 1302384 - RNA, 19 nt, Mycobacterium tuberculosis H37Rv
ccgcauccacgucgcccag

SEQ ID NO: 1302385 - RNA, 19 nt, Mycobacterium tuberculosis H37Rv
ccgcauaccuaacgagccg

SEQ ID NO: 1302386 - RNA, 20 nt, Mycobacterium tuberculosis H37Rv
ccgcauaaggcccaugccgu

SEQ ID NO: 1302387 - RNA, 15 nt, Mycobacterium tuberculosis H37Rv
ccgcauaaaucgggg

SEQ ID NO: 1302388 - RNA, 22 nt, Mycobacterium tuberculosis H37Rv
ccgcaguuauccgguguccugg

SEQ ID NO: 1302389 - RNA, 17 nt, Mycobacterium tuberculosis H37Rv
ccgcaguucaucgagag

SEQ ID NO: 1302390 - RNA, 16 nt, Mycobacterium tuberculosis H37Rv
ccgcaguucggucguc

SEQ ID NO: 1302391 - RNA, 16 nt, Mycobacterium tuberculosis H37Rv
ccgagcaucagauucg

SEQ ID NO: 1302392 - RNA, 16 nt, Mycobacterium tuberculosis H37Rv
ccgagcaccucggcca

SEQ ID NO: 1302393 - RNA, 18 nt, Mycobacterium tuberculosis H37Rv
ccgagcacgccgagcccg

SEQ ID NO: 1302394 - RNA, 19 nt, Mycobacterium tuberculosis H37Rv
ccgagcagacgcagaaucg

SEQ ID NO: 1302395 - RNA, 19 nt, Mycobacterium tuberculosis H37Rv
ccgagcacugacgggccgu

SEQ ID NO: 1302396 - RNA, 14 nt, Mycobacterium tuberculosis H37Rv
ccgagcagacgcgg

SEQ ID NO: 1302397 - RNA, 19 nt, Mycobacterium tuberculosis H37Rv
ccgagcagacacagaaucg

SEQ ID NO: 1302398 - RNA, 20 nt, Mycobacterium tuberculosis H37Rv
ccgagcagcuucucggcgag

SEQ ID NO: 1302399 - RNA, 20 nt, Mycobacterium tuberculosis H37Rv
ccgccgaagaaggugacgau

SEQ ID NO: 1302400 - RNA, 22 nt, Mycobacterium tuberculosis H37Rv
ccgccgaaggcgggggagccca

SEQ ID NO: 1302401 - RNA, 20 nt, Mycobacterium tuberculosis H37Rv
ccgccgacacccccggugcc

SEQ ID NO: 1302402 - RNA, 14 nt, Mycobacterium tuberculosis H37Rv
ccgccgacgccgcc

SEQ ID NO: 1302403 - RNA, 19 nt, Mycobacterium tuberculosis H37Rv
ccgccgaagaaggugacga

SEQ ID NO: 1302404 - RNA, 20 nt, Mycobacterium tuberculosis H37Rv
ccgccgacgccagauccuuc

SEQ ID NO: 1302405 - RNA, 21 nt, Mycobacterium tuberculosis H37Rv
ccgccgaccggagccgccgga

SEQ ID NO: 1302406 - RNA, 17 nt, Mycobacterium tuberculosis H37Rv
ccgcccuugccgccagc

SEQ ID NO: 1302407 - RNA, 23 nt, Mycobacterium tuberculosis H37Rv
ccgcccuguccggguagcggcgc

SEQ ID NO: 1302408 - RNA, 22 nt, Mycobacterium tuberculosis H37Rv
ccgccgaaaaccucgaaaccgu

SEQ ID NO: 1302409 - RNA, 16 nt, Mycobacterium tuberculosis H37Rv
ccgccgaaacucacca

SEQ ID NO: 1302410 - RNA, 16 nt, Mycobacterium tuberculosis H37Rv
ccgccgaacaccggua

SEQ ID NO: 1302411 - RNA, 12 nt, Mycobacterium tuberculosis H37Rv
ccgcccgguuga

SEQ ID NO: 1302412 - RNA, 21 nt, Mycobacterium tuberculosis H37Rv
ccgcccggugcuaaccgacgc

SEQ ID NO: 1302413 - RNA, 21 nt, Mycobacterium tuberculosis H37Rv
ccgcccgcgccuccguugccc

SEQ ID NO: 1302414 - RNA, 20 nt, Mycobacterium tuberculosis H37Rv
ccgccaucgcccgauccccg

SEQ ID NO: 1302415 - RNA, 14 nt, Mycobacterium tuberculosis H37Rv
ccgcccgcacgacg

SEQ ID NO: 1302416 - RNA, 15 nt, Mycobacterium tuberculosis H37Rv
ccgccaucaccgccg

SEQ ID NO: 1302417 - RNA, 21 nt, Mycobacterium tuberculosis H37Rv
ccgccgaucugcugcagcguc

SEQ ID NO: 1302418 - RNA, 18 nt, Mycobacterium tuberculosis H37Rv
ccgccgaucgaaccgcug

SEQ ID NO: 1302419 - RNA, 22 nt, Mycobacterium tuberculosis H37Rv
ccgccgaucgggcuucggccag

SEQ ID NO: 1302420 - RNA, 19 nt, Mycobacterium tuberculosis H37Rv
ccgccgaugccaccgcuug

SEQ ID NO: 1302421 - RNA, 12 nt, Mycobacterium tuberculosis H37Rv
ccgccgaugcca

SEQ ID NO: 1302422 - RNA, 18 nt, Mycobacterium tuberculosis H37Rv
ccgccgaugccaccgcuu

SEQ ID NO: 1302423 - RNA, 21 nt, Mycobacterium tuberculosis H37Rv
ccgccgaugaugugcggugac

SEQ ID NO: 1302424 - RNA, 15 nt, Mycobacterium tuberculosis H37Rv
ccgccgauaccgccg

SEQ ID NO: 1302425 - RNA, 12 nt, Mycobacterium tuberculosis H37Rv
ccgccgaucacu

SEQ ID NO: 1302426 - RNA, 12 nt, Mycobacterium tuberculosis H37Rv
ccgccgaucccg

SEQ ID NO: 1302427 - RNA, 19 nt, Mycobacterium tuberculosis H37Rv
ccgccgcagacgccgacuc

SEQ ID NO: 1302428 - RNA, 18 nt, Mycobacterium tuberculosis H37Rv
ccgccgaugucgacgaca

SEQ ID NO: 1302429 - RNA, 17 nt, Mycobacterium tuberculosis H37Rv
ccgccgaugcccgacac

SEQ ID NO: 1302430 - RNA, 20 nt, Mycobacterium tuberculosis H37Rv
ccgccgaugccaccgcuuga

SEQ ID NO: 1302431 - RNA, 22 nt, Mycobacterium tuberculosis H37Rv
ccgccgagauagcaacgaagcc

SEQ ID NO: 1302432 - RNA, 14 nt, Mycobacterium tuberculosis H37Rv
ccgccgagcaccgg

SEQ ID NO: 1302433 - RNA, 14 nt, Mycobacterium tuberculosis H37Rv
ccgccgagcagacg

SEQ ID NO: 1302434 - RNA, 20 nt, Mycobacterium tuberculosis H37Rv
ccgccgaggccgccguugcc

SEQ ID NO: 1302435 - RNA, 13 nt, Mycobacterium tuberculosis H37Rv
ccgccgaggccgc

SEQ ID NO: 1302436 - RNA, 21 nt, Mycobacterium tuberculosis H37Rv
ccgccgagcucggucaccacg

SEQ ID NO: 1302437 - RNA, 13 nt, Mycobacterium tuberculosis H37Rv
ccgccgagcuggc

SEQ ID NO: 1302438 - RNA, 16 nt, Mycobacterium tuberculosis H37Rv
ccgccgagcgguugcc

SEQ ID NO: 1302439 - RNA, 17 nt, Mycobacterium tuberculosis H37Rv
ccgccgagcucggucac

SEQ ID NO: 1302440 - RNA, 21 nt, Mycobacterium tuberculosis H37Rv
ccgccgccauaccucggcgac

SEQ ID NO: 1302441 - RNA, 20 nt, Mycobacterium tuberculosis H37Rv
ccgccgccauuggacagcgc

SEQ ID NO: 1302442 - RNA, 21 nt, Mycobacterium tuberculosis H37Rv
ccgccgcagcuuguccgguga

SEQ ID NO: 1302443 - RNA, 17 nt, Mycobacterium tuberculosis H37Rv
ccgccgccaccagcugc

SEQ ID NO: 1302444 - RNA, 21 nt, Mycobacterium tuberculosis H37Rv
ccgccgccggaucgccgguga

SEQ ID NO: 1302445 - RNA, 16 nt, Mycobacterium tuberculosis H37Rv
ccgccgccggaucgcc

SEQ ID NO: 1302446 - RNA, 16 nt, Mycobacterium tuberculosis H37Rv
ccgccgccgccgacgc

SEQ ID NO: 1302447 - RNA, 12 nt, Mycobacterium tuberculosis H37Rv
ccgccgcgacgg

SEQ ID NO: 1302448 - RNA, 15 nt, Mycobacterium tuberculosis H37Rv
ccgccgcgacggcac

SEQ ID NO: 1302449 - RNA, 23 nt, Mycobacterium tuberculosis H37Rv
ccgccgcgacggcacgaucaucg

SEQ ID NO: 1302450 - RNA, 22 nt, Mycobacterium tuberculosis H37Rv
ccgccgccugcuccucggccag

SEQ ID NO: 1302451 - RNA, 20 nt, Mycobacterium tuberculosis H37Rv
ccgccgcgaccacgcaccgc

SEQ ID NO: 1302452 - RNA, 15 nt, Mycobacterium tuberculosis H37Rv
ccgcgcguucggcga

SEQ ID NO: 1302453 - RNA, 16 nt, Mycobacterium tuberculosis H37Rv
ccgcgcguucggcgcu

SEQ ID NO: 1302454 - RNA, 22 nt, Mycobacterium tuberculosis H37Rv
ccgcgcguucggcgagcagcgc

SEQ ID NO: 1302455 - RNA, 15 nt, Mycobacterium tuberculosis H37Rv
ccgcgcgucgcccag

SEQ ID NO: 1302456 - RNA, 11 nt, Mycobacterium tuberculosis H37Rv
ccgcgcgucgc

SEQ ID NO: 1302457 - RNA, 16 nt, Mycobacterium tuberculosis H37Rv
ccgcgcggacacucgc

SEQ ID NO: 1302458 - RNA, 14 nt, Mycobacterium tuberculosis H37Rv
ccgcgcugagcacg

SEQ ID NO: 1302459 - RNA, 16 nt, Mycobacterium tuberculosis H37Rv
ccgcgcucucggucag

SEQ ID NO: 1302460 - RNA, 21 nt, Mycobacterium tuberculosis H37Rv
ccgcgcucgaacuccccgguc

SEQ ID NO: 1302461 - RNA, 18 nt, Mycobacterium tuberculosis H37Rv
ccgcgcucgcacccgcuc

SEQ ID NO: 1302462 - RNA, 18 nt, Mycobacterium tuberculosis H37Rv
ccgcgcguccgucggcga

SEQ ID NO: 1302463 - RNA, 22 nt, Mycobacterium tuberculosis H37Rv
ccgcgccgacacguugcagcuc

SEQ ID NO: 1302464 - RNA, 16 nt, Mycobacterium tuberculosis H37Rv
ccgcgccgaaucgcgg

SEQ ID NO: 1302465 - RNA, 13 nt, Mycobacterium tuberculosis H37Rv
ccgcgccgccagc

SEQ ID NO: 1302466 - RNA, 13 nt, Mycobacterium tuberculosis H37Rv
ccgcgccgagcag

SEQ ID NO: 1302467 - RNA, 15 nt, Mycobacterium tuberculosis H37Rv
ccgcgccgacgccgc

SEQ ID NO: 1302468 - RNA, 18 nt, Mycobacterium tuberculosis H37Rv
ccgcgccgacggccagca

SEQ ID NO: 1302469 - RNA, 13 nt, Mycobacterium tuberculosis H37Rv
ccgcgccucgguc

SEQ ID NO: 1302470 - RNA, 13 nt, Mycobacterium tuberculosis H37Rv
ccgcgcagcggug

SEQ ID NO: 1302471 - RNA, 12 nt, Mycobacterium tuberculosis H37Rv
ccgcgcagcguc

SEQ ID NO: 1302472 - RNA, 16 nt, Mycobacterium tuberculosis H37Rv
ccgcgcagcacugcgg

SEQ ID NO: 1302473 - RNA, 16 nt, Mycobacterium tuberculosis H37Rv
ccgcgccaguggccac

SEQ ID NO: 1302474 - RNA, 15 nt, Mycobacterium tuberculosis H37Rv
ccgcgaucgcgacac

SEQ ID NO: 1302475 - RNA, 15 nt, Mycobacterium tuberculosis H37Rv
ccgcgcaccgcggga

SEQ ID NO: 1302476 - RNA, 14 nt, Mycobacterium tuberculosis H37Rv
ccgcgcacgacaac

SEQ ID NO: 1302477 - RNA, 22 nt, Mycobacterium tuberculosis H37Rv
ccgcgcacgacaacuucgccgg

SEQ ID NO: 1302478 - RNA, 15 nt, Mycobacterium tuberculosis H37Rv
ccgcgaagccgaccg

SEQ ID NO: 1302479 - RNA, 16 nt, Mycobacterium tuberculosis H37Rv
ccgcgaaccgcggauc

SEQ ID NO: 1302480 - RNA, 18 nt, Mycobacterium tuberculosis H37Rv
ccgcgaaccgcggaucga

SEQ ID NO: 1302481 - RNA, 18 nt, Mycobacterium tuberculosis H37Rv
ccgcgagcgcgcgacugu

SEQ ID NO: 1302482 - RNA, 20 nt, Mycobacterium tuberculosis H37Rv
ccgcgaggcaagaacccgau

SEQ ID NO: 1302483 - RNA, 21 nt, Mycobacterium tuberculosis H37Rv
ccgcgagguugaccaccagcg

SEQ ID NO: 1302484 - RNA, 11 nt, Mycobacterium tuberculosis H37Rv
ccgcgaucgcc

SEQ ID NO: 1302485 - RNA, 15 nt, Mycobacterium tuberculosis H37Rv
ccgcgaucggcugac

SEQ ID NO: 1302486 - RNA, 13 nt, Mycobacterium tuberculosis H37Rv
ccgcgauccccac

SEQ ID NO: 1302487 - RNA, 23 nt, Mycobacterium tuberculosis H37Rv
ccgcgaucgccgacgccagaacg

SEQ ID NO: 1302488 - RNA, 21 nt, Mycobacterium tuberculosis H37Rv
ccgcgauccagcgcugaccgg

SEQ ID NO: 1302489 - RNA, 17 nt, Mycobacterium tuberculosis H37Rv
ccgcgaguaaucgaccg

SEQ ID NO: 1302490 - RNA, 22 nt, Mycobacterium tuberculosis H37Rv
ccgcgaguccaggcugaucccg

SEQ ID NO: 1302491 - RNA, 18 nt, Mycobacterium tuberculosis H37Rv
ccgccucaaugaccaccg

SEQ ID NO: 1302492 - RNA, 21 nt, Mycobacterium tuberculosis H37Rv
ccgccuaggaguuccucgauc

SEQ ID NO: 1302493 - RNA, 19 nt, Mycobacterium tuberculosis H37Rv
ccgccuggacgccgccgga

SEQ ID NO: 1302494 - RNA, 15 nt, Mycobacterium tuberculosis H37Rv
ccgccuggaucagcg

SEQ ID NO: 1302495 - RNA, 21 nt, Mycobacterium tuberculosis H37Rv
ccgccuggaaggaaccgaucg

SEQ ID NO: 1302496 - RNA, 15 nt, Mycobacterium tuberculosis H37Rv
ccgccguugccgauc

SEQ ID NO: 1302497 - RNA, 14 nt, Mycobacterium tuberculosis H37Rv
ccgccguugccgau

SEQ ID NO: 1302498 - RNA, 16 nt, Mycobacterium tuberculosis H37Rv
ccgccguugccaccgu

SEQ ID NO: 1302499 - RNA, 18 nt, Mycobacterium tuberculosis H37Rv
ccgccguugccgccguua

SEQ ID NO: 1302500 - RNA, 13 nt, Mycobacterium tuberculosis H37Rv
ccgccguugccgc

SEQ ID NO: 1302501 - RNA, 22 nt, Mycobacterium tuberculosis H37Rv
ccgccguugccguuggugccgc

SEQ ID NO: 1302502 - RNA, 21 nt, Mycobacterium tuberculosis H37Rv
ccgccguugccgccguuaccg

SEQ ID NO: 1302503 - RNA, 16 nt, Mycobacterium tuberculosis H37Rv
ccgccguugccgauca

SEQ ID NO: 1302504 - RNA, 16 nt, Mycobacterium tuberculosis H37Rv
ccgccuaaucggccug

SEQ ID NO: 1302505 - RNA, 17 nt, Mycobacterium tuberculosis H37Rv
ccgccuaaucggccugc

SEQ ID NO: 1302506 - RNA, 18 nt, Mycobacterium tuberculosis H37Rv
ccgcgaaauagcgagcgu

SEQ ID NO: 1302507 - RNA, 20 nt, Mycobacterium tuberculosis H37Rv
ccgcgaaauuacuucggcca

SEQ ID NO: 1302508 - RNA, 20 nt, Mycobacterium tuberculosis H37Rv
ccgcgaacccgaucgucgag

SEQ ID NO: 1302509 - RNA, 22 nt, Mycobacterium tuberculosis H37Rv
ccgcgaacccgaucgucgagcc

SEQ ID NO: 1302510 - RNA, 13 nt, Mycobacterium tuberculosis H37Rv
ccgccuucgccgc

SEQ ID NO: 1302511 - RNA, 20 nt, Mycobacterium tuberculosis H37Rv
ccgccuuacgcaccgaugcc

SEQ ID NO: 1302512 - RNA, 14 nt, Mycobacterium tuberculosis H37Rv
ccgccgggcucagc

SEQ ID NO: 1302513 - RNA, 18 nt, Mycobacterium tuberculosis H37Rv
ccgccgggcccucgccau

SEQ ID NO: 1302514 - RNA, 22 nt, Mycobacterium tuberculosis H37Rv
ccgccguccccgccgccguucc

SEQ ID NO: 1302515 - RNA, 19 nt, Mycobacterium tuberculosis H37Rv
ccgccgucaccgccguugc

SEQ ID NO: 1302516 - RNA, 19 nt, Mycobacterium tuberculosis H37Rv
ccgccgucaccccgauucg

SEQ ID NO: 1302517 - RNA, 15 nt, Mycobacterium tuberculosis H37Rv
ccgccgucaccgccg

SEQ ID NO: 1302518 - RNA, 17 nt, Mycobacterium tuberculosis H37Rv
ccgccgucaccgccguu

SEQ ID NO: 1302519 - RNA, 16 nt, Mycobacterium tuberculosis H37Rv
ccgccgucaccccgau

SEQ ID NO: 1302520 - RNA, 15 nt, Mycobacterium tuberculosis H37Rv
ccgccggucacgacg

SEQ ID NO: 1302521 - RNA, 20 nt, Mycobacterium tuberculosis H37Rv
ccgccggguccggaaccggu

SEQ ID NO: 1302522 - RNA, 23 nt, Mycobacterium tuberculosis H37Rv
ccgccgggaaauaucucggugac

SEQ ID NO: 1302523 - RNA, 13 nt, Mycobacterium tuberculosis H37Rv
ccgccgggaagcc

SEQ ID NO: 1302524 - RNA, 20 nt, Mycobacterium tuberculosis H37Rv
ccgccggcgccggagccgcc

SEQ ID NO: 1302525 - RNA, 18 nt, Mycobacterium tuberculosis H37Rv
ccgccggcgccgccggca

SEQ ID NO: 1302526 - RNA, 17 nt, Mycobacterium tuberculosis H37Rv
ccgccgcgcguucggcg

SEQ ID NO: 1302527 - RNA, 15 nt, Mycobacterium tuberculosis H37Rv
ccgccgcgccggcac

SEQ ID NO: 1302528 - RNA, 14 nt, Mycobacterium tuberculosis H37Rv
ccgccgcgccggca

SEQ ID NO: 1302529 - RNA, 15 nt, Mycobacterium tuberculosis H37Rv
ccgccgcgcauccgc

SEQ ID NO: 1302530 - RNA, 14 nt, Mycobacterium tuberculosis H37Rv
ccgccgcgauggcc

SEQ ID NO: 1302531 - RNA, 20 nt, Mycobacterium tuberculosis H37Rv
ccuggagcagccacgauccu

SEQ ID NO: 1302532 - RNA, 14 nt, Mycobacterium tuberculosis H37Rv
ccuggacugcagcg

SEQ ID NO: 1302533 - RNA, 15 nt, Mycobacterium tuberculosis H37Rv
ccuggaaugccgcca

SEQ ID NO: 1302534 - RNA, 16 nt, Mycobacterium tuberculosis H37Rv
ccuggcaacgacacgc

SEQ ID NO: 1302535 - RNA, 13 nt, Mycobacterium tuberculosis H37Rv
ccuggcacccggg

SEQ ID NO: 1302536 - RNA, 14 nt, Mycobacterium tuberculosis H37Rv
ccuggccacccaga

SEQ ID NO: 1302537 - RNA, 19 nt, Mycobacterium tuberculosis H37Rv
ccuggcggguguggcagug

SEQ ID NO: 1302538 - RNA, 19 nt, Mycobacterium tuberculosis H37Rv
ccuggcggguggcgaugag

SEQ ID NO: 1302539 - RNA, 16 nt, Mycobacterium tuberculosis H37Rv
ccuggcccgccacgau

SEQ ID NO: 1302540 - RNA, 17 nt, Mycobacterium tuberculosis H37Rv
ccuggccgggaccgccc

SEQ ID NO: 1302541 - RNA, 14 nt, Mycobacterium tuberculosis H37Rv
ccuggucgagcacg

SEQ ID NO: 1302542 - RNA, 12 nt, Mycobacterium tuberculosis H37Rv
ccuggucgagca

SEQ ID NO: 1302543 - RNA, 21 nt, Mycobacterium tuberculosis H37Rv
ccugguugaccucggugaaga

SEQ ID NO: 1302544 - RNA, 17 nt, Mycobacterium tuberculosis H37Rv
ccuggugcaaccgugcc

SEQ ID NO: 1302545 - RNA, 22 nt, Mycobacterium tuberculosis H37Rv
ccugguaggugucgugguagcg

SEQ ID NO: 1302546 - RNA, 21 nt, Mycobacterium tuberculosis H37Rv
ccugggauccggcggcaggua

SEQ ID NO: 1302547 - RNA, 21 nt, Mycobacterium tuberculosis H37Rv
ccuggcuaucgcagaacggac

SEQ ID NO: 1302548 - RNA, 16 nt, Mycobacterium tuberculosis H37Rv
ccuggggguggcagcg

SEQ ID NO: 1302549 - RNA, 18 nt, Mycobacterium tuberculosis H37Rv
ccugcgacacaacgggug

SEQ ID NO: 1302550 - RNA, 20 nt, Mycobacterium tuberculosis H37Rv
ccugccucggcgagccgcuc

SEQ ID NO: 1302551 - RNA, 19 nt, Mycobacterium tuberculosis H37Rv
ccugcgaaacgcuggccac

SEQ ID NO: 1302552 - RNA, 17 nt, Mycobacterium tuberculosis H37Rv
ccugcgagugcggcacg

SEQ ID NO: 1302553 - RNA, 23 nt, Mycobacterium tuberculosis H37Rv
ccugcgccgaguuguucgcccac

SEQ ID NO: 1302554 - RNA, 19 nt, Mycobacterium tuberculosis H37Rv
ccugcgccgcccgcgccac

SEQ ID NO: 1302555 - RNA, 16 nt, Mycobacterium tuberculosis H37Rv
ccugcccagcaccacc

SEQ ID NO: 1302556 - RNA, 14 nt, Mycobacterium tuberculosis H37Rv
ccugccaucacgcg

SEQ ID NO: 1302557 - RNA, 19 nt, Mycobacterium tuberculosis H37Rv
ccugccgacggcaucaacg

SEQ ID NO: 1302558 - RNA, 14 nt, Mycobacterium tuberculosis H37Rv
ccugccgaucccgu

SEQ ID NO: 1302559 - RNA, 13 nt, Mycobacterium tuberculosis H37Rv
ccugccggcagcg

SEQ ID NO: 1302560 - RNA, 14 nt, Mycobacterium tuberculosis H37Rv
ccugccgcgaugag

SEQ ID NO: 1302561 - RNA, 13 nt, Mycobacterium tuberculosis H37Rv
ccugcgucggccc

SEQ ID NO: 1302562 - RNA, 20 nt, Mycobacterium tuberculosis H37Rv
ccugcgucucgaugagcgcg

SEQ ID NO: 1302563 - RNA, 18 nt, Mycobacterium tuberculosis H37Rv
ccugcggguaggugacga

SEQ ID NO: 1302564 - RNA, 19 nt, Mycobacterium tuberculosis H37Rv
ccugcgggaucgccgagac

SEQ ID NO: 1302565 - RNA, 15 nt, Mycobacterium tuberculosis H37Rv
ccugcgggcccacgc

SEQ ID NO: 1302566 - RNA, 13 nt, Mycobacterium tuberculosis H37Rv
ccugcggaucgga

SEQ ID NO: 1302567 - RNA, 16 nt, Mycobacterium tuberculosis H37Rv
ccugcuccucggccag

SEQ ID NO: 1302568 - RNA, 15 nt, Mycobacterium tuberculosis H37Rv
ccugcucgauacggc

SEQ ID NO: 1302569 - RNA, 18 nt, Mycobacterium tuberculosis H37Rv
ccugcucggagagcagca

SEQ ID NO: 1302570 - RNA, 20 nt, Mycobacterium tuberculosis H37Rv
ccugcucgggcgugaucccg

SEQ ID NO: 1302571 - RNA, 16 nt, Mycobacterium tuberculosis H37Rv
ccugcucgucggccac

SEQ ID NO: 1302572 - RNA, 19 nt, Mycobacterium tuberculosis H37Rv
ccugcuggagcagcuaccg

SEQ ID NO: 1302573 - RNA, 17 nt, Mycobacterium tuberculosis H37Rv
ccugcuggucggugaug

SEQ ID NO: 1302574 - RNA, 19 nt, Mycobacterium tuberculosis H37Rv
ccugccacagcgacagcgu

SEQ ID NO: 1302575 - RNA, 12 nt, Mycobacterium tuberculosis H37Rv
ccugcaggccgc

SEQ ID NO: 1302576 - RNA, 16 nt, Mycobacterium tuberculosis H37Rv
ccugcaguucggcgua

SEQ ID NO: 1302577 - RNA, 12 nt, Mycobacterium tuberculosis H37Rv
ccugcagccgau

SEQ ID NO: 1302578 - RNA, 19 nt, Mycobacterium tuberculosis H37Rv
ccugcaacgccgcggacca

SEQ ID NO: 1302579 - RNA, 15 nt, Mycobacterium tuberculosis H37Rv
ccugcacccgacccg

SEQ ID NO: 1302580 - RNA, 17 nt, Mycobacterium tuberculosis H37Rv
ccugcacccgacccgau

SEQ ID NO: 1302581 - RNA, 21 nt, Mycobacterium tuberculosis H37Rv
ccugaccgaagucugcagacg

SEQ ID NO: 1302582 - RNA, 22 nt, Mycobacterium tuberculosis H37Rv
ccugacgccauucaucggcauc

SEQ ID NO: 1302583 - RNA, 19 nt, Mycobacterium tuberculosis H37Rv
ccugacgcucggucgccac

SEQ ID NO: 1302584 - RNA, 22 nt, Mycobacterium tuberculosis H37Rv
ccugaaucuuguuguucgccac

SEQ ID NO: 1302585 - RNA, 19 nt, Mycobacterium tuberculosis H37Rv
ccugaaucgguucggccag

SEQ ID NO: 1302586 - RNA, 17 nt, Mycobacterium tuberculosis H37Rv
ccugagcgugucuggcg

SEQ ID NO: 1302587 - RNA, 13 nt, Mycobacterium tuberculosis H37Rv
ccugagcggccau

SEQ ID NO: 1302588 - RNA, 15 nt, Mycobacterium tuberculosis H37Rv
ccugacucaucaccg

SEQ ID NO: 1302589 - RNA, 20 nt, Mycobacterium tuberculosis H37Rv
ccucugcugagcugcucgcc

SEQ ID NO: 1302590 - RNA, 18 nt, Mycobacterium tuberculosis H37Rv
ccucugucuucagcugcg

SEQ ID NO: 1302591 - RNA, 23 nt, Mycobacterium tuberculosis H37Rv
ccucucagcacgguuguuguaga

SEQ ID NO: 1302592 - RNA, 16 nt, Mycobacterium tuberculosis H37Rv
ccucguuaucgaccgc

SEQ ID NO: 1302593 - RNA, 17 nt, Mycobacterium tuberculosis H37Rv
ccucguugcugccggcg

SEQ ID NO: 1302594 - RNA, 20 nt, Mycobacterium tuberculosis H37Rv
ccucuaugcgggcagcgauc

SEQ ID NO: 1302595 - RNA, 14 nt, Mycobacterium tuberculosis H37Rv
ccucugcguccagc

SEQ ID NO: 1302596 - RNA, 15 nt, Mycobacterium tuberculosis H37Rv
ccucuugcaccaggg

SEQ ID NO: 1302597 - RNA, 16 nt, Mycobacterium tuberculosis H37Rv
ccucgacgucggcgag

SEQ ID NO: 1302598 - RNA, 17 nt, Mycobacterium tuberculosis H37Rv
ccucgacuucggcggga

SEQ ID NO: 1302599 - RNA, 16 nt, Mycobacterium tuberculosis H37Rv
ccucgauuguggccag

SEQ ID NO: 1302600 - RNA, 15 nt, Mycobacterium tuberculosis H37Rv
ccucgauggcggugg

SEQ ID NO: 1302601 - RNA, 15 nt, Mycobacterium tuberculosis H37Rv
ccucgagacggucga

SEQ ID NO: 1302602 - RNA, 20 nt, Mycobacterium tuberculosis H37Rv
ccucgaugcccuuggcgaug

SEQ ID NO: 1302603 - RNA, 13 nt, Mycobacterium tuberculosis H37Rv
ccucgauggccag

SEQ ID NO: 1302604 - RNA, 14 nt, Mycobacterium tuberculosis H37Rv
ccucgucaccgcga

SEQ ID NO: 1302605 - RNA, 13 nt, Mycobacterium tuberculosis H37Rv
ccucgucacccgg

SEQ ID NO: 1302606 - RNA, 15 nt, Mycobacterium tuberculosis H37Rv
ccucggcggcggcac

SEQ ID NO: 1302607 - RNA, 17 nt, Mycobacterium tuberculosis H37Rv
ccucggcggagacggcg

SEQ ID NO: 1302608 - RNA, 22 nt, Mycobacterium tuberculosis H37Rv
ccucggcggccagcucggccag

SEQ ID NO: 1302609 - RNA, 16 nt, Mycobacterium tuberculosis H37Rv
ccucggcgcugcgcac

SEQ ID NO: 1302610 - RNA, 15 nt, Mycobacterium tuberculosis H37Rv
ccucggcaucgccgc

SEQ ID NO: 1302611 - RNA, 15 nt, Mycobacterium tuberculosis H37Rv
ccucggcacggucgc

SEQ ID NO: 1302612 - RNA, 14 nt, Mycobacterium tuberculosis H37Rv
ccucggcaucgccg

SEQ ID NO: 1302613 - RNA, 13 nt, Mycobacterium tuberculosis H37Rv
ccgugguggucgg

SEQ ID NO: 1302614 - RNA, 19 nt, Mycobacterium tuberculosis H37Rv
ccgugguggcguaucgggc

SEQ ID NO: 1302615 - RNA, 23 nt, Mycobacterium tuberculosis H37Rv
ccucaccggguuggaagccgcac

SEQ ID NO: 1302616 - RNA, 15 nt, Mycobacterium tuberculosis H37Rv
ccucaccugacacgc

SEQ ID NO: 1302617 - RNA, 18 nt, Mycobacterium tuberculosis H37Rv
ccucagacagcugcacac

SEQ ID NO: 1302618 - RNA, 22 nt, Mycobacterium tuberculosis H37Rv
ccucagcgcgguccaucccgag

SEQ ID NO: 1302619 - RNA, 14 nt, Mycobacterium tuberculosis H37Rv
ccuccagcagcgac

SEQ ID NO: 1302620 - RNA, 17 nt, Mycobacterium tuberculosis H37Rv
ccucgacgaucagcacg

SEQ ID NO: 1302621 - RNA, 18 nt, Mycobacterium tuberculosis H37Rv
ccucgacgccgcgcagcc

SEQ ID NO: 1302622 - RNA, 21 nt, Mycobacterium tuberculosis H37Rv
ccucgaaacgcuuacccagcc

SEQ ID NO: 1302623 - RNA, 20 nt, Mycobacterium tuberculosis H37Rv
ccuccuuuguccucccggac

SEQ ID NO: 1302624 - RNA, 21 nt, Mycobacterium tuberculosis H37Rv
ccuccuugagccgggcaacca

SEQ ID NO: 1302625 - RNA, 12 nt, Mycobacterium tuberculosis H37Rv
ccuccugccgcc

SEQ ID NO: 1302626 - RNA, 16 nt, Mycobacterium tuberculosis H37Rv
ccuccucgugcaggac

SEQ ID NO: 1302627 - RNA, 14 nt, Mycobacterium tuberculosis H37Rv
ccuccgacgcgauc

SEQ ID NO: 1302628 - RNA, 21 nt, Mycobacterium tuberculosis H37Rv
ccucccauucccaacacagcc

SEQ ID NO: 1302629 - RNA, 21 nt, Mycobacterium tuberculosis H37Rv
ccuccagguagucgcgguagg

SEQ ID NO: 1302630 - RNA, 21 nt, Mycobacterium tuberculosis H37Rv
ccggugucuggguggacaggu

SEQ ID NO: 1302631 - RNA, 21 nt, Mycobacterium tuberculosis H37Rv
ccggugucucccuugccgcca

SEQ ID NO: 1302632 - RNA, 21 nt, Mycobacterium tuberculosis H37Rv
ccgguguaggccucggcagca

SEQ ID NO: 1302633 - RNA, 20 nt, Mycobacterium tuberculosis H37Rv
ccgguguagcagcgccagca

SEQ ID NO: 1302634 - RNA, 18 nt, Mycobacterium tuberculosis H37Rv
ccgguugaccgccgacac

SEQ ID NO: 1302635 - RNA, 13 nt, Mycobacterium tuberculosis H37Rv
ccgguucggugag

SEQ ID NO: 1302636 - RNA, 16 nt, Mycobacterium tuberculosis H37Rv
ccgguguguuuggcau

SEQ ID NO: 1302637 - RNA, 17 nt, Mycobacterium tuberculosis H37Rv
ccggugcuccucggcag

SEQ ID NO: 1302638 - RNA, 21 nt, Mycobacterium tuberculosis H37Rv
ccggugccggucgagugccuc

SEQ ID NO: 1302639 - RNA, 15 nt, Mycobacterium tuberculosis H37Rv
ccggugccggcguug

SEQ ID NO: 1302640 - RNA, 14 nt, Mycobacterium tuberculosis H37Rv
ccggugccggcgca

SEQ ID NO: 1302641 - RNA, 15 nt, Mycobacterium tuberculosis H37Rv
ccggugccgcgguag

SEQ ID NO: 1302642 - RNA, 19 nt, Mycobacterium tuberculosis H37Rv
ccggugccgccgcggccac

SEQ ID NO: 1302643 - RNA, 16 nt, Mycobacterium tuberculosis H37Rv
ccggugcgcauccguc

SEQ ID NO: 1302644 - RNA, 17 nt, Mycobacterium tuberculosis H37Rv
ccgguccccccguugcc

SEQ ID NO: 1302645 - RNA, 19 nt, Mycobacterium tuberculosis H37Rv
ccggugccguuggagccgc

SEQ ID NO: 1302646 - RNA, 19 nt, Mycobacterium tuberculosis H37Rv
ccgguccauggacggccag

SEQ ID NO: 1302647 - RNA, 17 nt, Mycobacterium tuberculosis H37Rv
ccggucccaaggcguug

SEQ ID NO: 1302648 - RNA, 13 nt, Mycobacterium tuberculosis H37Rv
ccggugacggugu

SEQ ID NO: 1302649 - RNA, 13 nt, Mycobacterium tuberculosis H37Rv
ccgguccgauucg

SEQ ID NO: 1302650 - RNA, 18 nt, Mycobacterium tuberculosis H37Rv
ccgguccagcccagcgcg

SEQ ID NO: 1302651 - RNA, 20 nt, Mycobacterium tuberculosis H37Rv
ccgguccacugucagcgauc

SEQ ID NO: 1302652 - RNA, 17 nt, Mycobacterium tuberculosis H37Rv
ccggucauaccaagcgc

SEQ ID NO: 1302653 - RNA, 14 nt, Mycobacterium tuberculosis H37Rv
ccggucaucggccg

SEQ ID NO: 1302654 - RNA, 16 nt, Mycobacterium tuberculosis H37Rv
ccggucaucccaagcg

SEQ ID NO: 1302655 - RNA, 19 nt, Mycobacterium tuberculosis H37Rv
ccggugauggugaccagca

SEQ ID NO: 1302656 - RNA, 16 nt, Mycobacterium tuberculosis H37Rv
ccggugauggccgacc

SEQ ID NO: 1302657 - RNA, 14 nt, Mycobacterium tuberculosis H37Rv
ccggugaugaccgg

SEQ ID NO: 1302658 - RNA, 13 nt, Mycobacterium tuberculosis H37Rv
ccggugauggccg

SEQ ID NO: 1302659 - RNA, 17 nt, Mycobacterium tuberculosis H37Rv
ccggugccgccguugcc

SEQ ID NO: 1302660 - RNA, 20 nt, Mycobacterium tuberculosis H37Rv
ccggugauccaacuggccgc

SEQ ID NO: 1302661 - RNA, 19 nt, Mycobacterium tuberculosis H37Rv
ccggugaugaccgcguaga

SEQ ID NO: 1302662 - RNA, 14 nt, Mycobacterium tuberculosis H37Rv
ccggugagcgagcg

SEQ ID NO: 1302663 - RNA, 21 nt, Mycobacterium tuberculosis H37Rv
ccggugagcgagcgcgcguag

SEQ ID NO: 1302664 - RNA, 22 nt, Mycobacterium tuberculosis H37Rv
ccguaucacgguugccgcgauc

SEQ ID NO: 1302665 - RNA, 13 nt, Mycobacterium tuberculosis H37Rv
ccguauccaggcg

SEQ ID NO: 1302666 - RNA, 22 nt, Mycobacterium tuberculosis H37Rv
ccguauaggcccgggcggccag

SEQ ID NO: 1302667 - RNA, 19 nt, Mycobacterium tuberculosis H37Rv
ccguauugaugcugcccga

SEQ ID NO: 1302668 - RNA, 16 nt, Mycobacterium tuberculosis H37Rv
ccguaguaccaaagcg

SEQ ID NO: 1302669 - RNA, 18 nt, Mycobacterium tuberculosis H37Rv
ccguaggugcacaacccg

SEQ ID NO: 1302670 - RNA, 16 nt, Mycobacterium tuberculosis H37Rv
ccguaggguggccgac

SEQ ID NO: 1302671 - RNA, 15 nt, Mycobacterium tuberculosis H37Rv
ccguaggcgccgaac

SEQ ID NO: 1302672 - RNA, 16 nt, Mycobacterium tuberculosis H37Rv
ccguagcccacgacga

SEQ ID NO: 1302673 - RNA, 19 nt, Mycobacterium tuberculosis H37Rv
ccgguuggacugacgucga

SEQ ID NO: 1302674 - RNA, 19 nt, Mycobacterium tuberculosis H37Rv
ccgguugaugguccgccag

SEQ ID NO: 1302675 - RNA, 17 nt, Mycobacterium tuberculosis H37Rv
ccgucacugaugggccg

SEQ ID NO: 1302676 - RNA, 18 nt, Mycobacterium tuberculosis H37Rv
ccgucacugaugggccgg

SEQ ID NO: 1302677 - RNA, 19 nt, Mycobacterium tuberculosis H37Rv
ccgucagaacaccggccag

SEQ ID NO: 1302678 - RNA, 20 nt, Mycobacterium tuberculosis H37Rv
ccgucaucgcggugugccgg

SEQ ID NO: 1302679 - RNA, 21 nt, Mycobacterium tuberculosis H37Rv
ccgucaucgcggugugccggu

SEQ ID NO: 1302680 - RNA, 15 nt, Mycobacterium tuberculosis H37Rv
ccgucaugccguuga

SEQ ID NO: 1302681 - RNA, 17 nt, Mycobacterium tuberculosis H37Rv
ccgucacgucguuuggc

SEQ ID NO: 1302682 - RNA, 16 nt, Mycobacterium tuberculosis H37Rv
ccgucacaagucgaca

SEQ ID NO: 1302683 - RNA, 23 nt, Mycobacterium tuberculosis H37Rv
ccgucacaagucgacacgccgaa

SEQ ID NO: 1302684 - RNA, 22 nt, Mycobacterium tuberculosis H37Rv
ccgucaaucgcaaugaccugca

SEQ ID NO: 1302685 - RNA, 13 nt, Mycobacterium tuberculosis H37Rv
ccgucucggcgac

SEQ ID NO: 1302686 - RNA, 19 nt, Mycobacterium tuberculosis H37Rv
ccgucucgcaccgcguuga

SEQ ID NO: 1302687 - RNA, 18 nt, Mycobacterium tuberculosis H37Rv
ccgucucgcggugcggca

SEQ ID NO: 1302688 - RNA, 14 nt, Mycobacterium tuberculosis H37Rv
ccgucucggcaugc

SEQ ID NO: 1302689 - RNA, 22 nt, Mycobacterium tuberculosis H37Rv
ccgucguugugccggucgauga

SEQ ID NO: 1302690 - RNA, 20 nt, Mycobacterium tuberculosis H37Rv
ccgucuccgguuucuacaac

SEQ ID NO: 1302691 - RNA, 15 nt, Mycobacterium tuberculosis H37Rv
ccgucgugaucggcg

SEQ ID NO: 1302692 - RNA, 15 nt, Mycobacterium tuberculosis H37Rv
ccgucgugccaccgu

SEQ ID NO: 1302693 - RNA, 21 nt, Mycobacterium tuberculosis H37Rv
ccgucgugcggggguggucuc

SEQ ID NO: 1302694 - RNA, 16 nt, Mycobacterium tuberculosis H37Rv
ccgucgucgugcacga

SEQ ID NO: 1302695 - RNA, 17 nt, Mycobacterium tuberculosis H37Rv
ccgucggugccgcggac

SEQ ID NO: 1302696 - RNA, 14 nt, Mycobacterium tuberculosis H37Rv
ccgucggucgccgg

SEQ ID NO: 1302697 - RNA, 16 nt, Mycobacterium tuberculosis H37Rv
ccgucggucgccggug

SEQ ID NO: 1302698 - RNA, 17 nt, Mycobacterium tuberculosis H37Rv
ccgucgucgucggcagc

SEQ ID NO: 1302699 - RNA, 20 nt, Mycobacterium tuberculosis H37Rv
ccgucgucgucggcagcguc

SEQ ID NO: 1302700 - RNA, 15 nt, Mycobacterium tuberculosis H37Rv
ccguccagcaacagc

SEQ ID NO: 1302701 - RNA, 13 nt, Mycobacterium tuberculosis H37Rv
ccguccgcaccgg

SEQ ID NO: 1302702 - RNA, 13 nt, Mycobacterium tuberculosis H37Rv
ccgucgcaccaga

SEQ ID NO: 1302703 - RNA, 14 nt, Mycobacterium tuberculosis H37Rv
ccgucgcaccagcg

SEQ ID NO: 1302704 - RNA, 19 nt, Mycobacterium tuberculosis H37Rv
ccgucgaugugcgguacau

SEQ ID NO: 1302705 - RNA, 19 nt, Mycobacterium tuberculosis H37Rv
ccguccgcggguagcgguu

SEQ ID NO: 1302706 - RNA, 23 nt, Mycobacterium tuberculosis H37Rv
ccgucgcccggguggcgucgauc

SEQ ID NO: 1302707 - RNA, 22 nt, Mycobacterium tuberculosis H37Rv
ccgucgcagccagcugaacacg

SEQ ID NO: 1302708 - RNA, 22 nt, Mycobacterium tuberculosis H37Rv
ccgucgcaucaggucggugguc

SEQ ID NO: 1302709 - RNA, 23 nt, Mycobacterium tuberculosis H37Rv
ccgucgcagaaaccauucggcga

SEQ ID NO: 1302710 - RNA, 19 nt, Mycobacterium tuberculosis H37Rv
ccgugagcaccagcagcac

SEQ ID NO: 1302711 - RNA, 23 nt, Mycobacterium tuberculosis H37Rv
ccgucuuguaggacaagugccgg

SEQ ID NO: 1302712 - RNA, 13 nt, Mycobacterium tuberculosis H37Rv
ccgucuggccguu

SEQ ID NO: 1302713 - RNA, 13 nt, Mycobacterium tuberculosis H37Rv
ccgucuucgccgc

SEQ ID NO: 1302714 - RNA, 14 nt, Mycobacterium tuberculosis H37Rv
ccgucuugccggcc

SEQ ID NO: 1302715 - RNA, 16 nt, Mycobacterium tuberculosis H37Rv
ccgugcacgaucgcgg

SEQ ID NO: 1302716 - RNA, 17 nt, Mycobacterium tuberculosis H37Rv
ccgugaucagcgcguag

SEQ ID NO: 1302717 - RNA, 13 nt, Mycobacterium tuberculosis H37Rv
ccgugaucagcuc

SEQ ID NO: 1302718 - RNA, 19 nt, Mycobacterium tuberculosis H37Rv
ccgugccgucaacgauggu

SEQ ID NO: 1302719 - RNA, 23 nt, Mycobacterium tuberculosis H37Rv
ccgugccgguguguccagcggau

SEQ ID NO: 1302720 - RNA, 18 nt, Mycobacterium tuberculosis H37Rv
ccgugccgguuuggccga

SEQ ID NO: 1302721 - RNA, 13 nt, Mycobacterium tuberculosis H37Rv
ccgugcgcacuga

SEQ ID NO: 1302722 - RNA, 16 nt, Mycobacterium tuberculosis H37Rv
ccgugcgaucgucaac

SEQ ID NO: 1302723 - RNA, 20 nt, Mycobacterium tuberculosis H37Rv
ccgugcggcggcugccgguu

SEQ ID NO: 1302724 - RNA, 23 nt, Mycobacterium tuberculosis H37Rv
ccgugcgguauuugaacgcccgc

SEQ ID NO: 1302725 - RNA, 18 nt, Mycobacterium tuberculosis H37Rv
ccgugcuguuccagcguc

SEQ ID NO: 1302726 - RNA, 14 nt, Mycobacterium tuberculosis H37Rv
ccgugcugcggcga

SEQ ID NO: 1302727 - RNA, 23 nt, Mycobacterium tuberculosis H37Rv
ccgugcucgucguacaugggcag

SEQ ID NO: 1302728 - RNA, 21 nt, Mycobacterium tuberculosis H37Rv
ccguggauaacgacugacaac

SEQ ID NO: 1302729 - RNA, 14 nt, Mycobacterium tuberculosis H37Rv
ccguggaucggcag

SEQ ID NO: 1302730 - RNA, 14 nt, Mycobacterium tuberculosis H37Rv
ccguggccaucgau

SEQ ID NO: 1302731 - RNA, 15 nt, Mycobacterium tuberculosis H37Rv
ccguggcccaacccg

SEQ ID NO: 1302732 - RNA, 20 nt, Mycobacterium tuberculosis H37Rv
ccguggcgaaugacggccag

SEQ ID NO: 1302733 - RNA, 15 nt, Mycobacterium tuberculosis H37Rv
ccguggcaucgccuc

SEQ ID NO: 1302734 - RNA, 15 nt, Mycobacterium tuberculosis H37Rv
ccguggcgcggucgg

SEQ ID NO: 1302735 - RNA, 18 nt, Mycobacterium tuberculosis H37Rv
ccguggcgccggucgccg

SEQ ID NO: 1302736 - RNA, 22 nt, Mycobacterium tuberculosis H37Rv
ccguggcggcgggccucggcga

SEQ ID NO: 1302737 - RNA, 12 nt, Mycobacterium tuberculosis H37Rv
ccggcucggcag

SEQ ID NO: 1302738 - RNA, 20 nt, Mycobacterium tuberculosis H37Rv
ccggcucuuuuucgaucgcu

SEQ ID NO: 1302739 - RNA, 21 nt, Mycobacterium tuberculosis H37Rv
ccggcuaccgccuugucggcg

SEQ ID NO: 1302740 - RNA, 16 nt, Mycobacterium tuberculosis H37Rv
ccggcuacggcgacac

SEQ ID NO: 1302741 - RNA, 22 nt, Mycobacterium tuberculosis H37Rv
ccggcuagauaacccaaccgcg

SEQ ID NO: 1302742 - RNA, 17 nt, Mycobacterium tuberculosis H37Rv
ccggcgauguuggccag

SEQ ID NO: 1302743 - RNA, 14 nt, Mycobacterium tuberculosis H37Rv
ccggcuaccgcgcu

SEQ ID NO: 1302744 - RNA, 14 nt, Mycobacterium tuberculosis H37Rv
ccggcgaugaccag

SEQ ID NO: 1302745 - RNA, 17 nt, Mycobacterium tuberculosis H37Rv
ccggcgaucguguccac

SEQ ID NO: 1302746 - RNA, 15 nt, Mycobacterium tuberculosis H37Rv
ccggcgaucucgacc

SEQ ID NO: 1302747 - RNA, 21 nt, Mycobacterium tuberculosis H37Rv
ccgggaaaguuguaucgcagc

SEQ ID NO: 1302748 - RNA, 16 nt, Mycobacterium tuberculosis H37Rv
ccgggaacccgagcuu

SEQ ID NO: 1302749 - RNA, 21 nt, Mycobacterium tuberculosis H37Rv
ccggcuugucgaccacgaccg

SEQ ID NO: 1302750 - RNA, 18 nt, Mycobacterium tuberculosis H37Rv
ccggcuuguccgugagca

SEQ ID NO: 1302751 - RNA, 24 nt, Mycobacterium tuberculosis H37Rv
ccggcuugggcgguagccgacgac

SEQ ID NO: 1302752 - RNA, 16 nt, Mycobacterium tuberculosis H37Rv
ccggcuugggcgguag

SEQ ID NO: 1302753 - RNA, 14 nt, Mycobacterium tuberculosis H37Rv
ccggcuugggccag

SEQ ID NO: 1302754 - RNA, 17 nt, Mycobacterium tuberculosis H37Rv
ccggcuuggccuuugcc

SEQ ID NO: 1302755 - RNA, 21 nt, Mycobacterium tuberculosis H37Rv
ccggcuuggccuuugccgucg

SEQ ID NO: 1302756 - RNA, 17 nt, Mycobacterium tuberculosis H37Rv
ccggcuuggcggcgauc

SEQ ID NO: 1302757 - RNA, 16 nt, Mycobacterium tuberculosis H37Rv
ccggcucgucgggcag

SEQ ID NO: 1302758 - RNA, 21 nt, Mycobacterium tuberculosis H37Rv
ccggcuggccagguggccgca

SEQ ID NO: 1302759 - RNA, 13 nt, Mycobacterium tuberculosis H37Rv
ccggcugcgccgg

SEQ ID NO: 1302760 - RNA, 23 nt, Mycobacterium tuberculosis H37Rv
ccggcugcgccgggcucgcgauc

SEQ ID NO: 1302761 - RNA, 23 nt, Mycobacterium tuberculosis H37Rv
ccggcugcuuuaaccgcgucauc

SEQ ID NO: 1302762 - RNA, 14 nt, Mycobacterium tuberculosis H37Rv
ccgggccgaucacc

SEQ ID NO: 1302763 - RNA, 19 nt, Mycobacterium tuberculosis H37Rv
ccgggccauucaccgcgca

SEQ ID NO: 1302764 - RNA, 18 nt, Mycobacterium tuberculosis H37Rv
ccgggcgcuugcaccagg

SEQ ID NO: 1302765 - RNA, 17 nt, Mycobacterium tuberculosis H37Rv
ccgggcggccagcugca

SEQ ID NO: 1302766 - RNA, 12 nt, Mycobacterium tuberculosis H37Rv
ccgggcggccaa

SEQ ID NO: 1302767 - RNA, 21 nt, Mycobacterium tuberculosis H37Rv
ccgggcggccaggcgcgacgu

SEQ ID NO: 1302768 - RNA, 17 nt, Mycobacterium tuberculosis H37Rv
ccgggcgcgccggccau

SEQ ID NO: 1302769 - RNA, 21 nt, Mycobacterium tuberculosis H37Rv
ccgggccaaugccguugaucg

SEQ ID NO: 1302770 - RNA, 17 nt, Mycobacterium tuberculosis H37Rv
ccgggccacgucgagca

SEQ ID NO: 1302771 - RNA, 11 nt, Mycobacterium tuberculosis H37Rv
ccgggccaccg

SEQ ID NO: 1302772 - RNA, 19 nt, Mycobacterium tuberculosis H37Rv
ccgggcagaugaugccguu

SEQ ID NO: 1302773 - RNA, 13 nt, Mycobacterium tuberculosis H37Rv
ccgggcacgcgag

SEQ ID NO: 1302774 - RNA, 14 nt, Mycobacterium tuberculosis H37Rv
ccgggcaaucgcuc

SEQ ID NO: 1302775 - RNA, 22 nt, Mycobacterium tuberculosis H37Rv
ccgggcacccuugccgauuccg

SEQ ID NO: 1302776 - RNA, 23 nt, Mycobacterium tuberculosis H37Rv
ccgggcacgaacaucagaucgcc

SEQ ID NO: 1302777 - RNA, 20 nt, Mycobacterium tuberculosis H37Rv
ccgggcaccacccuugccga

SEQ ID NO: 1302778 - RNA, 22 nt, Mycobacterium tuberculosis H37Rv
ccgggaccauagccugcgccga

SEQ ID NO: 1302779 - RNA, 12 nt, Mycobacterium tuberculosis H37Rv
ccgggaccgcga

SEQ ID NO: 1302780 - RNA, 14 nt, Mycobacterium tuberculosis H37Rv
ccgggaccgcgaac

SEQ ID NO: 1302781 - RNA, 14 nt, Mycobacterium tuberculosis H37Rv
ccgggacgugucgg

SEQ ID NO: 1302782 - RNA, 21 nt, Mycobacterium tuberculosis H37Rv
ccgggaagccguuuucgaaac

SEQ ID NO: 1302783 - RNA, 19 nt, Mycobacterium tuberculosis H37Rv
ccgggaaggaaccgggcaa

SEQ ID NO: 1302784 - RNA, 23 nt, Mycobacterium tuberculosis H37Rv
ccgggaauggacaggucgggcag

SEQ ID NO: 1302785 - RNA, 21 nt, Mycobacterium tuberculosis H37Rv
ccgggaagucgcugaagccgu

SEQ ID NO: 1302786 - RNA, 15 nt, Mycobacterium tuberculosis H37Rv
ccgggaagucgcuga

SEQ ID NO: 1302787 - RNA, 19 nt, Mycobacterium tuberculosis H37Rv
ccgggacagcagccggauc

SEQ ID NO: 1302788 - RNA, 15 nt, Mycobacterium tuberculosis H37Rv
ccgggcggcggugcg

SEQ ID NO: 1302789 - RNA, 23 nt, Mycobacterium tuberculosis H37Rv
ccgggcggcggcggauuccggca

SEQ ID NO: 1302790 - RNA, 17 nt, Mycobacterium tuberculosis H37Rv
ccgggcggccucguuga

SEQ ID NO: 1302791 - RNA, 17 nt, Mycobacterium tuberculosis H37Rv
ccgggcgggacucggcg

SEQ ID NO: 1302792 - RNA, 19 nt, Mycobacterium tuberculosis H37Rv
ccgggcggcgucggugagc

SEQ ID NO: 1302793 - RNA, 20 nt, Mycobacterium tuberculosis H37Rv
ccgggggguugaucggcaac

SEQ ID NO: 1302794 - RNA, 17 nt, Mycobacterium tuberculosis H37Rv
ccggggugacaucgcga

SEQ ID NO: 1302795 - RNA, 15 nt, Mycobacterium tuberculosis H37Rv
ccggggucgaacgcg

SEQ ID NO: 1302796 - RNA, 14 nt, Mycobacterium tuberculosis H37Rv
ccggggucggccug

SEQ ID NO: 1302797 - RNA, 19 nt, Mycobacterium tuberculosis H37Rv
ccggggugaacgcggacac

SEQ ID NO: 1302798 - RNA, 14 nt, Mycobacterium tuberculosis H37Rv
ccggggucgaacgc

SEQ ID NO: 1302799 - RNA, 17 nt, Mycobacterium tuberculosis H37Rv
ccgggggcaccguuacc

SEQ ID NO: 1302800 - RNA, 18 nt, Mycobacterium tuberculosis H37Rv
ccgggucaccagcgcauc

SEQ ID NO: 1302801 - RNA, 15 nt, Mycobacterium tuberculosis H37Rv
ccgggucagcgaccu

SEQ ID NO: 1302802 - RNA, 13 nt, Mycobacterium tuberculosis H37Rv
ccgggucggcacg

SEQ ID NO: 1302803 - RNA, 17 nt, Mycobacterium tuberculosis H37Rv
ccgggucgacgcgauga

SEQ ID NO: 1302804 - RNA, 17 nt, Mycobacterium tuberculosis H37Rv
ccggguccggaaccggu

SEQ ID NO: 1302805 - RNA, 19 nt, Mycobacterium tuberculosis H37Rv
ccggguccggugaacccga

SEQ ID NO: 1302806 - RNA, 22 nt, Mycobacterium tuberculosis H37Rv
ccgggucgaacuugaucaccgc

SEQ ID NO: 1302807 - RNA, 14 nt, Mycobacterium tuberculosis H37Rv
ccgggucgacgacg

SEQ ID NO: 1302808 - RNA, 18 nt, Mycobacterium tuberculosis H37Rv
ccgggucgacgacgucgc

SEQ ID NO: 1302809 - RNA, 12 nt, Mycobacterium tuberculosis H37Rv
ccgggucgaugc

SEQ ID NO: 1302810 - RNA, 14 nt, Mycobacterium tuberculosis H37Rv
ccgggucgauuucg

SEQ ID NO: 1302811 - RNA, 18 nt, Mycobacterium tuberculosis H37Rv
ccgggucgauuucgccgg

SEQ ID NO: 1302812 - RNA, 18 nt, Mycobacterium tuberculosis H37Rv
ccggguguggucgguggc

SEQ ID NO: 1302813 - RNA, 22 nt, Mycobacterium tuberculosis H37Rv
ccgggugggagcagccgaaccg

SEQ ID NO: 1302814 - RNA, 17 nt, Mycobacterium tuberculosis H37Rv
ccgggugcgagcgacac

SEQ ID NO: 1302815 - RNA, 16 nt, Mycobacterium tuberculosis H37Rv
ccgggugcgccguugc

SEQ ID NO: 1302816 - RNA, 18 nt, Mycobacterium tuberculosis H37Rv
ccgggucuguuggugaca

SEQ ID NO: 1302817 - RNA, 22 nt, Mycobacterium tuberculosis H37Rv
ccgggugaaacgauggcgauga

SEQ ID NO: 1302818 - RNA, 20 nt, Mycobacterium tuberculosis H37Rv
ccgggugcgacggcguugcc

SEQ ID NO: 1302819 - RNA, 13 nt, Mycobacterium tuberculosis H37Rv
ccggguucaccga

SEQ ID NO: 1302820 - RNA, 20 nt, Mycobacterium tuberculosis H37Rv
ccggguugagccgccgcgac

SEQ ID NO: 1302821 - RNA, 20 nt, Mycobacterium tuberculosis H37Rv
ccggguuccagcggcaccgc

SEQ ID NO: 1302822 - RNA, 19 nt, Mycobacterium tuberculosis H37Rv
ccggguuggcgccggccag

SEQ ID NO: 1302823 - RNA, 14 nt, Mycobacterium tuberculosis H37Rv
ccggguuugaucag

SEQ ID NO: 1302824 - RNA, 17 nt, Mycobacterium tuberculosis H37Rv
ccggguuugaucagcuc

SEQ ID NO: 1302825 - RNA, 21 nt, Mycobacterium tuberculosis H37Rv
ccggguuugaucagcucgguc

SEQ ID NO: 1302826 - RNA, 16 nt, Mycobacterium tuberculosis H37Rv
ccgguaauccguugcc

SEQ ID NO: 1302827 - RNA, 11 nt, Mycobacterium tuberculosis H37Rv
ccgguaccgcc

SEQ ID NO: 1302828 - RNA, 18 nt, Mycobacterium tuberculosis H37Rv
ccgguaccggcgacgaau

SEQ ID NO: 1302829 - RNA, 14 nt, Mycobacterium tuberculosis H37Rv
ccgguagcacagca

SEQ ID NO: 1302830 - RNA, 18 nt, Mycobacterium tuberculosis H37Rv
ccgguagaucuucggccg

SEQ ID NO: 1302831 - RNA, 15 nt, Mycobacterium tuberculosis H37Rv
ccgguagcagcgcuc

SEQ ID NO: 1302832 - RNA, 12 nt, Mycobacterium tuberculosis H37Rv
ccgguacgccgc

SEQ ID NO: 1302833 - RNA, 18 nt, Mycobacterium tuberculosis H37Rv
ccgguagaucagcgccug

SEQ ID NO: 1302834 - RNA, 12 nt, Mycobacterium tuberculosis H37Rv
ccgguaugcgcg

SEQ ID NO: 1302835 - RNA, 17 nt, Mycobacterium tuberculosis H37Rv
ccgguaggcggccagcg

SEQ ID NO: 1302836 - RNA, 17 nt, Mycobacterium tuberculosis H37Rv
ccgguaguagcugacca

SEQ ID NO: 1302837 - RNA, 17 nt, Mycobacterium tuberculosis H37Rv
ccgguaguacuagcacg

SEQ ID NO: 1302838 - RNA, 16 nt, Mycobacterium tuberculosis H37Rv
ccgguaguacuagcac

SEQ ID NO: 1302839 - RNA, 17 nt, Mycobacterium tuberculosis H37Rv
ccggucagcgcggcgca

SEQ ID NO: 1302840 - RNA, 16 nt, Mycobacterium tuberculosis H37Rv
ccggucagcgcggcga

SEQ ID NO: 1302841 - RNA, 13 nt, Mycobacterium tuberculosis H37Rv
ccggucagcgcgg

SEQ ID NO: 1302842 - RNA, 23 nt, Mycobacterium tuberculosis H37Rv
ccggucaggcaguccaccgcgcg

SEQ ID NO: 1302843 - RNA, 18 nt, Mycobacterium tuberculosis H37Rv
ccggucagcgcgcggcuc

SEQ ID NO: 1302844 - RNA, 21 nt, Mycobacterium tuberculosis H37Rv
ccggucagcgcgcggcucggg

SEQ ID NO: 1302845 - RNA, 12 nt, Mycobacterium tuberculosis H37Rv
ccggucagcgac

SEQ ID NO: 1302846 - RNA, 15 nt, Mycobacterium tuberculosis H37Rv
ccggucagcacaugg

SEQ ID NO: 1302847 - RNA, 13 nt, Mycobacterium tuberculosis H37Rv
ccggucacgucga

SEQ ID NO: 1302848 - RNA, 13 nt, Mycobacterium tuberculosis H37Rv
ccggucacgacgu

SEQ ID NO: 1302849 - RNA, 13 nt, Mycobacterium tuberculosis H37Rv
cgccgaucccggc

SEQ ID NO: 1302850 - RNA, 23 nt, Mycobacterium tuberculosis H37Rv
cgccgaucagcgaaccaccggcg

SEQ ID NO: 1302851 - RNA, 16 nt, Mycobacterium tuberculosis H37Rv
cgccgaucaccgcugu

SEQ ID NO: 1302852 - RNA, 19 nt, Mycobacterium tuberculosis H37Rv
cgccgaucacugucgggua

SEQ ID NO: 1302853 - RNA, 14 nt, Mycobacterium tuberculosis H37Rv
cgccgauucgccgu

SEQ ID NO: 1302854 - RNA, 17 nt, Mycobacterium tuberculosis H37Rv
cgccgauucgccgucgu

SEQ ID NO: 1302855 - RNA, 18 nt, Mycobacterium tuberculosis H37Rv
cgccgauuuugggaucgu

SEQ ID NO: 1302856 - RNA, 17 nt, Mycobacterium tuberculosis H37Rv
cgccgauuuggccguca

SEQ ID NO: 1302857 - RNA, 20 nt, Mycobacterium tuberculosis H37Rv
cgccgauguuggcagggcca

SEQ ID NO: 1302858 - RNA, 17 nt, Mycobacterium tuberculosis H37Rv
cgccgauuccaccgccg

SEQ ID NO: 1302859 - RNA, 16 nt, Mycobacterium tuberculosis H37Rv
cgccgcaaugacgucg

SEQ ID NO: 1302860 - RNA, 23 nt, Mycobacterium tuberculosis H37Rv
cgccgcaaugacgucgucggcca

SEQ ID NO: 1302861 - RNA, 17 nt, Mycobacterium tuberculosis H37Rv
cgccgcaaucagacggc

SEQ ID NO: 1302862 - RNA, 20 nt, Mycobacterium tuberculosis H37Rv
cgccgcaccaagcagcgacc

SEQ ID NO: 1302863 - RNA, 19 nt, Mycobacterium tuberculosis H37Rv
cgccgcacauuggugucca

SEQ ID NO: 1302864 - RNA, 16 nt, Mycobacterium tuberculosis H37Rv
cgccgcaauggaccga

SEQ ID NO: 1302865 - RNA, 23 nt, Mycobacterium tuberculosis H37Rv
cgccgcacaucugcgggacgucg

SEQ ID NO: 1302866 - RNA, 14 nt, Mycobacterium tuberculosis H37Rv
cgccgcacgccggc

SEQ ID NO: 1302867 - RNA, 16 nt, Mycobacterium tuberculosis H37Rv
cgccgcaccgccgcau

SEQ ID NO: 1302868 - RNA, 15 nt, Mycobacterium tuberculosis H37Rv
cgccgcacgccgacc

SEQ ID NO: 1302869 - RNA, 16 nt, Mycobacterium tuberculosis H37Rv
cgccgcagacgccgac

SEQ ID NO: 1302870 - RNA, 21 nt, Mycobacterium tuberculosis H37Rv
cgccgcacgccggcaugccag

SEQ ID NO: 1302871 - RNA, 13 nt, Mycobacterium tuberculosis H37Rv
cgccgcagcaggu

SEQ ID NO: 1302872 - RNA, 16 nt, Mycobacterium tuberculosis H37Rv
cgccgcagcgcaaccu

SEQ ID NO: 1302873 - RNA, 20 nt, Mycobacterium tuberculosis H37Rv
cgccgcagccugcaacgucu

SEQ ID NO: 1302874 - RNA, 15 nt, Mycobacterium tuberculosis H37Rv
cgccgcagcgcguac

SEQ ID NO: 1302875 - RNA, 13 nt, Mycobacterium tuberculosis H37Rv
cgccgcaguccgc

SEQ ID NO: 1302876 - RNA, 16 nt, Mycobacterium tuberculosis H37Rv
cgccgcaucggcggug

SEQ ID NO: 1302877 - RNA, 17 nt, Mycobacterium tuberculosis H37Rv
cgccgcaugccaccgag

SEQ ID NO: 1302878 - RNA, 13 nt, Mycobacterium tuberculosis H37Rv
cgccgauaucgca

SEQ ID NO: 1302879 - RNA, 14 nt, Mycobacterium tuberculosis H37Rv
cgccgauaucgcag

SEQ ID NO: 1302880 - RNA, 16 nt, Mycobacterium tuberculosis H37Rv
cgccgauaucggugac

SEQ ID NO: 1302881 - RNA, 19 nt, Mycobacterium tuberculosis H37Rv
cgccgauaucugccacguu

SEQ ID NO: 1302882 - RNA, 21 nt, Mycobacterium tuberculosis H37Rv
cgccgauacuucaucggcaca

SEQ ID NO: 1302883 - RNA, 19 nt, Mycobacterium tuberculosis H37Rv
cgccgauacuucaucggca

SEQ ID NO: 1302884 - RNA, 15 nt, Mycobacterium tuberculosis H37Rv
cgccgaucaccaccg

SEQ ID NO: 1302885 - RNA, 17 nt, Mycobacterium tuberculosis H37Rv
cgccgagguagauggcg

SEQ ID NO: 1302886 - RNA, 14 nt, Mycobacterium tuberculosis H37Rv
cgccgagauccgcg

SEQ ID NO: 1302887 - RNA, 15 nt, Mycobacterium tuberculosis H37Rv
cgccgagaucgacau

SEQ ID NO: 1302888 - RNA, 19 nt, Mycobacterium tuberculosis H37Rv
cgccgagcacacgucggga

SEQ ID NO: 1302889 - RNA, 16 nt, Mycobacterium tuberculosis H37Rv
cgccgagcagacgcgg

SEQ ID NO: 1302890 - RNA, 18 nt, Mycobacterium tuberculosis H37Rv
cgccgaggccucggccag

SEQ ID NO: 1302891 - RNA, 13 nt, Mycobacterium tuberculosis H37Rv
cgccgaggccgcc

SEQ ID NO: 1302892 - RNA, 15 nt, Mycobacterium tuberculosis H37Rv
cgccgaggcguucga

SEQ ID NO: 1302893 - RNA, 16 nt, Mycobacterium tuberculosis H37Rv
cgcccacuggugaucu

SEQ ID NO: 1302894 - RNA, 13 nt, Mycobacterium tuberculosis H37Rv
cgcccagaccgcc

SEQ ID NO: 1302895 - RNA, 22 nt, Mycobacterium tuberculosis H37Rv
cgcccacuauggcccgcacuug

SEQ ID NO: 1302896 - RNA, 14 nt, Mycobacterium tuberculosis H37Rv
cgcccagagccgcu

SEQ ID NO: 1302897 - RNA, 13 nt, Mycobacterium tuberculosis H37Rv
cgcccagagccgc

SEQ ID NO: 1302898 - RNA, 18 nt, Mycobacterium tuberculosis H37Rv
cgcccagaucgccgagau

SEQ ID NO: 1302899 - RNA, 21 nt, Mycobacterium tuberculosis H37Rv
cgcccagauguuuagcguccg

SEQ ID NO: 1302900 - RNA, 18 nt, Mycobacterium tuberculosis H37Rv
cgcccagcagcaccugca

SEQ ID NO: 1302901 - RNA, 13 nt, Mycobacterium tuberculosis H37Rv
cgcccagcaaggc

SEQ ID NO: 1302902 - RNA, 16 nt, Mycobacterium tuberculosis H37Rv
cgccgagaaccagcga

SEQ ID NO: 1302903 - RNA, 23 nt, Mycobacterium tuberculosis H37Rv
cgccgagaacgauguccgcgcga

SEQ ID NO: 1302904 - RNA, 14 nt, Mycobacterium tuberculosis H37Rv
cgccgagagcaccg

SEQ ID NO: 1302905 - RNA, 19 nt, Mycobacterium tuberculosis H37Rv
cgccgacuuccgcgucgcc

SEQ ID NO: 1302906 - RNA, 16 nt, Mycobacterium tuberculosis H37Rv
cgccgacuaguccgag

SEQ ID NO: 1302907 - RNA, 14 nt, Mycobacterium tuberculosis H37Rv
cgccgcgaaugucg

SEQ ID NO: 1302908 - RNA, 19 nt, Mycobacterium tuberculosis H37Rv
cgccgcgaagcgcucggca

SEQ ID NO: 1302909 - RNA, 22 nt, Mycobacterium tuberculosis H37Rv
cgccgcgaaugucgccgccugg

SEQ ID NO: 1302910 - RNA, 15 nt, Mycobacterium tuberculosis H37Rv
cgccgcgacgcacug

SEQ ID NO: 1302911 - RNA, 17 nt, Mycobacterium tuberculosis H37Rv
cgccgcgcgcgccgcau

SEQ ID NO: 1302912 - RNA, 13 nt, Mycobacterium tuberculosis H37Rv
cgccgcgccggca

SEQ ID NO: 1302913 - RNA, 21 nt, Mycobacterium tuberculosis H37Rv
cgccgcgaucuccuuggccgu

SEQ ID NO: 1302914 - RNA, 13 nt, Mycobacterium tuberculosis H37Rv
cgccgccggcaac

SEQ ID NO: 1302915 - RNA, 14 nt, Mycobacterium tuberculosis H37Rv
cgccgccggcaccu

SEQ ID NO: 1302916 - RNA, 20 nt, Mycobacterium tuberculosis H37Rv
cgccgccggcaccaccguug

SEQ ID NO: 1302917 - RNA, 16 nt, Mycobacterium tuberculosis H37Rv
cgccgccggcgccgga

SEQ ID NO: 1302918 - RNA, 14 nt, Mycobacterium tuberculosis H37Rv
cgccgccggcgcug

SEQ ID NO: 1302919 - RNA, 19 nt, Mycobacterium tuberculosis H37Rv
cgccgccggcggcgguacc

SEQ ID NO: 1302920 - RNA, 18 nt, Mycobacterium tuberculosis H37Rv
cgccgccggcggcgguac

SEQ ID NO: 1302921 - RNA, 21 nt, Mycobacterium tuberculosis H37Rv
cgccgccgaucuugagccgga

SEQ ID NO: 1302922 - RNA, 13 nt, Mycobacterium tuberculosis H37Rv
cgccgccgccaau

SEQ ID NO: 1302923 - RNA, 15 nt, Mycobacterium tuberculosis H37Rv
cgccgccgacgccgc

SEQ ID NO: 1302924 - RNA, 15 nt, Mycobacterium tuberculosis H37Rv
cgccgcccuguccgg

SEQ ID NO: 1302925 - RNA, 18 nt, Mycobacterium tuberculosis H37Rv
cgccgccgacaaucacca

SEQ ID NO: 1302926 - RNA, 18 nt, Mycobacterium tuberculosis H37Rv
cgccgcccgugccgcccu

SEQ ID NO: 1302927 - RNA, 17 nt, Mycobacterium tuberculosis H37Rv
cgccgccaacuccucag

SEQ ID NO: 1302928 - RNA, 20 nt, Mycobacterium tuberculosis H37Rv
cgccgccaagcucggccacc

SEQ ID NO: 1302929 - RNA, 13 nt, Mycobacterium tuberculosis H37Rv
cgccgccaccagg

SEQ ID NO: 1302930 - RNA, 23 nt, Mycobacterium tuberculosis H37Rv
cgccgccaccagcugcgcgaugu

SEQ ID NO: 1302931 - RNA, 14 nt, Mycobacterium tuberculosis H37Rv
cgccgccaccaccg

SEQ ID NO: 1302932 - RNA, 19 nt, Mycobacterium tuberculosis H37Rv
cgccgccacagcacccacg

SEQ ID NO: 1302933 - RNA, 20 nt, Mycobacterium tuberculosis H37Rv
cgccgccacugccggcagcg

SEQ ID NO: 1302934 - RNA, 12 nt, Mycobacterium tuberculosis H37Rv
cgccgccacgga

SEQ ID NO: 1302935 - RNA, 13 nt, Mycobacterium tuberculosis H37Rv
cgccgccacccgg

SEQ ID NO: 1302936 - RNA, 14 nt, Mycobacterium tuberculosis H37Rv
cgccgccacccggc

SEQ ID NO: 1302937 - RNA, 15 nt, Mycobacterium tuberculosis H37Rv
cgccgccacccggcg

SEQ ID NO: 1302938 - RNA, 20 nt, Mycobacterium tuberculosis H37Rv
cgccgccaccgaagccgccg

SEQ ID NO: 1302939 - RNA, 14 nt, Mycobacterium tuberculosis H37Rv
cgccgccaccggcg

SEQ ID NO: 1302940 - RNA, 14 nt, Mycobacterium tuberculosis H37Rv
cgccgccagcacca

SEQ ID NO: 1302941 - RNA, 15 nt, Mycobacterium tuberculosis H37Rv
cgccgccagcaccac

SEQ ID NO: 1302942 - RNA, 14 nt, Mycobacterium tuberculosis H37Rv
cgccgccagcagau

SEQ ID NO: 1302943 - RNA, 22 nt, Mycobacterium tuberculosis H37Rv
cgccgcccgcuccuccggcacc

SEQ ID NO: 1302944 - RNA, 17 nt, Mycobacterium tuberculosis H37Rv
cgccgcccgcgccacca

SEQ ID NO: 1302945 - RNA, 13 nt, Mycobacterium tuberculosis H37Rv
cgccgccccgaua

SEQ ID NO: 1302946 - RNA, 16 nt, Mycobacterium tuberculosis H37Rv
cgccgcccccgcccgu

SEQ ID NO: 1302947 - RNA, 14 nt, Mycobacterium tuberculosis H37Rv
cgccgccaucgccg

SEQ ID NO: 1302948 - RNA, 17 nt, Mycobacterium tuberculosis H37Rv
cgccgccaucgccgaug

SEQ ID NO: 1302949 - RNA, 21 nt, Mycobacterium tuberculosis H37Rv
cgccgcccaaaacgucaccgc

SEQ ID NO: 1302950 - RNA, 15 nt, Mycobacterium tuberculosis H37Rv
cgccgccauugccgc

SEQ ID NO: 1302951 - RNA, 15 nt, Mycobacterium tuberculosis H37Rv
cgccgccaucagccc

SEQ ID NO: 1302952 - RNA, 19 nt, Mycobacterium tuberculosis H37Rv
cgccgccauaccucggcga

SEQ ID NO: 1302953 - RNA, 18 nt, Mycobacterium tuberculosis H37Rv
cgccguccagucggucgg

SEQ ID NO: 1302954 - RNA, 21 nt, Mycobacterium tuberculosis H37Rv
cgccguccccaccgacgccga

SEQ ID NO: 1302955 - RNA, 17 nt, Mycobacterium tuberculosis H37Rv
cgccguccccgccgucg

SEQ ID NO: 1302956 - RNA, 22 nt, Mycobacterium tuberculosis H37Rv
cgccguccccgccgucgccacc

SEQ ID NO: 1302957 - RNA, 14 nt, Mycobacterium tuberculosis H37Rv
cgccgucgaugugg

SEQ ID NO: 1302958 - RNA, 13 nt, Mycobacterium tuberculosis H37Rv
cgccguaucggcg

SEQ ID NO: 1302959 - RNA, 20 nt, Mycobacterium tuberculosis H37Rv
cgccguaacagccggccgga

SEQ ID NO: 1302960 - RNA, 19 nt, Mycobacterium tuberculosis H37Rv
cgccguaagcaccagccag

SEQ ID NO: 1302961 - RNA, 18 nt, Mycobacterium tuberculosis H37Rv
cgccguacaucagcgcga

SEQ ID NO: 1302962 - RNA, 18 nt, Mycobacterium tuberculosis H37Rv
cgccguagaccagcaggc

SEQ ID NO: 1302963 - RNA, 17 nt, Mycobacterium tuberculosis H37Rv
cgccguagagccgcucg

SEQ ID NO: 1302964 - RNA, 19 nt, Mycobacterium tuberculosis H37Rv
cgccggugccaccgacgcc

SEQ ID NO: 1302965 - RNA, 13 nt, Mycobacterium tuberculosis H37Rv
cgccggugccacc

SEQ ID NO: 1302966 - RNA, 17 nt, Mycobacterium tuberculosis H37Rv
cgccggugccaccgacg

SEQ ID NO: 1302967 - RNA, 16 nt, Mycobacterium tuberculosis H37Rv
cgccggucgccggcug

SEQ ID NO: 1302968 - RNA, 18 nt, Mycobacterium tuberculosis H37Rv
cgccggugccaccggcug

SEQ ID NO: 1302969 - RNA, 21 nt, Mycobacterium tuberculosis H37Rv
cgccggugccaccggcuggug

SEQ ID NO: 1302970 - RNA, 15 nt, Mycobacterium tuberculosis H37Rv
cgccggugccgauca

SEQ ID NO: 1302971 - RNA, 17 nt, Mycobacterium tuberculosis H37Rv
cgccggugccgaucagc

SEQ ID NO: 1302972 - RNA, 17 nt, Mycobacterium tuberculosis H37Rv
cgccgguuucgaggcga

SEQ ID NO: 1302973 - RNA, 19 nt, Mycobacterium tuberculosis H37Rv
cgccggugccgccaucgcc

SEQ ID NO: 1302974 - RNA, 15 nt, Mycobacterium tuberculosis H37Rv
cgccggucgccggcu

SEQ ID NO: 1302975 - RNA, 16 nt, Mycobacterium tuberculosis H37Rv
cgccgguccucgucgg

SEQ ID NO: 1302976 - RNA, 11 nt, Mycobacterium tuberculosis H37Rv
cgccggucgcc

SEQ ID NO: 1302977 - RNA, 18 nt, Mycobacterium tuberculosis H37Rv
cgccggucaucccaagcg

SEQ ID NO: 1302978 - RNA, 14 nt, Mycobacterium tuberculosis H37Rv
cgccggucaucgcc

SEQ ID NO: 1302979 - RNA, 16 nt, Mycobacterium tuberculosis H37Rv
cgccggucaucccaag

SEQ ID NO: 1302980 - RNA, 17 nt, Mycobacterium tuberculosis H37Rv
cgccgguccccucggug

SEQ ID NO: 1302981 - RNA, 23 nt, Mycobacterium tuberculosis H37Rv
cgccggucccgcgugccacucga

SEQ ID NO: 1302982 - RNA, 14 nt, Mycobacterium tuberculosis H37Rv
cgccggucauccca

SEQ ID NO: 1302983 - RNA, 22 nt, Mycobacterium tuberculosis H37Rv
cgccggucagcaauacggcggc

SEQ ID NO: 1302984 - RNA, 18 nt, Mycobacterium tuberculosis H37Rv
cgccgguaggcggccagc

SEQ ID NO: 1302985 - RNA, 15 nt, Mycobacterium tuberculosis H37Rv
cgccgggcggcgcga

SEQ ID NO: 1302986 - RNA, 12 nt, Mycobacterium tuberculosis H37Rv
cgccgggcggca

SEQ ID NO: 1302987 - RNA, 22 nt, Mycobacterium tuberculosis H37Rv
cgccgggcuuacuugaucucgg

SEQ ID NO: 1302988 - RNA, 18 nt, Mycobacterium tuberculosis H37Rv
cgccggggaccacgguga

SEQ ID NO: 1302989 - RNA, 20 nt, Mycobacterium tuberculosis H37Rv
cgccggggauaccggucagc

SEQ ID NO: 1302990 - RNA, 15 nt, Mycobacterium tuberculosis H37Rv
cgccggggacgccgc

SEQ ID NO: 1302991 - RNA, 15 nt, Mycobacterium tuberculosis H37Rv
cgccggguucgccgg

SEQ ID NO: 1302992 - RNA, 17 nt, Mycobacterium tuberculosis H37Rv
cgccggguucgccggau

SEQ ID NO: 1302993 - RNA, 21 nt, Mycobacterium tuberculosis H37Rv
cgccgggugaggcggugacga

SEQ ID NO: 1302994 - RNA, 18 nt, Mycobacterium tuberculosis H37Rv
cgccgggugcaacggcgu

SEQ ID NO: 1302995 - RNA, 13 nt, Mycobacterium tuberculosis H37Rv
cgccgggucacgu

SEQ ID NO: 1302996 - RNA, 14 nt, Mycobacterium tuberculosis H37Rv
cgccgggucagccc

SEQ ID NO: 1302997 - RNA, 20 nt, Mycobacterium tuberculosis H37Rv
cgccgggggcaccguuaccg

SEQ ID NO: 1302998 - RNA, 17 nt, Mycobacterium tuberculosis H37Rv
cgccggggacacagcgu

SEQ ID NO: 1302999 - RNA, 16 nt, Mycobacterium tuberculosis H37Rv
cgccggggccgccgau

SEQ ID NO: 1303000 - RNA, 14 nt, Mycobacterium tuberculosis H37Rv
aacaccgccagcuc

SEQ ID NO: 1303001 - RNA, 21 nt, Mycobacterium tuberculosis H37Rv
aacaccgcggugaguucgccg

SEQ ID NO: 1303002 - RNA, 20 nt, Mycobacterium tuberculosis H37Rv
aacaccgccagcaugacacc

SEQ ID NO: 1303003 - RNA, 17 nt, Mycobacterium tuberculosis H37Rv
cgccggcgcugaucgcg

SEQ ID NO: 1303004 - RNA, 17 nt, Mycobacterium tuberculosis H37Rv
cgccggcgcgccgauga

SEQ ID NO: 1303005 - RNA, 17 nt, Mycobacterium tuberculosis H37Rv
cgccggcgacgggucgg

SEQ ID NO: 1303006 - RNA, 14 nt, Mycobacterium tuberculosis H37Rv
cgccggcgacgggu

SEQ ID NO: 1303007 - RNA, 13 nt, Mycobacterium tuberculosis H37Rv
cgccggcgaugcc

SEQ ID NO: 1303008 - RNA, 22 nt, Mycobacterium tuberculosis H37Rv
cgccggcgaauccgcacagguc

SEQ ID NO: 1303009 - RNA, 21 nt, Mycobacterium tuberculosis H37Rv
cgccggcgacaccgcaccgac

SEQ ID NO: 1303010 - RNA, 15 nt, Mycobacterium tuberculosis H37Rv
cgccggccugcucgg

SEQ ID NO: 1303011 - RNA, 17 nt, Mycobacterium tuberculosis H37Rv
cgccggccucgccgaag

SEQ ID NO: 1303012 - RNA, 20 nt, Mycobacterium tuberculosis H37Rv
cgccggccccgccguuaccg

SEQ ID NO: 1303013 - RNA, 16 nt, Mycobacterium tuberculosis H37Rv
cgccggccguccugac

SEQ ID NO: 1303014 - RNA, 21 nt, Mycobacterium tuberculosis H37Rv
cgccggccccgccgucaccgc

SEQ ID NO: 1303015 - RNA, 20 nt, Mycobacterium tuberculosis H37Rv
cgccggccccgccgaugccg

SEQ ID NO: 1303016 - RNA, 18 nt, Mycobacterium tuberculosis H37Rv
cgccggcccgaggcgggu

SEQ ID NO: 1303017 - RNA, 17 nt, Mycobacterium tuberculosis H37Rv
cgccggccccgccguca

SEQ ID NO: 1303018 - RNA, 16 nt, Mycobacterium tuberculosis H37Rv
cgccggccccgccgau

SEQ ID NO: 1303019 - RNA, 20 nt, Mycobacterium tuberculosis H37Rv
cgccggcccaucuucggacg

SEQ ID NO: 1303020 - RNA, 20 nt, Mycobacterium tuberculosis H37Rv
cgccggauggguggccagca

SEQ ID NO: 1303021 - RNA, 18 nt, Mycobacterium tuberculosis H37Rv
cgccggaugcugucagca

SEQ ID NO: 1303022 - RNA, 16 nt, Mycobacterium tuberculosis H37Rv
cgccggcacgcagcca

SEQ ID NO: 1303023 - RNA, 18 nt, Mycobacterium tuberculosis H37Rv
cgccggcaccucccuggc

SEQ ID NO: 1303024 - RNA, 14 nt, Mycobacterium tuberculosis H37Rv
cgccggcagcgucg

SEQ ID NO: 1303025 - RNA, 23 nt, Mycobacterium tuberculosis H37Rv
cgccggaugacaccgaccggguc

SEQ ID NO: 1303026 - RNA, 13 nt, Mycobacterium tuberculosis H37Rv
cgccggaucgccg

SEQ ID NO: 1303027 - RNA, 16 nt, Mycobacterium tuberculosis H37Rv
cgccggauccgccaga

SEQ ID NO: 1303028 - RNA, 19 nt, Mycobacterium tuberculosis H37Rv
cgccggaucgccacggugg

SEQ ID NO: 1303029 - RNA, 17 nt, Mycobacterium tuberculosis H37Rv
cgccggaacugcgcaac

SEQ ID NO: 1303030 - RNA, 20 nt, Mycobacterium tuberculosis H37Rv
cgccgcuggagaucacgccg

SEQ ID NO: 1303031 - RNA, 14 nt, Mycobacterium tuberculosis H37Rv
cgccgcugccgccu

SEQ ID NO: 1303032 - RNA, 16 nt, Mycobacterium tuberculosis H37Rv
cgccgcugccgccggu

SEQ ID NO: 1303033 - RNA, 22 nt, Mycobacterium tuberculosis H37Rv
cgccgcugacuccugcggcacc

SEQ ID NO: 1303034 - RNA, 13 nt, Mycobacterium tuberculosis H37Rv
cgccgcugccgcc

SEQ ID NO: 1303035 - RNA, 22 nt, Mycobacterium tuberculosis H37Rv
cgccgcugccaucuggguccgu

SEQ ID NO: 1303036 - RNA, 22 nt, Mycobacterium tuberculosis H37Rv
cgccgcggcagcguugacgguc

SEQ ID NO: 1303037 - RNA, 14 nt, Mycobacterium tuberculosis H37Rv
cgccgcuaccgaac

SEQ ID NO: 1303038 - RNA, 20 nt, Mycobacterium tuberculosis H37Rv
cgccgcgcuugcgaucggca

SEQ ID NO: 1303039 - RNA, 12 nt, Mycobacterium tuberculosis H37Rv
cgcgaccacgca

SEQ ID NO: 1303040 - RNA, 20 nt, Mycobacterium tuberculosis H37Rv
cgcgaccagaggcgugucga

SEQ ID NO: 1303041 - RNA, 17 nt, Mycobacterium tuberculosis H37Rv
cgcgaccacccgccgca

SEQ ID NO: 1303042 - RNA, 22 nt, Mycobacterium tuberculosis H37Rv
cgcgaccaaaccgcuguaaccg

SEQ ID NO: 1303043 - RNA, 15 nt, Mycobacterium tuberculosis H37Rv
cgcgacauucguccg

SEQ ID NO: 1303044 - RNA, 14 nt, Mycobacterium tuberculosis H37Rv
cgcgacacggccau

SEQ ID NO: 1303045 - RNA, 15 nt, Mycobacterium tuberculosis H37Rv
cgcgacagcggcguc

SEQ ID NO: 1303046 - RNA, 23 nt, Mycobacterium tuberculosis H37Rv
cgcgacagcggcgucggugccgc

SEQ ID NO: 1303047 - RNA, 21 nt, Mycobacterium tuberculosis H37Rv
cgcgaccgaugaucgguaccg

SEQ ID NO: 1303048 - RNA, 19 nt, Mycobacterium tuberculosis H37Rv
cgcgaccgcauugagcugg

SEQ ID NO: 1303049 - RNA, 17 nt, Mycobacterium tuberculosis H37Rv
cgcgaccgaccagccgu

SEQ ID NO: 1303050 - RNA, 18 nt, Mycobacterium tuberculosis H37Rv
cgcgaccgaccagccgug

SEQ ID NO: 1303051 - RNA, 13 nt, Mycobacterium tuberculosis H37Rv
cgcgaccagccag

SEQ ID NO: 1303052 - RNA, 16 nt, Mycobacterium tuberculosis H37Rv
cgcgaccauacccgcg

SEQ ID NO: 1303053 - RNA, 12 nt, Mycobacterium tuberculosis H37Rv
cgcgaccagcgc

SEQ ID NO: 1303054 - RNA, 17 nt, Mycobacterium tuberculosis H37Rv
cgcgacaaaucggucga

SEQ ID NO: 1303055 - RNA, 19 nt, Mycobacterium tuberculosis H37Rv
cgcgacacacgccgccggu

SEQ ID NO: 1303056 - RNA, 22 nt, Mycobacterium tuberculosis H37Rv
cgcgacagccguggcgcgacgu

SEQ ID NO: 1303057 - RNA, 20 nt, Mycobacterium tuberculosis H37Rv
cgcgaauuccucuguacccc

SEQ ID NO: 1303058 - RNA, 20 nt, Mycobacterium tuberculosis H37Rv
cgcgaauauagcggcguucc

SEQ ID NO: 1303059 - RNA, 17 nt, Mycobacterium tuberculosis H37Rv
cgcgaauaccagaccgg

SEQ ID NO: 1303060 - RNA, 20 nt, Mycobacterium tuberculosis H37Rv
cgcgaacucaugcccgacga

SEQ ID NO: 1303061 - RNA, 17 nt, Mycobacterium tuberculosis H37Rv
cgcgaagcgcucggcag

SEQ ID NO: 1303062 - RNA, 17 nt, Mycobacterium tuberculosis H37Rv
cgcgaagccaccagguc

SEQ ID NO: 1303063 - RNA, 18 nt, Mycobacterium tuberculosis H37Rv
cgccuugcacaagcugaa

SEQ ID NO: 1303064 - RNA, 15 nt, Mycobacterium tuberculosis H37Rv
cgccuugaucggcga

SEQ ID NO: 1303065 - RNA, 14 nt, Mycobacterium tuberculosis H37Rv
cgccuuggccacca

SEQ ID NO: 1303066 - RNA, 13 nt, Mycobacterium tuberculosis H37Rv
cgccuuggucgcc

SEQ ID NO: 1303067 - RNA, 17 nt, Mycobacterium tuberculosis H37Rv
cgccuuggucaccuucu

SEQ ID NO: 1303068 - RNA, 15 nt, Mycobacterium tuberculosis H37Rv
cgccuuggucgccgc

SEQ ID NO: 1303069 - RNA, 17 nt, Mycobacterium tuberculosis H37Rv
cgccuuggcgcccgcga

SEQ ID NO: 1303070 - RNA, 19 nt, Mycobacterium tuberculosis H37Rv
cgccuuguggcacacccgc

SEQ ID NO: 1303071 - RNA, 14 nt, Mycobacterium tuberculosis H37Rv
cgccuugucggcga

SEQ ID NO: 1303072 - RNA, 20 nt, Mycobacterium tuberculosis H37Rv
cgccuucuuggcaggugccu

SEQ ID NO: 1303073 - RNA, 16 nt, Mycobacterium tuberculosis H37Rv
cgccuugaagcggugg

SEQ ID NO: 1303074 - RNA, 14 nt, Mycobacterium tuberculosis H37Rv
cgccuugaucggcg

SEQ ID NO: 1303075 - RNA, 13 nt, Mycobacterium tuberculosis H37Rv
cgccuugagccga

SEQ ID NO: 1303076 - RNA, 15 nt, Mycobacterium tuberculosis H37Rv
cgcgaacaucgccag

SEQ ID NO: 1303077 - RNA, 13 nt, Mycobacterium tuberculosis H37Rv
cgcgaacccgcga

SEQ ID NO: 1303078 - RNA, 13 nt, Mycobacterium tuberculosis H37Rv
cgcgaacccugcu

SEQ ID NO: 1303079 - RNA, 17 nt, Mycobacterium tuberculosis H37Rv
cgcgaaccccagccgau

SEQ ID NO: 1303080 - RNA, 15 nt, Mycobacterium tuberculosis H37Rv
cgcgaaccgucucgg

SEQ ID NO: 1303081 - RNA, 15 nt, Mycobacterium tuberculosis H37Rv
cgcgaacgauuucgg

SEQ ID NO: 1303082 - RNA, 15 nt, Mycobacterium tuberculosis H37Rv
cgcgaaacgccgcaa

SEQ ID NO: 1303083 - RNA, 15 nt, Mycobacterium tuberculosis H37Rv
cgccugagcgcucga

SEQ ID NO: 1303084 - RNA, 14 nt, Mycobacterium tuberculosis H37Rv
cgccugagccacca

SEQ ID NO: 1303085 - RNA, 22 nt, Mycobacterium tuberculosis H37Rv
cgccugauaugacuugcgcgcg

SEQ ID NO: 1303086 - RNA, 16 nt, Mycobacterium tuberculosis H37Rv
cgccugauaggccuga

SEQ ID NO: 1303087 - RNA, 22 nt, Mycobacterium tuberculosis H37Rv
cgccucggugagcugcacgccg

SEQ ID NO: 1303088 - RNA, 15 nt, Mycobacterium tuberculosis H37Rv
cgccucgggcaccug

SEQ ID NO: 1303089 - RNA, 22 nt, Mycobacterium tuberculosis H37Rv
cgccucgggccggcguagcggc

SEQ ID NO: 1303090 - RNA, 19 nt, Mycobacterium tuberculosis H37Rv
cgccucgagcaacggacga

SEQ ID NO: 1303091 - RNA, 22 nt, Mycobacterium tuberculosis H37Rv
cgccuccucgugcaggaccagc

SEQ ID NO: 1303092 - RNA, 15 nt, Mycobacterium tuberculosis H37Rv
cgccucgaccgccag

SEQ ID NO: 1303093 - RNA, 14 nt, Mycobacterium tuberculosis H37Rv
cgccuccggcaccu

SEQ ID NO: 1303094 - RNA, 23 nt, Mycobacterium tuberculosis H37Rv
cgccuccguugcccccauugccg

SEQ ID NO: 1303095 - RNA, 13 nt, Mycobacterium tuberculosis H37Rv
cgccuccucgaua

SEQ ID NO: 1303096 - RNA, 18 nt, Mycobacterium tuberculosis H37Rv
cgccuccucgacgucggc

SEQ ID NO: 1303097 - RNA, 17 nt, Mycobacterium tuberculosis H37Rv
cgccuccucgacgucgg

SEQ ID NO: 1303098 - RNA, 13 nt, Mycobacterium tuberculosis H37Rv
cgccuccucgacg

SEQ ID NO: 1303099 - RNA, 21 nt, Mycobacterium tuberculosis H37Rv
cgccuccugccgccgcuccau

SEQ ID NO: 1303100 - RNA, 13 nt, Mycobacterium tuberculosis H37Rv
cgccuccucgauc

SEQ ID NO: 1303101 - RNA, 18 nt, Mycobacterium tuberculosis H37Rv
cgccuccacucuucgggc

SEQ ID NO: 1303102 - RNA, 13 nt, Mycobacterium tuberculosis H37Rv
cgccgucgccgau

SEQ ID NO: 1303103 - RNA, 13 nt, Mycobacterium tuberculosis H37Rv
cgccgucgccacc

SEQ ID NO: 1303104 - RNA, 20 nt, Mycobacterium tuberculosis H37Rv
cgccgucgccaccgguaccg

SEQ ID NO: 1303105 - RNA, 17 nt, Mycobacterium tuberculosis H37Rv
cgccgucgcagccagcu

SEQ ID NO: 1303106 - RNA, 14 nt, Mycobacterium tuberculosis H37Rv
cgccgucgccaccg

SEQ ID NO: 1303107 - RNA, 14 nt, Mycobacterium tuberculosis H37Rv
cgccuggacgccgc

SEQ ID NO: 1303108 - RNA, 22 nt, Mycobacterium tuberculosis H37Rv
cgccuggaagaucacgcgucgu

SEQ ID NO: 1303109 - RNA, 14 nt, Mycobacterium tuberculosis H37Rv
cgccuggaucagcg

SEQ ID NO: 1303110 - RNA, 18 nt, Mycobacterium tuberculosis H37Rv
cgccuggacgccgccgga

SEQ ID NO: 1303111 - RNA, 23 nt, Mycobacterium tuberculosis H37Rv
cgccuuccaggcgggcggcaccg

SEQ ID NO: 1303112 - RNA, 12 nt, Mycobacterium tuberculosis H37Rv
cgccugucgggc

SEQ ID NO: 1303113 - RNA, 21 nt, Mycobacterium tuberculosis H37Rv
cgccuguacgagcagaucgcg

SEQ ID NO: 1303114 - RNA, 13 nt, Mycobacterium tuberculosis H37Rv
cgccugugccacc

SEQ ID NO: 1303115 - RNA, 17 nt, Mycobacterium tuberculosis H37Rv
cgcgcagauacgcgugu

SEQ ID NO: 1303116 - RNA, 21 nt, Mycobacterium tuberculosis H37Rv
cgcgcagaucguccaccgccg

SEQ ID NO: 1303117 - RNA, 15 nt, Mycobacterium tuberculosis H37Rv
cgcgcagcacugcgg

SEQ ID NO: 1303118 - RNA, 13 nt, Mycobacterium tuberculosis H37Rv
cgcgcagcacugc

SEQ ID NO: 1303119 - RNA, 20 nt, Mycobacterium tuberculosis H37Rv
cgcgcagcaccggcucgacu

SEQ ID NO: 1303120 - RNA, 14 nt, Mycobacterium tuberculosis H37Rv
cgcgcagcaccggc

SEQ ID NO: 1303121 - RNA, 12 nt, Mycobacterium tuberculosis H37Rv
cgcgcagcagug

SEQ ID NO: 1303122 - RNA, 14 nt, Mycobacterium tuberculosis H37Rv
cgcgcauauccgca

SEQ ID NO: 1303123 - RNA, 13 nt, Mycobacterium tuberculosis H37Rv
cgcgcaggaagcc

SEQ ID NO: 1303124 - RNA, 14 nt, Mycobacterium tuberculosis H37Rv
cgcgccaucgucgc

SEQ ID NO: 1303125 - RNA, 15 nt, Mycobacterium tuberculosis H37Rv
cgcgcccgccucgac

SEQ ID NO: 1303126 - RNA, 23 nt, Mycobacterium tuberculosis H37Rv
cgcgcccuucagcacggugauca

SEQ ID NO: 1303127 - RNA, 17 nt, Mycobacterium tuberculosis H37Rv
cgcgccgaccaccgcug

SEQ ID NO: 1303128 - RNA, 14 nt, Mycobacterium tuberculosis H37Rv
cgcgccgaccaccg

SEQ ID NO: 1303129 - RNA, 19 nt, Mycobacterium tuberculosis H37Rv
cgcgcccaccccggccgca

SEQ ID NO: 1303130 - RNA, 20 nt, Mycobacterium tuberculosis H37Rv
cgcgcccaccccggccgcau

SEQ ID NO: 1303131 - RNA, 15 nt, Mycobacterium tuberculosis H37Rv
cgcgcccgacacccg

SEQ ID NO: 1303132 - RNA, 19 nt, Mycobacterium tuberculosis H37Rv
cgcgcccgagaccggcacc

SEQ ID NO: 1303133 - RNA, 15 nt, Mycobacterium tuberculosis H37Rv
cgcgcccgcaccacc

SEQ ID NO: 1303134 - RNA, 13 nt, Mycobacterium tuberculosis H37Rv
cgcgcccgccgau

SEQ ID NO: 1303135 - RNA, 14 nt, Mycobacterium tuberculosis H37Rv
cgcgcccgcaccac

SEQ ID NO: 1303136 - RNA, 13 nt, Mycobacterium tuberculosis H37Rv
cgcgcccgcacca

SEQ ID NO: 1303137 - RNA, 16 nt, Mycobacterium tuberculosis H37Rv
cgcgcccgagccggua

SEQ ID NO: 1303138 - RNA, 15 nt, Mycobacterium tuberculosis H37Rv
cgcgccgcauccagc

SEQ ID NO: 1303139 - RNA, 13 nt, Mycobacterium tuberculosis H37Rv
cgcgccgccucgg

SEQ ID NO: 1303140 - RNA, 16 nt, Mycobacterium tuberculosis H37Rv
cgcgccgcgcaucgcg

SEQ ID NO: 1303141 - RNA, 16 nt, Mycobacterium tuberculosis H37Rv
cgcgccgcacccggga

SEQ ID NO: 1303142 - RNA, 23 nt, Mycobacterium tuberculosis H37Rv
cgcgccgauuccaccgccgacgc

SEQ ID NO: 1303143 - RNA, 14 nt, Mycobacterium tuberculosis H37Rv
cgcgccgcacacgu

SEQ ID NO: 1303144 - RNA, 18 nt, Mycobacterium tuberculosis H37Rv
cgcgccgauuccaccgcc

SEQ ID NO: 1303145 - RNA, 14 nt, Mycobacterium tuberculosis H37Rv
cgcgccgaucacca

SEQ ID NO: 1303146 - RNA, 22 nt, Mycobacterium tuberculosis H37Rv
cgcgccggcggcaaagagcagc

SEQ ID NO: 1303147 - RNA, 16 nt, Mycobacterium tuberculosis H37Rv
cgcgccggcgacaccg

SEQ ID NO: 1303148 - RNA, 13 nt, Mycobacterium tuberculosis H37Rv
cgcgccggccgca

SEQ ID NO: 1303149 - RNA, 19 nt, Mycobacterium tuberculosis H37Rv
cgcgccgcgcucgccgaua

SEQ ID NO: 1303150 - RNA, 17 nt, Mycobacterium tuberculosis H37Rv
cgcgaccuugcccgcua

SEQ ID NO: 1303151 - RNA, 16 nt, Mycobacterium tuberculosis H37Rv
cgcgaccuccgcgauc

SEQ ID NO: 1303152 - RNA, 17 nt, Mycobacterium tuberculosis H37Rv
cgcgaccgucaggguca

SEQ ID NO: 1303153 - RNA, 13 nt, Mycobacterium tuberculosis H37Rv
cgcgaccgcgauc

SEQ ID NO: 1303154 - RNA, 18 nt, Mycobacterium tuberculosis H37Rv
cgcgacguagacgacguc

SEQ ID NO: 1303155 - RNA, 22 nt, Mycobacterium tuberculosis H37Rv
cgcgacggucaaggugcgccgc

SEQ ID NO: 1303156 - RNA, 23 nt, Mycobacterium tuberculosis H37Rv
cgcgacggucccuucgucaccgu

SEQ ID NO: 1303157 - RNA, 20 nt, Mycobacterium tuberculosis H37Rv
cgcgacguagacgacgucgg

SEQ ID NO: 1303158 - RNA, 22 nt, Mycobacterium tuberculosis H37Rv
cgcgacguagacgacgucggcc

SEQ ID NO: 1303159 - RNA, 22 nt, Mycobacterium tuberculosis H37Rv
cgcgacguaguggaagccgacc

SEQ ID NO: 1303160 - RNA, 23 nt, Mycobacterium tuberculosis H37Rv
cgcgagcaucugggguccgguga

SEQ ID NO: 1303161 - RNA, 22 nt, Mycobacterium tuberculosis H37Rv
cgcgagcaucugggguccggug

SEQ ID NO: 1303162 - RNA, 15 nt, Mycobacterium tuberculosis H37Rv
cgcgagcaucgacga

SEQ ID NO: 1303163 - RNA, 14 nt, Mycobacterium tuberculosis H37Rv
cgcgagcaucgacg

SEQ ID NO: 1303164 - RNA, 13 nt, Mycobacterium tuberculosis H37Rv
cgcgagcccgcca

SEQ ID NO: 1303165 - RNA, 14 nt, Mycobacterium tuberculosis H37Rv
cgcgaggaugcuga

SEQ ID NO: 1303166 - RNA, 15 nt, Mycobacterium tuberculosis H37Rv
cgcgagggccagcaa

SEQ ID NO: 1303167 - RNA, 19 nt, Mycobacterium tuberculosis H37Rv
cgcgagcgcuaucaccgcc

SEQ ID NO: 1303168 - RNA, 22 nt, Mycobacterium tuberculosis H37Rv
cgcgagcggaauggaggccgcc

SEQ ID NO: 1303169 - RNA, 22 nt, Mycobacterium tuberculosis H37Rv
cgcgagcggaugaaaucggcaa

SEQ ID NO: 1303170 - RNA, 18 nt, Mycobacterium tuberculosis H37Rv
cgcgaucgggccgaucuc

SEQ ID NO: 1303171 - RNA, 22 nt, Mycobacterium tuberculosis H37Rv
cgcgaucugaagguguccgcug

SEQ ID NO: 1303172 - RNA, 21 nt, Mycobacterium tuberculosis H37Rv
cgcgaugacacaccgcgucgg

SEQ ID NO: 1303173 - RNA, 20 nt, Mycobacterium tuberculosis H37Rv
cgcgaugggcccagcggccg

SEQ ID NO: 1303174 - RNA, 22 nt, Mycobacterium tuberculosis H37Rv
cgcgaugguuauccccuggcca

SEQ ID NO: 1303175 - RNA, 18 nt, Mycobacterium tuberculosis H37Rv
cgcgauggugguuccgcc

SEQ ID NO: 1303176 - RNA, 17 nt, Mycobacterium tuberculosis H37Rv
cgcgaucgggccgaucu

SEQ ID NO: 1303177 - RNA, 20 nt, Mycobacterium tuberculosis H37Rv
cgcgaucgggcccagcagcg

SEQ ID NO: 1303178 - RNA, 16 nt, Mycobacterium tuberculosis H37Rv
cgcgaucaggcgcucg

SEQ ID NO: 1303179 - RNA, 19 nt, Mycobacterium tuberculosis H37Rv
cgcgaucagaaacuccgga

SEQ ID NO: 1303180 - RNA, 21 nt, Mycobacterium tuberculosis H37Rv
cgcgaucagaaacuccggacc

SEQ ID NO: 1303181 - RNA, 15 nt, Mycobacterium tuberculosis H37Rv
cgcgaguccaggcug

SEQ ID NO: 1303182 - RNA, 17 nt, Mycobacterium tuberculosis H37Rv
cgcgaucacccacaugg

SEQ ID NO: 1303183 - RNA, 15 nt, Mycobacterium tuberculosis H37Rv
cgcgaucaccaccgg

SEQ ID NO: 1303184 - RNA, 17 nt, Mycobacterium tuberculosis H37Rv
cgcgaguagaucaucga

SEQ ID NO: 1303185 - RNA, 15 nt, Mycobacterium tuberculosis H37Rv
cgcgagguuggcguu

SEQ ID NO: 1303186 - RNA, 15 nt, Mycobacterium tuberculosis H37Rv
cgcgaguagcugacc

SEQ ID NO: 1303187 - RNA, 22 nt, Mycobacterium tuberculosis H37Rv
cgcgaguagcugacccgcggua

SEQ ID NO: 1303188 - RNA, 23 nt, Mycobacterium tuberculosis H37Rv
cgcgagucaccaaaggcgucuga

SEQ ID NO: 1303189 - RNA, 18 nt, Mycobacterium tuberculosis H37Rv
cgcgagugccaguccgau

SEQ ID NO: 1303190 - RNA, 21 nt, Mycobacterium tuberculosis H37Rv
cgcgauuagcaaaccgaccgu

SEQ ID NO: 1303191 - RNA, 16 nt, Mycobacterium tuberculosis H37Rv
cgcgaugugcgccacc

SEQ ID NO: 1303192 - RNA, 21 nt, Mycobacterium tuberculosis H37Rv
cgcgcaacccugccgcgauga

SEQ ID NO: 1303193 - RNA, 18 nt, Mycobacterium tuberculosis H37Rv
cgcgcacccguccgccgc

SEQ ID NO: 1303194 - RNA, 14 nt, Mycobacterium tuberculosis H37Rv
cgcgcaaccggccg

SEQ ID NO: 1303195 - RNA, 20 nt, Mycobacterium tuberculosis H37Rv
cgcgcaccggaucgccgucg

SEQ ID NO: 1303196 - RNA, 17 nt, Mycobacterium tuberculosis H37Rv
cgcgcaccggaucgccg

SEQ ID NO: 1303197 - RNA, 13 nt, Mycobacterium tuberculosis H37Rv
cgcgcaccggauc

SEQ ID NO: 1303198 - RNA, 14 nt, Mycobacterium tuberculosis H37Rv
cgcgucgagcagca

SEQ ID NO: 1303199 - RNA, 15 nt, Mycobacterium tuberculosis H37Rv
cgcgucgagugccgc

SEQ ID NO: 1303200 - RNA, 22 nt, Mycobacterium tuberculosis H37Rv
cgcgucgacccgaacugggcga

SEQ ID NO: 1303201 - RNA, 15 nt, Mycobacterium tuberculosis H37Rv
cgcgucgaccggaca

SEQ ID NO: 1303202 - RNA, 18 nt, Mycobacterium tuberculosis H37Rv
cgcguccucgccgcacgc

SEQ ID NO: 1303203 - RNA, 18 nt, Mycobacterium tuberculosis H37Rv
cgcgucccgccgcaccgc

SEQ ID NO: 1303204 - RNA, 14 nt, Mycobacterium tuberculosis H37Rv
cgcguccucgccgc

SEQ ID NO: 1303205 - RNA, 18 nt, Mycobacterium tuberculosis H37Rv
cgcguccggugcaccagg

SEQ ID NO: 1303206 - RNA, 16 nt, Mycobacterium tuberculosis H37Rv
cgcguccggugcacca

SEQ ID NO: 1303207 - RNA, 13 nt, Mycobacterium tuberculosis H37Rv
cgcguccgcgauc

SEQ ID NO: 1303208 - RNA, 15 nt, Mycobacterium tuberculosis H37Rv
cgcgucaggccagcg

SEQ ID NO: 1303209 - RNA, 22 nt, Mycobacterium tuberculosis H37Rv
cgcguaggccgcuaugcagguc

SEQ ID NO: 1303210 - RNA, 18 nt, Mycobacterium tuberculosis H37Rv
cgcguagaccccaaucga

SEQ ID NO: 1303211 - RNA, 22 nt, Mycobacterium tuberculosis H37Rv
cgcguagaguguccccggcugc

SEQ ID NO: 1303212 - RNA, 21 nt, Mycobacterium tuberculosis H37Rv
cgcguagccguggagcacagc

SEQ ID NO: 1303213 - RNA, 14 nt, Mycobacterium tuberculosis H37Rv
cgcgguggucagca

SEQ ID NO: 1303214 - RNA, 14 nt, Mycobacterium tuberculosis H37Rv
cgcgguggcggcga

SEQ ID NO: 1303215 - RNA, 19 nt, Mycobacterium tuberculosis H37Rv
cgcgguggcggcgagcagc

SEQ ID NO: 1303216 - RNA, 14 nt, Mycobacterium tuberculosis H37Rv
cgcgguggcggugu

SEQ ID NO: 1303217 - RNA, 21 nt, Mycobacterium tuberculosis H37Rv
cgcgguggcggugucggcgcc

SEQ ID NO: 1303218 - RNA, 18 nt, Mycobacterium tuberculosis H37Rv
cgcggugggcacagccag

SEQ ID NO: 1303219 - RNA, 17 nt, Mycobacterium tuberculosis H37Rv
cgcguacuucgcuggaa

SEQ ID NO: 1303220 - RNA, 23 nt, Mycobacterium tuberculosis H37Rv
cgcguaccgguggaaacccugca

SEQ ID NO: 1303221 - RNA, 22 nt, Mycobacterium tuberculosis H37Rv
cgcgguguagaagcgggcgucg

SEQ ID NO: 1303222 - RNA, 23 nt, Mycobacterium tuberculosis H37Rv
cgcgguguagaagcgggcgucgc

SEQ ID NO: 1303223 - RNA, 13 nt, Mycobacterium tuberculosis H37Rv
cgcgguacgccgg

SEQ ID NO: 1303224 - RNA, 17 nt, Mycobacterium tuberculosis H37Rv
cgcgguaccgcucgggc

SEQ ID NO: 1303225 - RNA, 14 nt, Mycobacterium tuberculosis H37Rv
cgcgguaccggugu

SEQ ID NO: 1303226 - RNA, 14 nt, Mycobacterium tuberculosis H37Rv
cgcgguaccgcucg

SEQ ID NO: 1303227 - RNA, 19 nt, Mycobacterium tuberculosis H37Rv
cgcggguuugaucuccacc

SEQ ID NO: 1303228 - RNA, 23 nt, Mycobacterium tuberculosis H37Rv
cgcggguuugaucuccaccuucu

SEQ ID NO: 1303229 - RNA, 18 nt, Mycobacterium tuberculosis H37Rv
cgcggguugucggcgacc

SEQ ID NO: 1303230 - RNA, 14 nt, Mycobacterium tuberculosis H37Rv
cgcgguaaccacgc

SEQ ID NO: 1303231 - RNA, 16 nt, Mycobacterium tuberculosis H37Rv
cgcgguaaccacgcgg

SEQ ID NO: 1303232 - RNA, 24 nt, Mycobacterium tuberculosis H37Rv
cgcgggcgagaacccacgcaugca

SEQ ID NO: 1303233 - RNA, 15 nt, Mycobacterium tuberculosis H37Rv
cgcgggcaagccgga

SEQ ID NO: 1303234 - RNA, 15 nt, Mycobacterium tuberculosis H37Rv
cgcgggauugcgcgc

SEQ ID NO: 1303235 - RNA, 18 nt, Mycobacterium tuberculosis H37Rv
cgcgggcacugguggcga

SEQ ID NO: 1303236 - RNA, 14 nt, Mycobacterium tuberculosis H37Rv
cgcgggcaguggca

SEQ ID NO: 1303237 - RNA, 15 nt, Mycobacterium tuberculosis H37Rv
cgcgggcacuggugg

SEQ ID NO: 1303238 - RNA, 13 nt, Mycobacterium tuberculosis H37Rv
cgcggugcccguc

SEQ ID NO: 1303239 - RNA, 22 nt, Mycobacterium tuberculosis H37Rv
cgcggugcccgcgaacgauccc

SEQ ID NO: 1303240 - RNA, 20 nt, Mycobacterium tuberculosis H37Rv
cgcggucucggugccgagca

SEQ ID NO: 1303241 - RNA, 17 nt, Mycobacterium tuberculosis H37Rv
cgcggucugaccgcguc

SEQ ID NO: 1303242 - RNA, 19 nt, Mycobacterium tuberculosis H37Rv
cgcggucugaccgcgucgg

SEQ ID NO: 1303243 - RNA, 16 nt, Mycobacterium tuberculosis H37Rv
cgcggucgacgacgcc

SEQ ID NO: 1303244 - RNA, 14 nt, Mycobacterium tuberculosis H37Rv
cgcggucauggcga

SEQ ID NO: 1303245 - RNA, 23 nt, Mycobacterium tuberculosis H37Rv
cgcuaccagcugggcgaccacuu

SEQ ID NO: 1303246 - RNA, 20 nt, Mycobacterium tuberculosis H37Rv
cgcuaaggugggcacagcga

SEQ ID NO: 1303247 - RNA, 20 nt, Mycobacterium tuberculosis H37Rv
cgcuaacugcuuuucgacgg

SEQ ID NO: 1303248 - RNA, 18 nt, Mycobacterium tuberculosis H37Rv
cgcucaccggggccgucg

SEQ ID NO: 1303249 - RNA, 17 nt, Mycobacterium tuberculosis H37Rv
cgcuacgcgcgcucgcu

SEQ ID NO: 1303250 - RNA, 20 nt, Mycobacterium tuberculosis H37Rv
cgcucacccggcgucucgca

SEQ ID NO: 1303251 - RNA, 11 nt, Mycobacterium tuberculosis H37Rv
cgcuacgcgcg

SEQ ID NO: 1303252 - RNA, 23 nt, Mycobacterium tuberculosis H37Rv
cgcucacugcagcgccucgaucc

SEQ ID NO: 1303253 - RNA, 16 nt, Mycobacterium tuberculosis H37Rv
cgcucacggggcguga

SEQ ID NO: 1303254 - RNA, 14 nt, Mycobacterium tuberculosis H37Rv
cgcucacgaagacc

SEQ ID NO: 1303255 - RNA, 21 nt, Mycobacterium tuberculosis H37Rv
cgcucagcgcggccacgccga

SEQ ID NO: 1303256 - RNA, 15 nt, Mycobacterium tuberculosis H37Rv
cgcuccaggucgaca

SEQ ID NO: 1303257 - RNA, 22 nt, Mycobacterium tuberculosis H37Rv
cgcucccaagaaggacaucacg

SEQ ID NO: 1303258 - RNA, 20 nt, Mycobacterium tuberculosis H37Rv
cgcuccggcgugcgcaaggc

SEQ ID NO: 1303259 - RNA, 22 nt, Mycobacterium tuberculosis H37Rv
cgcuccccagcgaaucacccgc

SEQ ID NO: 1303260 - RNA, 14 nt, Mycobacterium tuberculosis H37Rv
cgcucccgccggca

SEQ ID NO: 1303261 - RNA, 16 nt, Mycobacterium tuberculosis H37Rv
cgcucccgucucgaca

SEQ ID NO: 1303262 - RNA, 17 nt, Mycobacterium tuberculosis H37Rv
cgcucccugcacccagc

SEQ ID NO: 1303263 - RNA, 21 nt, Mycobacterium tuberculosis H37Rv
cgcucccugcacccagccgug

SEQ ID NO: 1303264 - RNA, 13 nt, Mycobacterium tuberculosis H37Rv
cgcgugcggcugc

SEQ ID NO: 1303265 - RNA, 12 nt, Mycobacterium tuberculosis H37Rv
cgcgugcugagu

SEQ ID NO: 1303266 - RNA, 12 nt, Mycobacterium tuberculosis H37Rv
cgcguucgcgca

SEQ ID NO: 1303267 - RNA, 18 nt, Mycobacterium tuberculosis H37Rv
cgcguugcguaucgaccc

SEQ ID NO: 1303268 - RNA, 14 nt, Mycobacterium tuberculosis H37Rv
cgcguucucggcac

SEQ ID NO: 1303269 - RNA, 14 nt, Mycobacterium tuberculosis H37Rv
cgcguucggcaccu

SEQ ID NO: 1303270 - RNA, 17 nt, Mycobacterium tuberculosis H37Rv
cgcguuggacaauucga

SEQ ID NO: 1303271 - RNA, 12 nt, Mycobacterium tuberculosis H37Rv
cgcguuggccac

SEQ ID NO: 1303272 - RNA, 14 nt, Mycobacterium tuberculosis H37Rv
cgcguuggguugaa

SEQ ID NO: 1303273 - RNA, 17 nt, Mycobacterium tuberculosis H37Rv
cgcguuucgccggaugc

SEQ ID NO: 1303274 - RNA, 18 nt, Mycobacterium tuberculosis H37Rv
cgcguuucgucgaccgcg

SEQ ID NO: 1303275 - RNA, 23 nt, Mycobacterium tuberculosis H37Rv
cgcuaaagcccccgcacgcucgg

SEQ ID NO: 1303276 - RNA, 18 nt, Mycobacterium tuberculosis H37Rv
cgcgugcgggggacgggu

SEQ ID NO: 1303277 - RNA, 22 nt, Mycobacterium tuberculosis H37Rv
cgcgugccgcaaccggcgaucg

SEQ ID NO: 1303278 - RNA, 19 nt, Mycobacterium tuberculosis H37Rv
cgcgugcccguggugaugg

SEQ ID NO: 1303279 - RNA, 12 nt, Mycobacterium tuberculosis H37Rv
cgcgugccgcaa

SEQ ID NO: 1303280 - RNA, 21 nt, Mycobacterium tuberculosis H37Rv
cgcgugccagcgccccgcggu

SEQ ID NO: 1303281 - RNA, 14 nt, Mycobacterium tuberculosis H37Rv
cgcgugcaccgagc

SEQ ID NO: 1303282 - RNA, 15 nt, Mycobacterium tuberculosis H37Rv
cgcgugagcagacgc

SEQ ID NO: 1303283 - RNA, 19 nt, Mycobacterium tuberculosis H37Rv
cgcgugcaggcugucaauc

SEQ ID NO: 1303284 - RNA, 14 nt, Mycobacterium tuberculosis H37Rv
cgcgugccacucga

SEQ ID NO: 1303285 - RNA, 17 nt, Mycobacterium tuberculosis H37Rv
cgcgugcaucgccugcg

SEQ ID NO: 1303286 - RNA, 15 nt, Mycobacterium tuberculosis H37Rv
cgcgugcagccccaa

SEQ ID NO: 1303287 - RNA, 19 nt, Mycobacterium tuberculosis H37Rv
cgcgucggcguuggggcuc

SEQ ID NO: 1303288 - RNA, 16 nt, Mycobacterium tuberculosis H37Rv
cgcgugacgaccagcc

SEQ ID NO: 1303289 - RNA, 14 nt, Mycobacterium tuberculosis H37Rv
cgcgucggcguugg

SEQ ID NO: 1303290 - RNA, 15 nt, Mycobacterium tuberculosis H37Rv
cgcgucggcggccag

SEQ ID NO: 1303291 - RNA, 23 nt, Mycobacterium tuberculosis H37Rv
cgcgucggccgaacaaccuucgg

SEQ ID NO: 1303292 - RNA, 15 nt, Mycobacterium tuberculosis H37Rv
cgcgucgaucugugg

SEQ ID NO: 1303293 - RNA, 15 nt, Mycobacterium tuberculosis H37Rv
cgcgucggcaccgau

SEQ ID NO: 1303294 - RNA, 16 nt, Mycobacterium tuberculosis H37Rv
cgcgucggcaccgauc

SEQ ID NO: 1303295 - RNA, 14 nt, Mycobacterium tuberculosis H37Rv
cgcggcaucccgcc

SEQ ID NO: 1303296 - RNA, 23 nt, Mycobacterium tuberculosis H37Rv
cgcggccaaucagcccgccggac

SEQ ID NO: 1303297 - RNA, 17 nt, Mycobacterium tuberculosis H37Rv
cgcggccacaucgccag

SEQ ID NO: 1303298 - RNA, 17 nt, Mycobacterium tuberculosis H37Rv
cgcggccaccaccgccg

SEQ ID NO: 1303299 - RNA, 23 nt, Mycobacterium tuberculosis H37Rv
cgcggccaccaccaggcugacgu

SEQ ID NO: 1303300 - RNA, 20 nt, Mycobacterium tuberculosis H37Rv
cgcggccaccacaacgccag

SEQ ID NO: 1303301 - RNA, 15 nt, Mycobacterium tuberculosis H37Rv
cgcggccaccaccag

SEQ ID NO: 1303302 - RNA, 16 nt, Mycobacterium tuberculosis H37Rv
cgcggccacccgcgac

SEQ ID NO: 1303303 - RNA, 21 nt, Mycobacterium tuberculosis H37Rv
cgcggccacccgcgacgaugu

SEQ ID NO: 1303304 - RNA, 13 nt, Mycobacterium tuberculosis H37Rv
cgcggcagcguug

SEQ ID NO: 1303305 - RNA, 12 nt, Mycobacterium tuberculosis H37Rv
cgcggcagcgga

SEQ ID NO: 1303306 - RNA, 13 nt, Mycobacterium tuberculosis H37Rv
cgcggcagcggau

SEQ ID NO: 1303307 - RNA, 15 nt, Mycobacterium tuberculosis H37Rv
cgcggcagcggauac

SEQ ID NO: 1303308 - RNA, 21 nt, Mycobacterium tuberculosis H37Rv
cgcggcagggcggugccaucg

SEQ ID NO: 1303309 - RNA, 13 nt, Mycobacterium tuberculosis H37Rv
cgcggcagcacga

SEQ ID NO: 1303310 - RNA, 21 nt, Mycobacterium tuberculosis H37Rv
cgcggcacggugugcggcauu

SEQ ID NO: 1303311 - RNA, 17 nt, Mycobacterium tuberculosis H37Rv
cgcggcaccgccgagca

SEQ ID NO: 1303312 - RNA, 20 nt, Mycobacterium tuberculosis H37Rv
cgcggcacgaucaaccgggu

SEQ ID NO: 1303313 - RNA, 14 nt, Mycobacterium tuberculosis H37Rv
cgcggcacgcucca

SEQ ID NO: 1303314 - RNA, 18 nt, Mycobacterium tuberculosis H37Rv
cgcggaucuguuccucgg

SEQ ID NO: 1303315 - RNA, 15 nt, Mycobacterium tuberculosis H37Rv
cgcggaucucaucgg

SEQ ID NO: 1303316 - RNA, 21 nt, Mycobacterium tuberculosis H37Rv
cgcggauguccaggagugcgg

SEQ ID NO: 1303317 - RNA, 13 nt, Mycobacterium tuberculosis H37Rv
cgcggaugcguug

SEQ ID NO: 1303318 - RNA, 20 nt, Mycobacterium tuberculosis H37Rv
cgcggaucgcgcugaucagc

SEQ ID NO: 1303319 - RNA, 17 nt, Mycobacterium tuberculosis H37Rv
cgcggaucgaccgccag

SEQ ID NO: 1303320 - RNA, 20 nt, Mycobacterium tuberculosis H37Rv
cgcggauuucgccgugauga

SEQ ID NO: 1303321 - RNA, 16 nt, Mycobacterium tuberculosis H37Rv
cgcggaugucggcauc

SEQ ID NO: 1303322 - RNA, 13 nt, Mycobacterium tuberculosis H37Rv
cgcggcaccgccg

SEQ ID NO: 1303323 - RNA, 20 nt, Mycobacterium tuberculosis H37Rv
cgcggcacccggucggccau

SEQ ID NO: 1303324 - RNA, 14 nt, Mycobacterium tuberculosis H37Rv
cgcggcaccacguc

SEQ ID NO: 1303325 - RNA, 19 nt, Mycobacterium tuberculosis H37Rv
cgcggcacccggucggcca

SEQ ID NO: 1303326 - RNA, 16 nt, Mycobacterium tuberculosis H37Rv
cgcggcacaccccggu

SEQ ID NO: 1303327 - RNA, 23 nt, Mycobacterium tuberculosis H37Rv
cgcgcuguugccaucgacgccgc

SEQ ID NO: 1303328 - RNA, 17 nt, Mycobacterium tuberculosis H37Rv
cgcgcuguuguacggcc

SEQ ID NO: 1303329 - RNA, 14 nt, Mycobacterium tuberculosis H37Rv
cgcgcuugcgaucg

SEQ ID NO: 1303330 - RNA, 18 nt, Mycobacterium tuberculosis H37Rv
cgcgcuugcgaucgccgc

SEQ ID NO: 1303331 - RNA, 16 nt, Mycobacterium tuberculosis H37Rv
cgcgcuugcgaucggc

SEQ ID NO: 1303332 - RNA, 17 nt, Mycobacterium tuberculosis H37Rv
cgcgcuugcgaucggca

SEQ ID NO: 1303333 - RNA, 20 nt, Mycobacterium tuberculosis H37Rv
cgcgcuugcgaucgccgcua

SEQ ID NO: 1303334 - RNA, 18 nt, Mycobacterium tuberculosis H37Rv
cgcgcuugcgccgcccau

SEQ ID NO: 1303335 - RNA, 14 nt, Mycobacterium tuberculosis H37Rv
cgcgcuguacugcc

SEQ ID NO: 1303336 - RNA, 16 nt, Mycobacterium tuberculosis H37Rv
cgcgccggcugccaca

SEQ ID NO: 1303337 - RNA, 16 nt, Mycobacterium tuberculosis H37Rv
cgcgcuggucggagac

SEQ ID NO: 1303338 - RNA, 14 nt, Mycobacterium tuberculosis H37Rv
cgcgccggcuaggg

SEQ ID NO: 1303339 - RNA, 18 nt, Mycobacterium tuberculosis H37Rv
cgcggaaucgcaucggcg

SEQ ID NO: 1303340 - RNA, 15 nt, Mycobacterium tuberculosis H37Rv
cgcggaaggccagcu

SEQ ID NO: 1303341 - RNA, 15 nt, Mycobacterium tuberculosis H37Rv
cgcggaauccgcggc

SEQ ID NO: 1303342 - RNA, 16 nt, Mycobacterium tuberculosis H37Rv
cgcggacacgaucgcg

SEQ ID NO: 1303343 - RNA, 13 nt, Mycobacterium tuberculosis H37Rv
cgcggacacucgc

SEQ ID NO: 1303344 - RNA, 22 nt, Mycobacterium tuberculosis H37Rv
cgcggacgcaacucgacgcgua

SEQ ID NO: 1303345 - RNA, 16 nt, Mycobacterium tuberculosis H37Rv
cgcggaucaccaucgc

SEQ ID NO: 1303346 - RNA, 19 nt, Mycobacterium tuberculosis H37Rv
cgcggaucaccaucgccgc

SEQ ID NO: 1303347 - RNA, 15 nt, Mycobacterium tuberculosis H37Rv
cgcggagucaagcag

SEQ ID NO: 1303348 - RNA, 14 nt, Mycobacterium tuberculosis H37Rv
cgcggaguagccgc

SEQ ID NO: 1303349 - RNA, 18 nt, Mycobacterium tuberculosis H37Rv
cgcggaguagccgcagcu

SEQ ID NO: 1303350 - RNA, 16 nt, Mycobacterium tuberculosis H37Rv
cgcggagcgugagcca

SEQ ID NO: 1303351 - RNA, 13 nt, Mycobacterium tuberculosis H37Rv
cgcggagggcgcc

SEQ ID NO: 1303352 - RNA, 14 nt, Mycobacterium tuberculosis H37Rv
cgcggagaacgcgu

SEQ ID NO: 1303353 - RNA, 17 nt, Mycobacterium tuberculosis H37Rv
cgcggagaacgcgucgc

SEQ ID NO: 1303354 - RNA, 14 nt, Mycobacterium tuberculosis H37Rv
cgcggacucgggca

SEQ ID NO: 1303355 - RNA, 15 nt, Mycobacterium tuberculosis H37Rv
cgcggagccaggacg

SEQ ID NO: 1303356 - RNA, 13 nt, Mycobacterium tuberculosis H37Rv
cgcggcgaccugu

SEQ ID NO: 1303357 - RNA, 14 nt, Mycobacterium tuberculosis H37Rv
cgcggccugcacca

SEQ ID NO: 1303358 - RNA, 20 nt, Mycobacterium tuberculosis H37Rv
cgcggccucguuguagccga

SEQ ID NO: 1303359 - RNA, 20 nt, Mycobacterium tuberculosis H37Rv
cgcggccgcaagccgcgagu

SEQ ID NO: 1303360 - RNA, 17 nt, Mycobacterium tuberculosis H37Rv
cgcggccgaggucgcgg

SEQ ID NO: 1303361 - RNA, 20 nt, Mycobacterium tuberculosis H37Rv
cgcggccgaggucacccggu

SEQ ID NO: 1303362 - RNA, 15 nt, Mycobacterium tuberculosis H37Rv
cgcggccgaggucgc

SEQ ID NO: 1303363 - RNA, 14 nt, Mycobacterium tuberculosis H37Rv
cgcggccccgccgu

SEQ ID NO: 1303364 - RNA, 21 nt, Mycobacterium tuberculosis H37Rv
cgcggcccagguccgcgugcu

SEQ ID NO: 1303365 - RNA, 18 nt, Mycobacterium tuberculosis H37Rv
cgcggccaucgccgacac

SEQ ID NO: 1303366 - RNA, 16 nt, Mycobacterium tuberculosis H37Rv
cgcggccaguacgucg

SEQ ID NO: 1303367 - RNA, 14 nt, Mycobacterium tuberculosis H37Rv
cgcggccagcggga

SEQ ID NO: 1303368 - RNA, 18 nt, Mycobacterium tuberculosis H37Rv
cgcggccagcaccagcuc

SEQ ID NO: 1303369 - RNA, 17 nt, Mycobacterium tuberculosis H37Rv
cgcggccagcagcagau

SEQ ID NO: 1303370 - RNA, 17 nt, Mycobacterium tuberculosis H37Rv
cgcggcauucucgagca

SEQ ID NO: 1303371 - RNA, 16 nt, Mycobacterium tuberculosis H37Rv
cgcggccagagccgcg

SEQ ID NO: 1303372 - RNA, 22 nt, Mycobacterium tuberculosis H37Rv
cgcggccacggucagccaggug

SEQ ID NO: 1303373 - RNA, 16 nt, Mycobacterium tuberculosis H37Rv
cgcggccaccgccugu

SEQ ID NO: 1303374 - RNA, 18 nt, Mycobacterium tuberculosis H37Rv
cgcggccaccgccuguac

SEQ ID NO: 1303375 - RNA, 14 nt, Mycobacterium tuberculosis H37Rv
cgcggccaccgccg

SEQ ID NO: 1303376 - RNA, 15 nt, Mycobacterium tuberculosis H37Rv
cgcggccacgccgau

SEQ ID NO: 1303377 - RNA, 12 nt, Mycobacterium tuberculosis H37Rv
cgcggcgccacc

SEQ ID NO: 1303378 - RNA, 13 nt, Mycobacterium tuberculosis H37Rv
cgcggcgccaccc

SEQ ID NO: 1303379 - RNA, 23 nt, Mycobacterium tuberculosis H37Rv
cgcggcgccacccgcgccgccag

SEQ ID NO: 1303380 - RNA, 18 nt, Mycobacterium tuberculosis H37Rv
cgcggcgcaggucgcgca

SEQ ID NO: 1303381 - RNA, 23 nt, Mycobacterium tuberculosis H37Rv
cgcggcgcacaacccgucgagcc

SEQ ID NO: 1303382 - RNA, 21 nt, Mycobacterium tuberculosis H37Rv
cgcggcgcagcaccgucggca

SEQ ID NO: 1303383 - RNA, 18 nt, Mycobacterium tuberculosis H37Rv
cgcggcgcccuggccgcc

SEQ ID NO: 1303384 - RNA, 14 nt, Mycobacterium tuberculosis H37Rv
cgcggcggccagcg

SEQ ID NO: 1303385 - RNA, 19 nt, Mycobacterium tuberculosis H37Rv
cgcggcgccgccacgguac

SEQ ID NO: 1303386 - RNA, 21 nt, Mycobacterium tuberculosis H37Rv
cgcggcugugcccgaucagcc

SEQ ID NO: 1303387 - RNA, 13 nt, Mycobacterium tuberculosis H37Rv
cgcgggaucggug

SEQ ID NO: 1303388 - RNA, 18 nt, Mycobacterium tuberculosis H37Rv
cgcggcugcgucgucugc

SEQ ID NO: 1303389 - RNA, 19 nt, Mycobacterium tuberculosis H37Rv
cgcggcugccgucuccugg

SEQ ID NO: 1303390 - RNA, 16 nt, Mycobacterium tuberculosis H37Rv
cgcggcugccagaaug

SEQ ID NO: 1303391 - RNA, 23 nt, Mycobacterium tuberculosis H37Rv
cgcggcuccguuguccagcgcga

SEQ ID NO: 1303392 - RNA, 15 nt, Mycobacterium tuberculosis H37Rv
cgcggcguaggcguu

SEQ ID NO: 1303393 - RNA, 18 nt, Mycobacterium tuberculosis H37Rv
cgcggcuaggccaagccg

SEQ ID NO: 1303394 - RNA, 18 nt, Mycobacterium tuberculosis H37Rv
cgcugggugaccaggaag

SEQ ID NO: 1303395 - RNA, 19 nt, Mycobacterium tuberculosis H37Rv
cgcugguauagcucacggu

SEQ ID NO: 1303396 - RNA, 21 nt, Mycobacterium tuberculosis H37Rv
cgcugggcgcgcucaucgacc

SEQ ID NO: 1303397 - RNA, 15 nt, Mycobacterium tuberculosis H37Rv
cgcugggccgaccgc

SEQ ID NO: 1303398 - RNA, 16 nt, Mycobacterium tuberculosis H37Rv
cgcuggcucaucgaag

SEQ ID NO: 1303399 - RNA, 12 nt, Mycobacterium tuberculosis H37Rv
cgcuggcgucgu

SEQ ID NO: 1303400 - RNA, 21 nt, Mycobacterium tuberculosis H37Rv
cgcuggcgggcgaucucggcg

SEQ ID NO: 1303401 - RNA, 16 nt, Mycobacterium tuberculosis H37Rv
cgcugggcccaucgcg

SEQ ID NO: 1303402 - RNA, 18 nt, Mycobacterium tuberculosis H37Rv
cgcugggaaaucccgacc

SEQ ID NO: 1303403 - RNA, 16 nt, Mycobacterium tuberculosis H37Rv
cgcuggcugacaccga

SEQ ID NO: 1303404 - RNA, 14 nt, Mycobacterium tuberculosis H37Rv
cgcugggacggucg

SEQ ID NO: 1303405 - RNA, 15 nt, Mycobacterium tuberculosis H37Rv
cgcuggccguccggu

SEQ ID NO: 1303406 - RNA, 17 nt, Mycobacterium tuberculosis H37Rv
cgcuggcgccgccggug

SEQ ID NO: 1303407 - RNA, 13 nt, Mycobacterium tuberculosis H37Rv
cgcuggaucgcgu

SEQ ID NO: 1303408 - RNA, 15 nt, Mycobacterium tuberculosis H37Rv
cgcuggcaaguccgg

SEQ ID NO: 1303409 - RNA, 23 nt, Mycobacterium tuberculosis H37Rv
cgcuggaucgagcuaguucggcg

SEQ ID NO: 1303410 - RNA, 21 nt, Mycobacterium tuberculosis H37Rv
cgcuggaggacccgcuacgac

SEQ ID NO: 1303411 - RNA, 14 nt, Mycobacterium tuberculosis H37Rv
cgcuggcaggccgg

SEQ ID NO: 1303412 - RNA, 15 nt, Mycobacterium tuberculosis H37Rv
cgcuggccauggugg

SEQ ID NO: 1303413 - RNA, 20 nt, Mycobacterium tuberculosis H37Rv
cgcuggcccgccagaacggc

SEQ ID NO: 1303414 - RNA, 13 nt, Mycobacterium tuberculosis H37Rv
cgcuggacggcgg

SEQ ID NO: 1303415 - RNA, 23 nt, Mycobacterium tuberculosis H37Rv
cgcuggaccugaugagcucaccg

SEQ ID NO: 1303416 - RNA, 19 nt, Mycobacterium tuberculosis H37Rv
cgcuggaccgggucgggca

SEQ ID NO: 1303417 - RNA, 21 nt, Mycobacterium tuberculosis H37Rv
cgcuggaacuuggcgucgaca

SEQ ID NO: 1303418 - RNA, 14 nt, Mycobacterium tuberculosis H37Rv
cgcugcuugcgggc

SEQ ID NO: 1303419 - RNA, 14 nt, Mycobacterium tuberculosis H37Rv
cgcugcugucgauu

SEQ ID NO: 1303420 - RNA, 15 nt, Mycobacterium tuberculosis H37Rv
cgcugcugccgcacc

SEQ ID NO: 1303421 - RNA, 13 nt, Mycobacterium tuberculosis H37Rv
cgcugcgcgacga

SEQ ID NO: 1303422 - RNA, 15 nt, Mycobacterium tuberculosis H37Rv
cgcugcgcgacugau

SEQ ID NO: 1303423 - RNA, 20 nt, Mycobacterium tuberculosis H37Rv
cgcugcggcgugccgggugg

SEQ ID NO: 1303424 - RNA, 16 nt, Mycobacterium tuberculosis H37Rv
cgcugcucuggacggu

SEQ ID NO: 1303425 - RNA, 17 nt, Mycobacterium tuberculosis H37Rv
cgcugcugaacaaccag

SEQ ID NO: 1303426 - RNA, 15 nt, Mycobacterium tuberculosis H37Rv
cgcugcgggucccaa

SEQ ID NO: 1303427 - RNA, 20 nt, Mycobacterium tuberculosis H37Rv
cgcugcgaugcugaucaccg

SEQ ID NO: 1303428 - RNA, 17 nt, Mycobacterium tuberculosis H37Rv
cgcugcgacuggccguc

SEQ ID NO: 1303429 - RNA, 18 nt, Mycobacterium tuberculosis H37Rv
cgcugcgaugcugaucac

SEQ ID NO: 1303430 - RNA, 13 nt, Mycobacterium tuberculosis H37Rv
cgcugcgaucacc

SEQ ID NO: 1303431 - RNA, 16 nt, Mycobacterium tuberculosis H37Rv
cgcugccgcugcgcgu

SEQ ID NO: 1303432 - RNA, 18 nt, Mycobacterium tuberculosis H37Rv
cgcugccaguucuuggcg

SEQ ID NO: 1303433 - RNA, 13 nt, Mycobacterium tuberculosis H37Rv
cgcugccagcggc

SEQ ID NO: 1303434 - RNA, 20 nt, Mycobacterium tuberculosis H37Rv
cgcugccagggugcgccggu

SEQ ID NO: 1303435 - RNA, 21 nt, Mycobacterium tuberculosis H37Rv
cgcugcccaaaagcgcggcaa

SEQ ID NO: 1303436 - RNA, 23 nt, Mycobacterium tuberculosis H37Rv
cgcugccagcauugacccgacga

SEQ ID NO: 1303437 - RNA, 21 nt, Mycobacterium tuberculosis H37Rv
cgcugccauugccugggcgac

SEQ ID NO: 1303438 - RNA, 13 nt, Mycobacterium tuberculosis H37Rv
cgcugccagccgu

SEQ ID NO: 1303439 - RNA, 19 nt, Mycobacterium tuberculosis H37Rv
cgcugccacuagcauuguc

SEQ ID NO: 1303440 - RNA, 16 nt, Mycobacterium tuberculosis H37Rv
cgcugccaauccgauc

SEQ ID NO: 1303441 - RNA, 13 nt, Mycobacterium tuberculosis H37Rv
cgcugccgcccuu

SEQ ID NO: 1303442 - RNA, 16 nt, Mycobacterium tuberculosis H37Rv
cgcugccgagcccacg

SEQ ID NO: 1303443 - RNA, 21 nt, Mycobacterium tuberculosis H37Rv
cgcugccgaagcggccaccgc

SEQ ID NO: 1303444 - RNA, 15 nt, Mycobacterium tuberculosis H37Rv
cgcugcccgcggugu

SEQ ID NO: 1303445 - RNA, 19 nt, Mycobacterium tuberculosis H37Rv
cgcugcccaucacacccgg

SEQ ID NO: 1303446 - RNA, 18 nt, Mycobacterium tuberculosis H37Rv
cgcugcccgccagcccau

SEQ ID NO: 1303447 - RNA, 16 nt, Mycobacterium tuberculosis H37Rv
cgcugcccaugcggca

SEQ ID NO: 1303448 - RNA, 21 nt, Mycobacterium tuberculosis H37Rv
cgcugauauccggaaccgguc

SEQ ID NO: 1303449 - RNA, 19 nt, Mycobacterium tuberculosis H37Rv
cgcugaucagauccucgac

SEQ ID NO: 1303450 - RNA, 14 nt, Mycobacterium tuberculosis H37Rv
cgcugauccacgau

SEQ ID NO: 1303451 - RNA, 13 nt, Mycobacterium tuberculosis H37Rv
cgcugaucucggu

SEQ ID NO: 1303452 - RNA, 16 nt, Mycobacterium tuberculosis H37Rv
cgcugauaguggcgcg

SEQ ID NO: 1303453 - RNA, 18 nt, Mycobacterium tuberculosis H37Rv
cgcuccuccggcaccaac

SEQ ID NO: 1303454 - RNA, 14 nt, Mycobacterium tuberculosis H37Rv
cgcuccuccggcac

SEQ ID NO: 1303455 - RNA, 16 nt, Mycobacterium tuberculosis H37Rv
cgcucgaacuccccgg

SEQ ID NO: 1303456 - RNA, 14 nt, Mycobacterium tuberculosis H37Rv
cgcucgaccagacg

SEQ ID NO: 1303457 - RNA, 18 nt, Mycobacterium tuberculosis H37Rv
cgcucgaccagacgcugc

SEQ ID NO: 1303458 - RNA, 21 nt, Mycobacterium tuberculosis H37Rv
cgcugcaaccgccggugccga

SEQ ID NO: 1303459 - RNA, 20 nt, Mycobacterium tuberculosis H37Rv
cgcugaucuggggcaccacg

SEQ ID NO: 1303460 - RNA, 16 nt, Mycobacterium tuberculosis H37Rv
cgcugaugcaucccaa

SEQ ID NO: 1303461 - RNA, 21 nt, Mycobacterium tuberculosis H37Rv
cgcugaucuuccccucggccg

SEQ ID NO: 1303462 - RNA, 22 nt, Mycobacterium tuberculosis H37Rv
cgcugcagauggaaccucggcg

SEQ ID NO: 1303463 - RNA, 15 nt, Mycobacterium tuberculosis H37Rv
cgcugcacgacaucg

SEQ ID NO: 1303464 - RNA, 16 nt, Mycobacterium tuberculosis H37Rv
cgcugcacguggccac

SEQ ID NO: 1303465 - RNA, 19 nt, Mycobacterium tuberculosis H37Rv
cgcugcagcucacgacugg

SEQ ID NO: 1303466 - RNA, 22 nt, Mycobacterium tuberculosis H37Rv
cgcugcauccgcagcaccaagg

SEQ ID NO: 1303467 - RNA, 15 nt, Mycobacterium tuberculosis H37Rv
cgcuuccaucgccac

SEQ ID NO: 1303468 - RNA, 15 nt, Mycobacterium tuberculosis H37Rv
cgcuuccucguaggc

SEQ ID NO: 1303469 - RNA, 20 nt, Mycobacterium tuberculosis H37Rv
cgcuucgcaagucauccagg

SEQ ID NO: 1303470 - RNA, 19 nt, Mycobacterium tuberculosis H37Rv
cgcuucgccacaccaugau

SEQ ID NO: 1303471 - RNA, 18 nt, Mycobacterium tuberculosis H37Rv
cgcuucacagccaccagc

SEQ ID NO: 1303472 - RNA, 20 nt, Mycobacterium tuberculosis H37Rv
cgcuucgucggccggcaccc

SEQ ID NO: 1303473 - RNA, 17 nt, Mycobacterium tuberculosis H37Rv
cgcuucggcggucgccg

SEQ ID NO: 1303474 - RNA, 23 nt, Mycobacterium tuberculosis H37Rv
cgcuugccccgccgagcaccggg

SEQ ID NO: 1303475 - RNA, 18 nt, Mycobacterium tuberculosis H37Rv
cgcuugccccgccgagca

SEQ ID NO: 1303476 - RNA, 17 nt, Mycobacterium tuberculosis H37Rv
cgcuugccgcugagccc

SEQ ID NO: 1303477 - RNA, 19 nt, Mycobacterium tuberculosis H37Rv
cgcuugcgaccccggcugc

SEQ ID NO: 1303478 - RNA, 13 nt, Mycobacterium tuberculosis H37Rv
cgcuugcaccagg

SEQ ID NO: 1303479 - RNA, 15 nt, Mycobacterium tuberculosis H37Rv
cgcuugaugccggcc

SEQ ID NO: 1303480 - RNA, 18 nt, Mycobacterium tuberculosis H37Rv
cgcuugaaagcgugaagu

SEQ ID NO: 1303481 - RNA, 17 nt, Mycobacterium tuberculosis H37Rv
cgcugucgcccucgauc

SEQ ID NO: 1303482 - RNA, 17 nt, Mycobacterium tuberculosis H37Rv
cgcugucguaccgcucg

SEQ ID NO: 1303483 - RNA, 16 nt, Mycobacterium tuberculosis H37Rv
cgcugugggucgaucc

SEQ ID NO: 1303484 - RNA, 20 nt, Mycobacterium tuberculosis H37Rv
cgcuguggucuucaucgccg

SEQ ID NO: 1303485 - RNA, 17 nt, Mycobacterium tuberculosis H37Rv
cgcuguugccaucgacg

SEQ ID NO: 1303486 - RNA, 14 nt, Mycobacterium tuberculosis H37Rv
cgcuguuccucgag

SEQ ID NO: 1303487 - RNA, 13 nt, Mycobacterium tuberculosis H37Rv
cgcuguuggccgg

SEQ ID NO: 1303488 - RNA, 16 nt, Mycobacterium tuberculosis H37Rv
cgcuguuggccggucc

SEQ ID NO: 1303489 - RNA, 15 nt, Mycobacterium tuberculosis H37Rv
cgcuguccgacuugu

SEQ ID NO: 1303490 - RNA, 20 nt, Mycobacterium tuberculosis H37Rv
cgcuggucuuucacguagcg

SEQ ID NO: 1303491 - RNA, 22 nt, Mycobacterium tuberculosis H37Rv
cgcuggugaaccacucggugau

SEQ ID NO: 1303492 - RNA, 19 nt, Mycobacterium tuberculosis H37Rv
cgcuggucgcgguggcggc

SEQ ID NO: 1303493 - RNA, 19 nt, Mycobacterium tuberculosis H37Rv
cgcuggucggagaccagcg

SEQ ID NO: 1303494 - RNA, 14 nt, Mycobacterium tuberculosis H37Rv
cgcuggugcgccca

SEQ ID NO: 1303495 - RNA, 20 nt, Mycobacterium tuberculosis H37Rv
cgcuggugcgccacgccacc

SEQ ID NO: 1303496 - RNA, 15 nt, Mycobacterium tuberculosis H37Rv
cgcuggugcgccacg

SEQ ID NO: 1303497 - RNA, 18 nt, Mycobacterium tuberculosis H37Rv
cgcuguaagcaugccguu

SEQ ID NO: 1303498 - RNA, 14 nt, Mycobacterium tuberculosis H37Rv
cgcugguggugauu

SEQ ID NO: 1303499 - RNA, 19 nt, Mycobacterium tuberculosis H37Rv
cgcugguggucagcaccca

SEQ ID NO: 1303500 - RNA, 14 nt, Mycobacterium tuberculosis H37Rv
cgcugguggucagc

SEQ ID NO: 1303501 - RNA, 18 nt, Mycobacterium tuberculosis H37Rv
cggaaccgguaucgccaa

SEQ ID NO: 1303502 - RNA, 17 nt, Mycobacterium tuberculosis H37Rv
cggaacgccggcaccga

SEQ ID NO: 1303503 - RNA, 19 nt, Mycobacterium tuberculosis H37Rv
cggaaccaguugacgaaga

SEQ ID NO: 1303504 - RNA, 19 nt, Mycobacterium tuberculosis H37Rv
cggaacccccagcugcagg

SEQ ID NO: 1303505 - RNA, 23 nt, Mycobacterium tuberculosis H37Rv
cggaacggguuggcgaucaucag

SEQ ID NO: 1303506 - RNA, 23 nt, Mycobacterium tuberculosis H37Rv
cggaaccguuugacgcgcucgcg

SEQ ID NO: 1303507 - RNA, 19 nt, Mycobacterium tuberculosis H37Rv
cggaaccggcgugcagcac

SEQ ID NO: 1303508 - RNA, 23 nt, Mycobacterium tuberculosis H37Rv
cggaagcccuuguagcacaccga

SEQ ID NO: 1303509 - RNA, 21 nt, Mycobacterium tuberculosis H37Rv
cggaagaccgcgggaccuucg

SEQ ID NO: 1303510 - RNA, 14 nt, Mycobacterium tuberculosis H37Rv
cggaagaagcagua

SEQ ID NO: 1303511 - RNA, 23 nt, Mycobacterium tuberculosis H37Rv
cggaauccccccugucgccgaug

SEQ ID NO: 1303512 - RNA, 21 nt, Mycobacterium tuberculosis H37Rv
cggaaucgguuucgaccugcg

SEQ ID NO: 1303513 - RNA, 20 nt, Mycobacterium tuberculosis H37Rv
cggaaucucuucggcggugc

SEQ ID NO: 1303514 - RNA, 16 nt, Mycobacterium tuberculosis H37Rv
cggaaucgucggcgcg

SEQ ID NO: 1303515 - RNA, 21 nt, Mycobacterium tuberculosis H37Rv
cggaauacccggcccauuguc

SEQ ID NO: 1303516 - RNA, 16 nt, Mycobacterium tuberculosis H37Rv
cggaauacccggccca

SEQ ID NO: 1303517 - RNA, 18 nt, Mycobacterium tuberculosis H37Rv
cggaaguacuccauggca

SEQ ID NO: 1303518 - RNA, 18 nt, Mycobacterium tuberculosis H37Rv
cggacaauuccgcuugcu

SEQ ID NO: 1303519 - RNA, 20 nt, Mycobacterium tuberculosis H37Rv
cggacaacacggcgaaccgg

SEQ ID NO: 1303520 - RNA, 18 nt, Mycobacterium tuberculosis H37Rv
cggacaaaagaacgccag

SEQ ID NO: 1303521 - RNA, 23 nt, Mycobacterium tuberculosis H37Rv
cggaauguugcgagugagcucag

SEQ ID NO: 1303522 - RNA, 21 nt, Mycobacterium tuberculosis H37Rv
cggaauguagccgacuucguc

SEQ ID NO: 1303523 - RNA, 18 nt, Mycobacterium tuberculosis H37Rv
cggaauggaggccgccga

SEQ ID NO: 1303524 - RNA, 14 nt, Mycobacterium tuberculosis H37Rv
cgcuuugcacagcg

SEQ ID NO: 1303525 - RNA, 18 nt, Mycobacterium tuberculosis H37Rv
cgcuuugaauugcgcgcc

SEQ ID NO: 1303526 - RNA, 23 nt, Mycobacterium tuberculosis H37Rv
cgcuuggcguauccuugcgacgu

SEQ ID NO: 1303527 - RNA, 12 nt, Mycobacterium tuberculosis H37Rv
cgcuugcgcggc

SEQ ID NO: 1303528 - RNA, 18 nt, Mycobacterium tuberculosis H37Rv
cgcuuggccuaugcugcc

SEQ ID NO: 1303529 - RNA, 13 nt, Mycobacterium tuberculosis H37Rv
cggaacacgaugc

SEQ ID NO: 1303530 - RNA, 20 nt, Mycobacterium tuberculosis H37Rv
cggaacaccgacgacaccag

SEQ ID NO: 1303531 - RNA, 21 nt, Mycobacterium tuberculosis H37Rv
cgcuuugggcugccguuagcu

SEQ ID NO: 1303532 - RNA, 14 nt, Mycobacterium tuberculosis H37Rv
cgcuuuggcguucg

SEQ ID NO: 1303533 - RNA, 14 nt, Mycobacterium tuberculosis H37Rv
cggaaaaccgcacc

SEQ ID NO: 1303534 - RNA, 22 nt, Mycobacterium tuberculosis H37Rv
cgggcggaugcuguugacccgu

SEQ ID NO: 1303535 - RNA, 20 nt, Mycobacterium tuberculosis H37Rv
cgggcggcauccugcacgac

SEQ ID NO: 1303536 - RNA, 16 nt, Mycobacterium tuberculosis H37Rv
cgggcgggagucgucg

SEQ ID NO: 1303537 - RNA, 20 nt, Mycobacterium tuberculosis H37Rv
cgggcggcgucgcggaucug

SEQ ID NO: 1303538 - RNA, 13 nt, Mycobacterium tuberculosis H37Rv
cgggcggcgucgg

SEQ ID NO: 1303539 - RNA, 19 nt, Mycobacterium tuberculosis H37Rv
cgggcggaaagcccgucgg

SEQ ID NO: 1303540 - RNA, 20 nt, Mycobacterium tuberculosis H37Rv
cgggcggaacgccggcaccg

SEQ ID NO: 1303541 - RNA, 18 nt, Mycobacterium tuberculosis H37Rv
cgggcggaacgccggcac

SEQ ID NO: 1303542 - RNA, 14 nt, Mycobacterium tuberculosis H37Rv
cgggcggaucgccg

SEQ ID NO: 1303543 - RNA, 13 nt, Mycobacterium tuberculosis H37Rv
cgggcggaggccg

SEQ ID NO: 1303544 - RNA, 17 nt, Mycobacterium tuberculosis H37Rv
cgggcgccgcagcgcuc

SEQ ID NO: 1303545 - RNA, 12 nt, Mycobacterium tuberculosis H37Rv
cgggcgccgcua

SEQ ID NO: 1303546 - RNA, 15 nt, Mycobacterium tuberculosis H37Rv
cgggcgccggaacga

SEQ ID NO: 1303547 - RNA, 17 nt, Mycobacterium tuberculosis H37Rv
cgggcgccccaccggcc

SEQ ID NO: 1303548 - RNA, 14 nt, Mycobacterium tuberculosis H37Rv
cgggcgcccaugcu

SEQ ID NO: 1303549 - RNA, 18 nt, Mycobacterium tuberculosis H37Rv
cgggcgccaacgggcugc

SEQ ID NO: 1303550 - RNA, 15 nt, Mycobacterium tuberculosis H37Rv
cgggcgucacggugc

SEQ ID NO: 1303551 - RNA, 17 nt, Mycobacterium tuberculosis H37Rv
cgggcgugguaucgccg

SEQ ID NO: 1303552 - RNA, 14 nt, Mycobacterium tuberculosis H37Rv
cgggcguggugagc

SEQ ID NO: 1303553 - RNA, 18 nt, Mycobacterium tuberculosis H37Rv
cgggcucgcauucggcga

SEQ ID NO: 1303554 - RNA, 22 nt, Mycobacterium tuberculosis H37Rv
cgggcucgcauguucuccacgc

SEQ ID NO: 1303555 - RNA, 13 nt, Mycobacterium tuberculosis H37Rv
cgggcucgcaugu

SEQ ID NO: 1303556 - RNA, 22 nt, Mycobacterium tuberculosis H37Rv
cgggcguuguuaucgaagcccg

SEQ ID NO: 1303557 - RNA, 14 nt, Mycobacterium tuberculosis H37Rv
cgggcgugugcagu

SEQ ID NO: 1303558 - RNA, 20 nt, Mycobacterium tuberculosis H37Rv
cgggcgggagucgucgagcu

SEQ ID NO: 1303559 - RNA, 13 nt, Mycobacterium tuberculosis H37Rv
cgggcgggcuggu

SEQ ID NO: 1303560 - RNA, 18 nt, Mycobacterium tuberculosis H37Rv
cgggcgggauccacccag

SEQ ID NO: 1303561 - RNA, 16 nt, Mycobacterium tuberculosis H37Rv
cgggcgguaaucgcga

SEQ ID NO: 1303562 - RNA, 17 nt, Mycobacterium tuberculosis H37Rv
cgggcgggugaacgcgu

SEQ ID NO: 1303563 - RNA, 19 nt, Mycobacterium tuberculosis H37Rv
cgggcggugggcagcagcu

SEQ ID NO: 1303564 - RNA, 17 nt, Mycobacterium tuberculosis H37Rv
cgggcgucaagccacac

SEQ ID NO: 1303565 - RNA, 19 nt, Mycobacterium tuberculosis H37Rv
cgggcggugcacaccgucg

SEQ ID NO: 1303566 - RNA, 13 nt, Mycobacterium tuberculosis H37Rv
cgggcggucgaga

SEQ ID NO: 1303567 - RNA, 17 nt, Mycobacterium tuberculosis H37Rv
cgggccuccugcuggcc

SEQ ID NO: 1303568 - RNA, 18 nt, Mycobacterium tuberculosis H37Rv
cgggcgaauccggcgggu

SEQ ID NO: 1303569 - RNA, 12 nt, Mycobacterium tuberculosis H37Rv
cgggccugcacg

SEQ ID NO: 1303570 - RNA, 14 nt, Mycobacterium tuberculosis H37Rv
cgggccucggcgcc

SEQ ID NO: 1303571 - RNA, 20 nt, Mycobacterium tuberculosis H37Rv
cgggcgcaagcagcccgggu

SEQ ID NO: 1303572 - RNA, 20 nt, Mycobacterium tuberculosis H37Rv
cgggcgcaacgagagcggcu

SEQ ID NO: 1303573 - RNA, 22 nt, Mycobacterium tuberculosis H37Rv
cgggcgcaacgggacgucaccg

SEQ ID NO: 1303574 - RNA, 16 nt, Mycobacterium tuberculosis H37Rv
cgggcgaugcugggcg

SEQ ID NO: 1303575 - RNA, 21 nt, Mycobacterium tuberculosis H37Rv
cgggcgaugcgggccgccagg

SEQ ID NO: 1303576 - RNA, 16 nt, Mycobacterium tuberculosis H37Rv
cgggcgaugacccgga

SEQ ID NO: 1303577 - RNA, 16 nt, Mycobacterium tuberculosis H37Rv
cgggcgauggccaguu

SEQ ID NO: 1303578 - RNA, 14 nt, Mycobacterium tuberculosis H37Rv
cgggcgauggccag

SEQ ID NO: 1303579 - RNA, 22 nt, Mycobacterium tuberculosis H37Rv
cgggcgagaacccacgcaugca

SEQ ID NO: 1303580 - RNA, 14 nt, Mycobacterium tuberculosis H37Rv
cgggcgacgguuuc

SEQ ID NO: 1303581 - RNA, 23 nt, Mycobacterium tuberculosis H37Rv
cgggcgaccugcggacccaccgc

SEQ ID NO: 1303582 - RNA, 20 nt, Mycobacterium tuberculosis H37Rv
cgggcgaccuccggaaucgc

SEQ ID NO: 1303583 - RNA, 12 nt, Mycobacterium tuberculosis H37Rv
cgggcgaccugc

SEQ ID NO: 1303584 - RNA, 22 nt, Mycobacterium tuberculosis H37Rv
cgggcgaccaacacgucgagca

SEQ ID NO: 1303585 - RNA, 15 nt, Mycobacterium tuberculosis H37Rv
cgggccggccgagcg

SEQ ID NO: 1303586 - RNA, 19 nt, Mycobacterium tuberculosis H37Rv
cgggccggcgagcucgacg

SEQ ID NO: 1303587 - RNA, 14 nt, Mycobacterium tuberculosis H37Rv
cgggccgcucggua

SEQ ID NO: 1303588 - RNA, 19 nt, Mycobacterium tuberculosis H37Rv
cgggccgcguagugcuccg

SEQ ID NO: 1303589 - RNA, 14 nt, Mycobacterium tuberculosis H37Rv
cgggccgccgagcu

SEQ ID NO: 1303590 - RNA, 19 nt, Mycobacterium tuberculosis H37Rv
cgggccgccgagcucgguc

SEQ ID NO: 1303591 - RNA, 16 nt, Mycobacterium tuberculosis H37Rv
cgggccgcacggucag

SEQ ID NO: 1303592 - RNA, 18 nt, Mycobacterium tuberculosis H37Rv
cgggccgcacggucagcg

SEQ ID NO: 1303593 - RNA, 21 nt, Mycobacterium tuberculosis H37Rv
cgggccgcacggucagcgcgc

SEQ ID NO: 1303594 - RNA, 17 nt, Mycobacterium tuberculosis H37Rv
cgggcccgucgucgucg

SEQ ID NO: 1303595 - RNA, 13 nt, Mycobacterium tuberculosis H37Rv
cgggcccgucguc

SEQ ID NO: 1303596 - RNA, 21 nt, Mycobacterium tuberculosis H37Rv
cgggccagcacccgcuccagc

SEQ ID NO: 1303597 - RNA, 16 nt, Mycobacterium tuberculosis H37Rv
cgggccaaagccguca

SEQ ID NO: 1303598 - RNA, 16 nt, Mycobacterium tuberculosis H37Rv
cgggcccgcguucucg

SEQ ID NO: 1303599 - RNA, 17 nt, Mycobacterium tuberculosis H37Rv
cgggccagcacccgcuc

SEQ ID NO: 1303600 - RNA, 16 nt, Mycobacterium tuberculosis H37Rv
cgggccaccaccgagu

SEQ ID NO: 1303601 - RNA, 15 nt, Mycobacterium tuberculosis H37Rv
cgggccaccgcuguc

SEQ ID NO: 1303602 - RNA, 22 nt, Mycobacterium tuberculosis H37Rv
cgggccaccguaaacagcgcgc

SEQ ID NO: 1303603 - RNA, 16 nt, Mycobacterium tuberculosis H37Rv
cgggccaaugccguug

SEQ ID NO: 1303604 - RNA, 17 nt, Mycobacterium tuberculosis H37Rv
cgggcaccaaccugagc

SEQ ID NO: 1303605 - RNA, 13 nt, Mycobacterium tuberculosis H37Rv
cgggcaccaauac

SEQ ID NO: 1303606 - RNA, 18 nt, Mycobacterium tuberculosis H37Rv
cgggcaccgcgcgcucca

SEQ ID NO: 1303607 - RNA, 13 nt, Mycobacterium tuberculosis H37Rv
cgggcaccugguc

SEQ ID NO: 1303608 - RNA, 15 nt, Mycobacterium tuberculosis H37Rv
cgggcaccuggucgg

SEQ ID NO: 1303609 - RNA, 22 nt, Mycobacterium tuberculosis H37Rv
cgggcaccgucggaacugacca

SEQ ID NO: 1303610 - RNA, 20 nt, Mycobacterium tuberculosis H37Rv
cgggcaccgucggaacugac

SEQ ID NO: 1303611 - RNA, 12 nt, Mycobacterium tuberculosis H37Rv
cgggcaccgucg

SEQ ID NO: 1303612 - RNA, 23 nt, Mycobacterium tuberculosis H37Rv
cgggcacgaacaucagaucgccg

SEQ ID NO: 1303613 - RNA, 18 nt, Mycobacterium tuberculosis H37Rv
cgggcaccuggucggccg

SEQ ID NO: 1303614 - RNA, 18 nt, Mycobacterium tuberculosis H37Rv
cgggcagggaccgcaucg

SEQ ID NO: 1303615 - RNA, 14 nt, Mycobacterium tuberculosis H37Rv
cgggcaugaucccc

SEQ ID NO: 1303616 - RNA, 14 nt, Mycobacterium tuberculosis H37Rv
cgggcagguccgcc

SEQ ID NO: 1303617 - RNA, 20 nt, Mycobacterium tuberculosis H37Rv
cgggcaugauccccguugac

SEQ ID NO: 1303618 - RNA, 20 nt, Mycobacterium tuberculosis H37Rv
cgggcaggagcagcacgucg

SEQ ID NO: 1303619 - RNA, 14 nt, Mycobacterium tuberculosis H37Rv
cgggcagcugggca

SEQ ID NO: 1303620 - RNA, 21 nt, Mycobacterium tuberculosis H37Rv
cgggcagcugguaggucaccg

SEQ ID NO: 1303621 - RNA, 22 nt, Mycobacterium tuberculosis H37Rv
cgggaucgcccaggcgcgacgu

SEQ ID NO: 1303622 - RNA, 17 nt, Mycobacterium tuberculosis H37Rv
cgggaucgacgucgcgg

SEQ ID NO: 1303623 - RNA, 16 nt, Mycobacterium tuberculosis H37Rv
cgggaucgccgagacc

SEQ ID NO: 1303624 - RNA, 18 nt, Mycobacterium tuberculosis H37Rv
cgggaucgccguccagca

SEQ ID NO: 1303625 - RNA, 12 nt, Mycobacterium tuberculosis H37Rv
cgggaucggccg

SEQ ID NO: 1303626 - RNA, 17 nt, Mycobacterium tuberculosis H37Rv
cgggaucguuggccagu

SEQ ID NO: 1303627 - RNA, 21 nt, Mycobacterium tuberculosis H37Rv
cgggaucgguggcggcacgca

SEQ ID NO: 1303628 - RNA, 18 nt, Mycobacterium tuberculosis H37Rv
cgggaucgucggcaacca

SEQ ID NO: 1303629 - RNA, 17 nt, Mycobacterium tuberculosis H37Rv
cgggaugaagccaccca

SEQ ID NO: 1303630 - RNA, 20 nt, Mycobacterium tuberculosis H37Rv
cgggcaacgccucgagcaac

SEQ ID NO: 1303631 - RNA, 13 nt, Mycobacterium tuberculosis H37Rv
cgggcaaccugcc

SEQ ID NO: 1303632 - RNA, 20 nt, Mycobacterium tuberculosis H37Rv
cgggcaaccggagaucccgg

SEQ ID NO: 1303633 - RNA, 16 nt, Mycobacterium tuberculosis H37Rv
cgggcaaccgaugacg

SEQ ID NO: 1303634 - RNA, 12 nt, Mycobacterium tuberculosis H37Rv
cgggcaaccgau

SEQ ID NO: 1303635 - RNA, 20 nt, Mycobacterium tuberculosis H37Rv
cgggcaaccacaucaccggc

SEQ ID NO: 1303636 - RNA, 20 nt, Mycobacterium tuberculosis H37Rv
cgggcaacacgauaucgggc

SEQ ID NO: 1303637 - RNA, 18 nt, Mycobacterium tuberculosis H37Rv
cgggcaaaucaagcacag

SEQ ID NO: 1303638 - RNA, 20 nt, Mycobacterium tuberculosis H37Rv
cgggaguccgguagcugugg

SEQ ID NO: 1303639 - RNA, 22 nt, Mycobacterium tuberculosis H37Rv
cgggaguccgguagcuguggug

SEQ ID NO: 1303640 - RNA, 13 nt, Mycobacterium tuberculosis H37Rv
cgggaggcguugc

SEQ ID NO: 1303641 - RNA, 13 nt, Mycobacterium tuberculosis H37Rv
cgggagucgucga

SEQ ID NO: 1303642 - RNA, 15 nt, Mycobacterium tuberculosis H37Rv
cgggagcgacgucgg

SEQ ID NO: 1303643 - RNA, 18 nt, Mycobacterium tuberculosis H37Rv
cgggagcgacgucgguga

SEQ ID NO: 1303644 - RNA, 21 nt, Mycobacterium tuberculosis H37Rv
cgggaccgugacguaucgccg

SEQ ID NO: 1303645 - RNA, 18 nt, Mycobacterium tuberculosis H37Rv
cgggagcggcugcggcaa

SEQ ID NO: 1303646 - RNA, 20 nt, Mycobacterium tuberculosis H37Rv
cgggagcgugggcgugagcg

SEQ ID NO: 1303647 - RNA, 17 nt, Mycobacterium tuberculosis H37Rv
cgggaggaugucgagcc

SEQ ID NO: 1303648 - RNA, 21 nt, Mycobacterium tuberculosis H37Rv
cgggaggccggcuaccgcgcu

SEQ ID NO: 1303649 - RNA, 18 nt, Mycobacterium tuberculosis H37Rv
cggcuucuugaccacgaa

SEQ ID NO: 1303650 - RNA, 13 nt, Mycobacterium tuberculosis H37Rv
cggcuugagccgc

SEQ ID NO: 1303651 - RNA, 20 nt, Mycobacterium tuberculosis H37Rv
cgggaccauagucgccgucg

SEQ ID NO: 1303652 - RNA, 20 nt, Mycobacterium tuberculosis H37Rv
cgggacccgugagcucgucg

SEQ ID NO: 1303653 - RNA, 12 nt, Mycobacterium tuberculosis H37Rv
cggcuugccgcc

SEQ ID NO: 1303654 - RNA, 17 nt, Mycobacterium tuberculosis H37Rv
cgggacagcagccggau

SEQ ID NO: 1303655 - RNA, 17 nt, Mycobacterium tuberculosis H37Rv
cggcucccauggcgcga

SEQ ID NO: 1303656 - RNA, 13 nt, Mycobacterium tuberculosis H37Rv
cggcuccaccggg

SEQ ID NO: 1303657 - RNA, 13 nt, Mycobacterium tuberculosis H37Rv
cggcucaccgauc

SEQ ID NO: 1303658 - RNA, 19 nt, Mycobacterium tuberculosis H37Rv
cggcucagcgugcgcuggc

SEQ ID NO: 1303659 - RNA, 16 nt, Mycobacterium tuberculosis H37Rv
cggcuagcaacggguc

SEQ ID NO: 1303660 - RNA, 22 nt, Mycobacterium tuberculosis H37Rv
cggcuagcugugcuucguuguc

SEQ ID NO: 1303661 - RNA, 17 nt, Mycobacterium tuberculosis H37Rv
cggcuaggccagcacgg

SEQ ID NO: 1303662 - RNA, 24 nt, Mycobacterium tuberculosis H37Rv
cggcuagucaagucuggcugagca

SEQ ID NO: 1303663 - RNA, 13 nt, Mycobacterium tuberculosis H37Rv
cggcucaccgaac

SEQ ID NO: 1303664 - RNA, 16 nt, Mycobacterium tuberculosis H37Rv
cggcucacagcacagc

SEQ ID NO: 1303665 - RNA, 21 nt, Mycobacterium tuberculosis H37Rv
cggcucaaggacgcaccgcca

SEQ ID NO: 1303666 - RNA, 23 nt, Mycobacterium tuberculosis H37Rv
cggcucaaggacgcaccgccagu

SEQ ID NO: 1303667 - RNA, 20 nt, Mycobacterium tuberculosis H37Rv
cggcucaaccucuggcggcg

SEQ ID NO: 1303668 - RNA, 18 nt, Mycobacterium tuberculosis H37Rv
cggcuauggguucgcggu

SEQ ID NO: 1303669 - RNA, 19 nt, Mycobacterium tuberculosis H37Rv
cggcuccgccguugccgcc

SEQ ID NO: 1303670 - RNA, 14 nt, Mycobacterium tuberculosis H37Rv
cggcuccgccguug

SEQ ID NO: 1303671 - RNA, 17 nt, Mycobacterium tuberculosis H37Rv
cggcuccgauuccgaac

SEQ ID NO: 1303672 - RNA, 15 nt, Mycobacterium tuberculosis H37Rv
cggcuccgggacggu

SEQ ID NO: 1303673 - RNA, 22 nt, Mycobacterium tuberculosis H37Rv
cggcuccuccccggcccgcuca

SEQ ID NO: 1303674 - RNA, 22 nt, Mycobacterium tuberculosis H37Rv
cggcucgagucgcagcacgggu

SEQ ID NO: 1303675 - RNA, 17 nt, Mycobacterium tuberculosis H37Rv
cggcucgagcucggcga

SEQ ID NO: 1303676 - RNA, 21 nt, Mycobacterium tuberculosis H37Rv
cggcuccuccgguaucggcga

SEQ ID NO: 1303677 - RNA, 12 nt, Mycobacterium tuberculosis H37Rv
cggcucggcgcu

SEQ ID NO: 1303678 - RNA, 18 nt, Mycobacterium tuberculosis H37Rv
cggcucggcaggugacca

SEQ ID NO: 1303679 - RNA, 14 nt, Mycobacterium tuberculosis H37Rv
cggcucgcgcggga

SEQ ID NO: 1303680 - RNA, 23 nt, Mycobacterium tuberculosis H37Rv
cggcucgcgcgggaaguccgucg

SEQ ID NO: 1303681 - RNA, 23 nt, Mycobacterium tuberculosis H37Rv
cggcucgucgaugucgacgucgc

SEQ ID NO: 1303682 - RNA, 15 nt, Mycobacterium tuberculosis H37Rv
cggcucgucgcucga

SEQ ID NO: 1303683 - RNA, 13 nt, Mycobacterium tuberculosis H37Rv
cggcucguccggg

SEQ ID NO: 1303684 - RNA, 20 nt, Mycobacterium tuberculosis H37Rv
cggcucgggaacuucgccga

SEQ ID NO: 1303685 - RNA, 22 nt, Mycobacterium tuberculosis H37Rv
cggcucgggaacuucgccgaag

SEQ ID NO: 1303686 - RNA, 18 nt, Mycobacterium tuberculosis H37Rv
cggcucgguaagugccuc

SEQ ID NO: 1303687 - RNA, 12 nt, Mycobacterium tuberculosis H37Rv
cggcucggugcg

SEQ ID NO: 1303688 - RNA, 17 nt, Mycobacterium tuberculosis H37Rv
cggcugccagugccgcc

SEQ ID NO: 1303689 - RNA, 17 nt, Mycobacterium tuberculosis H37Rv
cggcugccgcaccaagg

SEQ ID NO: 1303690 - RNA, 14 nt, Mycobacterium tuberculosis H37Rv
cggcugccgcucga

SEQ ID NO: 1303691 - RNA, 13 nt, Mycobacterium tuberculosis H37Rv
cggcugccgcggu

SEQ ID NO: 1303692 - RNA, 24 nt, Mycobacterium tuberculosis H37Rv
cggcugccgucuccuggucaaccg

SEQ ID NO: 1303693 - RNA, 16 nt, Mycobacterium tuberculosis H37Rv
cggcugccgcaccaag

SEQ ID NO: 1303694 - RNA, 18 nt, Mycobacterium tuberculosis H37Rv
cggcugcccaucggugau

SEQ ID NO: 1303695 - RNA, 15 nt, Mycobacterium tuberculosis H37Rv
cggcuuccuccucgg

SEQ ID NO: 1303696 - RNA, 20 nt, Mycobacterium tuberculosis H37Rv
cggcuuccuccucggcgcga

SEQ ID NO: 1303697 - RNA, 18 nt, Mycobacterium tuberculosis H37Rv
cggcuucgacgucggcga

SEQ ID NO: 1303698 - RNA, 15 nt, Mycobacterium tuberculosis H37Rv
cggcuucgccgcgcu

SEQ ID NO: 1303699 - RNA, 20 nt, Mycobacterium tuberculosis H37Rv
cggcuucucgaugaugucga

SEQ ID NO: 1303700 - RNA, 12 nt, Mycobacterium tuberculosis H37Rv
cggcuucggcga

SEQ ID NO: 1303701 - RNA, 20 nt, Mycobacterium tuberculosis H37Rv
cggcugucacgccugccacc

SEQ ID NO: 1303702 - RNA, 16 nt, Mycobacterium tuberculosis H37Rv
cggcugucacgccugc

SEQ ID NO: 1303703 - RNA, 22 nt, Mycobacterium tuberculosis H37Rv
cggcugguguccagccaggcga

SEQ ID NO: 1303704 - RNA, 19 nt, Mycobacterium tuberculosis H37Rv
cggcuggucgcugcugcga

SEQ ID NO: 1303705 - RNA, 17 nt, Mycobacterium tuberculosis H37Rv
cggcuggugccaacugc

SEQ ID NO: 1303706 - RNA, 19 nt, Mycobacterium tuberculosis H37Rv
cggcuggccgcgccucggu

SEQ ID NO: 1303707 - RNA, 21 nt, Mycobacterium tuberculosis H37Rv
cggcuggccgcgccucggucu

SEQ ID NO: 1303708 - RNA, 17 nt, Mycobacterium tuberculosis H37Rv
cggcuggucucuggcgu

SEQ ID NO: 1303709 - RNA, 11 nt, Mycobacterium tuberculosis H37Rv
cggcgucgaaa

SEQ ID NO: 1303710 - RNA, 17 nt, Mycobacterium tuberculosis H37Rv
cggcgucgaccucgcgg

SEQ ID NO: 1303711 - RNA, 12 nt, Mycobacterium tuberculosis H37Rv
cggcgucgaccu

SEQ ID NO: 1303712 - RNA, 15 nt, Mycobacterium tuberculosis H37Rv
cggcgucgacgucgg

SEQ ID NO: 1303713 - RNA, 23 nt, Mycobacterium tuberculosis H37Rv
cggcgucgacggcuccuccggua

SEQ ID NO: 1303714 - RNA, 19 nt, Mycobacterium tuberculosis H37Rv
cggcgucgaagugggugaa

SEQ ID NO: 1303715 - RNA, 18 nt, Mycobacterium tuberculosis H37Rv
cggcgucggccaccgccu

SEQ ID NO: 1303716 - RNA, 13 nt, Mycobacterium tuberculosis H37Rv
cggcgucggcgcc

SEQ ID NO: 1303717 - RNA, 16 nt, Mycobacterium tuberculosis H37Rv
cggcgucggccaccgc

SEQ ID NO: 1303718 - RNA, 13 nt, Mycobacterium tuberculosis H37Rv
cggcgucggccac

SEQ ID NO: 1303719 - RNA, 19 nt, Mycobacterium tuberculosis H37Rv
cggcgucgccgccauugcc

SEQ ID NO: 1303720 - RNA, 20 nt, Mycobacterium tuberculosis H37Rv
cggcgucgccgccauugccg

SEQ ID NO: 1303721 - RNA, 23 nt, Mycobacterium tuberculosis H37Rv
cggcgucguugccgggucaaccg

SEQ ID NO: 1303722 - RNA, 19 nt, Mycobacterium tuberculosis H37Rv
cggcgucugcccgcccagc

SEQ ID NO: 1303723 - RNA, 19 nt, Mycobacterium tuberculosis H37Rv
cggcgucuuccucggccac

SEQ ID NO: 1303724 - RNA, 19 nt, Mycobacterium tuberculosis H37Rv
cggcgucuucgucggaguc

SEQ ID NO: 1303725 - RNA, 18 nt, Mycobacterium tuberculosis H37Rv
cggcguacaaaccgucgg

SEQ ID NO: 1303726 - RNA, 20 nt, Mycobacterium tuberculosis H37Rv
cggcguacaaaccgucgggg

SEQ ID NO: 1303727 - RNA, 16 nt, Mycobacterium tuberculosis H37Rv
cggcguacagcgccug

SEQ ID NO: 1303728 - RNA, 20 nt, Mycobacterium tuberculosis H37Rv
cggcguacagcgccugggug

SEQ ID NO: 1303729 - RNA, 20 nt, Mycobacterium tuberculosis H37Rv
cggcggcccuuuccagggga

SEQ ID NO: 1303730 - RNA, 20 nt, Mycobacterium tuberculosis H37Rv
cggcggcccguuugccgguu

SEQ ID NO: 1303731 - RNA, 15 nt, Mycobacterium tuberculosis H37Rv
cggcgucagccccga

SEQ ID NO: 1303732 - RNA, 18 nt, Mycobacterium tuberculosis H37Rv
cggcgucacggcgugacc

SEQ ID NO: 1303733 - RNA, 19 nt, Mycobacterium tuberculosis H37Rv
cggcgucagccccgacugc

SEQ ID NO: 1303734 - RNA, 15 nt, Mycobacterium tuberculosis H37Rv
cggcguccagcagcg

SEQ ID NO: 1303735 - RNA, 15 nt, Mycobacterium tuberculosis H37Rv
cggcgugcuggcgca

SEQ ID NO: 1303736 - RNA, 17 nt, Mycobacterium tuberculosis H37Rv
cggcguggucggcggug

SEQ ID NO: 1303737 - RNA, 15 nt, Mycobacterium tuberculosis H37Rv
cggcgugguguccac

SEQ ID NO: 1303738 - RNA, 17 nt, Mycobacterium tuberculosis H37Rv
cggcgugguguccaccg

SEQ ID NO: 1303739 - RNA, 16 nt, Mycobacterium tuberculosis H37Rv
cggcgugucacgucgc

SEQ ID NO: 1303740 - RNA, 13 nt, Mycobacterium tuberculosis H37Rv
cggcguguccgcc

SEQ ID NO: 1303741 - RNA, 17 nt, Mycobacterium tuberculosis H37Rv
cggcguggucucgaugg

SEQ ID NO: 1303742 - RNA, 16 nt, Mycobacterium tuberculosis H37Rv
cggcgugucgguguac

SEQ ID NO: 1303743 - RNA, 22 nt, Mycobacterium tuberculosis H37Rv
cggcguggucgcgcggcaccga

SEQ ID NO: 1303744 - RNA, 20 nt, Mycobacterium tuberculosis H37Rv
cggcgugcuugcccagguug

SEQ ID NO: 1303745 - RNA, 18 nt, Mycobacterium tuberculosis H37Rv
cggcgugcgcggugaugg

SEQ ID NO: 1303746 - RNA, 16 nt, Mycobacterium tuberculosis H37Rv
cggcgugucucgucgc

SEQ ID NO: 1303747 - RNA, 20 nt, Mycobacterium tuberculosis H37Rv
cggcgugucugcccgagguc

SEQ ID NO: 1303748 - RNA, 19 nt, Mycobacterium tuberculosis H37Rv
cggcgugucgccgccacca

SEQ ID NO: 1303749 - RNA, 15 nt, Mycobacterium tuberculosis H37Rv
cggcguuaccgaccu

SEQ ID NO: 1303750 - RNA, 15 nt, Mycobacterium tuberculosis H37Rv
cggcguucccgccau

SEQ ID NO: 1303751 - RNA, 20 nt, Mycobacterium tuberculosis H37Rv
cggcguucccgccauugccg

SEQ ID NO: 1303752 - RNA, 16 nt, Mycobacterium tuberculosis H37Rv
cggcguuccaacucgg

SEQ ID NO: 1303753 - RNA, 19 nt, Mycobacterium tuberculosis H37Rv
cggcguuccaacucgguuc

SEQ ID NO: 1303754 - RNA, 22 nt, Mycobacterium tuberculosis H37Rv
cggcguugaucgacaucaccac

SEQ ID NO: 1303755 - RNA, 13 nt, Mycobacterium tuberculosis H37Rv
cggcguugaucga

SEQ ID NO: 1303756 - RNA, 21 nt, Mycobacterium tuberculosis H37Rv
cggcguugccgaaacccgagu

SEQ ID NO: 1303757 - RNA, 20 nt, Mycobacterium tuberculosis H37Rv
cggcguuccgggccgaucac

SEQ ID NO: 1303758 - RNA, 20 nt, Mycobacterium tuberculosis H37Rv
cggcguucaccugcgucggc

SEQ ID NO: 1303759 - RNA, 22 nt, Mycobacterium tuberculosis H37Rv
cggcuaagccuucggugucgcc

SEQ ID NO: 1303760 - RNA, 19 nt, Mycobacterium tuberculosis H37Rv
cggcuaagccuucgguguc

SEQ ID NO: 1303761 - RNA, 20 nt, Mycobacterium tuberculosis H37Rv
cggcuaccgcgcucccggcg

SEQ ID NO: 1303762 - RNA, 19 nt, Mycobacterium tuberculosis H37Rv
cggcuaccccgcagaaucc

SEQ ID NO: 1303763 - RNA, 17 nt, Mycobacterium tuberculosis H37Rv
cggcuaccgccgaccgg

SEQ ID NO: 1303764 - RNA, 15 nt, Mycobacterium tuberculosis H37Rv
cggcuaccggcgugu

SEQ ID NO: 1303765 - RNA, 15 nt, Mycobacterium tuberculosis H37Rv
cggcuacggcgacac

SEQ ID NO: 1303766 - RNA, 21 nt, Mycobacterium tuberculosis H37Rv
cggcguuguaguugcccacgu

SEQ ID NO: 1303767 - RNA, 18 nt, Mycobacterium tuberculosis H37Rv
cggcguuuccuucgacga

SEQ ID NO: 1303768 - RNA, 15 nt, Mycobacterium tuberculosis H37Rv
cggcguuuucgguga

SEQ ID NO: 1303769 - RNA, 16 nt, Mycobacterium tuberculosis H37Rv
cggcguuuucggugag

SEQ ID NO: 1303770 - RNA, 15 nt, Mycobacterium tuberculosis H37Rv
cggcguugucgacga

SEQ ID NO: 1303771 - RNA, 19 nt, Mycobacterium tuberculosis H37Rv
cggcguuggcgccguuacc

SEQ ID NO: 1303772 - RNA, 17 nt, Mycobacterium tuberculosis H37Rv
cggcguuggcgccguua

SEQ ID NO: 1303773 - RNA, 15 nt, Mycobacterium tuberculosis H37Rv
cggcguugccgccgu

SEQ ID NO: 1303774 - RNA, 14 nt, Mycobacterium tuberculosis H37Rv
cgggucgagccgga

SEQ ID NO: 1303775 - RNA, 20 nt, Mycobacterium tuberculosis H37Rv
cgggucgagccggacccggu

SEQ ID NO: 1303776 - RNA, 14 nt, Mycobacterium tuberculosis H37Rv
cgggucgaucaccg

SEQ ID NO: 1303777 - RNA, 16 nt, Mycobacterium tuberculosis H37Rv
cgggucgaucaccgac

SEQ ID NO: 1303778 - RNA, 20 nt, Mycobacterium tuberculosis H37Rv
cgggucgccggacugcggcc

SEQ ID NO: 1303779 - RNA, 20 nt, Mycobacterium tuberculosis H37Rv
cgggucgacgacgucgcgca

SEQ ID NO: 1303780 - RNA, 16 nt, Mycobacterium tuberculosis H37Rv
cgggucgaugucggca

SEQ ID NO: 1303781 - RNA, 22 nt, Mycobacterium tuberculosis H37Rv
cgggucgaugucggggccgucg

SEQ ID NO: 1303782 - RNA, 21 nt, Mycobacterium tuberculosis H37Rv
cggguccucgcggagccgucg

SEQ ID NO: 1303783 - RNA, 19 nt, Mycobacterium tuberculosis H37Rv
cggguccggugaacccgau

SEQ ID NO: 1303784 - RNA, 13 nt, Mycobacterium tuberculosis H37Rv
cggguccggugaa

SEQ ID NO: 1303785 - RNA, 14 nt, Mycobacterium tuberculosis H37Rv
cgggucgaccccgg

SEQ ID NO: 1303786 - RNA, 18 nt, Mycobacterium tuberculosis H37Rv
cggguccuucugccggga

SEQ ID NO: 1303787 - RNA, 15 nt, Mycobacterium tuberculosis H37Rv
cggguccuugcggcc

SEQ ID NO: 1303788 - RNA, 20 nt, Mycobacterium tuberculosis H37Rv
cggguccuggaucagccagu

SEQ ID NO: 1303789 - RNA, 18 nt, Mycobacterium tuberculosis H37Rv
cgggucgacguuaccgac

SEQ ID NO: 1303790 - RNA, 19 nt, Mycobacterium tuberculosis H37Rv
cgggucgacguuaccgacc

SEQ ID NO: 1303791 - RNA, 20 nt, Mycobacterium tuberculosis H37Rv
cgggucgacguuaccgaccg

SEQ ID NO: 1303792 - RNA, 23 nt, Mycobacterium tuberculosis H37Rv
cgggucagcugacgggccgcugu

SEQ ID NO: 1303793 - RNA, 17 nt, Mycobacterium tuberculosis H37Rv
cgggucaucuugccacc

SEQ ID NO: 1303794 - RNA, 19 nt, Mycobacterium tuberculosis H37Rv
cgggucauccgugucgaga

SEQ ID NO: 1303795 - RNA, 14 nt, Mycobacterium tuberculosis H37Rv
cgggucagcaccac

SEQ ID NO: 1303796 - RNA, 15 nt, Mycobacterium tuberculosis H37Rv
cgggucagcccagcc

SEQ ID NO: 1303797 - RNA, 13 nt, Mycobacterium tuberculosis H37Rv
cggguaucgccag

SEQ ID NO: 1303798 - RNA, 13 nt, Mycobacterium tuberculosis H37Rv
cggguagucgggc

SEQ ID NO: 1303799 - RNA, 20 nt, Mycobacterium tuberculosis H37Rv
cggguaggccgccgugguga

SEQ ID NO: 1303800 - RNA, 13 nt, Mycobacterium tuberculosis H37Rv
cggguagccggcg

SEQ ID NO: 1303801 - RNA, 20 nt, Mycobacterium tuberculosis H37Rv
cggguagccgucgaucccgg

SEQ ID NO: 1303802 - RNA, 19 nt, Mycobacterium tuberculosis H37Rv
cggguagccggcgugcacu

SEQ ID NO: 1303803 - RNA, 13 nt, Mycobacterium tuberculosis H37Rv
cggguagccgucg

SEQ ID NO: 1303804 - RNA, 17 nt, Mycobacterium tuberculosis H37Rv
cgggcucgguggcggac

SEQ ID NO: 1303805 - RNA, 15 nt, Mycobacterium tuberculosis H37Rv
cgggcucguccagca

SEQ ID NO: 1303806 - RNA, 20 nt, Mycobacterium tuberculosis H37Rv
cgggcucggcgucgccgcca

SEQ ID NO: 1303807 - RNA, 15 nt, Mycobacterium tuberculosis H37Rv
cgggcucggcgucgc

SEQ ID NO: 1303808 - RNA, 21 nt, Mycobacterium tuberculosis H37Rv
cgggcucguguccgccgucac

SEQ ID NO: 1303809 - RNA, 18 nt, Mycobacterium tuberculosis H37Rv
cgggcucguguccgccgu

SEQ ID NO: 1303810 - RNA, 15 nt, Mycobacterium tuberculosis H37Rv
cgggcucguguccgc

SEQ ID NO: 1303811 - RNA, 23 nt, Mycobacterium tuberculosis H37Rv
cgggcucgcuucaggcaccggau

SEQ ID NO: 1303812 - RNA, 18 nt, Mycobacterium tuberculosis H37Rv
cgggcucggcgaaggccg

SEQ ID NO: 1303813 - RNA, 15 nt, Mycobacterium tuberculosis H37Rv
cgggcucgcugcacc

SEQ ID NO: 1303814 - RNA, 21 nt, Mycobacterium tuberculosis H37Rv
cgggcucgcuucaggcaccgg

SEQ ID NO: 1303815 - RNA, 17 nt, Mycobacterium tuberculosis H37Rv
cggggucgccggcaccg

SEQ ID NO: 1303816 - RNA, 17 nt, Mycobacterium tuberculosis H37Rv
cgggcucucggcgucga

SEQ ID NO: 1303817 - RNA, 15 nt, Mycobacterium tuberculosis H37Rv
cgggguaucaaccgg

SEQ ID NO: 1303818 - RNA, 18 nt, Mycobacterium tuberculosis H37Rv
cgggguggccaccagcgg

SEQ ID NO: 1303819 - RNA, 12 nt, Mycobacterium tuberculosis H37Rv
cgggguggcgcg

SEQ ID NO: 1303820 - RNA, 13 nt, Mycobacterium tuberculosis H37Rv
cgggguggcggcg

SEQ ID NO: 1303821 - RNA, 17 nt, Mycobacterium tuberculosis H37Rv
cggggugcacgaugacg

SEQ ID NO: 1303822 - RNA, 21 nt, Mycobacterium tuberculosis H37Rv
cggggucgcggaucucaucgg

SEQ ID NO: 1303823 - RNA, 20 nt, Mycobacterium tuberculosis H37Rv
cggggugcccggccgccagc

SEQ ID NO: 1303824 - RNA, 15 nt, Mycobacterium tuberculosis H37Rv
cggggugcaccgucg

SEQ ID NO: 1303825 - RNA, 23 nt, Mycobacterium tuberculosis H37Rv
aacauuuucgcccgcuccgggac

SEQ ID NO: 1303826 - RNA, 20 nt, Mycobacterium tuberculosis H37Rv
aaccaaccucggaucgccag

SEQ ID NO: 1303827 - RNA, 14 nt, Mycobacterium tuberculosis H37Rv
aaccaacgcgaccg

SEQ ID NO: 1303828 - RNA, 17 nt, Mycobacterium tuberculosis H37Rv
cgggguuacucgcagcg

SEQ ID NO: 1303829 - RNA, 16 nt, Mycobacterium tuberculosis H37Rv
cggguuaucggcagca

SEQ ID NO: 1303830 - RNA, 23 nt, Mycobacterium tuberculosis H37Rv
cggguucacuuccgggcagcugg

SEQ ID NO: 1303831 - RNA, 20 nt, Mycobacterium tuberculosis H37Rv
cggguucgacguugaucgcc

SEQ ID NO: 1303832 - RNA, 20 nt, Mycobacterium tuberculosis H37Rv
cggguucgccggauccgauc

SEQ ID NO: 1303833 - RNA, 23 nt, Mycobacterium tuberculosis H37Rv
cggguucgacguugaucgccaug

SEQ ID NO: 1303834 - RNA, 15 nt, Mycobacterium tuberculosis H37Rv
cggguugagccgccg

SEQ ID NO: 1303835 - RNA, 20 nt, Mycobacterium tuberculosis H37Rv
cggguguucucgcgcgucgc

SEQ ID NO: 1303836 - RNA, 18 nt, Mycobacterium tuberculosis H37Rv
cggguguuccacaccagg

SEQ ID NO: 1303837 - RNA, 14 nt, Mycobacterium tuberculosis H37Rv
cggguguggccguu

SEQ ID NO: 1303838 - RNA, 23 nt, Mycobacterium tuberculosis H37Rv
cggguggugaaguagucggcgcc

SEQ ID NO: 1303839 - RNA, 18 nt, Mycobacterium tuberculosis H37Rv
cgggugggucguucaccg

SEQ ID NO: 1303840 - RNA, 20 nt, Mycobacterium tuberculosis H37Rv
cgggugguucaccucggcga

SEQ ID NO: 1303841 - RNA, 16 nt, Mycobacterium tuberculosis H37Rv
cggguggugccagguc

SEQ ID NO: 1303842 - RNA, 18 nt, Mycobacterium tuberculosis H37Rv
cgggugguuguucggcca

SEQ ID NO: 1303843 - RNA, 16 nt, Mycobacterium tuberculosis H37Rv
cgggugugacgcgcgc

SEQ ID NO: 1303844 - RNA, 21 nt, Mycobacterium tuberculosis H37Rv
cgggugcgacgcgaccgcgau

SEQ ID NO: 1303845 - RNA, 17 nt, Mycobacterium tuberculosis H37Rv
cgggugcgcacccgggu

SEQ ID NO: 1303846 - RNA, 18 nt, Mycobacterium tuberculosis H37Rv
cgggugcgccggcguuug

SEQ ID NO: 1303847 - RNA, 17 nt, Mycobacterium tuberculosis H37Rv
cgggugcgacggcguug

SEQ ID NO: 1303848 - RNA, 21 nt, Mycobacterium tuberculosis H37Rv
cgggugcgccguugccgccgu

SEQ ID NO: 1303849 - RNA, 14 nt, Mycobacterium tuberculosis H37Rv
cgggugcgccguug

SEQ ID NO: 1303850 - RNA, 16 nt, Mycobacterium tuberculosis H37Rv
cgggugcggacaccga

SEQ ID NO: 1303851 - RNA, 17 nt, Mycobacterium tuberculosis H37Rv
cgggugcgcugcgauca

SEQ ID NO: 1303852 - RNA, 16 nt, Mycobacterium tuberculosis H37Rv
cgggugcgcugcagcg

SEQ ID NO: 1303853 - RNA, 14 nt, Mycobacterium tuberculosis H37Rv
cgggugcgcugcga

SEQ ID NO: 1303854 - RNA, 16 nt, Mycobacterium tuberculosis H37Rv
cgggugcugauggguc

SEQ ID NO: 1303855 - RNA, 19 nt, Mycobacterium tuberculosis H37Rv
cggguggggaucacgauca

SEQ ID NO: 1303856 - RNA, 14 nt, Mycobacterium tuberculosis H37Rv
cgggugggccagug

SEQ ID NO: 1303857 - RNA, 21 nt, Mycobacterium tuberculosis H37Rv
cggguggcuuccggggugaca

SEQ ID NO: 1303858 - RNA, 15 nt, Mycobacterium tuberculosis H37Rv
cggguggcgccaguu

SEQ ID NO: 1303859 - RNA, 18 nt, Mycobacterium tuberculosis H37Rv
cggguggcgccaguucgg

SEQ ID NO: 1303860 - RNA, 19 nt, Mycobacterium tuberculosis H37Rv
cggguggcgccaguucggc

SEQ ID NO: 1303861 - RNA, 15 nt, Mycobacterium tuberculosis H37Rv
cggguggcgccggug

SEQ ID NO: 1303862 - RNA, 12 nt, Mycobacterium tuberculosis H37Rv
cggguggcgucg

SEQ ID NO: 1303863 - RNA, 18 nt, Mycobacterium tuberculosis H37Rv
cggguggccacgcccagg

SEQ ID NO: 1303864 - RNA, 20 nt, Mycobacterium tuberculosis H37Rv
cggguggccaucaccgcgcu

SEQ ID NO: 1303865 - RNA, 16 nt, Mycobacterium tuberculosis H37Rv
cggguggcagcggcga

SEQ ID NO: 1303866 - RNA, 19 nt, Mycobacterium tuberculosis H37Rv
cggguggcagcggcgaucg

SEQ ID NO: 1303867 - RNA, 21 nt, Mycobacterium tuberculosis H37Rv
cggguggaucuucaccucgau

SEQ ID NO: 1303868 - RNA, 22 nt, Mycobacterium tuberculosis H37Rv
cggguggacaccugcugcaccg

SEQ ID NO: 1303869 - RNA, 14 nt, Mycobacterium tuberculosis H37Rv
cgggucucggugcg

SEQ ID NO: 1303870 - RNA, 15 nt, Mycobacterium tuberculosis H37Rv
cgggucguucuccgc

SEQ ID NO: 1303871 - RNA, 23 nt, Mycobacterium tuberculosis H37Rv
cgggucgugcgacaacacgaccu

SEQ ID NO: 1303872 - RNA, 20 nt, Mycobacterium tuberculosis H37Rv
cgggucguccgccugcaccg

SEQ ID NO: 1303873 - RNA, 17 nt, Mycobacterium tuberculosis H37Rv
cgggucguccggcggca

SEQ ID NO: 1303874 - RNA, 18 nt, Mycobacterium tuberculosis H37Rv
cgggucgggcaccgcgcg

SEQ ID NO: 1303875 - RNA, 16 nt, Mycobacterium tuberculosis H37Rv
cgggucggcgacgaac

SEQ ID NO: 1303876 - RNA, 15 nt, Mycobacterium tuberculosis H37Rv
cgggucgggcaccgc

SEQ ID NO: 1303877 - RNA, 16 nt, Mycobacterium tuberculosis H37Rv
cgggucggcgaacgcc

SEQ ID NO: 1303878 - RNA, 17 nt, Mycobacterium tuberculosis H37Rv
cgggucggcgccgagca

SEQ ID NO: 1303879 - RNA, 19 nt, Mycobacterium tuberculosis H37Rv
cgggucggcacgacccggg

SEQ ID NO: 1303880 - RNA, 17 nt, Mycobacterium tuberculosis H37Rv
aaccaggcggccgcguc

SEQ ID NO: 1303881 - RNA, 23 nt, Mycobacterium tuberculosis H37Rv
aaccagugaccguauuucgucca

SEQ ID NO: 1303882 - RNA, 17 nt, Mycobacterium tuberculosis H37Rv
aaccaggugagcgacgc

SEQ ID NO: 1303883 - RNA, 14 nt, Mycobacterium tuberculosis H37Rv
cgggugaccaggcg

SEQ ID NO: 1303884 - RNA, 17 nt, Mycobacterium tuberculosis H37Rv
aaccagccgcggaucau

SEQ ID NO: 1303885 - RNA, 13 nt, Mycobacterium tuberculosis H37Rv
cgggugcaggcga

SEQ ID NO: 1303886 - RNA, 18 nt, Mycobacterium tuberculosis H37Rv
cgggugccgacgucggca

SEQ ID NO: 1303887 - RNA, 18 nt, Mycobacterium tuberculosis H37Rv
cgggugccgagcuggcga

SEQ ID NO: 1303888 - RNA, 17 nt, Mycobacterium tuberculosis H37Rv
cgggugcgacaucgguc

SEQ ID NO: 1303889 - RNA, 17 nt, Mycobacterium tuberculosis H37Rv
cgggugaguucggcgua

SEQ ID NO: 1303890 - RNA, 15 nt, Mycobacterium tuberculosis H37Rv
cgggugagcacccag

SEQ ID NO: 1303891 - RNA, 14 nt, Mycobacterium tuberculosis H37Rv
aaccagugcagcuc

SEQ ID NO: 1303892 - RNA, 16 nt, Mycobacterium tuberculosis H37Rv
cgggugaguucggcgu

SEQ ID NO: 1303893 - RNA, 15 nt, Mycobacterium tuberculosis H37Rv
cgggugacucgggca

SEQ ID NO: 1303894 - RNA, 18 nt, Mycobacterium tuberculosis H37Rv
cggucccaugugcccgca

SEQ ID NO: 1303895 - RNA, 23 nt, Mycobacterium tuberculosis H37Rv
cgguccccccguugccgccguug

SEQ ID NO: 1303896 - RNA, 20 nt, Mycobacterium tuberculosis H37Rv
cgguccauggacggccaggu

SEQ ID NO: 1303897 - RNA, 16 nt, Mycobacterium tuberculosis H37Rv
cggucccaaggcguug

SEQ ID NO: 1303898 - RNA, 19 nt, Mycobacterium tuberculosis H37Rv
cgguccauucguccgcggu

SEQ ID NO: 1303899 - RNA, 18 nt, Mycobacterium tuberculosis H37Rv
cgguccaggccggcaccc

SEQ ID NO: 1303900 - RNA, 13 nt, Mycobacterium tuberculosis H37Rv
cgguccagcgucg

SEQ ID NO: 1303901 - RNA, 16 nt, Mycobacterium tuberculosis H37Rv
cgguccagccaccgcc

SEQ ID NO: 1303902 - RNA, 22 nt, Mycobacterium tuberculosis H37Rv
cgguccacgggccgggcggugu

SEQ ID NO: 1303903 - RNA, 14 nt, Mycobacterium tuberculosis H37Rv
cggucccucaugcu

SEQ ID NO: 1303904 - RNA, 19 nt, Mycobacterium tuberculosis H37Rv
cgguccgauucgugcgguc

SEQ ID NO: 1303905 - RNA, 22 nt, Mycobacterium tuberculosis H37Rv
cgguccggauugaagucgucgg

SEQ ID NO: 1303906 - RNA, 20 nt, Mycobacterium tuberculosis H37Rv
cgguccgggaagucgcugaa

SEQ ID NO: 1303907 - RNA, 12 nt, Mycobacterium tuberculosis H37Rv
cggucgauagcg

SEQ ID NO: 1303908 - RNA, 22 nt, Mycobacterium tuberculosis H37Rv
cggucgaugucagccaccaucu

SEQ ID NO: 1303909 - RNA, 12 nt, Mycobacterium tuberculosis H37Rv
cggucgaugccg

SEQ ID NO: 1303910 - RNA, 16 nt, Mycobacterium tuberculosis H37Rv
cggucgauccggccag

SEQ ID NO: 1303911 - RNA, 21 nt, Mycobacterium tuberculosis H37Rv
cggucgaccaauuggucgagu

SEQ ID NO: 1303912 - RNA, 16 nt, Mycobacterium tuberculosis H37Rv
cggucgaccugagccc

SEQ ID NO: 1303913 - RNA, 19 nt, Mycobacterium tuberculosis H37Rv
cggucgacugggacgacgc

SEQ ID NO: 1303914 - RNA, 17 nt, Mycobacterium tuberculosis H37Rv
cggucgacuguucggga

SEQ ID NO: 1303915 - RNA, 20 nt, Mycobacterium tuberculosis H37Rv
cggucgacuccagcaccagc

SEQ ID NO: 1303916 - RNA, 14 nt, Mycobacterium tuberculosis H37Rv
cggucgacuccagc

SEQ ID NO: 1303917 - RNA, 17 nt, Mycobacterium tuberculosis H37Rv
cggucgaagcuggcacg

SEQ ID NO: 1303918 - RNA, 23 nt, Mycobacterium tuberculosis H37Rv
cggucgaauucuguugugccgca

SEQ ID NO: 1303919 - RNA, 21 nt, Mycobacterium tuberculosis H37Rv
cgguccugguguagccgagca

SEQ ID NO: 1303920 - RNA, 18 nt, Mycobacterium tuberculosis H37Rv
cgguccugcucgcacagc

SEQ ID NO: 1303921 - RNA, 13 nt, Mycobacterium tuberculosis H37Rv
cgguccucgucgg

SEQ ID NO: 1303922 - RNA, 14 nt, Mycobacterium tuberculosis H37Rv
cgguccuugccgua

SEQ ID NO: 1303923 - RNA, 14 nt, Mycobacterium tuberculosis H37Rv
cgguccugcucgca

SEQ ID NO: 1303924 - RNA, 16 nt, Mycobacterium tuberculosis H37Rv
cgguccucgagccgau

SEQ ID NO: 1303925 - RNA, 19 nt, Mycobacterium tuberculosis H37Rv
cgguccguucgcgccguug

SEQ ID NO: 1303926 - RNA, 18 nt, Mycobacterium tuberculosis H37Rv
cgguccgucaccaccgcc

SEQ ID NO: 1303927 - RNA, 14 nt, Mycobacterium tuberculosis H37Rv
cgguccgucaccac

SEQ ID NO: 1303928 - RNA, 17 nt, Mycobacterium tuberculosis H37Rv
cgguccguucgcgccgu

SEQ ID NO: 1303929 - RNA, 16 nt, Mycobacterium tuberculosis H37Rv
cggucaguauggcgac

SEQ ID NO: 1303930 - RNA, 20 nt, Mycobacterium tuberculosis H37Rv
cggucaggccgccgcggcga

SEQ ID NO: 1303931 - RNA, 19 nt, Mycobacterium tuberculosis H37Rv
cggucagcucgcugacggc

SEQ ID NO: 1303932 - RNA, 18 nt, Mycobacterium tuberculosis H37Rv
cggucaggcaguccaccg

SEQ ID NO: 1303933 - RNA, 13 nt, Mycobacterium tuberculosis H37Rv
cgguccaccggcc

SEQ ID NO: 1303934 - RNA, 21 nt, Mycobacterium tuberculosis H37Rv
cgguccagacccagcucgucg

SEQ ID NO: 1303935 - RNA, 16 nt, Mycobacterium tuberculosis H37Rv
cggucauggcgacggu

SEQ ID NO: 1303936 - RNA, 23 nt, Mycobacterium tuberculosis H37Rv
cggucaugggaucaggcugggca

SEQ ID NO: 1303937 - RNA, 18 nt, Mycobacterium tuberculosis H37Rv
cgguccaaaacaccgcca

SEQ ID NO: 1303938 - RNA, 13 nt, Mycobacterium tuberculosis H37Rv
cggucaucgccga

SEQ ID NO: 1303939 - RNA, 21 nt, Mycobacterium tuberculosis H37Rv
cggucaucccaagcguccgcu

SEQ ID NO: 1303940 - RNA, 20 nt, Mycobacterium tuberculosis H37Rv
cggucacgcugugcgguauc

SEQ ID NO: 1303941 - RNA, 16 nt, Mycobacterium tuberculosis H37Rv
cggucaccucgaugcg

SEQ ID NO: 1303942 - RNA, 14 nt, Mycobacterium tuberculosis H37Rv
cggucaccucgaug

SEQ ID NO: 1303943 - RNA, 23 nt, Mycobacterium tuberculosis H37Rv
cggucaccacggcggcggcguag

SEQ ID NO: 1303944 - RNA, 18 nt, Mycobacterium tuberculosis H37Rv
cggucaccgcgucaccgg

SEQ ID NO: 1303945 - RNA, 23 nt, Mycobacterium tuberculosis H37Rv
cggucaccaccgacccgcugcca

SEQ ID NO: 1303946 - RNA, 15 nt, Mycobacterium tuberculosis H37Rv
cggucagaugcgccg

SEQ ID NO: 1303947 - RNA, 21 nt, Mycobacterium tuberculosis H37Rv
cggucagaugcgccgcugguc

SEQ ID NO: 1303948 - RNA, 21 nt, Mycobacterium tuberculosis H37Rv
cggucagacgccggccgccga

SEQ ID NO: 1303949 - RNA, 17 nt, Mycobacterium tuberculosis H37Rv
cggucagccauguccgc

SEQ ID NO: 1303950 - RNA, 12 nt, Mycobacterium tuberculosis H37Rv
cggucagccgcg

SEQ ID NO: 1303951 - RNA, 13 nt, Mycobacterium tuberculosis H37Rv
cggucagcgccga

SEQ ID NO: 1303952 - RNA, 23 nt, Mycobacterium tuberculosis H37Rv
cggucagcgcgcacgacaggauc

SEQ ID NO: 1303953 - RNA, 15 nt, Mycobacterium tuberculosis H37Rv
cggucagcgcggcga

SEQ ID NO: 1303954 - RNA, 21 nt, Mycobacterium tuberculosis H37Rv
cgguagaucuucggccgcacu

SEQ ID NO: 1303955 - RNA, 14 nt, Mycobacterium tuberculosis H37Rv
cgguagacguugcc

SEQ ID NO: 1303956 - RNA, 19 nt, Mycobacterium tuberculosis H37Rv
cgguagacaagucggcgcu

SEQ ID NO: 1303957 - RNA, 13 nt, Mycobacterium tuberculosis H37Rv
cgguacugcgcag

SEQ ID NO: 1303958 - RNA, 16 nt, Mycobacterium tuberculosis H37Rv
cgguacggucugaugg

SEQ ID NO: 1303959 - RNA, 21 nt, Mycobacterium tuberculosis H37Rv
cgguacgaauugggcucuacu

SEQ ID NO: 1303960 - RNA, 22 nt, Mycobacterium tuberculosis H37Rv
cgguacgcaaccaaccgucggu

SEQ ID NO: 1303961 - RNA, 19 nt, Mycobacterium tuberculosis H37Rv
cgguaccugacagcucacg

SEQ ID NO: 1303962 - RNA, 14 nt, Mycobacterium tuberculosis H37Rv
cgguaccucgucga

SEQ ID NO: 1303963 - RNA, 19 nt, Mycobacterium tuberculosis H37Rv
cgguaggccaucugcucgc

SEQ ID NO: 1303964 - RNA, 16 nt, Mycobacterium tuberculosis H37Rv
cgguagcuggguccgu

SEQ ID NO: 1303965 - RNA, 20 nt, Mycobacterium tuberculosis H37Rv
cgguagcuggguccguccau

SEQ ID NO: 1303966 - RNA, 21 nt, Mycobacterium tuberculosis H37Rv
cgguagcugaccgugcugaau

SEQ ID NO: 1303967 - RNA, 16 nt, Mycobacterium tuberculosis H37Rv
cgguagcucauugccg

SEQ ID NO: 1303968 - RNA, 17 nt, Mycobacterium tuberculosis H37Rv
cgguagcucgucgagga

SEQ ID NO: 1303969 - RNA, 22 nt, Mycobacterium tuberculosis H37Rv
cgguagcgaucgugcugcccgc

SEQ ID NO: 1303970 - RNA, 18 nt, Mycobacterium tuberculosis H37Rv
cgguagccuggcuguccg

SEQ ID NO: 1303971 - RNA, 16 nt, Mycobacterium tuberculosis H37Rv
cgguagccuggcuguc

SEQ ID NO: 1303972 - RNA, 17 nt, Mycobacterium tuberculosis H37Rv
cgguagccgaccagcgc

SEQ ID NO: 1303973 - RNA, 20 nt, Mycobacterium tuberculosis H37Rv
cgguagccccgucgaccucc

SEQ ID NO: 1303974 - RNA, 17 nt, Mycobacterium tuberculosis H37Rv
cgguaucggugcugguc

SEQ ID NO: 1303975 - RNA, 18 nt, Mycobacterium tuberculosis H37Rv
cgguauucccgcuuggcg

SEQ ID NO: 1303976 - RNA, 13 nt, Mycobacterium tuberculosis H37Rv
cggucaacucgaa

SEQ ID NO: 1303977 - RNA, 16 nt, Mycobacterium tuberculosis H37Rv
cggucaacgcugacgu

SEQ ID NO: 1303978 - RNA, 19 nt, Mycobacterium tuberculosis H37Rv
cgguaguggggugcggguc

SEQ ID NO: 1303979 - RNA, 14 nt, Mycobacterium tuberculosis H37Rv
cgguagucggccag

SEQ ID NO: 1303980 - RNA, 14 nt, Mycobacterium tuberculosis H37Rv
cgguagucgccgag

SEQ ID NO: 1303981 - RNA, 18 nt, Mycobacterium tuberculosis H37Rv
cgguagucgccgucgggu

SEQ ID NO: 1303982 - RNA, 13 nt, Mycobacterium tuberculosis H37Rv
cgguagcuuccgc

SEQ ID NO: 1303983 - RNA, 12 nt, Mycobacterium tuberculosis H37Rv
cgguaggcggcc

SEQ ID NO: 1303984 - RNA, 18 nt, Mycobacterium tuberculosis H37Rv
cgguaggugcaugucgau

SEQ ID NO: 1303985 - RNA, 20 nt, Mycobacterium tuberculosis H37Rv
cgguacccguagcaccacau

SEQ ID NO: 1303986 - RNA, 18 nt, Mycobacterium tuberculosis H37Rv
cgguaccaucaccgcgcc

SEQ ID NO: 1303987 - RNA, 14 nt, Mycobacterium tuberculosis H37Rv
cgguacaucgacca

SEQ ID NO: 1303988 - RNA, 15 nt, Mycobacterium tuberculosis H37Rv
cgguacaucgaccac

SEQ ID NO: 1303989 - RNA, 21 nt, Mycobacterium tuberculosis H37Rv
cgguacaucgaccaccucgau

SEQ ID NO: 1303990 - RNA, 15 nt, Mycobacterium tuberculosis H37Rv
cgguaacuguccgcc

SEQ ID NO: 1303991 - RNA, 20 nt, Mycobacterium tuberculosis H37Rv
cgguaaagcucaccacaucg

SEQ ID NO: 1303992 - RNA, 13 nt, Mycobacterium tuberculosis H37Rv
cgguaaacguugg

SEQ ID NO: 1303993 - RNA, 19 nt, Mycobacterium tuberculosis H37Rv
cgguaaucgccaccgcaag

SEQ ID NO: 1303994 - RNA, 17 nt, Mycobacterium tuberculosis H37Rv
cggguuguggcacccgg

SEQ ID NO: 1303995 - RNA, 19 nt, Mycobacterium tuberculosis H37Rv
cggguuggucccgaugacc

SEQ ID NO: 1303996 - RNA, 15 nt, Mycobacterium tuberculosis H37Rv
cggcgacaacagcac

SEQ ID NO: 1303997 - RNA, 17 nt, Mycobacterium tuberculosis H37Rv
cggcgacaagccgagcc

SEQ ID NO: 1303998 - RNA, 15 nt, Mycobacterium tuberculosis H37Rv
cggcgaauacgaccg

SEQ ID NO: 1303999 - RNA, 21 nt, Mycobacterium tuberculosis H37Rv
cggcgaauacgaccgucgcgc

SEQ ID NO: 1304000 - RNA, 14 nt, Mycobacterium tuberculosis H37Rv
cggcgaauacgacc

SEQ ID NO: 1304001 - RNA, 20 nt, Mycobacterium tuberculosis H37Rv
cggcgaagucacgcacccgg

SEQ ID NO: 1304002 - RNA, 14 nt, Mycobacterium tuberculosis H37Rv
cggcgaagucacgc

SEQ ID NO: 1304003 - RNA, 22 nt, Mycobacterium tuberculosis H37Rv
cggcgaagguaguacuugccuu

SEQ ID NO: 1304004 - RNA, 22 nt, Mycobacterium tuberculosis H37Rv
cggcgacagcuuggccgguuca

SEQ ID NO: 1304005 - RNA, 18 nt, Mycobacterium tuberculosis H37Rv
cggcgacaugaucugcca

SEQ ID NO: 1304006 - RNA, 12 nt, Mycobacterium tuberculosis H37Rv
cggcgacaccgc

SEQ ID NO: 1304007 - RNA, 14 nt, Mycobacterium tuberculosis H37Rv
cggcgacacgccag

SEQ ID NO: 1304008 - RNA, 17 nt, Mycobacterium tuberculosis H37Rv
cggcgacaccgcaccga

SEQ ID NO: 1304009 - RNA, 18 nt, Mycobacterium tuberculosis H37Rv
cggcgaccaccagcgccg

SEQ ID NO: 1304010 - RNA, 16 nt, Mycobacterium tuberculosis H37Rv
cggcgaccacggcacc

SEQ ID NO: 1304011 - RNA, 14 nt, Mycobacterium tuberculosis H37Rv
cggcgaagccgggu

SEQ ID NO: 1304012 - RNA, 15 nt, Mycobacterium tuberculosis H37Rv
cggcgaagaccgccg

SEQ ID NO: 1304013 - RNA, 18 nt, Mycobacterium tuberculosis H37Rv
cggcgaagaccgccggga

SEQ ID NO: 1304014 - RNA, 19 nt, Mycobacterium tuberculosis H37Rv
cggcgaacugggugcgguc

SEQ ID NO: 1304015 - RNA, 19 nt, Mycobacterium tuberculosis H37Rv
cggcgaacucuacgguggu

SEQ ID NO: 1304016 - RNA, 14 nt, Mycobacterium tuberculosis H37Rv
cggcgaacugggug

SEQ ID NO: 1304017 - RNA, 18 nt, Mycobacterium tuberculosis H37Rv
cggcgaacucuacggugg

SEQ ID NO: 1304018 - RNA, 15 nt, Mycobacterium tuberculosis H37Rv
cggcgaacucggcga

SEQ ID NO: 1304019 - RNA, 17 nt, Mycobacterium tuberculosis H37Rv
cggcgaacucgggcgac

SEQ ID NO: 1304020 - RNA, 14 nt, Mycobacterium tuberculosis H37Rv
cggcgaaccagcgc

SEQ ID NO: 1304021 - RNA, 14 nt, Mycobacterium tuberculosis H37Rv
cggcgaacccaccg

SEQ ID NO: 1304022 - RNA, 20 nt, Mycobacterium tuberculosis H37Rv
cggcgaacaucaccgucgcc

SEQ ID NO: 1304023 - RNA, 18 nt, Mycobacterium tuberculosis H37Rv
cggcgaaccacggcagcc

SEQ ID NO: 1304024 - RNA, 17 nt, Mycobacterium tuberculosis H37Rv
cggcgaacaucaccguc

SEQ ID NO: 1304025 - RNA, 16 nt, Mycobacterium tuberculosis H37Rv
cggcgaacaaccacgc

SEQ ID NO: 1304026 - RNA, 17 nt, Mycobacterium tuberculosis H37Rv
cggcgaacagccccagg

SEQ ID NO: 1304027 - RNA, 18 nt, Mycobacterium tuberculosis H37Rv
cggcgaacccaccgcauu

SEQ ID NO: 1304028 - RNA, 15 nt, Mycobacterium tuberculosis H37Rv
cggcgaacccgccga

SEQ ID NO: 1304029 - RNA, 19 nt, Mycobacterium tuberculosis H37Rv
cggcgaaccggcccaccga

SEQ ID NO: 1304030 - RNA, 23 nt, Mycobacterium tuberculosis H37Rv
cggcgaaccuugguugccaacga

SEQ ID NO: 1304031 - RNA, 19 nt, Mycobacterium tuberculosis H37Rv
cggcgaacgcguccagcgc

SEQ ID NO: 1304032 - RNA, 16 nt, Mycobacterium tuberculosis H37Rv
cggcgaaaggccaguc

SEQ ID NO: 1304033 - RNA, 23 nt, Mycobacterium tuberculosis H37Rv
cggcgaaaucgacagcagcgcga

SEQ ID NO: 1304034 - RNA, 20 nt, Mycobacterium tuberculosis H37Rv
cggcgaaaugaagugcaccg

SEQ ID NO: 1304035 - RNA, 18 nt, Mycobacterium tuberculosis H37Rv
cggcgaaagcuugggcga

SEQ ID NO: 1304036 - RNA, 22 nt, Mycobacterium tuberculosis H37Rv
cggccuugcucagcacgccggg

SEQ ID NO: 1304037 - RNA, 21 nt, Mycobacterium tuberculosis H37Rv
cggcgaaacucgucgauucgg

SEQ ID NO: 1304038 - RNA, 23 nt, Mycobacterium tuberculosis H37Rv
cggccuugcgggcucucggcguc

SEQ ID NO: 1304039 - RNA, 21 nt, Mycobacterium tuberculosis H37Rv
cggccuugcgcacaggcgcga

SEQ ID NO: 1304040 - RNA, 13 nt, Mycobacterium tuberculosis H37Rv
cggccuugccacc

SEQ ID NO: 1304041 - RNA, 17 nt, Mycobacterium tuberculosis H37Rv
cggccuugccaccggua

SEQ ID NO: 1304042 - RNA, 18 nt, Mycobacterium tuberculosis H37Rv
cggccuugccaccgguac

SEQ ID NO: 1304043 - RNA, 19 nt, Mycobacterium tuberculosis H37Rv
cggccuugaucgugcuggc

SEQ ID NO: 1304044 - RNA, 16 nt, Mycobacterium tuberculosis H37Rv
cggccuugaucaccgu

SEQ ID NO: 1304045 - RNA, 17 nt, Mycobacterium tuberculosis H37Rv
cggccuugccgccggcu

SEQ ID NO: 1304046 - RNA, 15 nt, Mycobacterium tuberculosis H37Rv
cggccuugaucaccg

SEQ ID NO: 1304047 - RNA, 18 nt, Mycobacterium tuberculosis H37Rv
cggccuggccaccugguu

SEQ ID NO: 1304048 - RNA, 21 nt, Mycobacterium tuberculosis H37Rv
cggccugcucggcgaguucgg

SEQ ID NO: 1304049 - RNA, 15 nt, Mycobacterium tuberculosis H37Rv
cggccuggccaccug

SEQ ID NO: 1304050 - RNA, 14 nt, Mycobacterium tuberculosis H37Rv
cggccuggccaccu

SEQ ID NO: 1304051 - RNA, 14 nt, Mycobacterium tuberculosis H37Rv
cggccuggcacccg

SEQ ID NO: 1304052 - RNA, 18 nt, Mycobacterium tuberculosis H37Rv
cggccuggaucgugccga

SEQ ID NO: 1304053 - RNA, 17 nt, Mycobacterium tuberculosis H37Rv
cggccugcgcgaccgac

SEQ ID NO: 1304054 - RNA, 15 nt, Mycobacterium tuberculosis H37Rv
cggccugcggcaccg

SEQ ID NO: 1304055 - RNA, 20 nt, Mycobacterium tuberculosis H37Rv
cggccugcucgaccaugccg

SEQ ID NO: 1304056 - RNA, 17 nt, Mycobacterium tuberculosis H37Rv
cggccggccuagccgau

SEQ ID NO: 1304057 - RNA, 23 nt, Mycobacterium tuberculosis H37Rv
cggccggccgcucaccccgcgcu

SEQ ID NO: 1304058 - RNA, 23 nt, Mycobacterium tuberculosis H37Rv
cggccggcccggguaucgccagu

SEQ ID NO: 1304059 - RNA, 18 nt, Mycobacterium tuberculosis H37Rv
cggccggcaguccgagcu

SEQ ID NO: 1304060 - RNA, 22 nt, Mycobacterium tuberculosis H37Rv
cggccggcaccccacggccagu

SEQ ID NO: 1304061 - RNA, 17 nt, Mycobacterium tuberculosis H37Rv
cggcgauaacuccgcgg

SEQ ID NO: 1304062 - RNA, 18 nt, Mycobacterium tuberculosis H37Rv
cggcgauacccaucgauc

SEQ ID NO: 1304063 - RNA, 21 nt, Mycobacterium tuberculosis H37Rv
cggcgaucaacgcgcacgcgu

SEQ ID NO: 1304064 - RNA, 19 nt, Mycobacterium tuberculosis H37Rv
cggcgaucaacucgggcag

SEQ ID NO: 1304065 - RNA, 16 nt, Mycobacterium tuberculosis H37Rv
cggcgauaccgguugc

SEQ ID NO: 1304066 - RNA, 24 nt, Mycobacterium tuberculosis H37Rv
cggcgauaccgaggaucucgcggu

SEQ ID NO: 1304067 - RNA, 21 nt, Mycobacterium tuberculosis H37Rv
cggcgauaccgaggaucucgc

SEQ ID NO: 1304068 - RNA, 13 nt, Mycobacterium tuberculosis H37Rv
cggcgaggucccg

SEQ ID NO: 1304069 - RNA, 13 nt, Mycobacterium tuberculosis H37Rv
cggcgaguggcuc

SEQ ID NO: 1304070 - RNA, 20 nt, Mycobacterium tuberculosis H37Rv
cggcgagugguccagccaga

SEQ ID NO: 1304071 - RNA, 14 nt, Mycobacterium tuberculosis H37Rv
cggcgaggacgcgc

SEQ ID NO: 1304072 - RNA, 16 nt, Mycobacterium tuberculosis H37Rv
cggcgaggacggcggc

SEQ ID NO: 1304073 - RNA, 14 nt, Mycobacterium tuberculosis H37Rv
cggcgagggugagc

SEQ ID NO: 1304074 - RNA, 15 nt, Mycobacterium tuberculosis H37Rv
cggcgagcgcccugg

SEQ ID NO: 1304075 - RNA, 17 nt, Mycobacterium tuberculosis H37Rv
cggcgagcagacgccgc

SEQ ID NO: 1304076 - RNA, 19 nt, Mycobacterium tuberculosis H37Rv
cggcgagcacccgcugguc

SEQ ID NO: 1304077 - RNA, 14 nt, Mycobacterium tuberculosis H37Rv
cggcgagcaccacc

SEQ ID NO: 1304078 - RNA, 11 nt, Mycobacterium tuberculosis H37Rv
cggcgagcacc

SEQ ID NO: 1304079 - RNA, 16 nt, Mycobacterium tuberculosis H37Rv
cggcgacuacccagcc

SEQ ID NO: 1304080 - RNA, 17 nt, Mycobacterium tuberculosis H37Rv
cggcgacgggucgggca

SEQ ID NO: 1304081 - RNA, 24 nt, Mycobacterium tuberculosis H37Rv
cggcgacggugagggcgucgucga

SEQ ID NO: 1304082 - RNA, 22 nt, Mycobacterium tuberculosis H37Rv
cggcgacgugaauggugguguc

SEQ ID NO: 1304083 - RNA, 15 nt, Mycobacterium tuberculosis H37Rv
cggcgacucugugac

SEQ ID NO: 1304084 - RNA, 14 nt, Mycobacterium tuberculosis H37Rv
cggcgacugcagcg

SEQ ID NO: 1304085 - RNA, 23 nt, Mycobacterium tuberculosis H37Rv
cggcgagagggcggggcagaagu

SEQ ID NO: 1304086 - RNA, 18 nt, Mycobacterium tuberculosis H37Rv
cggcgagagggcggggca

SEQ ID NO: 1304087 - RNA, 14 nt, Mycobacterium tuberculosis H37Rv
cggcgagagcguca

SEQ ID NO: 1304088 - RNA, 12 nt, Mycobacterium tuberculosis H37Rv
cggcgacugcgu

SEQ ID NO: 1304089 - RNA, 13 nt, Mycobacterium tuberculosis H37Rv
cggcgacuguccc

SEQ ID NO: 1304090 - RNA, 14 nt, Mycobacterium tuberculosis H37Rv
cggcgagagccucg

SEQ ID NO: 1304091 - RNA, 19 nt, Mycobacterium tuberculosis H37Rv
cggcgagagccucggccau

SEQ ID NO: 1304092 - RNA, 20 nt, Mycobacterium tuberculosis H37Rv
cggcgagcacaugcugccgc

SEQ ID NO: 1304093 - RNA, 13 nt, Mycobacterium tuberculosis H37Rv
cggcgacggcguc

SEQ ID NO: 1304094 - RNA, 14 nt, Mycobacterium tuberculosis H37Rv
cggcgacggcgguc

SEQ ID NO: 1304095 - RNA, 13 nt, Mycobacterium tuberculosis H37Rv
cggcgacgccagu

SEQ ID NO: 1304096 - RNA, 13 nt, Mycobacterium tuberculosis H37Rv
cggcgacgucugc

SEQ ID NO: 1304097 - RNA, 18 nt, Mycobacterium tuberculosis H37Rv
cggcgacguuccgcucga

SEQ ID NO: 1304098 - RNA, 18 nt, Mycobacterium tuberculosis H37Rv
cggcgacgcgccgguuca

SEQ ID NO: 1304099 - RNA, 17 nt, Mycobacterium tuberculosis H37Rv
cggcgacgcuaccgccg

SEQ ID NO: 1304100 - RNA, 19 nt, Mycobacterium tuberculosis H37Rv
cggcgacgcuaccgccgga

SEQ ID NO: 1304101 - RNA, 16 nt, Mycobacterium tuberculosis H37Rv
cggcgacgcuaccgcc

SEQ ID NO: 1304102 - RNA, 20 nt, Mycobacterium tuberculosis H37Rv
cggcgacggccagcgcgucg

SEQ ID NO: 1304103 - RNA, 23 nt, Mycobacterium tuberculosis H37Rv
cggcgacgauucgagcgguugcc

SEQ ID NO: 1304104 - RNA, 15 nt, Mycobacterium tuberculosis H37Rv
cggcgacgaugucga

SEQ ID NO: 1304105 - RNA, 15 nt, Mycobacterium tuberculosis H37Rv
cggcgacgaucucgg

SEQ ID NO: 1304106 - RNA, 12 nt, Mycobacterium tuberculosis H37Rv
cggcgacgaugu

SEQ ID NO: 1304107 - RNA, 16 nt, Mycobacterium tuberculosis H37Rv
cggcgacgaccgucgg

SEQ ID NO: 1304108 - RNA, 13 nt, Mycobacterium tuberculosis H37Rv
cggcgacgaucuc

SEQ ID NO: 1304109 - RNA, 18 nt, Mycobacterium tuberculosis H37Rv
cggcgaccggguccggcg

SEQ ID NO: 1304110 - RNA, 12 nt, Mycobacterium tuberculosis H37Rv
cggcgaccgucg

SEQ ID NO: 1304111 - RNA, 17 nt, Mycobacterium tuberculosis H37Rv
cggcgaccuccgggaug

SEQ ID NO: 1304112 - RNA, 15 nt, Mycobacterium tuberculosis H37Rv
cggcgaccgcggucg

SEQ ID NO: 1304113 - RNA, 18 nt, Mycobacterium tuberculosis H37Rv
cggcgaccgcgcucaccg

SEQ ID NO: 1304114 - RNA, 13 nt, Mycobacterium tuberculosis H37Rv
cggcgaccgcgcu

SEQ ID NO: 1304115 - RNA, 22 nt, Mycobacterium tuberculosis H37Rv
cggcgaccugccggaccgcgga

SEQ ID NO: 1304116 - RNA, 20 nt, Mycobacterium tuberculosis H37Rv
cggcgacgaacucacgcagg

SEQ ID NO: 1304117 - RNA, 15 nt, Mycobacterium tuberculosis H37Rv
cggcgacgaccgucg

SEQ ID NO: 1304118 - RNA, 12 nt, Mycobacterium tuberculosis H37Rv
cggcgacccggu

SEQ ID NO: 1304119 - RNA, 16 nt, Mycobacterium tuberculosis H37Rv
cggcgacccgccugua

SEQ ID NO: 1304120 - RNA, 21 nt, Mycobacterium tuberculosis H37Rv
cggcgacccgccuguaccggc

SEQ ID NO: 1304121 - RNA, 17 nt, Mycobacterium tuberculosis H37Rv
cggcgaccgccugcgcg

SEQ ID NO: 1304122 - RNA, 23 nt, Mycobacterium tuberculosis H37Rv
cggcgaccccgaacauccgccgc

SEQ ID NO: 1304123 - RNA, 13 nt, Mycobacterium tuberculosis H37Rv
cggcgacccgggu

SEQ ID NO: 1304124 - RNA, 23 nt, Mycobacterium tuberculosis H37Rv
cggcgaccauaagcucguagagc

SEQ ID NO: 1304125 - RNA, 21 nt, Mycobacterium tuberculosis H37Rv
cggcgaccccgaacauccgcc

SEQ ID NO: 1304126 - RNA, 19 nt, Mycobacterium tuberculosis H37Rv
cggcgaccacggcaccgau

SEQ ID NO: 1304127 - RNA, 20 nt, Mycobacterium tuberculosis H37Rv
cggcgaccacggcaccgauc

SEQ ID NO: 1304128 - RNA, 18 nt, Mycobacterium tuberculosis H37Rv
cggcgaccacggcaccga

SEQ ID NO: 1304129 - RNA, 17 nt, Mycobacterium tuberculosis H37Rv
cggcgaccaccguuuga

SEQ ID NO: 1304130 - RNA, 13 nt, Mycobacterium tuberculosis H37Rv
cggcgaccaccgu

SEQ ID NO: 1304131 - RNA, 13 nt, Mycobacterium tuberculosis H37Rv
cggcgaucacgcg

SEQ ID NO: 1304132 - RNA, 11 nt, Mycobacterium tuberculosis H37Rv
cggcgaucacg

SEQ ID NO: 1304133 - RNA, 14 nt, Mycobacterium tuberculosis H37Rv
cggcgaucacgcga

SEQ ID NO: 1304134 - RNA, 13 nt, Mycobacterium tuberculosis H37Rv
cggcgaugcgguc

SEQ ID NO: 1304135 - RNA, 11 nt, Mycobacterium tuberculosis H37Rv
cggcgaugcgg

SEQ ID NO: 1304136 - RNA, 16 nt, Mycobacterium tuberculosis H37Rv
cggcgauuacggccag

SEQ ID NO: 1304137 - RNA, 17 nt, Mycobacterium tuberculosis H37Rv
cggcgauuacggccagu

SEQ ID NO: 1304138 - RNA, 15 nt, Mycobacterium tuberculosis H37Rv
cggcgaugcggucgg

SEQ ID NO: 1304139 - RNA, 13 nt, Mycobacterium tuberculosis H37Rv
cggcgauggagcg

SEQ ID NO: 1304140 - RNA, 17 nt, Mycobacterium tuberculosis H37Rv
cggcgauggagcgguag

SEQ ID NO: 1304141 - RNA, 18 nt, Mycobacterium tuberculosis H37Rv
cggcgauggccagcacgg

SEQ ID NO: 1304142 - RNA, 12 nt, Mycobacterium tuberculosis H37Rv
cggcgauggccc

SEQ ID NO: 1304143 - RNA, 18 nt, Mycobacterium tuberculosis H37Rv
cggcgcaagcgccgcgcu

SEQ ID NO: 1304144 - RNA, 15 nt, Mycobacterium tuberculosis H37Rv
cggcgauucccgcga

SEQ ID NO: 1304145 - RNA, 19 nt, Mycobacterium tuberculosis H37Rv
cggcgauuggaccgccaau

SEQ ID NO: 1304146 - RNA, 18 nt, Mycobacterium tuberculosis H37Rv
cggcgauuggcugugauc

SEQ ID NO: 1304147 - RNA, 19 nt, Mycobacterium tuberculosis H37Rv
cggcgcaagcgccgcgcuu

SEQ ID NO: 1304148 - RNA, 18 nt, Mycobacterium tuberculosis H37Rv
cggcgcaccuugaccguc

SEQ ID NO: 1304149 - RNA, 20 nt, Mycobacterium tuberculosis H37Rv
cggcgcaccuugaccgucgc

SEQ ID NO: 1304150 - RNA, 16 nt, Mycobacterium tuberculosis H37Rv
cggcgcaugcguaugc

SEQ ID NO: 1304151 - RNA, 19 nt, Mycobacterium tuberculosis H37Rv
cggcgcaguuggcaccagc

SEQ ID NO: 1304152 - RNA, 15 nt, Mycobacterium tuberculosis H37Rv
cggcgcagugguguc

SEQ ID NO: 1304153 - RNA, 22 nt, Mycobacterium tuberculosis H37Rv
cggcgccugacucaucaccgau

SEQ ID NO: 1304154 - RNA, 20 nt, Mycobacterium tuberculosis H37Rv
cggcgccugaggugcugcca

SEQ ID NO: 1304155 - RNA, 21 nt, Mycobacterium tuberculosis H37Rv
cggcgccugaggugcugccaa

SEQ ID NO: 1304156 - RNA, 21 nt, Mycobacterium tuberculosis H37Rv
cggcgccucguugccguagcu

SEQ ID NO: 1304157 - RNA, 14 nt, Mycobacterium tuberculosis H37Rv
cggcgccugcugcg

SEQ ID NO: 1304158 - RNA, 19 nt, Mycobacterium tuberculosis H37Rv
cggcgccuccggcaccucc

SEQ ID NO: 1304159 - RNA, 15 nt, Mycobacterium tuberculosis H37Rv
cggcgccuccggcac

SEQ ID NO: 1304160 - RNA, 16 nt, Mycobacterium tuberculosis H37Rv
cggcgccucggaccag

SEQ ID NO: 1304161 - RNA, 16 nt, Mycobacterium tuberculosis H37Rv
cggcgccucguugccg

SEQ ID NO: 1304162 - RNA, 20 nt, Mycobacterium tuberculosis H37Rv
cggcgccucaucggacagcg

SEQ ID NO: 1304163 - RNA, 17 nt, Mycobacterium tuberculosis H37Rv
cggcgccucaucggaca

SEQ ID NO: 1304164 - RNA, 20 nt, Mycobacterium tuberculosis H37Rv
cggcgccuaaagacucgacc

SEQ ID NO: 1304165 - RNA, 18 nt, Mycobacterium tuberculosis H37Rv
cggcgccuaaagacucga

SEQ ID NO: 1304166 - RNA, 22 nt, Mycobacterium tuberculosis H37Rv
cggcgccggggggcugcugcuc

SEQ ID NO: 1304167 - RNA, 18 nt, Mycobacterium tuberculosis H37Rv
cggcgccguugccgccgu

SEQ ID NO: 1304168 - RNA, 13 nt, Mycobacterium tuberculosis H37Rv
cggcgccggcuug

SEQ ID NO: 1304169 - RNA, 16 nt, Mycobacterium tuberculosis H37Rv
cggcgccggugccgcc

SEQ ID NO: 1304170 - RNA, 18 nt, Mycobacterium tuberculosis H37Rv
cggcgccgcccagcaucu

SEQ ID NO: 1304171 - RNA, 14 nt, Mycobacterium tuberculosis H37Rv
cggcgccgcccagc

SEQ ID NO: 1304172 - RNA, 20 nt, Mycobacterium tuberculosis H37Rv
cggcgccgcccgcgccacca

SEQ ID NO: 1304173 - RNA, 15 nt, Mycobacterium tuberculosis H37Rv
cggcgccgcaaugac

SEQ ID NO: 1304174 - RNA, 13 nt, Mycobacterium tuberculosis H37Rv
cggcgccggcgca

SEQ ID NO: 1304175 - RNA, 17 nt, Mycobacterium tuberculosis H37Rv
cggcgccggcgccucgu

SEQ ID NO: 1304176 - RNA, 22 nt, Mycobacterium tuberculosis H37Rv
cggcgccgcccaacgcgagcuu

SEQ ID NO: 1304177 - RNA, 14 nt, Mycobacterium tuberculosis H37Rv
cggcgccgccauug

SEQ ID NO: 1304178 - RNA, 17 nt, Mycobacterium tuberculosis H37Rv
cggcgccgccauugucg

SEQ ID NO: 1304179 - RNA, 13 nt, Mycobacterium tuberculosis H37Rv
cggcgccgccauu

SEQ ID NO: 1304180 - RNA, 18 nt, Mycobacterium tuberculosis H37Rv
cggcgccgccaucaacaa

SEQ ID NO: 1304181 - RNA, 15 nt, Mycobacterium tuberculosis H37Rv
cggcgccgccacgga

SEQ ID NO: 1304182 - RNA, 15 nt, Mycobacterium tuberculosis H37Rv
cggcgccgaggucga

SEQ ID NO: 1304183 - RNA, 19 nt, Mycobacterium tuberculosis H37Rv
cggcgccgcagaucaccgc

SEQ ID NO: 1304184 - RNA, 22 nt, Mycobacterium tuberculosis H37Rv
cggcgccgcagaucaccgccag

SEQ ID NO: 1304185 - RNA, 14 nt, Mycobacterium tuberculosis H37Rv
cggcgccgcaccca

SEQ ID NO: 1304186 - RNA, 17 nt, Mycobacterium tuberculosis H37Rv
cggcgccgaaaccgccg

SEQ ID NO: 1304187 - RNA, 23 nt, Mycobacterium tuberculosis H37Rv
cggcgccaggcaccacgaccgac

SEQ ID NO: 1304188 - RNA, 21 nt, Mycobacterium tuberculosis H37Rv
cggcgccaauggcggaccggg

SEQ ID NO: 1304189 - RNA, 12 nt, Mycobacterium tuberculosis H37Rv
cggcgccaccgc

SEQ ID NO: 1304190 - RNA, 24 nt, Mycobacterium tuberculosis H37Rv
cggcgccaccguugccgaaccacg

SEQ ID NO: 1304191 - RNA, 16 nt, Mycobacterium tuberculosis H37Rv
cggcgccagaucgacg

SEQ ID NO: 1304192 - RNA, 19 nt, Mycobacterium tuberculosis H37Rv
cggcggagcgaugcgggca

SEQ ID NO: 1304193 - RNA, 19 nt, Mycobacterium tuberculosis H37Rv
cggcggagacggcggccau

SEQ ID NO: 1304194 - RNA, 18 nt, Mycobacterium tuberculosis H37Rv
cggcgcugggacggucgc

SEQ ID NO: 1304195 - RNA, 19 nt, Mycobacterium tuberculosis H37Rv
cggcggacugagagauggu

SEQ ID NO: 1304196 - RNA, 20 nt, Mycobacterium tuberculosis H37Rv
cggcgcuggcgggcgaucuc

SEQ ID NO: 1304197 - RNA, 13 nt, Mycobacterium tuberculosis H37Rv
cggcgcuggccag

SEQ ID NO: 1304198 - RNA, 15 nt, Mycobacterium tuberculosis H37Rv
cggcgcuggccagca

SEQ ID NO: 1304199 - RNA, 22 nt, Mycobacterium tuberculosis H37Rv
cggcgcuggccgucgaagacga

SEQ ID NO: 1304200 - RNA, 15 nt, Mycobacterium tuberculosis H37Rv
cggcgcuggccgucg

SEQ ID NO: 1304201 - RNA, 14 nt, Mycobacterium tuberculosis H37Rv
cggcgcucggcgag

SEQ ID NO: 1304202 - RNA, 20 nt, Mycobacterium tuberculosis H37Rv
cggcgcucuugcucaccaga

SEQ ID NO: 1304203 - RNA, 14 nt, Mycobacterium tuberculosis H37Rv
cggcgcugcugcca

SEQ ID NO: 1304204 - RNA, 15 nt, Mycobacterium tuberculosis H37Rv
cggcgcugcgcgcga

SEQ ID NO: 1304205 - RNA, 15 nt, Mycobacterium tuberculosis H37Rv
cggcgcugaucgcga

SEQ ID NO: 1304206 - RNA, 15 nt, Mycobacterium tuberculosis H37Rv
cggcgcugaucgcgc

SEQ ID NO: 1304207 - RNA, 15 nt, Mycobacterium tuberculosis H37Rv
cggcgcugcgcgauc

SEQ ID NO: 1304208 - RNA, 13 nt, Mycobacterium tuberculosis H37Rv
cggcgcucggcca

SEQ ID NO: 1304209 - RNA, 15 nt, Mycobacterium tuberculosis H37Rv
cggcgcuccgccaga

SEQ ID NO: 1304210 - RNA, 20 nt, Mycobacterium tuberculosis H37Rv
cggcgcucccgccggcagcg

SEQ ID NO: 1304211 - RNA, 22 nt, Mycobacterium tuberculosis H37Rv
cggcgcucccgccggcagcguc

SEQ ID NO: 1304212 - RNA, 15 nt, Mycobacterium tuberculosis H37Rv
cggcggcagucgcgg

SEQ ID NO: 1304213 - RNA, 23 nt, Mycobacterium tuberculosis H37Rv
cggcggcaucaccuggcgugucg

SEQ ID NO: 1304214 - RNA, 14 nt, Mycobacterium tuberculosis H37Rv
cggcggccaccagu

SEQ ID NO: 1304215 - RNA, 22 nt, Mycobacterium tuberculosis H37Rv
cggcggccccaggggcaccagc

SEQ ID NO: 1304216 - RNA, 16 nt, Mycobacterium tuberculosis H37Rv
cggcggcccaucgacc

SEQ ID NO: 1304217 - RNA, 17 nt, Mycobacterium tuberculosis H37Rv
cggcggccccaggggca

SEQ ID NO: 1304218 - RNA, 22 nt, Mycobacterium tuberculosis H37Rv
cggcggccauguugcccugcaa

SEQ ID NO: 1304219 - RNA, 18 nt, Mycobacterium tuberculosis H37Rv
cggcggcccacgcgcacu

SEQ ID NO: 1304220 - RNA, 22 nt, Mycobacterium tuberculosis H37Rv
cggcggccauucggucagccag

SEQ ID NO: 1304221 - RNA, 16 nt, Mycobacterium tuberculosis H37Rv
cggcggccacggccau

SEQ ID NO: 1304222 - RNA, 20 nt, Mycobacterium tuberculosis H37Rv
cggcggccaccucuucucgg

SEQ ID NO: 1304223 - RNA, 13 nt, Mycobacterium tuberculosis H37Rv
cggcggaucugau

SEQ ID NO: 1304224 - RNA, 12 nt, Mycobacterium tuberculosis H37Rv
cggcggagugca

SEQ ID NO: 1304225 - RNA, 12 nt, Mycobacterium tuberculosis H37Rv
cggcggagucga

SEQ ID NO: 1304226 - RNA, 19 nt, Mycobacterium tuberculosis H37Rv
cggcgcguugggaccagug

SEQ ID NO: 1304227 - RNA, 19 nt, Mycobacterium tuberculosis H37Rv
cggcgcuagcgccgcgcuu

SEQ ID NO: 1304228 - RNA, 15 nt, Mycobacterium tuberculosis H37Rv
cggcgcuagcgccgc

SEQ ID NO: 1304229 - RNA, 18 nt, Mycobacterium tuberculosis H37Rv
cggcgcuagcgccgcgcu

SEQ ID NO: 1304230 - RNA, 17 nt, Mycobacterium tuberculosis H37Rv
cggcgcuaugaagucga

SEQ ID NO: 1304231 - RNA, 22 nt, Mycobacterium tuberculosis H37Rv
cggcgcggagagccugcucgca

SEQ ID NO: 1304232 - RNA, 15 nt, Mycobacterium tuberculosis H37Rv
cggcgcggagugccc

SEQ ID NO: 1304233 - RNA, 18 nt, Mycobacterium tuberculosis H37Rv
cggcgcggaacgcgucgc

SEQ ID NO: 1304234 - RNA, 12 nt, Mycobacterium tuberculosis H37Rv
cggcgcgcugaa

SEQ ID NO: 1304235 - RNA, 16 nt, Mycobacterium tuberculosis H37Rv
cggcgcggcggcgucg

SEQ ID NO: 1304236 - RNA, 15 nt, Mycobacterium tuberculosis H37Rv
cggcgcgcucggccg

SEQ ID NO: 1304237 - RNA, 14 nt, Mycobacterium tuberculosis H37Rv
cggcgcgcugcacg

SEQ ID NO: 1304238 - RNA, 18 nt, Mycobacterium tuberculosis H37Rv
cggcgcgcugcacggaau

SEQ ID NO: 1304239 - RNA, 14 nt, Mycobacterium tuberculosis H37Rv
cggcgcgcggguug

SEQ ID NO: 1304240 - RNA, 17 nt, Mycobacterium tuberculosis H37Rv
cggcgcgcgcugcgcag

SEQ ID NO: 1304241 - RNA, 17 nt, Mycobacterium tuberculosis H37Rv
cggcgcgcgcgccggcu

SEQ ID NO: 1304242 - RNA, 20 nt, Mycobacterium tuberculosis H37Rv
cggcgcgccaaacaccccgg

SEQ ID NO: 1304243 - RNA, 20 nt, Mycobacterium tuberculosis H37Rv
cggcgcgaagucuugaccgc

SEQ ID NO: 1304244 - RNA, 13 nt, Mycobacterium tuberculosis H37Rv
cggcgcgacaggu

SEQ ID NO: 1304245 - RNA, 21 nt, Mycobacterium tuberculosis H37Rv
cggcgcgacaggugcuaggag

SEQ ID NO: 1304246 - RNA, 16 nt, Mycobacterium tuberculosis H37Rv
cggcgcgacagccgug

SEQ ID NO: 1304247 - RNA, 23 nt, Mycobacterium tuberculosis H37Rv
cggcgcgacagccguggcgcgac

SEQ ID NO: 1304248 - RNA, 15 nt, Mycobacterium tuberculosis H37Rv
cggcgcgaaucacgu

SEQ ID NO: 1304249 - RNA, 20 nt, Mycobacterium tuberculosis H37Rv
cggcgccuggcggcgccgca

SEQ ID NO: 1304250 - RNA, 13 nt, Mycobacterium tuberculosis H37Rv
cggcccgacgggu

SEQ ID NO: 1304251 - RNA, 21 nt, Mycobacterium tuberculosis H37Rv
cggccccgccguuuccgccgc

SEQ ID NO: 1304252 - RNA, 23 nt, Mycobacterium tuberculosis H37Rv
cggccccgccgucaccgccguug

SEQ ID NO: 1304253 - RNA, 17 nt, Mycobacterium tuberculosis H37Rv
cggccccgccguugccg

SEQ ID NO: 1304254 - RNA, 19 nt, Mycobacterium tuberculosis H37Rv
cggccccgccgucaccgcc

SEQ ID NO: 1304255 - RNA, 14 nt, Mycobacterium tuberculosis H37Rv
cggccccgccgcua

SEQ ID NO: 1304256 - RNA, 15 nt, Mycobacterium tuberculosis H37Rv
cggccccgccgucac

SEQ ID NO: 1304257 - RNA, 14 nt, Mycobacterium tuberculosis H37Rv
cggccccgccgaug

SEQ ID NO: 1304258 - RNA, 13 nt, Mycobacterium tuberculosis H37Rv
cggcccgcccgua

SEQ ID NO: 1304259 - RNA, 18 nt, Mycobacterium tuberculosis H37Rv
cggcccgcaucguugccg

SEQ ID NO: 1304260 - RNA, 19 nt, Mycobacterium tuberculosis H37Rv
cggcccgcaucguugccga

SEQ ID NO: 1304261 - RNA, 20 nt, Mycobacterium tuberculosis H37Rv
cggcccgcaucguugccgac

SEQ ID NO: 1304262 - RNA, 14 nt, Mycobacterium tuberculosis H37Rv
cggcccgcagcgug

SEQ ID NO: 1304263 - RNA, 15 nt, Mycobacterium tuberculosis H37Rv
cggcccgaucaccag

SEQ ID NO: 1304264 - RNA, 17 nt, Mycobacterium tuberculosis H37Rv
cggcccgaucaccagcc

SEQ ID NO: 1304265 - RNA, 18 nt, Mycobacterium tuberculosis H37Rv
cggcccgcaacgcgucgg

SEQ ID NO: 1304266 - RNA, 21 nt, Mycobacterium tuberculosis H37Rv
cggcccgaucccgaucgauca

SEQ ID NO: 1304267 - RNA, 16 nt, Mycobacterium tuberculosis H37Rv
cggcccgcacggccgc

SEQ ID NO: 1304268 - RNA, 20 nt, Mycobacterium tuberculosis H37Rv
cggcccuacgcagcgcggcu

SEQ ID NO: 1304269 - RNA, 12 nt, Mycobacterium tuberculosis H37Rv
cggccgaaacgc

SEQ ID NO: 1304270 - RNA, 13 nt, Mycobacterium tuberculosis H37Rv
cggccgaaacgcc

SEQ ID NO: 1304271 - RNA, 12 nt, Mycobacterium tuberculosis H37Rv
cggcccuccacc

SEQ ID NO: 1304272 - RNA, 15 nt, Mycobacterium tuberculosis H37Rv
cggcccuccaccggu

SEQ ID NO: 1304273 - RNA, 17 nt, Mycobacterium tuberculosis H37Rv
cggcccguagcugcgca

SEQ ID NO: 1304274 - RNA, 20 nt, Mycobacterium tuberculosis H37Rv
cggcccguagcugcgcagcg

SEQ ID NO: 1304275 - RNA, 16 nt, Mycobacterium tuberculosis H37Rv
cggcccgugugggcgu

SEQ ID NO: 1304276 - RNA, 18 nt, Mycobacterium tuberculosis H37Rv
cggcccguuugccgguuc

SEQ ID NO: 1304277 - RNA, 17 nt, Mycobacterium tuberculosis H37Rv
cggcccuaaacaccgcg

SEQ ID NO: 1304278 - RNA, 17 nt, Mycobacterium tuberculosis H37Rv
cggcccgggcucggcga

SEQ ID NO: 1304279 - RNA, 16 nt, Mycobacterium tuberculosis H37Rv
cggcccgggcucggcg

SEQ ID NO: 1304280 - RNA, 15 nt, Mycobacterium tuberculosis H37Rv
cggcccggacgucgg

SEQ ID NO: 1304281 - RNA, 22 nt, Mycobacterium tuberculosis H37Rv
cggcccggucuacgccaccgag

SEQ ID NO: 1304282 - RNA, 13 nt, Mycobacterium tuberculosis H37Rv
cggcccgcugugg

SEQ ID NO: 1304283 - RNA, 21 nt, Mycobacterium tuberculosis H37Rv
cggcccgcucaacgggccgca

SEQ ID NO: 1304284 - RNA, 23 nt, Mycobacterium tuberculosis H37Rv
cggcccgcucauuggcauugccc

SEQ ID NO: 1304285 - RNA, 15 nt, Mycobacterium tuberculosis H37Rv
cggcccgcuccacgg

SEQ ID NO: 1304286 - RNA, 15 nt, Mycobacterium tuberculosis H37Rv
cggcccgcggucgcg

SEQ ID NO: 1304287 - RNA, 15 nt, Mycobacterium tuberculosis H37Rv
cggccgcacgccgac

SEQ ID NO: 1304288 - RNA, 14 nt, Mycobacterium tuberculosis H37Rv
cggccgcacccguu

SEQ ID NO: 1304289 - RNA, 15 nt, Mycobacterium tuberculosis H37Rv
cggccgccagcgcgc

SEQ ID NO: 1304290 - RNA, 15 nt, Mycobacterium tuberculosis H37Rv
cggccgccaucaucg

SEQ ID NO: 1304291 - RNA, 20 nt, Mycobacterium tuberculosis H37Rv
cggccgccaguucggcgucg

SEQ ID NO: 1304292 - RNA, 20 nt, Mycobacterium tuberculosis H37Rv
cggccgcgaccagcgccgca

SEQ ID NO: 1304293 - RNA, 22 nt, Mycobacterium tuberculosis H37Rv
cggccgcgaccagcgccgcacc

SEQ ID NO: 1304294 - RNA, 14 nt, Mycobacterium tuberculosis H37Rv
cggccgaugcgacc

SEQ ID NO: 1304295 - RNA, 23 nt, Mycobacterium tuberculosis H37Rv
cggccgauggugugcacggcuuc

SEQ ID NO: 1304296 - RNA, 17 nt, Mycobacterium tuberculosis H37Rv
cggccgaucucggugac

SEQ ID NO: 1304297 - RNA, 23 nt, Mycobacterium tuberculosis H37Rv
cggccgaaagagccagcggcacu

SEQ ID NO: 1304298 - RNA, 20 nt, Mycobacterium tuberculosis H37Rv
cggccgaacaaccuucgggc

SEQ ID NO: 1304299 - RNA, 13 nt, Mycobacterium tuberculosis H37Rv
cggccgcugccac

SEQ ID NO: 1304300 - RNA, 18 nt, Mycobacterium tuberculosis H37Rv
cggccggcaccccacggc

SEQ ID NO: 1304301 - RNA, 17 nt, Mycobacterium tuberculosis H37Rv
cggccgcugaucaacag

SEQ ID NO: 1304302 - RNA, 12 nt, Mycobacterium tuberculosis H37Rv
cggccgcuggcg

SEQ ID NO: 1304303 - RNA, 19 nt, Mycobacterium tuberculosis H37Rv
cggccgcucguuacgccga

SEQ ID NO: 1304304 - RNA, 15 nt, Mycobacterium tuberculosis H37Rv
cggccgcgccgucgg

SEQ ID NO: 1304305 - RNA, 17 nt, Mycobacterium tuberculosis H37Rv
cggccgcgugcucgccg

SEQ ID NO: 1304306 - RNA, 19 nt, Mycobacterium tuberculosis H37Rv
cggccgcgugcucgccgua

SEQ ID NO: 1304307 - RNA, 12 nt, Mycobacterium tuberculosis H37Rv
cggccgcgcugc

SEQ ID NO: 1304308 - RNA, 13 nt, Mycobacterium tuberculosis H37Rv
cggccgcgcugaa

SEQ ID NO: 1304309 - RNA, 14 nt, Mycobacterium tuberculosis H37Rv
cggccgcgacggau

SEQ ID NO: 1304310 - RNA, 12 nt, Mycobacterium tuberculosis H37Rv
cggccgcgaugg

SEQ ID NO: 1304311 - RNA, 14 nt, Mycobacterium tuberculosis H37Rv
cggccgcgacgaca

SEQ ID NO: 1304312 - RNA, 17 nt, Mycobacterium tuberculosis H37Rv
cggccgccuucuccggc

SEQ ID NO: 1304313 - RNA, 19 nt, Mycobacterium tuberculosis H37Rv
cggccagccuaccggcuac

SEQ ID NO: 1304314 - RNA, 23 nt, Mycobacterium tuberculosis H37Rv
cggccagcaagacgaugacagac

SEQ ID NO: 1304315 - RNA, 21 nt, Mycobacterium tuberculosis H37Rv
cggccagauagguuccaccgg

SEQ ID NO: 1304316 - RNA, 16 nt, Mycobacterium tuberculosis H37Rv
cggccaccaccgccgc

SEQ ID NO: 1304317 - RNA, 22 nt, Mycobacterium tuberculosis H37Rv
cggccaggaguuugaccaccug

SEQ ID NO: 1304318 - RNA, 18 nt, Mycobacterium tuberculosis H37Rv
cggccaggauuucgcagu

SEQ ID NO: 1304319 - RNA, 17 nt, Mycobacterium tuberculosis H37Rv
cggccagcuguucgagc

SEQ ID NO: 1304320 - RNA, 19 nt, Mycobacterium tuberculosis H37Rv
cggccagcuugcggagccg

SEQ ID NO: 1304321 - RNA, 14 nt, Mycobacterium tuberculosis H37Rv
cggccagcucgggc

SEQ ID NO: 1304322 - RNA, 19 nt, Mycobacterium tuberculosis H37Rv
cggccagcuccagcgccgc

SEQ ID NO: 1304323 - RNA, 18 nt, Mycobacterium tuberculosis H37Rv
cggccagcgccucgguga

SEQ ID NO: 1304324 - RNA, 14 nt, Mycobacterium tuberculosis H37Rv
cggcccccggcagc

SEQ ID NO: 1304325 - RNA, 15 nt, Mycobacterium tuberculosis H37Rv
cggcccccccccagg

SEQ ID NO: 1304326 - RNA, 18 nt, Mycobacterium tuberculosis H37Rv
cggccccgaaacgauggc

SEQ ID NO: 1304327 - RNA, 16 nt, Mycobacterium tuberculosis H37Rv
cggccccgaaacgaug

SEQ ID NO: 1304328 - RNA, 14 nt, Mycobacterium tuberculosis H37Rv
cggcccagguugcc

SEQ ID NO: 1304329 - RNA, 21 nt, Mycobacterium tuberculosis H37Rv
cggccaugguguucggcagcg

SEQ ID NO: 1304330 - RNA, 17 nt, Mycobacterium tuberculosis H37Rv
cggccauguagccguug

SEQ ID NO: 1304331 - RNA, 20 nt, Mycobacterium tuberculosis H37Rv
cggccauguugcccugcaac

SEQ ID NO: 1304332 - RNA, 14 nt, Mycobacterium tuberculosis H37Rv
cggccaucguccag

SEQ ID NO: 1304333 - RNA, 13 nt, Mycobacterium tuberculosis H37Rv
cggccaucgucca

SEQ ID NO: 1304334 - RNA, 20 nt, Mycobacterium tuberculosis H37Rv
cggcccaaacggcgugucgg

SEQ ID NO: 1304335 - RNA, 20 nt, Mycobacterium tuberculosis H37Rv
cggccauugcccgggcggga

SEQ ID NO: 1304336 - RNA, 21 nt, Mycobacterium tuberculosis H37Rv
cggccauuagcagcacccggg

SEQ ID NO: 1304337 - RNA, 20 nt, Mycobacterium tuberculosis H37Rv
cggccauuagcagcacccgg

SEQ ID NO: 1304338 - RNA, 15 nt, Mycobacterium tuberculosis H37Rv
cggccaguacgucga

SEQ ID NO: 1304339 - RNA, 18 nt, Mycobacterium tuberculosis H37Rv
cggccaguacgucgauca

SEQ ID NO: 1304340 - RNA, 23 nt, Mycobacterium tuberculosis H37Rv
cggccagugacaacgcgaugccg

SEQ ID NO: 1304341 - RNA, 14 nt, Mycobacterium tuberculosis H37Rv
cggccagugccggu

SEQ ID NO: 1304342 - RNA, 12 nt, Mycobacterium tuberculosis H37Rv
cggccaucgacg

SEQ ID NO: 1304343 - RNA, 19 nt, Mycobacterium tuberculosis H37Rv
cggccaucgaccguccggg

SEQ ID NO: 1304344 - RNA, 13 nt, Mycobacterium tuberculosis H37Rv
cggccaucgcccg

SEQ ID NO: 1304345 - RNA, 17 nt, Mycobacterium tuberculosis H37Rv
cggccauccaccgcaga

SEQ ID NO: 1304346 - RNA, 14 nt, Mycobacterium tuberculosis H37Rv
cggccaucgaccgu

SEQ ID NO: 1304347 - RNA, 19 nt, Mycobacterium tuberculosis H37Rv
cggccauccggucgcucga

SEQ ID NO: 1304348 - RNA, 12 nt, Mycobacterium tuberculosis H37Rv
cggccauccacc

SEQ ID NO: 1304349 - RNA, 14 nt, Mycobacterium tuberculosis H37Rv
aacaucuccgcguc

SEQ ID NO: 1304350 - RNA, 23 nt, Mycobacterium tuberculosis H37Rv
aacaucggaacgugaccgacgcc

SEQ ID NO: 1304351 - RNA, 22 nt, Mycobacterium tuberculosis H37Rv
cggccaggucgcgauagccgcc

SEQ ID NO: 1304352 - RNA, 17 nt, Mycobacterium tuberculosis H37Rv
cggccaggucggcguug

SEQ ID NO: 1304353 - RNA, 15 nt, Mycobacterium tuberculosis H37Rv
aacaucgagcgccag

SEQ ID NO: 1304354 - RNA, 13 nt, Mycobacterium tuberculosis H37Rv
cggcagcguugac

SEQ ID NO: 1304355 - RNA, 16 nt, Mycobacterium tuberculosis H37Rv
cggcaggugcccaucg

SEQ ID NO: 1304356 - RNA, 16 nt, Mycobacterium tuberculosis H37Rv
cggcagcguccacaug

SEQ ID NO: 1304357 - RNA, 18 nt, Mycobacterium tuberculosis H37Rv
cggcagcggugcuggugg

SEQ ID NO: 1304358 - RNA, 20 nt, Mycobacterium tuberculosis H37Rv
cggcagcggguuugccgggc

SEQ ID NO: 1304359 - RNA, 18 nt, Mycobacterium tuberculosis H37Rv
cggcagcggcgcgcugca

SEQ ID NO: 1304360 - RNA, 18 nt, Mycobacterium tuberculosis H37Rv
cggcagcggcgcucggcg

SEQ ID NO: 1304361 - RNA, 15 nt, Mycobacterium tuberculosis H37Rv
cggcagcggcgauca

SEQ ID NO: 1304362 - RNA, 17 nt, Mycobacterium tuberculosis H37Rv
cggcagcggcgcgcugc

SEQ ID NO: 1304363 - RNA, 21 nt, Mycobacterium tuberculosis H37Rv
cggcagcggcgaguuggccgu

SEQ ID NO: 1304364 - RNA, 18 nt, Mycobacterium tuberculosis H37Rv
cggcagcgaggccauguu

SEQ ID NO: 1304365 - RNA, 21 nt, Mycobacterium tuberculosis H37Rv
cggcagcgcccagaucgccga

SEQ ID NO: 1304366 - RNA, 16 nt, Mycobacterium tuberculosis H37Rv
cggcagcgagucgacg

SEQ ID NO: 1304367 - RNA, 22 nt, Mycobacterium tuberculosis H37Rv
cggcagcgaucggggcggugac

SEQ ID NO: 1304368 - RNA, 14 nt, Mycobacterium tuberculosis H37Rv
cggcagcgaugcgg

SEQ ID NO: 1304369 - RNA, 17 nt, Mycobacterium tuberculosis H37Rv
cggcagcgcggccaauu

SEQ ID NO: 1304370 - RNA, 19 nt, Mycobacterium tuberculosis H37Rv
cggcagcgccggucggauc

SEQ ID NO: 1304371 - RNA, 21 nt, Mycobacterium tuberculosis H37Rv
cggcagcgcgaucgauuccgc

SEQ ID NO: 1304372 - RNA, 17 nt, Mycobacterium tuberculosis H37Rv
cggcagccccugccgau

SEQ ID NO: 1304373 - RNA, 16 nt, Mycobacterium tuberculosis H37Rv
cggcagccccugccga

SEQ ID NO: 1304374 - RNA, 21 nt, Mycobacterium tuberculosis H37Rv
cggcagccagccaccggggaa

SEQ ID NO: 1304375 - RNA, 13 nt, Mycobacterium tuberculosis H37Rv
cggcagccaccgu

SEQ ID NO: 1304376 - RNA, 13 nt, Mycobacterium tuberculosis H37Rv
cggcagccgcaua

SEQ ID NO: 1304377 - RNA, 18 nt, Mycobacterium tuberculosis H37Rv
cggccaaagacccggcac

SEQ ID NO: 1304378 - RNA, 18 nt, Mycobacterium tuberculosis H37Rv
cggcaugcucaccgaaac

SEQ ID NO: 1304379 - RNA, 18 nt, Mycobacterium tuberculosis H37Rv
cggcauggauacgcagca

SEQ ID NO: 1304380 - RNA, 17 nt, Mycobacterium tuberculosis H37Rv
cggcaugcgcagaaacg

SEQ ID NO: 1304381 - RNA, 18 nt, Mycobacterium tuberculosis H37Rv
cggccaacagucgcagca

SEQ ID NO: 1304382 - RNA, 21 nt, Mycobacterium tuberculosis H37Rv
cggccaacagguccaccggcc

SEQ ID NO: 1304383 - RNA, 23 nt, Mycobacterium tuberculosis H37Rv
cggccaaagacccggcacccagu

SEQ ID NO: 1304384 - RNA, 20 nt, Mycobacterium tuberculosis H37Rv
cggccaaagcuuucccguug

SEQ ID NO: 1304385 - RNA, 22 nt, Mycobacterium tuberculosis H37Rv
cggccaacaccacuagcggcuc

SEQ ID NO: 1304386 - RNA, 13 nt, Mycobacterium tuberculosis H37Rv
cggccaacagcac

SEQ ID NO: 1304387 - RNA, 19 nt, Mycobacterium tuberculosis H37Rv
cggccaacugggccgagcg

SEQ ID NO: 1304388 - RNA, 23 nt, Mycobacterium tuberculosis H37Rv
cggccaccaccgagcgcaacccg

SEQ ID NO: 1304389 - RNA, 15 nt, Mycobacterium tuberculosis H37Rv
cggccaccaccgccg

SEQ ID NO: 1304390 - RNA, 21 nt, Mycobacterium tuberculosis H37Rv
cggccaacggcuccgggcgcu

SEQ ID NO: 1304391 - RNA, 16 nt, Mycobacterium tuberculosis H37Rv
cggccaacugggccga

SEQ ID NO: 1304392 - RNA, 15 nt, Mycobacterium tuberculosis H37Rv
cggccaacggcaccc

SEQ ID NO: 1304393 - RNA, 20 nt, Mycobacterium tuberculosis H37Rv
cggccaacgacggccgacaa

SEQ ID NO: 1304394 - RNA, 18 nt, Mycobacterium tuberculosis H37Rv
cggccaacgacgacccgu

SEQ ID NO: 1304395 - RNA, 22 nt, Mycobacterium tuberculosis H37Rv
cggcaucgcgggcggcgcuggc

SEQ ID NO: 1304396 - RNA, 17 nt, Mycobacterium tuberculosis H37Rv
cggcaugcagccccacu

SEQ ID NO: 1304397 - RNA, 21 nt, Mycobacterium tuberculosis H37Rv
cggcaugauuuuucgcaguga

SEQ ID NO: 1304398 - RNA, 15 nt, Mycobacterium tuberculosis H37Rv
cggcaucuccaccgu

SEQ ID NO: 1304399 - RNA, 18 nt, Mycobacterium tuberculosis H37Rv
cggcaucugguauggguc

SEQ ID NO: 1304400 - RNA, 18 nt, Mycobacterium tuberculosis H37Rv
cggcauaacgaucccgug

SEQ ID NO: 1304401 - RNA, 18 nt, Mycobacterium tuberculosis H37Rv
cggcauaacccuggccgg

SEQ ID NO: 1304402 - RNA, 16 nt, Mycobacterium tuberculosis H37Rv
cggcauaaacaucggu

SEQ ID NO: 1304403 - RNA, 14 nt, Mycobacterium tuberculosis H37Rv
cggcauacaacugg

SEQ ID NO: 1304404 - RNA, 23 nt, Mycobacterium tuberculosis H37Rv
cggcaguucgcggccaucgccga

SEQ ID NO: 1304405 - RNA, 23 nt, Mycobacterium tuberculosis H37Rv
cggcacgaaaaugggggcuggua

SEQ ID NO: 1304406 - RNA, 22 nt, Mycobacterium tuberculosis H37Rv
cggcaccgacugcugucaccgc

SEQ ID NO: 1304407 - RNA, 13 nt, Mycobacterium tuberculosis H37Rv
cggcaccgacggu

SEQ ID NO: 1304408 - RNA, 23 nt, Mycobacterium tuberculosis H37Rv
cggcacccgucgggugcugaugg

SEQ ID NO: 1304409 - RNA, 16 nt, Mycobacterium tuberculosis H37Rv
cggcacccggcagagc

SEQ ID NO: 1304410 - RNA, 18 nt, Mycobacterium tuberculosis H37Rv
cggcacccggucggccau

SEQ ID NO: 1304411 - RNA, 15 nt, Mycobacterium tuberculosis H37Rv
cggacagcgucucgg

SEQ ID NO: 1304412 - RNA, 14 nt, Mycobacterium tuberculosis H37Rv
cggacagcucgcgg

SEQ ID NO: 1304413 - RNA, 16 nt, Mycobacterium tuberculosis H37Rv
cggacagcucgcggua

SEQ ID NO: 1304414 - RNA, 15 nt, Mycobacterium tuberculosis H37Rv
cggcacccgcacggc

SEQ ID NO: 1304415 - RNA, 12 nt, Mycobacterium tuberculosis H37Rv
cggcacgucguc

SEQ ID NO: 1304416 - RNA, 16 nt, Mycobacterium tuberculosis H37Rv
cggcacgggcgucguc

SEQ ID NO: 1304417 - RNA, 17 nt, Mycobacterium tuberculosis H37Rv
cggcacggaugcgaugg

SEQ ID NO: 1304418 - RNA, 13 nt, Mycobacterium tuberculosis H37Rv
cggcacgcucgcg

SEQ ID NO: 1304419 - RNA, 15 nt, Mycobacterium tuberculosis H37Rv
cggcacgcuccagcu

SEQ ID NO: 1304420 - RNA, 22 nt, Mycobacterium tuberculosis H37Rv
cggcacgcuccagcucggccag

SEQ ID NO: 1304421 - RNA, 23 nt, Mycobacterium tuberculosis H37Rv
cggcacgcuccagcucggccagu

SEQ ID NO: 1304422 - RNA, 23 nt, Mycobacterium tuberculosis H37Rv
cggcacgcacgcgguucaccacg

SEQ ID NO: 1304423 - RNA, 19 nt, Mycobacterium tuberculosis H37Rv
cggcacgcagccaaugccg

SEQ ID NO: 1304424 - RNA, 19 nt, Mycobacterium tuberculosis H37Rv
cggcagaucccacgccagg

SEQ ID NO: 1304425 - RNA, 14 nt, Mycobacterium tuberculosis H37Rv
cggcagaugcagcg

SEQ ID NO: 1304426 - RNA, 22 nt, Mycobacterium tuberculosis H37Rv
cggcagaugcagcgggucgccg

SEQ ID NO: 1304427 - RNA, 16 nt, Mycobacterium tuberculosis H37Rv
cggcagacacgcugca

SEQ ID NO: 1304428 - RNA, 20 nt, Mycobacterium tuberculosis H37Rv
cggcagacgcguuucgucga

SEQ ID NO: 1304429 - RNA, 21 nt, Mycobacterium tuberculosis H37Rv
cggcagaccgaccucggcgac

SEQ ID NO: 1304430 - RNA, 17 nt, Mycobacterium tuberculosis H37Rv
cggcagaccgaccucgg

SEQ ID NO: 1304431 - RNA, 21 nt, Mycobacterium tuberculosis H37Rv
cggcagaauccggucgaugac

SEQ ID NO: 1304432 - RNA, 13 nt, Mycobacterium tuberculosis H37Rv
cggcagaccgacc

SEQ ID NO: 1304433 - RNA, 19 nt, Mycobacterium tuberculosis H37Rv
cggcacuuagcccgauggu

SEQ ID NO: 1304434 - RNA, 22 nt, Mycobacterium tuberculosis H37Rv
cggcacuugggaaggauggucg

SEQ ID NO: 1304435 - RNA, 20 nt, Mycobacterium tuberculosis H37Rv
cggcacuugggaaggauggu

SEQ ID NO: 1304436 - RNA, 15 nt, Mycobacterium tuberculosis H37Rv
cggcacugaccgcga

SEQ ID NO: 1304437 - RNA, 14 nt, Mycobacterium tuberculosis H37Rv
cggcacugaucugc

SEQ ID NO: 1304438 - RNA, 14 nt, Mycobacterium tuberculosis H37Rv
cggcacugcggcca

SEQ ID NO: 1304439 - RNA, 13 nt, Mycobacterium tuberculosis H37Rv
cggcacugaccgc

SEQ ID NO: 1304440 - RNA, 15 nt, Mycobacterium tuberculosis H37Rv
cggcacuacgcagcc

SEQ ID NO: 1304441 - RNA, 13 nt, Mycobacterium tuberculosis H37Rv
cggcagcaucggu

SEQ ID NO: 1304442 - RNA, 12 nt, Mycobacterium tuberculosis H37Rv
cggcagccacca

SEQ ID NO: 1304443 - RNA, 22 nt, Mycobacterium tuberculosis H37Rv
aacagugacgccacgaccgccg

SEQ ID NO: 1304444 - RNA, 22 nt, Mycobacterium tuberculosis H37Rv
aacaguugcacaccggcacugc

SEQ ID NO: 1304445 - RNA, 15 nt, Mycobacterium tuberculosis H37Rv
cggcagcaccgguga

SEQ ID NO: 1304446 - RNA, 15 nt, Mycobacterium tuberculosis H37Rv
cggcagcacggucug

SEQ ID NO: 1304447 - RNA, 14 nt, Mycobacterium tuberculosis H37Rv
cggcagcacggucu

SEQ ID NO: 1304448 - RNA, 21 nt, Mycobacterium tuberculosis H37Rv
cggcagcagaguucccugaug

SEQ ID NO: 1304449 - RNA, 15 nt, Mycobacterium tuberculosis H37Rv
ggccgcaaugcguug

SEQ ID NO: 1304450 - RNA, 12 nt, Mycobacterium tuberculosis H37Rv
ggccgcaaccau

SEQ ID NO: 1304451 - RNA, 16 nt, Mycobacterium tuberculosis H37Rv
ggccgauuccgcgcgu

SEQ ID NO: 1304452 - RNA, 16 nt, Mycobacterium tuberculosis H37Rv
ggccgcagcggccagc

SEQ ID NO: 1304453 - RNA, 22 nt, Mycobacterium tuberculosis H37Rv
ggccgcacugggugcgucgacc

SEQ ID NO: 1304454 - RNA, 19 nt, Mycobacterium tuberculosis H37Rv
ggccgcacgucgaccucgg

SEQ ID NO: 1304455 - RNA, 15 nt, Mycobacterium tuberculosis H37Rv
ggccgcacggucagc

SEQ ID NO: 1304456 - RNA, 18 nt, Mycobacterium tuberculosis H37Rv
ggccgcacgccggccagc

SEQ ID NO: 1304457 - RNA, 23 nt, Mycobacterium tuberculosis H37Rv
ggccgccuacccguucuucgcga

SEQ ID NO: 1304458 - RNA, 11 nt, Mycobacterium tuberculosis H37Rv
ggccgccgguc

SEQ ID NO: 1304459 - RNA, 12 nt, Mycobacterium tuberculosis H37Rv
ggccgccggucc

SEQ ID NO: 1304460 - RNA, 14 nt, Mycobacterium tuberculosis H37Rv
ggccgccgcgcacc

SEQ ID NO: 1304461 - RNA, 16 nt, Mycobacterium tuberculosis H37Rv
ggccgccgcgauggcc

SEQ ID NO: 1304462 - RNA, 13 nt, Mycobacterium tuberculosis H37Rv
ggccgccgcgcac

SEQ ID NO: 1304463 - RNA, 23 nt, Mycobacterium tuberculosis H37Rv
ggccgccgcagcuccccgaccga

SEQ ID NO: 1304464 - RNA, 12 nt, Mycobacterium tuberculosis H37Rv
ggccgccgagga

SEQ ID NO: 1304465 - RNA, 12 nt, Mycobacterium tuberculosis H37Rv
ggccgccgcaag

SEQ ID NO: 1304466 - RNA, 14 nt, Mycobacterium tuberculosis H37Rv
ggccgccgaugcca

SEQ ID NO: 1304467 - RNA, 20 nt, Mycobacterium tuberculosis H37Rv
ggccgccgaugccaccgcuu

SEQ ID NO: 1304468 - RNA, 12 nt, Mycobacterium tuberculosis H37Rv
ggccgcggcagc

SEQ ID NO: 1304469 - RNA, 15 nt, Mycobacterium tuberculosis H37Rv
ggccgcgcgacaacc

SEQ ID NO: 1304470 - RNA, 16 nt, Mycobacterium tuberculosis H37Rv
ggccgcgccucggucu

SEQ ID NO: 1304471 - RNA, 21 nt, Mycobacterium tuberculosis H37Rv
ggccgcgcccgccucgaccgc

SEQ ID NO: 1304472 - RNA, 17 nt, Mycobacterium tuberculosis H37Rv
ggccgcgacguugaacu

SEQ ID NO: 1304473 - RNA, 13 nt, Mycobacterium tuberculosis H37Rv
ggccgcgaccagc

SEQ ID NO: 1304474 - RNA, 23 nt, Mycobacterium tuberculosis H37Rv
ggccgcgacaauggugcccagga

SEQ ID NO: 1304475 - RNA, 20 nt, Mycobacterium tuberculosis H37Rv
ggccgcgaccggcguaaccg

SEQ ID NO: 1304476 - RNA, 14 nt, Mycobacterium tuberculosis H37Rv
ggccgcgaccagcg

SEQ ID NO: 1304477 - RNA, 19 nt, Mycobacterium tuberculosis H37Rv
ggccgccuucuccggcguc

SEQ ID NO: 1304478 - RNA, 18 nt, Mycobacterium tuberculosis H37Rv
ggccgccuucuccggcgu

SEQ ID NO: 1304479 - RNA, 22 nt, Mycobacterium tuberculosis H37Rv
ggccgccucguacggaccgucg

SEQ ID NO: 1304480 - RNA, 23 nt, Mycobacterium tuberculosis H37Rv
ggccgccucgcggaugagcucgg

SEQ ID NO: 1304481 - RNA, 21 nt, Mycobacterium tuberculosis H37Rv
ggccgccugccucgccugcac

SEQ ID NO: 1304482 - RNA, 16 nt, Mycobacterium tuberculosis H37Rv
ggccgcggcggccagc

SEQ ID NO: 1304483 - RNA, 12 nt, Mycobacterium tuberculosis H37Rv
ggccgcggcguc

SEQ ID NO: 1304484 - RNA, 22 nt, Mycobacterium tuberculosis H37Rv
ggccgcugugggucgauccggu

SEQ ID NO: 1304485 - RNA, 23 nt, Mycobacterium tuberculosis H37Rv
ggccgcugucguaccgcucggcg

SEQ ID NO: 1304486 - RNA, 14 nt, Mycobacterium tuberculosis H37Rv
ggccgcuuggcgua

SEQ ID NO: 1304487 - RNA, 13 nt, Mycobacterium tuberculosis H37Rv
ggccgcuucgggc

SEQ ID NO: 1304488 - RNA, 13 nt, Mycobacterium tuberculosis H37Rv
ggccggagccggu

SEQ ID NO: 1304489 - RNA, 19 nt, Mycobacterium tuberculosis H37Rv
ggccggagccggugccgac

SEQ ID NO: 1304490 - RNA, 19 nt, Mycobacterium tuberculosis H37Rv
ggccggagucgacgacguc

SEQ ID NO: 1304491 - RNA, 18 nt, Mycobacterium tuberculosis H37Rv
ggccgcuuugcgcgguca

SEQ ID NO: 1304492 - RNA, 14 nt, Mycobacterium tuberculosis H37Rv
ggccggaacgcccg

SEQ ID NO: 1304493 - RNA, 20 nt, Mycobacterium tuberculosis H37Rv
ggccgcuuugcgcggucagc

SEQ ID NO: 1304494 - RNA, 16 nt, Mycobacterium tuberculosis H37Rv
ggccggauacggcgac

SEQ ID NO: 1304495 - RNA, 19 nt, Mycobacterium tuberculosis H37Rv
ggccggaucccagugccag

SEQ ID NO: 1304496 - RNA, 22 nt, Mycobacterium tuberculosis H37Rv
ggccggaucccagugccagugc

SEQ ID NO: 1304497 - RNA, 16 nt, Mycobacterium tuberculosis H37Rv
ggccggaugucgacga

SEQ ID NO: 1304498 - RNA, 22 nt, Mycobacterium tuberculosis H37Rv
ggccggcaaugccgcggccagu

SEQ ID NO: 1304499 - RNA, 18 nt, Mycobacterium tuberculosis H37Rv
ggccggcacccaccagug

SEQ ID NO: 1304500 - RNA, 14 nt, Mycobacterium tuberculosis H37Rv
ggccggccgcgauc

SEQ ID NO: 1304501 - RNA, 18 nt, Mycobacterium tuberculosis H37Rv
ggccggcgagcucgacga

SEQ ID NO: 1304502 - RNA, 15 nt, Mycobacterium tuberculosis H37Rv
ggccggcgacgcguc

SEQ ID NO: 1304503 - RNA, 17 nt, Mycobacterium tuberculosis H37Rv
ggccggcgacgcgucga

SEQ ID NO: 1304504 - RNA, 12 nt, Mycobacterium tuberculosis H37Rv
ggccggccggca

SEQ ID NO: 1304505 - RNA, 17 nt, Mycobacterium tuberculosis H37Rv
ggccgggucauccgugu

SEQ ID NO: 1304506 - RNA, 16 nt, Mycobacterium tuberculosis H37Rv
ggccggggucggcccg

SEQ ID NO: 1304507 - RNA, 20 nt, Mycobacterium tuberculosis H37Rv
ggccgguggaaaagccacgg

SEQ ID NO: 1304508 - RNA, 23 nt, Mycobacterium tuberculosis H37Rv
ggccggguuccagcggcaccgcg

SEQ ID NO: 1304509 - RNA, 18 nt, Mycobacterium tuberculosis H37Rv
ggccggguucgcgucuga

SEQ ID NO: 1304510 - RNA, 23 nt, Mycobacterium tuberculosis H37Rv
ggccguccggcuuggcggcgauc

SEQ ID NO: 1304511 - RNA, 20 nt, Mycobacterium tuberculosis H37Rv
ggccguccgguccgucgggu

SEQ ID NO: 1304512 - RNA, 20 nt, Mycobacterium tuberculosis H37Rv
ggccguccucggucagcucg

SEQ ID NO: 1304513 - RNA, 13 nt, Mycobacterium tuberculosis H37Rv
ggccguccgcacc

SEQ ID NO: 1304514 - RNA, 15 nt, Mycobacterium tuberculosis H37Rv
ggccguccgcaccgg

SEQ ID NO: 1304515 - RNA, 17 nt, Mycobacterium tuberculosis H37Rv
ggccguccgcaccggcg

SEQ ID NO: 1304516 - RNA, 16 nt, Mycobacterium tuberculosis H37Rv
ggccguagcccacgac

SEQ ID NO: 1304517 - RNA, 13 nt, Mycobacterium tuberculosis H37Rv
ggccguacucgau

SEQ ID NO: 1304518 - RNA, 15 nt, Mycobacterium tuberculosis H37Rv
ggccguacaacagcg

SEQ ID NO: 1304519 - RNA, 16 nt, Mycobacterium tuberculosis H37Rv
ggccgguucgcccgag

SEQ ID NO: 1304520 - RNA, 15 nt, Mycobacterium tuberculosis H37Rv
ggccgucgcuggugu

SEQ ID NO: 1304521 - RNA, 14 nt, Mycobacterium tuberculosis H37Rv
ggccgucgacgauc

SEQ ID NO: 1304522 - RNA, 12 nt, Mycobacterium tuberculosis H37Rv
ggccgucgacgc

SEQ ID NO: 1304523 - RNA, 12 nt, Mycobacterium tuberculosis H37Rv
ggccgucgaccc

SEQ ID NO: 1304524 - RNA, 15 nt, Mycobacterium tuberculosis H37Rv
ggccgucgacccagc

SEQ ID NO: 1304525 - RNA, 16 nt, Mycobacterium tuberculosis H37Rv
ggccgucgaucuucuc

SEQ ID NO: 1304526 - RNA, 23 nt, Mycobacterium tuberculosis H37Rv
ggccgucgacgcaugggucaugg

SEQ ID NO: 1304527 - RNA, 20 nt, Mycobacterium tuberculosis H37Rv
ggccgucgauugcaggucgg

SEQ ID NO: 1304528 - RNA, 19 nt, Mycobacterium tuberculosis H37Rv
ggccgucguugccggcgac

SEQ ID NO: 1304529 - RNA, 16 nt, Mycobacterium tuberculosis H37Rv
ggccgucgucggucac

SEQ ID NO: 1304530 - RNA, 18 nt, Mycobacterium tuberculosis H37Rv
ggccgucgucggucaccg

SEQ ID NO: 1304531 - RNA, 12 nt, Mycobacterium tuberculosis H37Rv
ggccgugccgcc

SEQ ID NO: 1304532 - RNA, 16 nt, Mycobacterium tuberculosis H37Rv
ggccguugacgguguc

SEQ ID NO: 1304533 - RNA, 19 nt, Mycobacterium tuberculosis H37Rv
ggccguugcuauucgccag

SEQ ID NO: 1304534 - RNA, 19 nt, Mycobacterium tuberculosis H37Rv
ggccguguucuaccugcac

SEQ ID NO: 1304535 - RNA, 20 nt, Mycobacterium tuberculosis H37Rv
ggccguguucuaccugcacc

SEQ ID NO: 1304536 - RNA, 21 nt, Mycobacterium tuberculosis H37Rv
ggccguucgcccuaauccgcu

SEQ ID NO: 1304537 - RNA, 19 nt, Mycobacterium tuberculosis H37Rv
ggccguugggccaccggcg

SEQ ID NO: 1304538 - RNA, 20 nt, Mycobacterium tuberculosis H37Rv
ggccguugggccaccggcgc

SEQ ID NO: 1304539 - RNA, 22 nt, Mycobacterium tuberculosis H37Rv
ggccguuggcggcgguggccag

SEQ ID NO: 1304540 - RNA, 24 nt, Mycobacterium tuberculosis H37Rv
ggccguuucggcgccgucgcccag

SEQ ID NO: 1304541 - RNA, 18 nt, Mycobacterium tuberculosis H37Rv
ggccuaacucgccugcac

SEQ ID NO: 1304542 - RNA, 18 nt, Mycobacterium tuberculosis H37Rv
ggccuccacccgccacgg

SEQ ID NO: 1304543 - RNA, 16 nt, Mycobacterium tuberculosis H37Rv
ggccuccgcugccgcc

SEQ ID NO: 1304544 - RNA, 23 nt, Mycobacterium tuberculosis H37Rv
ggccucccacucacccagcuugg

SEQ ID NO: 1304545 - RNA, 18 nt, Mycobacterium tuberculosis H37Rv
ggccugagcgugucuggc

SEQ ID NO: 1304546 - RNA, 19 nt, Mycobacterium tuberculosis H37Rv
ggccugaccggcucgccgg

SEQ ID NO: 1304547 - RNA, 19 nt, Mycobacterium tuberculosis H37Rv
ggccugauuccacugggcc

SEQ ID NO: 1304548 - RNA, 13 nt, Mycobacterium tuberculosis H37Rv
ggccugcggcaac

SEQ ID NO: 1304549 - RNA, 22 nt, Mycobacterium tuberculosis H37Rv
ggccugcgcuucguccagcgau

SEQ ID NO: 1304550 - RNA, 21 nt, Mycobacterium tuberculosis H37Rv
ggccugcggcaccggcucagg

SEQ ID NO: 1304551 - RNA, 16 nt, Mycobacterium tuberculosis H37Rv
ggccugcgccggcgcu

SEQ ID NO: 1304552 - RNA, 18 nt, Mycobacterium tuberculosis H37Rv
ggccugcgcgaccgacca

SEQ ID NO: 1304553 - RNA, 17 nt, Mycobacterium tuberculosis H37Rv
ggccugcgcgauccgcg

SEQ ID NO: 1304554 - RNA, 22 nt, Mycobacterium tuberculosis H37Rv
ggccugcgaacacgcgaugacg

SEQ ID NO: 1304555 - RNA, 14 nt, Mycobacterium tuberculosis H37Rv
ggccugccggcagc

SEQ ID NO: 1304556 - RNA, 14 nt, Mycobacterium tuberculosis H37Rv
ggccugcagcgcga

SEQ ID NO: 1304557 - RNA, 17 nt, Mycobacterium tuberculosis H37Rv
ggccugcagcgaugacg

SEQ ID NO: 1304558 - RNA, 17 nt, Mycobacterium tuberculosis H37Rv
ggccgaguccggcaaga

SEQ ID NO: 1304559 - RNA, 17 nt, Mycobacterium tuberculosis H37Rv
ggccgaucagcguggcg

SEQ ID NO: 1304560 - RNA, 16 nt, Mycobacterium tuberculosis H37Rv
ggccgaguucgucagc

SEQ ID NO: 1304561 - RNA, 17 nt, Mycobacterium tuberculosis H37Rv
ggccgagucgauugcca

SEQ ID NO: 1304562 - RNA, 19 nt, Mycobacterium tuberculosis H37Rv
ggccgagugcccagcgaug

SEQ ID NO: 1304563 - RNA, 22 nt, Mycobacterium tuberculosis H37Rv
ggccgagcgcaccacggcgguc

SEQ ID NO: 1304564 - RNA, 19 nt, Mycobacterium tuberculosis H37Rv
ggccgagcgcaccgcugac

SEQ ID NO: 1304565 - RNA, 16 nt, Mycobacterium tuberculosis H37Rv
ggccgacgucgaccac

SEQ ID NO: 1304566 - RNA, 17 nt, Mycobacterium tuberculosis H37Rv
ggccgagcauccgacac

SEQ ID NO: 1304567 - RNA, 15 nt, Mycobacterium tuberculosis H37Rv
ggccgagaucacgcc

SEQ ID NO: 1304568 - RNA, 18 nt, Mycobacterium tuberculosis H37Rv
ggccgacgucgaccacug

SEQ ID NO: 1304569 - RNA, 16 nt, Mycobacterium tuberculosis H37Rv
ggccgacgggacaacc

SEQ ID NO: 1304570 - RNA, 17 nt, Mycobacterium tuberculosis H37Rv
ggccgacgugacaacug

SEQ ID NO: 1304571 - RNA, 14 nt, Mycobacterium tuberculosis H37Rv
ggccgacucgaggu

SEQ ID NO: 1304572 - RNA, 21 nt, Mycobacterium tuberculosis H37Rv
ggcccuucaguucgacggugc

SEQ ID NO: 1304573 - RNA, 22 nt, Mycobacterium tuberculosis H37Rv
ggcccuugcucguccaggucgg

SEQ ID NO: 1304574 - RNA, 20 nt, Mycobacterium tuberculosis H37Rv
ggcccuggccagcccgagcu

SEQ ID NO: 1304575 - RNA, 17 nt, Mycobacterium tuberculosis H37Rv
ggcccugcacagcagcg

SEQ ID NO: 1304576 - RNA, 23 nt, Mycobacterium tuberculosis H37Rv
ggcccuuguggaguacggcgaug

SEQ ID NO: 1304577 - RNA, 22 nt, Mycobacterium tuberculosis H37Rv
ggccgaacagcugcccgccagc

SEQ ID NO: 1304578 - RNA, 14 nt, Mycobacterium tuberculosis H37Rv
ggccgaacagccga

SEQ ID NO: 1304579 - RNA, 23 nt, Mycobacterium tuberculosis H37Rv
ggccgaaaacgacaucaccaccg

SEQ ID NO: 1304580 - RNA, 20 nt, Mycobacterium tuberculosis H37Rv
ggcccugcacagcagcguca

SEQ ID NO: 1304581 - RNA, 14 nt, Mycobacterium tuberculosis H37Rv
ggcccucggcgauc

SEQ ID NO: 1304582 - RNA, 19 nt, Mycobacterium tuberculosis H37Rv
ggcccucgagcagugccgu

SEQ ID NO: 1304583 - RNA, 15 nt, Mycobacterium tuberculosis H37Rv
ggcccuccucgguga

SEQ ID NO: 1304584 - RNA, 18 nt, Mycobacterium tuberculosis H37Rv
ggcccuccggcgcagcga

SEQ ID NO: 1304585 - RNA, 19 nt, Mycobacterium tuberculosis H37Rv
ggcccuccggcgcagcgac

SEQ ID NO: 1304586 - RNA, 21 nt, Mycobacterium tuberculosis H37Rv
ggcccuccggcgcagcgaccg

SEQ ID NO: 1304587 - RNA, 11 nt, Mycobacterium tuberculosis H37Rv
ggccgacaccg

SEQ ID NO: 1304588 - RNA, 20 nt, Mycobacterium tuberculosis H37Rv
ggccgacacgaacgcugcuc

SEQ ID NO: 1304589 - RNA, 20 nt, Mycobacterium tuberculosis H37Rv
ggccgacaaugucggcgaug

SEQ ID NO: 1304590 - RNA, 18 nt, Mycobacterium tuberculosis H37Rv
ggccgaacgggucggcga

SEQ ID NO: 1304591 - RNA, 19 nt, Mycobacterium tuberculosis H37Rv
ggccgaacgggucggcgac

SEQ ID NO: 1304592 - RNA, 13 nt, Mycobacterium tuberculosis H37Rv
ggccgaaccggua

SEQ ID NO: 1304593 - RNA, 16 nt, Mycobacterium tuberculosis H37Rv
ggccgaaccguucggc

SEQ ID NO: 1304594 - RNA, 13 nt, Mycobacterium tuberculosis H37Rv
ggccgaacggguc

SEQ ID NO: 1304595 - RNA, 21 nt, Mycobacterium tuberculosis H37Rv
ggccgaccgcgacccggccca

SEQ ID NO: 1304596 - RNA, 14 nt, Mycobacterium tuberculosis H37Rv
ggccgaccgcgcac

SEQ ID NO: 1304597 - RNA, 15 nt, Mycobacterium tuberculosis H37Rv
ggccgaccgcgcaca

SEQ ID NO: 1304598 - RNA, 14 nt, Mycobacterium tuberculosis H37Rv
ggccgacgauagcg

SEQ ID NO: 1304599 - RNA, 14 nt, Mycobacterium tuberculosis H37Rv
ggccgaccagccga

SEQ ID NO: 1304600 - RNA, 16 nt, Mycobacterium tuberculosis H37Rv
ggccgaccagccgauc

SEQ ID NO: 1304601 - RNA, 17 nt, Mycobacterium tuberculosis H37Rv
ggccgaccagccgauca

SEQ ID NO: 1304602 - RNA, 23 nt, Mycobacterium tuberculosis H37Rv
ggccgaccagccgaucaucaccg

SEQ ID NO: 1304603 - RNA, 18 nt, Mycobacterium tuberculosis H37Rv
ggccgacagccaccgcga

SEQ ID NO: 1304604 - RNA, 22 nt, Mycobacterium tuberculosis H37Rv
ggcccgcgcguacccgaucagc

SEQ ID NO: 1304605 - RNA, 15 nt, Mycobacterium tuberculosis H37Rv
ggcccgccgucaccg

SEQ ID NO: 1304606 - RNA, 14 nt, Mycobacterium tuberculosis H37Rv
ggcccgcucggggu

SEQ ID NO: 1304607 - RNA, 19 nt, Mycobacterium tuberculosis H37Rv
ggcccgcucgaucggcagc

SEQ ID NO: 1304608 - RNA, 19 nt, Mycobacterium tuberculosis H37Rv
ggcccgcuccacggucagg

SEQ ID NO: 1304609 - RNA, 21 nt, Mycobacterium tuberculosis H37Rv
ggcccgcggugacgcaacauc

SEQ ID NO: 1304610 - RNA, 16 nt, Mycobacterium tuberculosis H37Rv
ggcccgcgggcaagcc

SEQ ID NO: 1304611 - RNA, 13 nt, Mycobacterium tuberculosis H37Rv
ggcccgcgggauc

SEQ ID NO: 1304612 - RNA, 17 nt, Mycobacterium tuberculosis H37Rv
ggcccgguccgccauug

SEQ ID NO: 1304613 - RNA, 12 nt, Mycobacterium tuberculosis H37Rv
ggcccgucgcgu

SEQ ID NO: 1304614 - RNA, 17 nt, Mycobacterium tuberculosis H37Rv
ggcccgucgcgucgacc

SEQ ID NO: 1304615 - RNA, 21 nt, Mycobacterium tuberculosis H37Rv
ggcccguagcugcgcagcgca

SEQ ID NO: 1304616 - RNA, 22 nt, Mycobacterium tuberculosis H37Rv
ggcccgugccacagcucgccgu

SEQ ID NO: 1304617 - RNA, 22 nt, Mycobacterium tuberculosis H37Rv
ggcccgugccuggccggugcgc

SEQ ID NO: 1304618 - RNA, 17 nt, Mycobacterium tuberculosis H37Rv
ggcccgucgugaccgac

SEQ ID NO: 1304619 - RNA, 19 nt, Mycobacterium tuberculosis H37Rv
ggcccgucgucgucgacac

SEQ ID NO: 1304620 - RNA, 15 nt, Mycobacterium tuberculosis H37Rv
ggcccgugugggcgu

SEQ ID NO: 1304621 - RNA, 24 nt, Mycobacterium tuberculosis H37Rv
ggcccggucuacgccaccgagauc

SEQ ID NO: 1304622 - RNA, 16 nt, Mycobacterium tuberculosis H37Rv
ggcccgggcucggcga

SEQ ID NO: 1304623 - RNA, 14 nt, Mycobacterium tuberculosis H37Rv
ggcccggcucacag

SEQ ID NO: 1304624 - RNA, 18 nt, Mycobacterium tuberculosis H37Rv
ggcccggcuacgacggcg

SEQ ID NO: 1304625 - RNA, 15 nt, Mycobacterium tuberculosis H37Rv
ggcccggcggccagc

SEQ ID NO: 1304626 - RNA, 18 nt, Mycobacterium tuberculosis H37Rv
ggcccgcauccgcaccga

SEQ ID NO: 1304627 - RNA, 20 nt, Mycobacterium tuberculosis H37Rv
ggcccgcacgaaccggucga

SEQ ID NO: 1304628 - RNA, 16 nt, Mycobacterium tuberculosis H37Rv
ggcccgcacggccgca

SEQ ID NO: 1304629 - RNA, 17 nt, Mycobacterium tuberculosis H37Rv
ggcccgaucccgaucga

SEQ ID NO: 1304630 - RNA, 13 nt, Mycobacterium tuberculosis H37Rv
ggcccgaugaccg

SEQ ID NO: 1304631 - RNA, 17 nt, Mycobacterium tuberculosis H37Rv
ggcccgaggcggguaca

SEQ ID NO: 1304632 - RNA, 16 nt, Mycobacterium tuberculosis H37Rv
ggcccgacccggccga

SEQ ID NO: 1304633 - RNA, 20 nt, Mycobacterium tuberculosis H37Rv
ggcccgaccuguccacccag

SEQ ID NO: 1304634 - RNA, 18 nt, Mycobacterium tuberculosis H37Rv
ggccccgaaacgauggcc

SEQ ID NO: 1304635 - RNA, 17 nt, Mycobacterium tuberculosis H37Rv
ggcccgacgacgacguu

SEQ ID NO: 1304636 - RNA, 14 nt, Mycobacterium tuberculosis H37Rv
ggcccgacgacgac

SEQ ID NO: 1304637 - RNA, 16 nt, Mycobacterium tuberculosis H37Rv
ggccccgccagcggca

SEQ ID NO: 1304638 - RNA, 16 nt, Mycobacterium tuberculosis H37Rv
ggccccgccgauggag

SEQ ID NO: 1304639 - RNA, 18 nt, Mycobacterium tuberculosis H37Rv
ggcccccaguucggcguc

SEQ ID NO: 1304640 - RNA, 14 nt, Mycobacterium tuberculosis H37Rv
ggcccccgguaccg

SEQ ID NO: 1304641 - RNA, 21 nt, Mycobacterium tuberculosis H37Rv
ggccaggccgaugccgaccuu

SEQ ID NO: 1304642 - RNA, 15 nt, Mycobacterium tuberculosis H37Rv
ggccaggaucaaccg

SEQ ID NO: 1304643 - RNA, 20 nt, Mycobacterium tuberculosis H37Rv
ggccccaagcgugcugccgc

SEQ ID NO: 1304644 - RNA, 16 nt, Mycobacterium tuberculosis H37Rv
ggcccauugucgauca

SEQ ID NO: 1304645 - RNA, 21 nt, Mycobacterium tuberculosis H37Rv
ggccccaagcgugcugccgcc

SEQ ID NO: 1304646 - RNA, 13 nt, Mycobacterium tuberculosis H37Rv
ggccccaccgagc

SEQ ID NO: 1304647 - RNA, 16 nt, Mycobacterium tuberculosis H37Rv
ggccccaccgguaccg

SEQ ID NO: 1304648 - RNA, 16 nt, Mycobacterium tuberculosis H37Rv
ggccaggcugcgcagu

SEQ ID NO: 1304649 - RNA, 14 nt, Mycobacterium tuberculosis H37Rv
ggccaggcugccuc

SEQ ID NO: 1304650 - RNA, 23 nt, Mycobacterium tuberculosis H37Rv
ggccaggcuauggugccggugau

SEQ ID NO: 1304651 - RNA, 18 nt, Mycobacterium tuberculosis H37Rv
ggccaauccggcggcgac

SEQ ID NO: 1304652 - RNA, 14 nt, Mycobacterium tuberculosis H37Rv
ggccacauaccacc

SEQ ID NO: 1304653 - RNA, 16 nt, Mycobacterium tuberculosis H37Rv
ggccaccaggugccgu

SEQ ID NO: 1304654 - RNA, 12 nt, Mycobacterium tuberculosis H37Rv
ggccacagugca

SEQ ID NO: 1304655 - RNA, 19 nt, Mycobacterium tuberculosis H37Rv
ggccaccaucgccgccguu

SEQ ID NO: 1304656 - RNA, 14 nt, Mycobacterium tuberculosis H37Rv
ggccaccaucgccg

SEQ ID NO: 1304657 - RNA, 17 nt, Mycobacterium tuberculosis H37Rv
ggccaccccgucggggu

SEQ ID NO: 1304658 - RNA, 16 nt, Mycobacterium tuberculosis H37Rv
ggccaacgaacgugcc

SEQ ID NO: 1304659 - RNA, 20 nt, Mycobacterium tuberculosis H37Rv
ggccaacccugcggcgucgu

SEQ ID NO: 1304660 - RNA, 21 nt, Mycobacterium tuberculosis H37Rv
ggccaaccgggucguucgggu

SEQ ID NO: 1304661 - RNA, 13 nt, Mycobacterium tuberculosis H37Rv
ggccaagauggcg

SEQ ID NO: 1304662 - RNA, 16 nt, Mycobacterium tuberculosis H37Rv
ggccaagccggcgagu

SEQ ID NO: 1304663 - RNA, 15 nt, Mycobacterium tuberculosis H37Rv
ggccaaggucgaccc

SEQ ID NO: 1304664 - RNA, 15 nt, Mycobacterium tuberculosis H37Rv
ggccaagguggccac

SEQ ID NO: 1304665 - RNA, 21 nt, Mycobacterium tuberculosis H37Rv
ggccaacggcuccgggcgcuc

SEQ ID NO: 1304666 - RNA, 12 nt, Mycobacterium tuberculosis H37Rv
ggccaacggcgc

SEQ ID NO: 1304667 - RNA, 13 nt, Mycobacterium tuberculosis H37Rv
ggccaacucgaca

SEQ ID NO: 1304668 - RNA, 18 nt, Mycobacterium tuberculosis H37Rv
ggccacgguggcgcaagu

SEQ ID NO: 1304669 - RNA, 23 nt, Mycobacterium tuberculosis H37Rv
ggccaccucgaaugcauccgcgu

SEQ ID NO: 1304670 - RNA, 17 nt, Mycobacterium tuberculosis H37Rv
ggccaccgucagcgcga

SEQ ID NO: 1304671 - RNA, 17 nt, Mycobacterium tuberculosis H37Rv
ggccacccgcaggucgc

SEQ ID NO: 1304672 - RNA, 13 nt, Mycobacterium tuberculosis H37Rv
ggccaccgaggcg

SEQ ID NO: 1304673 - RNA, 22 nt, Mycobacterium tuberculosis H37Rv
ggccaccgaacgcggccaccga

SEQ ID NO: 1304674 - RNA, 15 nt, Mycobacterium tuberculosis H37Rv
ggccagcccagccgg

SEQ ID NO: 1304675 - RNA, 18 nt, Mycobacterium tuberculosis H37Rv
ggccagcccacucgucga

SEQ ID NO: 1304676 - RNA, 17 nt, Mycobacterium tuberculosis H37Rv
ggccagcagggccacca

SEQ ID NO: 1304677 - RNA, 22 nt, Mycobacterium tuberculosis H37Rv
ggccagaacggaauucagcgac

SEQ ID NO: 1304678 - RNA, 21 nt, Mycobacterium tuberculosis H37Rv
ggccacuugaugcucgaugcg

SEQ ID NO: 1304679 - RNA, 17 nt, Mycobacterium tuberculosis H37Rv
ggccacuugcucggcga

SEQ ID NO: 1304680 - RNA, 16 nt, Mycobacterium tuberculosis H37Rv
ggccagacggugcagc

SEQ ID NO: 1304681 - RNA, 23 nt, Mycobacterium tuberculosis H37Rv
ggccagcagcgacuccagcgccc

SEQ ID NO: 1304682 - RNA, 14 nt, Mycobacterium tuberculosis H37Rv
ggccagcagcgcgg

SEQ ID NO: 1304683 - RNA, 18 nt, Mycobacterium tuberculosis H37Rv
ggccagcagcgcgggauc

SEQ ID NO: 1304684 - RNA, 17 nt, Mycobacterium tuberculosis H37Rv
ggccagcaaguacgcgu

SEQ ID NO: 1304685 - RNA, 19 nt, Mycobacterium tuberculosis H37Rv
ggccagcaacugccgcacc

SEQ ID NO: 1304686 - RNA, 18 nt, Mycobacterium tuberculosis H37Rv
ggccagcgguaaugccag

SEQ ID NO: 1304687 - RNA, 22 nt, Mycobacterium tuberculosis H37Rv
ggccagcgggugaaucgacacc

SEQ ID NO: 1304688 - RNA, 14 nt, Mycobacterium tuberculosis H37Rv
ggccaggaccaacu

SEQ ID NO: 1304689 - RNA, 19 nt, Mycobacterium tuberculosis H37Rv
ggccagcuccgugacaccg

SEQ ID NO: 1304690 - RNA, 20 nt, Mycobacterium tuberculosis H37Rv
ggccagcuccucagccaccg

SEQ ID NO: 1304691 - RNA, 12 nt, Mycobacterium tuberculosis H37Rv
ggccagcgcggc

SEQ ID NO: 1304692 - RNA, 15 nt, Mycobacterium tuberculosis H37Rv
ggccagccgcuccac

SEQ ID NO: 1304693 - RNA, 15 nt, Mycobacterium tuberculosis H37Rv
ggccagccgcucacc

SEQ ID NO: 1304694 - RNA, 19 nt, Mycobacterium tuberculosis H37Rv
ggcagcucguccagcgagc

SEQ ID NO: 1304695 - RNA, 17 nt, Mycobacterium tuberculosis H37Rv
ggcagcuccgccgccga

SEQ ID NO: 1304696 - RNA, 12 nt, Mycobacterium tuberculosis H37Rv
ggcagcggcgau

SEQ ID NO: 1304697 - RNA, 21 nt, Mycobacterium tuberculosis H37Rv
ggcagcggcgaucaggcggac

SEQ ID NO: 1304698 - RNA, 13 nt, Mycobacterium tuberculosis H37Rv
ggcagcggcgagu

SEQ ID NO: 1304699 - RNA, 17 nt, Mycobacterium tuberculosis H37Rv
ggcagcggcaucggcca

SEQ ID NO: 1304700 - RNA, 17 nt, Mycobacterium tuberculosis H37Rv
ggcagcggaccgcugcc

SEQ ID NO: 1304701 - RNA, 19 nt, Mycobacterium tuberculosis H37Rv
ggcagcgcucucauagcga

SEQ ID NO: 1304702 - RNA, 15 nt, Mycobacterium tuberculosis H37Rv
ggcagcgcggccagu

SEQ ID NO: 1304703 - RNA, 22 nt, Mycobacterium tuberculosis H37Rv
ggcagacgcguuucgucgaccg

SEQ ID NO: 1304704 - RNA, 22 nt, Mycobacterium tuberculosis H37Rv
ggcacugugaggucauuggcga

SEQ ID NO: 1304705 - RNA, 21 nt, Mycobacterium tuberculosis H37Rv
ggcagaucccacgccaggauc

SEQ ID NO: 1304706 - RNA, 23 nt, Mycobacterium tuberculosis H37Rv
ggcagaugagucaaaauccgcgu

SEQ ID NO: 1304707 - RNA, 13 nt, Mycobacterium tuberculosis H37Rv
ggcagcgcgauca

SEQ ID NO: 1304708 - RNA, 19 nt, Mycobacterium tuberculosis H37Rv
ggcagcaaaaaccagcguc

SEQ ID NO: 1304709 - RNA, 20 nt, Mycobacterium tuberculosis H37Rv
ggcagcaaaaacgcugccgc

SEQ ID NO: 1304710 - RNA, 14 nt, Mycobacterium tuberculosis H37Rv
ggcagcgcgaucga

SEQ ID NO: 1304711 - RNA, 13 nt, Mycobacterium tuberculosis H37Rv
ggcagcgcggaug

SEQ ID NO: 1304712 - RNA, 23 nt, Mycobacterium tuberculosis H37Rv
ggcagcgcggaugucggcaucga

SEQ ID NO: 1304713 - RNA, 13 nt, Mycobacterium tuberculosis H37Rv
ggcagcgcggcac

SEQ ID NO: 1304714 - RNA, 20 nt, Mycobacterium tuberculosis H37Rv
ggcagcuugccaaucaccgu

SEQ ID NO: 1304715 - RNA, 19 nt, Mycobacterium tuberculosis H37Rv
ggcagcuugccaaucaccg

SEQ ID NO: 1304716 - RNA, 21 nt, Mycobacterium tuberculosis H37Rv
ggcagcuucucgccgacgaac

SEQ ID NO: 1304717 - RNA, 16 nt, Mycobacterium tuberculosis H37Rv
ggcaggcccgacggcg

SEQ ID NO: 1304718 - RNA, 22 nt, Mycobacterium tuberculosis H37Rv
ggcaggaucuccgggucgaugu

SEQ ID NO: 1304719 - RNA, 19 nt, Mycobacterium tuberculosis H37Rv
ggcaggucuucgcugucga

SEQ ID NO: 1304720 - RNA, 18 nt, Mycobacterium tuberculosis H37Rv
ggcaggcgggggaucggu

SEQ ID NO: 1304721 - RNA, 16 nt, Mycobacterium tuberculosis H37Rv
ggcaggccucggcgcc

SEQ ID NO: 1304722 - RNA, 19 nt, Mycobacterium tuberculosis H37Rv
ggcagguugcguugcagga

SEQ ID NO: 1304723 - RNA, 14 nt, Mycobacterium tuberculosis H37Rv
ggcaguuuggcggc

SEQ ID NO: 1304724 - RNA, 13 nt, Mycobacterium tuberculosis H37Rv
ggcaguuugcggg

SEQ ID NO: 1304725 - RNA, 22 nt, Mycobacterium tuberculosis H37Rv
ggcauaacccuggccggugcgc

SEQ ID NO: 1304726 - RNA, 20 nt, Mycobacterium tuberculosis H37Rv
ggcaguugaacucgaccacc

SEQ ID NO: 1304727 - RNA, 21 nt, Mycobacterium tuberculosis H37Rv
ggcaguugaacucgaccaccg

SEQ ID NO: 1304728 - RNA, 15 nt, Mycobacterium tuberculosis H37Rv
ggcaguagcuguggc

SEQ ID NO: 1304729 - RNA, 20 nt, Mycobacterium tuberculosis H37Rv
ggcaucgucgucgcugccgc

SEQ ID NO: 1304730 - RNA, 21 nt, Mycobacterium tuberculosis H37Rv
ggcauacauccaggcuguggc

SEQ ID NO: 1304731 - RNA, 23 nt, Mycobacterium tuberculosis H37Rv
ggcauacaucgccuugcccagcg

SEQ ID NO: 1304732 - RNA, 22 nt, Mycobacterium tuberculosis H37Rv
ggcaucggucagcgcggcaagc

SEQ ID NO: 1304733 - RNA, 15 nt, Mycobacterium tuberculosis H37Rv
ggcaucgucgccgag

SEQ ID NO: 1304734 - RNA, 18 nt, Mycobacterium tuberculosis H37Rv
ggcaugacgaaugcgggu

SEQ ID NO: 1304735 - RNA, 14 nt, Mycobacterium tuberculosis H37Rv
ggcauggcgccguu

SEQ ID NO: 1304736 - RNA, 22 nt, Mycobacterium tuberculosis H37Rv
ggcauuccggugugcuugcucg

SEQ ID NO: 1304737 - RNA, 22 nt, Mycobacterium tuberculosis H37Rv
ggcaugggcccugcacagcagc

SEQ ID NO: 1304738 - RNA, 23 nt, Mycobacterium tuberculosis H37Rv
ggcaugugacaucgggccgccga

SEQ ID NO: 1304739 - RNA, 17 nt, Mycobacterium tuberculosis H37Rv
ggcauguaccgaccgcg

SEQ ID NO: 1304740 - RNA, 17 nt, Mycobacterium tuberculosis H37Rv
ggcauugguaccggcuu

SEQ ID NO: 1304741 - RNA, 21 nt, Mycobacterium tuberculosis H37Rv
ggccaaaccccugcacggugc

SEQ ID NO: 1304742 - RNA, 20 nt, Mycobacterium tuberculosis H37Rv
ggccaacagucgcagcacgg

SEQ ID NO: 1304743 - RNA, 17 nt, Mycobacterium tuberculosis H37Rv
ggccaacagguccaccg

SEQ ID NO: 1304744 - RNA, 18 nt, Mycobacterium tuberculosis H37Rv
ggccaacagucgcagcac

SEQ ID NO: 1304745 - RNA, 18 nt, Mycobacterium tuberculosis H37Rv
ggccaaauaacgcgggau

SEQ ID NO: 1304746 - RNA, 13 nt, Mycobacterium tuberculosis H37Rv
ggccaacaccuca

SEQ ID NO: 1304747 - RNA, 13 nt, Mycobacterium tuberculosis H37Rv
ggcacccagucgg

SEQ ID NO: 1304748 - RNA, 14 nt, Mycobacterium tuberculosis H37Rv
ggcaccccggccac

SEQ ID NO: 1304749 - RNA, 20 nt, Mycobacterium tuberculosis H37Rv
ggcacccccgucgccaccga

SEQ ID NO: 1304750 - RNA, 14 nt, Mycobacterium tuberculosis H37Rv
ggcacccgacucgu

SEQ ID NO: 1304751 - RNA, 17 nt, Mycobacterium tuberculosis H37Rv
ggcaccaccaagcucgg

SEQ ID NO: 1304752 - RNA, 19 nt, Mycobacterium tuberculosis H37Rv
ggcaccaccacaccggagc

SEQ ID NO: 1304753 - RNA, 21 nt, Mycobacterium tuberculosis H37Rv
ggcacauugaucgacggccag

SEQ ID NO: 1304754 - RNA, 15 nt, Mycobacterium tuberculosis H37Rv
ggcaccaaccugagc

SEQ ID NO: 1304755 - RNA, 14 nt, Mycobacterium tuberculosis H37Rv
ggcaccaacgccac

SEQ ID NO: 1304756 - RNA, 20 nt, Mycobacterium tuberculosis H37Rv
ggcacccaauuucgaccaga

SEQ ID NO: 1304757 - RNA, 17 nt, Mycobacterium tuberculosis H37Rv
ggcaccaccacgccgac

SEQ ID NO: 1304758 - RNA, 19 nt, Mycobacterium tuberculosis H37Rv
ggcaccuccagcaccaccg

SEQ ID NO: 1304759 - RNA, 17 nt, Mycobacterium tuberculosis H37Rv
ggcaccuccgccggcac

SEQ ID NO: 1304760 - RNA, 16 nt, Mycobacterium tuberculosis H37Rv
ggcaccgcggccagcg

SEQ ID NO: 1304761 - RNA, 18 nt, Mycobacterium tuberculosis H37Rv
ggcaccgcccuugccgcc

SEQ ID NO: 1304762 - RNA, 14 nt, Mycobacterium tuberculosis H37Rv
ggcaccgcugccgc

SEQ ID NO: 1304763 - RNA, 17 nt, Mycobacterium tuberculosis H37Rv
ggcaccgacgucggcuu

SEQ ID NO: 1304764 - RNA, 19 nt, Mycobacterium tuberculosis H37Rv
ggcaccgauggcgcaccgg

SEQ ID NO: 1304765 - RNA, 13 nt, Mycobacterium tuberculosis H37Rv
ggcaccgauggcg

SEQ ID NO: 1304766 - RNA, 13 nt, Mycobacterium tuberculosis H37Rv
ggcaccgcgcgcu

SEQ ID NO: 1304767 - RNA, 15 nt, Mycobacterium tuberculosis H37Rv
ggcacgaaucccccg

SEQ ID NO: 1304768 - RNA, 14 nt, Mycobacterium tuberculosis H37Rv
ggcacgacgccggc

SEQ ID NO: 1304769 - RNA, 22 nt, Mycobacterium tuberculosis H37Rv
ggcacgcgggaagugcacccgg

SEQ ID NO: 1304770 - RNA, 14 nt, Mycobacterium tuberculosis H37Rv
ggcacgcgggaagu

SEQ ID NO: 1304771 - RNA, 18 nt, Mycobacterium tuberculosis H37Rv
ggcacgcggcgaugaugg

SEQ ID NO: 1304772 - RNA, 16 nt, Mycobacterium tuberculosis H37Rv
ggcacucccuggggua

SEQ ID NO: 1304773 - RNA, 12 nt, Mycobacterium tuberculosis H37Rv
ggcacugaucgg

SEQ ID NO: 1304774 - RNA, 22 nt, Mycobacterium tuberculosis H37Rv
ggcacugaucggaaacggagcc

SEQ ID NO: 1304775 - RNA, 14 nt, Mycobacterium tuberculosis H37Rv
ggcacugcggccag

SEQ ID NO: 1304776 - RNA, 16 nt, Mycobacterium tuberculosis H37Rv
ggcacuccaccgggau

SEQ ID NO: 1304777 - RNA, 19 nt, Mycobacterium tuberculosis H37Rv
ggcacggccccugccacga

SEQ ID NO: 1304778 - RNA, 18 nt, Mycobacterium tuberculosis H37Rv
ggcacguugugaucguca

SEQ ID NO: 1304779 - RNA, 18 nt, Mycobacterium tuberculosis H37Rv
ggcacggaugcgauggcc

SEQ ID NO: 1304780 - RNA, 22 nt, Mycobacterium tuberculosis H37Rv
ggcacggaaguacuccacccag

SEQ ID NO: 1304781 - RNA, 13 nt, Mycobacterium tuberculosis H37Rv
ggcacgcugucga

SEQ ID NO: 1304782 - RNA, 20 nt, Mycobacterium tuberculosis H37Rv
ggcacgcuccagcucggcca

SEQ ID NO: 1304783 - RNA, 14 nt, Mycobacterium tuberculosis H37Rv
ggcacaucgcacaa

SEQ ID NO: 1304784 - RNA, 18 nt, Mycobacterium tuberculosis H37Rv
ggcacaucgcacggucgc

SEQ ID NO: 1304785 - RNA, 22 nt, Mycobacterium tuberculosis H37Rv
ggcaaugaucaucccggcgcgu

SEQ ID NO: 1304786 - RNA, 22 nt, Mycobacterium tuberculosis H37Rv
ggcaaugaccccggcguugccg

SEQ ID NO: 1304787 - RNA, 18 nt, Mycobacterium tuberculosis H37Rv
ggcaaugacggccugcac

SEQ ID NO: 1304788 - RNA, 15 nt, Mycobacterium tuberculosis H37Rv
ggcaaugcggggcaa

SEQ ID NO: 1304789 - RNA, 19 nt, Mycobacterium tuberculosis H37Rv
ggcaaucgcgggcgauggc

SEQ ID NO: 1304790 - RNA, 19 nt, Mycobacterium tuberculosis H37Rv
ggcaagccacgccggucgc

SEQ ID NO: 1304791 - RNA, 18 nt, Mycobacterium tuberculosis H37Rv
ggcaagcacgcgacggcg

SEQ ID NO: 1304792 - RNA, 14 nt, Mycobacterium tuberculosis H37Rv
ggcaacgaucaggu

SEQ ID NO: 1304793 - RNA, 20 nt, Mycobacterium tuberculosis H37Rv
ggcaagaccgaacagcggca

SEQ ID NO: 1304794 - RNA, 22 nt, Mycobacterium tuberculosis H37Rv
ggcaaacguaccgucauggcga

SEQ ID NO: 1304795 - RNA, 17 nt, Mycobacterium tuberculosis H37Rv
ggcaaacgcacccaucg

SEQ ID NO: 1304796 - RNA, 15 nt, Mycobacterium tuberculosis H37Rv
ggcaaccagcagcag

SEQ ID NO: 1304797 - RNA, 21 nt, Mycobacterium tuberculosis H37Rv
ggcaaccaccggccgcgcaga

SEQ ID NO: 1304798 - RNA, 21 nt, Mycobacterium tuberculosis H37Rv
ggcaaagcgagcaccgcggua

SEQ ID NO: 1304799 - RNA, 22 nt, Mycobacterium tuberculosis H37Rv
ggcaaagcgagcaccgcgguag

SEQ ID NO: 1304800 - RNA, 13 nt, Mycobacterium tuberculosis H37Rv
ggcaacgacacgc

SEQ ID NO: 1304801 - RNA, 18 nt, Mycobacterium tuberculosis H37Rv
ggauugcuugggugccuc

SEQ ID NO: 1304802 - RNA, 20 nt, Mycobacterium tuberculosis H37Rv
ggauuggaggcgggcguuga

SEQ ID NO: 1304803 - RNA, 19 nt, Mycobacterium tuberculosis H37Rv
ggauugcuguacugcggug

SEQ ID NO: 1304804 - RNA, 17 nt, Mycobacterium tuberculosis H37Rv
ggauucggcugccaccg

SEQ ID NO: 1304805 - RNA, 17 nt, Mycobacterium tuberculosis H37Rv
ggauguuugcucggccu

SEQ ID NO: 1304806 - RNA, 20 nt, Mycobacterium tuberculosis H37Rv
ggaugucgagcccgucgagu

SEQ ID NO: 1304807 - RNA, 22 nt, Mycobacterium tuberculosis H37Rv
ggauguccuugaaccagcgcgu

SEQ ID NO: 1304808 - RNA, 15 nt, Mycobacterium tuberculosis H37Rv
ggauggcucgccgaa

SEQ ID NO: 1304809 - RNA, 19 nt, Mycobacterium tuberculosis H37Rv
ggaugccugccucggcgag

SEQ ID NO: 1304810 - RNA, 22 nt, Mycobacterium tuberculosis H37Rv
ggaugcgcaaccgcggccccga

SEQ ID NO: 1304811 - RNA, 15 nt, Mycobacterium tuberculosis H37Rv
ggaugccggaaagca

SEQ ID NO: 1304812 - RNA, 22 nt, Mycobacterium tuberculosis H37Rv
ggaugcaugucaaguucgccag

SEQ ID NO: 1304813 - RNA, 20 nt, Mycobacterium tuberculosis H37Rv
ggauggaccacgaaccgggu

SEQ ID NO: 1304814 - RNA, 14 nt, Mycobacterium tuberculosis H37Rv
ggauggacucgaca

SEQ ID NO: 1304815 - RNA, 22 nt, Mycobacterium tuberculosis H37Rv
ggaugcucgauccacugccgcg

SEQ ID NO: 1304816 - RNA, 16 nt, Mycobacterium tuberculosis H37Rv
ggaugcugagcgccag

SEQ ID NO: 1304817 - RNA, 19 nt, Mycobacterium tuberculosis H37Rv
ggaugcggacucagcggcg

SEQ ID NO: 1304818 - RNA, 21 nt, Mycobacterium tuberculosis H37Rv
ggaucgcggucagcgggucga

SEQ ID NO: 1304819 - RNA, 22 nt, Mycobacterium tuberculosis H37Rv
ggaucggcggccgcgaccagcg

SEQ ID NO: 1304820 - RNA, 12 nt, Mycobacterium tuberculosis H37Rv
ggaucggcggau

SEQ ID NO: 1304821 - RNA, 15 nt, Mycobacterium tuberculosis H37Rv
ggaucggccugucca

SEQ ID NO: 1304822 - RNA, 15 nt, Mycobacterium tuberculosis H37Rv
ggaucgccaccggcg

SEQ ID NO: 1304823 - RNA, 16 nt, Mycobacterium tuberculosis H37Rv
ggaucgaucugcggag

SEQ ID NO: 1304824 - RNA, 17 nt, Mycobacterium tuberculosis H37Rv
ggaucgccgagaccgcg

SEQ ID NO: 1304825 - RNA, 17 nt, Mycobacterium tuberculosis H37Rv
ggaucgccgaaucggca

SEQ ID NO: 1304826 - RNA, 24 nt, Mycobacterium tuberculosis H37Rv
ggaucgcccaggcgcgacguacga

SEQ ID NO: 1304827 - RNA, 21 nt, Mycobacterium tuberculosis H37Rv
ggaacaacggcguaaucggga

SEQ ID NO: 1304828 - RNA, 13 nt, Mycobacterium tuberculosis H37Rv
ggaaaugucgcac

SEQ ID NO: 1304829 - RNA, 20 nt, Mycobacterium tuberculosis H37Rv
ggaucguucgcgugccagcg

SEQ ID NO: 1304830 - RNA, 22 nt, Mycobacterium tuberculosis H37Rv
ggaucguacgggucggcgacga

SEQ ID NO: 1304831 - RNA, 22 nt, Mycobacterium tuberculosis H37Rv
ggaucggugguacgugcgagcc

SEQ ID NO: 1304832 - RNA, 22 nt, Mycobacterium tuberculosis H37Rv
ggaucgguuccggccccgucgu

SEQ ID NO: 1304833 - RNA, 13 nt, Mycobacterium tuberculosis H37Rv
ggaucggugguac

SEQ ID NO: 1304834 - RNA, 16 nt, Mycobacterium tuberculosis H37Rv
ggaucucuuucggaug

SEQ ID NO: 1304835 - RNA, 17 nt, Mycobacterium tuberculosis H37Rv
ggaucugcagcacgcgu

SEQ ID NO: 1304836 - RNA, 19 nt, Mycobacterium tuberculosis H37Rv
ggaucucguuggugccuuc

SEQ ID NO: 1304837 - RNA, 20 nt, Mycobacterium tuberculosis H37Rv
ggaucugacggcgccgucga

SEQ ID NO: 1304838 - RNA, 16 nt, Mycobacterium tuberculosis H37Rv
ggaucuuggccagcag

SEQ ID NO: 1304839 - RNA, 21 nt, Mycobacterium tuberculosis H37Rv
ggaugaccagugaucagcgca

SEQ ID NO: 1304840 - RNA, 16 nt, Mycobacterium tuberculosis H37Rv
ggaugaccuuggccgu

SEQ ID NO: 1304841 - RNA, 21 nt, Mycobacterium tuberculosis H37Rv
ggcgcgaaaccaguccaucga

SEQ ID NO: 1304842 - RNA, 12 nt, Mycobacterium tuberculosis H37Rv
ggcgcgaccaga

SEQ ID NO: 1304843 - RNA, 22 nt, Mycobacterium tuberculosis H37Rv
ggcgcgaccggucugaucggcu

SEQ ID NO: 1304844 - RNA, 13 nt, Mycobacterium tuberculosis H37Rv
ggcgcgaccgcgg

SEQ ID NO: 1304845 - RNA, 19 nt, Mycobacterium tuberculosis H37Rv
ggcgccugacucaucaccg

SEQ ID NO: 1304846 - RNA, 14 nt, Mycobacterium tuberculosis H37Rv
ggcgcgcucaucga

SEQ ID NO: 1304847 - RNA, 13 nt, Mycobacterium tuberculosis H37Rv
ggcgcgcugcacg

SEQ ID NO: 1304848 - RNA, 21 nt, Mycobacterium tuberculosis H37Rv
ggcgcgcugcacggaaucgca

SEQ ID NO: 1304849 - RNA, 20 nt, Mycobacterium tuberculosis H37Rv
ggcgcgcggggccucgcgag

SEQ ID NO: 1304850 - RNA, 21 nt, Mycobacterium tuberculosis H37Rv
ggcgcgcggguugucggcgac

SEQ ID NO: 1304851 - RNA, 22 nt, Mycobacterium tuberculosis H37Rv
ggcgcgaccuccgcgaucaccg

SEQ ID NO: 1304852 - RNA, 18 nt, Mycobacterium tuberculosis H37Rv
ggcgcgggccggcgacug

SEQ ID NO: 1304853 - RNA, 21 nt, Mycobacterium tuberculosis H37Rv
ggcgcggauacgggcagugaa

SEQ ID NO: 1304854 - RNA, 18 nt, Mycobacterium tuberculosis H37Rv
ggcgcggagagccugcuc

SEQ ID NO: 1304855 - RNA, 22 nt, Mycobacterium tuberculosis H37Rv
ggcgcguaguaaugcucgacgu

SEQ ID NO: 1304856 - RNA, 17 nt, Mycobacterium tuberculosis H37Rv
ggcgcgguuucggcguc

SEQ ID NO: 1304857 - RNA, 17 nt, Mycobacterium tuberculosis H37Rv
ggcgcgguuugcucguu

SEQ ID NO: 1304858 - RNA, 16 nt, Mycobacterium tuberculosis H37Rv
ggcgcggugcgcucac

SEQ ID NO: 1304859 - RNA, 17 nt, Mycobacterium tuberculosis H37Rv
ggcgcgguaccgcucgg

SEQ ID NO: 1304860 - RNA, 19 nt, Mycobacterium tuberculosis H37Rv
ggcgcggucggagucgagc

SEQ ID NO: 1304861 - RNA, 16 nt, Mycobacterium tuberculosis H37Rv
ggcgcgggugcggauc

SEQ ID NO: 1304862 - RNA, 15 nt, Mycobacterium tuberculosis H37Rv
ggcgcgggugaccag

SEQ ID NO: 1304863 - RNA, 15 nt, Mycobacterium tuberculosis H37Rv
ggcgcgggucggcga

SEQ ID NO: 1304864 - RNA, 20 nt, Mycobacterium tuberculosis H37Rv
ggcgcugacuagggucaccg

SEQ ID NO: 1304865 - RNA, 21 nt, Mycobacterium tuberculosis H37Rv
ggcgcugcccgggcugccgcc

SEQ ID NO: 1304866 - RNA, 14 nt, Mycobacterium tuberculosis H37Rv
ggcgcugaucggca

SEQ ID NO: 1304867 - RNA, 11 nt, Mycobacterium tuberculosis H37Rv
ggcgcugaucg

SEQ ID NO: 1304868 - RNA, 12 nt, Mycobacterium tuberculosis H37Rv
ggcgcugaucgc

SEQ ID NO: 1304869 - RNA, 21 nt, Mycobacterium tuberculosis H37Rv
ggcgcuggaccgggucgggca

SEQ ID NO: 1304870 - RNA, 12 nt, Mycobacterium tuberculosis H37Rv
ggcgcugcuggc

SEQ ID NO: 1304871 - RNA, 21 nt, Mycobacterium tuberculosis H37Rv
ggcgcugcugccauugccgau

SEQ ID NO: 1304872 - RNA, 17 nt, Mycobacterium tuberculosis H37Rv
ggcgcuggcgggcgauc

SEQ ID NO: 1304873 - RNA, 23 nt, Mycobacterium tuberculosis H37Rv
ggcgcugggauguucgaucagcg

SEQ ID NO: 1304874 - RNA, 17 nt, Mycobacterium tuberculosis H37Rv
ggcgcugggacggucgc

SEQ ID NO: 1304875 - RNA, 23 nt, Mycobacterium tuberculosis H37Rv
ggcgcuaccuguguugagcggca

SEQ ID NO: 1304876 - RNA, 13 nt, Mycobacterium tuberculosis H37Rv
ggcgcuaccagcc

SEQ ID NO: 1304877 - RNA, 21 nt, Mycobacterium tuberculosis H37Rv
ggcgcucccgccggcagcguc

SEQ ID NO: 1304878 - RNA, 23 nt, Mycobacterium tuberculosis H37Rv
ggcgcucccgccggcagcgucgg

SEQ ID NO: 1304879 - RNA, 23 nt, Mycobacterium tuberculosis H37Rv
ggcgcuaaaacgccagucgagca

SEQ ID NO: 1304880 - RNA, 17 nt, Mycobacterium tuberculosis H37Rv
ggcgcguugcguaucga

SEQ ID NO: 1304881 - RNA, 20 nt, Mycobacterium tuberculosis H37Rv
ggcgcguugcguaucgaccc

SEQ ID NO: 1304882 - RNA, 21 nt, Mycobacterium tuberculosis H37Rv
ggcgcguugcguaucgacccg

SEQ ID NO: 1304883 - RNA, 17 nt, Mycobacterium tuberculosis H37Rv
ggcgcucggcgagcaac

SEQ ID NO: 1304884 - RNA, 19 nt, Mycobacterium tuberculosis H37Rv
ggcgcucgaaggccgcacu

SEQ ID NO: 1304885 - RNA, 23 nt, Mycobacterium tuberculosis H37Rv
ggcggcgaugggcuacuugguca

SEQ ID NO: 1304886 - RNA, 21 nt, Mycobacterium tuberculosis H37Rv
ggcggcggggacucugccacc

SEQ ID NO: 1304887 - RNA, 16 nt, Mycobacterium tuberculosis H37Rv
ggcggcggcggcaagu

SEQ ID NO: 1304888 - RNA, 20 nt, Mycobacterium tuberculosis H37Rv
ggcggcgaucaacucgggca

SEQ ID NO: 1304889 - RNA, 20 nt, Mycobacterium tuberculosis H37Rv
ggcggcgaggcgagucaccg

SEQ ID NO: 1304890 - RNA, 20 nt, Mycobacterium tuberculosis H37Rv
ggcggccugagcgucgucgc

SEQ ID NO: 1304891 - RNA, 19 nt, Mycobacterium tuberculosis H37Rv
ggcggccuucggccggcgu

SEQ ID NO: 1304892 - RNA, 23 nt, Mycobacterium tuberculosis H37Rv
ggcggccuggucggccaggucga

SEQ ID NO: 1304893 - RNA, 14 nt, Mycobacterium tuberculosis H37Rv
ggcggccuggcacc

SEQ ID NO: 1304894 - RNA, 19 nt, Mycobacterium tuberculosis H37Rv
ggcggcgguggccagcguc

SEQ ID NO: 1304895 - RNA, 16 nt, Mycobacterium tuberculosis H37Rv
ggcggcgguggcguua

SEQ ID NO: 1304896 - RNA, 22 nt, Mycobacterium tuberculosis H37Rv
ggcggcguccaccugcuccgcu

SEQ ID NO: 1304897 - RNA, 14 nt, Mycobacterium tuberculosis H37Rv
ggcggcggucgagc

SEQ ID NO: 1304898 - RNA, 15 nt, Mycobacterium tuberculosis H37Rv
ggcggcggugcagca

SEQ ID NO: 1304899 - RNA, 15 nt, Mycobacterium tuberculosis H37Rv
ggcggcggucggcug

SEQ ID NO: 1304900 - RNA, 16 nt, Mycobacterium tuberculosis H37Rv
ggcggcggugccacga

SEQ ID NO: 1304901 - RNA, 20 nt, Mycobacterium tuberculosis H37Rv
ggcggcggugcgucagcugg

SEQ ID NO: 1304902 - RNA, 22 nt, Mycobacterium tuberculosis H37Rv
ggcggcggugcgucagcugguu

SEQ ID NO: 1304903 - RNA, 11 nt, Mycobacterium tuberculosis H37Rv
ggcggcgucgc

SEQ ID NO: 1304904 - RNA, 21 nt, Mycobacterium tuberculosis H37Rv
ggcggcgucgacggcuccucc

SEQ ID NO: 1304905 - RNA, 13 nt, Mycobacterium tuberculosis H37Rv
ggcggcgucgagc

SEQ ID NO: 1304906 - RNA, 14 nt, Mycobacterium tuberculosis H37Rv
ggcggcgucgagca

SEQ ID NO: 1304907 - RNA, 15 nt, Mycobacterium tuberculosis H37Rv
ggcggcugaacggca

SEQ ID NO: 1304908 - RNA, 19 nt, Mycobacterium tuberculosis H37Rv
ggcggcuucgacgucggcg

SEQ ID NO: 1304909 - RNA, 18 nt, Mycobacterium tuberculosis H37Rv
ggcggcuuccucgagcga

SEQ ID NO: 1304910 - RNA, 14 nt, Mycobacterium tuberculosis H37Rv
ggcggcugccgguu

SEQ ID NO: 1304911 - RNA, 12 nt, Mycobacterium tuberculosis H37Rv
ggcggcugucgg

SEQ ID NO: 1304912 - RNA, 21 nt, Mycobacterium tuberculosis H37Rv
ggcggcaggugcggcggcauc

SEQ ID NO: 1304913 - RNA, 16 nt, Mycobacterium tuberculosis H37Rv
ggcggcagcggcgauc

SEQ ID NO: 1304914 - RNA, 13 nt, Mycobacterium tuberculosis H37Rv
ggcggcagcgauc

SEQ ID NO: 1304915 - RNA, 18 nt, Mycobacterium tuberculosis H37Rv
ggcggcagcauauccgcc

SEQ ID NO: 1304916 - RNA, 14 nt, Mycobacterium tuberculosis H37Rv
ggcggccagggugc

SEQ ID NO: 1304917 - RNA, 14 nt, Mycobacterium tuberculosis H37Rv
ggcggccaguucgg

SEQ ID NO: 1304918 - RNA, 13 nt, Mycobacterium tuberculosis H37Rv
ggcggccaguugc

SEQ ID NO: 1304919 - RNA, 16 nt, Mycobacterium tuberculosis H37Rv
ggcggccaucgacgac

SEQ ID NO: 1304920 - RNA, 16 nt, Mycobacterium tuberculosis H37Rv
ggcggcauccugcacg

SEQ ID NO: 1304921 - RNA, 16 nt, Mycobacterium tuberculosis H37Rv
ggcggcccgguggaca

SEQ ID NO: 1304922 - RNA, 19 nt, Mycobacterium tuberculosis H37Rv
ggcggcccguuugccgguu

SEQ ID NO: 1304923 - RNA, 17 nt, Mycobacterium tuberculosis H37Rv
ggcggcccggucuacgc

SEQ ID NO: 1304924 - RNA, 14 nt, Mycobacterium tuberculosis H37Rv
ggcggcccgcucgg

SEQ ID NO: 1304925 - RNA, 20 nt, Mycobacterium tuberculosis H37Rv
ggcggccauucggucagcca

SEQ ID NO: 1304926 - RNA, 22 nt, Mycobacterium tuberculosis H37Rv
ggcggccaugucagcggccugc

SEQ ID NO: 1304927 - RNA, 14 nt, Mycobacterium tuberculosis H37Rv
ggcggccccggcau

SEQ ID NO: 1304928 - RNA, 16 nt, Mycobacterium tuberculosis H37Rv
ggcgcuguagucgcgc

SEQ ID NO: 1304929 - RNA, 19 nt, Mycobacterium tuberculosis H37Rv
ggcgcuuaugcgucugcuc

SEQ ID NO: 1304930 - RNA, 20 nt, Mycobacterium tuberculosis H37Rv
ggcgcuuaugcgucugcucg

SEQ ID NO: 1304931 - RNA, 18 nt, Mycobacterium tuberculosis H37Rv
ggcggaucugaucggcgc

SEQ ID NO: 1304932 - RNA, 15 nt, Mycobacterium tuberculosis H37Rv
ggcggauggccgccu

SEQ ID NO: 1304933 - RNA, 16 nt, Mycobacterium tuberculosis H37Rv
ggcgccgucaccgauc

SEQ ID NO: 1304934 - RNA, 15 nt, Mycobacterium tuberculosis H37Rv
ggcgccggugccgcc

SEQ ID NO: 1304935 - RNA, 17 nt, Mycobacterium tuberculosis H37Rv
ggcgccggggggcugcu

SEQ ID NO: 1304936 - RNA, 17 nt, Mycobacterium tuberculosis H37Rv
ggcgccgccgucgccgc

SEQ ID NO: 1304937 - RNA, 18 nt, Mycobacterium tuberculosis H37Rv
ggcgccgccguugccgcc

SEQ ID NO: 1304938 - RNA, 18 nt, Mycobacterium tuberculosis H37Rv
ggcgccgccggugccacc

SEQ ID NO: 1304939 - RNA, 22 nt, Mycobacterium tuberculosis H37Rv
ggcgccgauaccggcggcgagc

SEQ ID NO: 1304940 - RNA, 13 nt, Mycobacterium tuberculosis H37Rv
ggcgccgaggucg

SEQ ID NO: 1304941 - RNA, 22 nt, Mycobacterium tuberculosis H37Rv
ggcgccgacgacuccggcaagc

SEQ ID NO: 1304942 - RNA, 21 nt, Mycobacterium tuberculosis H37Rv
ggcgcccccgccauugccgcc

SEQ ID NO: 1304943 - RNA, 14 nt, Mycobacterium tuberculosis H37Rv
ggcgcccgaagccg

SEQ ID NO: 1304944 - RNA, 14 nt, Mycobacterium tuberculosis H37Rv
ggcgcccccgacga

SEQ ID NO: 1304945 - RNA, 14 nt, Mycobacterium tuberculosis H37Rv
ggcgcccccgccau

SEQ ID NO: 1304946 - RNA, 20 nt, Mycobacterium tuberculosis H37Rv
ggcgcccagcucgucgagcu

SEQ ID NO: 1304947 - RNA, 15 nt, Mycobacterium tuberculosis H37Rv
ggcgcccagcgcuag

SEQ ID NO: 1304948 - RNA, 14 nt, Mycobacterium tuberculosis H37Rv
ggcgcccaucgcga

SEQ ID NO: 1304949 - RNA, 14 nt, Mycobacterium tuberculosis H37Rv
ggcgcccagcucgu

SEQ ID NO: 1304950 - RNA, 17 nt, Mycobacterium tuberculosis H37Rv
ggcgcccagcgccucga

SEQ ID NO: 1304951 - RNA, 13 nt, Mycobacterium tuberculosis H37Rv
ggcgccaggucgg

SEQ ID NO: 1304952 - RNA, 13 nt, Mycobacterium tuberculosis H37Rv
ggcgccaguucgg

SEQ ID NO: 1304953 - RNA, 14 nt, Mycobacterium tuberculosis H37Rv
ggcgcccacaucgu

SEQ ID NO: 1304954 - RNA, 20 nt, Mycobacterium tuberculosis H37Rv
ggcgcagccugccgaugacg

SEQ ID NO: 1304955 - RNA, 16 nt, Mycobacterium tuberculosis H37Rv
ggcgcagcgaccggua

SEQ ID NO: 1304956 - RNA, 13 nt, Mycobacterium tuberculosis H37Rv
ggcgcagcgccag

SEQ ID NO: 1304957 - RNA, 22 nt, Mycobacterium tuberculosis H37Rv
ggcgcaccagggagccguucaa

SEQ ID NO: 1304958 - RNA, 12 nt, Mycobacterium tuberculosis H37Rv
ggcgcaccaccg

SEQ ID NO: 1304959 - RNA, 14 nt, Mycobacterium tuberculosis H37Rv
ggcgcacgauggug

SEQ ID NO: 1304960 - RNA, 16 nt, Mycobacterium tuberculosis H37Rv
ggcgcacgaaaccgca

SEQ ID NO: 1304961 - RNA, 20 nt, Mycobacterium tuberculosis H37Rv
ggcgcaccugggcugccggc

SEQ ID NO: 1304962 - RNA, 20 nt, Mycobacterium tuberculosis H37Rv
ggcgcaccgcggaccggcgu

SEQ ID NO: 1304963 - RNA, 21 nt, Mycobacterium tuberculosis H37Rv
ggcgcaccgcggaccggcguc

SEQ ID NO: 1304964 - RNA, 19 nt, Mycobacterium tuberculosis H37Rv
ggcgcaccggcgucggcgc

SEQ ID NO: 1304965 - RNA, 15 nt, Mycobacterium tuberculosis H37Rv
ggcgcagcacggcgg

SEQ ID NO: 1304966 - RNA, 16 nt, Mycobacterium tuberculosis H37Rv
ggcgcagagucaacgu

SEQ ID NO: 1304967 - RNA, 19 nt, Mycobacterium tuberculosis H37Rv
ggcgcagagucaacgucgu

SEQ ID NO: 1304968 - RNA, 18 nt, Mycobacterium tuberculosis H37Rv
ggcgaguacaggcgcagc

SEQ ID NO: 1304969 - RNA, 15 nt, Mycobacterium tuberculosis H37Rv
ggcgaguacggccug

SEQ ID NO: 1304970 - RNA, 16 nt, Mycobacterium tuberculosis H37Rv
ggcgaggugcucggau

SEQ ID NO: 1304971 - RNA, 19 nt, Mycobacterium tuberculosis H37Rv
ggcgaggugcucggaucgg

SEQ ID NO: 1304972 - RNA, 17 nt, Mycobacterium tuberculosis H37Rv
ggcgaggucccggccga

SEQ ID NO: 1304973 - RNA, 20 nt, Mycobacterium tuberculosis H37Rv
ggcgagggugaagacaccgg

SEQ ID NO: 1304974 - RNA, 19 nt, Mycobacterium tuberculosis H37Rv
ggccugcuugucaacccgg

SEQ ID NO: 1304975 - RNA, 16 nt, Mycobacterium tuberculosis H37Rv
ggccugggacggcggc

SEQ ID NO: 1304976 - RNA, 17 nt, Mycobacterium tuberculosis H37Rv
ggcgauaucgcacaugg

SEQ ID NO: 1304977 - RNA, 14 nt, Mycobacterium tuberculosis H37Rv
ggcgauaucggccc

SEQ ID NO: 1304978 - RNA, 17 nt, Mycobacterium tuberculosis H37Rv
ggcgaucaaccgcuguc

SEQ ID NO: 1304979 - RNA, 19 nt, Mycobacterium tuberculosis H37Rv
ggcgaucaaccgcugucac

SEQ ID NO: 1304980 - RNA, 21 nt, Mycobacterium tuberculosis H37Rv
ggcgauacgcgcgucggguau

SEQ ID NO: 1304981 - RNA, 20 nt, Mycobacterium tuberculosis H37Rv
ggcgaguuaggccgccagcc

SEQ ID NO: 1304982 - RNA, 22 nt, Mycobacterium tuberculosis H37Rv
ggcgauaaccgacgaucaacgg

SEQ ID NO: 1304983 - RNA, 18 nt, Mycobacterium tuberculosis H37Rv
ggcgaucagcagcgccag

SEQ ID NO: 1304984 - RNA, 12 nt, Mycobacterium tuberculosis H37Rv
ggcgaucacgcg

SEQ ID NO: 1304985 - RNA, 13 nt, Mycobacterium tuberculosis H37Rv
ggcgaucaccgag

SEQ ID NO: 1304986 - RNA, 17 nt, Mycobacterium tuberculosis H37Rv
ggcgauccggucggcca

SEQ ID NO: 1304987 - RNA, 23 nt, Mycobacterium tuberculosis H37Rv
ggcgauccgguaggccaucugcu

SEQ ID NO: 1304988 - RNA, 18 nt, Mycobacterium tuberculosis H37Rv
ggcgaucgcauccgcggu

SEQ ID NO: 1304989 - RNA, 20 nt, Mycobacterium tuberculosis H37Rv
ggcgaugaggaacguuucgc

SEQ ID NO: 1304990 - RNA, 16 nt, Mycobacterium tuberculosis H37Rv
ggcgaugaugacggcg

SEQ ID NO: 1304991 - RNA, 18 nt, Mycobacterium tuberculosis H37Rv
ggcgaugagcaugcccag

SEQ ID NO: 1304992 - RNA, 16 nt, Mycobacterium tuberculosis H37Rv
ggcgaugagcgcgauc

SEQ ID NO: 1304993 - RNA, 19 nt, Mycobacterium tuberculosis H37Rv
ggcgaugagcgugccgcag

SEQ ID NO: 1304994 - RNA, 17 nt, Mycobacterium tuberculosis H37Rv
ggcgaugcagccgggaa

SEQ ID NO: 1304995 - RNA, 17 nt, Mycobacterium tuberculosis H37Rv
ggcgaucguguccaccg

SEQ ID NO: 1304996 - RNA, 20 nt, Mycobacterium tuberculosis H37Rv
ggcgaucguguccaccggac

SEQ ID NO: 1304997 - RNA, 18 nt, Mycobacterium tuberculosis H37Rv
ggcgaucgcuucgcaagu

SEQ ID NO: 1304998 - RNA, 16 nt, Mycobacterium tuberculosis H37Rv
ggcgaucgacaccgug

SEQ ID NO: 1304999 - RNA, 13 nt, Mycobacterium tuberculosis H37Rv
ggcgaucuggucg

SEQ ID NO: 1305000 - RNA, 18 nt, Mycobacterium tuberculosis H37Rv
ggcgaucugggugccggu

SEQ ID NO: 1305001 - RNA, 14 nt, Mycobacterium tuberculosis H37Rv
ggcgaucucgacgg

SEQ ID NO: 1305002 - RNA, 16 nt, Mycobacterium tuberculosis H37Rv
ggcgaucucuaccagc

SEQ ID NO: 1305003 - RNA, 20 nt, Mycobacterium tuberculosis H37Rv
ggcgauuuugcgucugcucg

SEQ ID NO: 1305004 - RNA, 19 nt, Mycobacterium tuberculosis H37Rv
ggcgauucugugucugcuc

SEQ ID NO: 1305005 - RNA, 23 nt, Mycobacterium tuberculosis H37Rv
ggcgauucugcgucugcucggcg

SEQ ID NO: 1305006 - RNA, 16 nt, Mycobacterium tuberculosis H37Rv
ggcgauugcgccgcac

SEQ ID NO: 1305007 - RNA, 19 nt, Mycobacterium tuberculosis H37Rv
ggcgauucugcgucugcuc

SEQ ID NO: 1305008 - RNA, 12 nt, Mycobacterium tuberculosis H37Rv
ggcgauguucga

SEQ ID NO: 1305009 - RNA, 15 nt, Mycobacterium tuberculosis H37Rv
ggcgauuacggccag

SEQ ID NO: 1305010 - RNA, 16 nt, Mycobacterium tuberculosis H37Rv
ggcgauggucuccucg

SEQ ID NO: 1305011 - RNA, 23 nt, Mycobacterium tuberculosis H37Rv
ggcgaugggucugguguccaccg

SEQ ID NO: 1305012 - RNA, 16 nt, Mycobacterium tuberculosis H37Rv
ggcgauggcaccgugg

SEQ ID NO: 1305013 - RNA, 14 nt, Mycobacterium tuberculosis H37Rv
ggcgucgccgccgu

SEQ ID NO: 1305014 - RNA, 15 nt, Mycobacterium tuberculosis H37Rv
ggcgucgccgccguu

SEQ ID NO: 1305015 - RNA, 22 nt, Mycobacterium tuberculosis H37Rv
ggcgucgccgccguugccgcca

SEQ ID NO: 1305016 - RNA, 21 nt, Mycobacterium tuberculosis H37Rv
ggcgucgccgccauugccgcc

SEQ ID NO: 1305017 - RNA, 18 nt, Mycobacterium tuberculosis H37Rv
ggcgucgaugucauccga

SEQ ID NO: 1305018 - RNA, 17 nt, Mycobacterium tuberculosis H37Rv
ggcgucgcaacgcgauc

SEQ ID NO: 1305019 - RNA, 14 nt, Mycobacterium tuberculosis H37Rv
ggcgucgaucucga

SEQ ID NO: 1305020 - RNA, 16 nt, Mycobacterium tuberculosis H37Rv
ggcgucgaguucgguu

SEQ ID NO: 1305021 - RNA, 14 nt, Mycobacterium tuberculosis H37Rv
ggcgucgacuggcc

SEQ ID NO: 1305022 - RNA, 22 nt, Mycobacterium tuberculosis H37Rv
ggcgucgaccucgcgggcgauc

SEQ ID NO: 1305023 - RNA, 21 nt, Mycobacterium tuberculosis H37Rv
ggcgucgaccuuauugccgag

SEQ ID NO: 1305024 - RNA, 22 nt, Mycobacterium tuberculosis H37Rv
ggcgucgacccugcccagcacc

SEQ ID NO: 1305025 - RNA, 12 nt, Mycobacterium tuberculosis H37Rv
ggcgucgcugcc

SEQ ID NO: 1305026 - RNA, 17 nt, Mycobacterium tuberculosis H37Rv
ggcgucggacaugccga

SEQ ID NO: 1305027 - RNA, 15 nt, Mycobacterium tuberculosis H37Rv
ggcgucgcucgucgu

SEQ ID NO: 1305028 - RNA, 12 nt, Mycobacterium tuberculosis H37Rv
ggcgucggcgac

SEQ ID NO: 1305029 - RNA, 15 nt, Mycobacterium tuberculosis H37Rv
ggcgucggcgcccag

SEQ ID NO: 1305030 - RNA, 17 nt, Mycobacterium tuberculosis H37Rv
ggcgucggccacccggu

SEQ ID NO: 1305031 - RNA, 22 nt, Mycobacterium tuberculosis H37Rv
ggcguccaucgccaccgcguca

SEQ ID NO: 1305032 - RNA, 19 nt, Mycobacterium tuberculosis H37Rv
ggcgucccaaucgggaucg

SEQ ID NO: 1305033 - RNA, 19 nt, Mycobacterium tuberculosis H37Rv
ggcgucccagccgaucacg

SEQ ID NO: 1305034 - RNA, 22 nt, Mycobacterium tuberculosis H37Rv
ggcgucccggcggucagcggcu

SEQ ID NO: 1305035 - RNA, 15 nt, Mycobacterium tuberculosis H37Rv
ggcguccgccggcga

SEQ ID NO: 1305036 - RNA, 18 nt, Mycobacterium tuberculosis H37Rv
ggcgggcgagugucagca

SEQ ID NO: 1305037 - RNA, 23 nt, Mycobacterium tuberculosis H37Rv
ggcgucgaaggugaccaggcgga

SEQ ID NO: 1305038 - RNA, 21 nt, Mycobacterium tuberculosis H37Rv
ggcgucgaauucagcugcacc

SEQ ID NO: 1305039 - RNA, 19 nt, Mycobacterium tuberculosis H37Rv
ggcgucgacaacacgccgu

SEQ ID NO: 1305040 - RNA, 21 nt, Mycobacterium tuberculosis H37Rv
ggcgucgacaacacgccgucg

SEQ ID NO: 1305041 - RNA, 22 nt, Mycobacterium tuberculosis H37Rv
ggcgucgacagauugcucggug

SEQ ID NO: 1305042 - RNA, 19 nt, Mycobacterium tuberculosis H37Rv
ggcgucgaauucagcugca

SEQ ID NO: 1305043 - RNA, 18 nt, Mycobacterium tuberculosis H37Rv
ggcguccuugcgcagcac

SEQ ID NO: 1305044 - RNA, 15 nt, Mycobacterium tuberculosis H37Rv
ggcguccucgucgag

SEQ ID NO: 1305045 - RNA, 21 nt, Mycobacterium tuberculosis H37Rv
ggcguccuugcgcagcaccag

SEQ ID NO: 1305046 - RNA, 13 nt, Mycobacterium tuberculosis H37Rv
ggcguccgggauc

SEQ ID NO: 1305047 - RNA, 16 nt, Mycobacterium tuberculosis H37Rv
ggcgucugagcgagcu

SEQ ID NO: 1305048 - RNA, 21 nt, Mycobacterium tuberculosis H37Rv
ggcgucuuucggguccgacag

SEQ ID NO: 1305049 - RNA, 12 nt, Mycobacterium tuberculosis H37Rv
ggcgugagccga

SEQ ID NO: 1305050 - RNA, 23 nt, Mycobacterium tuberculosis H37Rv
ggcgugaccuaccuccucggcgu

SEQ ID NO: 1305051 - RNA, 15 nt, Mycobacterium tuberculosis H37Rv
ggcgugaacguucuu

SEQ ID NO: 1305052 - RNA, 23 nt, Mycobacterium tuberculosis H37Rv
ggcgucguucgagaccccgacga

SEQ ID NO: 1305053 - RNA, 12 nt, Mycobacterium tuberculosis H37Rv
ggcgucgucggu

SEQ ID NO: 1305054 - RNA, 19 nt, Mycobacterium tuberculosis H37Rv
ggcgucgugguggccacgg

SEQ ID NO: 1305055 - RNA, 15 nt, Mycobacterium tuberculosis H37Rv
ggcgucgucgaugau

SEQ ID NO: 1305056 - RNA, 20 nt, Mycobacterium tuberculosis H37Rv
ggcgucgucgauggcugcgc

SEQ ID NO: 1305057 - RNA, 20 nt, Mycobacterium tuberculosis H37Rv
ggcgucgucgaguuggccau

SEQ ID NO: 1305058 - RNA, 17 nt, Mycobacterium tuberculosis H37Rv
ggcgucgucgaguuggc

SEQ ID NO: 1305059 - RNA, 16 nt, Mycobacterium tuberculosis H37Rv
ggcgucguagucgucg

SEQ ID NO: 1305060 - RNA, 16 nt, Mycobacterium tuberculosis H37Rv
ggcgugcagcacuugg

SEQ ID NO: 1305061 - RNA, 16 nt, Mycobacterium tuberculosis H37Rv
ggcguggaugcccggu

SEQ ID NO: 1305062 - RNA, 18 nt, Mycobacterium tuberculosis H37Rv
ggcgugcugugcucacga

SEQ ID NO: 1305063 - RNA, 19 nt, Mycobacterium tuberculosis H37Rv
ggcgugcucggaggcgauc

SEQ ID NO: 1305064 - RNA, 12 nt, Mycobacterium tuberculosis H37Rv
ggcgugcgugga

SEQ ID NO: 1305065 - RNA, 14 nt, Mycobacterium tuberculosis H37Rv
ggcgugcucgccgg

SEQ ID NO: 1305066 - RNA, 18 nt, Mycobacterium tuberculosis H37Rv
ggcgugcggacugacguc

SEQ ID NO: 1305067 - RNA, 24 nt, Mycobacterium tuberculosis H37Rv
ggcucccguacucccguggccgau

SEQ ID NO: 1305068 - RNA, 15 nt, Mycobacterium tuberculosis H37Rv
ggcuccgaacauggc

SEQ ID NO: 1305069 - RNA, 21 nt, Mycobacterium tuberculosis H37Rv
ggcuccgauuccgaacugguc

SEQ ID NO: 1305070 - RNA, 20 nt, Mycobacterium tuberculosis H37Rv
ggcuccgauucuucgaugau

SEQ ID NO: 1305071 - RNA, 18 nt, Mycobacterium tuberculosis H37Rv
ggcuccgccguugccgcc

SEQ ID NO: 1305072 - RNA, 13 nt, Mycobacterium tuberculosis H37Rv
ggcuccgccagcg

SEQ ID NO: 1305073 - RNA, 16 nt, Mycobacterium tuberculosis H37Rv
ggcuccgccagcgccg

SEQ ID NO: 1305074 - RNA, 17 nt, Mycobacterium tuberculosis H37Rv
ggcucgaaccgacgcgu

SEQ ID NO: 1305075 - RNA, 17 nt, Mycobacterium tuberculosis H37Rv
ggcuccguuguccagcg

SEQ ID NO: 1305076 - RNA, 20 nt, Mycobacterium tuberculosis H37Rv
ggcuccuccgguaucggcga

SEQ ID NO: 1305077 - RNA, 13 nt, Mycobacterium tuberculosis H37Rv
ggcuccggcggca

SEQ ID NO: 1305078 - RNA, 23 nt, Mycobacterium tuberculosis H37Rv
ggcucccacucccgccccgcuca

SEQ ID NO: 1305079 - RNA, 13 nt, Mycobacterium tuberculosis H37Rv
ggcuccagcgcgc

SEQ ID NO: 1305080 - RNA, 16 nt, Mycobacterium tuberculosis H37Rv
ggcucacagcacagcg

SEQ ID NO: 1305081 - RNA, 20 nt, Mycobacterium tuberculosis H37Rv
ggcucacaugcccgcaccgu

SEQ ID NO: 1305082 - RNA, 17 nt, Mycobacterium tuberculosis H37Rv
ggcucacaugugcgcgu

SEQ ID NO: 1305083 - RNA, 14 nt, Mycobacterium tuberculosis H37Rv
ggcuacaucggcgg

SEQ ID NO: 1305084 - RNA, 20 nt, Mycobacterium tuberculosis H37Rv
ggcuacaucggcggcgucga

SEQ ID NO: 1305085 - RNA, 18 nt, Mycobacterium tuberculosis H37Rv
ggcuaccgccgaccggac

SEQ ID NO: 1305086 - RNA, 16 nt, Mycobacterium tuberculosis H37Rv
ggcuaggccagcacgg

SEQ ID NO: 1305087 - RNA, 15 nt, Mycobacterium tuberculosis H37Rv
ggcuaggcaccagcg

SEQ ID NO: 1305088 - RNA, 21 nt, Mycobacterium tuberculosis H37Rv
ggcuaggcaccagcggaucgc

SEQ ID NO: 1305089 - RNA, 19 nt, Mycobacterium tuberculosis H37Rv
ggcuaguugagcgcugcgc

SEQ ID NO: 1305090 - RNA, 22 nt, Mycobacterium tuberculosis H37Rv
ggcuaguugggugggugcagca

SEQ ID NO: 1305091 - RNA, 23 nt, Mycobacterium tuberculosis H37Rv
ggcguuguuaucgaagcccgagu

SEQ ID NO: 1305092 - RNA, 22 nt, Mycobacterium tuberculosis H37Rv
ggcguuugagaacaacgggauc

SEQ ID NO: 1305093 - RNA, 12 nt, Mycobacterium tuberculosis H37Rv
ggcguugccacc

SEQ ID NO: 1305094 - RNA, 17 nt, Mycobacterium tuberculosis H37Rv
ggcguuggcggcuucgc

SEQ ID NO: 1305095 - RNA, 15 nt, Mycobacterium tuberculosis H37Rv
ggcguugccgccguu

SEQ ID NO: 1305096 - RNA, 16 nt, Mycobacterium tuberculosis H37Rv
ggcguuacgggcgauc

SEQ ID NO: 1305097 - RNA, 20 nt, Mycobacterium tuberculosis H37Rv
ggcguucccacuggaggucg

SEQ ID NO: 1305098 - RNA, 21 nt, Mycobacterium tuberculosis H37Rv
ggcguucucgauugucgccgc

SEQ ID NO: 1305099 - RNA, 15 nt, Mycobacterium tuberculosis H37Rv
ggcguguucugaucg

SEQ ID NO: 1305100 - RNA, 18 nt, Mycobacterium tuberculosis H37Rv
ggcgugucgcgucgcagg

SEQ ID NO: 1305101 - RNA, 21 nt, Mycobacterium tuberculosis H37Rv
ggcguucaccacgaucgcgag

SEQ ID NO: 1305102 - RNA, 14 nt, Mycobacterium tuberculosis H37Rv
ggcguucagcggcc

SEQ ID NO: 1305103 - RNA, 16 nt, Mycobacterium tuberculosis H37Rv
ggcgugguaucgccgg

SEQ ID NO: 1305104 - RNA, 18 nt, Mycobacterium tuberculosis H37Rv
ggcguggucucggucagc

SEQ ID NO: 1305105 - RNA, 22 nt, Mycobacterium tuberculosis H37Rv
ggcguggugagccucggcgagc

SEQ ID NO: 1305106 - RNA, 17 nt, Mycobacterium tuberculosis H37Rv
ggcgugggugucggcua

SEQ ID NO: 1305107 - RNA, 15 nt, Mycobacterium tuberculosis H37Rv
ggcgugucgcgucgc

SEQ ID NO: 1305108 - RNA, 18 nt, Mycobacterium tuberculosis H37Rv
ggcgugucgccgccacca

SEQ ID NO: 1305109 - RNA, 13 nt, Mycobacterium tuberculosis H37Rv
ggcguguacgucg

SEQ ID NO: 1305110 - RNA, 13 nt, Mycobacterium tuberculosis H37Rv
ggcgugucgccgc

SEQ ID NO: 1305111 - RNA, 22 nt, Mycobacterium tuberculosis H37Rv
ggcucggugcgccagaucaccg

SEQ ID NO: 1305112 - RNA, 21 nt, Mycobacterium tuberculosis H37Rv
ggcucgggugcgcccggccaa

SEQ ID NO: 1305113 - RNA, 13 nt, Mycobacterium tuberculosis H37Rv
ggcucggccagcc

SEQ ID NO: 1305114 - RNA, 16 nt, Mycobacterium tuberculosis H37Rv
ggcucgcugcaacauc

SEQ ID NO: 1305115 - RNA, 12 nt, Mycobacterium tuberculosis H37Rv
ggcucgcugcaa

SEQ ID NO: 1305116 - RNA, 21 nt, Mycobacterium tuberculosis H37Rv
ggcucgcucgccgagcugugc

SEQ ID NO: 1305117 - RNA, 16 nt, Mycobacterium tuberculosis H37Rv
ggcucgcgaucgucac

SEQ ID NO: 1305118 - RNA, 22 nt, Mycobacterium tuberculosis H37Rv
ggcucgacgaugcggucaacgc

SEQ ID NO: 1305119 - RNA, 14 nt, Mycobacterium tuberculosis H37Rv
ggcucgacgaugcg

SEQ ID NO: 1305120 - RNA, 15 nt, Mycobacterium tuberculosis H37Rv
ggcucgacgcgucgc

SEQ ID NO: 1305121 - RNA, 16 nt, Mycobacterium tuberculosis H37Rv
ggcucgagcucggcga

SEQ ID NO: 1305122 - RNA, 18 nt, Mycobacterium tuberculosis H37Rv
ggcucgagcucggcgaug

SEQ ID NO: 1305123 - RNA, 17 nt, Mycobacterium tuberculosis H37Rv
ggcucgagucgcagcac

SEQ ID NO: 1305124 - RNA, 18 nt, Mycobacterium tuberculosis H37Rv
ggcucgcauucggcgagc

SEQ ID NO: 1305125 - RNA, 20 nt, Mycobacterium tuberculosis H37Rv
ggcucgcauguucuccacgc

SEQ ID NO: 1305126 - RNA, 22 nt, Mycobacterium tuberculosis H37Rv
ggcugaagacgaauaacgccgc

SEQ ID NO: 1305127 - RNA, 18 nt, Mycobacterium tuberculosis H37Rv
ggcugaaacauccccgag

SEQ ID NO: 1305128 - RNA, 22 nt, Mycobacterium tuberculosis H37Rv
ggcugacccauggucaccagcu

SEQ ID NO: 1305129 - RNA, 23 nt, Mycobacterium tuberculosis H37Rv
ggcugacaacgacaacacccacg

SEQ ID NO: 1305130 - RNA, 14 nt, Mycobacterium tuberculosis H37Rv
ggcugacaccgauc

SEQ ID NO: 1305131 - RNA, 15 nt, Mycobacterium tuberculosis H37Rv
ggcucuguagcgucg

SEQ ID NO: 1305132 - RNA, 19 nt, Mycobacterium tuberculosis H37Rv
ggcucuguagcgucgcacc

SEQ ID NO: 1305133 - RNA, 13 nt, Mycobacterium tuberculosis H37Rv
ggcucucggcguc

SEQ ID NO: 1305134 - RNA, 22 nt, Mycobacterium tuberculosis H37Rv
ggcucuacucgcggccggcguc

SEQ ID NO: 1305135 - RNA, 19 nt, Mycobacterium tuberculosis H37Rv
ggcucucagcgacagcugc

SEQ ID NO: 1305136 - RNA, 14 nt, Mycobacterium tuberculosis H37Rv
ggcucucacgagcg

SEQ ID NO: 1305137 - RNA, 22 nt, Mycobacterium tuberculosis H37Rv
ggcucgugcguguaccugucca

SEQ ID NO: 1305138 - RNA, 20 nt, Mycobacterium tuberculosis H37Rv
ggcucgucagguuccgcgac

SEQ ID NO: 1305139 - RNA, 21 nt, Mycobacterium tuberculosis H37Rv
ggcugcagugccgcacccaga

SEQ ID NO: 1305140 - RNA, 20 nt, Mycobacterium tuberculosis H37Rv
ggcugcauccuccucgucga

SEQ ID NO: 1305141 - RNA, 12 nt, Mycobacterium tuberculosis H37Rv
ggcugcaggugc

SEQ ID NO: 1305142 - RNA, 22 nt, Mycobacterium tuberculosis H37Rv
ggcugccauuccagaucaacgc

SEQ ID NO: 1305143 - RNA, 22 nt, Mycobacterium tuberculosis H37Rv
ggcugccaucccgaucccggcc

SEQ ID NO: 1305144 - RNA, 21 nt, Mycobacterium tuberculosis H37Rv
ggcugccaccagggccgcagu

SEQ ID NO: 1305145 - RNA, 14 nt, Mycobacterium tuberculosis H37Rv
ggcugccacgaacg

SEQ ID NO: 1305146 - RNA, 18 nt, Mycobacterium tuberculosis H37Rv
ggcugcccaucggugauc

SEQ ID NO: 1305147 - RNA, 20 nt, Mycobacterium tuberculosis H37Rv
ggcugcccaugguggcgauc

SEQ ID NO: 1305148 - RNA, 18 nt, Mycobacterium tuberculosis H37Rv
ggcugcccguucugccca

SEQ ID NO: 1305149 - RNA, 15 nt, Mycobacterium tuberculosis H37Rv
ggcugcccgagaucg

SEQ ID NO: 1305150 - RNA, 14 nt, Mycobacterium tuberculosis H37Rv
ggcugaggaacgcc

SEQ ID NO: 1305151 - RNA, 17 nt, Mycobacterium tuberculosis H37Rv
ggcugcaaccagcggca

SEQ ID NO: 1305152 - RNA, 13 nt, Mycobacterium tuberculosis H37Rv
ggcugauuggccc

SEQ ID NO: 1305153 - RNA, 22 nt, Mycobacterium tuberculosis H37Rv
ggcugauuggcccaccgccguu

SEQ ID NO: 1305154 - RNA, 15 nt, Mycobacterium tuberculosis H37Rv
ggcugaucccggcca

SEQ ID NO: 1305155 - RNA, 22 nt, Mycobacterium tuberculosis H37Rv
ggcugaucccggccaggccgac

SEQ ID NO: 1305156 - RNA, 13 nt, Mycobacterium tuberculosis H37Rv
ggcugaucgcccg

SEQ ID NO: 1305157 - RNA, 13 nt, Mycobacterium tuberculosis H37Rv
ggcugcucgacgg

SEQ ID NO: 1305158 - RNA, 17 nt, Mycobacterium tuberculosis H37Rv
ggcugcguucgccggaa

SEQ ID NO: 1305159 - RNA, 22 nt, Mycobacterium tuberculosis H37Rv
ggcugcgccggaaccccucgau

SEQ ID NO: 1305160 - RNA, 18 nt, Mycobacterium tuberculosis H37Rv
ggcugcggaggcggguug

SEQ ID NO: 1305161 - RNA, 22 nt, Mycobacterium tuberculosis H37Rv
ggcugcgcuuugcacagcggca

SEQ ID NO: 1305162 - RNA, 13 nt, Mycobacterium tuberculosis H37Rv
ggcugcgcgcucg

SEQ ID NO: 1305163 - RNA, 22 nt, Mycobacterium tuberculosis H37Rv
ggcugcgcgcucggccagcauc

SEQ ID NO: 1305164 - RNA, 22 nt, Mycobacterium tuberculosis H37Rv
ggcugcgaaagccacucgcgca

SEQ ID NO: 1305165 - RNA, 22 nt, Mycobacterium tuberculosis H37Rv
ggcugcgacaggacgucggcga

SEQ ID NO: 1305166 - RNA, 19 nt, Mycobacterium tuberculosis H37Rv
ggcugccaucccgaucccg

SEQ ID NO: 1305167 - RNA, 23 nt, Mycobacterium tuberculosis H37Rv
ggcugccgcggcugccaucccga

SEQ ID NO: 1305168 - RNA, 12 nt, Mycobacterium tuberculosis H37Rv
ggcugccggcaa

SEQ ID NO: 1305169 - RNA, 14 nt, Mycobacterium tuberculosis H37Rv
ggcugccgccguug

SEQ ID NO: 1305170 - RNA, 20 nt, Mycobacterium tuberculosis H37Rv
ggcugccgcaugcgcuccgg

SEQ ID NO: 1305171 - RNA, 23 nt, Mycobacterium tuberculosis H37Rv
ggcugccgcaaacgcggcgucga

SEQ ID NO: 1305172 - RNA, 22 nt, Mycobacterium tuberculosis H37Rv
ggcuucgacgucggcgaccagg

SEQ ID NO: 1305173 - RNA, 19 nt, Mycobacterium tuberculosis H37Rv
ggcuuccagggcggccauc

SEQ ID NO: 1305174 - RNA, 23 nt, Mycobacterium tuberculosis H37Rv
ggcuucgcuggcuugggccagcg

SEQ ID NO: 1305175 - RNA, 23 nt, Mycobacterium tuberculosis H37Rv
ggcuucggagaacacgucgacac

SEQ ID NO: 1305176 - RNA, 15 nt, Mycobacterium tuberculosis H37Rv
ggcuucggagccgac

SEQ ID NO: 1305177 - RNA, 11 nt, Mycobacterium tuberculosis H37Rv
ggcuucgccga

SEQ ID NO: 1305178 - RNA, 20 nt, Mycobacterium tuberculosis H37Rv
ggcuucggcgagcgcaucgg

SEQ ID NO: 1305179 - RNA, 17 nt, Mycobacterium tuberculosis H37Rv
ggcuugacugcacacca

SEQ ID NO: 1305180 - RNA, 19 nt, Mycobacterium tuberculosis H37Rv
ggcuucuugaccacgaacg

SEQ ID NO: 1305181 - RNA, 13 nt, Mycobacterium tuberculosis H37Rv
ggcuuggcgucga

SEQ ID NO: 1305182 - RNA, 14 nt, Mycobacterium tuberculosis H37Rv
ggcuuggaccagcg

SEQ ID NO: 1305183 - RNA, 17 nt, Mycobacterium tuberculosis H37Rv
ggcuugccugcgccgag

SEQ ID NO: 1305184 - RNA, 16 nt, Mycobacterium tuberculosis H37Rv
ggcuugcgcagcagcg

SEQ ID NO: 1305185 - RNA, 23 nt, Mycobacterium tuberculosis H37Rv
ggcuuucagcaccggaucgacca

SEQ ID NO: 1305186 - RNA, 13 nt, Mycobacterium tuberculosis H37Rv
ggcuugugcccaa

SEQ ID NO: 1305187 - RNA, 13 nt, Mycobacterium tuberculosis H37Rv
ggcuuggcgucgg

SEQ ID NO: 1305188 - RNA, 16 nt, Mycobacterium tuberculosis H37Rv
ggcuuggcgucggccg

SEQ ID NO: 1305189 - RNA, 19 nt, Mycobacterium tuberculosis H37Rv
ggcuugggaaacccggcca

SEQ ID NO: 1305190 - RNA, 15 nt, Mycobacterium tuberculosis H37Rv
ggcuugucauccccg

SEQ ID NO: 1305191 - RNA, 18 nt, Mycobacterium tuberculosis H37Rv
ggcuuuugcgucugcucg

SEQ ID NO: 1305192 - RNA, 20 nt, Mycobacterium tuberculosis H37Rv
ggcuuuugcgucugcucgcc

SEQ ID NO: 1305193 - RNA, 13 nt, Mycobacterium tuberculosis H37Rv
gggaacguccagc

SEQ ID NO: 1305194 - RNA, 18 nt, Mycobacterium tuberculosis H37Rv
ggcuggccgacucgaggu

SEQ ID NO: 1305195 - RNA, 22 nt, Mycobacterium tuberculosis H37Rv
ggcuggcgauggccguccgacc

SEQ ID NO: 1305196 - RNA, 21 nt, Mycobacterium tuberculosis H37Rv
ggcugggacgucuccaccgcg

SEQ ID NO: 1305197 - RNA, 15 nt, Mycobacterium tuberculosis H37Rv
ggcugggggauaccg

SEQ ID NO: 1305198 - RNA, 22 nt, Mycobacterium tuberculosis H37Rv
ggcugggucagguugucggcga

SEQ ID NO: 1305199 - RNA, 16 nt, Mycobacterium tuberculosis H37Rv
ggcuggcgucaccgcg

SEQ ID NO: 1305200 - RNA, 16 nt, Mycobacterium tuberculosis H37Rv
ggcuggccagcacgcc

SEQ ID NO: 1305201 - RNA, 18 nt, Mycobacterium tuberculosis H37Rv
ggcuguugacgccacgac

SEQ ID NO: 1305202 - RNA, 17 nt, Mycobacterium tuberculosis H37Rv
ggcuguugacgccacga

SEQ ID NO: 1305203 - RNA, 18 nt, Mycobacterium tuberculosis H37Rv
ggcugugcccgaucagcc

SEQ ID NO: 1305204 - RNA, 17 nt, Mycobacterium tuberculosis H37Rv
ggcugugccccagggca

SEQ ID NO: 1305205 - RNA, 13 nt, Mycobacterium tuberculosis H37Rv
ggcugugccggcc

SEQ ID NO: 1305206 - RNA, 23 nt, Mycobacterium tuberculosis H37Rv
ggcugugauguuguucagcaggc

SEQ ID NO: 1305207 - RNA, 23 nt, Mycobacterium tuberculosis H37Rv
ggcugucgugauacagcucggug

SEQ ID NO: 1305208 - RNA, 20 nt, Mycobacterium tuberculosis H37Rv
ggcugucugcccgcgcucgg

SEQ ID NO: 1305209 - RNA, 20 nt, Mycobacterium tuberculosis H37Rv
ggcuguccgaccucgccgcg

SEQ ID NO: 1305210 - RNA, 19 nt, Mycobacterium tuberculosis H37Rv
ggcuguccgaccucgccgc

SEQ ID NO: 1305211 - RNA, 19 nt, Mycobacterium tuberculosis H37Rv
ggcugucacgccugccacc

SEQ ID NO: 1305212 - RNA, 22 nt, Mycobacterium tuberculosis H37Rv
ggcuguaguccgcuacugcgac

SEQ ID NO: 1305213 - RNA, 21 nt, Mycobacterium tuberculosis H37Rv
ggcugucacaagccugccggc

SEQ ID NO: 1305214 - RNA, 15 nt, Mycobacterium tuberculosis H37Rv
ggcugucacgccugc

SEQ ID NO: 1305215 - RNA, 14 nt, Mycobacterium tuberculosis H37Rv
ggcuguaggcgauc

SEQ ID NO: 1305216 - RNA, 22 nt, Mycobacterium tuberculosis H37Rv
ggcuguaacacccggccgccga

SEQ ID NO: 1305217 - RNA, 15 nt, Mycobacterium tuberculosis H37Rv
ggcugguuacucacc

SEQ ID NO: 1305218 - RNA, 15 nt, Mycobacterium tuberculosis H37Rv
ggcugguguccagcc

SEQ ID NO: 1305219 - RNA, 22 nt, Mycobacterium tuberculosis H37Rv
ggcuggugucagcugauuaccg

SEQ ID NO: 1305220 - RNA, 23 nt, Mycobacterium tuberculosis H37Rv
ggcugguccgggugccggugcgc

SEQ ID NO: 1305221 - RNA, 18 nt, Mycobacterium tuberculosis H37Rv
gucucugucauugcugcc

SEQ ID NO: 1305222 - RNA, 16 nt, Mycobacterium tuberculosis H37Rv
gucucgucgccccguu

SEQ ID NO: 1305223 - RNA, 17 nt, Mycobacterium tuberculosis H37Rv
gucucgccgcgcaccga

SEQ ID NO: 1305224 - RNA, 17 nt, Mycobacterium tuberculosis H37Rv
gucugacagaccgggca

SEQ ID NO: 1305225 - RNA, 12 nt, Mycobacterium tuberculosis H37Rv
gucugccagcac

SEQ ID NO: 1305226 - RNA, 14 nt, Mycobacterium tuberculosis H37Rv
gucugcccaguguc

SEQ ID NO: 1305227 - RNA, 21 nt, Mycobacterium tuberculosis H37Rv
gucugcccaguguccggcgac

SEQ ID NO: 1305228 - RNA, 15 nt, Mycobacterium tuberculosis H37Rv
gucugcagacggucc

SEQ ID NO: 1305229 - RNA, 12 nt, Mycobacterium tuberculosis H37Rv
gucuccggcaag

SEQ ID NO: 1305230 - RNA, 19 nt, Mycobacterium tuberculosis H37Rv
gucuccggcaccgagucua

SEQ ID NO: 1305231 - RNA, 22 nt, Mycobacterium tuberculosis H37Rv
gucuccggcgccaccgccgcug

SEQ ID NO: 1305232 - RNA, 21 nt, Mycobacterium tuberculosis H37Rv
gucuccucgaauucgcgcucu

SEQ ID NO: 1305233 - RNA, 21 nt, Mycobacterium tuberculosis H37Rv
gucuccuucggcgacugcgca

SEQ ID NO: 1305234 - RNA, 20 nt, Mycobacterium tuberculosis H37Rv
gucuccaccgcgaugacgac

SEQ ID NO: 1305235 - RNA, 21 nt, Mycobacterium tuberculosis H37Rv
gucuacgacgucgcuguaggc

SEQ ID NO: 1305236 - RNA, 13 nt, Mycobacterium tuberculosis H37Rv
gucguugcgcggu

SEQ ID NO: 1305237 - RNA, 15 nt, Mycobacterium tuberculosis H37Rv
gucuggcgguaucga

SEQ ID NO: 1305238 - RNA, 17 nt, Mycobacterium tuberculosis H37Rv
gucuggcgaacagugac

SEQ ID NO: 1305239 - RNA, 22 nt, Mycobacterium tuberculosis H37Rv
gucugguggucggcgacgucgc

SEQ ID NO: 1305240 - RNA, 23 nt, Mycobacterium tuberculosis H37Rv
gucugguugucgaucucggccag

SEQ ID NO: 1305241 - RNA, 18 nt, Mycobacterium tuberculosis H37Rv
gucuguacaacgacacgc

SEQ ID NO: 1305242 - RNA, 15 nt, Mycobacterium tuberculosis H37Rv
gucuguuggugacag

SEQ ID NO: 1305243 - RNA, 22 nt, Mycobacterium tuberculosis H37Rv
gucugugcucacggcggcgaac

SEQ ID NO: 1305244 - RNA, 12 nt, Mycobacterium tuberculosis H37Rv
gucugcucgcca

SEQ ID NO: 1305245 - RNA, 15 nt, Mycobacterium tuberculosis H37Rv
gucugcugaccggag

SEQ ID NO: 1305246 - RNA, 16 nt, Mycobacterium tuberculosis H37Rv
gucugcgcggugcccg

SEQ ID NO: 1305247 - RNA, 15 nt, Mycobacterium tuberculosis H37Rv
gucugcgacuggauc

SEQ ID NO: 1305248 - RNA, 16 nt, Mycobacterium tuberculosis H37Rv
gucuuaucggcgucgu

SEQ ID NO: 1305249 - RNA, 23 nt, Mycobacterium tuberculosis H37Rv
gucuuccaggagcgccgucaucg

SEQ ID NO: 1305250 - RNA, 21 nt, Mycobacterium tuberculosis H37Rv
gucuucgguuaaggugcgauc

SEQ ID NO: 1305251 - RNA, 19 nt, Mycobacterium tuberculosis H37Rv
gucuucgggcucguccagc

SEQ ID NO: 1305252 - RNA, 14 nt, Mycobacterium tuberculosis H37Rv
gucuugcaucgccg

SEQ ID NO: 1305253 - RNA, 17 nt, Mycobacterium tuberculosis H37Rv
gucuuggacagcagcag

SEQ ID NO: 1305254 - RNA, 18 nt, Mycobacterium tuberculosis H37Rv
gugaccguauuucgucca

SEQ ID NO: 1305255 - RNA, 12 nt, Mycobacterium tuberculosis H37Rv
gugaccuucgcu

SEQ ID NO: 1305256 - RNA, 22 nt, Mycobacterium tuberculosis H37Rv
gugacgaagccgaccucacggc

SEQ ID NO: 1305257 - RNA, 12 nt, Mycobacterium tuberculosis H37Rv
gugaccucgucg

SEQ ID NO: 1305258 - RNA, 23 nt, Mycobacterium tuberculosis H37Rv
gugacgcgcgccggauacaccgg

SEQ ID NO: 1305259 - RNA, 24 nt, Mycobacterium tuberculosis H37Rv
gugacggaguuggcccgacgcagc

SEQ ID NO: 1305260 - RNA, 17 nt, Mycobacterium tuberculosis H37Rv
gugacgauucgagcaac

SEQ ID NO: 1305261 - RNA, 16 nt, Mycobacterium tuberculosis H37Rv
gugacgauugccacca

SEQ ID NO: 1305262 - RNA, 14 nt, Mycobacterium tuberculosis H37Rv
gugacgggacccgg

SEQ ID NO: 1305263 - RNA, 19 nt, Mycobacterium tuberculosis H37Rv
gugacguagggcagcgcca

SEQ ID NO: 1305264 - RNA, 17 nt, Mycobacterium tuberculosis H37Rv
gugacguuccgcucgcc

SEQ ID NO: 1305265 - RNA, 19 nt, Mycobacterium tuberculosis H37Rv
gugacuuauccggccagug

SEQ ID NO: 1305266 - RNA, 16 nt, Mycobacterium tuberculosis H37Rv
gugacguugucgccaa

SEQ ID NO: 1305267 - RNA, 18 nt, Mycobacterium tuberculosis H37Rv
gugacuuugacccguucc

SEQ ID NO: 1305268 - RNA, 20 nt, Mycobacterium tuberculosis H37Rv
gugacuucgguggcgggcuu

SEQ ID NO: 1305269 - RNA, 23 nt, Mycobacterium tuberculosis H37Rv
gugagauugguggcccgggccac

SEQ ID NO: 1305270 - RNA, 16 nt, Mycobacterium tuberculosis H37Rv
gugagcaccagcagca

SEQ ID NO: 1305271 - RNA, 20 nt, Mycobacterium tuberculosis H37Rv
gugagcgcgcucaggucauc

SEQ ID NO: 1305272 - RNA, 20 nt, Mycobacterium tuberculosis H37Rv
gugagcucggcugcucgacg

SEQ ID NO: 1305273 - RNA, 18 nt, Mycobacterium tuberculosis H37Rv
gugaggccgaccagcaca

SEQ ID NO: 1305274 - RNA, 19 nt, Mycobacterium tuberculosis H37Rv
gugagcaccagcagcacca

SEQ ID NO: 1305275 - RNA, 14 nt, Mycobacterium tuberculosis H37Rv
gugagcaugcgacg

SEQ ID NO: 1305276 - RNA, 14 nt, Mycobacterium tuberculosis H37Rv
gugagccacgcgca

SEQ ID NO: 1305277 - RNA, 18 nt, Mycobacterium tuberculosis H37Rv
gugagcgaucgggugcac

SEQ ID NO: 1305278 - RNA, 16 nt, Mycobacterium tuberculosis H37Rv
gugaccgagccgcgau

SEQ ID NO: 1305279 - RNA, 17 nt, Mycobacterium tuberculosis H37Rv
gugaccgacugcggguu

SEQ ID NO: 1305280 - RNA, 13 nt, Mycobacterium tuberculosis H37Rv
gugaccgccgaug

SEQ ID NO: 1305281 - RNA, 16 nt, Mycobacterium tuberculosis H37Rv
gugaccacugaaccgu

SEQ ID NO: 1305282 - RNA, 21 nt, Mycobacterium tuberculosis H37Rv
gugacccgcugggccgcaucg

SEQ ID NO: 1305283 - RNA, 23 nt, Mycobacterium tuberculosis H37Rv
gugacccgcuauucggcggcaug

SEQ ID NO: 1305284 - RNA, 20 nt, Mycobacterium tuberculosis H37Rv
gugaaucgcacgacgcgaca

SEQ ID NO: 1305285 - RNA, 19 nt, Mycobacterium tuberculosis H37Rv
gugaaguuguuggccagac

SEQ ID NO: 1305286 - RNA, 19 nt, Mycobacterium tuberculosis H37Rv
gugacagcccgcuggccgu

SEQ ID NO: 1305287 - RNA, 12 nt, Mycobacterium tuberculosis H37Rv
gugacaacgcga

SEQ ID NO: 1305288 - RNA, 17 nt, Mycobacterium tuberculosis H37Rv
gugaccaccccggccaa

SEQ ID NO: 1305289 - RNA, 12 nt, Mycobacterium tuberculosis H37Rv
gugacaucgcga

SEQ ID NO: 1305290 - RNA, 18 nt, Mycobacterium tuberculosis H37Rv
gugaaaugcgcgaucguc

SEQ ID NO: 1305291 - RNA, 23 nt, Mycobacterium tuberculosis H37Rv
gugaaccuuacgacgccguaucg

SEQ ID NO: 1305292 - RNA, 13 nt, Mycobacterium tuberculosis H37Rv
gugaacagcaggu

SEQ ID NO: 1305293 - RNA, 17 nt, Mycobacterium tuberculosis H37Rv
gugaacgcggacaccgc

SEQ ID NO: 1305294 - RNA, 18 nt, Mycobacterium tuberculosis H37Rv
gugaacggugucaacggc

SEQ ID NO: 1305295 - RNA, 19 nt, Mycobacterium tuberculosis H37Rv
gugaacgagaugccgcgau

SEQ ID NO: 1305296 - RNA, 14 nt, Mycobacterium tuberculosis H37Rv
gugaacggcagcac

SEQ ID NO: 1305297 - RNA, 18 nt, Mycobacterium tuberculosis H37Rv
gugaacucgugacagcgg

SEQ ID NO: 1305298 - RNA, 21 nt, Mycobacterium tuberculosis H37Rv
gugaagggcccacggugcgau

SEQ ID NO: 1305299 - RNA, 18 nt, Mycobacterium tuberculosis H37Rv
gucggucaaaccggugcc

SEQ ID NO: 1305300 - RNA, 15 nt, Mycobacterium tuberculosis H37Rv
gucggucaccauggc

SEQ ID NO: 1305301 - RNA, 14 nt, Mycobacterium tuberculosis H37Rv
gucggucaccaugg

SEQ ID NO: 1305302 - RNA, 15 nt, Mycobacterium tuberculosis H37Rv
gucggguuuggccga

SEQ ID NO: 1305303 - RNA, 18 nt, Mycobacterium tuberculosis H37Rv
gucggucacgacggcacg

SEQ ID NO: 1305304 - RNA, 18 nt, Mycobacterium tuberculosis H37Rv
gucgggugugcaggccgc

SEQ ID NO: 1305305 - RNA, 16 nt, Mycobacterium tuberculosis H37Rv
gucgggugugcgcaga

SEQ ID NO: 1305306 - RNA, 17 nt, Mycobacterium tuberculosis H37Rv
gucggguugcgacgaac

SEQ ID NO: 1305307 - RNA, 14 nt, Mycobacterium tuberculosis H37Rv
gucggguuggccgg

SEQ ID NO: 1305308 - RNA, 13 nt, Mycobacterium tuberculosis H37Rv
gucgggucgcacc

SEQ ID NO: 1305309 - RNA, 17 nt, Mycobacterium tuberculosis H37Rv
gucggguagugcccaca

SEQ ID NO: 1305310 - RNA, 18 nt, Mycobacterium tuberculosis H37Rv
gucggugaucacggucgg

SEQ ID NO: 1305311 - RNA, 22 nt, Mycobacterium tuberculosis H37Rv
gucggugaggaagcggccggug

SEQ ID NO: 1305312 - RNA, 17 nt, Mycobacterium tuberculosis H37Rv
gucggugaggucgaugc

SEQ ID NO: 1305313 - RNA, 21 nt, Mycobacterium tuberculosis H37Rv
gucggugaaaugacggcugaa

SEQ ID NO: 1305314 - RNA, 17 nt, Mycobacterium tuberculosis H37Rv
gucggugaccguucggc

SEQ ID NO: 1305315 - RNA, 18 nt, Mycobacterium tuberculosis H37Rv
gucggucgcuucagcgcc

SEQ ID NO: 1305316 - RNA, 22 nt, Mycobacterium tuberculosis H37Rv
gucggucggaucggcgccgcau

SEQ ID NO: 1305317 - RNA, 18 nt, Mycobacterium tuberculosis H37Rv
gucggucaucgguugacc

SEQ ID NO: 1305318 - RNA, 14 nt, Mycobacterium tuberculosis H37Rv
gucgggccaggcga

SEQ ID NO: 1305319 - RNA, 17 nt, Mycobacterium tuberculosis H37Rv
gucgggcccagccggac

SEQ ID NO: 1305320 - RNA, 20 nt, Mycobacterium tuberculosis H37Rv
gucgggcagauaugacggca

SEQ ID NO: 1305321 - RNA, 14 nt, Mycobacterium tuberculosis H37Rv
gucgggcaccgcgc

SEQ ID NO: 1305322 - RNA, 20 nt, Mycobacterium tuberculosis H37Rv
gucgggcacaccgacgccgc

SEQ ID NO: 1305323 - RNA, 17 nt, Mycobacterium tuberculosis H37Rv
gucgggcacaucgcacg

SEQ ID NO: 1305324 - RNA, 19 nt, Mycobacterium tuberculosis H37Rv
gucgggcuaauccagcagc

SEQ ID NO: 1305325 - RNA, 14 nt, Mycobacterium tuberculosis H37Rv
gucgggcggcgacc

SEQ ID NO: 1305326 - RNA, 16 nt, Mycobacterium tuberculosis H37Rv
gucgggccugccggag

SEQ ID NO: 1305327 - RNA, 22 nt, Mycobacterium tuberculosis H37Rv
gucgggcucgcauucggcgagc

SEQ ID NO: 1305328 - RNA, 17 nt, Mycobacterium tuberculosis H37Rv
gucggggagcugcggcg

SEQ ID NO: 1305329 - RNA, 19 nt, Mycobacterium tuberculosis H37Rv
gucgggcuggguggccaac

SEQ ID NO: 1305330 - RNA, 20 nt, Mycobacterium tuberculosis H37Rv
gucggggugggacaggucgg

SEQ ID NO: 1305331 - RNA, 15 nt, Mycobacterium tuberculosis H37Rv
gucgggggucgcacc

SEQ ID NO: 1305332 - RNA, 22 nt, Mycobacterium tuberculosis H37Rv
gucgggggcuuaugcgucugcu

SEQ ID NO: 1305333 - RNA, 22 nt, Mycobacterium tuberculosis H37Rv
gucggggccgucgucggucacc

SEQ ID NO: 1305334 - RNA, 16 nt, Mycobacterium tuberculosis H37Rv
gucggggccgucgucg

SEQ ID NO: 1305335 - RNA, 20 nt, Mycobacterium tuberculosis H37Rv
gucggggccgucgucgguca

SEQ ID NO: 1305336 - RNA, 14 nt, Mycobacterium tuberculosis H37Rv
gucggcggugaacg

SEQ ID NO: 1305337 - RNA, 16 nt, Mycobacterium tuberculosis H37Rv
gucggcuagcaacggg

SEQ ID NO: 1305338 - RNA, 16 nt, Mycobacterium tuberculosis H37Rv
gucggcuaccgccgac

SEQ ID NO: 1305339 - RNA, 16 nt, Mycobacterium tuberculosis H37Rv
gucggcgcgcaccucg

SEQ ID NO: 1305340 - RNA, 22 nt, Mycobacterium tuberculosis H37Rv
gucggcggccuucuccccgauc

SEQ ID NO: 1305341 - RNA, 16 nt, Mycobacterium tuberculosis H37Rv
gucggcggcgaacagc

SEQ ID NO: 1305342 - RNA, 19 nt, Mycobacterium tuberculosis H37Rv
gucggcgccucggaccaga

SEQ ID NO: 1305343 - RNA, 23 nt, Mycobacterium tuberculosis H37Rv
gucggcggcuuccucgagcgaac

SEQ ID NO: 1305344 - RNA, 14 nt, Mycobacterium tuberculosis H37Rv
gucggcggcuucgu

SEQ ID NO: 1305345 - RNA, 13 nt, Mycobacterium tuberculosis H37Rv
gucggcugucgug

SEQ ID NO: 1305346 - RNA, 22 nt, Mycobacterium tuberculosis H37Rv
gucgggaacuucuccgagaugc

SEQ ID NO: 1305347 - RNA, 17 nt, Mycobacterium tuberculosis H37Rv
gucgggcacaccgacgc

SEQ ID NO: 1305348 - RNA, 18 nt, Mycobacterium tuberculosis H37Rv
gucgggacgcugccgguc

SEQ ID NO: 1305349 - RNA, 15 nt, Mycobacterium tuberculosis H37Rv
gucgggacggccaac

SEQ ID NO: 1305350 - RNA, 22 nt, Mycobacterium tuberculosis H37Rv
gucggcgaaaggccagucgugc

SEQ ID NO: 1305351 - RNA, 22 nt, Mycobacterium tuberculosis H37Rv
gucggcgaaccacggcagccaa

SEQ ID NO: 1305352 - RNA, 19 nt, Mycobacterium tuberculosis H37Rv
gucggcgaacaaccgccgc

SEQ ID NO: 1305353 - RNA, 19 nt, Mycobacterium tuberculosis H37Rv
gucggcgaacgcguccagc

SEQ ID NO: 1305354 - RNA, 22 nt, Mycobacterium tuberculosis H37Rv
gucgcgggccaagccggagccc

SEQ ID NO: 1305355 - RNA, 15 nt, Mycobacterium tuberculosis H37Rv
gucggccuugggucg

SEQ ID NO: 1305356 - RNA, 13 nt, Mycobacterium tuberculosis H37Rv
gucgcggcguucg

SEQ ID NO: 1305357 - RNA, 14 nt, Mycobacterium tuberculosis H37Rv
gucggcgccggcau

SEQ ID NO: 1305358 - RNA, 13 nt, Mycobacterium tuberculosis H37Rv
gucggcgccgagc

SEQ ID NO: 1305359 - RNA, 13 nt, Mycobacterium tuberculosis H37Rv
gucggcgccgaag

SEQ ID NO: 1305360 - RNA, 18 nt, Mycobacterium tuberculosis H37Rv
gucggcgacgaaccgcca

SEQ ID NO: 1305361 - RNA, 13 nt, Mycobacterium tuberculosis H37Rv
gucggcgaccagg

SEQ ID NO: 1305362 - RNA, 16 nt, Mycobacterium tuberculosis H37Rv
gucggcgaauuccucg

SEQ ID NO: 1305363 - RNA, 16 nt, Mycobacterium tuberculosis H37Rv
gucggcgaccaccagc

SEQ ID NO: 1305364 - RNA, 17 nt, Mycobacterium tuberculosis H37Rv
gucgucggacucguccu

SEQ ID NO: 1305365 - RNA, 16 nt, Mycobacterium tuberculosis H37Rv
gucgucggcggcgaac

SEQ ID NO: 1305366 - RNA, 21 nt, Mycobacterium tuberculosis H37Rv
gucgucguguuggccgggucg

SEQ ID NO: 1305367 - RNA, 17 nt, Mycobacterium tuberculosis H37Rv
gucgucguuucgccagc

SEQ ID NO: 1305368 - RNA, 15 nt, Mycobacterium tuberculosis H37Rv
gucgucuuggcgauc

SEQ ID NO: 1305369 - RNA, 19 nt, Mycobacterium tuberculosis H37Rv
gucgucguagcuggcgauc

SEQ ID NO: 1305370 - RNA, 18 nt, Mycobacterium tuberculosis H37Rv
gucgucggugcgccacga

SEQ ID NO: 1305371 - RNA, 14 nt, Mycobacterium tuberculosis H37Rv
gucgucgugguagc

SEQ ID NO: 1305372 - RNA, 22 nt, Mycobacterium tuberculosis H37Rv
gucguucuccgcgccgccgaug

SEQ ID NO: 1305373 - RNA, 12 nt, Mycobacterium tuberculosis H37Rv
gucguggucgau

SEQ ID NO: 1305374 - RNA, 21 nt, Mycobacterium tuberculosis H37Rv
gucguugccggacaaccuggg

SEQ ID NO: 1305375 - RNA, 22 nt, Mycobacterium tuberculosis H37Rv
gucguugccagggcgggcgucg

SEQ ID NO: 1305376 - RNA, 13 nt, Mycobacterium tuberculosis H37Rv
gucguugccggac

SEQ ID NO: 1305377 - RNA, 19 nt, Mycobacterium tuberculosis H37Rv
gucguugccggacaaccug

SEQ ID NO: 1305378 - RNA, 14 nt, Mycobacterium tuberculosis H37Rv
gucguugcccgcga

SEQ ID NO: 1305379 - RNA, 21 nt, Mycobacterium tuberculosis H37Rv
gucgugccacuuccacggcgu

SEQ ID NO: 1305380 - RNA, 20 nt, Mycobacterium tuberculosis H37Rv
gucgugcgcggccggcacga

SEQ ID NO: 1305381 - RNA, 18 nt, Mycobacterium tuberculosis H37Rv
gucgugcggggguggucu

SEQ ID NO: 1305382 - RNA, 20 nt, Mycobacterium tuberculosis H37Rv
gucgugcgacaacacgaccu

SEQ ID NO: 1305383 - RNA, 18 nt, Mycobacterium tuberculosis H37Rv
gucguggcgcucggcgag

SEQ ID NO: 1305384 - RNA, 18 nt, Mycobacterium tuberculosis H37Rv
gucgugcucucggcgaau

SEQ ID NO: 1305385 - RNA, 17 nt, Mycobacterium tuberculosis H37Rv
gucgugcucucggcgaa

SEQ ID NO: 1305386 - RNA, 22 nt, Mycobacterium tuberculosis H37Rv
gucgguguuuggccgccgaauc

SEQ ID NO: 1305387 - RNA, 17 nt, Mycobacterium tuberculosis H37Rv
gucgguguuuggccgcc

SEQ ID NO: 1305388 - RNA, 16 nt, Mycobacterium tuberculosis H37Rv
gucggugucgguucgg

SEQ ID NO: 1305389 - RNA, 22 nt, Mycobacterium tuberculosis H37Rv
gucggugggugccagccggucg

SEQ ID NO: 1305390 - RNA, 18 nt, Mycobacterium tuberculosis H37Rv
gucggugcgcgcggcgac

SEQ ID NO: 1305391 - RNA, 10 nt, Mycobacterium tuberculosis H37Rv
gucggugcgg

SEQ ID NO: 1305392 - RNA, 20 nt, Mycobacterium tuberculosis H37Rv
gucggugcggaacacgaugc

SEQ ID NO: 1305393 - RNA, 22 nt, Mycobacterium tuberculosis H37Rv
gucgguucagccacgcagcacg

SEQ ID NO: 1305394 - RNA, 15 nt, Mycobacterium tuberculosis H37Rv
gucguaccggccuuc

SEQ ID NO: 1305395 - RNA, 18 nt, Mycobacterium tuberculosis H37Rv
gucguaccgcucggcggc

SEQ ID NO: 1305396 - RNA, 16 nt, Mycobacterium tuberculosis H37Rv
gucguacccggcaacg

SEQ ID NO: 1305397 - RNA, 18 nt, Mycobacterium tuberculosis H37Rv
gucguacccggcaacggg

SEQ ID NO: 1305398 - RNA, 17 nt, Mycobacterium tuberculosis H37Rv
gucguacaugggcagau

SEQ ID NO: 1305399 - RNA, 18 nt, Mycobacterium tuberculosis H37Rv
gucguaggacaccaccgu

SEQ ID NO: 1305400 - RNA, 23 nt, Mycobacterium tuberculosis H37Rv
gucguagccgaacccgccgucac

SEQ ID NO: 1305401 - RNA, 17 nt, Mycobacterium tuberculosis H37Rv
gucguagcgacgccauc

SEQ ID NO: 1305402 - RNA, 19 nt, Mycobacterium tuberculosis H37Rv
gucguagagauacgggaac

SEQ ID NO: 1305403 - RNA, 20 nt, Mycobacterium tuberculosis H37Rv
gucguccggaucggucggca

SEQ ID NO: 1305404 - RNA, 19 nt, Mycobacterium tuberculosis H37Rv
gucguccggaucggucggc

SEQ ID NO: 1305405 - RNA, 18 nt, Mycobacterium tuberculosis H37Rv
gucguccgcgccaguggc

SEQ ID NO: 1305406 - RNA, 21 nt, Mycobacterium tuberculosis H37Rv
gucguccgcgccaguggccac

SEQ ID NO: 1305407 - RNA, 17 nt, Mycobacterium tuberculosis H37Rv
gucguccgccgcagcgc

SEQ ID NO: 1305408 - RNA, 18 nt, Mycobacterium tuberculosis H37Rv
gucguccgccgcagcgca

SEQ ID NO: 1305409 - RNA, 22 nt, Mycobacterium tuberculosis H37Rv
gucgucgaaauggauugcggca

SEQ ID NO: 1305410 - RNA, 21 nt, Mycobacterium tuberculosis H37Rv
gucgucgcaaacuucgcgcac

SEQ ID NO: 1305411 - RNA, 13 nt, Mycobacterium tuberculosis H37Rv
gucgucgagguca

SEQ ID NO: 1305412 - RNA, 14 nt, Mycobacterium tuberculosis H37Rv
gucgucgaggucac

SEQ ID NO: 1305413 - RNA, 21 nt, Mycobacterium tuberculosis H37Rv
gucgucgagguccucgagguc

SEQ ID NO: 1305414 - RNA, 18 nt, Mycobacterium tuberculosis H37Rv
gucgucgagucgacaagc

SEQ ID NO: 1305415 - RNA, 16 nt, Mycobacterium tuberculosis H37Rv
gucgucgaccaccuga

SEQ ID NO: 1305416 - RNA, 14 nt, Mycobacterium tuberculosis H37Rv
gucgucgagcgcgc

SEQ ID NO: 1305417 - RNA, 17 nt, Mycobacterium tuberculosis H37Rv
gucgucaugccagucgc

SEQ ID NO: 1305418 - RNA, 20 nt, Mycobacterium tuberculosis H37Rv
gucgucaucgagcgggaucg

SEQ ID NO: 1305419 - RNA, 19 nt, Mycobacterium tuberculosis H37Rv
gucgucaucgagcgggauc

SEQ ID NO: 1305420 - RNA, 14 nt, Mycobacterium tuberculosis H37Rv
gucguaggcgauga

SEQ ID NO: 1305421 - RNA, 15 nt, Mycobacterium tuberculosis H37Rv
gucguagucgucggc

SEQ ID NO: 1305422 - RNA, 18 nt, Mycobacterium tuberculosis H37Rv
gucguagucgguagcuga

SEQ ID NO: 1305423 - RNA, 14 nt, Mycobacterium tuberculosis H37Rv
gucgccggucaucg

SEQ ID NO: 1305424 - RNA, 13 nt, Mycobacterium tuberculosis H37Rv
gucgccggugacg

SEQ ID NO: 1305425 - RNA, 18 nt, Mycobacterium tuberculosis H37Rv
gucgccggugacgacguc

SEQ ID NO: 1305426 - RNA, 16 nt, Mycobacterium tuberculosis H37Rv
gucgccgucggugccg

SEQ ID NO: 1305427 - RNA, 18 nt, Mycobacterium tuberculosis H37Rv
gucgccggcauacaccgu

SEQ ID NO: 1305428 - RNA, 22 nt, Mycobacterium tuberculosis H37Rv
gucgccggauagcgcagcucgc

SEQ ID NO: 1305429 - RNA, 20 nt, Mycobacterium tuberculosis H37Rv
gucgccggaugcugucagca

SEQ ID NO: 1305430 - RNA, 16 nt, Mycobacterium tuberculosis H37Rv
gucgccggauagcgca

SEQ ID NO: 1305431 - RNA, 13 nt, Mycobacterium tuberculosis H37Rv
gucgccggcgucg

SEQ ID NO: 1305432 - RNA, 16 nt, Mycobacterium tuberculosis H37Rv
gucgccgaccacucga

SEQ ID NO: 1305433 - RNA, 21 nt, Mycobacterium tuberculosis H37Rv
gucgccgaguaccggccagcc

SEQ ID NO: 1305434 - RNA, 16 nt, Mycobacterium tuberculosis H37Rv
gucgcgcugcugucga

SEQ ID NO: 1305435 - RNA, 21 nt, Mycobacterium tuberculosis H37Rv
gucgcgccaggcuugcggcac

SEQ ID NO: 1305436 - RNA, 17 nt, Mycobacterium tuberculosis H37Rv
gucgcgcgaccuggucg

SEQ ID NO: 1305437 - RNA, 21 nt, Mycobacterium tuberculosis H37Rv
gucgcgcgccuuggccagcgc

SEQ ID NO: 1305438 - RNA, 21 nt, Mycobacterium tuberculosis H37Rv
gucgccucaccggcgcgagca

SEQ ID NO: 1305439 - RNA, 13 nt, Mycobacterium tuberculosis H37Rv
gucgccuccagca

SEQ ID NO: 1305440 - RNA, 20 nt, Mycobacterium tuberculosis H37Rv
gucgccuccugccgccgcuc

SEQ ID NO: 1305441 - RNA, 20 nt, Mycobacterium tuberculosis H37Rv
gucgccugcccccgcgcgca

SEQ ID NO: 1305442 - RNA, 18 nt, Mycobacterium tuberculosis H37Rv
gucgccuucggguucggu

SEQ ID NO: 1305443 - RNA, 17 nt, Mycobacterium tuberculosis H37Rv
gucgcgccaggcgcgau

SEQ ID NO: 1305444 - RNA, 17 nt, Mycobacterium tuberculosis H37Rv
gucgccuucccagccga

SEQ ID NO: 1305445 - RNA, 19 nt, Mycobacterium tuberculosis H37Rv
gucgccuucguaaccacga

SEQ ID NO: 1305446 - RNA, 23 nt, Mycobacterium tuberculosis H37Rv
gucgcgcaucgccuccucgacgu

SEQ ID NO: 1305447 - RNA, 20 nt, Mycobacterium tuberculosis H37Rv
gucgccaccagagucaacau

SEQ ID NO: 1305448 - RNA, 23 nt, Mycobacterium tuberculosis H37Rv
gucgccaaucgaguagcugaccg

SEQ ID NO: 1305449 - RNA, 14 nt, Mycobacterium tuberculosis H37Rv
gucgccaccgccgg

SEQ ID NO: 1305450 - RNA, 14 nt, Mycobacterium tuberculosis H37Rv
gucgccaccgguac

SEQ ID NO: 1305451 - RNA, 16 nt, Mycobacterium tuberculosis H37Rv
gucgccaccgguaccg

SEQ ID NO: 1305452 - RNA, 22 nt, Mycobacterium tuberculosis H37Rv
gucgccaccgguaccgaucagc

SEQ ID NO: 1305453 - RNA, 17 nt, Mycobacterium tuberculosis H37Rv
gucgcagaccagacugc

SEQ ID NO: 1305454 - RNA, 20 nt, Mycobacterium tuberculosis H37Rv
gucgcagcagaccacaacgc

SEQ ID NO: 1305455 - RNA, 12 nt, Mycobacterium tuberculosis H37Rv
gucgcacggugc

SEQ ID NO: 1305456 - RNA, 13 nt, Mycobacterium tuberculosis H37Rv
gucgccagaccgc

SEQ ID NO: 1305457 - RNA, 20 nt, Mycobacterium tuberculosis H37Rv
gucgccagaccgcaccauug

SEQ ID NO: 1305458 - RNA, 21 nt, Mycobacterium tuberculosis H37Rv
gucgccacccgcgcuccaaca

SEQ ID NO: 1305459 - RNA, 16 nt, Mycobacterium tuberculosis H37Rv
gucgcccaaccgaacc

SEQ ID NO: 1305460 - RNA, 18 nt, Mycobacterium tuberculosis H37Rv
gucgccauuccaucgcgc

SEQ ID NO: 1305461 - RNA, 20 nt, Mycobacterium tuberculosis H37Rv
gucgcccagccacugacggc

SEQ ID NO: 1305462 - RNA, 14 nt, Mycobacterium tuberculosis H37Rv
gucgccccaagcgc

SEQ ID NO: 1305463 - RNA, 20 nt, Mycobacterium tuberculosis H37Rv
gucgcccagccgagcguggc

SEQ ID NO: 1305464 - RNA, 18 nt, Mycobacterium tuberculosis H37Rv
gucgaugucguuggccac

SEQ ID NO: 1305465 - RNA, 21 nt, Mycobacterium tuberculosis H37Rv
gucgaugugcgguacaucgac

SEQ ID NO: 1305466 - RNA, 15 nt, Mycobacterium tuberculosis H37Rv
gucgaugucgucgac

SEQ ID NO: 1305467 - RNA, 23 nt, Mycobacterium tuberculosis H37Rv
gucgauguccgcagcaccgucgg

SEQ ID NO: 1305468 - RNA, 18 nt, Mycobacterium tuberculosis H37Rv
gucgauggugcggcccaa

SEQ ID NO: 1305469 - RNA, 15 nt, Mycobacterium tuberculosis H37Rv
gucgauuucggcggc

SEQ ID NO: 1305470 - RNA, 15 nt, Mycobacterium tuberculosis H37Rv
gucgauuucggcgac

SEQ ID NO: 1305471 - RNA, 18 nt, Mycobacterium tuberculosis H37Rv
gucgauuucgccgucgcu

SEQ ID NO: 1305472 - RNA, 15 nt, Mycobacterium tuberculosis H37Rv
gucgauuucgccguc

SEQ ID NO: 1305473 - RNA, 15 nt, Mycobacterium tuberculosis H37Rv
gucgauuucgacgac

SEQ ID NO: 1305474 - RNA, 15 nt, Mycobacterium tuberculosis H37Rv
gucgauuucgaugac

SEQ ID NO: 1305475 - RNA, 23 nt, Mycobacterium tuberculosis H37Rv
gucgcacccaacuccaucagcgc

SEQ ID NO: 1305476 - RNA, 14 nt, Mycobacterium tuberculosis H37Rv
gucgaugcgcugcu

SEQ ID NO: 1305477 - RNA, 18 nt, Mycobacterium tuberculosis H37Rv
gucgaugccggugugcgc

SEQ ID NO: 1305478 - RNA, 18 nt, Mycobacterium tuberculosis H37Rv
gucgaugaggaucaucga

SEQ ID NO: 1305479 - RNA, 19 nt, Mycobacterium tuberculosis H37Rv
gucgaugaggaucaucgag

SEQ ID NO: 1305480 - RNA, 18 nt, Mycobacterium tuberculosis H37Rv
gucgaugagugacggucc

SEQ ID NO: 1305481 - RNA, 23 nt, Mycobacterium tuberculosis H37Rv
gucgagccgccagauugccugac

SEQ ID NO: 1305482 - RNA, 20 nt, Mycobacterium tuberculosis H37Rv
gucgagccacccaccgacau

SEQ ID NO: 1305483 - RNA, 20 nt, Mycobacterium tuberculosis H37Rv
gucgaucucgaucgacccgg

SEQ ID NO: 1305484 - RNA, 18 nt, Mycobacterium tuberculosis H37Rv
gucgaucguugccgcuga

SEQ ID NO: 1305485 - RNA, 13 nt, Mycobacterium tuberculosis H37Rv
gucgaucugcccc

SEQ ID NO: 1305486 - RNA, 21 nt, Mycobacterium tuberculosis H37Rv
gucgaucucggccagggucac

SEQ ID NO: 1305487 - RNA, 16 nt, Mycobacterium tuberculosis H37Rv
gucgauccggcgccau

SEQ ID NO: 1305488 - RNA, 14 nt, Mycobacterium tuberculosis H37Rv
gucgaggucacgcg

SEQ ID NO: 1305489 - RNA, 17 nt, Mycobacterium tuberculosis H37Rv
gucgagagguucgccgu

SEQ ID NO: 1305490 - RNA, 19 nt, Mycobacterium tuberculosis H37Rv
gucgacgcgguccucgagc

SEQ ID NO: 1305491 - RNA, 20 nt, Mycobacterium tuberculosis H37Rv
gucgagcacaccgaggucgc

SEQ ID NO: 1305492 - RNA, 17 nt, Mycobacterium tuberculosis H37Rv
gucgagauagccgacgu

SEQ ID NO: 1305493 - RNA, 18 nt, Mycobacterium tuberculosis H37Rv
gucgagagguucgccguc

SEQ ID NO: 1305494 - RNA, 21 nt, Mycobacterium tuberculosis H37Rv
gucgagaucucacgugcccgc

SEQ ID NO: 1305495 - RNA, 16 nt, Mycobacterium tuberculosis H37Rv
gucgagcacggugagc

SEQ ID NO: 1305496 - RNA, 14 nt, Mycobacterium tuberculosis H37Rv
gucgagcagcgcca

SEQ ID NO: 1305497 - RNA, 20 nt, Mycobacterium tuberculosis H37Rv
gucgacgcccauggcgucga

SEQ ID NO: 1305498 - RNA, 18 nt, Mycobacterium tuberculosis H37Rv
gucgacgauucccgcgga

SEQ ID NO: 1305499 - RNA, 19 nt, Mycobacterium tuberculosis H37Rv
gucgacgcccgauacgcca

SEQ ID NO: 1305500 - RNA, 13 nt, Mycobacterium tuberculosis H37Rv
gucgacgccgauc

SEQ ID NO: 1305501 - RNA, 16 nt, Mycobacterium tuberculosis H37Rv
gucgacgccggccagc

SEQ ID NO: 1305502 - RNA, 17 nt, Mycobacterium tuberculosis H37Rv
gucgacgagcaccgcgc

SEQ ID NO: 1305503 - RNA, 15 nt, Mycobacterium tuberculosis H37Rv
gucgacgaucagcga

SEQ ID NO: 1305504 - RNA, 23 nt, Mycobacterium tuberculosis H37Rv
gucgacgaugucggcaccauagc

SEQ ID NO: 1305505 - RNA, 20 nt, Mycobacterium tuberculosis H37Rv
gucgacgcagugcccgaucg

SEQ ID NO: 1305506 - RNA, 16 nt, Mycobacterium tuberculosis H37Rv
guccggguagcggcgc

SEQ ID NO: 1305507 - RNA, 20 nt, Mycobacterium tuberculosis H37Rv
guccggggaccucggcgauc

SEQ ID NO: 1305508 - RNA, 17 nt, Mycobacterium tuberculosis H37Rv
guccuuggacaggucga

SEQ ID NO: 1305509 - RNA, 13 nt, Mycobacterium tuberculosis H37Rv
guccuugcggucc

SEQ ID NO: 1305510 - RNA, 20 nt, Mycobacterium tuberculosis H37Rv
guccuugaugcgccccauga

SEQ ID NO: 1305511 - RNA, 18 nt, Mycobacterium tuberculosis H37Rv
gucgaaacccacguacgc

SEQ ID NO: 1305512 - RNA, 21 nt, Mycobacterium tuberculosis H37Rv
gucgaaauggauugcggcacg

SEQ ID NO: 1305513 - RNA, 14 nt, Mycobacterium tuberculosis H37Rv
gucgaacacgucgg

SEQ ID NO: 1305514 - RNA, 16 nt, Mycobacterium tuberculosis H37Rv
gucgaacaccguccaa

SEQ ID NO: 1305515 - RNA, 20 nt, Mycobacterium tuberculosis H37Rv
gucgaacucgccccgcgugu

SEQ ID NO: 1305516 - RNA, 13 nt, Mycobacterium tuberculosis H37Rv
gucgaaccaggua

SEQ ID NO: 1305517 - RNA, 16 nt, Mycobacterium tuberculosis H37Rv
gucgaacgcguugacc

SEQ ID NO: 1305518 - RNA, 19 nt, Mycobacterium tuberculosis H37Rv
gucgaacauggcacgcggg

SEQ ID NO: 1305519 - RNA, 14 nt, Mycobacterium tuberculosis H37Rv
gucgaacaucaccg

SEQ ID NO: 1305520 - RNA, 17 nt, Mycobacterium tuberculosis H37Rv
gucgaaccuaccgugua

SEQ ID NO: 1305521 - RNA, 21 nt, Mycobacterium tuberculosis H37Rv
gucgaacgcaugcucgaucgc

SEQ ID NO: 1305522 - RNA, 22 nt, Mycobacterium tuberculosis H37Rv
gucgaacaggccggccgcgauc

SEQ ID NO: 1305523 - RNA, 19 nt, Mycobacterium tuberculosis H37Rv
gucgaacaggaucagcgac

SEQ ID NO: 1305524 - RNA, 14 nt, Mycobacterium tuberculosis H37Rv
gucgacccaccaug

SEQ ID NO: 1305525 - RNA, 18 nt, Mycobacterium tuberculosis H37Rv
gucgacccaacgcagauc

SEQ ID NO: 1305526 - RNA, 12 nt, Mycobacterium tuberculosis H37Rv
gucgaccaggcc

SEQ ID NO: 1305527 - RNA, 21 nt, Mycobacterium tuberculosis H37Rv
gucgaccaggccacugccgac

SEQ ID NO: 1305528 - RNA, 19 nt, Mycobacterium tuberculosis H37Rv
gucgaccccugaaucaccg

SEQ ID NO: 1305529 - RNA, 16 nt, Mycobacterium tuberculosis H37Rv
gucgacgacaacgaug

SEQ ID NO: 1305530 - RNA, 14 nt, Mycobacterium tuberculosis H37Rv
gucgacgacgucgc

SEQ ID NO: 1305531 - RNA, 18 nt, Mycobacterium tuberculosis H37Rv
gucagcugggacccgagc

SEQ ID NO: 1305532 - RNA, 12 nt, Mycobacterium tuberculosis H37Rv
gucaggaaaccg

SEQ ID NO: 1305533 - RNA, 22 nt, Mycobacterium tuberculosis H37Rv
gucaggaacaaguagccgucgu

SEQ ID NO: 1305534 - RNA, 15 nt, Mycobacterium tuberculosis H37Rv
gucagcucgaucacg

SEQ ID NO: 1305535 - RNA, 19 nt, Mycobacterium tuberculosis H37Rv
guaucgcagcaucugcggg

SEQ ID NO: 1305536 - RNA, 19 nt, Mycobacterium tuberculosis H37Rv
gucagguggccaaugccuu

SEQ ID NO: 1305537 - RNA, 17 nt, Mycobacterium tuberculosis H37Rv
gucagguugucggcgau

SEQ ID NO: 1305538 - RNA, 17 nt, Mycobacterium tuberculosis H37Rv
gucaucgggcagcggca

SEQ ID NO: 1305539 - RNA, 23 nt, Mycobacterium tuberculosis H37Rv
gucaguugugcguugcgcugcgc

SEQ ID NO: 1305540 - RNA, 23 nt, Mycobacterium tuberculosis H37Rv
gucauaagacggauuguccggga

SEQ ID NO: 1305541 - RNA, 17 nt, Mycobacterium tuberculosis H37Rv
gucaucuggcgcgccac

SEQ ID NO: 1305542 - RNA, 17 nt, Mycobacterium tuberculosis H37Rv
gucaugaaaucgaugac

SEQ ID NO: 1305543 - RNA, 11 nt, Mycobacterium tuberculosis H37Rv
gucauggccga

SEQ ID NO: 1305544 - RNA, 21 nt, Mycobacterium tuberculosis H37Rv
gucauggcuuuggccgcuucg

SEQ ID NO: 1305545 - RNA, 16 nt, Mycobacterium tuberculosis H37Rv
gucaugggaucaggcu

SEQ ID NO: 1305546 - RNA, 14 nt, Mycobacterium tuberculosis H37Rv
guccacugccaccg

SEQ ID NO: 1305547 - RNA, 18 nt, Mycobacterium tuberculosis H37Rv
guccacugaucaggccga

SEQ ID NO: 1305548 - RNA, 17 nt, Mycobacterium tuberculosis H37Rv
guccagacccagcucgu

SEQ ID NO: 1305549 - RNA, 17 nt, Mycobacterium tuberculosis H37Rv
guccacugucagcgauc

SEQ ID NO: 1305550 - RNA, 23 nt, Mycobacterium tuberculosis H37Rv
guccagauagugcuccacguccg

SEQ ID NO: 1305551 - RNA, 19 nt, Mycobacterium tuberculosis H37Rv
guccagcacggccacguca

SEQ ID NO: 1305552 - RNA, 20 nt, Mycobacterium tuberculosis H37Rv
guccagcaaaugcggcgcgu

SEQ ID NO: 1305553 - RNA, 17 nt, Mycobacterium tuberculosis H37Rv
guccaccacgacgucgg

SEQ ID NO: 1305554 - RNA, 14 nt, Mycobacterium tuberculosis H37Rv
guccacccacgauc

SEQ ID NO: 1305555 - RNA, 18 nt, Mycobacterium tuberculosis H37Rv
guccaccgcgaugcccca

SEQ ID NO: 1305556 - RNA, 20 nt, Mycobacterium tuberculosis H37Rv
guccacaugguacggacgcu

SEQ ID NO: 1305557 - RNA, 16 nt, Mycobacterium tuberculosis H37Rv
guccacaacgucguga

SEQ ID NO: 1305558 - RNA, 18 nt, Mycobacterium tuberculosis H37Rv
guccaacucggcccgggu

SEQ ID NO: 1305559 - RNA, 22 nt, Mycobacterium tuberculosis H37Rv
guccaauuccagcucacgaugu

SEQ ID NO: 1305560 - RNA, 18 nt, Mycobacterium tuberculosis H37Rv
guccaaucuucucgagcc

SEQ ID NO: 1305561 - RNA, 17 nt, Mycobacterium tuberculosis H37Rv
guccaagaaccacgacg

SEQ ID NO: 1305562 - RNA, 17 nt, Mycobacterium tuberculosis H37Rv
guccaauuccgcagaga

SEQ ID NO: 1305563 - RNA, 16 nt, Mycobacterium tuberculosis H37Rv
guccaauuggcgucgu

SEQ ID NO: 1305564 - RNA, 16 nt, Mycobacterium tuberculosis H37Rv
guccaauugucaagcc

SEQ ID NO: 1305565 - RNA, 16 nt, Mycobacterium tuberculosis H37Rv
gucauuauucgcgcaa

SEQ ID NO: 1305566 - RNA, 13 nt, Mycobacterium tuberculosis H37Rv
gucauugcccuug

SEQ ID NO: 1305567 - RNA, 18 nt, Mycobacterium tuberculosis H37Rv
gucccaccagguacgcga

SEQ ID NO: 1305568 - RNA, 20 nt, Mycobacterium tuberculosis H37Rv
gucccaccagguacgcgauc

SEQ ID NO: 1305569 - RNA, 21 nt, Mycobacterium tuberculosis H37Rv
gucccaccagguacgcgauca

SEQ ID NO: 1305570 - RNA, 15 nt, Mycobacterium tuberculosis H37Rv
gucccaaggcguugg

SEQ ID NO: 1305571 - RNA, 15 nt, Mycobacterium tuberculosis H37Rv
gucccaacacggcga

SEQ ID NO: 1305572 - RNA, 19 nt, Mycobacterium tuberculosis H37Rv
guccccaggugggcagcag

SEQ ID NO: 1305573 - RNA, 15 nt, Mycobacterium tuberculosis H37Rv
guccccaugcagcgc

SEQ ID NO: 1305574 - RNA, 18 nt, Mycobacterium tuberculosis H37Rv
guccccgaaccgagcgga

SEQ ID NO: 1305575 - RNA, 17 nt, Mycobacterium tuberculosis H37Rv
guccccaggugggcagc

SEQ ID NO: 1305576 - RNA, 15 nt, Mycobacterium tuberculosis H37Rv
guccaggcgcugcag

SEQ ID NO: 1305577 - RNA, 16 nt, Mycobacterium tuberculosis H37Rv
guccagguggcgcgga

SEQ ID NO: 1305578 - RNA, 13 nt, Mycobacterium tuberculosis H37Rv
guccaggugaccg

SEQ ID NO: 1305579 - RNA, 20 nt, Mycobacterium tuberculosis H37Rv
guccaggguggucgucgucu

SEQ ID NO: 1305580 - RNA, 15 nt, Mycobacterium tuberculosis H37Rv
guccagccaggcgau

SEQ ID NO: 1305581 - RNA, 16 nt, Mycobacterium tuberculosis H37Rv
guccagccaccgccgc

SEQ ID NO: 1305582 - RNA, 15 nt, Mycobacterium tuberculosis H37Rv
guccagccaacggga

SEQ ID NO: 1305583 - RNA, 22 nt, Mycobacterium tuberculosis H37Rv
guccagcagcucggccgaggcg

SEQ ID NO: 1305584 - RNA, 14 nt, Mycobacterium tuberculosis H37Rv
guccagcagcucgg

SEQ ID NO: 1305585 - RNA, 12 nt, Mycobacterium tuberculosis H37Rv
guccagcagugc

SEQ ID NO: 1305586 - RNA, 15 nt, Mycobacterium tuberculosis H37Rv
guccagcagcgacgc

SEQ ID NO: 1305587 - RNA, 11 nt, Mycobacterium tuberculosis H37Rv
guccagcagcu

SEQ ID NO: 1305588 - RNA, 16 nt, Mycobacterium tuberculosis H37Rv
guccaggacggucgcc

SEQ ID NO: 1305589 - RNA, 20 nt, Mycobacterium tuberculosis H37Rv
guccagcgggcauaacccgc

SEQ ID NO: 1305590 - RNA, 22 nt, Mycobacterium tuberculosis H37Rv
guccgcgcucagcuccggcgac

SEQ ID NO: 1305591 - RNA, 17 nt, Mycobacterium tuberculosis H37Rv
guccgcgcgcaagucga

SEQ ID NO: 1305592 - RNA, 20 nt, Mycobacterium tuberculosis H37Rv
guccggcguacucggugauc

SEQ ID NO: 1305593 - RNA, 13 nt, Mycobacterium tuberculosis H37Rv
guccggccggucc

SEQ ID NO: 1305594 - RNA, 20 nt, Mycobacterium tuberculosis H37Rv
guccgcauccgcgacggcgc

SEQ ID NO: 1305595 - RNA, 17 nt, Mycobacterium tuberculosis H37Rv
guccgccaccgcgagca

SEQ ID NO: 1305596 - RNA, 17 nt, Mycobacterium tuberculosis H37Rv
guccgcagcaccgucgg

SEQ ID NO: 1305597 - RNA, 13 nt, Mycobacterium tuberculosis H37Rv
guccgcagcgucc

SEQ ID NO: 1305598 - RNA, 16 nt, Mycobacterium tuberculosis H37Rv
guccgcagcaccgucg

SEQ ID NO: 1305599 - RNA, 20 nt, Mycobacterium tuberculosis H37Rv
guccgcgaucugcagcgcgg

SEQ ID NO: 1305600 - RNA, 17 nt, Mycobacterium tuberculosis H37Rv
guccgcgauggccgcgu

SEQ ID NO: 1305601 - RNA, 22 nt, Mycobacterium tuberculosis H37Rv
guccgccauuggcgccgucacc

SEQ ID NO: 1305602 - RNA, 13 nt, Mycobacterium tuberculosis H37Rv
guccgcacaacga

SEQ ID NO: 1305603 - RNA, 17 nt, Mycobacterium tuberculosis H37Rv
guccgaugcgugccgac

SEQ ID NO: 1305604 - RNA, 20 nt, Mycobacterium tuberculosis H37Rv
guccgaucggcgcgccgauc

SEQ ID NO: 1305605 - RNA, 19 nt, Mycobacterium tuberculosis H37Rv
guccgaucggcgcgccgau

SEQ ID NO: 1305606 - RNA, 12 nt, Mycobacterium tuberculosis H37Rv
guccgacgggcc

SEQ ID NO: 1305607 - RNA, 13 nt, Mycobacterium tuberculosis H37Rv
guccgacgcgugu

SEQ ID NO: 1305608 - RNA, 15 nt, Mycobacterium tuberculosis H37Rv
gucccugcgccguca

SEQ ID NO: 1305609 - RNA, 16 nt, Mycobacterium tuberculosis H37Rv
guccccgccgucgcca

SEQ ID NO: 1305610 - RNA, 15 nt, Mycobacterium tuberculosis H37Rv
guccccgcagcucga

SEQ ID NO: 1305611 - RNA, 21 nt, Mycobacterium tuberculosis H37Rv
guccccgcccggccagcucgg

SEQ ID NO: 1305612 - RNA, 19 nt, Mycobacterium tuberculosis H37Rv
gucccgucgaugugcggua

SEQ ID NO: 1305613 - RNA, 21 nt, Mycobacterium tuberculosis H37Rv
guccccccagauccgcagcgu

SEQ ID NO: 1305614 - RNA, 21 nt, Mycobacterium tuberculosis H37Rv
gucccgugcgcgcgcagcuga

SEQ ID NO: 1305615 - RNA, 20 nt, Mycobacterium tuberculosis H37Rv
gucccugcgccgucaacacc

SEQ ID NO: 1305616 - RNA, 14 nt, Mycobacterium tuberculosis H37Rv
ggugaccguucggc

SEQ ID NO: 1305617 - RNA, 20 nt, Mycobacterium tuberculosis H37Rv
ggugaccgugaacggcucgg

SEQ ID NO: 1305618 - RNA, 18 nt, Mycobacterium tuberculosis H37Rv
ggugaacgcggacaccgc

SEQ ID NO: 1305619 - RNA, 21 nt, Mycobacterium tuberculosis H37Rv
ggugaaccgcgcggcgaucga

SEQ ID NO: 1305620 - RNA, 20 nt, Mycobacterium tuberculosis H37Rv
ggugaaccgggacagcagcc

SEQ ID NO: 1305621 - RNA, 23 nt, Mycobacterium tuberculosis H37Rv
ggugaacgacaugggcaggccgc

SEQ ID NO: 1305622 - RNA, 15 nt, Mycobacterium tuberculosis H37Rv
ggucucgaccuucgg

SEQ ID NO: 1305623 - RNA, 19 nt, Mycobacterium tuberculosis H37Rv
ggucgugcaggcgacggcu

SEQ ID NO: 1305624 - RNA, 13 nt, Mycobacterium tuberculosis H37Rv
ggucgucggcguc

SEQ ID NO: 1305625 - RNA, 17 nt, Mycobacterium tuberculosis H37Rv
ggucugacaucggccaa

SEQ ID NO: 1305626 - RNA, 17 nt, Mycobacterium tuberculosis H37Rv
ggucucggugccgagca

SEQ ID NO: 1305627 - RNA, 16 nt, Mycobacterium tuberculosis H37Rv
ggugagcugcgccaga

SEQ ID NO: 1305628 - RNA, 20 nt, Mycobacterium tuberculosis H37Rv
ggugacugcgggccgcucgg

SEQ ID NO: 1305629 - RNA, 20 nt, Mycobacterium tuberculosis H37Rv
ggugaggaucauggcgucga

SEQ ID NO: 1305630 - RNA, 17 nt, Mycobacterium tuberculosis H37Rv
ggugaggugaccaacgg

SEQ ID NO: 1305631 - RNA, 17 nt, Mycobacterium tuberculosis H37Rv
ggugaucuugccggcca

SEQ ID NO: 1305632 - RNA, 23 nt, Mycobacterium tuberculosis H37Rv
ggugagguugacccccggguaga

SEQ ID NO: 1305633 - RNA, 21 nt, Mycobacterium tuberculosis H37Rv
ggugaguagauugcugacgag

SEQ ID NO: 1305634 - RNA, 21 nt, Mycobacterium tuberculosis H37Rv
ggugacgggaucgucggcaac

SEQ ID NO: 1305635 - RNA, 18 nt, Mycobacterium tuberculosis H37Rv
ggugacgguggccggcaa

SEQ ID NO: 1305636 - RNA, 18 nt, Mycobacterium tuberculosis H37Rv
ggugacgccgccagcacc

SEQ ID NO: 1305637 - RNA, 21 nt, Mycobacterium tuberculosis H37Rv
ggugaccucgucgaccgggaa

SEQ ID NO: 1305638 - RNA, 16 nt, Mycobacterium tuberculosis H37Rv
ggugaccuugaugcca

SEQ ID NO: 1305639 - RNA, 12 nt, Mycobacterium tuberculosis H37Rv
ggugaccggguu

SEQ ID NO: 1305640 - RNA, 14 nt, Mycobacterium tuberculosis H37Rv
ggugaccucgucga

SEQ ID NO: 1305641 - RNA, 13 nt, Mycobacterium tuberculosis H37Rv
ggugacgaucagg

SEQ ID NO: 1305642 - RNA, 23 nt, Mycobacterium tuberculosis H37Rv
ggugacgagcacaugcucgacgc

SEQ ID NO: 1305643 - RNA, 17 nt, Mycobacterium tuberculosis H37Rv
ggugacgacgucgccgc

SEQ ID NO: 1305644 - RNA, 17 nt, Mycobacterium tuberculosis H37Rv
ggugacgaucgacagcc

SEQ ID NO: 1305645 - RNA, 17 nt, Mycobacterium tuberculosis H37Rv
ggugacgauugccacca

SEQ ID NO: 1305646 - RNA, 13 nt, Mycobacterium tuberculosis H37Rv
ggucggcugucac

SEQ ID NO: 1305647 - RNA, 22 nt, Mycobacterium tuberculosis H37Rv
ggucggcuacggccagugccau

SEQ ID NO: 1305648 - RNA, 22 nt, Mycobacterium tuberculosis H37Rv
ggucggcgugcccgccggcgag

SEQ ID NO: 1305649 - RNA, 13 nt, Mycobacterium tuberculosis H37Rv
ggucggcgguagc

SEQ ID NO: 1305650 - RNA, 14 nt, Mycobacterium tuberculosis H37Rv
ggucggcgcgccgu

SEQ ID NO: 1305651 - RNA, 14 nt, Mycobacterium tuberculosis H37Rv
ggucggcgauggcg

SEQ ID NO: 1305652 - RNA, 20 nt, Mycobacterium tuberculosis H37Rv
ggucgguggucucgacggcg

SEQ ID NO: 1305653 - RNA, 22 nt, Mycobacterium tuberculosis H37Rv
ggucggugggcuugccgcgcac

SEQ ID NO: 1305654 - RNA, 23 nt, Mycobacterium tuberculosis H37Rv
ggucggugacgaagagcaccgcg

SEQ ID NO: 1305655 - RNA, 15 nt, Mycobacterium tuberculosis H37Rv
ggucggugacgaaga

SEQ ID NO: 1305656 - RNA, 23 nt, Mycobacterium tuberculosis H37Rv
ggucgucauccuggucaccagcc

SEQ ID NO: 1305657 - RNA, 16 nt, Mycobacterium tuberculosis H37Rv
ggucguccgccugcac

SEQ ID NO: 1305658 - RNA, 22 nt, Mycobacterium tuberculosis H37Rv
ggucguaggcgcuaggaacgcc

SEQ ID NO: 1305659 - RNA, 13 nt, Mycobacterium tuberculosis H37Rv
ggucgucgcgauc

SEQ ID NO: 1305660 - RNA, 17 nt, Mycobacterium tuberculosis H37Rv
ggucggaaugccgucgc

SEQ ID NO: 1305661 - RNA, 15 nt, Mycobacterium tuberculosis H37Rv
ggucggacagcgucu

SEQ ID NO: 1305662 - RNA, 18 nt, Mycobacterium tuberculosis H37Rv
ggucggagagguagagca

SEQ ID NO: 1305663 - RNA, 12 nt, Mycobacterium tuberculosis H37Rv
ggucgcugucca

SEQ ID NO: 1305664 - RNA, 13 nt, Mycobacterium tuberculosis H37Rv
ggucggaucggcg

SEQ ID NO: 1305665 - RNA, 16 nt, Mycobacterium tuberculosis H37Rv
ggucggcaccaccacg

SEQ ID NO: 1305666 - RNA, 14 nt, Mycobacterium tuberculosis H37Rv
ggucggaucggcgc

SEQ ID NO: 1305667 - RNA, 22 nt, Mycobacterium tuberculosis H37Rv
ggucggcaaugucuucgauacc

SEQ ID NO: 1305668 - RNA, 19 nt, Mycobacterium tuberculosis H37Rv
ggucggcacgacccgggaa

SEQ ID NO: 1305669 - RNA, 16 nt, Mycobacterium tuberculosis H37Rv
ggucggcacgacccgg

SEQ ID NO: 1305670 - RNA, 13 nt, Mycobacterium tuberculosis H37Rv
ggucgcugcgaug

SEQ ID NO: 1305671 - RNA, 20 nt, Mycobacterium tuberculosis H37Rv
ggucgcugcugcgaucgccg

SEQ ID NO: 1305672 - RNA, 16 nt, Mycobacterium tuberculosis H37Rv
ggucgcugcugcgauc

SEQ ID NO: 1305673 - RNA, 16 nt, Mycobacterium tuberculosis H37Rv
ggucgcugcugccgca

SEQ ID NO: 1305674 - RNA, 13 nt, Mycobacterium tuberculosis H37Rv
ggucgcucgacga

SEQ ID NO: 1305675 - RNA, 14 nt, Mycobacterium tuberculosis H37Rv
ggucgcucgacgac

SEQ ID NO: 1305676 - RNA, 17 nt, Mycobacterium tuberculosis H37Rv
ggucgcguccacccacg

SEQ ID NO: 1305677 - RNA, 20 nt, Mycobacterium tuberculosis H37Rv
gguccgcacgaucugcaggc

SEQ ID NO: 1305678 - RNA, 21 nt, Mycobacterium tuberculosis H37Rv
ggucccacaccuccucgagca

SEQ ID NO: 1305679 - RNA, 13 nt, Mycobacterium tuberculosis H37Rv
ggucccacggccg

SEQ ID NO: 1305680 - RNA, 15 nt, Mycobacterium tuberculosis H37Rv
gguccaucgcgcugc

SEQ ID NO: 1305681 - RNA, 22 nt, Mycobacterium tuberculosis H37Rv
gguccaggcguuggaucccagc

SEQ ID NO: 1305682 - RNA, 18 nt, Mycobacterium tuberculosis H37Rv
gguccagccaacgggaac

SEQ ID NO: 1305683 - RNA, 18 nt, Mycobacterium tuberculosis H37Rv
gguccaaccccagcgaca

SEQ ID NO: 1305684 - RNA, 19 nt, Mycobacterium tuberculosis H37Rv
ggucaucggccgucucggc

SEQ ID NO: 1305685 - RNA, 20 nt, Mycobacterium tuberculosis H37Rv
ggucaucgccagcggcaauc

SEQ ID NO: 1305686 - RNA, 15 nt, Mycobacterium tuberculosis H37Rv
ggucagguccugggu

SEQ ID NO: 1305687 - RNA, 15 nt, Mycobacterium tuberculosis H37Rv
gguaguugcucggcu

SEQ ID NO: 1305688 - RNA, 18 nt, Mycobacterium tuberculosis H37Rv
ggucagcgggcuugccgu

SEQ ID NO: 1305689 - RNA, 14 nt, Mycobacterium tuberculosis H37Rv
gguagucgcgguag

SEQ ID NO: 1305690 - RNA, 16 nt, Mycobacterium tuberculosis H37Rv
gguaggugacgacguc

SEQ ID NO: 1305691 - RNA, 16 nt, Mycobacterium tuberculosis H37Rv
gguaggucaccgguca

SEQ ID NO: 1305692 - RNA, 14 nt, Mycobacterium tuberculosis H37Rv
gguagucgacgauc

SEQ ID NO: 1305693 - RNA, 14 nt, Mycobacterium tuberculosis H37Rv
gguagucgcccgug

SEQ ID NO: 1305694 - RNA, 15 nt, Mycobacterium tuberculosis H37Rv
ggucaggaucgcacc

SEQ ID NO: 1305695 - RNA, 15 nt, Mycobacterium tuberculosis H37Rv
ggucaggccgacguc

SEQ ID NO: 1305696 - RNA, 15 nt, Mycobacterium tuberculosis H37Rv
ggucagcugcugcca

SEQ ID NO: 1305697 - RNA, 15 nt, Mycobacterium tuberculosis H37Rv
ggucagcucgucggc

SEQ ID NO: 1305698 - RNA, 19 nt, Mycobacterium tuberculosis H37Rv
ggucagcugggacccgagc

SEQ ID NO: 1305699 - RNA, 20 nt, Mycobacterium tuberculosis H37Rv
ggucagcucggugaugucgg

SEQ ID NO: 1305700 - RNA, 19 nt, Mycobacterium tuberculosis H37Rv
ggucagcgcugccaccgcg

SEQ ID NO: 1305701 - RNA, 11 nt, Mycobacterium tuberculosis H37Rv
ggucagcggcc

SEQ ID NO: 1305702 - RNA, 19 nt, Mycobacterium tuberculosis H37Rv
ggucagcgugccgguggcg

SEQ ID NO: 1305703 - RNA, 21 nt, Mycobacterium tuberculosis H37Rv
ggucgaucaggggcccacccg

SEQ ID NO: 1305704 - RNA, 20 nt, Mycobacterium tuberculosis H37Rv
ggucgauccacucggcgauc

SEQ ID NO: 1305705 - RNA, 18 nt, Mycobacterium tuberculosis H37Rv
ggucgauccggugccgaa

SEQ ID NO: 1305706 - RNA, 12 nt, Mycobacterium tuberculosis H37Rv
ggucgauccggu

SEQ ID NO: 1305707 - RNA, 17 nt, Mycobacterium tuberculosis H37Rv
ggucgaugaccucguca

SEQ ID NO: 1305708 - RNA, 20 nt, Mycobacterium tuberculosis H37Rv
ggucgcccgaucggcggauc

SEQ ID NO: 1305709 - RNA, 18 nt, Mycobacterium tuberculosis H37Rv
ggucgccaccuucgacga

SEQ ID NO: 1305710 - RNA, 13 nt, Mycobacterium tuberculosis H37Rv
ggucgccaagauc

SEQ ID NO: 1305711 - RNA, 23 nt, Mycobacterium tuberculosis H37Rv
ggucgccaacgccagcaccagcg

SEQ ID NO: 1305712 - RNA, 21 nt, Mycobacterium tuberculosis H37Rv
ggucgccaacgccagcaccag

SEQ ID NO: 1305713 - RNA, 14 nt, Mycobacterium tuberculosis H37Rv
ggucgcgcggcacc

SEQ ID NO: 1305714 - RNA, 15 nt, Mycobacterium tuberculosis H37Rv
ggucgcgcggcaccg

SEQ ID NO: 1305715 - RNA, 14 nt, Mycobacterium tuberculosis H37Rv
ggucgcgcucgcga

SEQ ID NO: 1305716 - RNA, 15 nt, Mycobacterium tuberculosis H37Rv
ggucgacgucggugu

SEQ ID NO: 1305717 - RNA, 18 nt, Mycobacterium tuberculosis H37Rv
ggucgacuccagcaccag

SEQ ID NO: 1305718 - RNA, 22 nt, Mycobacterium tuberculosis H37Rv
ggucgaacuugaucaccgcgua

SEQ ID NO: 1305719 - RNA, 15 nt, Mycobacterium tuberculosis H37Rv
ggucgacggccacgg

SEQ ID NO: 1305720 - RNA, 23 nt, Mycobacterium tuberculosis H37Rv
ggucgagcacgcugcugcgggug

SEQ ID NO: 1305721 - RNA, 15 nt, Mycobacterium tuberculosis H37Rv
ggucgaucagcggcg

SEQ ID NO: 1305722 - RNA, 22 nt, Mycobacterium tuberculosis H37Rv
ggucgagcagugccucggcgau

SEQ ID NO: 1305723 - RNA, 21 nt, Mycobacterium tuberculosis H37Rv
ggucgagcagugccucggcga

SEQ ID NO: 1305724 - RNA, 13 nt, Mycobacterium tuberculosis H37Rv
ggucgaucaccga

SEQ ID NO: 1305725 - RNA, 16 nt, Mycobacterium tuberculosis H37Rv
gguccugcucgcacag

SEQ ID NO: 1305726 - RNA, 15 nt, Mycobacterium tuberculosis H37Rv
gguccggaaccggua

SEQ ID NO: 1305727 - RNA, 13 nt, Mycobacterium tuberculosis H37Rv
gguccgccgucga

SEQ ID NO: 1305728 - RNA, 16 nt, Mycobacterium tuberculosis H37Rv
gguccgcgugcugccg

SEQ ID NO: 1305729 - RNA, 18 nt, Mycobacterium tuberculosis H37Rv
gguccugguguagccgag

SEQ ID NO: 1305730 - RNA, 19 nt, Mycobacterium tuberculosis H37Rv
ggucgaacuugaucaccgc

SEQ ID NO: 1305731 - RNA, 21 nt, Mycobacterium tuberculosis H37Rv
ggucgaacucgccccgcgugu

SEQ ID NO: 1305732 - RNA, 16 nt, Mycobacterium tuberculosis H37Rv
ggggcuacaacugccg

SEQ ID NO: 1305733 - RNA, 20 nt, Mycobacterium tuberculosis H37Rv
ggggcuacaacugccgagca

SEQ ID NO: 1305734 - RNA, 10 nt, Mycobacterium tuberculosis H37Rv
ggggcgucgc

SEQ ID NO: 1305735 - RNA, 23 nt, Mycobacterium tuberculosis H37Rv
ggggcgcccggccaggucgacac

SEQ ID NO: 1305736 - RNA, 20 nt, Mycobacterium tuberculosis H37Rv
gggggcuuuugcgucugcug

SEQ ID NO: 1305737 - RNA, 13 nt, Mycobacterium tuberculosis H37Rv
ggggugcgcccag

SEQ ID NO: 1305738 - RNA, 18 nt, Mycobacterium tuberculosis H37Rv
ggggugcuuacgugauau

SEQ ID NO: 1305739 - RNA, 15 nt, Mycobacterium tuberculosis H37Rv
ggggugugcgguugc

SEQ ID NO: 1305740 - RNA, 16 nt, Mycobacterium tuberculosis H37Rv
gggguggucgaacucg

SEQ ID NO: 1305741 - RNA, 17 nt, Mycobacterium tuberculosis H37Rv
ggggucgccggcaccgg

SEQ ID NO: 1305742 - RNA, 14 nt, Mycobacterium tuberculosis H37Rv
ggggugccggcgau

SEQ ID NO: 1305743 - RNA, 11 nt, Mycobacterium tuberculosis H37Rv
gggguccagcg

SEQ ID NO: 1305744 - RNA, 18 nt, Mycobacterium tuberculosis H37Rv
ggggucagcucgccagcc

SEQ ID NO: 1305745 - RNA, 21 nt, Mycobacterium tuberculosis H37Rv
ggggucggccugcggcaccgg

SEQ ID NO: 1305746 - RNA, 18 nt, Mycobacterium tuberculosis H37Rv
ggggucacccaucucgaa

SEQ ID NO: 1305747 - RNA, 20 nt, Mycobacterium tuberculosis H37Rv
ggggcuuaugcgacugcucg

SEQ ID NO: 1305748 - RNA, 16 nt, Mycobacterium tuberculosis H37Rv
ggggucgaacagcucg

SEQ ID NO: 1305749 - RNA, 14 nt, Mycobacterium tuberculosis H37Rv
gggacagcagccgg

SEQ ID NO: 1305750 - RNA, 21 nt, Mycobacterium tuberculosis H37Rv
gggaaucagugaagacaccag

SEQ ID NO: 1305751 - RNA, 16 nt, Mycobacterium tuberculosis H37Rv
gggaaggaaccgggca

SEQ ID NO: 1305752 - RNA, 20 nt, Mycobacterium tuberculosis H37Rv
gggaccacccgguccugcuc

SEQ ID NO: 1305753 - RNA, 11 nt, Mycobacterium tuberculosis H37Rv
gggaccaccga

SEQ ID NO: 1305754 - RNA, 18 nt, Mycobacterium tuberculosis H37Rv
gggaccccgcugcgacgu

SEQ ID NO: 1305755 - RNA, 17 nt, Mycobacterium tuberculosis H37Rv
gggacccgagaucaccg

SEQ ID NO: 1305756 - RNA, 13 nt, Mycobacterium tuberculosis H37Rv
gggaccacgguga

SEQ ID NO: 1305757 - RNA, 14 nt, Mycobacterium tuberculosis H37Rv
ggggcagcucaucg

SEQ ID NO: 1305758 - RNA, 19 nt, Mycobacterium tuberculosis H37Rv
ggggauuuugcgucugcuc

SEQ ID NO: 1305759 - RNA, 15 nt, Mycobacterium tuberculosis H37Rv
ggggcaggaucuccg

SEQ ID NO: 1305760 - RNA, 15 nt, Mycobacterium tuberculosis H37Rv
ggggccccaugccga

SEQ ID NO: 1305761 - RNA, 17 nt, Mycobacterium tuberculosis H37Rv
ggggcccggccgccacu

SEQ ID NO: 1305762 - RNA, 20 nt, Mycobacterium tuberculosis H37Rv
ggggcagguccgccccguug

SEQ ID NO: 1305763 - RNA, 15 nt, Mycobacterium tuberculosis H37Rv
ggggcaggucgagcg

SEQ ID NO: 1305764 - RNA, 22 nt, Mycobacterium tuberculosis H37Rv
gggucgcgagcccgccacagcc

SEQ ID NO: 1305765 - RNA, 22 nt, Mycobacterium tuberculosis H37Rv
gggucgacguaggacugccagc

SEQ ID NO: 1305766 - RNA, 19 nt, Mycobacterium tuberculosis H37Rv
ggguccucgagcggcagau

SEQ ID NO: 1305767 - RNA, 20 nt, Mycobacterium tuberculosis H37Rv
gggucgaccggaaugcccgg

SEQ ID NO: 1305768 - RNA, 16 nt, Mycobacterium tuberculosis H37Rv
gggucgaccccggcca

SEQ ID NO: 1305769 - RNA, 21 nt, Mycobacterium tuberculosis H37Rv
gggucgacgagauccagcgcc

SEQ ID NO: 1305770 - RNA, 13 nt, Mycobacterium tuberculosis H37Rv
gggucaucgccag

SEQ ID NO: 1305771 - RNA, 18 nt, Mycobacterium tuberculosis H37Rv
gggucaucgccagcggca

SEQ ID NO: 1305772 - RNA, 15 nt, Mycobacterium tuberculosis H37Rv
gggucagcucgguga

SEQ ID NO: 1305773 - RNA, 14 nt, Mycobacterium tuberculosis H37Rv
gggucagcucggug

SEQ ID NO: 1305774 - RNA, 15 nt, Mycobacterium tuberculosis H37Rv
ggguccagcgggauc

SEQ ID NO: 1305775 - RNA, 19 nt, Mycobacterium tuberculosis H37Rv
ggguccgaugcgugccgac

SEQ ID NO: 1305776 - RNA, 14 nt, Mycobacterium tuberculosis H37Rv
ggguauggcggcga

SEQ ID NO: 1305777 - RNA, 12 nt, Mycobacterium tuberculosis H37Rv
gggucagcucga

SEQ ID NO: 1305778 - RNA, 22 nt, Mycobacterium tuberculosis H37Rv
ggguaagcgaccgacgccauug

SEQ ID NO: 1305779 - RNA, 13 nt, Mycobacterium tuberculosis H37Rv
gggguuggcguca

SEQ ID NO: 1305780 - RNA, 18 nt, Mycobacterium tuberculosis H37Rv
gggguuguccucggcgau

SEQ ID NO: 1305781 - RNA, 16 nt, Mycobacterium tuberculosis H37Rv
ggguagaccuucucgc

SEQ ID NO: 1305782 - RNA, 15 nt, Mycobacterium tuberculosis H37Rv
ggguagacaccgcga

SEQ ID NO: 1305783 - RNA, 19 nt, Mycobacterium tuberculosis H37Rv
ggguagcgcgagcagacgu

SEQ ID NO: 1305784 - RNA, 16 nt, Mycobacterium tuberculosis H37Rv
ggguacgcaucucgag

SEQ ID NO: 1305785 - RNA, 20 nt, Mycobacterium tuberculosis H37Rv
ggguaccucccgcuugcggg

SEQ ID NO: 1305786 - RNA, 21 nt, Mycobacterium tuberculosis H37Rv
ggguaauucuugacgccgaug

SEQ ID NO: 1305787 - RNA, 16 nt, Mycobacterium tuberculosis H37Rv
ggguacccaucugcuc

SEQ ID NO: 1305788 - RNA, 22 nt, Mycobacterium tuberculosis H37Rv
gggugcgcgcgaccauacccgc

SEQ ID NO: 1305789 - RNA, 14 nt, Mycobacterium tuberculosis H37Rv
gggugugcccgggu

SEQ ID NO: 1305790 - RNA, 15 nt, Mycobacterium tuberculosis H37Rv
gggugucggugucga

SEQ ID NO: 1305791 - RNA, 23 nt, Mycobacterium tuberculosis H37Rv
gggugucaaucacccagccggaa

SEQ ID NO: 1305792 - RNA, 18 nt, Mycobacterium tuberculosis H37Rv
ggguggccaccagcggca

SEQ ID NO: 1305793 - RNA, 20 nt, Mycobacterium tuberculosis H37Rv
ggguggccagcaacugccgc

SEQ ID NO: 1305794 - RNA, 15 nt, Mycobacterium tuberculosis H37Rv
ggguggccagcaggc

SEQ ID NO: 1305795 - RNA, 15 nt, Mycobacterium tuberculosis H37Rv
gggugcucagcgaca

SEQ ID NO: 1305796 - RNA, 14 nt, Mycobacterium tuberculosis H37Rv
gggucuugacggcg

SEQ ID NO: 1305797 - RNA, 15 nt, Mycobacterium tuberculosis H37Rv
gggucuuugcccgcc

SEQ ID NO: 1305798 - RNA, 21 nt, Mycobacterium tuberculosis H37Rv
gggugaagacaccggcgucga

SEQ ID NO: 1305799 - RNA, 21 nt, Mycobacterium tuberculosis H37Rv
gggugacaucgcgaggcguca

SEQ ID NO: 1305800 - RNA, 12 nt, Mycobacterium tuberculosis H37Rv
gggugacugcgg

SEQ ID NO: 1305801 - RNA, 18 nt, Mycobacterium tuberculosis H37Rv
gggugaguucggcguaga

SEQ ID NO: 1305802 - RNA, 17 nt, Mycobacterium tuberculosis H37Rv
gggugagugaccacgcu

SEQ ID NO: 1305803 - RNA, 12 nt, Mycobacterium tuberculosis H37Rv
gggucgugcgac

SEQ ID NO: 1305804 - RNA, 14 nt, Mycobacterium tuberculosis H37Rv
gggucguucgccga

SEQ ID NO: 1305805 - RNA, 13 nt, Mycobacterium tuberculosis H37Rv
gggucgugccagc

SEQ ID NO: 1305806 - RNA, 22 nt, Mycobacterium tuberculosis H37Rv
gggucgucguugggauccggug

SEQ ID NO: 1305807 - RNA, 17 nt, Mycobacterium tuberculosis H37Rv
gggucgucaugccaguc

SEQ ID NO: 1305808 - RNA, 18 nt, Mycobacterium tuberculosis H37Rv
gggucgucauacagcgcc

SEQ ID NO: 1305809 - RNA, 20 nt, Mycobacterium tuberculosis H37Rv
gggucggggaagacgaccgu

SEQ ID NO: 1305810 - RNA, 15 nt, Mycobacterium tuberculosis H37Rv
gggucggggcggcau

SEQ ID NO: 1305811 - RNA, 21 nt, Mycobacterium tuberculosis H37Rv
gggucggucacgacggcacgc

SEQ ID NO: 1305812 - RNA, 14 nt, Mycobacterium tuberculosis H37Rv
gggucggucaaugc

SEQ ID NO: 1305813 - RNA, 12 nt, Mycobacterium tuberculosis H37Rv
gggucggcgaug

SEQ ID NO: 1305814 - RNA, 23 nt, Mycobacterium tuberculosis H37Rv
gggucggcgauggcggcaucgau

SEQ ID NO: 1305815 - RNA, 18 nt, Mycobacterium tuberculosis H37Rv
ggguuugagccaaucgug

SEQ ID NO: 1305816 - RNA, 15 nt, Mycobacterium tuberculosis H37Rv
ggguuugcagcgaua

SEQ ID NO: 1305817 - RNA, 13 nt, Mycobacterium tuberculosis H37Rv
ggguugugccgcc

SEQ ID NO: 1305818 - RNA, 18 nt, Mycobacterium tuberculosis H37Rv
ggguggcgaggcagcacc

SEQ ID NO: 1305819 - RNA, 22 nt, Mycobacterium tuberculosis H37Rv
ggguuggccgaacagcugcccg

SEQ ID NO: 1305820 - RNA, 15 nt, Mycobacterium tuberculosis H37Rv
gguaccaaccugcgc

SEQ ID NO: 1305821 - RNA, 18 nt, Mycobacterium tuberculosis H37Rv
gguaccaaagcugucgac

SEQ ID NO: 1305822 - RNA, 13 nt, Mycobacterium tuberculosis H37Rv
gguacaucgacca

SEQ ID NO: 1305823 - RNA, 16 nt, Mycobacterium tuberculosis H37Rv
gguacaucaccacgau

SEQ ID NO: 1305824 - RNA, 15 nt, Mycobacterium tuberculosis H37Rv
gguacgucaccgggu

SEQ ID NO: 1305825 - RNA, 14 nt, Mycobacterium tuberculosis H37Rv
gguacucccgcgau

SEQ ID NO: 1305826 - RNA, 21 nt, Mycobacterium tuberculosis H37Rv
gguagaacuccucgcugucga

SEQ ID NO: 1305827 - RNA, 13 nt, Mycobacterium tuberculosis H37Rv
gguagccgggcac

SEQ ID NO: 1305828 - RNA, 13 nt, Mycobacterium tuberculosis H37Rv
gguagccggcgac

SEQ ID NO: 1305829 - RNA, 15 nt, Mycobacterium tuberculosis H37Rv
gguagcggaccugcg

SEQ ID NO: 1305830 - RNA, 20 nt, Mycobacterium tuberculosis H37Rv
gguagcggaccugcgagauc

SEQ ID NO: 1305831 - RNA, 18 nt, Mycobacterium tuberculosis H37Rv
gguagcggaucgcgguca

SEQ ID NO: 1305832 - RNA, 15 nt, Mycobacterium tuberculosis H37Rv
gguagccugaccagc

SEQ ID NO: 1305833 - RNA, 22 nt, Mycobacterium tuberculosis H37Rv
gguucaccgaggugccgcgcag

SEQ ID NO: 1305834 - RNA, 16 nt, Mycobacterium tuberculosis H37Rv
gguucaugaacaucgg

SEQ ID NO: 1305835 - RNA, 17 nt, Mycobacterium tuberculosis H37Rv
gguucgacgucugccca

SEQ ID NO: 1305836 - RNA, 17 nt, Mycobacterium tuberculosis H37Rv
gguucgaaucccaucgg

SEQ ID NO: 1305837 - RNA, 20 nt, Mycobacterium tuberculosis H37Rv
gguucgaacgcgaucgaccu

SEQ ID NO: 1305838 - RNA, 19 nt, Mycobacterium tuberculosis H37Rv
gguucccuuguucccgaaa

SEQ ID NO: 1305839 - RNA, 14 nt, Mycobacterium tuberculosis H37Rv
gguuccgcugucga

SEQ ID NO: 1305840 - RNA, 13 nt, Mycobacterium tuberculosis H37Rv
gguucggcgucga

SEQ ID NO: 1305841 - RNA, 14 nt, Mycobacterium tuberculosis H37Rv
gguucgggacgcga

SEQ ID NO: 1305842 - RNA, 21 nt, Mycobacterium tuberculosis H37Rv
ggugugcucgccgaccagcuu

SEQ ID NO: 1305843 - RNA, 16 nt, Mycobacterium tuberculosis H37Rv
ggugugcugccaccgg

SEQ ID NO: 1305844 - RNA, 19 nt, Mycobacterium tuberculosis H37Rv
gguguggacuucagcaggc

SEQ ID NO: 1305845 - RNA, 16 nt, Mycobacterium tuberculosis H37Rv
ggugugauacagcgcc

SEQ ID NO: 1305846 - RNA, 13 nt, Mycobacterium tuberculosis H37Rv
ggugugcagcagc

SEQ ID NO: 1305847 - RNA, 15 nt, Mycobacterium tuberculosis H37Rv
ggugugcgaacaagu

SEQ ID NO: 1305848 - RNA, 16 nt, Mycobacterium tuberculosis H37Rv
ggugugggcgcaacga

SEQ ID NO: 1305849 - RNA, 13 nt, Mycobacterium tuberculosis H37Rv
ggugugucccggg

SEQ ID NO: 1305850 - RNA, 15 nt, Mycobacterium tuberculosis H37Rv
gguguggucaccagg

SEQ ID NO: 1305851 - RNA, 13 nt, Mycobacterium tuberculosis H37Rv
gguguuggacgcc

SEQ ID NO: 1305852 - RNA, 17 nt, Mycobacterium tuberculosis H37Rv
gguguugagaucgcccg

SEQ ID NO: 1305853 - RNA, 14 nt, Mycobacterium tuberculosis H37Rv
gguguugccggaga

SEQ ID NO: 1305854 - RNA, 17 nt, Mycobacterium tuberculosis H37Rv
gguguuugucgcggugg

SEQ ID NO: 1305855 - RNA, 15 nt, Mycobacterium tuberculosis H37Rv
gguuggccaccagcu

SEQ ID NO: 1305856 - RNA, 18 nt, Mycobacterium tuberculosis H37Rv
gguuggccgaacagcugc

SEQ ID NO: 1305857 - RNA, 19 nt, Mycobacterium tuberculosis H37Rv
gguuggccgaacagcugcc

SEQ ID NO: 1305858 - RNA, 23 nt, Mycobacterium tuberculosis H37Rv
gguugcucgagcgguggcgucgu

SEQ ID NO: 1305859 - RNA, 21 nt, Mycobacterium tuberculosis H37Rv
gguuggcaagcacggcgucga

SEQ ID NO: 1305860 - RNA, 13 nt, Mycobacterium tuberculosis H37Rv
gguugcucgagcg

SEQ ID NO: 1305861 - RNA, 19 nt, Mycobacterium tuberculosis H37Rv
gguuguugacgaugaacgc

SEQ ID NO: 1305862 - RNA, 13 nt, Mycobacterium tuberculosis H37Rv
gguugucggcgau

SEQ ID NO: 1305863 - RNA, 15 nt, Mycobacterium tuberculosis H37Rv
gguuggcucggcgca

SEQ ID NO: 1305864 - RNA, 14 nt, Mycobacterium tuberculosis H37Rv
gguuggcuccggug

SEQ ID NO: 1305865 - RNA, 21 nt, Mycobacterium tuberculosis H37Rv
gguuggcucggcgcagcacau

SEQ ID NO: 1305866 - RNA, 14 nt, Mycobacterium tuberculosis H37Rv
gguuggucccgaug

SEQ ID NO: 1305867 - RNA, 15 nt, Mycobacterium tuberculosis H37Rv
gguucuugaccagca

SEQ ID NO: 1305868 - RNA, 15 nt, Mycobacterium tuberculosis H37Rv
gguugacgggcucgg

SEQ ID NO: 1305869 - RNA, 16 nt, Mycobacterium tuberculosis H37Rv
gguugacccccgggua

SEQ ID NO: 1305870 - RNA, 18 nt, Mycobacterium tuberculosis H37Rv
gguugaugacggcgucga

SEQ ID NO: 1305871 - RNA, 18 nt, Mycobacterium tuberculosis H37Rv
gguugagauggucaccgg

SEQ ID NO: 1305872 - RNA, 22 nt, Mycobacterium tuberculosis H37Rv
gguugccgcaccagucgcgcag

SEQ ID NO: 1305873 - RNA, 16 nt, Mycobacterium tuberculosis H37Rv
gguugcccucaccgau

SEQ ID NO: 1305874 - RNA, 21 nt, Mycobacterium tuberculosis H37Rv
gguugcgacgugaccggcaau

SEQ ID NO: 1305875 - RNA, 16 nt, Mycobacterium tuberculosis H37Rv
gguugcgaacucggcc

SEQ ID NO: 1305876 - RNA, 20 nt, Mycobacterium tuberculosis H37Rv
gguugcgcccguacacgauc

SEQ ID NO: 1305877 - RNA, 18 nt, Mycobacterium tuberculosis H37Rv
gguggcgccggccgguca

SEQ ID NO: 1305878 - RNA, 17 nt, Mycobacterium tuberculosis H37Rv
gguggcgccgucggccg

SEQ ID NO: 1305879 - RNA, 23 nt, Mycobacterium tuberculosis H37Rv
gguggcgggguugaucaccgaca

SEQ ID NO: 1305880 - RNA, 13 nt, Mycobacterium tuberculosis H37Rv
gguggcgucaccg

SEQ ID NO: 1305881 - RNA, 21 nt, Mycobacterium tuberculosis H37Rv
gguggcguggcccucggcgau

SEQ ID NO: 1305882 - RNA, 21 nt, Mycobacterium tuberculosis H37Rv
gguggcggcggugccacgauc

SEQ ID NO: 1305883 - RNA, 20 nt, Mycobacterium tuberculosis H37Rv
gguggcggcgcugcgcgauc

SEQ ID NO: 1305884 - RNA, 21 nt, Mycobacterium tuberculosis H37Rv
gguggcgaucaucggccccga

SEQ ID NO: 1305885 - RNA, 19 nt, Mycobacterium tuberculosis H37Rv
gguggacgcagagucaacg

SEQ ID NO: 1305886 - RNA, 13 nt, Mycobacterium tuberculosis H37Rv
ggugcuuggccgc

SEQ ID NO: 1305887 - RNA, 19 nt, Mycobacterium tuberculosis H37Rv
gguggccucauccaccgau

SEQ ID NO: 1305888 - RNA, 17 nt, Mycobacterium tuberculosis H37Rv
gguggccucauccaccg

SEQ ID NO: 1305889 - RNA, 22 nt, Mycobacterium tuberculosis H37Rv
ggugcugccgauagggauggcg

SEQ ID NO: 1305890 - RNA, 23 nt, Mycobacterium tuberculosis H37Rv
ggugcuggucaacagcggcaaga

SEQ ID NO: 1305891 - RNA, 15 nt, Mycobacterium tuberculosis H37Rv
gguggaccgccgauc

SEQ ID NO: 1305892 - RNA, 16 nt, Mycobacterium tuberculosis H37Rv
gguggaccggucgaca

SEQ ID NO: 1305893 - RNA, 21 nt, Mycobacterium tuberculosis H37Rv
gguggacgagccagaggugga

SEQ ID NO: 1305894 - RNA, 19 nt, Mycobacterium tuberculosis H37Rv
gguggccgcaucgacgcuc

SEQ ID NO: 1305895 - RNA, 16 nt, Mycobacterium tuberculosis H37Rv
gguggacaccugcugc

SEQ ID NO: 1305896 - RNA, 14 nt, Mycobacterium tuberculosis H37Rv
gguggaaucagggu

SEQ ID NO: 1305897 - RNA, 17 nt, Mycobacterium tuberculosis H37Rv
ggugauggccgaccagc

SEQ ID NO: 1305898 - RNA, 18 nt, Mycobacterium tuberculosis H37Rv
ggugauguagggcugcuc

SEQ ID NO: 1305899 - RNA, 22 nt, Mycobacterium tuberculosis H37Rv
ggugcugaugggucaggccgac

SEQ ID NO: 1305900 - RNA, 15 nt, Mycobacterium tuberculosis H37Rv
ggugauggccgacgu

SEQ ID NO: 1305901 - RNA, 21 nt, Mycobacterium tuberculosis H37Rv
gguguagcccagccgggugga

SEQ ID NO: 1305902 - RNA, 15 nt, Mycobacterium tuberculosis H37Rv
gguguagcccaucgg

SEQ ID NO: 1305903 - RNA, 18 nt, Mycobacterium tuberculosis H37Rv
gguguagcccuccgagca

SEQ ID NO: 1305904 - RNA, 14 nt, Mycobacterium tuberculosis H37Rv
gguguagccgagca

SEQ ID NO: 1305905 - RNA, 23 nt, Mycobacterium tuberculosis H37Rv
gguguaauuggcaacacagcuga

SEQ ID NO: 1305906 - RNA, 13 nt, Mycobacterium tuberculosis H37Rv
gguggugucgcuc

SEQ ID NO: 1305907 - RNA, 14 nt, Mycobacterium tuberculosis H37Rv
gguggugucgcucg

SEQ ID NO: 1305908 - RNA, 18 nt, Mycobacterium tuberculosis H37Rv
ggugucggugcgcggcaa

SEQ ID NO: 1305909 - RNA, 16 nt, Mycobacterium tuberculosis H37Rv
ggugucggcuggucgc

SEQ ID NO: 1305910 - RNA, 17 nt, Mycobacterium tuberculosis H37Rv
ggugucggugucgacgu

SEQ ID NO: 1305911 - RNA, 15 nt, Mycobacterium tuberculosis H37Rv
ggugucggcucgagu

SEQ ID NO: 1305912 - RNA, 17 nt, Mycobacterium tuberculosis H37Rv
gguguccuccagcugcg

SEQ ID NO: 1305913 - RNA, 19 nt, Mycobacterium tuberculosis H37Rv
ggugucaugaacgaccgga

SEQ ID NO: 1305914 - RNA, 16 nt, Mycobacterium tuberculosis H37Rv
gguguccauguucucc

SEQ ID NO: 1305915 - RNA, 14 nt, Mycobacterium tuberculosis H37Rv
gguguccucgucga

SEQ ID NO: 1305916 - RNA, 20 nt, Mycobacterium tuberculosis H37Rv
ggugucgcgaucgcggcauc

SEQ ID NO: 1305917 - RNA, 20 nt, Mycobacterium tuberculosis H37Rv
gguggucacgcagucgggca

SEQ ID NO: 1305918 - RNA, 23 nt, Mycobacterium tuberculosis H37Rv
gguggucacgcagucgggcagcg

SEQ ID NO: 1305919 - RNA, 13 nt, Mycobacterium tuberculosis H37Rv
ggugggucggcuu

SEQ ID NO: 1305920 - RNA, 23 nt, Mycobacterium tuberculosis H37Rv
ggugggucggggcggcauuggcg

SEQ ID NO: 1305921 - RNA, 21 nt, Mycobacterium tuberculosis H37Rv
ggugggugacguaggcgcuga

SEQ ID NO: 1305922 - RNA, 14 nt, Mycobacterium tuberculosis H37Rv
ggugggcagcaggc

SEQ ID NO: 1305923 - RNA, 16 nt, Mycobacterium tuberculosis H37Rv
gguggucgucccgaug

SEQ ID NO: 1305924 - RNA, 15 nt, Mycobacterium tuberculosis H37Rv
gguggggucggucug

SEQ ID NO: 1305925 - RNA, 17 nt, Mycobacterium tuberculosis H37Rv
ggugggcuaggucgcgc

SEQ ID NO: 1305926 - RNA, 19 nt, Mycobacterium tuberculosis H37Rv
ggugggcgcagagucaacg

SEQ ID NO: 1305927 - RNA, 23 nt, Mycobacterium tuberculosis H37Rv
gguggcgucaugcccaggugcgu

SEQ ID NO: 1305928 - RNA, 21 nt, Mycobacterium tuberculosis H37Rv
gguggcgguaccuagccgcag

SEQ ID NO: 1305929 - RNA, 18 nt, Mycobacterium tuberculosis H37Rv
gguggcguuacgggcgau

SEQ ID NO: 1305930 - RNA, 20 nt, Mycobacterium tuberculosis H37Rv
gguggcuuuugcgucugcuc

SEQ ID NO: 1305931 - RNA, 15 nt, Mycobacterium tuberculosis H37Rv
gguggcugguguuga

SEQ ID NO: 1305932 - RNA, 14 nt, Mycobacterium tuberculosis H37Rv
ggugggagcagccg

SEQ ID NO: 1305933 - RNA, 13 nt, Mycobacterium tuberculosis H37Rv
ggugggcagcagc

SEQ ID NO: 1305934 - RNA, 22 nt, Mycobacterium tuberculosis H37Rv
guaguucaccaacgcgggaacg

SEQ ID NO: 1305935 - RNA, 14 nt, Mycobacterium tuberculosis H37Rv
guaguucgaugacu

SEQ ID NO: 1305936 - RNA, 17 nt, Mycobacterium tuberculosis H37Rv
guaguuggugaacaugu

SEQ ID NO: 1305937 - RNA, 19 nt, Mycobacterium tuberculosis H37Rv
guauaccgagggucgggca

SEQ ID NO: 1305938 - RNA, 23 nt, Mycobacterium tuberculosis H37Rv
guauccgacgucggugaccucgg

SEQ ID NO: 1305939 - RNA, 15 nt, Mycobacterium tuberculosis H37Rv
guagggcaucgucgc

SEQ ID NO: 1305940 - RNA, 12 nt, Mycobacterium tuberculosis H37Rv
guagggcaucgu

SEQ ID NO: 1305941 - RNA, 15 nt, Mycobacterium tuberculosis H37Rv
guaggcggccagcgc

SEQ ID NO: 1305942 - RNA, 20 nt, Mycobacterium tuberculosis H37Rv
guagcgguucaucaccguca

SEQ ID NO: 1305943 - RNA, 22 nt, Mycobacterium tuberculosis H37Rv
guagcggucguagacagucugc

SEQ ID NO: 1305944 - RNA, 19 nt, Mycobacterium tuberculosis H37Rv
guagcggcggcgcccggcu

SEQ ID NO: 1305945 - RNA, 15 nt, Mycobacterium tuberculosis H37Rv
guagcgggggagcga

SEQ ID NO: 1305946 - RNA, 18 nt, Mycobacterium tuberculosis H37Rv
guagcggcccuucgacga

SEQ ID NO: 1305947 - RNA, 13 nt, Mycobacterium tuberculosis H37Rv
guagccgcccagc

SEQ ID NO: 1305948 - RNA, 18 nt, Mycobacterium tuberculosis H37Rv
guagccgcggccacaaug

SEQ ID NO: 1305949 - RNA, 14 nt, Mycobacterium tuberculosis H37Rv
guagccgcugcacg

SEQ ID NO: 1305950 - RNA, 13 nt, Mycobacterium tuberculosis H37Rv
guagcccggaccg

SEQ ID NO: 1305951 - RNA, 19 nt, Mycobacterium tuberculosis H37Rv
guagccgaccggcagcgau

SEQ ID NO: 1305952 - RNA, 13 nt, Mycobacterium tuberculosis H37Rv
guagccgaccagg

SEQ ID NO: 1305953 - RNA, 19 nt, Mycobacterium tuberculosis H37Rv
guagcccgcgucgacgagc

SEQ ID NO: 1305954 - RNA, 13 nt, Mycobacterium tuberculosis H37Rv
guagcccaucggc

SEQ ID NO: 1305955 - RNA, 14 nt, Mycobacterium tuberculosis H37Rv
guagcccaucggca

SEQ ID NO: 1305956 - RNA, 23 nt, Mycobacterium tuberculosis H37Rv
guagagucguuuggcgccgccga

SEQ ID NO: 1305957 - RNA, 14 nt, Mycobacterium tuberculosis H37Rv
guagccagcgcgcu

SEQ ID NO: 1305958 - RNA, 14 nt, Mycobacterium tuberculosis H37Rv
guagagcgcaccgc

SEQ ID NO: 1305959 - RNA, 21 nt, Mycobacterium tuberculosis H37Rv
guagacgucgaccgugucacc

SEQ ID NO: 1305960 - RNA, 17 nt, Mycobacterium tuberculosis H37Rv
guagaggucaucagcgu

SEQ ID NO: 1305961 - RNA, 17 nt, Mycobacterium tuberculosis H37Rv
guagaacgcuagcgcca

SEQ ID NO: 1305962 - RNA, 15 nt, Mycobacterium tuberculosis H37Rv
guagaagucgaucgc

SEQ ID NO: 1305963 - RNA, 18 nt, Mycobacterium tuberculosis H37Rv
guagacaacagucgacaa

SEQ ID NO: 1305964 - RNA, 13 nt, Mycobacterium tuberculosis H37Rv
guagacaccgcga

SEQ ID NO: 1305965 - RNA, 20 nt, Mycobacterium tuberculosis H37Rv
guagacaccgcgaucaccac

SEQ ID NO: 1305966 - RNA, 15 nt, Mycobacterium tuberculosis H37Rv
guacucggccagcgc

SEQ ID NO: 1305967 - RNA, 17 nt, Mycobacterium tuberculosis H37Rv
guacucggccagcucgu

SEQ ID NO: 1305968 - RNA, 15 nt, Mycobacterium tuberculosis H37Rv
guacggcccgcaucg

SEQ ID NO: 1305969 - RNA, 21 nt, Mycobacterium tuberculosis H37Rv
guacucagguggaagugcacc

SEQ ID NO: 1305970 - RNA, 21 nt, Mycobacterium tuberculosis H37Rv
guacuaacaacaccaccagca

SEQ ID NO: 1305971 - RNA, 14 nt, Mycobacterium tuberculosis H37Rv
guacggccaacauc

SEQ ID NO: 1305972 - RNA, 14 nt, Mycobacterium tuberculosis H37Rv
guacggaccgucgc

SEQ ID NO: 1305973 - RNA, 16 nt, Mycobacterium tuberculosis H37Rv
guacgcgucggugacc

SEQ ID NO: 1305974 - RNA, 14 nt, Mycobacterium tuberculosis H37Rv
guacgccggacccg

SEQ ID NO: 1305975 - RNA, 15 nt, Mycobacterium tuberculosis H37Rv
guacgccgccgcgac

SEQ ID NO: 1305976 - RNA, 23 nt, Mycobacterium tuberculosis H37Rv
guacgcccgcucggagaucgcca

SEQ ID NO: 1305977 - RNA, 16 nt, Mycobacterium tuberculosis H37Rv
guacgcaucgccguca

SEQ ID NO: 1305978 - RNA, 15 nt, Mycobacterium tuberculosis H37Rv
guaccaccggcaccg

SEQ ID NO: 1305979 - RNA, 13 nt, Mycobacterium tuberculosis H37Rv
guaccaccggcac

SEQ ID NO: 1305980 - RNA, 15 nt, Mycobacterium tuberculosis H37Rv
guaccaccgcggugu

SEQ ID NO: 1305981 - RNA, 16 nt, Mycobacterium tuberculosis H37Rv
guaccgcccgcaccgu

SEQ ID NO: 1305982 - RNA, 18 nt, Mycobacterium tuberculosis H37Rv
guaccggcuucgucggcc

SEQ ID NO: 1305983 - RNA, 19 nt, Mycobacterium tuberculosis H37Rv
guaccgggcgagucccggc

SEQ ID NO: 1305984 - RNA, 17 nt, Mycobacterium tuberculosis H37Rv
guaccggcaaacgcgca

SEQ ID NO: 1305985 - RNA, 20 nt, Mycobacterium tuberculosis H37Rv
guaccggaaucggcggcgga

SEQ ID NO: 1305986 - RNA, 15 nt, Mycobacterium tuberculosis H37Rv
guaccggaaucggcg

SEQ ID NO: 1305987 - RNA, 22 nt, Mycobacterium tuberculosis H37Rv
gguuucgaauguuucggcgaua

SEQ ID NO: 1305988 - RNA, 14 nt, Mycobacterium tuberculosis H37Rv
gguuugcagcgaua

SEQ ID NO: 1305989 - RNA, 12 nt, Mycobacterium tuberculosis H37Rv
gguuugccggcg

SEQ ID NO: 1305990 - RNA, 15 nt, Mycobacterium tuberculosis H37Rv
guaaacaacgcgaua

SEQ ID NO: 1305991 - RNA, 18 nt, Mycobacterium tuberculosis H37Rv
guaaaccgauaucgcugc

SEQ ID NO: 1305992 - RNA, 22 nt, Mycobacterium tuberculosis H37Rv
guaaagaucuugucgcguucgg

SEQ ID NO: 1305993 - RNA, 18 nt, Mycobacterium tuberculosis H37Rv
guaacacccggccgccga

SEQ ID NO: 1305994 - RNA, 20 nt, Mycobacterium tuberculosis H37Rv
guaacgguaaccggcccgau

SEQ ID NO: 1305995 - RNA, 18 nt, Mycobacterium tuberculosis H37Rv
guaacgccaagcucggcc

SEQ ID NO: 1305996 - RNA, 15 nt, Mycobacterium tuberculosis H37Rv
guaaccguccgcgga

SEQ ID NO: 1305997 - RNA, 14 nt, Mycobacterium tuberculosis H37Rv
guaacgcagcggca

SEQ ID NO: 1305998 - RNA, 17 nt, Mycobacterium tuberculosis H37Rv
guaaccggcagcgguaa

SEQ ID NO: 1305999 - RNA, 22 nt, Mycobacterium tuberculosis H37Rv
guaaccguagcccugcucagcu

SEQ ID NO: 1306000 - RNA, 18 nt, Mycobacterium tuberculosis H37Rv
guaaccggcggcagcgau

SEQ ID NO: 1306001 - RNA, 22 nt, Mycobacterium tuberculosis H37Rv
guaaccgcgcguaggccgcuau

SEQ ID NO: 1306002 - RNA, 15 nt, Mycobacterium tuberculosis H37Rv
guaaugccagcggca

SEQ ID NO: 1306003 - RNA, 21 nt, Mycobacterium tuberculosis H37Rv
gcgcuaaggugggcacagcga

SEQ ID NO: 1306004 - RNA, 16 nt, Mycobacterium tuberculosis H37Rv
gcgcucaccgacgcug

SEQ ID NO: 1306005 - RNA, 14 nt, Mycobacterium tuberculosis H37Rv
gcgcuaggaacgcc

SEQ ID NO: 1306006 - RNA, 15 nt, Mycobacterium tuberculosis H37Rv
gcgcuaucaugacca

SEQ ID NO: 1306007 - RNA, 14 nt, Mycobacterium tuberculosis H37Rv
gcgcuauaggccgc

SEQ ID NO: 1306008 - RNA, 16 nt, Mycobacterium tuberculosis H37Rv
gcgcucaacggcgaaa

SEQ ID NO: 1306009 - RNA, 17 nt, Mycobacterium tuberculosis H37Rv
gcgcuccagccgcgcgu

SEQ ID NO: 1306010 - RNA, 18 nt, Mycobacterium tuberculosis H37Rv
gcgcucccacgcuucggc

SEQ ID NO: 1306011 - RNA, 20 nt, Mycobacterium tuberculosis H37Rv
gcgcuccagcacccgcgcga

SEQ ID NO: 1306012 - RNA, 24 nt, Mycobacterium tuberculosis H37Rv
gcgcuccagauggggcucgagugu

SEQ ID NO: 1306013 - RNA, 19 nt, Mycobacterium tuberculosis H37Rv
gcgcuccacugaccagguc

SEQ ID NO: 1306014 - RNA, 17 nt, Mycobacterium tuberculosis H37Rv
gcgcuccacugaccagg

SEQ ID NO: 1306015 - RNA, 14 nt, Mycobacterium tuberculosis H37Rv
gcgcucaucgaccg

SEQ ID NO: 1306016 - RNA, 22 nt, Mycobacterium tuberculosis H37Rv
gcgcucauguucucgaccgcgu

SEQ ID NO: 1306017 - RNA, 23 nt, Mycobacterium tuberculosis H37Rv
gcgcucagcuccggcgacucugu

SEQ ID NO: 1306018 - RNA, 17 nt, Mycobacterium tuberculosis H37Rv
gcgcucagcgcggccac

SEQ ID NO: 1306019 - RNA, 19 nt, Mycobacterium tuberculosis H37Rv
gcgcguggcagugcaggcg

SEQ ID NO: 1306020 - RNA, 22 nt, Mycobacterium tuberculosis H37Rv
gcgcguggucgccccgaugacc

SEQ ID NO: 1306021 - RNA, 18 nt, Mycobacterium tuberculosis H37Rv
gcgcguggcagugcaggc

SEQ ID NO: 1306022 - RNA, 18 nt, Mycobacterium tuberculosis H37Rv
gcgcguuggcgagguugc

SEQ ID NO: 1306023 - RNA, 14 nt, Mycobacterium tuberculosis H37Rv
gcgcguugcgguca

SEQ ID NO: 1306024 - RNA, 15 nt, Mycobacterium tuberculosis H37Rv
gcgcguugcggucaa

SEQ ID NO: 1306025 - RNA, 19 nt, Mycobacterium tuberculosis H37Rv
gcgcguucgucgucgcuga

SEQ ID NO: 1306026 - RNA, 13 nt, Mycobacterium tuberculosis H37Rv
gcgcguucgucgu

SEQ ID NO: 1306027 - RNA, 20 nt, Mycobacterium tuberculosis H37Rv
gcgcguucggcgcugaucgc

SEQ ID NO: 1306028 - RNA, 15 nt, Mycobacterium tuberculosis H37Rv
gcgcgucgagcgacc

SEQ ID NO: 1306029 - RNA, 22 nt, Mycobacterium tuberculosis H37Rv
gcgcgucgaguuuugcggccag

SEQ ID NO: 1306030 - RNA, 19 nt, Mycobacterium tuberculosis H37Rv
gcgcguccccagcgccacc

SEQ ID NO: 1306031 - RNA, 16 nt, Mycobacterium tuberculosis H37Rv
gcgcgucgcgugggau

SEQ ID NO: 1306032 - RNA, 17 nt, Mycobacterium tuberculosis H37Rv
gcgcgucggcaccgauc

SEQ ID NO: 1306033 - RNA, 13 nt, Mycobacterium tuberculosis H37Rv
gcgcgucgccgaa

SEQ ID NO: 1306034 - RNA, 17 nt, Mycobacterium tuberculosis H37Rv
gcgcgugacgaccagcc

SEQ ID NO: 1306035 - RNA, 13 nt, Mycobacterium tuberculosis H37Rv
gcgcgugacgacc

SEQ ID NO: 1306036 - RNA, 12 nt, Mycobacterium tuberculosis H37Rv
gcgcgugcagcc

SEQ ID NO: 1306037 - RNA, 14 nt, Mycobacterium tuberculosis H37Rv
gcgcgucgucgcgc

SEQ ID NO: 1306038 - RNA, 14 nt, Mycobacterium tuberculosis H37Rv
gcgcgucguccagg

SEQ ID NO: 1306039 - RNA, 15 nt, Mycobacterium tuberculosis H37Rv
gcgcgucggucaccg

SEQ ID NO: 1306040 - RNA, 22 nt, Mycobacterium tuberculosis H37Rv
gcgcggguuugcgguaguccgc

SEQ ID NO: 1306041 - RNA, 17 nt, Mycobacterium tuberculosis H37Rv
gcgcgguagcucgucga

SEQ ID NO: 1306042 - RNA, 16 nt, Mycobacterium tuberculosis H37Rv
gcgcgguagucgucgc

SEQ ID NO: 1306043 - RNA, 23 nt, Mycobacterium tuberculosis H37Rv
gcgcggguggcgccaggucggcg

SEQ ID NO: 1306044 - RNA, 22 nt, Mycobacterium tuberculosis H37Rv
gcgcggguggcgccaguucggc

SEQ ID NO: 1306045 - RNA, 23 nt, Mycobacterium tuberculosis H37Rv
gcgcggguggcgccaguucggcg

SEQ ID NO: 1306046 - RNA, 17 nt, Mycobacterium tuberculosis H37Rv
gcgcgggugaccaggcg

SEQ ID NO: 1306047 - RNA, 24 nt, Mycobacterium tuberculosis H37Rv
gcgcgggugguucaccucggcgac

SEQ ID NO: 1306048 - RNA, 16 nt, Mycobacterium tuberculosis H37Rv
gcgcgguacugcgcag

SEQ ID NO: 1306049 - RNA, 14 nt, Mycobacterium tuberculosis H37Rv
gcgcggucgcgcga

SEQ ID NO: 1306050 - RNA, 14 nt, Mycobacterium tuberculosis H37Rv
gcgcggucucgagu

SEQ ID NO: 1306051 - RNA, 16 nt, Mycobacterium tuberculosis H37Rv
gcgcgggucggcgacc

SEQ ID NO: 1306052 - RNA, 15 nt, Mycobacterium tuberculosis H37Rv
gcgcgucacauccga

SEQ ID NO: 1306053 - RNA, 22 nt, Mycobacterium tuberculosis H37Rv
gcgcgucaggccagcgcucacc

SEQ ID NO: 1306054 - RNA, 22 nt, Mycobacterium tuberculosis H37Rv
gcgcgguuucggcgucaccgug

SEQ ID NO: 1306055 - RNA, 19 nt, Mycobacterium tuberculosis H37Rv
gcgcguacccgaucagcga

SEQ ID NO: 1306056 - RNA, 13 nt, Mycobacterium tuberculosis H37Rv
gcgcguagccaau

SEQ ID NO: 1306057 - RNA, 13 nt, Mycobacterium tuberculosis H37Rv
gcgcgguggucag

SEQ ID NO: 1306058 - RNA, 17 nt, Mycobacterium tuberculosis H37Rv
gcgcggugccggccguu

SEQ ID NO: 1306059 - RNA, 23 nt, Mycobacterium tuberculosis H37Rv
gcgcggugccggccguucguggg

SEQ ID NO: 1306060 - RNA, 20 nt, Mycobacterium tuberculosis H37Rv
gcgcgguggccaacucgaca

SEQ ID NO: 1306061 - RNA, 15 nt, Mycobacterium tuberculosis H37Rv
gcgcggugaccgggu

SEQ ID NO: 1306062 - RNA, 21 nt, Mycobacterium tuberculosis H37Rv
gcgcggucugaccgcgucggc

SEQ ID NO: 1306063 - RNA, 22 nt, Mycobacterium tuberculosis H37Rv
gcgcggucugaccgcgucggcg

SEQ ID NO: 1306064 - RNA, 13 nt, Mycobacterium tuberculosis H37Rv
gcgcggcgcacaa

SEQ ID NO: 1306065 - RNA, 21 nt, Mycobacterium tuberculosis H37Rv
gcgcggcgcagcaccgucggc

SEQ ID NO: 1306066 - RNA, 15 nt, Mycobacterium tuberculosis H37Rv
gcgcggcgcauuccg

SEQ ID NO: 1306067 - RNA, 16 nt, Mycobacterium tuberculosis H37Rv
gcgcggcgccgcaaug

SEQ ID NO: 1306068 - RNA, 11 nt, Mycobacterium tuberculosis H37Rv
gcgcggcgauc

SEQ ID NO: 1306069 - RNA, 14 nt, Mycobacterium tuberculosis H37Rv
gcgcggcgagcacg

SEQ ID NO: 1306070 - RNA, 19 nt, Mycobacterium tuberculosis H37Rv
gcgcggcgacgacggccug

SEQ ID NO: 1306071 - RNA, 18 nt, Mycobacterium tuberculosis H37Rv
gcgcggccugcaccagcg

SEQ ID NO: 1306072 - RNA, 19 nt, Mycobacterium tuberculosis H37Rv
gcgcggccggccgcucacc

SEQ ID NO: 1306073 - RNA, 14 nt, Mycobacterium tuberculosis H37Rv
gcgcggccggcacg

SEQ ID NO: 1306074 - RNA, 13 nt, Mycobacterium tuberculosis H37Rv
gcgcggcucacgg

SEQ ID NO: 1306075 - RNA, 17 nt, Mycobacterium tuberculosis H37Rv
gcgcggcggcguccacc

SEQ ID NO: 1306076 - RNA, 17 nt, Mycobacterium tuberculosis H37Rv
gcgcggcgcgggucacg

SEQ ID NO: 1306077 - RNA, 17 nt, Mycobacterium tuberculosis H37Rv
gcgcgggcggaucgccg

SEQ ID NO: 1306078 - RNA, 15 nt, Mycobacterium tuberculosis H37Rv
gcgcgggccggcgac

SEQ ID NO: 1306079 - RNA, 21 nt, Mycobacterium tuberculosis H37Rv
gcgcgggcacgcccucgucga

SEQ ID NO: 1306080 - RNA, 18 nt, Mycobacterium tuberculosis H37Rv
gcgcgggccaccacgcgc

SEQ ID NO: 1306081 - RNA, 21 nt, Mycobacterium tuberculosis H37Rv
gcgcggcuuguaccgcaauca

SEQ ID NO: 1306082 - RNA, 17 nt, Mycobacterium tuberculosis H37Rv
gcgcggcugccgcggug

SEQ ID NO: 1306083 - RNA, 15 nt, Mycobacterium tuberculosis H37Rv
gcgcgcacacggcua

SEQ ID NO: 1306084 - RNA, 11 nt, Mycobacterium tuberculosis H37Rv
gcgcgaucgau

SEQ ID NO: 1306085 - RNA, 21 nt, Mycobacterium tuberculosis H37Rv
gcgcgcaaucgugguucggcg

SEQ ID NO: 1306086 - RNA, 13 nt, Mycobacterium tuberculosis H37Rv
gcgcgcaccaccg

SEQ ID NO: 1306087 - RNA, 14 nt, Mycobacterium tuberculosis H37Rv
gcgcgcaacccugc

SEQ ID NO: 1306088 - RNA, 21 nt, Mycobacterium tuberculosis H37Rv
gcgcgcaacacauccaguaac

SEQ ID NO: 1306089 - RNA, 14 nt, Mycobacterium tuberculosis H37Rv
gcgcgaucggugcc

SEQ ID NO: 1306090 - RNA, 11 nt, Mycobacterium tuberculosis H37Rv
gcgcgaucgac

SEQ ID NO: 1306091 - RNA, 17 nt, Mycobacterium tuberculosis H37Rv
gcgcgauccccgcgcug

SEQ ID NO: 1306092 - RNA, 23 nt, Mycobacterium tuberculosis H37Rv
gcgcgaucccaacgcccgggcga

SEQ ID NO: 1306093 - RNA, 14 nt, Mycobacterium tuberculosis H37Rv
gcgcgauccccgcg

SEQ ID NO: 1306094 - RNA, 21 nt, Mycobacterium tuberculosis H37Rv
gcgcgacugauccucgaugac

SEQ ID NO: 1306095 - RNA, 21 nt, Mycobacterium tuberculosis H37Rv
gcgcgacuguacaccgacacg

SEQ ID NO: 1306096 - RNA, 21 nt, Mycobacterium tuberculosis H37Rv
gcgcgacguagacgacgucgg

SEQ ID NO: 1306097 - RNA, 13 nt, Mycobacterium tuberculosis H37Rv
gcgcgacggacca

SEQ ID NO: 1306098 - RNA, 16 nt, Mycobacterium tuberculosis H37Rv
gcgcgacgagcaugcg

SEQ ID NO: 1306099 - RNA, 20 nt, Mycobacterium tuberculosis H37Rv
gcgcgacaacccggcgucga

SEQ ID NO: 1306100 - RNA, 21 nt, Mycobacterium tuberculosis H37Rv
gcgcgacaacccggcgucgac

SEQ ID NO: 1306101 - RNA, 17 nt, Mycobacterium tuberculosis H37Rv
gcgcgaccucgcuggcc

SEQ ID NO: 1306102 - RNA, 18 nt, Mycobacterium tuberculosis H37Rv
gcgcgacagacagcaccg

SEQ ID NO: 1306103 - RNA, 15 nt, Mycobacterium tuberculosis H37Rv
gcgcgacaacccggc

SEQ ID NO: 1306104 - RNA, 21 nt, Mycobacterium tuberculosis H37Rv
gcgcgaaguuugcgacgacgc

SEQ ID NO: 1306105 - RNA, 18 nt, Mycobacterium tuberculosis H37Rv
gcgcgaagucuugaccgc

SEQ ID NO: 1306106 - RNA, 20 nt, Mycobacterium tuberculosis H37Rv
gcgccgucucgaagcucagc

SEQ ID NO: 1306107 - RNA, 16 nt, Mycobacterium tuberculosis H37Rv
gcgcgaaggucagcga

SEQ ID NO: 1306108 - RNA, 14 nt, Mycobacterium tuberculosis H37Rv
gcgccgugacccau

SEQ ID NO: 1306109 - RNA, 14 nt, Mycobacterium tuberculosis H37Rv
gcgcgccgaucacg

SEQ ID NO: 1306110 - RNA, 12 nt, Mycobacterium tuberculosis H37Rv
gcgcgcccgaau

SEQ ID NO: 1306111 - RNA, 14 nt, Mycobacterium tuberculosis H37Rv
gcgcgccgcugggu

SEQ ID NO: 1306112 - RNA, 17 nt, Mycobacterium tuberculosis H37Rv
gcgcgccggauacaccg

SEQ ID NO: 1306113 - RNA, 22 nt, Mycobacterium tuberculosis H37Rv
gcgcgccacggugucgucgacc

SEQ ID NO: 1306114 - RNA, 16 nt, Mycobacterium tuberculosis H37Rv
gcgcgccaaucgccca

SEQ ID NO: 1306115 - RNA, 19 nt, Mycobacterium tuberculosis H37Rv
gcgcgcgugaagaacacgu

SEQ ID NO: 1306116 - RNA, 17 nt, Mycobacterium tuberculosis H37Rv
gcgcgcucaggucaucg

SEQ ID NO: 1306117 - RNA, 15 nt, Mycobacterium tuberculosis H37Rv
gcgcgcucgcucacc

SEQ ID NO: 1306118 - RNA, 19 nt, Mycobacterium tuberculosis H37Rv
gcgcgcucgcggcuucagu

SEQ ID NO: 1306119 - RNA, 14 nt, Mycobacterium tuberculosis H37Rv
gcgcgcucggccag

SEQ ID NO: 1306120 - RNA, 13 nt, Mycobacterium tuberculosis H37Rv
gcgcgcuggcggg

SEQ ID NO: 1306121 - RNA, 14 nt, Mycobacterium tuberculosis H37Rv
gcgcgcugcgcgac

SEQ ID NO: 1306122 - RNA, 13 nt, Mycobacterium tuberculosis H37Rv
gcgcgcugcgcag

SEQ ID NO: 1306123 - RNA, 14 nt, Mycobacterium tuberculosis H37Rv
gcgcggaucgucga

SEQ ID NO: 1306124 - RNA, 20 nt, Mycobacterium tuberculosis H37Rv
gcgcggaucgucgaggcacg

SEQ ID NO: 1306125 - RNA, 21 nt, Mycobacterium tuberculosis H37Rv
gcgcgcuguuguacggcccaa

SEQ ID NO: 1306126 - RNA, 15 nt, Mycobacterium tuberculosis H37Rv
gcgcggccacccgcg

SEQ ID NO: 1306127 - RNA, 16 nt, Mycobacterium tuberculosis H37Rv
gcgcggccacccgcga

SEQ ID NO: 1306128 - RNA, 16 nt, Mycobacterium tuberculosis H37Rv
gcgcggcaaccgucga

SEQ ID NO: 1306129 - RNA, 13 nt, Mycobacterium tuberculosis H37Rv
gcgcggcacccgg

SEQ ID NO: 1306130 - RNA, 17 nt, Mycobacterium tuberculosis H37Rv
gcgcggcaccgauggcg

SEQ ID NO: 1306131 - RNA, 18 nt, Mycobacterium tuberculosis H37Rv
gcgcggcacccggucggc

SEQ ID NO: 1306132 - RNA, 20 nt, Mycobacterium tuberculosis H37Rv
gcgcggauggccucggcgau

SEQ ID NO: 1306133 - RNA, 12 nt, Mycobacterium tuberculosis H37Rv
gcgcggccccga

SEQ ID NO: 1306134 - RNA, 14 nt, Mycobacterium tuberculosis H37Rv
gcgcggccgcagcc

SEQ ID NO: 1306135 - RNA, 14 nt, Mycobacterium tuberculosis H37Rv
gcgcggccacuugg

SEQ ID NO: 1306136 - RNA, 21 nt, Mycobacterium tuberculosis H37Rv
gcgcggccacgccgaucaaca

SEQ ID NO: 1306137 - RNA, 15 nt, Mycobacterium tuberculosis H37Rv
gcgcggccaauugcg

SEQ ID NO: 1306138 - RNA, 18 nt, Mycobacterium tuberculosis H37Rv
gcgcggcauucucgagca

SEQ ID NO: 1306139 - RNA, 17 nt, Mycobacterium tuberculosis H37Rv
gcgcggccacccgcgac

SEQ ID NO: 1306140 - RNA, 15 nt, Mycobacterium tuberculosis H37Rv
gcgcgccggcgucgg

SEQ ID NO: 1306141 - RNA, 23 nt, Mycobacterium tuberculosis H37Rv
gcgcgccggcgguagucggccag

SEQ ID NO: 1306142 - RNA, 13 nt, Mycobacterium tuberculosis H37Rv
gcgcgccggcgac

SEQ ID NO: 1306143 - RNA, 12 nt, Mycobacterium tuberculosis H37Rv
gcgcgccggcga

SEQ ID NO: 1306144 - RNA, 13 nt, Mycobacterium tuberculosis H37Rv
gcgcgcgauggcg

SEQ ID NO: 1306145 - RNA, 16 nt, Mycobacterium tuberculosis H37Rv
gcgcgccuuggccagc

SEQ ID NO: 1306146 - RNA, 19 nt, Mycobacterium tuberculosis H37Rv
gcgcgcgaaccccagccga

SEQ ID NO: 1306147 - RNA, 12 nt, Mycobacterium tuberculosis H37Rv
gcgcgcgacugu

SEQ ID NO: 1306148 - RNA, 12 nt, Mycobacterium tuberculosis H37Rv
gcgcgcggcaac

SEQ ID NO: 1306149 - RNA, 14 nt, Mycobacterium tuberculosis H37Rv
gcgcgcgcucgggc

SEQ ID NO: 1306150 - RNA, 20 nt, Mycobacterium tuberculosis H37Rv
gcgcgcgccgcugggugacc

SEQ ID NO: 1306151 - RNA, 18 nt, Mycobacterium tuberculosis H37Rv
gcgccaguguggugcggc

SEQ ID NO: 1306152 - RNA, 15 nt, Mycobacterium tuberculosis H37Rv
gcgccaguguggugc

SEQ ID NO: 1306153 - RNA, 16 nt, Mycobacterium tuberculosis H37Rv
gcgccauagccgcgac

SEQ ID NO: 1306154 - RNA, 20 nt, Mycobacterium tuberculosis H37Rv
gcgccauuccaagacguugc

SEQ ID NO: 1306155 - RNA, 15 nt, Mycobacterium tuberculosis H37Rv
gcgccauuccaagac

SEQ ID NO: 1306156 - RNA, 17 nt, Mycobacterium tuberculosis H37Rv
gcgcccgacgaacagcg

SEQ ID NO: 1306157 - RNA, 15 nt, Mycobacterium tuberculosis H37Rv
gcgcccgacggaguu

SEQ ID NO: 1306158 - RNA, 22 nt, Mycobacterium tuberculosis H37Rv
gcgcccaccaugaucacaccga

SEQ ID NO: 1306159 - RNA, 19 nt, Mycobacterium tuberculosis H37Rv
gcgcccaccccggccgcau

SEQ ID NO: 1306160 - RNA, 13 nt, Mycobacterium tuberculosis H37Rv
gcgcccagcucga

SEQ ID NO: 1306161 - RNA, 15 nt, Mycobacterium tuberculosis H37Rv
gcgcccaccgaaacc

SEQ ID NO: 1306162 - RNA, 22 nt, Mycobacterium tuberculosis H37Rv
gcgcccgcccgagccgcugcga

SEQ ID NO: 1306163 - RNA, 14 nt, Mycobacterium tuberculosis H37Rv
gcgcccggccaagc

SEQ ID NO: 1306164 - RNA, 15 nt, Mycobacterium tuberculosis H37Rv
gcgcccgcaccaccg

SEQ ID NO: 1306165 - RNA, 22 nt, Mycobacterium tuberculosis H37Rv
gcgccgaaacagcacccagacg

SEQ ID NO: 1306166 - RNA, 16 nt, Mycobacterium tuberculosis H37Rv
gcgcccuucagcacgg

SEQ ID NO: 1306167 - RNA, 19 nt, Mycobacterium tuberculosis H37Rv
gcgccgacccguaccagcc

SEQ ID NO: 1306168 - RNA, 23 nt, Mycobacterium tuberculosis H37Rv
gcgccgacccgcgcgccggcgac

SEQ ID NO: 1306169 - RNA, 13 nt, Mycobacterium tuberculosis H37Rv
gcgccgacccgcg

SEQ ID NO: 1306170 - RNA, 13 nt, Mycobacterium tuberculosis H37Rv
gcgccgaggucga

SEQ ID NO: 1306171 - RNA, 21 nt, Mycobacterium tuberculosis H37Rv
gcgccgacgaaaucgucgggu

SEQ ID NO: 1306172 - RNA, 17 nt, Mycobacterium tuberculosis H37Rv
gcgccgaucaccaccgg

SEQ ID NO: 1306173 - RNA, 14 nt, Mycobacterium tuberculosis H37Rv
gcgccgaucaccac

SEQ ID NO: 1306174 - RNA, 13 nt, Mycobacterium tuberculosis H37Rv
gcgccgaucagcg

SEQ ID NO: 1306175 - RNA, 20 nt, Mycobacterium tuberculosis H37Rv
gcgccgaugaacguggcgac

SEQ ID NO: 1306176 - RNA, 17 nt, Mycobacterium tuberculosis H37Rv
gcgccgaugaacguggc

SEQ ID NO: 1306177 - RNA, 17 nt, Mycobacterium tuberculosis H37Rv
gcgccgcagaucaccgc

SEQ ID NO: 1306178 - RNA, 21 nt, Mycobacterium tuberculosis H37Rv
gcgccgcagaucaccgccagc

SEQ ID NO: 1306179 - RNA, 19 nt, Mycobacterium tuberculosis H37Rv
gcgccgcagcaggugcauc

SEQ ID NO: 1306180 - RNA, 17 nt, Mycobacterium tuberculosis H37Rv
gcgccgcacggcgacgc

SEQ ID NO: 1306181 - RNA, 14 nt, Mycobacterium tuberculosis H37Rv
gcgccgcacgccga

SEQ ID NO: 1306182 - RNA, 22 nt, Mycobacterium tuberculosis H37Rv
gcgccgcgacaaaucggucgac

SEQ ID NO: 1306183 - RNA, 16 nt, Mycobacterium tuberculosis H37Rv
gcgccgccgucgccgc

SEQ ID NO: 1306184 - RNA, 16 nt, Mycobacterium tuberculosis H37Rv
gcgccgccgucgccgu

SEQ ID NO: 1306185 - RNA, 12 nt, Mycobacterium tuberculosis H37Rv
gcgccgccguug

SEQ ID NO: 1306186 - RNA, 14 nt, Mycobacterium tuberculosis H37Rv
gcgccgccgucgcc

SEQ ID NO: 1306187 - RNA, 16 nt, Mycobacterium tuberculosis H37Rv
gcgccgccggugccac

SEQ ID NO: 1306188 - RNA, 18 nt, Mycobacterium tuberculosis H37Rv
gcgccgcggcggauggcg

SEQ ID NO: 1306189 - RNA, 21 nt, Mycobacterium tuberculosis H37Rv
gcgccgcgcuugcgaucggca

SEQ ID NO: 1306190 - RNA, 13 nt, Mycobacterium tuberculosis H37Rv
gcgccgcgcucga

SEQ ID NO: 1306191 - RNA, 18 nt, Mycobacterium tuberculosis H37Rv
gcgccgcgcucgacgagc

SEQ ID NO: 1306192 - RNA, 17 nt, Mycobacterium tuberculosis H37Rv
gcgccgcgcucgccgau

SEQ ID NO: 1306193 - RNA, 16 nt, Mycobacterium tuberculosis H37Rv
gcgccgcgcuugcgau

SEQ ID NO: 1306194 - RNA, 17 nt, Mycobacterium tuberculosis H37Rv
gcgccgcauaccaguac

SEQ ID NO: 1306195 - RNA, 14 nt, Mycobacterium tuberculosis H37Rv
gcgccgcauccagc

SEQ ID NO: 1306196 - RNA, 14 nt, Mycobacterium tuberculosis H37Rv
gcgccgcaucggcg

SEQ ID NO: 1306197 - RNA, 21 nt, Mycobacterium tuberculosis H37Rv
gcgccgccagguguucgccgg

SEQ ID NO: 1306198 - RNA, 16 nt, Mycobacterium tuberculosis H37Rv
gcgccgccaucacgca

SEQ ID NO: 1306199 - RNA, 20 nt, Mycobacterium tuberculosis H37Rv
gcgccgccccauacuugcgc

SEQ ID NO: 1306200 - RNA, 16 nt, Mycobacterium tuberculosis H37Rv
gcgccgccccgcucgg

SEQ ID NO: 1306201 - RNA, 20 nt, Mycobacterium tuberculosis H37Rv
gcgccgcccgcgccaccagc

SEQ ID NO: 1306202 - RNA, 18 nt, Mycobacterium tuberculosis H37Rv
gcgccgccauugucgcca

SEQ ID NO: 1306203 - RNA, 15 nt, Mycobacterium tuberculosis H37Rv
gcgccgccggcgcgu

SEQ ID NO: 1306204 - RNA, 12 nt, Mycobacterium tuberculosis H37Rv
gcgccgccggca

SEQ ID NO: 1306205 - RNA, 18 nt, Mycobacterium tuberculosis H37Rv
gcgccgccggcaccaccg

SEQ ID NO: 1306206 - RNA, 14 nt, Mycobacterium tuberculosis H37Rv
gcgccgccgccacc

SEQ ID NO: 1306207 - RNA, 13 nt, Mycobacterium tuberculosis H37Rv
gcgccggugccgc

SEQ ID NO: 1306208 - RNA, 23 nt, Mycobacterium tuberculosis H37Rv
gcgccgguuacccggaccgucgu

SEQ ID NO: 1306209 - RNA, 23 nt, Mycobacterium tuberculosis H37Rv
gcgccggugccggccaucgcccg

SEQ ID NO: 1306210 - RNA, 18 nt, Mycobacterium tuberculosis H37Rv
gcgccgguuucgaggcga

SEQ ID NO: 1306211 - RNA, 14 nt, Mycobacterium tuberculosis H37Rv
gcgccguacagcgg

SEQ ID NO: 1306212 - RNA, 22 nt, Mycobacterium tuberculosis H37Rv
gcgccgguuacccggaccgucg

SEQ ID NO: 1306213 - RNA, 22 nt, Mycobacterium tuberculosis H37Rv
gcgccggugccgccuccgccug

SEQ ID NO: 1306214 - RNA, 16 nt, Mycobacterium tuberculosis H37Rv
gcgccggugccggcca

SEQ ID NO: 1306215 - RNA, 13 nt, Mycobacterium tuberculosis H37Rv
gcgccgucgucgc

SEQ ID NO: 1306216 - RNA, 22 nt, Mycobacterium tuberculosis H37Rv
gcgccgucguugugccggucga

SEQ ID NO: 1306217 - RNA, 16 nt, Mycobacterium tuberculosis H37Rv
gcgccgucgucgacca

SEQ ID NO: 1306218 - RNA, 20 nt, Mycobacterium tuberculosis H37Rv
gcgccgucccgaaacgccgg

SEQ ID NO: 1306219 - RNA, 12 nt, Mycobacterium tuberculosis H37Rv
gcgccgucagcc

SEQ ID NO: 1306220 - RNA, 16 nt, Mycobacterium tuberculosis H37Rv
gcgccgucaccgaucg

SEQ ID NO: 1306221 - RNA, 19 nt, Mycobacterium tuberculosis H37Rv
gcgccguagagccgcucgg

SEQ ID NO: 1306222 - RNA, 22 nt, Mycobacterium tuberculosis H37Rv
gcgccguagagccgcucggcgu

SEQ ID NO: 1306223 - RNA, 17 nt, Mycobacterium tuberculosis H37Rv
gcgccggggccgccgau

SEQ ID NO: 1306224 - RNA, 16 nt, Mycobacterium tuberculosis H37Rv
gcgccggggccgccga

SEQ ID NO: 1306225 - RNA, 19 nt, Mycobacterium tuberculosis H37Rv
gcgccggggauaccgguca

SEQ ID NO: 1306226 - RNA, 15 nt, Mycobacterium tuberculosis H37Rv
gcgccggggaccacg

SEQ ID NO: 1306227 - RNA, 21 nt, Mycobacterium tuberculosis H37Rv
gcgccggcgucggucgucggg

SEQ ID NO: 1306228 - RNA, 15 nt, Mycobacterium tuberculosis H37Rv
gcgccgggcucgcga

SEQ ID NO: 1306229 - RNA, 15 nt, Mycobacterium tuberculosis H37Rv
gcgccgggcucggcg

SEQ ID NO: 1306230 - RNA, 21 nt, Mycobacterium tuberculosis H37Rv
gcgccggcgucggcgcccagc

SEQ ID NO: 1306231 - RNA, 15 nt, Mycobacterium tuberculosis H37Rv
gcgccggcggccacc

SEQ ID NO: 1306232 - RNA, 20 nt, Mycobacterium tuberculosis H37Rv
gcgccggcggaccccucgac

SEQ ID NO: 1306233 - RNA, 21 nt, Mycobacterium tuberculosis H37Rv
gcgccggcggaccccucgacc

SEQ ID NO: 1306234 - RNA, 18 nt, Mycobacterium tuberculosis H37Rv
gcgccggcgcgucggcac

SEQ ID NO: 1306235 - RNA, 18 nt, Mycobacterium tuberculosis H37Rv
gcgccggauccacaccga

SEQ ID NO: 1306236 - RNA, 23 nt, Mycobacterium tuberculosis H37Rv
gcgccggagccgcccaagccgcc

SEQ ID NO: 1306237 - RNA, 16 nt, Mycobacterium tuberculosis H37Rv
gcgccggagaucgucg

SEQ ID NO: 1306238 - RNA, 14 nt, Mycobacterium tuberculosis H37Rv
gcgccggaccagcu

SEQ ID NO: 1306239 - RNA, 20 nt, Mycobacterium tuberculosis H37Rv
gcgcacaaacauacgccacc

SEQ ID NO: 1306240 - RNA, 17 nt, Mycobacterium tuberculosis H37Rv
gcgcacaguucgccgga

SEQ ID NO: 1306241 - RNA, 18 nt, Mycobacterium tuberculosis H37Rv
gcgaguuucugcucgacc

SEQ ID NO: 1306242 - RNA, 21 nt, Mycobacterium tuberculosis H37Rv
gcgauauccacaauccgcucg

SEQ ID NO: 1306243 - RNA, 15 nt, Mycobacterium tuberculosis H37Rv
gcgauaggugcucgc

SEQ ID NO: 1306244 - RNA, 14 nt, Mycobacterium tuberculosis H37Rv
gcgauagcggcgcu

SEQ ID NO: 1306245 - RNA, 19 nt, Mycobacterium tuberculosis H37Rv
gcgcacccagcccagccgu

SEQ ID NO: 1306246 - RNA, 20 nt, Mycobacterium tuberculosis H37Rv
gcgcaccggucaacguggau

SEQ ID NO: 1306247 - RNA, 16 nt, Mycobacterium tuberculosis H37Rv
gcgcaccggcgucggc

SEQ ID NO: 1306248 - RNA, 15 nt, Mycobacterium tuberculosis H37Rv
gcgcaccucggcgaa

SEQ ID NO: 1306249 - RNA, 22 nt, Mycobacterium tuberculosis H37Rv
gcgcaccugaucggucaacucg

SEQ ID NO: 1306250 - RNA, 16 nt, Mycobacterium tuberculosis H37Rv
gcgcacggaccaucgc

SEQ ID NO: 1306251 - RNA, 15 nt, Mycobacterium tuberculosis H37Rv
gcgcagaacgaucgc

SEQ ID NO: 1306252 - RNA, 14 nt, Mycobacterium tuberculosis H37Rv
gcgcacggcgucgg

SEQ ID NO: 1306253 - RNA, 18 nt, Mycobacterium tuberculosis H37Rv
gcgcacggcgccgacccg

SEQ ID NO: 1306254 - RNA, 20 nt, Mycobacterium tuberculosis H37Rv
gcgcagagcguuccgcucga

SEQ ID NO: 1306255 - RNA, 16 nt, Mycobacterium tuberculosis H37Rv
gcgcagaacgaucgcg

SEQ ID NO: 1306256 - RNA, 15 nt, Mycobacterium tuberculosis H37Rv
gcgcagauacgcgug

SEQ ID NO: 1306257 - RNA, 15 nt, Mycobacterium tuberculosis H37Rv
gcgcagacaucggag

SEQ ID NO: 1306258 - RNA, 17 nt, Mycobacterium tuberculosis H37Rv
gcgcagauagcgcucga

SEQ ID NO: 1306259 - RNA, 21 nt, Mycobacterium tuberculosis H37Rv
gcgcagaucguccaccgccga

SEQ ID NO: 1306260 - RNA, 20 nt, Mycobacterium tuberculosis H37Rv
gcgcagaugagcgcggcgac

SEQ ID NO: 1306261 - RNA, 14 nt, Mycobacterium tuberculosis H37Rv
gcgcagcacugcgg

SEQ ID NO: 1306262 - RNA, 17 nt, Mycobacterium tuberculosis H37Rv
gcgcagcaccggcucga

SEQ ID NO: 1306263 - RNA, 18 nt, Mycobacterium tuberculosis H37Rv
gcgcagauuugcuccagc

SEQ ID NO: 1306264 - RNA, 20 nt, Mycobacterium tuberculosis H37Rv
gcgcagcauaaagaggucgg

SEQ ID NO: 1306265 - RNA, 20 nt, Mycobacterium tuberculosis H37Rv
gcgcagccgcagccgguuaa

SEQ ID NO: 1306266 - RNA, 20 nt, Mycobacterium tuberculosis H37Rv
gcgcagccuucucgcugacc

SEQ ID NO: 1306267 - RNA, 20 nt, Mycobacterium tuberculosis H37Rv
gcgcagccgggucuacagcg

SEQ ID NO: 1306268 - RNA, 14 nt, Mycobacterium tuberculosis H37Rv
gcgcagccgcucga

SEQ ID NO: 1306269 - RNA, 20 nt, Mycobacterium tuberculosis H37Rv
gcgcagccggcccgucgcgu

SEQ ID NO: 1306270 - RNA, 22 nt, Mycobacterium tuberculosis H37Rv
gcgcagugacgccucgacaccc

SEQ ID NO: 1306271 - RNA, 15 nt, Mycobacterium tuberculosis H37Rv
gcgcagugcaccgcg

SEQ ID NO: 1306272 - RNA, 16 nt, Mycobacterium tuberculosis H37Rv
gcgcagugcaccgcgu

SEQ ID NO: 1306273 - RNA, 16 nt, Mycobacterium tuberculosis H37Rv
gcgcagugacgccucg

SEQ ID NO: 1306274 - RNA, 23 nt, Mycobacterium tuberculosis H37Rv
gcgcaguuggcaccagccgguga

SEQ ID NO: 1306275 - RNA, 16 nt, Mycobacterium tuberculosis H37Rv
gcgcauugcgcuucca

SEQ ID NO: 1306276 - RNA, 14 nt, Mycobacterium tuberculosis H37Rv
gcgcaucgucgaaa

SEQ ID NO: 1306277 - RNA, 17 nt, Mycobacterium tuberculosis H37Rv
gcgccacagcagcguug

SEQ ID NO: 1306278 - RNA, 15 nt, Mycobacterium tuberculosis H37Rv
gcgccacagcagcgu

SEQ ID NO: 1306279 - RNA, 18 nt, Mycobacterium tuberculosis H37Rv
gcgccacccagcaccagg

SEQ ID NO: 1306280 - RNA, 15 nt, Mycobacterium tuberculosis H37Rv
gcgccaccaccggcg

SEQ ID NO: 1306281 - RNA, 15 nt, Mycobacterium tuberculosis H37Rv
gcgccacgucgacgg

SEQ ID NO: 1306282 - RNA, 14 nt, Mycobacterium tuberculosis H37Rv
gcgccacguccauc

SEQ ID NO: 1306283 - RNA, 21 nt, Mycobacterium tuberculosis H37Rv
gcgccaccguuugcgcaccgg

SEQ ID NO: 1306284 - RNA, 13 nt, Mycobacterium tuberculosis H37Rv
gcgccacgguguc

SEQ ID NO: 1306285 - RNA, 20 nt, Mycobacterium tuberculosis H37Rv
gcgccaccguuaccgccguu

SEQ ID NO: 1306286 - RNA, 13 nt, Mycobacterium tuberculosis H37Rv
gcgccaccgccgc

SEQ ID NO: 1306287 - RNA, 21 nt, Mycobacterium tuberculosis H37Rv
gcgccacccgaucgggcguca

SEQ ID NO: 1306288 - RNA, 14 nt, Mycobacterium tuberculosis H37Rv
gcgccaccgaccga

SEQ ID NO: 1306289 - RNA, 16 nt, Mycobacterium tuberculosis H37Rv
gcgcagcucaccgacg

SEQ ID NO: 1306290 - RNA, 13 nt, Mycobacterium tuberculosis H37Rv
gcgcaggccgaca

SEQ ID NO: 1306291 - RNA, 23 nt, Mycobacterium tuberculosis H37Rv
gcgcaggaagcccacgaucgcgu

SEQ ID NO: 1306292 - RNA, 21 nt, Mycobacterium tuberculosis H37Rv
gcgcaggaagcccacgaucgc

SEQ ID NO: 1306293 - RNA, 20 nt, Mycobacterium tuberculosis H37Rv
gcgcaggcuuccagccacag

SEQ ID NO: 1306294 - RNA, 22 nt, Mycobacterium tuberculosis H37Rv
gcgcagguagucgacgacgugg

SEQ ID NO: 1306295 - RNA, 19 nt, Mycobacterium tuberculosis H37Rv
gcgcagguagcgccgcacu

SEQ ID NO: 1306296 - RNA, 15 nt, Mycobacterium tuberculosis H37Rv
gcgcagguacgccuc

SEQ ID NO: 1306297 - RNA, 22 nt, Mycobacterium tuberculosis H37Rv
gcgcaggguucgucgggacgcc

SEQ ID NO: 1306298 - RNA, 21 nt, Mycobacterium tuberculosis H37Rv
gcgcagguaucgguauaacga

SEQ ID NO: 1306299 - RNA, 15 nt, Mycobacterium tuberculosis H37Rv
gcgcagggcgucggc

SEQ ID NO: 1306300 - RNA, 18 nt, Mycobacterium tuberculosis H37Rv
gccggguccgcggagaac

SEQ ID NO: 1306301 - RNA, 16 nt, Mycobacterium tuberculosis H37Rv
gccggggccgccgaug

SEQ ID NO: 1306302 - RNA, 22 nt, Mycobacterium tuberculosis H37Rv
gccgggguaggggucgaggucu

SEQ ID NO: 1306303 - RNA, 21 nt, Mycobacterium tuberculosis H37Rv
gccgggugcgcacccgggugc

SEQ ID NO: 1306304 - RNA, 23 nt, Mycobacterium tuberculosis H37Rv
gccgguacacguccaguggcagc

SEQ ID NO: 1306305 - RNA, 14 nt, Mycobacterium tuberculosis H37Rv
gccgggugcaggcg

SEQ ID NO: 1306306 - RNA, 14 nt, Mycobacterium tuberculosis H37Rv
gccgggucggugac

SEQ ID NO: 1306307 - RNA, 19 nt, Mycobacterium tuberculosis H37Rv
gccgggugaggcgggucgc

SEQ ID NO: 1306308 - RNA, 13 nt, Mycobacterium tuberculosis H37Rv
gccgguagccggg

SEQ ID NO: 1306309 - RNA, 13 nt, Mycobacterium tuberculosis H37Rv
gccggucggaucg

SEQ ID NO: 1306310 - RNA, 18 nt, Mycobacterium tuberculosis H37Rv
gccggucaguauggcgac

SEQ ID NO: 1306311 - RNA, 22 nt, Mycobacterium tuberculosis H37Rv
gccggucaugauccgaacuucg

SEQ ID NO: 1306312 - RNA, 20 nt, Mycobacterium tuberculosis H37Rv
gccggucauuucaacguauc

SEQ ID NO: 1306313 - RNA, 20 nt, Mycobacterium tuberculosis H37Rv
gccgguagcugucgccuuug

SEQ ID NO: 1306314 - RNA, 16 nt, Mycobacterium tuberculosis H37Rv
gccgguucccgaucag

SEQ ID NO: 1306315 - RNA, 19 nt, Mycobacterium tuberculosis H37Rv
gccgguucccgaucaggcg

SEQ ID NO: 1306316 - RNA, 20 nt, Mycobacterium tuberculosis H37Rv
gccgguucccgaucaggcgg

SEQ ID NO: 1306317 - RNA, 14 nt, Mycobacterium tuberculosis H37Rv
gccgguucggcgau

SEQ ID NO: 1306318 - RNA, 21 nt, Mycobacterium tuberculosis H37Rv
gccggugcgaauggugcaacg

SEQ ID NO: 1306319 - RNA, 21 nt, Mycobacterium tuberculosis H37Rv
gccgguguguccagcggaucg

SEQ ID NO: 1306320 - RNA, 15 nt, Mycobacterium tuberculosis H37Rv
gccgguguguccagc

SEQ ID NO: 1306321 - RNA, 17 nt, Mycobacterium tuberculosis H37Rv
gccggugugcggcguac

SEQ ID NO: 1306322 - RNA, 15 nt, Mycobacterium tuberculosis H37Rv
gccggugugcgccaa

SEQ ID NO: 1306323 - RNA, 16 nt, Mycobacterium tuberculosis H37Rv
gccggugccgaucagc

SEQ ID NO: 1306324 - RNA, 17 nt, Mycobacterium tuberculosis H37Rv
gccggugccgacggcgc

SEQ ID NO: 1306325 - RNA, 19 nt, Mycobacterium tuberculosis H37Rv
gccggugccgccggugccg

SEQ ID NO: 1306326 - RNA, 16 nt, Mycobacterium tuberculosis H37Rv
gccggugccggcgcac

SEQ ID NO: 1306327 - RNA, 21 nt, Mycobacterium tuberculosis H37Rv
gccggucgucgcgcaguucca

SEQ ID NO: 1306328 - RNA, 19 nt, Mycobacterium tuberculosis H37Rv
gccguacaucagcgcgaac

SEQ ID NO: 1306329 - RNA, 15 nt, Mycobacterium tuberculosis H37Rv
gccguacagcgcaaa

SEQ ID NO: 1306330 - RNA, 23 nt, Mycobacterium tuberculosis H37Rv
gccguacacaccgagcaccucgg

SEQ ID NO: 1306331 - RNA, 17 nt, Mycobacterium tuberculosis H37Rv
gccguagcccacgacga

SEQ ID NO: 1306332 - RNA, 18 nt, Mycobacterium tuberculosis H37Rv
gccguagcccacgacgaa

SEQ ID NO: 1306333 - RNA, 21 nt, Mycobacterium tuberculosis H37Rv
gccgguucccuuguucccgaa

SEQ ID NO: 1306334 - RNA, 21 nt, Mycobacterium tuberculosis H37Rv
gccguaaagccaacuggucgc

SEQ ID NO: 1306335 - RNA, 14 nt, Mycobacterium tuberculosis H37Rv
gccgguugccaccu

SEQ ID NO: 1306336 - RNA, 17 nt, Mycobacterium tuberculosis H37Rv
gccgguuccucagcggc

SEQ ID NO: 1306337 - RNA, 23 nt, Mycobacterium tuberculosis H37Rv
gccgguucgcccagcaggcccuu

SEQ ID NO: 1306338 - RNA, 19 nt, Mycobacterium tuberculosis H37Rv
gccggcguagcggcgauac

SEQ ID NO: 1306339 - RNA, 18 nt, Mycobacterium tuberculosis H37Rv
gccggcguaggcaggauc

SEQ ID NO: 1306340 - RNA, 17 nt, Mycobacterium tuberculosis H37Rv
gccggcguagcggcgau

SEQ ID NO: 1306341 - RNA, 19 nt, Mycobacterium tuberculosis H37Rv
gccggcguagaucaucagc

SEQ ID NO: 1306342 - RNA, 19 nt, Mycobacterium tuberculosis H37Rv
gccggcgguguuggcgcca

SEQ ID NO: 1306343 - RNA, 21 nt, Mycobacterium tuberculosis H37Rv
gccggcgguguuggcgccagc

SEQ ID NO: 1306344 - RNA, 20 nt, Mycobacterium tuberculosis H37Rv
gccgcugauguacccggcga

SEQ ID NO: 1306345 - RNA, 16 nt, Mycobacterium tuberculosis H37Rv
gccgcugaucgccgac

SEQ ID NO: 1306346 - RNA, 14 nt, Mycobacterium tuberculosis H37Rv
gccgcugaucaaca

SEQ ID NO: 1306347 - RNA, 17 nt, Mycobacterium tuberculosis H37Rv
gccgcucgggccagcga

SEQ ID NO: 1306348 - RNA, 22 nt, Mycobacterium tuberculosis H37Rv
gccggcuaccgccuugucggcg

SEQ ID NO: 1306349 - RNA, 12 nt, Mycobacterium tuberculosis H37Rv
gccggcuagggc

SEQ ID NO: 1306350 - RNA, 21 nt, Mycobacterium tuberculosis H37Rv
gccggcuagauaacccaaccg

SEQ ID NO: 1306351 - RNA, 18 nt, Mycobacterium tuberculosis H37Rv
gccggcucaucgcagccg

SEQ ID NO: 1306352 - RNA, 22 nt, Mycobacterium tuberculosis H37Rv
gccggcguugccgaaacccgag

SEQ ID NO: 1306353 - RNA, 13 nt, Mycobacterium tuberculosis H37Rv
gccggcgucgaug

SEQ ID NO: 1306354 - RNA, 12 nt, Mycobacterium tuberculosis H37Rv
gccggcgucgag

SEQ ID NO: 1306355 - RNA, 15 nt, Mycobacterium tuberculosis H37Rv
gccggcgucgagccg

SEQ ID NO: 1306356 - RNA, 18 nt, Mycobacterium tuberculosis H37Rv
gccgggaauuucgacacg

SEQ ID NO: 1306357 - RNA, 17 nt, Mycobacterium tuberculosis H37Rv
gccgggaguguguccga

SEQ ID NO: 1306358 - RNA, 15 nt, Mycobacterium tuberculosis H37Rv
gccgggagggguuca

SEQ ID NO: 1306359 - RNA, 23 nt, Mycobacterium tuberculosis H37Rv
gccggcuugcagugaggucaucg

SEQ ID NO: 1306360 - RNA, 15 nt, Mycobacterium tuberculosis H37Rv
gccggcuucgcccag

SEQ ID NO: 1306361 - RNA, 16 nt, Mycobacterium tuberculosis H37Rv
gccggcuucggugagc

SEQ ID NO: 1306362 - RNA, 21 nt, Mycobacterium tuberculosis H37Rv
gccgggaaacaccggcuuggu

SEQ ID NO: 1306363 - RNA, 14 nt, Mycobacterium tuberculosis H37Rv
gccgggaaccucgc

SEQ ID NO: 1306364 - RNA, 19 nt, Mycobacterium tuberculosis H37Rv
gccggcuugucgaccacga

SEQ ID NO: 1306365 - RNA, 18 nt, Mycobacterium tuberculosis H37Rv
gccggcuugucgaccacg

SEQ ID NO: 1306366 - RNA, 17 nt, Mycobacterium tuberculosis H37Rv
gccggcuugucgaccac

SEQ ID NO: 1306367 - RNA, 17 nt, Mycobacterium tuberculosis H37Rv
gccgggcagucaggccu

SEQ ID NO: 1306368 - RNA, 18 nt, Mycobacterium tuberculosis H37Rv
gccgggccacggcugacc

SEQ ID NO: 1306369 - RNA, 20 nt, Mycobacterium tuberculosis H37Rv
gccgggcaguguggucauug

SEQ ID NO: 1306370 - RNA, 16 nt, Mycobacterium tuberculosis H37Rv
gccgggccgccgagcg

SEQ ID NO: 1306371 - RNA, 15 nt, Mycobacterium tuberculosis H37Rv
gccgggccaggccga

SEQ ID NO: 1306372 - RNA, 18 nt, Mycobacterium tuberculosis H37Rv
gccgggcgaguacaggcg

SEQ ID NO: 1306373 - RNA, 17 nt, Mycobacterium tuberculosis H37Rv
gccgggcuuguagacgc

SEQ ID NO: 1306374 - RNA, 23 nt, Mycobacterium tuberculosis H37Rv
gccgggcuuguagacgccaugca

SEQ ID NO: 1306375 - RNA, 16 nt, Mycobacterium tuberculosis H37Rv
gccgggcucgcgaucg

SEQ ID NO: 1306376 - RNA, 21 nt, Mycobacterium tuberculosis H37Rv
gccgggcucgcgaucgucacg

SEQ ID NO: 1306377 - RNA, 20 nt, Mycobacterium tuberculosis H37Rv
gccgggcucagcugggccgc

SEQ ID NO: 1306378 - RNA, 15 nt, Mycobacterium tuberculosis H37Rv
gccguuggugccgcc

SEQ ID NO: 1306379 - RNA, 23 nt, Mycobacterium tuberculosis H37Rv
gccguuggugccgccugugccac

SEQ ID NO: 1306380 - RNA, 18 nt, Mycobacterium tuberculosis H37Rv
gccguuguagacggcggc

SEQ ID NO: 1306381 - RNA, 20 nt, Mycobacterium tuberculosis H37Rv
gccguuccggcugcuuuaac

SEQ ID NO: 1306382 - RNA, 16 nt, Mycobacterium tuberculosis H37Rv
gccguuccguaucggg

SEQ ID NO: 1306383 - RNA, 14 nt, Mycobacterium tuberculosis H37Rv
gccguucggcaucu

SEQ ID NO: 1306384 - RNA, 19 nt, Mycobacterium tuberculosis H37Rv
gccguucggggcgcgguac

SEQ ID NO: 1306385 - RNA, 13 nt, Mycobacterium tuberculosis H37Rv
gccguggcaucgc

SEQ ID NO: 1306386 - RNA, 17 nt, Mycobacterium tuberculosis H37Rv
gccguggcagucgcacg

SEQ ID NO: 1306387 - RNA, 19 nt, Mycobacterium tuberculosis H37Rv
gccgugcccggugcggugc

SEQ ID NO: 1306388 - RNA, 20 nt, Mycobacterium tuberculosis H37Rv
gccgugugcaucggcgaccg

SEQ ID NO: 1306389 - RNA, 13 nt, Mycobacterium tuberculosis H37Rv
gccguguucgggg

SEQ ID NO: 1306390 - RNA, 21 nt, Mycobacterium tuberculosis H37Rv
gccguguucgggggcggucgc

SEQ ID NO: 1306391 - RNA, 17 nt, Mycobacterium tuberculosis H37Rv
gccguuaccgagcccga

SEQ ID NO: 1306392 - RNA, 21 nt, Mycobacterium tuberculosis H37Rv
gccguuaccgccaaacgcugc

SEQ ID NO: 1306393 - RNA, 17 nt, Mycobacterium tuberculosis H37Rv
gccguggcgucggcguc

SEQ ID NO: 1306394 - RNA, 16 nt, Mycobacterium tuberculosis H37Rv
gccguggcgucggcgu

SEQ ID NO: 1306395 - RNA, 18 nt, Mycobacterium tuberculosis H37Rv
gccgugucgggcgcgaaa

SEQ ID NO: 1306396 - RNA, 20 nt, Mycobacterium tuberculosis H37Rv
gccguggcgaaugacggcca

SEQ ID NO: 1306397 - RNA, 18 nt, Mycobacterium tuberculosis H37Rv
gccguggcauguugcgga

SEQ ID NO: 1306398 - RNA, 22 nt, Mycobacterium tuberculosis H37Rv
gccgucaccgaucgaacagugc

SEQ ID NO: 1306399 - RNA, 21 nt, Mycobacterium tuberculosis H37Rv
gccgucaccgccguugccgcc

SEQ ID NO: 1306400 - RNA, 21 nt, Mycobacterium tuberculosis H37Rv
gccgucaccgccguugccgau

SEQ ID NO: 1306401 - RNA, 19 nt, Mycobacterium tuberculosis H37Rv
gccgucaccgccgaccagg

SEQ ID NO: 1306402 - RNA, 20 nt, Mycobacterium tuberculosis H37Rv
gccgucaccgccgaccaggc

SEQ ID NO: 1306403 - RNA, 20 nt, Mycobacterium tuberculosis H37Rv
gccgucacggcaguacccca

SEQ ID NO: 1306404 - RNA, 15 nt, Mycobacterium tuberculosis H37Rv
gccgucaccggucgg

SEQ ID NO: 1306405 - RNA, 22 nt, Mycobacterium tuberculosis H37Rv
gccgucgagcucccacaggacc

SEQ ID NO: 1306406 - RNA, 15 nt, Mycobacterium tuberculosis H37Rv
gccgucgagcacggu

SEQ ID NO: 1306407 - RNA, 16 nt, Mycobacterium tuberculosis H37Rv
gccgucaccggucggc

SEQ ID NO: 1306408 - RNA, 21 nt, Mycobacterium tuberculosis H37Rv
gccgucgacgucgauggugcg

SEQ ID NO: 1306409 - RNA, 14 nt, Mycobacterium tuberculosis H37Rv
gccgucggacaccg

SEQ ID NO: 1306410 - RNA, 13 nt, Mycobacterium tuberculosis H37Rv
gccgucgcggcac

SEQ ID NO: 1306411 - RNA, 16 nt, Mycobacterium tuberculosis H37Rv
gccgucgccugcaagc

SEQ ID NO: 1306412 - RNA, 21 nt, Mycobacterium tuberculosis H37Rv
gccgucgaguccaggccggca

SEQ ID NO: 1306413 - RNA, 12 nt, Mycobacterium tuberculosis H37Rv
gccgucgcagcc

SEQ ID NO: 1306414 - RNA, 23 nt, Mycobacterium tuberculosis H37Rv
gccgucgauguugcccagcauga

SEQ ID NO: 1306415 - RNA, 16 nt, Mycobacterium tuberculosis H37Rv
gccgucgcaccagauc

SEQ ID NO: 1306416 - RNA, 13 nt, Mycobacterium tuberculosis H37Rv
gccgucgaucccg

SEQ ID NO: 1306417 - RNA, 19 nt, Mycobacterium tuberculosis H37Rv
gccgugaugauguccgggu

SEQ ID NO: 1306418 - RNA, 20 nt, Mycobacterium tuberculosis H37Rv
gccgugaugucccgcaaaau

SEQ ID NO: 1306419 - RNA, 19 nt, Mycobacterium tuberculosis H37Rv
gccgucucgcggugcggca

SEQ ID NO: 1306420 - RNA, 19 nt, Mycobacterium tuberculosis H37Rv
gccgucuccuggucaaccg

SEQ ID NO: 1306421 - RNA, 13 nt, Mycobacterium tuberculosis H37Rv
gccgucgcgcgac

SEQ ID NO: 1306422 - RNA, 12 nt, Mycobacterium tuberculosis H37Rv
gccgucucggca

SEQ ID NO: 1306423 - RNA, 21 nt, Mycobacterium tuberculosis H37Rv
gccgucgugccaccguugggc

SEQ ID NO: 1306424 - RNA, 15 nt, Mycobacterium tuberculosis H37Rv
gccgucgugccaccg

SEQ ID NO: 1306425 - RNA, 22 nt, Mycobacterium tuberculosis H37Rv
gccgucgugugacacaacgauc

SEQ ID NO: 1306426 - RNA, 16 nt, Mycobacterium tuberculosis H37Rv
gccgucggcgcugcgc

SEQ ID NO: 1306427 - RNA, 14 nt, Mycobacterium tuberculosis H37Rv
gccgucgugccacc

SEQ ID NO: 1306428 - RNA, 12 nt, Mycobacterium tuberculosis H37Rv
gccgucggcgcu

SEQ ID NO: 1306429 - RNA, 18 nt, Mycobacterium tuberculosis H37Rv
gccgucggcgagcagacg

SEQ ID NO: 1306430 - RNA, 12 nt, Mycobacterium tuberculosis H37Rv
gccgucggcgaa

SEQ ID NO: 1306431 - RNA, 15 nt, Mycobacterium tuberculosis H37Rv
gccgucggcgcgcac

SEQ ID NO: 1306432 - RNA, 16 nt, Mycobacterium tuberculosis H37Rv
gccgucggccggcaac

SEQ ID NO: 1306433 - RNA, 17 nt, Mycobacterium tuberculosis H37Rv
gccgucggccucggcgg

SEQ ID NO: 1306434 - RNA, 21 nt, Mycobacterium tuberculosis H37Rv
gccucuagcuugacaacccug

SEQ ID NO: 1306435 - RNA, 20 nt, Mycobacterium tuberculosis H37Rv
gccucugaccagccggucuu

SEQ ID NO: 1306436 - RNA, 14 nt, Mycobacterium tuberculosis H37Rv
gccucugaccagcc

SEQ ID NO: 1306437 - RNA, 18 nt, Mycobacterium tuberculosis H37Rv
gccucuggaucacgucga

SEQ ID NO: 1306438 - RNA, 21 nt, Mycobacterium tuberculosis H37Rv
gccugaaacgauugcugcggc

SEQ ID NO: 1306439 - RNA, 13 nt, Mycobacterium tuberculosis H37Rv
gccugaaccacgc

SEQ ID NO: 1306440 - RNA, 16 nt, Mycobacterium tuberculosis H37Rv
gccucguccagcucgg

SEQ ID NO: 1306441 - RNA, 18 nt, Mycobacterium tuberculosis H37Rv
gccucgucgccgcgguag

SEQ ID NO: 1306442 - RNA, 19 nt, Mycobacterium tuberculosis H37Rv
gccucgguggucuuggccc

SEQ ID NO: 1306443 - RNA, 19 nt, Mycobacterium tuberculosis H37Rv
gccucgccggccgccagcc

SEQ ID NO: 1306444 - RNA, 16 nt, Mycobacterium tuberculosis H37Rv
gccucgccauccauga

SEQ ID NO: 1306445 - RNA, 19 nt, Mycobacterium tuberculosis H37Rv
gccucgccgaaguggucuc

SEQ ID NO: 1306446 - RNA, 16 nt, Mycobacterium tuberculosis H37Rv
gccucgcagcgacacg

SEQ ID NO: 1306447 - RNA, 17 nt, Mycobacterium tuberculosis H37Rv
gccuaggucgacgccga

SEQ ID NO: 1306448 - RNA, 20 nt, Mycobacterium tuberculosis H37Rv
gccuaggucgacgccgacca

SEQ ID NO: 1306449 - RNA, 14 nt, Mycobacterium tuberculosis H37Rv
gccuaguacgccga

SEQ ID NO: 1306450 - RNA, 15 nt, Mycobacterium tuberculosis H37Rv
gccuaguacgccgag

SEQ ID NO: 1306451 - RNA, 16 nt, Mycobacterium tuberculosis H37Rv
gccucagaaccggguc

SEQ ID NO: 1306452 - RNA, 17 nt, Mycobacterium tuberculosis H37Rv
gccucagcccggccagc

SEQ ID NO: 1306453 - RNA, 15 nt, Mycobacterium tuberculosis H37Rv
gccucaagcucgccg

SEQ ID NO: 1306454 - RNA, 18 nt, Mycobacterium tuberculosis H37Rv
gccucagcccggccagcc

SEQ ID NO: 1306455 - RNA, 16 nt, Mycobacterium tuberculosis H37Rv
gccucagcccgucagc

SEQ ID NO: 1306456 - RNA, 19 nt, Mycobacterium tuberculosis H37Rv
gccucauccaccgauggcg

SEQ ID NO: 1306457 - RNA, 12 nt, Mycobacterium tuberculosis H37Rv
gccuccaccgcg

SEQ ID NO: 1306458 - RNA, 12 nt, Mycobacterium tuberculosis H37Rv
gccuccaccagg

SEQ ID NO: 1306459 - RNA, 16 nt, Mycobacterium tuberculosis H37Rv
gccuccgccugcccca

SEQ ID NO: 1306460 - RNA, 22 nt, Mycobacterium tuberculosis H37Rv
gccuccgaggaauacagcuuga

SEQ ID NO: 1306461 - RNA, 19 nt, Mycobacterium tuberculosis H37Rv
gccuccaucgcgacaucgg

SEQ ID NO: 1306462 - RNA, 20 nt, Mycobacterium tuberculosis H37Rv
gccuccauuucgucggagaa

SEQ ID NO: 1306463 - RNA, 16 nt, Mycobacterium tuberculosis H37Rv
gccuccguugccccca

SEQ ID NO: 1306464 - RNA, 15 nt, Mycobacterium tuberculosis H37Rv
gccuccgcugccgcc

SEQ ID NO: 1306465 - RNA, 20 nt, Mycobacterium tuberculosis H37Rv
gccuccggauccucggccgc

SEQ ID NO: 1306466 - RNA, 14 nt, Mycobacterium tuberculosis H37Rv
gccuccuccccgac

SEQ ID NO: 1306467 - RNA, 14 nt, Mycobacterium tuberculosis H37Rv
gcgacgaccgucgg

SEQ ID NO: 1306468 - RNA, 13 nt, Mycobacterium tuberculosis H37Rv
gcgacgacgccaa

SEQ ID NO: 1306469 - RNA, 16 nt, Mycobacterium tuberculosis H37Rv
gcgaccuggucgaacu

SEQ ID NO: 1306470 - RNA, 17 nt, Mycobacterium tuberculosis H37Rv
gcgacgacgacaccgcg

SEQ ID NO: 1306471 - RNA, 16 nt, Mycobacterium tuberculosis H37Rv
gcgacgacgcccacca

SEQ ID NO: 1306472 - RNA, 15 nt, Mycobacterium tuberculosis H37Rv
gcgacgagcccaccg

SEQ ID NO: 1306473 - RNA, 20 nt, Mycobacterium tuberculosis H37Rv
gcgacgaggcaaugcgagca

SEQ ID NO: 1306474 - RNA, 12 nt, Mycobacterium tuberculosis H37Rv
aagcccggucgc

SEQ ID NO: 1306475 - RNA, 21 nt, Mycobacterium tuberculosis H37Rv
gcgaccagcucagcugcggau

SEQ ID NO: 1306476 - RNA, 14 nt, Mycobacterium tuberculosis H37Rv
gcgaccagcucagc

SEQ ID NO: 1306477 - RNA, 16 nt, Mycobacterium tuberculosis H37Rv
gcgaccagugguggcc

SEQ ID NO: 1306478 - RNA, 18 nt, Mycobacterium tuberculosis H37Rv
gcgaccaggcgcggcgac

SEQ ID NO: 1306479 - RNA, 16 nt, Mycobacterium tuberculosis H37Rv
gcgaccaucucgacgu

SEQ ID NO: 1306480 - RNA, 18 nt, Mycobacterium tuberculosis H37Rv
gcgaccagugguggccga

SEQ ID NO: 1306481 - RNA, 20 nt, Mycobacterium tuberculosis H37Rv
gcgacccggcccagcgcccc

SEQ ID NO: 1306482 - RNA, 19 nt, Mycobacterium tuberculosis H37Rv
gcgacccggcccagcgccc

SEQ ID NO: 1306483 - RNA, 16 nt, Mycobacterium tuberculosis H37Rv
gcgacccggcccagcg

SEQ ID NO: 1306484 - RNA, 15 nt, Mycobacterium tuberculosis H37Rv
gcgacccgcagaccg

SEQ ID NO: 1306485 - RNA, 21 nt, Mycobacterium tuberculosis H37Rv
gcgaccaucuuaacgucggca

SEQ ID NO: 1306486 - RNA, 19 nt, Mycobacterium tuberculosis H37Rv
gcgaccauauucagcucgg

SEQ ID NO: 1306487 - RNA, 15 nt, Mycobacterium tuberculosis H37Rv
gcgacccggccagcg

SEQ ID NO: 1306488 - RNA, 13 nt, Mycobacterium tuberculosis H37Rv
gcgaccggcguaa

SEQ ID NO: 1306489 - RNA, 17 nt, Mycobacterium tuberculosis H37Rv
gcgaccgcgggccgacg

SEQ ID NO: 1306490 - RNA, 14 nt, Mycobacterium tuberculosis H37Rv
gcgaccgaccagcc

SEQ ID NO: 1306491 - RNA, 16 nt, Mycobacterium tuberculosis H37Rv
gcgaccgcgagggcca

SEQ ID NO: 1306492 - RNA, 14 nt, Mycobacterium tuberculosis H37Rv
gcgaccgcgauccc

SEQ ID NO: 1306493 - RNA, 12 nt, Mycobacterium tuberculosis H37Rv
gcgacccgucga

SEQ ID NO: 1306494 - RNA, 21 nt, Mycobacterium tuberculosis H37Rv
gcgacccggguagacaccgcg

SEQ ID NO: 1306495 - RNA, 19 nt, Mycobacterium tuberculosis H37Rv
gcgacccggguagacaccg

SEQ ID NO: 1306496 - RNA, 13 nt, Mycobacterium tuberculosis H37Rv
gcgaccacgcacc

SEQ ID NO: 1306497 - RNA, 15 nt, Mycobacterium tuberculosis H37Rv
gcgaccacgcaccgc

SEQ ID NO: 1306498 - RNA, 19 nt, Mycobacterium tuberculosis H37Rv
gcgacaugaucugccaccg

SEQ ID NO: 1306499 - RNA, 18 nt, Mycobacterium tuberculosis H37Rv
aagcccgauucagcgccc

SEQ ID NO: 1306500 - RNA, 15 nt, Mycobacterium tuberculosis H37Rv
aagcccccgcacgca

SEQ ID NO: 1306501 - RNA, 15 nt, Mycobacterium tuberculosis H37Rv
aagcccccgcacgcu

SEQ ID NO: 1306502 - RNA, 20 nt, Mycobacterium tuberculosis H37Rv
aagcccccgcacgcucggcg

SEQ ID NO: 1306503 - RNA, 17 nt, Mycobacterium tuberculosis H37Rv
gcgaaugugaucacccg

SEQ ID NO: 1306504 - RNA, 19 nt, Mycobacterium tuberculosis H37Rv
gcgaauugcaggacgcggg

SEQ ID NO: 1306505 - RNA, 18 nt, Mycobacterium tuberculosis H37Rv
gcgacaacaccacggugc

SEQ ID NO: 1306506 - RNA, 17 nt, Mycobacterium tuberculosis H37Rv
gcgacaaaucggucgac

SEQ ID NO: 1306507 - RNA, 21 nt, Mycobacterium tuberculosis H37Rv
gcgacaacagcacguacugcu

SEQ ID NO: 1306508 - RNA, 21 nt, Mycobacterium tuberculosis H37Rv
gcgacaaacguguugaccggg

SEQ ID NO: 1306509 - RNA, 16 nt, Mycobacterium tuberculosis H37Rv
gcgacaaggucgucga

SEQ ID NO: 1306510 - RNA, 16 nt, Mycobacterium tuberculosis H37Rv
gcgacacgccagccgu

SEQ ID NO: 1306511 - RNA, 19 nt, Mycobacterium tuberculosis H37Rv
gcgacacgccggcgggcug

SEQ ID NO: 1306512 - RNA, 13 nt, Mycobacterium tuberculosis H37Rv
gcgacaacccggc

SEQ ID NO: 1306513 - RNA, 20 nt, Mycobacterium tuberculosis H37Rv
gcgaaugcauuggcggugcg

SEQ ID NO: 1306514 - RNA, 23 nt, Mycobacterium tuberculosis H37Rv
gcgaaucuuugguagucugcacg

SEQ ID NO: 1306515 - RNA, 14 nt, Mycobacterium tuberculosis H37Rv
gcgaaugucgccgc

SEQ ID NO: 1306516 - RNA, 22 nt, Mycobacterium tuberculosis H37Rv
gcgaaucggcccgugccacagc

SEQ ID NO: 1306517 - RNA, 21 nt, Mycobacterium tuberculosis H37Rv
gcgaaucggcccgugccacag

SEQ ID NO: 1306518 - RNA, 15 nt, Mycobacterium tuberculosis H37Rv
gcgaaucgguggucg

SEQ ID NO: 1306519 - RNA, 17 nt, Mycobacterium tuberculosis H37Rv
gcgacuuggcaucgcga

SEQ ID NO: 1306520 - RNA, 17 nt, Mycobacterium tuberculosis H37Rv
gcgacuuggugacaccg

SEQ ID NO: 1306521 - RNA, 18 nt, Mycobacterium tuberculosis H37Rv
gcgacuuucugcgcgugg

SEQ ID NO: 1306522 - RNA, 18 nt, Mycobacterium tuberculosis H37Rv
gcgagaacccacgcaugc

SEQ ID NO: 1306523 - RNA, 19 nt, Mycobacterium tuberculosis H37Rv
gcgagaaucacggucaucu

SEQ ID NO: 1306524 - RNA, 14 nt, Mycobacterium tuberculosis H37Rv
gcgagaaucccggg

SEQ ID NO: 1306525 - RNA, 13 nt, Mycobacterium tuberculosis H37Rv
gcgagaagcaggg

SEQ ID NO: 1306526 - RNA, 15 nt, Mycobacterium tuberculosis H37Rv
gcgagaaggugcugc

SEQ ID NO: 1306527 - RNA, 18 nt, Mycobacterium tuberculosis H37Rv
gcgacucugcgucugcuc

SEQ ID NO: 1306528 - RNA, 14 nt, Mycobacterium tuberculosis H37Rv
gcgacugagaucgc

SEQ ID NO: 1306529 - RNA, 13 nt, Mycobacterium tuberculosis H37Rv
gcgacucggugcg

SEQ ID NO: 1306530 - RNA, 21 nt, Mycobacterium tuberculosis H37Rv
gcgacucgccggcgaauccgc

SEQ ID NO: 1306531 - RNA, 20 nt, Mycobacterium tuberculosis H37Rv
gcgacucgaggaccugcucg

SEQ ID NO: 1306532 - RNA, 16 nt, Mycobacterium tuberculosis H37Rv
gcgacgucaucgccga

SEQ ID NO: 1306533 - RNA, 19 nt, Mycobacterium tuberculosis H37Rv
gcgacgcggaguccgucga

SEQ ID NO: 1306534 - RNA, 14 nt, Mycobacterium tuberculosis H37Rv
gcgacgcggccagc

SEQ ID NO: 1306535 - RNA, 14 nt, Mycobacterium tuberculosis H37Rv
gcgacgcgaccgcg

SEQ ID NO: 1306536 - RNA, 13 nt, Mycobacterium tuberculosis H37Rv
gcgacgcugacac

SEQ ID NO: 1306537 - RNA, 15 nt, Mycobacterium tuberculosis H37Rv
gcgacgcggucaucg

SEQ ID NO: 1306538 - RNA, 14 nt, Mycobacterium tuberculosis H37Rv
gcgacgcucgcugc

SEQ ID NO: 1306539 - RNA, 22 nt, Mycobacterium tuberculosis H37Rv
gcgacgcguagcacggcgaucc

SEQ ID NO: 1306540 - RNA, 16 nt, Mycobacterium tuberculosis H37Rv
gcgacguccaccagcc

SEQ ID NO: 1306541 - RNA, 18 nt, Mycobacterium tuberculosis H37Rv
gcgacguagacgacgucg

SEQ ID NO: 1306542 - RNA, 22 nt, Mycobacterium tuberculosis H37Rv
gcgacggugagggcgucgucga

SEQ ID NO: 1306543 - RNA, 19 nt, Mycobacterium tuberculosis H37Rv
gcgacggucgugaucggcg

SEQ ID NO: 1306544 - RNA, 21 nt, Mycobacterium tuberculosis H37Rv
gcgagcacccguugaucgcgg

SEQ ID NO: 1306545 - RNA, 21 nt, Mycobacterium tuberculosis H37Rv
gcgagcagacacagaaucgcc

SEQ ID NO: 1306546 - RNA, 14 nt, Mycobacterium tuberculosis H37Rv
gcgagcaacacgag

SEQ ID NO: 1306547 - RNA, 18 nt, Mycobacterium tuberculosis H37Rv
gcgagcaacucguccagc

SEQ ID NO: 1306548 - RNA, 20 nt, Mycobacterium tuberculosis H37Rv
gcgagcgccuuucggucacg

SEQ ID NO: 1306549 - RNA, 13 nt, Mycobacterium tuberculosis H37Rv
gcgagcgcgcgua

SEQ ID NO: 1306550 - RNA, 16 nt, Mycobacterium tuberculosis H37Rv
gcgagcgcgcguagcg

SEQ ID NO: 1306551 - RNA, 19 nt, Mycobacterium tuberculosis H37Rv
gcgagcggauccgugucgc

SEQ ID NO: 1306552 - RNA, 11 nt, Mycobacterium tuberculosis H37Rv
gcgagcgcggc

SEQ ID NO: 1306553 - RNA, 21 nt, Mycobacterium tuberculosis H37Rv
gcgagcagacgcaaaaucgca

SEQ ID NO: 1306554 - RNA, 20 nt, Mycobacterium tuberculosis H37Rv
gcgagcagacgcaaaaucgc

SEQ ID NO: 1306555 - RNA, 21 nt, Mycobacterium tuberculosis H37Rv
gcgagcagacgcagaaucgca

SEQ ID NO: 1306556 - RNA, 22 nt, Mycobacterium tuberculosis H37Rv
gcgagcucaacacgagcgguac

SEQ ID NO: 1306557 - RNA, 18 nt, Mycobacterium tuberculosis H37Rv
gcgagcgggugcgucgau

SEQ ID NO: 1306558 - RNA, 14 nt, Mycobacterium tuberculosis H37Rv
gcgagcggucgacg

SEQ ID NO: 1306559 - RNA, 15 nt, Mycobacterium tuberculosis H37Rv
gcgagcggucgacgu

SEQ ID NO: 1306560 - RNA, 22 nt, Mycobacterium tuberculosis H37Rv
gcgagcggcgaacucgggcgac

SEQ ID NO: 1306561 - RNA, 17 nt, Mycobacterium tuberculosis H37Rv
gcgagcuguaggucagc

SEQ ID NO: 1306562 - RNA, 21 nt, Mycobacterium tuberculosis H37Rv
gcgagcugcgggucgcguuuc

SEQ ID NO: 1306563 - RNA, 18 nt, Mycobacterium tuberculosis H37Rv
gcgagcugcgggucgcgu

SEQ ID NO: 1306564 - RNA, 22 nt, Mycobacterium tuberculosis H37Rv
gcgagcuggcguucccgcucgg

SEQ ID NO: 1306565 - RNA, 21 nt, Mycobacterium tuberculosis H37Rv
gcgaggcgcucgagugcguug

SEQ ID NO: 1306566 - RNA, 21 nt, Mycobacterium tuberculosis H37Rv
gcgagggccaguguugcggac

SEQ ID NO: 1306567 - RNA, 12 nt, Mycobacterium tuberculosis H37Rv
gcgagucgcacu

SEQ ID NO: 1306568 - RNA, 15 nt, Mycobacterium tuberculosis H37Rv
gcgagucgucgccaa

SEQ ID NO: 1306569 - RNA, 19 nt, Mycobacterium tuberculosis H37Rv
gcgaguuaggccgccagcc

SEQ ID NO: 1306570 - RNA, 12 nt, Mycobacterium tuberculosis H37Rv
gcgaacacgcga

SEQ ID NO: 1306571 - RNA, 18 nt, Mycobacterium tuberculosis H37Rv
gcgaacacccggucaucg

SEQ ID NO: 1306572 - RNA, 13 nt, Mycobacterium tuberculosis H37Rv
gcgaacagcucgu

SEQ ID NO: 1306573 - RNA, 16 nt, Mycobacterium tuberculosis H37Rv
gcgaacaacgcggacu

SEQ ID NO: 1306574 - RNA, 16 nt, Mycobacterium tuberculosis H37Rv
gcgaaaucgacagcag

SEQ ID NO: 1306575 - RNA, 19 nt, Mycobacterium tuberculosis H37Rv
gcgaaaugcccaucaccag

SEQ ID NO: 1306576 - RNA, 18 nt, Mycobacterium tuberculosis H37Rv
gcgaaauccgcgaucggc

SEQ ID NO: 1306577 - RNA, 22 nt, Mycobacterium tuberculosis H37Rv
gcgaaauccgcgaucggcugac

SEQ ID NO: 1306578 - RNA, 19 nt, Mycobacterium tuberculosis H37Rv
gcgaaauauuggcccguca

SEQ ID NO: 1306579 - RNA, 20 nt, Mycobacterium tuberculosis H37Rv
gcgaaauauuggcccgucac

SEQ ID NO: 1306580 - RNA, 16 nt, Mycobacterium tuberculosis H37Rv
gcgaaccggccgucga

SEQ ID NO: 1306581 - RNA, 22 nt, Mycobacterium tuberculosis H37Rv
gcgaacgaucccgccgaucgaa

SEQ ID NO: 1306582 - RNA, 22 nt, Mycobacterium tuberculosis H37Rv
gcgaacggauucccgcccagca

SEQ ID NO: 1306583 - RNA, 22 nt, Mycobacterium tuberculosis H37Rv
gcgaacgcguccagcgcggccu

SEQ ID NO: 1306584 - RNA, 15 nt, Mycobacterium tuberculosis H37Rv
gcgaaccgccggcac

SEQ ID NO: 1306585 - RNA, 14 nt, Mycobacterium tuberculosis H37Rv
gcgaaccgcuccga

SEQ ID NO: 1306586 - RNA, 14 nt, Mycobacterium tuberculosis H37Rv
gcgaaccgccggca

SEQ ID NO: 1306587 - RNA, 20 nt, Mycobacterium tuberculosis H37Rv
gcgaacccgaucgucgagcc

SEQ ID NO: 1306588 - RNA, 15 nt, Mycobacterium tuberculosis H37Rv
gcgaacccgcguuga

SEQ ID NO: 1306589 - RNA, 14 nt, Mycobacterium tuberculosis H37Rv
gcgaaccacggcag

SEQ ID NO: 1306590 - RNA, 16 nt, Mycobacterium tuberculosis H37Rv
gcgaacaucgccagcg

SEQ ID NO: 1306591 - RNA, 14 nt, Mycobacterium tuberculosis H37Rv
gcgaacaucaccgu

SEQ ID NO: 1306592 - RNA, 22 nt, Mycobacterium tuberculosis H37Rv
gcgaagccgguucgcccagcag

SEQ ID NO: 1306593 - RNA, 18 nt, Mycobacterium tuberculosis H37Rv
gcgaagccgguucgccca

SEQ ID NO: 1306594 - RNA, 13 nt, Mycobacterium tuberculosis H37Rv
gcgaagccgagca

SEQ ID NO: 1306595 - RNA, 16 nt, Mycobacterium tuberculosis H37Rv
gcgaagccaccagguc

SEQ ID NO: 1306596 - RNA, 18 nt, Mycobacterium tuberculosis H37Rv
gcgaagcacaccguccgu

SEQ ID NO: 1306597 - RNA, 13 nt, Mycobacterium tuberculosis H37Rv
gcgaagccaccag

SEQ ID NO: 1306598 - RNA, 14 nt, Mycobacterium tuberculosis H37Rv
gcgaagagcgcacu

SEQ ID NO: 1306599 - RNA, 16 nt, Mycobacterium tuberculosis H37Rv
gcgaagcacaccgucc

SEQ ID NO: 1306600 - RNA, 12 nt, Mycobacterium tuberculosis H37Rv
gcgaagacuagc

SEQ ID NO: 1306601 - RNA, 19 nt, Mycobacterium tuberculosis H37Rv
gcgaagacuagcugcuagc

SEQ ID NO: 1306602 - RNA, 20 nt, Mycobacterium tuberculosis H37Rv
gcgaacucgcgccgagccag

SEQ ID NO: 1306603 - RNA, 19 nt, Mycobacterium tuberculosis H37Rv
gcgaacucuacgguggugc

SEQ ID NO: 1306604 - RNA, 16 nt, Mycobacterium tuberculosis H37Rv
gcgaacucaugcccga

SEQ ID NO: 1306605 - RNA, 17 nt, Mycobacterium tuberculosis H37Rv
gcgaacuccaucaccac

SEQ ID NO: 1306606 - RNA, 16 nt, Mycobacterium tuberculosis H37Rv
gcgaacgggucgggac

SEQ ID NO: 1306607 - RNA, 20 nt, Mycobacterium tuberculosis H37Rv
gcgaacgggcuuccgacaug

SEQ ID NO: 1306608 - RNA, 18 nt, Mycobacterium tuberculosis H37Rv
gcgaaguggaucuggcgc

SEQ ID NO: 1306609 - RNA, 14 nt, Mycobacterium tuberculosis H37Rv
gcgaauagccacca

SEQ ID NO: 1306610 - RNA, 15 nt, Mycobacterium tuberculosis H37Rv
gcgaaggcgccgaac

SEQ ID NO: 1306611 - RNA, 14 nt, Mycobacterium tuberculosis H37Rv
gcgaagcuagagcc

SEQ ID NO: 1306612 - RNA, 15 nt, Mycobacterium tuberculosis H37Rv
gcgaaggucagcgac

SEQ ID NO: 1306613 - RNA, 18 nt, Mycobacterium tuberculosis H37Rv
gcgaagucgacucgccac

SEQ ID NO: 1306614 - RNA, 19 nt, Mycobacterium tuberculosis H37Rv
gccuugacccuccgcaucg

SEQ ID NO: 1306615 - RNA, 14 nt, Mycobacterium tuberculosis H37Rv
gccuugacgaucga

SEQ ID NO: 1306616 - RNA, 20 nt, Mycobacterium tuberculosis H37Rv
gccuucggugucgccgaaca

SEQ ID NO: 1306617 - RNA, 14 nt, Mycobacterium tuberculosis H37Rv
gccuucggugucgc

SEQ ID NO: 1306618 - RNA, 23 nt, Mycobacterium tuberculosis H37Rv
gccuucggugucgccgaacaccg

SEQ ID NO: 1306619 - RNA, 16 nt, Mycobacterium tuberculosis H37Rv
gccuucggggugcacg

SEQ ID NO: 1306620 - RNA, 16 nt, Mycobacterium tuberculosis H37Rv
gccuucggugccggaa

SEQ ID NO: 1306621 - RNA, 21 nt, Mycobacterium tuberculosis H37Rv
gccuucgggccaggauccgac

SEQ ID NO: 1306622 - RNA, 15 nt, Mycobacterium tuberculosis H37Rv
gccuucagcggucgc

SEQ ID NO: 1306623 - RNA, 21 nt, Mycobacterium tuberculosis H37Rv
gccugugccaccgcuggaucg

SEQ ID NO: 1306624 - RNA, 23 nt, Mycobacterium tuberculosis H37Rv
gccugcagguugguaauccgggc

SEQ ID NO: 1306625 - RNA, 17 nt, Mycobacterium tuberculosis H37Rv
gccugcagcgcgacccg

SEQ ID NO: 1306626 - RNA, 14 nt, Mycobacterium tuberculosis H37Rv
gccuugauugccgc

SEQ ID NO: 1306627 - RNA, 14 nt, Mycobacterium tuberculosis H37Rv
gccuugaucggcga

SEQ ID NO: 1306628 - RNA, 19 nt, Mycobacterium tuberculosis H37Rv
gccuugcagcgcguucggc

SEQ ID NO: 1306629 - RNA, 20 nt, Mycobacterium tuberculosis H37Rv
gccuugccgucgagcuccca

SEQ ID NO: 1306630 - RNA, 17 nt, Mycobacterium tuberculosis H37Rv
gccuuggucgcgucggc

SEQ ID NO: 1306631 - RNA, 14 nt, Mycobacterium tuberculosis H37Rv
gccuugucggcgau

SEQ ID NO: 1306632 - RNA, 18 nt, Mycobacterium tuberculosis H37Rv
gccuuggucgccgccuuc

SEQ ID NO: 1306633 - RNA, 14 nt, Mycobacterium tuberculosis H37Rv
gcgaaaaucccgcu

SEQ ID NO: 1306634 - RNA, 16 nt, Mycobacterium tuberculosis H37Rv
gcgaaacgcuggccac

SEQ ID NO: 1306635 - RNA, 16 nt, Mycobacterium tuberculosis H37Rv
gcgaaagcaccgagca

SEQ ID NO: 1306636 - RNA, 22 nt, Mycobacterium tuberculosis H37Rv
gcgaaacagcuugcugcgcacc

SEQ ID NO: 1306637 - RNA, 16 nt, Mycobacterium tuberculosis H37Rv
gcgaaacaucucggcg

SEQ ID NO: 1306638 - RNA, 21 nt, Mycobacterium tuberculosis H37Rv
gccuuugagggcgacgacuuc

SEQ ID NO: 1306639 - RNA, 20 nt, Mycobacterium tuberculosis H37Rv
gcggccagcagcaacgaccc

SEQ ID NO: 1306640 - RNA, 19 nt, Mycobacterium tuberculosis H37Rv
gcggccagcaucgcggugg

SEQ ID NO: 1306641 - RNA, 12 nt, Mycobacterium tuberculosis H37Rv
gcggccagcgau

SEQ ID NO: 1306642 - RNA, 15 nt, Mycobacterium tuberculosis H37Rv
gcggccagugcucgc

SEQ ID NO: 1306643 - RNA, 19 nt, Mycobacterium tuberculosis H37Rv
gcggccaguacgucgauca

SEQ ID NO: 1306644 - RNA, 23 nt, Mycobacterium tuberculosis H37Rv
gcggccaguacgucgaucaacag

SEQ ID NO: 1306645 - RNA, 15 nt, Mycobacterium tuberculosis H37Rv
gcggccaggcgcgac

SEQ ID NO: 1306646 - RNA, 13 nt, Mycobacterium tuberculosis H37Rv
gcggccaggcggu

SEQ ID NO: 1306647 - RNA, 22 nt, Mycobacterium tuberculosis H37Rv
gcggccaggcgguacgggucgc

SEQ ID NO: 1306648 - RNA, 18 nt, Mycobacterium tuberculosis H37Rv
gcggccagggcgucgacc

SEQ ID NO: 1306649 - RNA, 20 nt, Mycobacterium tuberculosis H37Rv
gcggccagcuccagcgccgc

SEQ ID NO: 1306650 - RNA, 23 nt, Mycobacterium tuberculosis H37Rv
gcggccagcuccagcgccgcggu

SEQ ID NO: 1306651 - RNA, 16 nt, Mycobacterium tuberculosis H37Rv
gcggccagcgcgucgc

SEQ ID NO: 1306652 - RNA, 15 nt, Mycobacterium tuberculosis H37Rv
gcggccaagucacca

SEQ ID NO: 1306653 - RNA, 17 nt, Mycobacterium tuberculosis H37Rv
gcggccacaaacccgau

SEQ ID NO: 1306654 - RNA, 13 nt, Mycobacterium tuberculosis H37Rv
gcggccaccaccg

SEQ ID NO: 1306655 - RNA, 16 nt, Mycobacterium tuberculosis H37Rv
gcggccacaucgccag

SEQ ID NO: 1306656 - RNA, 21 nt, Mycobacterium tuberculosis H37Rv
gcggccacaucgccagcagca

SEQ ID NO: 1306657 - RNA, 23 nt, Mycobacterium tuberculosis H37Rv
gcggccacuuggaugcgacccgu

SEQ ID NO: 1306658 - RNA, 22 nt, Mycobacterium tuberculosis H37Rv
gcggccagauagguuccaccgg

SEQ ID NO: 1306659 - RNA, 14 nt, Mycobacterium tuberculosis H37Rv
gcggccacggucag

SEQ ID NO: 1306660 - RNA, 23 nt, Mycobacterium tuberculosis H37Rv
gcggccaccgccgccgccgacgc

SEQ ID NO: 1306661 - RNA, 17 nt, Mycobacterium tuberculosis H37Rv
gcggccacccgcgacga

SEQ ID NO: 1306662 - RNA, 16 nt, Mycobacterium tuberculosis H37Rv
gcggccaccugcuggc

SEQ ID NO: 1306663 - RNA, 23 nt, Mycobacterium tuberculosis H37Rv
gcggccaccgccgccgccaccgg

SEQ ID NO: 1306664 - RNA, 14 nt, Mycobacterium tuberculosis H37Rv
aagcgagcggucga

SEQ ID NO: 1306665 - RNA, 16 nt, Mycobacterium tuberculosis H37Rv
gcggcagccaagcgag

SEQ ID NO: 1306666 - RNA, 18 nt, Mycobacterium tuberculosis H37Rv
gcggcagccaagcgagcg

SEQ ID NO: 1306667 - RNA, 12 nt, Mycobacterium tuberculosis H37Rv
gcggcacgucgg

SEQ ID NO: 1306668 - RNA, 23 nt, Mycobacterium tuberculosis H37Rv
gcggcacugaucugcguugcggc

SEQ ID NO: 1306669 - RNA, 13 nt, Mycobacterium tuberculosis H37Rv
gcgcucgaucacg

SEQ ID NO: 1306670 - RNA, 23 nt, Mycobacterium tuberculosis H37Rv
gcgcucgauggcggccaccagcg

SEQ ID NO: 1306671 - RNA, 18 nt, Mycobacterium tuberculosis H37Rv
gcgcucgcacccgcucgg

SEQ ID NO: 1306672 - RNA, 15 nt, Mycobacterium tuberculosis H37Rv
gcggcacgcucgcgc

SEQ ID NO: 1306673 - RNA, 20 nt, Mycobacterium tuberculosis H37Rv
gcgcucgcacccgcucggcg

SEQ ID NO: 1306674 - RNA, 13 nt, Mycobacterium tuberculosis H37Rv
gcgcucgauggcg

SEQ ID NO: 1306675 - RNA, 17 nt, Mycobacterium tuberculosis H37Rv
gcggcaucccgccacac

SEQ ID NO: 1306676 - RNA, 11 nt, Mycobacterium tuberculosis H37Rv
aagcgcacgcu

SEQ ID NO: 1306677 - RNA, 20 nt, Mycobacterium tuberculosis H37Rv
aagcgaucgccggccgcgug

SEQ ID NO: 1306678 - RNA, 19 nt, Mycobacterium tuberculosis H37Rv
gcggcauccacaccgaccg

SEQ ID NO: 1306679 - RNA, 16 nt, Mycobacterium tuberculosis H37Rv
gcggcaucgaggccag

SEQ ID NO: 1306680 - RNA, 21 nt, Mycobacterium tuberculosis H37Rv
gcggccccggcauugcccgag

SEQ ID NO: 1306681 - RNA, 18 nt, Mycobacterium tuberculosis H37Rv
gcggccccggcauugccc

SEQ ID NO: 1306682 - RNA, 19 nt, Mycobacterium tuberculosis H37Rv
aagcgcgguuucggcgaug

SEQ ID NO: 1306683 - RNA, 21 nt, Mycobacterium tuberculosis H37Rv
gcggccccgacauacgucggg

SEQ ID NO: 1306684 - RNA, 19 nt, Mycobacterium tuberculosis H37Rv
gcggcccaaccggucgugg

SEQ ID NO: 1306685 - RNA, 14 nt, Mycobacterium tuberculosis H37Rv
gcggcccacaccag

SEQ ID NO: 1306686 - RNA, 22 nt, Mycobacterium tuberculosis H37Rv
gcggccauguugcccugcaacc

SEQ ID NO: 1306687 - RNA, 17 nt, Mycobacterium tuberculosis H37Rv
gcggcccaaccggucgu

SEQ ID NO: 1306688 - RNA, 17 nt, Mycobacterium tuberculosis H37Rv
gcggccaucccgcguuc

SEQ ID NO: 1306689 - RNA, 22 nt, Mycobacterium tuberculosis H37Rv
gcggccauccggcggcggccag

SEQ ID NO: 1306690 - RNA, 21 nt, Mycobacterium tuberculosis H37Rv
gcggcccgauagaucgcgugg

SEQ ID NO: 1306691 - RNA, 16 nt, Mycobacterium tuberculosis H37Rv
gcggcccgaucaccag

SEQ ID NO: 1306692 - RNA, 14 nt, Mycobacterium tuberculosis H37Rv
gcggcccgcagcgu

SEQ ID NO: 1306693 - RNA, 13 nt, Mycobacterium tuberculosis H37Rv
aagcgggcgucgc

SEQ ID NO: 1306694 - RNA, 19 nt, Mycobacterium tuberculosis H37Rv
aagcggcugcccgagaucg

SEQ ID NO: 1306695 - RNA, 16 nt, Mycobacterium tuberculosis H37Rv
gcggccccgucgccga

SEQ ID NO: 1306696 - RNA, 13 nt, Mycobacterium tuberculosis H37Rv
gcggcccgcucgg

SEQ ID NO: 1306697 - RNA, 21 nt, Mycobacterium tuberculosis H37Rv
gcggcccgcaucguugccgac

SEQ ID NO: 1306698 - RNA, 19 nt, Mycobacterium tuberculosis H37Rv
gcggccuuggcgacgucgc

SEQ ID NO: 1306699 - RNA, 18 nt, Mycobacterium tuberculosis H37Rv
gcggccuugcucagcacg

SEQ ID NO: 1306700 - RNA, 15 nt, Mycobacterium tuberculosis H37Rv
gcggccuugcucagc

SEQ ID NO: 1306701 - RNA, 23 nt, Mycobacterium tuberculosis H37Rv
gcggccuugcgcacaggcgcgau

SEQ ID NO: 1306702 - RNA, 18 nt, Mycobacterium tuberculosis H37Rv
gcggccuucggccggcgu

SEQ ID NO: 1306703 - RNA, 20 nt, Mycobacterium tuberculosis H37Rv
gcggccuucgggugugacgc

SEQ ID NO: 1306704 - RNA, 16 nt, Mycobacterium tuberculosis H37Rv
gcggccugggccagcc

SEQ ID NO: 1306705 - RNA, 15 nt, Mycobacterium tuberculosis H37Rv
gcggccucgaccucu

SEQ ID NO: 1306706 - RNA, 15 nt, Mycobacterium tuberculosis H37Rv
gcggccugcucgacc

SEQ ID NO: 1306707 - RNA, 13 nt, Mycobacterium tuberculosis H37Rv
gcggccugcucga

SEQ ID NO: 1306708 - RNA, 21 nt, Mycobacterium tuberculosis H37Rv
gcggccucccgcaaugcgagc

SEQ ID NO: 1306709 - RNA, 14 nt, Mycobacterium tuberculosis H37Rv
gcggccuaggacgc

SEQ ID NO: 1306710 - RNA, 20 nt, Mycobacterium tuberculosis H37Rv
gcggccggccgcccgcucga

SEQ ID NO: 1306711 - RNA, 15 nt, Mycobacterium tuberculosis H37Rv
gcggccggccgcuca

SEQ ID NO: 1306712 - RNA, 23 nt, Mycobacterium tuberculosis H37Rv
gcggccgcgucgucgagaaucgg

SEQ ID NO: 1306713 - RNA, 14 nt, Mycobacterium tuberculosis H37Rv
gcggccgcggcgau

SEQ ID NO: 1306714 - RNA, 23 nt, Mycobacterium tuberculosis H37Rv
gcggccgcgaccagcgccgcacc

SEQ ID NO: 1306715 - RNA, 15 nt, Mycobacterium tuberculosis H37Rv
gcggccgcgagguga

SEQ ID NO: 1306716 - RNA, 14 nt, Mycobacterium tuberculosis H37Rv
gcggccgaccgcga

SEQ ID NO: 1306717 - RNA, 20 nt, Mycobacterium tuberculosis H37Rv
gcggccgcgaccagcgccgc

SEQ ID NO: 1306718 - RNA, 20 nt, Mycobacterium tuberculosis H37Rv
gcggcccugcuugcaggcga

SEQ ID NO: 1306719 - RNA, 15 nt, Mycobacterium tuberculosis H37Rv
gcggcugaacggcag

SEQ ID NO: 1306720 - RNA, 18 nt, Mycobacterium tuberculosis H37Rv
gcggcuccguuguccagc

SEQ ID NO: 1306721 - RNA, 16 nt, Mycobacterium tuberculosis H37Rv
gcggcguguacgucga

SEQ ID NO: 1306722 - RNA, 22 nt, Mycobacterium tuberculosis H37Rv
gcggcguuccccgagaacggcg

SEQ ID NO: 1306723 - RNA, 19 nt, Mycobacterium tuberculosis H37Rv
gcggcguuccaacucgguu

SEQ ID NO: 1306724 - RNA, 22 nt, Mycobacterium tuberculosis H37Rv
gcggcuccgcccggcgugucgc

SEQ ID NO: 1306725 - RNA, 23 nt, Mycobacterium tuberculosis H37Rv
gcggcguuccgggccgaucaccc

SEQ ID NO: 1306726 - RNA, 21 nt, Mycobacterium tuberculosis H37Rv
gcggcugucacgccugccacc

SEQ ID NO: 1306727 - RNA, 15 nt, Mycobacterium tuberculosis H37Rv
gcggcugugcccgau

SEQ ID NO: 1306728 - RNA, 20 nt, Mycobacterium tuberculosis H37Rv
gcggcugucacgccugccac

SEQ ID NO: 1306729 - RNA, 23 nt, Mycobacterium tuberculosis H37Rv
gcggcugcccgagaucgcgugcg

SEQ ID NO: 1306730 - RNA, 15 nt, Mycobacterium tuberculosis H37Rv
gcggcugcagccgac

SEQ ID NO: 1306731 - RNA, 13 nt, Mycobacterium tuberculosis H37Rv
gcggcugcaccgg

SEQ ID NO: 1306732 - RNA, 22 nt, Mycobacterium tuberculosis H37Rv
gcggcugccgcggugccaaccg

SEQ ID NO: 1306733 - RNA, 15 nt, Mycobacterium tuberculosis H37Rv
gcggcuggcccgcau

SEQ ID NO: 1306734 - RNA, 16 nt, Mycobacterium tuberculosis H37Rv
gcggcugcuuggucgc

SEQ ID NO: 1306735 - RNA, 19 nt, Mycobacterium tuberculosis H37Rv
gcgggaacgaucgaugacc

SEQ ID NO: 1306736 - RNA, 14 nt, Mycobacterium tuberculosis H37Rv
gcgggaacgaugcc

SEQ ID NO: 1306737 - RNA, 20 nt, Mycobacterium tuberculosis H37Rv
gcgggaagaacaucaccucg

SEQ ID NO: 1306738 - RNA, 21 nt, Mycobacterium tuberculosis H37Rv
gcgggaagaacaucaccucga

SEQ ID NO: 1306739 - RNA, 23 nt, Mycobacterium tuberculosis H37Rv
gcgggaaacccaugcaugcguug

SEQ ID NO: 1306740 - RNA, 18 nt, Mycobacterium tuberculosis H37Rv
gcggcuucgucgacaucg

SEQ ID NO: 1306741 - RNA, 20 nt, Mycobacterium tuberculosis H37Rv
gcggcuucgacgucggcgac

SEQ ID NO: 1306742 - RNA, 15 nt, Mycobacterium tuberculosis H37Rv
gcggcuucgacgucg

SEQ ID NO: 1306743 - RNA, 20 nt, Mycobacterium tuberculosis H37Rv
gcgggaucgguggcggcacg

SEQ ID NO: 1306744 - RNA, 22 nt, Mycobacterium tuberculosis H37Rv
gcgggaucugagggcucggugg

SEQ ID NO: 1306745 - RNA, 14 nt, Mycobacterium tuberculosis H37Rv
gcgggaugacgguu

SEQ ID NO: 1306746 - RNA, 13 nt, Mycobacterium tuberculosis H37Rv
gcgggauggacag

SEQ ID NO: 1306747 - RNA, 13 nt, Mycobacterium tuberculosis H37Rv
gcgggauugcgcg

SEQ ID NO: 1306748 - RNA, 19 nt, Mycobacterium tuberculosis H37Rv
gcgggcaaccacaucaccg

SEQ ID NO: 1306749 - RNA, 22 nt, Mycobacterium tuberculosis H37Rv
gcgggcacaauaggcuccagcg

SEQ ID NO: 1306750 - RNA, 14 nt, Mycobacterium tuberculosis H37Rv
gcgggccggugaac

SEQ ID NO: 1306751 - RNA, 14 nt, Mycobacterium tuberculosis H37Rv
gcgggccgcucggu

SEQ ID NO: 1306752 - RNA, 15 nt, Mycobacterium tuberculosis H37Rv
gcgggccgcucggua

SEQ ID NO: 1306753 - RNA, 16 nt, Mycobacterium tuberculosis H37Rv
gcgggcaugauccccg

SEQ ID NO: 1306754 - RNA, 14 nt, Mycobacterium tuberculosis H37Rv
gcgggcaugccggc

SEQ ID NO: 1306755 - RNA, 14 nt, Mycobacterium tuberculosis H37Rv
gcgggccaccaccg

SEQ ID NO: 1306756 - RNA, 15 nt, Mycobacterium tuberculosis H37Rv
gcgggccacgaucgg

SEQ ID NO: 1306757 - RNA, 21 nt, Mycobacterium tuberculosis H37Rv
gcgggccacgaucggcugguu

SEQ ID NO: 1306758 - RNA, 14 nt, Mycobacterium tuberculosis H37Rv
gcggcgcguggugc

SEQ ID NO: 1306759 - RNA, 18 nt, Mycobacterium tuberculosis H37Rv
gcggcgcucccgccggca

SEQ ID NO: 1306760 - RNA, 13 nt, Mycobacterium tuberculosis H37Rv
gcggcgcgagcag

SEQ ID NO: 1306761 - RNA, 12 nt, Mycobacterium tuberculosis H37Rv
gcggcgccguuc

SEQ ID NO: 1306762 - RNA, 21 nt, Mycobacterium tuberculosis H37Rv
gcggcgccugacucaucaccg

SEQ ID NO: 1306763 - RNA, 13 nt, Mycobacterium tuberculosis H37Rv
gcggcgccgucga

SEQ ID NO: 1306764 - RNA, 21 nt, Mycobacterium tuberculosis H37Rv
gcggcgccggggggcugcugc

SEQ ID NO: 1306765 - RNA, 19 nt, Mycobacterium tuberculosis H37Rv
gcggcgccaguauggccgc

SEQ ID NO: 1306766 - RNA, 15 nt, Mycobacterium tuberculosis H37Rv
gcggcgacguggcgc

SEQ ID NO: 1306767 - RNA, 15 nt, Mycobacterium tuberculosis H37Rv
gcggcgacgacggcc

SEQ ID NO: 1306768 - RNA, 14 nt, Mycobacterium tuberculosis H37Rv
gcggcgaccgucga

SEQ ID NO: 1306769 - RNA, 23 nt, Mycobacterium tuberculosis H37Rv
gcggcgaccgucgauuucgacga

SEQ ID NO: 1306770 - RNA, 21 nt, Mycobacterium tuberculosis H37Rv
gcggcggugucacgacccaag

SEQ ID NO: 1306771 - RNA, 17 nt, Mycobacterium tuberculosis H37Rv
gcggcggugcgucagcu

SEQ ID NO: 1306772 - RNA, 16 nt, Mycobacterium tuberculosis H37Rv
gcggcgguggugucgc

SEQ ID NO: 1306773 - RNA, 22 nt, Mycobacterium tuberculosis H37Rv
gcggcggugguaccggcgccac

SEQ ID NO: 1306774 - RNA, 16 nt, Mycobacterium tuberculosis H37Rv
gcggcgugcgcgguga

SEQ ID NO: 1306775 - RNA, 17 nt, Mycobacterium tuberculosis H37Rv
gcggcgucgucgucgag

SEQ ID NO: 1306776 - RNA, 18 nt, Mycobacterium tuberculosis H37Rv
gcggcgucuucgucggag

SEQ ID NO: 1306777 - RNA, 21 nt, Mycobacterium tuberculosis H37Rv
gcggcguccaucgcgcgccga

SEQ ID NO: 1306778 - RNA, 13 nt, Mycobacterium tuberculosis H37Rv
gcggcguccagca

SEQ ID NO: 1306779 - RNA, 14 nt, Mycobacterium tuberculosis H37Rv
gcggcggguccucg

SEQ ID NO: 1306780 - RNA, 19 nt, Mycobacterium tuberculosis H37Rv
gcggcggauuccggcaucg

SEQ ID NO: 1306781 - RNA, 12 nt, Mycobacterium tuberculosis H37Rv
gcggcggcaucg

SEQ ID NO: 1306782 - RNA, 15 nt, Mycobacterium tuberculosis H37Rv
gcggcggccuggcac

SEQ ID NO: 1306783 - RNA, 18 nt, Mycobacterium tuberculosis H37Rv
gcggcggcgcgaucgacg

SEQ ID NO: 1306784 - RNA, 16 nt, Mycobacterium tuberculosis H37Rv
gcggcggcgcgaucga

SEQ ID NO: 1306785 - RNA, 19 nt, Mycobacterium tuberculosis H37Rv
gcggcggcgcgaucgacgc

SEQ ID NO: 1306786 - RNA, 14 nt, Mycobacterium tuberculosis H37Rv
gcggcggcgacgag

SEQ ID NO: 1306787 - RNA, 14 nt, Mycobacterium tuberculosis H37Rv
gcgucggucaccga

SEQ ID NO: 1306788 - RNA, 15 nt, Mycobacterium tuberculosis H37Rv
gcgucggcgucaucc

SEQ ID NO: 1306789 - RNA, 17 nt, Mycobacterium tuberculosis H37Rv
gcgucggcggccaguac

SEQ ID NO: 1306790 - RNA, 23 nt, Mycobacterium tuberculosis H37Rv
gcgucggcggcuuccucgagcga

SEQ ID NO: 1306791 - RNA, 15 nt, Mycobacterium tuberculosis H37Rv
gcgucggcggcuucc

SEQ ID NO: 1306792 - RNA, 15 nt, Mycobacterium tuberculosis H37Rv
gcgucggcugccgcg

SEQ ID NO: 1306793 - RNA, 15 nt, Mycobacterium tuberculosis H37Rv
gcgucgcugaccgcg

SEQ ID NO: 1306794 - RNA, 15 nt, Mycobacterium tuberculosis H37Rv
gcguccgucgucggc

SEQ ID NO: 1306795 - RNA, 15 nt, Mycobacterium tuberculosis H37Rv
gcguccgucggcgaa

SEQ ID NO: 1306796 - RNA, 15 nt, Mycobacterium tuberculosis H37Rv
gcgucgaccacaggc

SEQ ID NO: 1306797 - RNA, 17 nt, Mycobacterium tuberculosis H37Rv
gcgucgacaucggugac

SEQ ID NO: 1306798 - RNA, 21 nt, Mycobacterium tuberculosis H37Rv
gcgucgaccaagguguccagc

SEQ ID NO: 1306799 - RNA, 17 nt, Mycobacterium tuberculosis H37Rv
gcguccuccucgguguc

SEQ ID NO: 1306800 - RNA, 16 nt, Mycobacterium tuberculosis H37Rv
gcgucgaugucgccgc

SEQ ID NO: 1306801 - RNA, 21 nt, Mycobacterium tuberculosis H37Rv
gcgucgacuggccguuucggc

SEQ ID NO: 1306802 - RNA, 15 nt, Mycobacterium tuberculosis H37Rv
gcgucgaccggacaa

SEQ ID NO: 1306803 - RNA, 13 nt, Mycobacterium tuberculosis H37Rv
gcgucgaccacgc

SEQ ID NO: 1306804 - RNA, 21 nt, Mycobacterium tuberculosis H37Rv
gcgucaccccggucccgccga

SEQ ID NO: 1306805 - RNA, 18 nt, Mycobacterium tuberculosis H37Rv
gcgucacaccacgacgcg

SEQ ID NO: 1306806 - RNA, 21 nt, Mycobacterium tuberculosis H37Rv
gcgucaaccgaucggucgucc

SEQ ID NO: 1306807 - RNA, 15 nt, Mycobacterium tuberculosis H37Rv
gcgucaacgcuguug

SEQ ID NO: 1306808 - RNA, 14 nt, Mycobacterium tuberculosis H37Rv
gcguagcagcgaua

SEQ ID NO: 1306809 - RNA, 18 nt, Mycobacterium tuberculosis H37Rv
gcguacgacccccgauca

SEQ ID NO: 1306810 - RNA, 17 nt, Mycobacterium tuberculosis H37Rv
gcguagcaggucgacgg

SEQ ID NO: 1306811 - RNA, 18 nt, Mycobacterium tuberculosis H37Rv
gcguagaucaucagcgac

SEQ ID NO: 1306812 - RNA, 19 nt, Mycobacterium tuberculosis H37Rv
gcguagaucaucagcgacu

SEQ ID NO: 1306813 - RNA, 16 nt, Mycobacterium tuberculosis H37Rv
gcguaguccaggccgu

SEQ ID NO: 1306814 - RNA, 17 nt, Mycobacterium tuberculosis H37Rv
gcguaguccaggccguc

SEQ ID NO: 1306815 - RNA, 18 nt, Mycobacterium tuberculosis H37Rv
gcgucacccugucgcgca

SEQ ID NO: 1306816 - RNA, 16 nt, Mycobacterium tuberculosis H37Rv
gcgucaggcacaacgc

SEQ ID NO: 1306817 - RNA, 22 nt, Mycobacterium tuberculosis H37Rv
gcgucagccgcaccccgcccga

SEQ ID NO: 1306818 - RNA, 19 nt, Mycobacterium tuberculosis H37Rv
gcgucaccgccggugcuga

SEQ ID NO: 1306819 - RNA, 19 nt, Mycobacterium tuberculosis H37Rv
gcgucacccugucgcgcac

SEQ ID NO: 1306820 - RNA, 18 nt, Mycobacterium tuberculosis H37Rv
gcguccaggccagggcgg

SEQ ID NO: 1306821 - RNA, 20 nt, Mycobacterium tuberculosis H37Rv
gcgucaggccagagucgccc

SEQ ID NO: 1306822 - RNA, 18 nt, Mycobacterium tuberculosis H37Rv
gcguccaucgccaccgcg

SEQ ID NO: 1306823 - RNA, 22 nt, Mycobacterium tuberculosis H37Rv
gcguccaggugcgccguggcau

SEQ ID NO: 1306824 - RNA, 22 nt, Mycobacterium tuberculosis H37Rv
gcgucccaaucgggaucgcugc

SEQ ID NO: 1306825 - RNA, 15 nt, Mycobacterium tuberculosis H37Rv
gcguccccagcgcca

SEQ ID NO: 1306826 - RNA, 14 nt, Mycobacterium tuberculosis H37Rv
gcgucccagccgau

SEQ ID NO: 1306827 - RNA, 15 nt, Mycobacterium tuberculosis H37Rv
gcgugaugguugcuc

SEQ ID NO: 1306828 - RNA, 19 nt, Mycobacterium tuberculosis H37Rv
gcgugcacccccaucaccg

SEQ ID NO: 1306829 - RNA, 16 nt, Mycobacterium tuberculosis H37Rv
gcgugcacugaccgcg

SEQ ID NO: 1306830 - RNA, 23 nt, Mycobacterium tuberculosis H37Rv
gcgugcaccgagccgucgucgag

SEQ ID NO: 1306831 - RNA, 19 nt, Mycobacterium tuberculosis H37Rv
gcgugcgggggacgggucg

SEQ ID NO: 1306832 - RNA, 15 nt, Mycobacterium tuberculosis H37Rv
gcgugcagacccggu

SEQ ID NO: 1306833 - RNA, 18 nt, Mycobacterium tuberculosis H37Rv
gcguggaucuuggccagc

SEQ ID NO: 1306834 - RNA, 22 nt, Mycobacterium tuberculosis H37Rv
gcguggacgcccgcccgcacga

SEQ ID NO: 1306835 - RNA, 22 nt, Mycobacterium tuberculosis H37Rv
gcguggaaaccggugguagcga

SEQ ID NO: 1306836 - RNA, 13 nt, Mycobacterium tuberculosis H37Rv
gcgugcugcggcu

SEQ ID NO: 1306837 - RNA, 15 nt, Mycobacterium tuberculosis H37Rv
gcgugcucggccugu

SEQ ID NO: 1306838 - RNA, 13 nt, Mycobacterium tuberculosis H37Rv
gcgugcucgacaa

SEQ ID NO: 1306839 - RNA, 21 nt, Mycobacterium tuberculosis H37Rv
gcgugguacuuucacgcucgu

SEQ ID NO: 1306840 - RNA, 16 nt, Mycobacterium tuberculosis H37Rv
gcgugguauccgccgu

SEQ ID NO: 1306841 - RNA, 18 nt, Mycobacterium tuberculosis H37Rv
gcgugguauccgccguuc

SEQ ID NO: 1306842 - RNA, 15 nt, Mycobacterium tuberculosis H37Rv
gcgugggugucggcg

SEQ ID NO: 1306843 - RNA, 19 nt, Mycobacterium tuberculosis H37Rv
gcguggcuggcggcgaccg

SEQ ID NO: 1306844 - RNA, 15 nt, Mycobacterium tuberculosis H37Rv
gcgugggcauucccg

SEQ ID NO: 1306845 - RNA, 12 nt, Mycobacterium tuberculosis H37Rv
gcguuacgccgc

SEQ ID NO: 1306846 - RNA, 18 nt, Mycobacterium tuberculosis H37Rv
gcguucaccugcgucggc

SEQ ID NO: 1306847 - RNA, 19 nt, Mycobacterium tuberculosis H37Rv
gcguucaaggucuccagac

SEQ ID NO: 1306848 - RNA, 23 nt, Mycobacterium tuberculosis H37Rv
gcguucaacaccgccgaccuagu

SEQ ID NO: 1306849 - RNA, 14 nt, Mycobacterium tuberculosis H37Rv
gcgucugcuggcgc

SEQ ID NO: 1306850 - RNA, 12 nt, Mycobacterium tuberculosis H37Rv
gcgucuggcgac

SEQ ID NO: 1306851 - RNA, 12 nt, Mycobacterium tuberculosis H37Rv
gcgucugcucgg

SEQ ID NO: 1306852 - RNA, 16 nt, Mycobacterium tuberculosis H37Rv
gcgucugcucggcauc

SEQ ID NO: 1306853 - RNA, 14 nt, Mycobacterium tuberculosis H37Rv
gcgucugcucggcg

SEQ ID NO: 1306854 - RNA, 18 nt, Mycobacterium tuberculosis H37Rv
gcgucugcugaccggagu

SEQ ID NO: 1306855 - RNA, 14 nt, Mycobacterium tuberculosis H37Rv
gcgucuggucagcc

SEQ ID NO: 1306856 - RNA, 18 nt, Mycobacterium tuberculosis H37Rv
gcgucugugucccgucga

SEQ ID NO: 1306857 - RNA, 20 nt, Mycobacterium tuberculosis H37Rv
gcgucggucagcugugcgac

SEQ ID NO: 1306858 - RNA, 13 nt, Mycobacterium tuberculosis H37Rv
gcgucggugccgc

SEQ ID NO: 1306859 - RNA, 15 nt, Mycobacterium tuberculosis H37Rv
gcgucguagaggugc

SEQ ID NO: 1306860 - RNA, 15 nt, Mycobacterium tuberculosis H37Rv
gcgucguagaacgug

SEQ ID NO: 1306861 - RNA, 21 nt, Mycobacterium tuberculosis H37Rv
gcgugagccaugccgcucggc

SEQ ID NO: 1306862 - RNA, 14 nt, Mycobacterium tuberculosis H37Rv
gcgugagcagacgc

SEQ ID NO: 1306863 - RNA, 12 nt, Mycobacterium tuberculosis H37Rv
gcgugagcgccg

SEQ ID NO: 1306864 - RNA, 16 nt, Mycobacterium tuberculosis H37Rv
gcgugagcagacgcaa

SEQ ID NO: 1306865 - RNA, 15 nt, Mycobacterium tuberculosis H37Rv
gcgugacgaccagcc

SEQ ID NO: 1306866 - RNA, 14 nt, Mycobacterium tuberculosis H37Rv
gcgugacgaccagc

SEQ ID NO: 1306867 - RNA, 13 nt, Mycobacterium tuberculosis H37Rv
aaggacgacaccg

SEQ ID NO: 1306868 - RNA, 19 nt, Mycobacterium tuberculosis H37Rv
gcgugaccgugccgucggc

SEQ ID NO: 1306869 - RNA, 22 nt, Mycobacterium tuberculosis H37Rv
gcgugacgcuaacgucgaucuc

SEQ ID NO: 1306870 - RNA, 19 nt, Mycobacterium tuberculosis H37Rv
gcgugaaaugcacgaucgc

SEQ ID NO: 1306871 - RNA, 19 nt, Mycobacterium tuberculosis H37Rv
gcgguggcccgccggcaac

SEQ ID NO: 1306872 - RNA, 16 nt, Mycobacterium tuberculosis H37Rv
gcgguggaccgcucga

SEQ ID NO: 1306873 - RNA, 17 nt, Mycobacterium tuberculosis H37Rv
gcgguggcggcgagcag

SEQ ID NO: 1306874 - RNA, 22 nt, Mycobacterium tuberculosis H37Rv
gcgguggccucccacggcgcgu

SEQ ID NO: 1306875 - RNA, 12 nt, Mycobacterium tuberculosis H37Rv
gcggugggcaca

SEQ ID NO: 1306876 - RNA, 14 nt, Mycobacterium tuberculosis H37Rv
gcggugggcagcag

SEQ ID NO: 1306877 - RNA, 15 nt, Mycobacterium tuberculosis H37Rv
gcggugccgggaucg

SEQ ID NO: 1306878 - RNA, 12 nt, Mycobacterium tuberculosis H37Rv
gcggugcgcggu

SEQ ID NO: 1306879 - RNA, 20 nt, Mycobacterium tuberculosis H37Rv
gcggugcgcucacuggcgau

SEQ ID NO: 1306880 - RNA, 13 nt, Mycobacterium tuberculosis H37Rv
gcggugcggcaac

SEQ ID NO: 1306881 - RNA, 22 nt, Mycobacterium tuberculosis H37Rv
gcggugcgcagcuuggccagcc

SEQ ID NO: 1306882 - RNA, 18 nt, Mycobacterium tuberculosis H37Rv
gcggugugcacgucacgc

SEQ ID NO: 1306883 - RNA, 16 nt, Mycobacterium tuberculosis H37Rv
gcgguguauccgacgu

SEQ ID NO: 1306884 - RNA, 18 nt, Mycobacterium tuberculosis H37Rv
gcgguguagagcgcaccg

SEQ ID NO: 1306885 - RNA, 23 nt, Mycobacterium tuberculosis H37Rv
gcgguguccagaacgguggcgcg

SEQ ID NO: 1306886 - RNA, 14 nt, Mycobacterium tuberculosis H37Rv
gcggugucacgacc

SEQ ID NO: 1306887 - RNA, 15 nt, Mycobacterium tuberculosis H37Rv
gcggugucgaccuca

SEQ ID NO: 1306888 - RNA, 22 nt, Mycobacterium tuberculosis H37Rv
gcggugggccagguuuugccgc

SEQ ID NO: 1306889 - RNA, 14 nt, Mycobacterium tuberculosis H37Rv
gcggugggucgucg

SEQ ID NO: 1306890 - RNA, 16 nt, Mycobacterium tuberculosis H37Rv
gcgguggucgcgaccg

SEQ ID NO: 1306891 - RNA, 21 nt, Mycobacterium tuberculosis H37Rv
gcgguguuggacgcgggccga

SEQ ID NO: 1306892 - RNA, 13 nt, Mycobacterium tuberculosis H37Rv
gcgguguggucgc

SEQ ID NO: 1306893 - RNA, 13 nt, Mycobacterium tuberculosis H37Rv
gcggugugccgag

SEQ ID NO: 1306894 - RNA, 22 nt, Mycobacterium tuberculosis H37Rv
gcgguguggcuugcgucgcgga

SEQ ID NO: 1306895 - RNA, 18 nt, Mycobacterium tuberculosis H37Rv
gcgguuagcagccgcuga

SEQ ID NO: 1306896 - RNA, 15 nt, Mycobacterium tuberculosis H37Rv
gcgguuaucgccgag

SEQ ID NO: 1306897 - RNA, 14 nt, Mycobacterium tuberculosis H37Rv
gcgguuaucgccga

SEQ ID NO: 1306898 - RNA, 15 nt, Mycobacterium tuberculosis H37Rv
gcgguucaucaccgu

SEQ ID NO: 1306899 - RNA, 22 nt, Mycobacterium tuberculosis H37Rv
gcgguugugcugggugccgcag

SEQ ID NO: 1306900 - RNA, 17 nt, Mycobacterium tuberculosis H37Rv
gcgguuguggcugaucc

SEQ ID NO: 1306901 - RNA, 19 nt, Mycobacterium tuberculosis H37Rv
gcgguucgaacgcgaucga

SEQ ID NO: 1306902 - RNA, 16 nt, Mycobacterium tuberculosis H37Rv
gcgguugauucgugcg

SEQ ID NO: 1306903 - RNA, 13 nt, Mycobacterium tuberculosis H37Rv
gcgguugcgcgga

SEQ ID NO: 1306904 - RNA, 15 nt, Mycobacterium tuberculosis H37Rv
gcguaaugcugcugc

SEQ ID NO: 1306905 - RNA, 18 nt, Mycobacterium tuberculosis H37Rv
gcguaauugucgaugucc

SEQ ID NO: 1306906 - RNA, 19 nt, Mycobacterium tuberculosis H37Rv
gcguacccgaucagcgacg

SEQ ID NO: 1306907 - RNA, 18 nt, Mycobacterium tuberculosis H37Rv
gcguacccgaucagcgac

SEQ ID NO: 1306908 - RNA, 16 nt, Mycobacterium tuberculosis H37Rv
gcguacccgaucagcg

SEQ ID NO: 1306909 - RNA, 16 nt, Mycobacterium tuberculosis H37Rv
gcguacucggugaucg

SEQ ID NO: 1306910 - RNA, 23 nt, Mycobacterium tuberculosis H37Rv
gcguacucccccgaaccugcggc

SEQ ID NO: 1306911 - RNA, 18 nt, Mycobacterium tuberculosis H37Rv
gcguaccagcuggccacu

SEQ ID NO: 1306912 - RNA, 16 nt, Mycobacterium tuberculosis H37Rv
gcguacaaaccgucgg

SEQ ID NO: 1306913 - RNA, 22 nt, Mycobacterium tuberculosis H37Rv
gcguacauucgggcgugcucgc

SEQ ID NO: 1306914 - RNA, 17 nt, Mycobacterium tuberculosis H37Rv
gcguacagcgccugggu

SEQ ID NO: 1306915 - RNA, 18 nt, Mycobacterium tuberculosis H37Rv
gcggucguugauuucggc

SEQ ID NO: 1306916 - RNA, 22 nt, Mycobacterium tuberculosis H37Rv
gcggucgugccccgcggucucg

SEQ ID NO: 1306917 - RNA, 16 nt, Mycobacterium tuberculosis H37Rv
gcggucugcgcgucgc

SEQ ID NO: 1306918 - RNA, 14 nt, Mycobacterium tuberculosis H37Rv
gcggucugguuguc

SEQ ID NO: 1306919 - RNA, 23 nt, Mycobacterium tuberculosis H37Rv
gcggucugguugucgaucucggc

SEQ ID NO: 1306920 - RNA, 19 nt, Mycobacterium tuberculosis H37Rv
gcggucucggugccgagca

SEQ ID NO: 1306921 - RNA, 18 nt, Mycobacterium tuberculosis H37Rv
gcggucugcgcgucgcgu

SEQ ID NO: 1306922 - RNA, 22 nt, Mycobacterium tuberculosis H37Rv
gcggucgucacggaccgccacc

SEQ ID NO: 1306923 - RNA, 12 nt, Mycobacterium tuberculosis H37Rv
gcggucgcccag

SEQ ID NO: 1306924 - RNA, 13 nt, Mycobacterium tuberculosis H37Rv
gcggucgcuaucc

SEQ ID NO: 1306925 - RNA, 16 nt, Mycobacterium tuberculosis H37Rv
gcggucggcagcgacg

SEQ ID NO: 1306926 - RNA, 22 nt, Mycobacterium tuberculosis H37Rv
gcggugaacuucuccaccagcg

SEQ ID NO: 1306927 - RNA, 19 nt, Mycobacterium tuberculosis H37Rv
gcggugaaaucgcacagcg

SEQ ID NO: 1306928 - RNA, 15 nt, Mycobacterium tuberculosis H37Rv
gcggugacgccagcc

SEQ ID NO: 1306929 - RNA, 21 nt, Mycobacterium tuberculosis H37Rv
gcggugacggugccgguuuuc

SEQ ID NO: 1306930 - RNA, 17 nt, Mycobacterium tuberculosis H37Rv
gcggugaucccacgagc

SEQ ID NO: 1306931 - RNA, 23 nt, Mycobacterium tuberculosis H37Rv
gcggugaucgauccggcuccacc

SEQ ID NO: 1306932 - RNA, 20 nt, Mycobacterium tuberculosis H37Rv
gcggugccaaccgcgggaac

SEQ ID NO: 1306933 - RNA, 17 nt, Mycobacterium tuberculosis H37Rv
gcggugcccgcaccaga

SEQ ID NO: 1306934 - RNA, 13 nt, Mycobacterium tuberculosis H37Rv
gcggugcccgcga

SEQ ID NO: 1306935 - RNA, 12 nt, Mycobacterium tuberculosis H37Rv
gcgggcgccuug

SEQ ID NO: 1306936 - RNA, 22 nt, Mycobacterium tuberculosis H37Rv
gcgguagcuuccgcgacgcucg

SEQ ID NO: 1306937 - RNA, 17 nt, Mycobacterium tuberculosis H37Rv
gcgguagcuuccgcgac

SEQ ID NO: 1306938 - RNA, 16 nt, Mycobacterium tuberculosis H37Rv
gcgguacaccgacacg

SEQ ID NO: 1306939 - RNA, 17 nt, Mycobacterium tuberculosis H37Rv
gcgguagcucauugccg

SEQ ID NO: 1306940 - RNA, 22 nt, Mycobacterium tuberculosis H37Rv
gcgguaggcguuggacgcgaac

SEQ ID NO: 1306941 - RNA, 20 nt, Mycobacterium tuberculosis H37Rv
gcgguacaccgacacgccgu

SEQ ID NO: 1306942 - RNA, 14 nt, Mycobacterium tuberculosis H37Rv
gcgguaauggcgug

SEQ ID NO: 1306943 - RNA, 14 nt, Mycobacterium tuberculosis H37Rv
gcgguacccgaugu

SEQ ID NO: 1306944 - RNA, 17 nt, Mycobacterium tuberculosis H37Rv
gcggucaccgacgcaga

SEQ ID NO: 1306945 - RNA, 22 nt, Mycobacterium tuberculosis H37Rv
gcggucaauguggcgcuucggc

SEQ ID NO: 1306946 - RNA, 17 nt, Mycobacterium tuberculosis H37Rv
gcggucagcagcgccgu

SEQ ID NO: 1306947 - RNA, 20 nt, Mycobacterium tuberculosis H37Rv
gcggucaauguggcgcuucg

SEQ ID NO: 1306948 - RNA, 22 nt, Mycobacterium tuberculosis H37Rv
gcggucgauguccgcagcaccg

SEQ ID NO: 1306949 - RNA, 18 nt, Mycobacterium tuberculosis H37Rv
gcgguccgagcggcaucg

SEQ ID NO: 1306950 - RNA, 19 nt, Mycobacterium tuberculosis H37Rv
gcggucccugaagccagcg

SEQ ID NO: 1306951 - RNA, 15 nt, Mycobacterium tuberculosis H37Rv
gcgguccagccaccg

SEQ ID NO: 1306952 - RNA, 15 nt, Mycobacterium tuberculosis H37Rv
gcgguccagcgucgc

SEQ ID NO: 1306953 - RNA, 16 nt, Mycobacterium tuberculosis H37Rv
gcguuccacacagauc

SEQ ID NO: 1306954 - RNA, 15 nt, Mycobacterium tuberculosis H37Rv
gcucagcugcggauu

SEQ ID NO: 1306955 - RNA, 16 nt, Mycobacterium tuberculosis H37Rv
gcucagcuccggcgac

SEQ ID NO: 1306956 - RNA, 15 nt, Mycobacterium tuberculosis H37Rv
gcucaucgcggcgaa

SEQ ID NO: 1306957 - RNA, 18 nt, Mycobacterium tuberculosis H37Rv
gcucaucgaagcuucggc

SEQ ID NO: 1306958 - RNA, 20 nt, Mycobacterium tuberculosis H37Rv
gcucaggguguucacguuca

SEQ ID NO: 1306959 - RNA, 12 nt, Mycobacterium tuberculosis H37Rv
gcucaggugcuc

SEQ ID NO: 1306960 - RNA, 17 nt, Mycobacterium tuberculosis H37Rv
gcucagcuggucggcuu

SEQ ID NO: 1306961 - RNA, 20 nt, Mycobacterium tuberculosis H37Rv
gcuccaacgauggaacgggc

SEQ ID NO: 1306962 - RNA, 14 nt, Mycobacterium tuberculosis H37Rv
gcuccaccgucgca

SEQ ID NO: 1306963 - RNA, 22 nt, Mycobacterium tuberculosis H37Rv
gcuccagcaccgugacccugau

SEQ ID NO: 1306964 - RNA, 20 nt, Mycobacterium tuberculosis H37Rv
gcuccaaaagccucagccgc

SEQ ID NO: 1306965 - RNA, 14 nt, Mycobacterium tuberculosis H37Rv
gcucauugccgauu

SEQ ID NO: 1306966 - RNA, 22 nt, Mycobacterium tuberculosis H37Rv
gcuccaacuccaagaugccgcc

SEQ ID NO: 1306967 - RNA, 13 nt, Mycobacterium tuberculosis H37Rv
gcuccaagcgcgg

SEQ ID NO: 1306968 - RNA, 18 nt, Mycobacterium tuberculosis H37Rv
gcuccaacaaugccagcu

SEQ ID NO: 1306969 - RNA, 16 nt, Mycobacterium tuberculosis H37Rv
gcucaugaccgcucgg

SEQ ID NO: 1306970 - RNA, 18 nt, Mycobacterium tuberculosis H37Rv
gcucaucgggcacaucgc

SEQ ID NO: 1306971 - RNA, 18 nt, Mycobacterium tuberculosis H37Rv
gcucauguucucgaccgc

SEQ ID NO: 1306972 - RNA, 16 nt, Mycobacterium tuberculosis H37Rv
gcucccaugaucgccg

SEQ ID NO: 1306973 - RNA, 18 nt, Mycobacterium tuberculosis H37Rv
gcucccauggcgcgagca

SEQ ID NO: 1306974 - RNA, 14 nt, Mycobacterium tuberculosis H37Rv
gcuccccgccggaa

SEQ ID NO: 1306975 - RNA, 21 nt, Mycobacterium tuberculosis H37Rv
gcucgauggcggccaccagcg

SEQ ID NO: 1306976 - RNA, 15 nt, Mycobacterium tuberculosis H37Rv
gcucgcaaucguugg

SEQ ID NO: 1306977 - RNA, 22 nt, Mycobacterium tuberculosis H37Rv
gcucgauguccucgauccgggc

SEQ ID NO: 1306978 - RNA, 17 nt, Mycobacterium tuberculosis H37Rv
gcucgagucgcagcacg

SEQ ID NO: 1306979 - RNA, 21 nt, Mycobacterium tuberculosis H37Rv
gcucgaguguggccgaaagcc

SEQ ID NO: 1306980 - RNA, 17 nt, Mycobacterium tuberculosis H37Rv
gcucgaugcgaucgacg

SEQ ID NO: 1306981 - RNA, 15 nt, Mycobacterium tuberculosis H37Rv
gcucgagcucggcga

SEQ ID NO: 1306982 - RNA, 16 nt, Mycobacterium tuberculosis H37Rv
gcucgagcucggcgau

SEQ ID NO: 1306983 - RNA, 18 nt, Mycobacterium tuberculosis H37Rv
gcucgacaaccacggcag

SEQ ID NO: 1306984 - RNA, 19 nt, Mycobacterium tuberculosis H37Rv
gcucgaacuccccggucgc

SEQ ID NO: 1306985 - RNA, 21 nt, Mycobacterium tuberculosis H37Rv
gcucgaaggaccggcaccugg

SEQ ID NO: 1306986 - RNA, 20 nt, Mycobacterium tuberculosis H37Rv
gcuccuucagggcgucgaac

SEQ ID NO: 1306987 - RNA, 15 nt, Mycobacterium tuberculosis H37Rv
gcuccuugaggucac

SEQ ID NO: 1306988 - RNA, 16 nt, Mycobacterium tuberculosis H37Rv
gcucgaacucggcggc

SEQ ID NO: 1306989 - RNA, 19 nt, Mycobacterium tuberculosis H37Rv
gcucgaacucggcggccag

SEQ ID NO: 1306990 - RNA, 14 nt, Mycobacterium tuberculosis H37Rv
gcucgaacagcucg

SEQ ID NO: 1306991 - RNA, 15 nt, Mycobacterium tuberculosis H37Rv
gcuccgggacgguga

SEQ ID NO: 1306992 - RNA, 16 nt, Mycobacterium tuberculosis H37Rv
gcuccgggacggugaa

SEQ ID NO: 1306993 - RNA, 20 nt, Mycobacterium tuberculosis H37Rv
gcuccgggaauggcgaccac

SEQ ID NO: 1306994 - RNA, 15 nt, Mycobacterium tuberculosis H37Rv
gcuccgggucgacga

SEQ ID NO: 1306995 - RNA, 22 nt, Mycobacterium tuberculosis H37Rv
gcuccggccaggggaucaccgg

SEQ ID NO: 1306996 - RNA, 13 nt, Mycobacterium tuberculosis H37Rv
gcuccgcugucac

SEQ ID NO: 1306997 - RNA, 22 nt, Mycobacterium tuberculosis H37Rv
gcuccgaaguccacgcaccacg

SEQ ID NO: 1306998 - RNA, 16 nt, Mycobacterium tuberculosis H37Rv
gcucccgggcgcucac

SEQ ID NO: 1306999 - RNA, 16 nt, Mycobacterium tuberculosis H37Rv
gcucggccuguucggc

SEQ ID NO: 1307000 - RNA, 11 nt, Mycobacterium tuberculosis H37Rv
gcucggcgaag

SEQ ID NO: 1307001 - RNA, 21 nt, Mycobacterium tuberculosis H37Rv
gcucggagagguagggcucca

SEQ ID NO: 1307002 - RNA, 23 nt, Mycobacterium tuberculosis H37Rv
gcucggagagguagggcuccacc

SEQ ID NO: 1307003 - RNA, 22 nt, Mycobacterium tuberculosis H37Rv
gcucggcagcaucuccgucggc

SEQ ID NO: 1307004 - RNA, 21 nt, Mycobacterium tuberculosis H37Rv
gcucggcaccgagcuugucca

SEQ ID NO: 1307005 - RNA, 15 nt, Mycobacterium tuberculosis H37Rv
gcucgccagcacgac

SEQ ID NO: 1307006 - RNA, 18 nt, Mycobacterium tuberculosis H37Rv
gcucgccagccugaaccg

SEQ ID NO: 1307007 - RNA, 13 nt, Mycobacterium tuberculosis H37Rv
gcucgcaggccgg

SEQ ID NO: 1307008 - RNA, 17 nt, Mycobacterium tuberculosis H37Rv
gcucgcagccacgcaaa

SEQ ID NO: 1307009 - RNA, 16 nt, Mycobacterium tuberculosis H37Rv
gcucgcaaucguuggc

SEQ ID NO: 1307010 - RNA, 13 nt, Mycobacterium tuberculosis H37Rv
gcucgccgugacc

SEQ ID NO: 1307011 - RNA, 13 nt, Mycobacterium tuberculosis H37Rv
gcucgcgaucguc

SEQ ID NO: 1307012 - RNA, 14 nt, Mycobacterium tuberculosis H37Rv
gcucgcgaucguca

SEQ ID NO: 1307013 - RNA, 15 nt, Mycobacterium tuberculosis H37Rv
gcucgcgcacgucga

SEQ ID NO: 1307014 - RNA, 17 nt, Mycobacterium tuberculosis H37Rv
gcucgcgcacgucgacg

SEQ ID NO: 1307015 - RNA, 13 nt, Mycobacterium tuberculosis H37Rv
gcucgcggucaug

SEQ ID NO: 1307016 - RNA, 15 nt, Mycobacterium tuberculosis H37Rv
gcucgcgggccaaag

SEQ ID NO: 1307017 - RNA, 13 nt, Mycobacterium tuberculosis H37Rv
gcugacccgccga

SEQ ID NO: 1307018 - RNA, 17 nt, Mycobacterium tuberculosis H37Rv
gcugacccgccgacgac

SEQ ID NO: 1307019 - RNA, 17 nt, Mycobacterium tuberculosis H37Rv
gcugaccccgccggcug

SEQ ID NO: 1307020 - RNA, 16 nt, Mycobacterium tuberculosis H37Rv
gcugacccgcgguagc

SEQ ID NO: 1307021 - RNA, 14 nt, Mycobacterium tuberculosis H37Rv
gcugaccccggcag

SEQ ID NO: 1307022 - RNA, 23 nt, Mycobacterium tuberculosis H37Rv
gcugacaccgauccggccgccga

SEQ ID NO: 1307023 - RNA, 13 nt, Mycobacterium tuberculosis H37Rv
gcugacacgacga

SEQ ID NO: 1307024 - RNA, 13 nt, Mycobacterium tuberculosis H37Rv
gcugaccagcguc

SEQ ID NO: 1307025 - RNA, 17 nt, Mycobacterium tuberculosis H37Rv
gcugagcggccggcaug

SEQ ID NO: 1307026 - RNA, 11 nt, Mycobacterium tuberculosis H37Rv
gcugagcucga

SEQ ID NO: 1307027 - RNA, 16 nt, Mycobacterium tuberculosis H37Rv
gcugagccggucauag

SEQ ID NO: 1307028 - RNA, 20 nt, Mycobacterium tuberculosis H37Rv
gcugagcagcgcggccagag

SEQ ID NO: 1307029 - RNA, 13 nt, Mycobacterium tuberculosis H37Rv
gcugagcgggcaa

SEQ ID NO: 1307030 - RNA, 19 nt, Mycobacterium tuberculosis H37Rv
gcugaggguggaccggucg

SEQ ID NO: 1307031 - RNA, 20 nt, Mycobacterium tuberculosis H37Rv
gcugaggaagcggcggcaac

SEQ ID NO: 1307032 - RNA, 19 nt, Mycobacterium tuberculosis H37Rv
gcugauagcggucggucac

SEQ ID NO: 1307033 - RNA, 15 nt, Mycobacterium tuberculosis H37Rv
gcugaucgccgacaa

SEQ ID NO: 1307034 - RNA, 23 nt, Mycobacterium tuberculosis H37Rv
gcugaucgccgacaauggcagcg

SEQ ID NO: 1307035 - RNA, 16 nt, Mycobacterium tuberculosis H37Rv
gcugaucaggucuucg

SEQ ID NO: 1307036 - RNA, 16 nt, Mycobacterium tuberculosis H37Rv
gcugaucccggccagg

SEQ ID NO: 1307037 - RNA, 22 nt, Mycobacterium tuberculosis H37Rv
gcugaaugcuugcgcagcaccg

SEQ ID NO: 1307038 - RNA, 15 nt, Mycobacterium tuberculosis H37Rv
gcugaauucggcgag

SEQ ID NO: 1307039 - RNA, 18 nt, Mycobacterium tuberculosis H37Rv
gcugaauuggcgccgaug

SEQ ID NO: 1307040 - RNA, 13 nt, Mycobacterium tuberculosis H37Rv
gcucugaggucac

SEQ ID NO: 1307041 - RNA, 14 nt, Mycobacterium tuberculosis H37Rv
gcucucggucagag

SEQ ID NO: 1307042 - RNA, 17 nt, Mycobacterium tuberculosis H37Rv
gcucucgcggcguucgc

SEQ ID NO: 1307043 - RNA, 22 nt, Mycobacterium tuberculosis H37Rv
gcucugaugguguacacgucgc

SEQ ID NO: 1307044 - RNA, 17 nt, Mycobacterium tuberculosis H37Rv
gcucucuucgcgcgcug

SEQ ID NO: 1307045 - RNA, 16 nt, Mycobacterium tuberculosis H37Rv
gcucguuugcgagcag

SEQ ID NO: 1307046 - RNA, 20 nt, Mycobacterium tuberculosis H37Rv
gcucguuguguauggucacg

SEQ ID NO: 1307047 - RNA, 16 nt, Mycobacterium tuberculosis H37Rv
gcucguugaugcggcu

SEQ ID NO: 1307048 - RNA, 18 nt, Mycobacterium tuberculosis H37Rv
gcucguuccggcggucaa

SEQ ID NO: 1307049 - RNA, 17 nt, Mycobacterium tuberculosis H37Rv
gcucguuacgccgagca

SEQ ID NO: 1307050 - RNA, 17 nt, Mycobacterium tuberculosis H37Rv
gcucggcugcucgacgg

SEQ ID NO: 1307051 - RNA, 21 nt, Mycobacterium tuberculosis H37Rv
gcucggcuauggguucgcggu

SEQ ID NO: 1307052 - RNA, 15 nt, Mycobacterium tuberculosis H37Rv
gcucggcugcucgac

SEQ ID NO: 1307053 - RNA, 16 nt, Mycobacterium tuberculosis H37Rv
gcucggcugcucgacg

SEQ ID NO: 1307054 - RNA, 18 nt, Mycobacterium tuberculosis H37Rv
gcucggcuauggguucgc

SEQ ID NO: 1307055 - RNA, 19 nt, Mycobacterium tuberculosis H37Rv
gcucggcggugccgcggcu

SEQ ID NO: 1307056 - RNA, 15 nt, Mycobacterium tuberculosis H37Rv
gcucggcgugucggg

SEQ ID NO: 1307057 - RNA, 13 nt, Mycobacterium tuberculosis H37Rv
gcucggcggugcc

SEQ ID NO: 1307058 - RNA, 19 nt, Mycobacterium tuberculosis H37Rv
gcugcguggcgaaccaggg

SEQ ID NO: 1307059 - RNA, 16 nt, Mycobacterium tuberculosis H37Rv
gcugcguucgccggaa

SEQ ID NO: 1307060 - RNA, 19 nt, Mycobacterium tuberculosis H37Rv
gcugcgggugauugagcuc

SEQ ID NO: 1307061 - RNA, 12 nt, Mycobacterium tuberculosis H37Rv
gcugcggugccg

SEQ ID NO: 1307062 - RNA, 16 nt, Mycobacterium tuberculosis H37Rv
gcugcggugcgggcuu

SEQ ID NO: 1307063 - RNA, 23 nt, Mycobacterium tuberculosis H37Rv
gcugcgcgacugauccucgauga

SEQ ID NO: 1307064 - RNA, 14 nt, Mycobacterium tuberculosis H37Rv
gcugcgcgauggcc

SEQ ID NO: 1307065 - RNA, 23 nt, Mycobacterium tuberculosis H37Rv
gcugcggguagccgucgaucccg

SEQ ID NO: 1307066 - RNA, 13 nt, Mycobacterium tuberculosis H37Rv
gcugcgggucucg

SEQ ID NO: 1307067 - RNA, 16 nt, Mycobacterium tuberculosis H37Rv
gcugcgggucagcgcc

SEQ ID NO: 1307068 - RNA, 17 nt, Mycobacterium tuberculosis H37Rv
gcugcgggucucgccga

SEQ ID NO: 1307069 - RNA, 13 nt, Mycobacterium tuberculosis H37Rv
gcugcgcggugcc

SEQ ID NO: 1307070 - RNA, 16 nt, Mycobacterium tuberculosis H37Rv
gcugccgccaccgcug

SEQ ID NO: 1307071 - RNA, 18 nt, Mycobacterium tuberculosis H37Rv
gcugccgcaucggcaagg

SEQ ID NO: 1307072 - RNA, 23 nt, Mycobacterium tuberculosis H37Rv
gcugccgauacagcacauccagc

SEQ ID NO: 1307073 - RNA, 21 nt, Mycobacterium tuberculosis H37Rv
gcugccggcaacagcucgccu

SEQ ID NO: 1307074 - RNA, 18 nt, Mycobacterium tuberculosis H37Rv
gcugccgcggcugccauc

SEQ ID NO: 1307075 - RNA, 13 nt, Mycobacterium tuberculosis H37Rv
gcugccgcggugc

SEQ ID NO: 1307076 - RNA, 17 nt, Mycobacterium tuberculosis H37Rv
gcugccgccguugccgu

SEQ ID NO: 1307077 - RNA, 18 nt, Mycobacterium tuberculosis H37Rv
gcugcgccgggcucgcga

SEQ ID NO: 1307078 - RNA, 15 nt, Mycobacterium tuberculosis H37Rv
gcugccaagcgaccu

SEQ ID NO: 1307079 - RNA, 23 nt, Mycobacterium tuberculosis H37Rv
gcugccaaacuaacggcagccac

SEQ ID NO: 1307080 - RNA, 22 nt, Mycobacterium tuberculosis H37Rv
gcugccaugcgggugucgggca

SEQ ID NO: 1307081 - RNA, 17 nt, Mycobacterium tuberculosis H37Rv
gcugccacaggugaccu

SEQ ID NO: 1307082 - RNA, 19 nt, Mycobacterium tuberculosis H37Rv
gcugcccaaaagcgcggca

SEQ ID NO: 1307083 - RNA, 16 nt, Mycobacterium tuberculosis H37Rv
gcugcccaaccgguca

SEQ ID NO: 1307084 - RNA, 13 nt, Mycobacterium tuberculosis H37Rv
gcugccauugccu

SEQ ID NO: 1307085 - RNA, 14 nt, Mycobacterium tuberculosis H37Rv
gcugccgagcgguc

SEQ ID NO: 1307086 - RNA, 20 nt, Mycobacterium tuberculosis H37Rv
gcugccgaucaauggcaacg

SEQ ID NO: 1307087 - RNA, 20 nt, Mycobacterium tuberculosis H37Rv
gcugccgauagcgcggcacc

SEQ ID NO: 1307088 - RNA, 16 nt, Mycobacterium tuberculosis H37Rv
gcugccgaagcggcca

SEQ ID NO: 1307089 - RNA, 18 nt, Mycobacterium tuberculosis H37Rv
gcugcccaucggugaucg

SEQ ID NO: 1307090 - RNA, 18 nt, Mycobacterium tuberculosis H37Rv
gcugcaaccagcggcaca

SEQ ID NO: 1307091 - RNA, 23 nt, Mycobacterium tuberculosis H37Rv
gcugaugaagaugauuucgccga

SEQ ID NO: 1307092 - RNA, 21 nt, Mycobacterium tuberculosis H37Rv
gcugcagcacggcuucgcggu

SEQ ID NO: 1307093 - RNA, 18 nt, Mycobacterium tuberculosis H37Rv
gcugcagauggaaccucg

SEQ ID NO: 1307094 - RNA, 18 nt, Mycobacterium tuberculosis H37Rv
gcugcagcgagaccucuc

SEQ ID NO: 1307095 - RNA, 18 nt, Mycobacterium tuberculosis H37Rv
gcugcuccaguucgccgu

SEQ ID NO: 1307096 - RNA, 17 nt, Mycobacterium tuberculosis H37Rv
gcugcucugagcuuggu

SEQ ID NO: 1307097 - RNA, 19 nt, Mycobacterium tuberculosis H37Rv
gcugcucgucgugagacug

SEQ ID NO: 1307098 - RNA, 14 nt, Mycobacterium tuberculosis H37Rv
gcugcucgucgucg

SEQ ID NO: 1307099 - RNA, 19 nt, Mycobacterium tuberculosis H37Rv
gcuggcguucccgcucggc

SEQ ID NO: 1307100 - RNA, 23 nt, Mycobacterium tuberculosis H37Rv
gcuggcguugcugaugucgccgg

SEQ ID NO: 1307101 - RNA, 22 nt, Mycobacterium tuberculosis H37Rv
gcuggcucaucgaagcuucggc

SEQ ID NO: 1307102 - RNA, 21 nt, Mycobacterium tuberculosis H37Rv
gcuggcucaccgacaugacgc

SEQ ID NO: 1307103 - RNA, 14 nt, Mycobacterium tuberculosis H37Rv
gcuggcugacaccg

SEQ ID NO: 1307104 - RNA, 12 nt, Mycobacterium tuberculosis H37Rv
gcuggcugacga

SEQ ID NO: 1307105 - RNA, 19 nt, Mycobacterium tuberculosis H37Rv
gcugggacggucgcucggc

SEQ ID NO: 1307106 - RNA, 21 nt, Mycobacterium tuberculosis H37Rv
gcugggacgucuccaccgcga

SEQ ID NO: 1307107 - RNA, 13 nt, Mycobacterium tuberculosis H37Rv
gcugggaggcgcg

SEQ ID NO: 1307108 - RNA, 19 nt, Mycobacterium tuberculosis H37Rv
gcugggaggcgcggucgac

SEQ ID NO: 1307109 - RNA, 18 nt, Mycobacterium tuberculosis H37Rv
gcugggcaucaccgacgc

SEQ ID NO: 1307110 - RNA, 15 nt, Mycobacterium tuberculosis H37Rv
gcugggcaucaccga

SEQ ID NO: 1307111 - RNA, 20 nt, Mycobacterium tuberculosis H37Rv
gcugggcagaccgaucggca

SEQ ID NO: 1307112 - RNA, 21 nt, Mycobacterium tuberculosis H37Rv
gcugggauguucgaucagcga

SEQ ID NO: 1307113 - RNA, 17 nt, Mycobacterium tuberculosis H37Rv
gcugggcagaccgaucg

SEQ ID NO: 1307114 - RNA, 17 nt, Mycobacterium tuberculosis H37Rv
gcugggcgcgcucaucg

SEQ ID NO: 1307115 - RNA, 21 nt, Mycobacterium tuberculosis H37Rv
gcugggcgccgcgcucgacga

SEQ ID NO: 1307116 - RNA, 15 nt, Mycobacterium tuberculosis H37Rv
gcugggcgccaugcg

SEQ ID NO: 1307117 - RNA, 15 nt, Mycobacterium tuberculosis H37Rv
gcugguggcggcgac

SEQ ID NO: 1307118 - RNA, 13 nt, Mycobacterium tuberculosis H37Rv
gcuggugguaucg

SEQ ID NO: 1307119 - RNA, 16 nt, Mycobacterium tuberculosis H37Rv
gcugguuucggggacc

SEQ ID NO: 1307120 - RNA, 20 nt, Mycobacterium tuberculosis H37Rv
gcugguuucggggaccacgc

SEQ ID NO: 1307121 - RNA, 14 nt, Mycobacterium tuberculosis H37Rv
gcugguguccagcc

SEQ ID NO: 1307122 - RNA, 22 nt, Mycobacterium tuberculosis H37Rv
gcuggugugcgggcgugagugc

SEQ ID NO: 1307123 - RNA, 13 nt, Mycobacterium tuberculosis H37Rv
gcuggucgagcag

SEQ ID NO: 1307124 - RNA, 18 nt, Mycobacterium tuberculosis H37Rv
gcuggucgcugcugcgau

SEQ ID NO: 1307125 - RNA, 17 nt, Mycobacterium tuberculosis H37Rv
gcuggugccaacugcgc

SEQ ID NO: 1307126 - RNA, 20 nt, Mycobacterium tuberculosis H37Rv
gcuggugccaacugcgccgu

SEQ ID NO: 1307127 - RNA, 20 nt, Mycobacterium tuberculosis H37Rv
gcuggugcgccacgccaccg

SEQ ID NO: 1307128 - RNA, 22 nt, Mycobacterium tuberculosis H37Rv
gcuggugcguagcccacccggg

SEQ ID NO: 1307129 - RNA, 15 nt, Mycobacterium tuberculosis H37Rv
gcugggggucaaucg

SEQ ID NO: 1307130 - RNA, 17 nt, Mycobacterium tuberculosis H37Rv
gcugggcuucgagugcg

SEQ ID NO: 1307131 - RNA, 15 nt, Mycobacterium tuberculosis H37Rv
gcugggucgccguuu

SEQ ID NO: 1307132 - RNA, 20 nt, Mycobacterium tuberculosis H37Rv
gcugggucagguugucggcg

SEQ ID NO: 1307133 - RNA, 15 nt, Mycobacterium tuberculosis H37Rv
gcuggucagguaucg

SEQ ID NO: 1307134 - RNA, 19 nt, Mycobacterium tuberculosis H37Rv
gcugguccuccuucggugg

SEQ ID NO: 1307135 - RNA, 20 nt, Mycobacterium tuberculosis H37Rv
gcugguaggucaccggucac

SEQ ID NO: 1307136 - RNA, 18 nt, Mycobacterium tuberculosis H37Rv
gcugugaucgagucgcga

SEQ ID NO: 1307137 - RNA, 18 nt, Mycobacterium tuberculosis H37Rv
gcuguggcccgcggugac

SEQ ID NO: 1307138 - RNA, 20 nt, Mycobacterium tuberculosis H37Rv
gcugugcuucguugucggcg

SEQ ID NO: 1307139 - RNA, 14 nt, Mycobacterium tuberculosis H37Rv
gcugugcgguaucg

SEQ ID NO: 1307140 - RNA, 19 nt, Mycobacterium tuberculosis H37Rv
gcugugcggucgucaccgu

SEQ ID NO: 1307141 - RNA, 14 nt, Mycobacterium tuberculosis H37Rv
gcugucggugccgu

SEQ ID NO: 1307142 - RNA, 17 nt, Mycobacterium tuberculosis H37Rv
gcugucggcaugccggu

SEQ ID NO: 1307143 - RNA, 22 nt, Mycobacterium tuberculosis H37Rv
gcuguaagcaugccguugcgau

SEQ ID NO: 1307144 - RNA, 21 nt, Mycobacterium tuberculosis H37Rv
gcuguacccgaccagcaccag

SEQ ID NO: 1307145 - RNA, 21 nt, Mycobacterium tuberculosis H37Rv
gcuguaacacccggccgccga

SEQ ID NO: 1307146 - RNA, 15 nt, Mycobacterium tuberculosis H37Rv
gcuguaggcgaucac

SEQ ID NO: 1307147 - RNA, 19 nt, Mycobacterium tuberculosis H37Rv
gcugucaguucccgcuuga

SEQ ID NO: 1307148 - RNA, 11 nt, Mycobacterium tuberculosis H37Rv
gcuguccaccg

SEQ ID NO: 1307149 - RNA, 19 nt, Mycobacterium tuberculosis H37Rv
gcugucgaaguuggucacg

SEQ ID NO: 1307150 - RNA, 20 nt, Mycobacterium tuberculosis H37Rv
gcugucgaaguuggucacga

SEQ ID NO: 1307151 - RNA, 18 nt, Mycobacterium tuberculosis H37Rv
gcugucgaccgcgaucac

SEQ ID NO: 1307152 - RNA, 14 nt, Mycobacterium tuberculosis H37Rv
gcuguccgacuugu

SEQ ID NO: 1307153 - RNA, 20 nt, Mycobacterium tuberculosis H37Rv
gcuuacuugaucucggcgag

SEQ ID NO: 1307154 - RNA, 14 nt, Mycobacterium tuberculosis H37Rv
gcuuacuugaucuc

SEQ ID NO: 1307155 - RNA, 23 nt, Mycobacterium tuberculosis H37Rv
ggaaaccucuucgggugcagcca

SEQ ID NO: 1307156 - RNA, 15 nt, Mycobacterium tuberculosis H37Rv
ggaaaaagcccgaca

SEQ ID NO: 1307157 - RNA, 17 nt, Mycobacterium tuberculosis H37Rv
ggaaaccacagcgccau

SEQ ID NO: 1307158 - RNA, 14 nt, Mycobacterium tuberculosis H37Rv
ggaaaccaucgcca

SEQ ID NO: 1307159 - RNA, 16 nt, Mycobacterium tuberculosis H37Rv
ggaaaccacagcgcca

SEQ ID NO: 1307160 - RNA, 17 nt, Mycobacterium tuberculosis H37Rv
ggaaacagcgaucgccg

SEQ ID NO: 1307161 - RNA, 16 nt, Mycobacterium tuberculosis H37Rv
ggaaaaccccggccac

SEQ ID NO: 1307162 - RNA, 21 nt, Mycobacterium tuberculosis H37Rv
gcuuugagucccgguagacca

SEQ ID NO: 1307163 - RNA, 20 nt, Mycobacterium tuberculosis H37Rv
gcuuugagucccgguagacc

SEQ ID NO: 1307164 - RNA, 16 nt, Mycobacterium tuberculosis H37Rv
gcuugggccggugcag

SEQ ID NO: 1307165 - RNA, 15 nt, Mycobacterium tuberculosis H37Rv
gcuuggcuuggccgu

SEQ ID NO: 1307166 - RNA, 22 nt, Mycobacterium tuberculosis H37Rv
gcuuggggccggaugucgacga

SEQ ID NO: 1307167 - RNA, 14 nt, Mycobacterium tuberculosis H37Rv
gcuuggcgccgaug

SEQ ID NO: 1307168 - RNA, 19 nt, Mycobacterium tuberculosis H37Rv
gcuuggcgccgaugccggc

SEQ ID NO: 1307169 - RNA, 16 nt, Mycobacterium tuberculosis H37Rv
gcuuggcgagccacgg

SEQ ID NO: 1307170 - RNA, 14 nt, Mycobacterium tuberculosis H37Rv
gcuuggccgggagu

SEQ ID NO: 1307171 - RNA, 19 nt, Mycobacterium tuberculosis H37Rv
gcuuggccaaaaccaggga

SEQ ID NO: 1307172 - RNA, 18 nt, Mycobacterium tuberculosis H37Rv
gcuuguacgaacugcuga

SEQ ID NO: 1307173 - RNA, 18 nt, Mycobacterium tuberculosis H37Rv
gcuuguagcgcaucgcca

SEQ ID NO: 1307174 - RNA, 16 nt, Mycobacterium tuberculosis H37Rv
gcuugguguauucgcg

SEQ ID NO: 1307175 - RNA, 21 nt, Mycobacterium tuberculosis H37Rv
gcuugguguauucgcggaugc

SEQ ID NO: 1307176 - RNA, 19 nt, Mycobacterium tuberculosis H37Rv
gcuugcccgaagagcacgu

SEQ ID NO: 1307177 - RNA, 21 nt, Mycobacterium tuberculosis H37Rv
gcuugcagugaggucaucguc

SEQ ID NO: 1307178 - RNA, 14 nt, Mycobacterium tuberculosis H37Rv
gcuugccgaccugc

SEQ ID NO: 1307179 - RNA, 16 nt, Mycobacterium tuberculosis H37Rv
gcuugcgcagccgcag

SEQ ID NO: 1307180 - RNA, 15 nt, Mycobacterium tuberculosis H37Rv
gcuugcgccggauga

SEQ ID NO: 1307181 - RNA, 15 nt, Mycobacterium tuberculosis H37Rv
gcuugcgcagccgca

SEQ ID NO: 1307182 - RNA, 15 nt, Mycobacterium tuberculosis H37Rv
gcuugcgcagcagcg

SEQ ID NO: 1307183 - RNA, 15 nt, Mycobacterium tuberculosis H37Rv
gcuugccgucgcuga

SEQ ID NO: 1307184 - RNA, 15 nt, Mycobacterium tuberculosis H37Rv
gcuugagcgccgaug

SEQ ID NO: 1307185 - RNA, 22 nt, Mycobacterium tuberculosis H37Rv
gcuugagcacacguccggcgau

SEQ ID NO: 1307186 - RNA, 17 nt, Mycobacterium tuberculosis H37Rv
gcuucgucggccagcag

SEQ ID NO: 1307187 - RNA, 16 nt, Mycobacterium tuberculosis H37Rv
gcuucuagcccguugu

SEQ ID NO: 1307188 - RNA, 20 nt, Mycobacterium tuberculosis H37Rv
gcuucugcgucugcucgcgg

SEQ ID NO: 1307189 - RNA, 16 nt, Mycobacterium tuberculosis H37Rv
gcuucaggaucggcga

SEQ ID NO: 1307190 - RNA, 15 nt, Mycobacterium tuberculosis H37Rv
gcuuccagcaucagu

SEQ ID NO: 1307191 - RNA, 15 nt, Mycobacterium tuberculosis H37Rv
gcuuccagggcgacg

SEQ ID NO: 1307192 - RNA, 21 nt, Mycobacterium tuberculosis H37Rv
gcuuccagccggagucaccga

SEQ ID NO: 1307193 - RNA, 18 nt, Mycobacterium tuberculosis H37Rv
gcuuccggaacaaaggcu

SEQ ID NO: 1307194 - RNA, 17 nt, Mycobacterium tuberculosis H37Rv
gcuuccgaccgcuccga

SEQ ID NO: 1307195 - RNA, 21 nt, Mycobacterium tuberculosis H37Rv
gcuucggacuggggcacgcca

SEQ ID NO: 1307196 - RNA, 20 nt, Mycobacterium tuberculosis H37Rv
gcuucgcgguuggcggcgau

SEQ ID NO: 1307197 - RNA, 17 nt, Mycobacterium tuberculosis H37Rv
gcuucggcggccgagcg

SEQ ID NO: 1307198 - RNA, 14 nt, Mycobacterium tuberculosis H37Rv
gcuucggcgugcgu

SEQ ID NO: 1307199 - RNA, 13 nt, Mycobacterium tuberculosis H37Rv
gcuucggugaccc

SEQ ID NO: 1307200 - RNA, 16 nt, Mycobacterium tuberculosis H37Rv
gcuucgucggccggca

SEQ ID NO: 1307201 - RNA, 15 nt, Mycobacterium tuberculosis H37Rv
gcuucguccaccgcg

SEQ ID NO: 1307202 - RNA, 16 nt, Mycobacterium tuberculosis H37Rv
gcuucgccgcgcagcc

SEQ ID NO: 1307203 - RNA, 14 nt, Mycobacterium tuberculosis H37Rv
gcuucgccgcgcag

SEQ ID NO: 1307204 - RNA, 20 nt, Mycobacterium tuberculosis H37Rv
gcuucgccgaguugaccgcc

SEQ ID NO: 1307205 - RNA, 16 nt, Mycobacterium tuberculosis H37Rv
gcuucgccacaccaug

SEQ ID NO: 1307206 - RNA, 18 nt, Mycobacterium tuberculosis H37Rv
gcuucgacgucggcgacc

SEQ ID NO: 1307207 - RNA, 18 nt, Mycobacterium tuberculosis H37Rv
gcuucgaccaucaccacg

SEQ ID NO: 1307208 - RNA, 20 nt, Mycobacterium tuberculosis H37Rv
gcuucgaccgaguaccgaua

SEQ ID NO: 1307209 - RNA, 18 nt, Mycobacterium tuberculosis H37Rv
gcuucgagguggcugcgc

SEQ ID NO: 1307210 - RNA, 23 nt, Mycobacterium tuberculosis H37Rv
gcuuccucgagcgaaccgaagcc

SEQ ID NO: 1307211 - RNA, 20 nt, Mycobacterium tuberculosis H37Rv
gccagcaucagcgccagcga

SEQ ID NO: 1307212 - RNA, 12 nt, Mycobacterium tuberculosis H37Rv
gccagcaucgcg

SEQ ID NO: 1307213 - RNA, 18 nt, Mycobacterium tuberculosis H37Rv
gccagcaggcggcugaac

SEQ ID NO: 1307214 - RNA, 15 nt, Mycobacterium tuberculosis H37Rv
gccagcaugacaccg

SEQ ID NO: 1307215 - RNA, 12 nt, Mycobacterium tuberculosis H37Rv
gccagcaucagc

SEQ ID NO: 1307216 - RNA, 22 nt, Mycobacterium tuberculosis H37Rv
gccagcaggaacgccgugccgu

SEQ ID NO: 1307217 - RNA, 20 nt, Mycobacterium tuberculosis H37Rv
gccagcagcaaugcgguacc

SEQ ID NO: 1307218 - RNA, 20 nt, Mycobacterium tuberculosis H37Rv
gccagcagcaaucagccgcc

SEQ ID NO: 1307219 - RNA, 16 nt, Mycobacterium tuberculosis H37Rv
gccagcagcaaucagc

SEQ ID NO: 1307220 - RNA, 15 nt, Mycobacterium tuberculosis H37Rv
gccagcagaucaggu

SEQ ID NO: 1307221 - RNA, 19 nt, Mycobacterium tuberculosis H37Rv
gccagcacugccaucgcgg

SEQ ID NO: 1307222 - RNA, 16 nt, Mycobacterium tuberculosis H37Rv
gccagcacuccaccgc

SEQ ID NO: 1307223 - RNA, 16 nt, Mycobacterium tuberculosis H37Rv
gccacuugaugcucga

SEQ ID NO: 1307224 - RNA, 17 nt, Mycobacterium tuberculosis H37Rv
gccacuugaugcucgau

SEQ ID NO: 1307225 - RNA, 17 nt, Mycobacterium tuberculosis H37Rv
gccagcaacagcgcggu

SEQ ID NO: 1307226 - RNA, 17 nt, Mycobacterium tuberculosis H37Rv
gccagcaaugcccgcac

SEQ ID NO: 1307227 - RNA, 18 nt, Mycobacterium tuberculosis H37Rv
gccagcaaguacgcgucg

SEQ ID NO: 1307228 - RNA, 18 nt, Mycobacterium tuberculosis H37Rv
gccagcaagucugcccga

SEQ ID NO: 1307229 - RNA, 14 nt, Mycobacterium tuberculosis H37Rv
gccagcaagugcgg

SEQ ID NO: 1307230 - RNA, 15 nt, Mycobacterium tuberculosis H37Rv
gccagcaaugcccgc

SEQ ID NO: 1307231 - RNA, 15 nt, Mycobacterium tuberculosis H37Rv
gccagccgcacgguu

SEQ ID NO: 1307232 - RNA, 19 nt, Mycobacterium tuberculosis H37Rv
gccagccgaaacauugccc

SEQ ID NO: 1307233 - RNA, 17 nt, Mycobacterium tuberculosis H37Rv
gccagccgucaccgcga

SEQ ID NO: 1307234 - RNA, 20 nt, Mycobacterium tuberculosis H37Rv
gccagccguucucgcccacc

SEQ ID NO: 1307235 - RNA, 19 nt, Mycobacterium tuberculosis H37Rv
gccagccguucucgcccac

SEQ ID NO: 1307236 - RNA, 22 nt, Mycobacterium tuberculosis H37Rv
gccagcgccccgcgguccuggu

SEQ ID NO: 1307237 - RNA, 14 nt, Mycobacterium tuberculosis H37Rv
gccagcgccaugcu

SEQ ID NO: 1307238 - RNA, 15 nt, Mycobacterium tuberculosis H37Rv
gccagcgacgcgguc

SEQ ID NO: 1307239 - RNA, 16 nt, Mycobacterium tuberculosis H37Rv
gccagcgacgcgguca

SEQ ID NO: 1307240 - RNA, 18 nt, Mycobacterium tuberculosis H37Rv
gccagcgccggucagggc

SEQ ID NO: 1307241 - RNA, 16 nt, Mycobacterium tuberculosis H37Rv
gccagcgccgccggca

SEQ ID NO: 1307242 - RNA, 17 nt, Mycobacterium tuberculosis H37Rv
gccagcgccgccggcac

SEQ ID NO: 1307243 - RNA, 19 nt, Mycobacterium tuberculosis H37Rv
gccagcgccgccggcaccu

SEQ ID NO: 1307244 - RNA, 15 nt, Mycobacterium tuberculosis H37Rv
gccagcguggugauc

SEQ ID NO: 1307245 - RNA, 20 nt, Mycobacterium tuberculosis H37Rv
gccagcgggugaaucgacac

SEQ ID NO: 1307246 - RNA, 19 nt, Mycobacterium tuberculosis H37Rv
gccagcgguaaugccagcg

SEQ ID NO: 1307247 - RNA, 15 nt, Mycobacterium tuberculosis H37Rv
gccagcguuggcggc

SEQ ID NO: 1307248 - RNA, 13 nt, Mycobacterium tuberculosis H37Rv
gccagcguuggcg

SEQ ID NO: 1307249 - RNA, 14 nt, Mycobacterium tuberculosis H37Rv
gccagcguguccgc

SEQ ID NO: 1307250 - RNA, 12 nt, Mycobacterium tuberculosis H37Rv
gccagcucgggc

SEQ ID NO: 1307251 - RNA, 19 nt, Mycobacterium tuberculosis H37Rv
gccagcucgccggccgggu

SEQ ID NO: 1307252 - RNA, 19 nt, Mycobacterium tuberculosis H37Rv
gccagcuccggcgcuccac

SEQ ID NO: 1307253 - RNA, 18 nt, Mycobacterium tuberculosis H37Rv
gccagcuccgccugccgc

SEQ ID NO: 1307254 - RNA, 22 nt, Mycobacterium tuberculosis H37Rv
gccagcugcgcagcgcaacauc

SEQ ID NO: 1307255 - RNA, 20 nt, Mycobacterium tuberculosis H37Rv
gccaggccgaccgcgcacau

SEQ ID NO: 1307256 - RNA, 21 nt, Mycobacterium tuberculosis H37Rv
gccaggcacguccgaucggcg

SEQ ID NO: 1307257 - RNA, 16 nt, Mycobacterium tuberculosis H37Rv
gccaggcaagccagca

SEQ ID NO: 1307258 - RNA, 23 nt, Mycobacterium tuberculosis H37Rv
gccaggaguuugaccaccugguu

SEQ ID NO: 1307259 - RNA, 17 nt, Mycobacterium tuberculosis H37Rv
gccaggauccgaccccg

SEQ ID NO: 1307260 - RNA, 18 nt, Mycobacterium tuberculosis H37Rv
gccaggauccgaccccgc

SEQ ID NO: 1307261 - RNA, 16 nt, Mycobacterium tuberculosis H37Rv
gccaggauaaguccgg

SEQ ID NO: 1307262 - RNA, 18 nt, Mycobacterium tuberculosis H37Rv
gccaggucgacgggcacg

SEQ ID NO: 1307263 - RNA, 18 nt, Mycobacterium tuberculosis H37Rv
gccagguccgccggugcc

SEQ ID NO: 1307264 - RNA, 15 nt, Mycobacterium tuberculosis H37Rv
gccaggucgagcacc

SEQ ID NO: 1307265 - RNA, 13 nt, Mycobacterium tuberculosis H37Rv
gccaggucgagca

SEQ ID NO: 1307266 - RNA, 12 nt, Mycobacterium tuberculosis H37Rv
gccaggucaucg

SEQ ID NO: 1307267 - RNA, 16 nt, Mycobacterium tuberculosis H37Rv
gccaggucgacgggca

SEQ ID NO: 1307268 - RNA, 21 nt, Mycobacterium tuberculosis H37Rv
gccaggucggcgggcgcgggu

SEQ ID NO: 1307269 - RNA, 18 nt, Mycobacterium tuberculosis H37Rv
gccaggucggcgaugaug

SEQ ID NO: 1307270 - RNA, 13 nt, Mycobacterium tuberculosis H37Rv
gccaggucggcca

SEQ ID NO: 1307271 - RNA, 18 nt, Mycobacterium tuberculosis H37Rv
gccagggcuugccggguu

SEQ ID NO: 1307272 - RNA, 19 nt, Mycobacterium tuberculosis H37Rv
gccaggucgccaccuucga

SEQ ID NO: 1307273 - RNA, 15 nt, Mycobacterium tuberculosis H37Rv
gccaguccggggaac

SEQ ID NO: 1307274 - RNA, 15 nt, Mycobacterium tuberculosis H37Rv
gccagucgaucgcgg

SEQ ID NO: 1307275 - RNA, 14 nt, Mycobacterium tuberculosis H37Rv
gccagucgagcacc

SEQ ID NO: 1307276 - RNA, 16 nt, Mycobacterium tuberculosis H37Rv
gccagucgcaggaucg

SEQ ID NO: 1307277 - RNA, 19 nt, Mycobacterium tuberculosis H37Rv
gccagucgcaggaucggcg

SEQ ID NO: 1307278 - RNA, 13 nt, Mycobacterium tuberculosis H37Rv
gccagggaucagc

SEQ ID NO: 1307279 - RNA, 15 nt, Mycobacterium tuberculosis H37Rv
gccaggccgcacagc

SEQ ID NO: 1307280 - RNA, 13 nt, Mycobacterium tuberculosis H37Rv
gccaggccgagcc

SEQ ID NO: 1307281 - RNA, 22 nt, Mycobacterium tuberculosis H37Rv
gccagggcgguggccacccggc

SEQ ID NO: 1307282 - RNA, 13 nt, Mycobacterium tuberculosis H37Rv
gccacccgcggaa

SEQ ID NO: 1307283 - RNA, 13 nt, Mycobacterium tuberculosis H37Rv
gccacccgcaacu

SEQ ID NO: 1307284 - RNA, 14 nt, Mycobacterium tuberculosis H37Rv
gccaccgaccgagu

SEQ ID NO: 1307285 - RNA, 16 nt, Mycobacterium tuberculosis H37Rv
gccaccgaccgcacga

SEQ ID NO: 1307286 - RNA, 17 nt, Mycobacterium tuberculosis H37Rv
gccaccgaacgcggcca

SEQ ID NO: 1307287 - RNA, 20 nt, Mycobacterium tuberculosis H37Rv
gccaccgcgacaccccggaa

SEQ ID NO: 1307288 - RNA, 21 nt, Mycobacterium tuberculosis H37Rv
gccaccgccggcagcaucggc

SEQ ID NO: 1307289 - RNA, 14 nt, Mycobacterium tuberculosis H37Rv
gccaccgccggcag

SEQ ID NO: 1307290 - RNA, 17 nt, Mycobacterium tuberculosis H37Rv
gccaccgccgaaaaccu

SEQ ID NO: 1307291 - RNA, 13 nt, Mycobacterium tuberculosis H37Rv
gccaccgccggca

SEQ ID NO: 1307292 - RNA, 15 nt, Mycobacterium tuberculosis H37Rv
gccaccgcacguucg

SEQ ID NO: 1307293 - RNA, 19 nt, Mycobacterium tuberculosis H37Rv
gccaccgcaacucgccgaa

SEQ ID NO: 1307294 - RNA, 18 nt, Mycobacterium tuberculosis H37Rv
gccaccgauaccgucagc

SEQ ID NO: 1307295 - RNA, 20 nt, Mycobacterium tuberculosis H37Rv
gccaccgccagcgucgacac

SEQ ID NO: 1307296 - RNA, 17 nt, Mycobacterium tuberculosis H37Rv
gccaccgccagcgucga

SEQ ID NO: 1307297 - RNA, 13 nt, Mycobacterium tuberculosis H37Rv
gccaccgccacca

SEQ ID NO: 1307298 - RNA, 17 nt, Mycobacterium tuberculosis H37Rv
gccaccgcacguucggc

SEQ ID NO: 1307299 - RNA, 13 nt, Mycobacterium tuberculosis H37Rv
gccaccgcaagaa

SEQ ID NO: 1307300 - RNA, 17 nt, Mycobacterium tuberculosis H37Rv
gccaccgcagacgccgu

SEQ ID NO: 1307301 - RNA, 20 nt, Mycobacterium tuberculosis H37Rv
gccaccgcagacgugguagc

SEQ ID NO: 1307302 - RNA, 16 nt, Mycobacterium tuberculosis H37Rv
gccaccgcaucgccga

SEQ ID NO: 1307303 - RNA, 18 nt, Mycobacterium tuberculosis H37Rv
gccaccggcgcgaccgcg

SEQ ID NO: 1307304 - RNA, 14 nt, Mycobacterium tuberculosis H37Rv
gccaccggcgccac

SEQ ID NO: 1307305 - RNA, 15 nt, Mycobacterium tuberculosis H37Rv
gccaccggcgccacc

SEQ ID NO: 1307306 - RNA, 23 nt, Mycobacterium tuberculosis H37Rv
gccaccggccgcggcgccuagca

SEQ ID NO: 1307307 - RNA, 16 nt, Mycobacterium tuberculosis H37Rv
gccaccgcugccggca

SEQ ID NO: 1307308 - RNA, 20 nt, Mycobacterium tuberculosis H37Rv
gccaccgcgggcggcaucgc

SEQ ID NO: 1307309 - RNA, 18 nt, Mycobacterium tuberculosis H37Rv
gccaccgcggucagcucg

SEQ ID NO: 1307310 - RNA, 19 nt, Mycobacterium tuberculosis H37Rv
gccaccgcggucagcucgg

SEQ ID NO: 1307311 - RNA, 16 nt, Mycobacterium tuberculosis H37Rv
gccaccgcgacgagcg

SEQ ID NO: 1307312 - RNA, 18 nt, Mycobacterium tuberculosis H37Rv
gccaccgucacccaucga

SEQ ID NO: 1307313 - RNA, 14 nt, Mycobacterium tuberculosis H37Rv
gccaccguagccga

SEQ ID NO: 1307314 - RNA, 23 nt, Mycobacterium tuberculosis H37Rv
gccaccgguuuggagcucaucga

SEQ ID NO: 1307315 - RNA, 13 nt, Mycobacterium tuberculosis H37Rv
gccaccgucagcg

SEQ ID NO: 1307316 - RNA, 16 nt, Mycobacterium tuberculosis H37Rv
gccaccgucagcgcga

SEQ ID NO: 1307317 - RNA, 17 nt, Mycobacterium tuberculosis H37Rv
gccaccgucaugccgac

SEQ ID NO: 1307318 - RNA, 19 nt, Mycobacterium tuberculosis H37Rv
gccaccgucaugccgacga

SEQ ID NO: 1307319 - RNA, 23 nt, Mycobacterium tuberculosis H37Rv
gccaccucgccggccgucagcac

SEQ ID NO: 1307320 - RNA, 16 nt, Mycobacterium tuberculosis H37Rv
gccaccggcgucgacg

SEQ ID NO: 1307321 - RNA, 21 nt, Mycobacterium tuberculosis H37Rv
gccaccggcgucgacgucggc

SEQ ID NO: 1307322 - RNA, 22 nt, Mycobacterium tuberculosis H37Rv
gccaccggugagcgcagcuuga

SEQ ID NO: 1307323 - RNA, 17 nt, Mycobacterium tuberculosis H37Rv
gccaccgguaccggcga

SEQ ID NO: 1307324 - RNA, 18 nt, Mycobacterium tuberculosis H37Rv
gccaccugacuaccguca

SEQ ID NO: 1307325 - RNA, 19 nt, Mycobacterium tuberculosis H37Rv
gccaccugugcgaacagcg

SEQ ID NO: 1307326 - RNA, 17 nt, Mycobacterium tuberculosis H37Rv
gccaccucggaggugcc

SEQ ID NO: 1307327 - RNA, 19 nt, Mycobacterium tuberculosis H37Rv
gccaccuuggacaccacga

SEQ ID NO: 1307328 - RNA, 23 nt, Mycobacterium tuberculosis H37Rv
gccaccugguuuacccgcaugga

SEQ ID NO: 1307329 - RNA, 22 nt, Mycobacterium tuberculosis H37Rv
gccacgcucggugcugcgccga

SEQ ID NO: 1307330 - RNA, 15 nt, Mycobacterium tuberculosis H37Rv
gccacgcucggugcu

SEQ ID NO: 1307331 - RNA, 21 nt, Mycobacterium tuberculosis H37Rv
gccacgcguuccuccagcagc

SEQ ID NO: 1307332 - RNA, 16 nt, Mycobacterium tuberculosis H37Rv
gccacgguucgggcag

SEQ ID NO: 1307333 - RNA, 14 nt, Mycobacterium tuberculosis H37Rv
gccacguagcagcg

SEQ ID NO: 1307334 - RNA, 20 nt, Mycobacterium tuberculosis H37Rv
gccacguagcagcgccggca

SEQ ID NO: 1307335 - RNA, 14 nt, Mycobacterium tuberculosis H37Rv
gccacgucggcgaa

SEQ ID NO: 1307336 - RNA, 15 nt, Mycobacterium tuberculosis H37Rv
gccacgucggcgaac

SEQ ID NO: 1307337 - RNA, 19 nt, Mycobacterium tuberculosis H37Rv
gccacguccaucaccggcg

SEQ ID NO: 1307338 - RNA, 16 nt, Mycobacterium tuberculosis H37Rv
gccacgucgaugugcg

SEQ ID NO: 1307339 - RNA, 22 nt, Mycobacterium tuberculosis H37Rv
gccacuccugaguuccggucga

SEQ ID NO: 1307340 - RNA, 16 nt, Mycobacterium tuberculosis H37Rv
gccacugcuuccggaa

SEQ ID NO: 1307341 - RNA, 21 nt, Mycobacterium tuberculosis H37Rv
gccacuguugaagaagcccga

SEQ ID NO: 1307342 - RNA, 17 nt, Mycobacterium tuberculosis H37Rv
gccacguugaucccgaa

SEQ ID NO: 1307343 - RNA, 16 nt, Mycobacterium tuberculosis H37Rv
gccacguggucgagca

SEQ ID NO: 1307344 - RNA, 17 nt, Mycobacterium tuberculosis H37Rv
gccacguuguccgcgac

SEQ ID NO: 1307345 - RNA, 20 nt, Mycobacterium tuberculosis H37Rv
gccacguggucgagcaggcg

SEQ ID NO: 1307346 - RNA, 20 nt, Mycobacterium tuberculosis H37Rv
gccacuagcauugucgccgg

SEQ ID NO: 1307347 - RNA, 13 nt, Mycobacterium tuberculosis H37Rv
gccacucacuacg

SEQ ID NO: 1307348 - RNA, 17 nt, Mycobacterium tuberculosis H37Rv
gcagucgcacggugccg

SEQ ID NO: 1307349 - RNA, 16 nt, Mycobacterium tuberculosis H37Rv
gccaacuggucgccaa

SEQ ID NO: 1307350 - RNA, 23 nt, Mycobacterium tuberculosis H37Rv
gccaagaaagacgcuguccaggu

SEQ ID NO: 1307351 - RNA, 17 nt, Mycobacterium tuberculosis H37Rv
gccaacugggccgagcg

SEQ ID NO: 1307352 - RNA, 15 nt, Mycobacterium tuberculosis H37Rv
gccaacuugcucagc

SEQ ID NO: 1307353 - RNA, 14 nt, Mycobacterium tuberculosis H37Rv
gccaagacgucggc

SEQ ID NO: 1307354 - RNA, 14 nt, Mycobacterium tuberculosis H37Rv
gcagugaccgcugg

SEQ ID NO: 1307355 - RNA, 15 nt, Mycobacterium tuberculosis H37Rv
gcagugacguuccgc

SEQ ID NO: 1307356 - RNA, 15 nt, Mycobacterium tuberculosis H37Rv
gccaacucaggccgg

SEQ ID NO: 1307357 - RNA, 15 nt, Mycobacterium tuberculosis H37Rv
gccaacucgaccgac

SEQ ID NO: 1307358 - RNA, 13 nt, Mycobacterium tuberculosis H37Rv
gcagugaccucgu

SEQ ID NO: 1307359 - RNA, 18 nt, Mycobacterium tuberculosis H37Rv
gccacaaccucgucguca

SEQ ID NO: 1307360 - RNA, 21 nt, Mycobacterium tuberculosis H37Rv
gccacagcagcguugacggcu

SEQ ID NO: 1307361 - RNA, 17 nt, Mycobacterium tuberculosis H37Rv
gccacagccgaccucga

SEQ ID NO: 1307362 - RNA, 15 nt, Mycobacterium tuberculosis H37Rv
gccacagcgacagcg

SEQ ID NO: 1307363 - RNA, 16 nt, Mycobacterium tuberculosis H37Rv
gccacagcgacagcgu

SEQ ID NO: 1307364 - RNA, 15 nt, Mycobacterium tuberculosis H37Rv
gccaaguacgcgacc

SEQ ID NO: 1307365 - RNA, 19 nt, Mycobacterium tuberculosis H37Rv
gccaaguacgcgaccgcga

SEQ ID NO: 1307366 - RNA, 22 nt, Mycobacterium tuberculosis H37Rv
gccaaggcuuccuccgacgcga

SEQ ID NO: 1307367 - RNA, 20 nt, Mycobacterium tuberculosis H37Rv
gccaaguccgcucaccuuug

SEQ ID NO: 1307368 - RNA, 15 nt, Mycobacterium tuberculosis H37Rv
gccaaugcugcaggu

SEQ ID NO: 1307369 - RNA, 19 nt, Mycobacterium tuberculosis H37Rv
gccaccaucgccgccguug

SEQ ID NO: 1307370 - RNA, 17 nt, Mycobacterium tuberculosis H37Rv
gccaccaggggaccgcg

SEQ ID NO: 1307371 - RNA, 19 nt, Mycobacterium tuberculosis H37Rv
gccaccaguuguccggcua

SEQ ID NO: 1307372 - RNA, 21 nt, Mycobacterium tuberculosis H37Rv
gccaccaucaccucgcacgac

SEQ ID NO: 1307373 - RNA, 18 nt, Mycobacterium tuberculosis H37Rv
gccacccagaaugacauc

SEQ ID NO: 1307374 - RNA, 20 nt, Mycobacterium tuberculosis H37Rv
gccacccagaaugacaucgu

SEQ ID NO: 1307375 - RNA, 17 nt, Mycobacterium tuberculosis H37Rv
gccacccagaugcagcg

SEQ ID NO: 1307376 - RNA, 21 nt, Mycobacterium tuberculosis H37Rv
gccacccagcacgcgcgcgac

SEQ ID NO: 1307377 - RNA, 22 nt, Mycobacterium tuberculosis H37Rv
gccaccccgagcucaccaaggu

SEQ ID NO: 1307378 - RNA, 20 nt, Mycobacterium tuberculosis H37Rv
gccaccagcgacgaccacac

SEQ ID NO: 1307379 - RNA, 12 nt, Mycobacterium tuberculosis H37Rv
gccaccagccgg

SEQ ID NO: 1307380 - RNA, 22 nt, Mycobacterium tuberculosis H37Rv
gccaccagcgcacgcucggcac

SEQ ID NO: 1307381 - RNA, 13 nt, Mycobacterium tuberculosis H37Rv
gccaccagcccga

SEQ ID NO: 1307382 - RNA, 16 nt, Mycobacterium tuberculosis H37Rv
gccaccagcuggcgau

SEQ ID NO: 1307383 - RNA, 18 nt, Mycobacterium tuberculosis H37Rv
gccaccagggcacguucg

SEQ ID NO: 1307384 - RNA, 23 nt, Mycobacterium tuberculosis H37Rv
gccaccaaccucaucgcggucgc

SEQ ID NO: 1307385 - RNA, 19 nt, Mycobacterium tuberculosis H37Rv
gccaccacaacgccaggaa

SEQ ID NO: 1307386 - RNA, 22 nt, Mycobacterium tuberculosis H37Rv
gccacagcucgccgugaccagg

SEQ ID NO: 1307387 - RNA, 17 nt, Mycobacterium tuberculosis H37Rv
gccaccacccaggccau

SEQ ID NO: 1307388 - RNA, 22 nt, Mycobacterium tuberculosis H37Rv
gccaccaccgccgccggcaccg

SEQ ID NO: 1307389 - RNA, 20 nt, Mycobacterium tuberculosis H37Rv
gccaccagaaacaccgacga

SEQ ID NO: 1307390 - RNA, 13 nt, Mycobacterium tuberculosis H37Rv
gccaccagaaucc

SEQ ID NO: 1307391 - RNA, 21 nt, Mycobacterium tuberculosis H37Rv
gccaccagacaacgccgucga

SEQ ID NO: 1307392 - RNA, 18 nt, Mycobacterium tuberculosis H37Rv
gccaccagacaacgccgu

SEQ ID NO: 1307393 - RNA, 23 nt, Mycobacterium tuberculosis H37Rv
gccaccacgcuccccagcgaauc

SEQ ID NO: 1307394 - RNA, 18 nt, Mycobacterium tuberculosis H37Rv
gccaccacggcgcgcucg

SEQ ID NO: 1307395 - RNA, 16 nt, Mycobacterium tuberculosis H37Rv
gccaccacgccgucga

SEQ ID NO: 1307396 - RNA, 21 nt, Mycobacterium tuberculosis H37Rv
gccaccacgccgucgacaaca

SEQ ID NO: 1307397 - RNA, 12 nt, Mycobacterium tuberculosis H37Rv
gccaccacgcgc

SEQ ID NO: 1307398 - RNA, 21 nt, Mycobacterium tuberculosis H37Rv
gcccgaggcggguacaccacg

SEQ ID NO: 1307399 - RNA, 16 nt, Mycobacterium tuberculosis H37Rv
gccccugccacgacga

SEQ ID NO: 1307400 - RNA, 22 nt, Mycobacterium tuberculosis H37Rv
gcccgaucgaagaaacggcguc

SEQ ID NO: 1307401 - RNA, 13 nt, Mycobacterium tuberculosis H37Rv
gcccgaucccgau

SEQ ID NO: 1307402 - RNA, 22 nt, Mycobacterium tuberculosis H37Rv
gcccgagugugaaucgcacgac

SEQ ID NO: 1307403 - RNA, 14 nt, Mycobacterium tuberculosis H37Rv
gcccgaucagccgu

SEQ ID NO: 1307404 - RNA, 23 nt, Mycobacterium tuberculosis H37Rv
gcccgauccggaucccaccaccg

SEQ ID NO: 1307405 - RNA, 22 nt, Mycobacterium tuberculosis H37Rv
gcccgauccgguuaugcgguac

SEQ ID NO: 1307406 - RNA, 18 nt, Mycobacterium tuberculosis H37Rv
gcccgauccccggagaac

SEQ ID NO: 1307407 - RNA, 19 nt, Mycobacterium tuberculosis H37Rv
gcccgagucucgucgggua

SEQ ID NO: 1307408 - RNA, 16 nt, Mycobacterium tuberculosis H37Rv
gcccgcagcgcuucca

SEQ ID NO: 1307409 - RNA, 21 nt, Mycobacterium tuberculosis H37Rv
gcccgcaacacugaguucggu

SEQ ID NO: 1307410 - RNA, 16 nt, Mycobacterium tuberculosis H37Rv
gcccgauggugccgac

SEQ ID NO: 1307411 - RNA, 20 nt, Mycobacterium tuberculosis H37Rv
gcccgaugcccucgauggcc

SEQ ID NO: 1307412 - RNA, 21 nt, Mycobacterium tuberculosis H37Rv
gcccgccagucccccgcucga

SEQ ID NO: 1307413 - RNA, 15 nt, Mycobacterium tuberculosis H37Rv
gcccgcauugaucuc

SEQ ID NO: 1307414 - RNA, 23 nt, Mycobacterium tuberculosis H37Rv
gcccgcauugccaacgcccacgu

SEQ ID NO: 1307415 - RNA, 20 nt, Mycobacterium tuberculosis H37Rv
gcccgcggacgugccggucc

SEQ ID NO: 1307416 - RNA, 15 nt, Mycobacterium tuberculosis H37Rv
gcccgcgcucgcacc

SEQ ID NO: 1307417 - RNA, 13 nt, Mycobacterium tuberculosis H37Rv
gcccgcgcucggc

SEQ ID NO: 1307418 - RNA, 16 nt, Mycobacterium tuberculosis H37Rv
gcccgcgcucggcaug

SEQ ID NO: 1307419 - RNA, 21 nt, Mycobacterium tuberculosis H37Rv
gcccgcgcguacccgaucagc

SEQ ID NO: 1307420 - RNA, 22 nt, Mycobacterium tuberculosis H37Rv
gcccgcguugccaaagcccaca

SEQ ID NO: 1307421 - RNA, 23 nt, Mycobacterium tuberculosis H37Rv
gcccgcguuugcgaagcccacgu

SEQ ID NO: 1307422 - RNA, 13 nt, Mycobacterium tuberculosis H37Rv
gcccgcgucgacg

SEQ ID NO: 1307423 - RNA, 17 nt, Mycobacterium tuberculosis H37Rv
gcccgcgugcgcauccc

SEQ ID NO: 1307424 - RNA, 19 nt, Mycobacterium tuberculosis H37Rv
gcccgcgugcgcaucccga

SEQ ID NO: 1307425 - RNA, 14 nt, Mycobacterium tuberculosis H37Rv
gcccgcggugacgc

SEQ ID NO: 1307426 - RNA, 18 nt, Mycobacterium tuberculosis H37Rv
gcccgcgguccggcgaaa

SEQ ID NO: 1307427 - RNA, 22 nt, Mycobacterium tuberculosis H37Rv
gcccgcgaauacgaggacgacg

SEQ ID NO: 1307428 - RNA, 14 nt, Mycobacterium tuberculosis H37Rv
gcccgcgagcugua

SEQ ID NO: 1307429 - RNA, 18 nt, Mycobacterium tuberculosis H37Rv
gcccgcgcggcgcauucc

SEQ ID NO: 1307430 - RNA, 13 nt, Mycobacterium tuberculosis H37Rv
gcccgccggcaac

SEQ ID NO: 1307431 - RNA, 15 nt, Mycobacterium tuberculosis H37Rv
gccccccgacuccgg

SEQ ID NO: 1307432 - RNA, 20 nt, Mycobacterium tuberculosis H37Rv
gccccccggcgacggcguag

SEQ ID NO: 1307433 - RNA, 15 nt, Mycobacterium tuberculosis H37Rv
aagacgccggcgaug

SEQ ID NO: 1307434 - RNA, 16 nt, Mycobacterium tuberculosis H37Rv
gccccgcggccagcag

SEQ ID NO: 1307435 - RNA, 15 nt, Mycobacterium tuberculosis H37Rv
gccccgcggccagca

SEQ ID NO: 1307436 - RNA, 21 nt, Mycobacterium tuberculosis H37Rv
gccccgcgcguucggcgagca

SEQ ID NO: 1307437 - RNA, 15 nt, Mycobacterium tuberculosis H37Rv
gccccgcgcagcguc

SEQ ID NO: 1307438 - RNA, 14 nt, Mycobacterium tuberculosis H37Rv
gccccgccgucacc

SEQ ID NO: 1307439 - RNA, 17 nt, Mycobacterium tuberculosis H37Rv
gccccgacauacgucgg

SEQ ID NO: 1307440 - RNA, 22 nt, Mycobacterium tuberculosis H37Rv
gccccgugggccucgaucagcg

SEQ ID NO: 1307441 - RNA, 16 nt, Mycobacterium tuberculosis H37Rv
gccccgucgccgauca

SEQ ID NO: 1307442 - RNA, 15 nt, Mycobacterium tuberculosis H37Rv
gccccggugccgacc

SEQ ID NO: 1307443 - RNA, 14 nt, Mycobacterium tuberculosis H37Rv
gccccggucggcga

SEQ ID NO: 1307444 - RNA, 17 nt, Mycobacterium tuberculosis H37Rv
gccccgggggaagcgcc

SEQ ID NO: 1307445 - RNA, 16 nt, Mycobacterium tuberculosis H37Rv
gccccggcgcguucca

SEQ ID NO: 1307446 - RNA, 17 nt, Mycobacterium tuberculosis H37Rv
gccccggcgcggccagc

SEQ ID NO: 1307447 - RNA, 18 nt, Mycobacterium tuberculosis H37Rv
gccccggcgacccgguca

SEQ ID NO: 1307448 - RNA, 15 nt, Mycobacterium tuberculosis H37Rv
gccccaccgacagcc

SEQ ID NO: 1307449 - RNA, 21 nt, Mycobacterium tuberculosis H37Rv
gcccaucuucggacgccagcu

SEQ ID NO: 1307450 - RNA, 14 nt, Mycobacterium tuberculosis H37Rv
gccccacaccuugg

SEQ ID NO: 1307451 - RNA, 17 nt, Mycobacterium tuberculosis H37Rv
gcccaucucaugcaucu

SEQ ID NO: 1307452 - RNA, 23 nt, Mycobacterium tuberculosis H37Rv
gcccaucucgggcaggccgucga

SEQ ID NO: 1307453 - RNA, 20 nt, Mycobacterium tuberculosis H37Rv
gccccagccaugcugcucga

SEQ ID NO: 1307454 - RNA, 14 nt, Mycobacterium tuberculosis H37Rv
gccccagcugcggu

SEQ ID NO: 1307455 - RNA, 20 nt, Mycobacterium tuberculosis H37Rv
gcccccagugcacgcucggc

SEQ ID NO: 1307456 - RNA, 16 nt, Mycobacterium tuberculosis H37Rv
gccccagguagucgac

SEQ ID NO: 1307457 - RNA, 24 nt, Mycobacterium tuberculosis H37Rv
gccccaggugguucaaccggacga

SEQ ID NO: 1307458 - RNA, 16 nt, Mycobacterium tuberculosis H37Rv
gcccagcgcacggacc

SEQ ID NO: 1307459 - RNA, 17 nt, Mycobacterium tuberculosis H37Rv
gcccagcgaugcgcuca

SEQ ID NO: 1307460 - RNA, 15 nt, Mycobacterium tuberculosis H37Rv
gcccagcgacccggc

SEQ ID NO: 1307461 - RNA, 18 nt, Mycobacterium tuberculosis H37Rv
gcccagcgaccgcugcag

SEQ ID NO: 1307462 - RNA, 19 nt, Mycobacterium tuberculosis H37Rv
gcccagccggguggacacc

SEQ ID NO: 1307463 - RNA, 16 nt, Mycobacterium tuberculosis H37Rv
gcccagccggaccgcg

SEQ ID NO: 1307464 - RNA, 14 nt, Mycobacterium tuberculosis H37Rv
gcccagccgccagc

SEQ ID NO: 1307465 - RNA, 14 nt, Mycobacterium tuberculosis H37Rv
gcccagcccggcgu

SEQ ID NO: 1307466 - RNA, 18 nt, Mycobacterium tuberculosis H37Rv
gcccaggcaaaccgauca

SEQ ID NO: 1307467 - RNA, 14 nt, Mycobacterium tuberculosis H37Rv
gcccaggcauggcc

SEQ ID NO: 1307468 - RNA, 17 nt, Mycobacterium tuberculosis H37Rv
gcccagcugcgccgaac

SEQ ID NO: 1307469 - RNA, 23 nt, Mycobacterium tuberculosis H37Rv
gcccagcgucugugucccgucga

SEQ ID NO: 1307470 - RNA, 18 nt, Mycobacterium tuberculosis H37Rv
gcccagcgucaucccgau

SEQ ID NO: 1307471 - RNA, 14 nt, Mycobacterium tuberculosis H37Rv
gcccagcggaauca

SEQ ID NO: 1307472 - RNA, 20 nt, Mycobacterium tuberculosis H37Rv
gcccagcaggucgucggcgu

SEQ ID NO: 1307473 - RNA, 22 nt, Mycobacterium tuberculosis H37Rv
gcccagcagguuccacggccag

SEQ ID NO: 1307474 - RNA, 16 nt, Mycobacterium tuberculosis H37Rv
gcccagcaaggcccga

SEQ ID NO: 1307475 - RNA, 20 nt, Mycobacterium tuberculosis H37Rv
gcccagaaaaccgccgcaac

SEQ ID NO: 1307476 - RNA, 16 nt, Mycobacterium tuberculosis H37Rv
gcccacggcgaccagg

SEQ ID NO: 1307477 - RNA, 15 nt, Mycobacterium tuberculosis H37Rv
gcccacggcagcgcc

SEQ ID NO: 1307478 - RNA, 17 nt, Mycobacterium tuberculosis H37Rv
gcccacggcgaccacgc

SEQ ID NO: 1307479 - RNA, 18 nt, Mycobacterium tuberculosis H37Rv
gcccacgggccggccgag

SEQ ID NO: 1307480 - RNA, 19 nt, Mycobacterium tuberculosis H37Rv
gcccacguugacggcgaac

SEQ ID NO: 1307481 - RNA, 19 nt, Mycobacterium tuberculosis H37Rv
gcccaccgucgcauacgcc

SEQ ID NO: 1307482 - RNA, 12 nt, Mycobacterium tuberculosis H37Rv
gcccaccggucg

SEQ ID NO: 1307483 - RNA, 14 nt, Mycobacterium tuberculosis H37Rv
gccauuggacagcg

SEQ ID NO: 1307484 - RNA, 14 nt, Mycobacterium tuberculosis H37Rv
gccauugucgccaa

SEQ ID NO: 1307485 - RNA, 19 nt, Mycobacterium tuberculosis H37Rv
gccauucuucgaucagcgg

SEQ ID NO: 1307486 - RNA, 18 nt, Mycobacterium tuberculosis H37Rv
gccauguugcccugcaac

SEQ ID NO: 1307487 - RNA, 15 nt, Mycobacterium tuberculosis H37Rv
gccauguggacggca

SEQ ID NO: 1307488 - RNA, 14 nt, Mycobacterium tuberculosis H37Rv
gccauguggcgucg

SEQ ID NO: 1307489 - RNA, 16 nt, Mycobacterium tuberculosis H37Rv
aagaccgacagcggca

SEQ ID NO: 1307490 - RNA, 14 nt, Mycobacterium tuberculosis H37Rv
aagaccaccgccca

SEQ ID NO: 1307491 - RNA, 16 nt, Mycobacterium tuberculosis H37Rv
aagaccaagagcgcgc

SEQ ID NO: 1307492 - RNA, 14 nt, Mycobacterium tuberculosis H37Rv
aagacagcgcggga

SEQ ID NO: 1307493 - RNA, 16 nt, Mycobacterium tuberculosis H37Rv
aagacaccggcgucga

SEQ ID NO: 1307494 - RNA, 21 nt, Mycobacterium tuberculosis H37Rv
gccagucgugcuugcccgguu

SEQ ID NO: 1307495 - RNA, 14 nt, Mycobacterium tuberculosis H37Rv
gccaugcggcgcgu

SEQ ID NO: 1307496 - RNA, 21 nt, Mycobacterium tuberculosis H37Rv
gccaugcuaggaccaccagcg

SEQ ID NO: 1307497 - RNA, 18 nt, Mycobacterium tuberculosis H37Rv
gccaugcgccaacccggc

SEQ ID NO: 1307498 - RNA, 17 nt, Mycobacterium tuberculosis H37Rv
gccaugcuaggaccacc

SEQ ID NO: 1307499 - RNA, 15 nt, Mycobacterium tuberculosis H37Rv
gccaugcugcccuug

SEQ ID NO: 1307500 - RNA, 18 nt, Mycobacterium tuberculosis H37Rv
gccauggccgccguuggc

SEQ ID NO: 1307501 - RNA, 14 nt, Mycobacterium tuberculosis H37Rv
gcccacaccagcgc

SEQ ID NO: 1307502 - RNA, 19 nt, Mycobacterium tuberculosis H37Rv
gcccacaccagcgcagcau

SEQ ID NO: 1307503 - RNA, 22 nt, Mycobacterium tuberculosis H37Rv
gcccaauccaccgauucggcga

SEQ ID NO: 1307504 - RNA, 17 nt, Mycobacterium tuberculosis H37Rv
gcccaauggcguucguc

SEQ ID NO: 1307505 - RNA, 17 nt, Mycobacterium tuberculosis H37Rv
gcccaacucggccagcu

SEQ ID NO: 1307506 - RNA, 23 nt, Mycobacterium tuberculosis H37Rv
gcccaacgcgauguccagguggc

SEQ ID NO: 1307507 - RNA, 17 nt, Mycobacterium tuberculosis H37Rv
gcccaagcaguccacga

SEQ ID NO: 1307508 - RNA, 22 nt, Mycobacterium tuberculosis H37Rv
gcccaaguucuaagcguuuggc

SEQ ID NO: 1307509 - RNA, 15 nt, Mycobacterium tuberculosis H37Rv
gcccaacgucgccag

SEQ ID NO: 1307510 - RNA, 17 nt, Mycobacterium tuberculosis H37Rv
gcccaacggaagaccgc

SEQ ID NO: 1307511 - RNA, 20 nt, Mycobacterium tuberculosis H37Rv
gcccaacgcgagcuugauuc

SEQ ID NO: 1307512 - RNA, 18 nt, Mycobacterium tuberculosis H37Rv
gcccaacaacgcuucggc

SEQ ID NO: 1307513 - RNA, 13 nt, Mycobacterium tuberculosis H37Rv
gcccaaccggucg

SEQ ID NO: 1307514 - RNA, 13 nt, Mycobacterium tuberculosis H37Rv
gcccaacaccgcg

SEQ ID NO: 1307515 - RNA, 17 nt, Mycobacterium tuberculosis H37Rv
gcccaaaagcgcggcaa

SEQ ID NO: 1307516 - RNA, 20 nt, Mycobacterium tuberculosis H37Rv
gcccaaaacgucaccgccgg

SEQ ID NO: 1307517 - RNA, 14 nt, Mycobacterium tuberculosis H37Rv
gcccaaaagcgcgg

SEQ ID NO: 1307518 - RNA, 20 nt, Mycobacterium tuberculosis H37Rv
gcccaccgcaacgcuucggc

SEQ ID NO: 1307519 - RNA, 21 nt, Mycobacterium tuberculosis H37Rv
gcccacccgggugggccagug

SEQ ID NO: 1307520 - RNA, 18 nt, Mycobacterium tuberculosis H37Rv
gcccaccgcugcggcacc

SEQ ID NO: 1307521 - RNA, 22 nt, Mycobacterium tuberculosis H37Rv
gcccacauguccagcguccugg

SEQ ID NO: 1307522 - RNA, 17 nt, Mycobacterium tuberculosis H37Rv
gcccacauguccagcgu

SEQ ID NO: 1307523 - RNA, 18 nt, Mycobacterium tuberculosis H37Rv
gcccacagcugacgagcc

SEQ ID NO: 1307524 - RNA, 15 nt, Mycobacterium tuberculosis H37Rv
gccgcgcguuccagc

SEQ ID NO: 1307525 - RNA, 15 nt, Mycobacterium tuberculosis H37Rv
gccgcgcguccgggc

SEQ ID NO: 1307526 - RNA, 13 nt, Mycobacterium tuberculosis H37Rv
gccgcgcgguacu

SEQ ID NO: 1307527 - RNA, 14 nt, Mycobacterium tuberculosis H37Rv
gccgcgcgggucac

SEQ ID NO: 1307528 - RNA, 18 nt, Mycobacterium tuberculosis H37Rv
gccgcgcgggugcucggu

SEQ ID NO: 1307529 - RNA, 13 nt, Mycobacterium tuberculosis H37Rv
gccgcgcggcgac

SEQ ID NO: 1307530 - RNA, 15 nt, Mycobacterium tuberculosis H37Rv
gccgcgcggcgagag

SEQ ID NO: 1307531 - RNA, 22 nt, Mycobacterium tuberculosis H37Rv
gccgcgcgcugccgcugcgcgu

SEQ ID NO: 1307532 - RNA, 18 nt, Mycobacterium tuberculosis H37Rv
gccgcgcgacaacccggc

SEQ ID NO: 1307533 - RNA, 15 nt, Mycobacterium tuberculosis H37Rv
gccgcgccgucccga

SEQ ID NO: 1307534 - RNA, 16 nt, Mycobacterium tuberculosis H37Rv
gccgcgccgucggcga

SEQ ID NO: 1307535 - RNA, 13 nt, Mycobacterium tuberculosis H37Rv
gccgcgccggcac

SEQ ID NO: 1307536 - RNA, 13 nt, Mycobacterium tuberculosis H37Rv
gccgcgccgcaga

SEQ ID NO: 1307537 - RNA, 21 nt, Mycobacterium tuberculosis H37Rv
gccgcgccgaccucaucggca

SEQ ID NO: 1307538 - RNA, 18 nt, Mycobacterium tuberculosis H37Rv
gccgcgccgauuccaccg

SEQ ID NO: 1307539 - RNA, 14 nt, Mycobacterium tuberculosis H37Rv
gccgcgccgaaucg

SEQ ID NO: 1307540 - RNA, 17 nt, Mycobacterium tuberculosis H37Rv
gccgcgccgaaucgcgg

SEQ ID NO: 1307541 - RNA, 20 nt, Mycobacterium tuberculosis H37Rv
gccgcgcccggcgcaagcgc

SEQ ID NO: 1307542 - RNA, 20 nt, Mycobacterium tuberculosis H37Rv
gccgcgcucgucgaaguagc

SEQ ID NO: 1307543 - RNA, 14 nt, Mycobacterium tuberculosis H37Rv
gccgcgcucgucga

SEQ ID NO: 1307544 - RNA, 13 nt, Mycobacterium tuberculosis H37Rv
gccgcgcucgaac

SEQ ID NO: 1307545 - RNA, 19 nt, Mycobacterium tuberculosis H37Rv
gccgcggacuugcgagccg

SEQ ID NO: 1307546 - RNA, 17 nt, Mycobacterium tuberculosis H37Rv
gccgcggacguggucgg

SEQ ID NO: 1307547 - RNA, 16 nt, Mycobacterium tuberculosis H37Rv
gccgcggacggcgaac

SEQ ID NO: 1307548 - RNA, 20 nt, Mycobacterium tuberculosis H37Rv
gccgcggaggcggccagccu

SEQ ID NO: 1307549 - RNA, 21 nt, Mycobacterium tuberculosis H37Rv
gccgcggcacccaggugucgc

SEQ ID NO: 1307550 - RNA, 16 nt, Mycobacterium tuberculosis H37Rv
gccgcggcacccaggu

SEQ ID NO: 1307551 - RNA, 21 nt, Mycobacterium tuberculosis H37Rv
gccgcggccacaaccucgucg

SEQ ID NO: 1307552 - RNA, 14 nt, Mycobacterium tuberculosis H37Rv
gccgcggaccgcga

SEQ ID NO: 1307553 - RNA, 14 nt, Mycobacterium tuberculosis H37Rv
gccgcgcuugcgau

SEQ ID NO: 1307554 - RNA, 17 nt, Mycobacterium tuberculosis H37Rv
gccgcggcggcagcggc

SEQ ID NO: 1307555 - RNA, 14 nt, Mycobacterium tuberculosis H37Rv
gccgcggcggccag

SEQ ID NO: 1307556 - RNA, 17 nt, Mycobacterium tuberculosis H37Rv
gccgcggcggccagcgc

SEQ ID NO: 1307557 - RNA, 18 nt, Mycobacterium tuberculosis H37Rv
gccgcggcggaauucggg

SEQ ID NO: 1307558 - RNA, 13 nt, Mycobacterium tuberculosis H37Rv
gccgcggcgccua

SEQ ID NO: 1307559 - RNA, 17 nt, Mycobacterium tuberculosis H37Rv
gccgcggcgcgacggca

SEQ ID NO: 1307560 - RNA, 14 nt, Mycobacterium tuberculosis H37Rv
gccgcggcccucga

SEQ ID NO: 1307561 - RNA, 21 nt, Mycobacterium tuberculosis H37Rv
gccgcggcccgcucgaucggc

SEQ ID NO: 1307562 - RNA, 20 nt, Mycobacterium tuberculosis H37Rv
gccgcggccacaucgccagc

SEQ ID NO: 1307563 - RNA, 23 nt, Mycobacterium tuberculosis H37Rv
gccgcggccaccgccgccgccga

SEQ ID NO: 1307564 - RNA, 16 nt, Mycobacterium tuberculosis H37Rv
gccgcggcugccaucc

SEQ ID NO: 1307565 - RNA, 17 nt, Mycobacterium tuberculosis H37Rv
gccgcgggacaccaccg

SEQ ID NO: 1307566 - RNA, 17 nt, Mycobacterium tuberculosis H37Rv
gccgcgggacaucaccg

SEQ ID NO: 1307567 - RNA, 18 nt, Mycobacterium tuberculosis H37Rv
gccgcgggacaucaccgc

SEQ ID NO: 1307568 - RNA, 15 nt, Mycobacterium tuberculosis H37Rv
gccgcggggaucagc

SEQ ID NO: 1307569 - RNA, 15 nt, Mycobacterium tuberculosis H37Rv
gccgcggucguuggc

SEQ ID NO: 1307570 - RNA, 24 nt, Mycobacterium tuberculosis H37Rv
gccgcggucgugaucagcaggacg

SEQ ID NO: 1307571 - RNA, 18 nt, Mycobacterium tuberculosis H37Rv
gccgcggucgugaucagc

SEQ ID NO: 1307572 - RNA, 14 nt, Mycobacterium tuberculosis H37Rv
gccgcggucggcca

SEQ ID NO: 1307573 - RNA, 15 nt, Mycobacterium tuberculosis H37Rv
gccgcggucggcgac

SEQ ID NO: 1307574 - RNA, 20 nt, Mycobacterium tuberculosis H37Rv
gccgcggucagauccagaga

SEQ ID NO: 1307575 - RNA, 17 nt, Mycobacterium tuberculosis H37Rv
gccgcggucggaccacc

SEQ ID NO: 1307576 - RNA, 13 nt, Mycobacterium tuberculosis H37Rv
gccgcgugcagcc

SEQ ID NO: 1307577 - RNA, 14 nt, Mycobacterium tuberculosis H37Rv
gccgcgucgucggc

SEQ ID NO: 1307578 - RNA, 16 nt, Mycobacterium tuberculosis H37Rv
gccgcgucgcugagca

SEQ ID NO: 1307579 - RNA, 15 nt, Mycobacterium tuberculosis H37Rv
gccgcgucgagcacc

SEQ ID NO: 1307580 - RNA, 15 nt, Mycobacterium tuberculosis H37Rv
gccgcgucgaacugg

SEQ ID NO: 1307581 - RNA, 22 nt, Mycobacterium tuberculosis H37Rv
gccgcguaggccuugcucagcc

SEQ ID NO: 1307582 - RNA, 20 nt, Mycobacterium tuberculosis H37Rv
gccgcguagguggccagcgc

SEQ ID NO: 1307583 - RNA, 17 nt, Mycobacterium tuberculosis H37Rv
gccgcgguuaucgccga

SEQ ID NO: 1307584 - RNA, 21 nt, Mycobacterium tuberculosis H37Rv
gccgcgguguagaagcgggcg

SEQ ID NO: 1307585 - RNA, 22 nt, Mycobacterium tuberculosis H37Rv
gccgcgguguauccgacgucgg

SEQ ID NO: 1307586 - RNA, 15 nt, Mycobacterium tuberculosis H37Rv
gccgcggugacggga

SEQ ID NO: 1307587 - RNA, 19 nt, Mycobacterium tuberculosis H37Rv
gccgcggugaugggccagg

SEQ ID NO: 1307588 - RNA, 15 nt, Mycobacterium tuberculosis H37Rv
gccgcggugccaacc

SEQ ID NO: 1307589 - RNA, 21 nt, Mycobacterium tuberculosis H37Rv
gccgcucgcugaaccggaucg

SEQ ID NO: 1307590 - RNA, 21 nt, Mycobacterium tuberculosis H37Rv
gccgcugaacucaacgggacc

SEQ ID NO: 1307591 - RNA, 23 nt, Mycobacterium tuberculosis H37Rv
gccgcugaagccaggauugccgc

SEQ ID NO: 1307592 - RNA, 16 nt, Mycobacterium tuberculosis H37Rv
gccgcuccacguacgc

SEQ ID NO: 1307593 - RNA, 14 nt, Mycobacterium tuberculosis H37Rv
gccgcucauccagc

SEQ ID NO: 1307594 - RNA, 13 nt, Mycobacterium tuberculosis H37Rv
gccgcuaccguca

SEQ ID NO: 1307595 - RNA, 19 nt, Mycobacterium tuberculosis H37Rv
gccgcuacccccgauggcg

SEQ ID NO: 1307596 - RNA, 23 nt, Mycobacterium tuberculosis H37Rv
gccgcuaucgaggaggcggucga

SEQ ID NO: 1307597 - RNA, 23 nt, Mycobacterium tuberculosis H37Rv
gccgcucacauacagcaggccgc

SEQ ID NO: 1307598 - RNA, 17 nt, Mycobacterium tuberculosis H37Rv
gccgcguugccggucgc

SEQ ID NO: 1307599 - RNA, 18 nt, Mycobacterium tuberculosis H37Rv
gccgcguuucccggaaua

SEQ ID NO: 1307600 - RNA, 20 nt, Mycobacterium tuberculosis H37Rv
gccgcguggcuggcggcgac

SEQ ID NO: 1307601 - RNA, 23 nt, Mycobacterium tuberculosis H37Rv
gccgcgugguuccggcgugcagc

SEQ ID NO: 1307602 - RNA, 13 nt, Mycobacterium tuberculosis H37Rv
gccgcgugcucgc

SEQ ID NO: 1307603 - RNA, 19 nt, Mycobacterium tuberculosis H37Rv
gccgccggcggcgguaccg

SEQ ID NO: 1307604 - RNA, 19 nt, Mycobacterium tuberculosis H37Rv
gccgccggcgccgccggca

SEQ ID NO: 1307605 - RNA, 16 nt, Mycobacterium tuberculosis H37Rv
gccgccggcgccggca

SEQ ID NO: 1307606 - RNA, 21 nt, Mycobacterium tuberculosis H37Rv
gccgccggcgcccaggccgau

SEQ ID NO: 1307607 - RNA, 15 nt, Mycobacterium tuberculosis H37Rv
gccgccggcuccgcc

SEQ ID NO: 1307608 - RNA, 18 nt, Mycobacterium tuberculosis H37Rv
gccgccggcuccgccagc

SEQ ID NO: 1307609 - RNA, 15 nt, Mycobacterium tuberculosis H37Rv
gccgccggugccacc

SEQ ID NO: 1307610 - RNA, 16 nt, Mycobacterium tuberculosis H37Rv
gccgccggugccaccg

SEQ ID NO: 1307611 - RNA, 20 nt, Mycobacterium tuberculosis H37Rv
gccgccggugccacccuugc

SEQ ID NO: 1307612 - RNA, 15 nt, Mycobacterium tuberculosis H37Rv
gccgccggugccgau

SEQ ID NO: 1307613 - RNA, 17 nt, Mycobacterium tuberculosis H37Rv
gccgccggugccgauca

SEQ ID NO: 1307614 - RNA, 14 nt, Mycobacterium tuberculosis H37Rv
gccgccggucaucc

SEQ ID NO: 1307615 - RNA, 11 nt, Mycobacterium tuberculosis H37Rv
gccgccgguca

SEQ ID NO: 1307616 - RNA, 22 nt, Mycobacterium tuberculosis H37Rv
gccgccgguccauggacggcca

SEQ ID NO: 1307617 - RNA, 17 nt, Mycobacterium tuberculosis H37Rv
gccgccgggucgaacgc

SEQ ID NO: 1307618 - RNA, 23 nt, Mycobacterium tuberculosis H37Rv
gccgccguccccaccgacgccga

SEQ ID NO: 1307619 - RNA, 22 nt, Mycobacterium tuberculosis H37Rv
gccgccguccccgccgucgcca

SEQ ID NO: 1307620 - RNA, 15 nt, Mycobacterium tuberculosis H37Rv
gccgccgucgccgau

SEQ ID NO: 1307621 - RNA, 14 nt, Mycobacterium tuberculosis H37Rv
gccgccgucgauga

SEQ ID NO: 1307622 - RNA, 21 nt, Mycobacterium tuberculosis H37Rv
gccgccgucgccacgcccagc

SEQ ID NO: 1307623 - RNA, 18 nt, Mycobacterium tuberculosis H37Rv
gccgccgucggcgagcag

SEQ ID NO: 1307624 - RNA, 23 nt, Mycobacterium tuberculosis H37Rv
gccgccgucaccgccguugccga

SEQ ID NO: 1307625 - RNA, 12 nt, Mycobacterium tuberculosis H37Rv
gccgccgucacc

SEQ ID NO: 1307626 - RNA, 13 nt, Mycobacterium tuberculosis H37Rv
gccgccgucaccg

SEQ ID NO: 1307627 - RNA, 20 nt, Mycobacterium tuberculosis H37Rv
gccgccgucaccgccgacca

SEQ ID NO: 1307628 - RNA, 19 nt, Mycobacterium tuberculosis H37Rv
gccgccgguguaacccucg

SEQ ID NO: 1307629 - RNA, 14 nt, Mycobacterium tuberculosis H37Rv
gccgccgguuccgc

SEQ ID NO: 1307630 - RNA, 14 nt, Mycobacterium tuberculosis H37Rv
gccgccggugccgc

SEQ ID NO: 1307631 - RNA, 14 nt, Mycobacterium tuberculosis H37Rv
gccgccgguggugc

SEQ ID NO: 1307632 - RNA, 14 nt, Mycobacterium tuberculosis H37Rv
gccgccgugguugc

SEQ ID NO: 1307633 - RNA, 21 nt, Mycobacterium tuberculosis H37Rv
gccgccguggcgucggcguca

SEQ ID NO: 1307634 - RNA, 23 nt, Mycobacterium tuberculosis H37Rv
gccgccguucccaccaccaccgc

SEQ ID NO: 1307635 - RNA, 19 nt, Mycobacterium tuberculosis H37Rv
gccgccguuaccgagcccg

SEQ ID NO: 1307636 - RNA, 16 nt, Mycobacterium tuberculosis H37Rv
gccgccgucgucgucg

SEQ ID NO: 1307637 - RNA, 18 nt, Mycobacterium tuberculosis H37Rv
gccgccguugccgccagc

SEQ ID NO: 1307638 - RNA, 20 nt, Mycobacterium tuberculosis H37Rv
gccgccguugccgccagcgc

SEQ ID NO: 1307639 - RNA, 18 nt, Mycobacterium tuberculosis H37Rv
gccgccguugccgccgaa

SEQ ID NO: 1307640 - RNA, 15 nt, Mycobacterium tuberculosis H37Rv
gccgccguugccacc

SEQ ID NO: 1307641 - RNA, 16 nt, Mycobacterium tuberculosis H37Rv
gccgccguugccaccg

SEQ ID NO: 1307642 - RNA, 23 nt, Mycobacterium tuberculosis H37Rv
gccgccguugccaccguagccga

SEQ ID NO: 1307643 - RNA, 17 nt, Mycobacterium tuberculosis H37Rv
gccgccguugccgauca

SEQ ID NO: 1307644 - RNA, 14 nt, Mycobacterium tuberculosis H37Rv
gccgccguugccgu

SEQ ID NO: 1307645 - RNA, 20 nt, Mycobacterium tuberculosis H37Rv
gccgccguugccgucgucgc

SEQ ID NO: 1307646 - RNA, 23 nt, Mycobacterium tuberculosis H37Rv
gccgccagauuggcgcugcccgc

SEQ ID NO: 1307647 - RNA, 15 nt, Mycobacterium tuberculosis H37Rv
gccgccacugccggc

SEQ ID NO: 1307648 - RNA, 13 nt, Mycobacterium tuberculosis H37Rv
gccgccgauaccg

SEQ ID NO: 1307649 - RNA, 13 nt, Mycobacterium tuberculosis H37Rv
gccgccgcccugg

SEQ ID NO: 1307650 - RNA, 13 nt, Mycobacterium tuberculosis H37Rv
gccgccgccgauc

SEQ ID NO: 1307651 - RNA, 17 nt, Mycobacterium tuberculosis H37Rv
gccgccgaugucgacga

SEQ ID NO: 1307652 - RNA, 15 nt, Mycobacterium tuberculosis H37Rv
gccgccgaugccgcc

SEQ ID NO: 1307653 - RNA, 17 nt, Mycobacterium tuberculosis H37Rv
gccgccggacccgucga

SEQ ID NO: 1307654 - RNA, 19 nt, Mycobacterium tuberculosis H37Rv
gccgccggacccgucgagc

SEQ ID NO: 1307655 - RNA, 23 nt, Mycobacterium tuberculosis H37Rv
gccgccgcuuucgccggcgccaa

SEQ ID NO: 1307656 - RNA, 23 nt, Mycobacterium tuberculosis H37Rv
gccgccggaagcgccggccgauc

SEQ ID NO: 1307657 - RNA, 14 nt, Mycobacterium tuberculosis H37Rv
gccgccggaaucga

SEQ ID NO: 1307658 - RNA, 15 nt, Mycobacterium tuberculosis H37Rv
gccgccgcugccgcc

SEQ ID NO: 1307659 - RNA, 15 nt, Mycobacterium tuberculosis H37Rv
gccgccgcggcgaag

SEQ ID NO: 1307660 - RNA, 14 nt, Mycobacterium tuberculosis H37Rv
gccgccgcggccac

SEQ ID NO: 1307661 - RNA, 15 nt, Mycobacterium tuberculosis H37Rv
gccgccggcgccagc

SEQ ID NO: 1307662 - RNA, 17 nt, Mycobacterium tuberculosis H37Rv
gccgccggcgccagcgc

SEQ ID NO: 1307663 - RNA, 18 nt, Mycobacterium tuberculosis H37Rv
gccgccggccaugugcac

SEQ ID NO: 1307664 - RNA, 23 nt, Mycobacterium tuberculosis H37Rv
gccgccggccaguccgcgcgcaa

SEQ ID NO: 1307665 - RNA, 15 nt, Mycobacterium tuberculosis H37Rv
gccgccggccagcgu

SEQ ID NO: 1307666 - RNA, 13 nt, Mycobacterium tuberculosis H37Rv
gccgccggccagc

SEQ ID NO: 1307667 - RNA, 17 nt, Mycobacterium tuberculosis H37Rv
gccgccggcagcgcgga

SEQ ID NO: 1307668 - RNA, 19 nt, Mycobacterium tuberculosis H37Rv
gccgccggcaccgccggca

SEQ ID NO: 1307669 - RNA, 17 nt, Mycobacterium tuberculosis H37Rv
gccgccggcaccaccgu

SEQ ID NO: 1307670 - RNA, 15 nt, Mycobacterium tuberculosis H37Rv
gccgccggaucgccg

SEQ ID NO: 1307671 - RNA, 15 nt, Mycobacterium tuberculosis H37Rv
gccgccggaucgcca

SEQ ID NO: 1307672 - RNA, 15 nt, Mycobacterium tuberculosis H37Rv
gccgccugacccggc

SEQ ID NO: 1307673 - RNA, 16 nt, Mycobacterium tuberculosis H37Rv
gccgccuccgcggcau

SEQ ID NO: 1307674 - RNA, 16 nt, Mycobacterium tuberculosis H37Rv
gccgccuccggugcau

SEQ ID NO: 1307675 - RNA, 18 nt, Mycobacterium tuberculosis H37Rv
gccgccucaaugaccacc

SEQ ID NO: 1307676 - RNA, 14 nt, Mycobacterium tuberculosis H37Rv
gccgccuucgccgc

SEQ ID NO: 1307677 - RNA, 20 nt, Mycobacterium tuberculosis H37Rv
gccgccugcuccucggccag

SEQ ID NO: 1307678 - RNA, 23 nt, Mycobacterium tuberculosis H37Rv
gccgccugcuccucggccagcgu

SEQ ID NO: 1307679 - RNA, 21 nt, Mycobacterium tuberculosis H37Rv
gccgccuggacgccgccggag

SEQ ID NO: 1307680 - RNA, 20 nt, Mycobacterium tuberculosis H37Rv
gccgccugcgccgccagcgc

SEQ ID NO: 1307681 - RNA, 20 nt, Mycobacterium tuberculosis H37Rv
gccgccuuggucgcgucggc

SEQ ID NO: 1307682 - RNA, 17 nt, Mycobacterium tuberculosis H37Rv
gccgccuucucgcgaag

SEQ ID NO: 1307683 - RNA, 22 nt, Mycobacterium tuberculosis H37Rv
gccgcgaaaucaccgcugaggu

SEQ ID NO: 1307684 - RNA, 15 nt, Mycobacterium tuberculosis H37Rv
gccgcgaacgggucg

SEQ ID NO: 1307685 - RNA, 17 nt, Mycobacterium tuberculosis H37Rv
gccgcgaaugucgccgc

SEQ ID NO: 1307686 - RNA, 22 nt, Mycobacterium tuberculosis H37Rv
gccgcgacaaaucggucgacga

SEQ ID NO: 1307687 - RNA, 14 nt, Mycobacterium tuberculosis H37Rv
gccgcgacggcacg

SEQ ID NO: 1307688 - RNA, 19 nt, Mycobacterium tuberculosis H37Rv
gccgcgacgacacgccugg

SEQ ID NO: 1307689 - RNA, 15 nt, Mycobacterium tuberculosis H37Rv
gccgcgacgacacgc

SEQ ID NO: 1307690 - RNA, 14 nt, Mycobacterium tuberculosis H37Rv
gccgcgacgacacg

SEQ ID NO: 1307691 - RNA, 21 nt, Mycobacterium tuberculosis H37Rv
gccgcgacauccgcggcaugc

SEQ ID NO: 1307692 - RNA, 14 nt, Mycobacterium tuberculosis H37Rv
gccgcgacccgcgc

SEQ ID NO: 1307693 - RNA, 12 nt, Mycobacterium tuberculosis H37Rv
gccgcgaccagc

SEQ ID NO: 1307694 - RNA, 17 nt, Mycobacterium tuberculosis H37Rv
gccgcgaccggcguaac

SEQ ID NO: 1307695 - RNA, 20 nt, Mycobacterium tuberculosis H37Rv
gccgcgaccggcguaaccgg

SEQ ID NO: 1307696 - RNA, 16 nt, Mycobacterium tuberculosis H37Rv
gccgcgaccagcgccg

SEQ ID NO: 1307697 - RNA, 13 nt, Mycobacterium tuberculosis H37Rv
gccgcgaccgcga

SEQ ID NO: 1307698 - RNA, 21 nt, Mycobacterium tuberculosis H37Rv
gccgcgaucuccuuggccguu

SEQ ID NO: 1307699 - RNA, 12 nt, Mycobacterium tuberculosis H37Rv
gccgcgaucgac

SEQ ID NO: 1307700 - RNA, 22 nt, Mycobacterium tuberculosis H37Rv
gccgcgaucgggcccagcagcg

SEQ ID NO: 1307701 - RNA, 17 nt, Mycobacterium tuberculosis H37Rv
gccgcgaggcaccgaca

SEQ ID NO: 1307702 - RNA, 17 nt, Mycobacterium tuberculosis H37Rv
gccgcgaugacggugcc

SEQ ID NO: 1307703 - RNA, 21 nt, Mycobacterium tuberculosis H37Rv
gccgcgcaccaacaccagcgc

SEQ ID NO: 1307704 - RNA, 21 nt, Mycobacterium tuberculosis H37Rv
gccgcgcccgccucgaccgcc

SEQ ID NO: 1307705 - RNA, 16 nt, Mycobacterium tuberculosis H37Rv
gccgcgcccaccauga

SEQ ID NO: 1307706 - RNA, 24 nt, Mycobacterium tuberculosis H37Rv
gccgcgcccaccaugaucacaccg

SEQ ID NO: 1307707 - RNA, 16 nt, Mycobacterium tuberculosis H37Rv
gccgcgcccaaugcgg

SEQ ID NO: 1307708 - RNA, 12 nt, Mycobacterium tuberculosis H37Rv
gccgcgccagcu

SEQ ID NO: 1307709 - RNA, 18 nt, Mycobacterium tuberculosis H37Rv
gccgcgcaucugucgcgc

SEQ ID NO: 1307710 - RNA, 13 nt, Mycobacterium tuberculosis H37Rv
gccgcgcagcugc

SEQ ID NO: 1307711 - RNA, 20 nt, Mycobacterium tuberculosis H37Rv
gccgcgcagccgcucgacgg

SEQ ID NO: 1307712 - RNA, 20 nt, Mycobacterium tuberculosis H37Rv
gcccugcgccucggcggcca

SEQ ID NO: 1307713 - RNA, 13 nt, Mycobacterium tuberculosis H37Rv
gcccugcggccac

SEQ ID NO: 1307714 - RNA, 17 nt, Mycobacterium tuberculosis H37Rv
gcccuggcaacgacacg

SEQ ID NO: 1307715 - RNA, 15 nt, Mycobacterium tuberculosis H37Rv
gcccuggcaacgaca

SEQ ID NO: 1307716 - RNA, 13 nt, Mycobacterium tuberculosis H37Rv
gcccugcucgccg

SEQ ID NO: 1307717 - RNA, 15 nt, Mycobacterium tuberculosis H37Rv
gcccuggacgucggc

SEQ ID NO: 1307718 - RNA, 15 nt, Mycobacterium tuberculosis H37Rv
gcccugguccaggcc

SEQ ID NO: 1307719 - RNA, 19 nt, Mycobacterium tuberculosis H37Rv
gcccuucagcacggugauc

SEQ ID NO: 1307720 - RNA, 17 nt, Mycobacterium tuberculosis H37Rv
gcccuucgacgaggacg

SEQ ID NO: 1307721 - RNA, 20 nt, Mycobacterium tuberculosis H37Rv
gcccuggccgcccuggccgc

SEQ ID NO: 1307722 - RNA, 21 nt, Mycobacterium tuberculosis H37Rv
gcccucuaugcgggcagcgau

SEQ ID NO: 1307723 - RNA, 19 nt, Mycobacterium tuberculosis H37Rv
gcccucguuaucgaccgcc

SEQ ID NO: 1307724 - RNA, 21 nt, Mycobacterium tuberculosis H37Rv
gcccugacacccaucgaccgc

SEQ ID NO: 1307725 - RNA, 21 nt, Mycobacterium tuberculosis H37Rv
gcccucgccauggcguucugc

SEQ ID NO: 1307726 - RNA, 17 nt, Mycobacterium tuberculosis H37Rv
gcccucgccuucgccgc

SEQ ID NO: 1307727 - RNA, 23 nt, Mycobacterium tuberculosis H37Rv
gcccucggcggagacggcggcca

SEQ ID NO: 1307728 - RNA, 16 nt, Mycobacterium tuberculosis H37Rv
gcccuccucgaccgcg

SEQ ID NO: 1307729 - RNA, 20 nt, Mycobacterium tuberculosis H37Rv
gcccgcugagcacucaugau

SEQ ID NO: 1307730 - RNA, 16 nt, Mycobacterium tuberculosis H37Rv
gcccgcugagccagcu

SEQ ID NO: 1307731 - RNA, 20 nt, Mycobacterium tuberculosis H37Rv
gcccgcugaucagauccucg

SEQ ID NO: 1307732 - RNA, 13 nt, Mycobacterium tuberculosis H37Rv
gcccgcugcagac

SEQ ID NO: 1307733 - RNA, 21 nt, Mycobacterium tuberculosis H37Rv
gcccucgacguccaucccggc

SEQ ID NO: 1307734 - RNA, 16 nt, Mycobacterium tuberculosis H37Rv
gcccucgaugccgcgu

SEQ ID NO: 1307735 - RNA, 23 nt, Mycobacterium tuberculosis H37Rv
gcccgcucggccgcagccagcgg

SEQ ID NO: 1307736 - RNA, 17 nt, Mycobacterium tuberculosis H37Rv
gcccgcucguaggaccu

SEQ ID NO: 1307737 - RNA, 20 nt, Mycobacterium tuberculosis H37Rv
gcccgcuccugcucgucgag

SEQ ID NO: 1307738 - RNA, 21 nt, Mycobacterium tuberculosis H37Rv
gcccgcuccugcucgucgagc

SEQ ID NO: 1307739 - RNA, 19 nt, Mycobacterium tuberculosis H37Rv
gcccgcucgaucggcagcc

SEQ ID NO: 1307740 - RNA, 20 nt, Mycobacterium tuberculosis H37Rv
gcccgcuccuccggcaccaa

SEQ ID NO: 1307741 - RNA, 15 nt, Mycobacterium tuberculosis H37Rv
gcccgcucggagauc

SEQ ID NO: 1307742 - RNA, 16 nt, Mycobacterium tuberculosis H37Rv
gcccgcuacggcagcc

SEQ ID NO: 1307743 - RNA, 15 nt, Mycobacterium tuberculosis H37Rv
gcccgcucauuggca

SEQ ID NO: 1307744 - RNA, 20 nt, Mycobacterium tuberculosis H37Rv
gcccgcucauuggcauugcc

SEQ ID NO: 1307745 - RNA, 15 nt, Mycobacterium tuberculosis H37Rv
gccgaagcugcccaa

SEQ ID NO: 1307746 - RNA, 14 nt, Mycobacterium tuberculosis H37Rv
gccgaagcucaucg

SEQ ID NO: 1307747 - RNA, 16 nt, Mycobacterium tuberculosis H37Rv
gccgaacagcaggccu

SEQ ID NO: 1307748 - RNA, 18 nt, Mycobacterium tuberculosis H37Rv
gccgaauaacagcaggca

SEQ ID NO: 1307749 - RNA, 23 nt, Mycobacterium tuberculosis H37Rv
gccgaaguuuuggaagcccgaau

SEQ ID NO: 1307750 - RNA, 18 nt, Mycobacterium tuberculosis H37Rv
gccgaaguugaugucgcg

SEQ ID NO: 1307751 - RNA, 16 nt, Mycobacterium tuberculosis H37Rv
gccgacaagucaagau

SEQ ID NO: 1307752 - RNA, 17 nt, Mycobacterium tuberculosis H37Rv
gccgaauaccacaccgu

SEQ ID NO: 1307753 - RNA, 16 nt, Mycobacterium tuberculosis H37Rv
gccgacaccacggcgc

SEQ ID NO: 1307754 - RNA, 18 nt, Mycobacterium tuberculosis H37Rv
gccgaaggggaacgcgcc

SEQ ID NO: 1307755 - RNA, 22 nt, Mycobacterium tuberculosis H37Rv
gccgaaguuuuggaagcccgaa

SEQ ID NO: 1307756 - RNA, 22 nt, Mycobacterium tuberculosis H37Rv
gccgaacaccgucagcgucuga

SEQ ID NO: 1307757 - RNA, 14 nt, Mycobacterium tuberculosis H37Rv
gccgaacaccguca

SEQ ID NO: 1307758 - RNA, 16 nt, Mycobacterium tuberculosis H37Rv
gccgaaaaucgcagcc

SEQ ID NO: 1307759 - RNA, 17 nt, Mycobacterium tuberculosis H37Rv
gccgaaaaagaccgaca

SEQ ID NO: 1307760 - RNA, 23 nt, Mycobacterium tuberculosis H37Rv
gccgacacccucgggcaacucgg

SEQ ID NO: 1307761 - RNA, 14 nt, Mycobacterium tuberculosis H37Rv
gccgacacgccgau

SEQ ID NO: 1307762 - RNA, 14 nt, Mycobacterium tuberculosis H37Rv
gccgacacgaacgc

SEQ ID NO: 1307763 - RNA, 16 nt, Mycobacterium tuberculosis H37Rv
gccgacacgaacgcug

SEQ ID NO: 1307764 - RNA, 20 nt, Mycobacterium tuberculosis H37Rv
gccgaccccggaaugcccga

SEQ ID NO: 1307765 - RNA, 16 nt, Mycobacterium tuberculosis H37Rv
gccgacccgaucaccu

SEQ ID NO: 1307766 - RNA, 22 nt, Mycobacterium tuberculosis H37Rv
gccgacccgacgcuggucggcg

SEQ ID NO: 1307767 - RNA, 16 nt, Mycobacterium tuberculosis H37Rv
gccgaccagucgacgu

SEQ ID NO: 1307768 - RNA, 16 nt, Mycobacterium tuberculosis H37Rv
gccgaccaggaccacc

SEQ ID NO: 1307769 - RNA, 16 nt, Mycobacterium tuberculosis H37Rv
gccgaccaggccagag

SEQ ID NO: 1307770 - RNA, 14 nt, Mycobacterium tuberculosis H37Rv
gccgaccagcgcgg

SEQ ID NO: 1307771 - RNA, 22 nt, Mycobacterium tuberculosis H37Rv
gccgacgcuccaggguccggac

SEQ ID NO: 1307772 - RNA, 18 nt, Mycobacterium tuberculosis H37Rv
gccgacgccguugcccac

SEQ ID NO: 1307773 - RNA, 22 nt, Mycobacterium tuberculosis H37Rv
gccgacgccgccggcgccaccg

SEQ ID NO: 1307774 - RNA, 14 nt, Mycobacterium tuberculosis H37Rv
gccgacgauccacg

SEQ ID NO: 1307775 - RNA, 13 nt, Mycobacterium tuberculosis H37Rv
gccgacgccguug

SEQ ID NO: 1307776 - RNA, 17 nt, Mycobacterium tuberculosis H37Rv
gccgacgaacugcagcc

SEQ ID NO: 1307777 - RNA, 18 nt, Mycobacterium tuberculosis H37Rv
gccgacgaaaucgucggg

SEQ ID NO: 1307778 - RNA, 16 nt, Mycobacterium tuberculosis H37Rv
gccgaccuucucggcg

SEQ ID NO: 1307779 - RNA, 19 nt, Mycobacterium tuberculosis H37Rv
gccgaccuucucggcguac

SEQ ID NO: 1307780 - RNA, 18 nt, Mycobacterium tuberculosis H37Rv
gccgacgacaacagccag

SEQ ID NO: 1307781 - RNA, 17 nt, Mycobacterium tuberculosis H37Rv
gccgaccggcagcgaug

SEQ ID NO: 1307782 - RNA, 12 nt, Mycobacterium tuberculosis H37Rv
gccgaccgggua

SEQ ID NO: 1307783 - RNA, 19 nt, Mycobacterium tuberculosis H37Rv
gccgaccugguaugccgcc

SEQ ID NO: 1307784 - RNA, 13 nt, Mycobacterium tuberculosis H37Rv
gccgcacgucgac

SEQ ID NO: 1307785 - RNA, 20 nt, Mycobacterium tuberculosis H37Rv
gccgcacugggugcgucgac

SEQ ID NO: 1307786 - RNA, 17 nt, Mycobacterium tuberculosis H37Rv
gccgcacgggcgaccug

SEQ ID NO: 1307787 - RNA, 19 nt, Mycobacterium tuberculosis H37Rv
gccgcacgccuacgaugac

SEQ ID NO: 1307788 - RNA, 12 nt, Mycobacterium tuberculosis H37Rv
gccgcacgucga

SEQ ID NO: 1307789 - RNA, 18 nt, Mycobacterium tuberculosis H37Rv
gccgcacgcuagccgaca

SEQ ID NO: 1307790 - RNA, 13 nt, Mycobacterium tuberculosis H37Rv
gccgcacggcgac

SEQ ID NO: 1307791 - RNA, 17 nt, Mycobacterium tuberculosis H37Rv
gccgcacgccgaccagc

SEQ ID NO: 1307792 - RNA, 22 nt, Mycobacterium tuberculosis H37Rv
gccgcagcuuuaaucguggcac

SEQ ID NO: 1307793 - RNA, 16 nt, Mycobacterium tuberculosis H37Rv
gccgcagcggccagcc

SEQ ID NO: 1307794 - RNA, 19 nt, Mycobacterium tuberculosis H37Rv
gccgcagcuccccgaccga

SEQ ID NO: 1307795 - RNA, 12 nt, Mycobacterium tuberculosis H37Rv
gccgcagcggcc

SEQ ID NO: 1307796 - RNA, 23 nt, Mycobacterium tuberculosis H37Rv
gccgccaccagggcacguucggc

SEQ ID NO: 1307797 - RNA, 15 nt, Mycobacterium tuberculosis H37Rv
gccgccaccgaggcc

SEQ ID NO: 1307798 - RNA, 13 nt, Mycobacterium tuberculosis H37Rv
gccgccacccggc

SEQ ID NO: 1307799 - RNA, 21 nt, Mycobacterium tuberculosis H37Rv
gccgccaccagcgcgagcccg

SEQ ID NO: 1307800 - RNA, 14 nt, Mycobacterium tuberculosis H37Rv
gccgccacccgcaa

SEQ ID NO: 1307801 - RNA, 13 nt, Mycobacterium tuberculosis H37Rv
gccgccaccuugg

SEQ ID NO: 1307802 - RNA, 22 nt, Mycobacterium tuberculosis H37Rv
gccgccaccgcugucgauggac

SEQ ID NO: 1307803 - RNA, 14 nt, Mycobacterium tuberculosis H37Rv
gccgccaccggcga

SEQ ID NO: 1307804 - RNA, 15 nt, Mycobacterium tuberculosis H37Rv
gccgccaccggcguc

SEQ ID NO: 1307805 - RNA, 17 nt, Mycobacterium tuberculosis H37Rv
gccgcauccagccgugc

SEQ ID NO: 1307806 - RNA, 20 nt, Mycobacterium tuberculosis H37Rv
gccgcagggccgcgcgcacu

SEQ ID NO: 1307807 - RNA, 23 nt, Mycobacterium tuberculosis H37Rv
gccgcaucgucgccgcgcagaaa

SEQ ID NO: 1307808 - RNA, 14 nt, Mycobacterium tuberculosis H37Rv
gccgcaucgucgcc

SEQ ID NO: 1307809 - RNA, 22 nt, Mycobacterium tuberculosis H37Rv
gccgcaucgggcguacauucgg

SEQ ID NO: 1307810 - RNA, 19 nt, Mycobacterium tuberculosis H37Rv
gccgcaucgccucaccacg

SEQ ID NO: 1307811 - RNA, 15 nt, Mycobacterium tuberculosis H37Rv
gccgcaucggcgaac

SEQ ID NO: 1307812 - RNA, 16 nt, Mycobacterium tuberculosis H37Rv
gccgcaaccggcgauc

SEQ ID NO: 1307813 - RNA, 13 nt, Mycobacterium tuberculosis H37Rv
gccgcaccgccgc

SEQ ID NO: 1307814 - RNA, 21 nt, Mycobacterium tuberculosis H37Rv
gccgcacgauggccgucgauc

SEQ ID NO: 1307815 - RNA, 13 nt, Mycobacterium tuberculosis H37Rv
gccgcacgauggc

SEQ ID NO: 1307816 - RNA, 14 nt, Mycobacterium tuberculosis H37Rv
gccgcacgccgacc

SEQ ID NO: 1307817 - RNA, 20 nt, Mycobacterium tuberculosis H37Rv
gccgcacgaugccgggaacg

SEQ ID NO: 1307818 - RNA, 19 nt, Mycobacterium tuberculosis H37Rv
gccgcacgaugccgggaac

SEQ ID NO: 1307819 - RNA, 18 nt, Mycobacterium tuberculosis H37Rv
gccgcacgauagccgaaa

SEQ ID NO: 1307820 - RNA, 17 nt, Mycobacterium tuberculosis H37Rv
gccgcaccggaucaccg

SEQ ID NO: 1307821 - RNA, 12 nt, Mycobacterium tuberculosis H37Rv
gccgcaccggug

SEQ ID NO: 1307822 - RNA, 19 nt, Mycobacterium tuberculosis H37Rv
gccgauggcuuggugccca

SEQ ID NO: 1307823 - RNA, 20 nt, Mycobacterium tuberculosis H37Rv
gccgauggcuuggugcccaa

SEQ ID NO: 1307824 - RNA, 22 nt, Mycobacterium tuberculosis H37Rv
gccgauggaugggcugcgcguc

SEQ ID NO: 1307825 - RNA, 20 nt, Mycobacterium tuberculosis H37Rv
gccgaugcgggucucgaccu

SEQ ID NO: 1307826 - RNA, 17 nt, Mycobacterium tuberculosis H37Rv
gccgaugcgggucucga

SEQ ID NO: 1307827 - RNA, 23 nt, Mycobacterium tuberculosis H37Rv
gccgauguuggcagggccagcgg

SEQ ID NO: 1307828 - RNA, 14 nt, Mycobacterium tuberculosis H37Rv
gccgauuccaccgc

SEQ ID NO: 1307829 - RNA, 18 nt, Mycobacterium tuberculosis H37Rv
gccgauuacggugaucgc

SEQ ID NO: 1307830 - RNA, 17 nt, Mycobacterium tuberculosis H37Rv
gccgauuccaccgccga

SEQ ID NO: 1307831 - RNA, 15 nt, Mycobacterium tuberculosis H37Rv
gccgaugucgacgac

SEQ ID NO: 1307832 - RNA, 20 nt, Mycobacterium tuberculosis H37Rv
gccgauguagacgguggcgc

SEQ ID NO: 1307833 - RNA, 17 nt, Mycobacterium tuberculosis H37Rv
gccgacggcgggcgauc

SEQ ID NO: 1307834 - RNA, 18 nt, Mycobacterium tuberculosis H37Rv
gccgagcagacgcagaau

SEQ ID NO: 1307835 - RNA, 18 nt, Mycobacterium tuberculosis H37Rv
gccgagcagacgcggaau

SEQ ID NO: 1307836 - RNA, 17 nt, Mycobacterium tuberculosis H37Rv
gccgacgggaaccucga

SEQ ID NO: 1307837 - RNA, 17 nt, Mycobacterium tuberculosis H37Rv
gccgaggccuaccaggc

SEQ ID NO: 1307838 - RNA, 18 nt, Mycobacterium tuberculosis H37Rv
gccgaggccuaccaggcg

SEQ ID NO: 1307839 - RNA, 14 nt, Mycobacterium tuberculosis H37Rv
gccgaggcagcguc

SEQ ID NO: 1307840 - RNA, 16 nt, Mycobacterium tuberculosis H37Rv
gccgagcggaccaccg

SEQ ID NO: 1307841 - RNA, 19 nt, Mycobacterium tuberculosis H37Rv
gccgagcggagacuccagc

SEQ ID NO: 1307842 - RNA, 15 nt, Mycobacterium tuberculosis H37Rv
gccgagcgcgccgaa

SEQ ID NO: 1307843 - RNA, 21 nt, Mycobacterium tuberculosis H37Rv
gccgaggaauacucucgcgac

SEQ ID NO: 1307844 - RNA, 14 nt, Mycobacterium tuberculosis H37Rv
gccgaggaccagag

SEQ ID NO: 1307845 - RNA, 13 nt, Mycobacterium tuberculosis H37Rv
gccgagcggugcc

SEQ ID NO: 1307846 - RNA, 18 nt, Mycobacterium tuberculosis H37Rv
gccgaguagauggucgac

SEQ ID NO: 1307847 - RNA, 15 nt, Mycobacterium tuberculosis H37Rv
gccgaguccggcaag

SEQ ID NO: 1307848 - RNA, 16 nt, Mycobacterium tuberculosis H37Rv
gccgaucaccgcaucg

SEQ ID NO: 1307849 - RNA, 23 nt, Mycobacterium tuberculosis H37Rv
gccgaucaccgcaucggugccaa

SEQ ID NO: 1307850 - RNA, 23 nt, Mycobacterium tuberculosis H37Rv
gccgaucaccgcuguguucagcg

SEQ ID NO: 1307851 - RNA, 14 nt, Mycobacterium tuberculosis H37Rv
gccgaucaccaccg

SEQ ID NO: 1307852 - RNA, 22 nt, Mycobacterium tuberculosis H37Rv
gccgaucaccaccggcagauga

SEQ ID NO: 1307853 - RNA, 15 nt, Mycobacterium tuberculosis H37Rv
gccgaucccggcggu

SEQ ID NO: 1307854 - RNA, 15 nt, Mycobacterium tuberculosis H37Rv
gccgaugacgauggc

SEQ ID NO: 1307855 - RNA, 18 nt, Mycobacterium tuberculosis H37Rv
gccgaugacgauggccgc

SEQ ID NO: 1307856 - RNA, 17 nt, Mycobacterium tuberculosis H37Rv
gccgaugcgacgcagac

SEQ ID NO: 1307857 - RNA, 16 nt, Mycobacterium tuberculosis H37Rv
gccgaugccgccggca

SEQ ID NO: 1307858 - RNA, 17 nt, Mycobacterium tuberculosis H37Rv
gccgaugccgccggcac

SEQ ID NO: 1307859 - RNA, 16 nt, Mycobacterium tuberculosis H37Rv
gccgaugcccaucacg

SEQ ID NO: 1307860 - RNA, 17 nt, Mycobacterium tuberculosis H37Rv
gccgaugaacguggcga

SEQ ID NO: 1307861 - RNA, 13 nt, Mycobacterium tuberculosis H37Rv
gccgaugacgaug

SEQ ID NO: 1307862 - RNA, 23 nt, Mycobacterium tuberculosis H37Rv
gccgaugaccgccugcuggccgc

SEQ ID NO: 1307863 - RNA, 12 nt, Mycobacterium tuberculosis H37Rv
gccgaucggcac

SEQ ID NO: 1307864 - RNA, 11 nt, Mycobacterium tuberculosis H37Rv
gccgaucgccg

SEQ ID NO: 1307865 - RNA, 22 nt, Mycobacterium tuberculosis H37Rv
gccgaucggccugcagcgauga

SEQ ID NO: 1307866 - RNA, 21 nt, Mycobacterium tuberculosis H37Rv
gccgaucggccugcagcgaug

SEQ ID NO: 1307867 - RNA, 14 nt, Mycobacterium tuberculosis H37Rv
gccgaucggccaac

SEQ ID NO: 1307868 - RNA, 22 nt, Mycobacterium tuberculosis H37Rv
gccgaucugguaagucagcucg

SEQ ID NO: 1307869 - RNA, 18 nt, Mycobacterium tuberculosis H37Rv
gcacccaacuccaucagc

SEQ ID NO: 1307870 - RNA, 23 nt, Mycobacterium tuberculosis H37Rv
gcaccaugggucuggcaggccag

SEQ ID NO: 1307871 - RNA, 17 nt, Mycobacterium tuberculosis H37Rv
gcaccaggcggccguaa

SEQ ID NO: 1307872 - RNA, 18 nt, Mycobacterium tuberculosis H37Rv
gcacccaccagugcaucg

SEQ ID NO: 1307873 - RNA, 20 nt, Mycobacterium tuberculosis H37Rv
gcacccaccgaagcgaacgg

SEQ ID NO: 1307874 - RNA, 15 nt, Mycobacterium tuberculosis H37Rv
gcacccaaugccacc

SEQ ID NO: 1307875 - RNA, 21 nt, Mycobacterium tuberculosis H37Rv
gcacccaacuccaucagcgcg

SEQ ID NO: 1307876 - RNA, 14 nt, Mycobacterium tuberculosis H37Rv
gcacccagaccgcc

SEQ ID NO: 1307877 - RNA, 16 nt, Mycobacterium tuberculosis H37Rv
gcacccagacgauggc

SEQ ID NO: 1307878 - RNA, 21 nt, Mycobacterium tuberculosis H37Rv
gcacccagacgauggccaggu

SEQ ID NO: 1307879 - RNA, 12 nt, Mycobacterium tuberculosis H37Rv
gcacccagaccg

SEQ ID NO: 1307880 - RNA, 20 nt, Mycobacterium tuberculosis H37Rv
gcacccgaauuugucggcga

SEQ ID NO: 1307881 - RNA, 18 nt, Mycobacterium tuberculosis H37Rv
gcacccgacucgucggcc

SEQ ID NO: 1307882 - RNA, 19 nt, Mycobacterium tuberculosis H37Rv
gcacccgaauuugucggcg

SEQ ID NO: 1307883 - RNA, 18 nt, Mycobacterium tuberculosis H37Rv
gcacccgaaacaccgucu

SEQ ID NO: 1307884 - RNA, 13 nt, Mycobacterium tuberculosis H37Rv
gcaccagcucggu

SEQ ID NO: 1307885 - RNA, 22 nt, Mycobacterium tuberculosis H37Rv
gcaccagcggcugaccgggcag

SEQ ID NO: 1307886 - RNA, 14 nt, Mycobacterium tuberculosis H37Rv
gcaccagcgaaucc

SEQ ID NO: 1307887 - RNA, 20 nt, Mycobacterium tuberculosis H37Rv
gcaccagcauucucgccgac

SEQ ID NO: 1307888 - RNA, 14 nt, Mycobacterium tuberculosis H37Rv
gcaccagccgguga

SEQ ID NO: 1307889 - RNA, 18 nt, Mycobacterium tuberculosis H37Rv
gcaccagcacggcaacca

SEQ ID NO: 1307890 - RNA, 20 nt, Mycobacterium tuberculosis H37Rv
gcaccggaucgccgucgcga

SEQ ID NO: 1307891 - RNA, 15 nt, Mycobacterium tuberculosis H37Rv
gcaccggaucgacca

SEQ ID NO: 1307892 - RNA, 19 nt, Mycobacterium tuberculosis H37Rv
gcaccggagucggcgucga

SEQ ID NO: 1307893 - RNA, 14 nt, Mycobacterium tuberculosis H37Rv
gcaccggaucggcu

SEQ ID NO: 1307894 - RNA, 19 nt, Mycobacterium tuberculosis H37Rv
gcaccgcgguggggucgac

SEQ ID NO: 1307895 - RNA, 22 nt, Mycobacterium tuberculosis H37Rv
gcaccgcgguggggucgacgca

SEQ ID NO: 1307896 - RNA, 17 nt, Mycobacterium tuberculosis H37Rv
gcaccgcugcggccagc

SEQ ID NO: 1307897 - RNA, 21 nt, Mycobacterium tuberculosis H37Rv
gcaccgcugcggccagcgaug

SEQ ID NO: 1307898 - RNA, 14 nt, Mycobacterium tuberculosis H37Rv
gcaccgccggcucc

SEQ ID NO: 1307899 - RNA, 17 nt, Mycobacterium tuberculosis H37Rv
gcaccgccggcuccgcc

SEQ ID NO: 1307900 - RNA, 18 nt, Mycobacterium tuberculosis H37Rv
gcaccgcgguacgccggu

SEQ ID NO: 1307901 - RNA, 16 nt, Mycobacterium tuberculosis H37Rv
gcaccgcgguagccga

SEQ ID NO: 1307902 - RNA, 18 nt, Mycobacterium tuberculosis H37Rv
gcaccgcgacgacgaggu

SEQ ID NO: 1307903 - RNA, 15 nt, Mycobacterium tuberculosis H37Rv
gcaccgcgacgacga

SEQ ID NO: 1307904 - RNA, 17 nt, Mycobacterium tuberculosis H37Rv
gcaccgccgcugccauc

SEQ ID NO: 1307905 - RNA, 14 nt, Mycobacterium tuberculosis H37Rv
gcaccgccggccuu

SEQ ID NO: 1307906 - RNA, 16 nt, Mycobacterium tuberculosis H37Rv
gcaccgccggcgacgg

SEQ ID NO: 1307907 - RNA, 23 nt, Mycobacterium tuberculosis H37Rv
gcaccgccggcgcccaggccgau

SEQ ID NO: 1307908 - RNA, 22 nt, Mycobacterium tuberculosis H37Rv
gcaccgccgcccaaaacgucac

SEQ ID NO: 1307909 - RNA, 20 nt, Mycobacterium tuberculosis H37Rv
gcaccgauggcgcaccggcg

SEQ ID NO: 1307910 - RNA, 20 nt, Mycobacterium tuberculosis H37Rv
gcaccgaugcugacgaugcg

SEQ ID NO: 1307911 - RNA, 14 nt, Mycobacterium tuberculosis H37Rv
gcaccgaucaacgg

SEQ ID NO: 1307912 - RNA, 12 nt, Mycobacterium tuberculosis H37Rv
gcaccgaugccu

SEQ ID NO: 1307913 - RNA, 21 nt, Mycobacterium tuberculosis H37Rv
gcaccgauggcgcaccggcgu

SEQ ID NO: 1307914 - RNA, 20 nt, Mycobacterium tuberculosis H37Rv
gcaccgauuccagcggaagc

SEQ ID NO: 1307915 - RNA, 22 nt, Mycobacterium tuberculosis H37Rv
gcaccgcacggaggcggaccag

SEQ ID NO: 1307916 - RNA, 14 nt, Mycobacterium tuberculosis H37Rv
gcaccgaggccgcc

SEQ ID NO: 1307917 - RNA, 15 nt, Mycobacterium tuberculosis H37Rv
gcacccggucgagcg

SEQ ID NO: 1307918 - RNA, 22 nt, Mycobacterium tuberculosis H37Rv
gcaccgagcugagcggccagca

SEQ ID NO: 1307919 - RNA, 14 nt, Mycobacterium tuberculosis H37Rv
gcacccggucggcg

SEQ ID NO: 1307920 - RNA, 22 nt, Mycobacterium tuberculosis H37Rv
gcacccggcgauuggaccgcca

SEQ ID NO: 1307921 - RNA, 17 nt, Mycobacterium tuberculosis H37Rv
gcacccggccaccggac

SEQ ID NO: 1307922 - RNA, 18 nt, Mycobacterium tuberculosis H37Rv
gcacccgggccacgucga

SEQ ID NO: 1307923 - RNA, 18 nt, Mycobacterium tuberculosis H37Rv
gcacccgggccgccucga

SEQ ID NO: 1307924 - RNA, 17 nt, Mycobacterium tuberculosis H37Rv
gcacccgggccugggac

SEQ ID NO: 1307925 - RNA, 13 nt, Mycobacterium tuberculosis H37Rv
gcacacgaucgcg

SEQ ID NO: 1307926 - RNA, 14 nt, Mycobacterium tuberculosis H37Rv
gcacaccgucgucg

SEQ ID NO: 1307927 - RNA, 14 nt, Mycobacterium tuberculosis H37Rv
gcacaccgucgcac

SEQ ID NO: 1307928 - RNA, 22 nt, Mycobacterium tuberculosis H37Rv
gcacaccgucgcgcucgcacca

SEQ ID NO: 1307929 - RNA, 20 nt, Mycobacterium tuberculosis H37Rv
gcacacguccggcgaugacc

SEQ ID NO: 1307930 - RNA, 13 nt, Mycobacterium tuberculosis H37Rv
gcacacggccuug

SEQ ID NO: 1307931 - RNA, 20 nt, Mycobacterium tuberculosis H37Rv
gcacacggccuugccgauca

SEQ ID NO: 1307932 - RNA, 21 nt, Mycobacterium tuberculosis H37Rv
gcacagcccggcgacgacccg

SEQ ID NO: 1307933 - RNA, 15 nt, Mycobacterium tuberculosis H37Rv
gcacagcccggcgac

SEQ ID NO: 1307934 - RNA, 13 nt, Mycobacterium tuberculosis H37Rv
gcacagcgcagcc

SEQ ID NO: 1307935 - RNA, 15 nt, Mycobacterium tuberculosis H37Rv
gcacagcgaccaucg

SEQ ID NO: 1307936 - RNA, 18 nt, Mycobacterium tuberculosis H37Rv
gcacaggauuggccgcug

SEQ ID NO: 1307937 - RNA, 17 nt, Mycobacterium tuberculosis H37Rv
gcacagguccggguugg

SEQ ID NO: 1307938 - RNA, 15 nt, Mycobacterium tuberculosis H37Rv
gcacaccgucgacga

SEQ ID NO: 1307939 - RNA, 17 nt, Mycobacterium tuberculosis H37Rv
gcacaaaaucagcgauu

SEQ ID NO: 1307940 - RNA, 19 nt, Mycobacterium tuberculosis H37Rv
gcaacaggcccacggcgac

SEQ ID NO: 1307941 - RNA, 21 nt, Mycobacterium tuberculosis H37Rv
gcaacaucgaauaugacugcg

SEQ ID NO: 1307942 - RNA, 20 nt, Mycobacterium tuberculosis H37Rv
gcaccacaccgugggcgacg

SEQ ID NO: 1307943 - RNA, 15 nt, Mycobacterium tuberculosis H37Rv
gcaccaccacccgau

SEQ ID NO: 1307944 - RNA, 16 nt, Mycobacterium tuberculosis H37Rv
gcaccaccacgccgac

SEQ ID NO: 1307945 - RNA, 15 nt, Mycobacterium tuberculosis H37Rv
gcaccaagacgccac

SEQ ID NO: 1307946 - RNA, 19 nt, Mycobacterium tuberculosis H37Rv
gcaccaagcagcgaccagc

SEQ ID NO: 1307947 - RNA, 22 nt, Mycobacterium tuberculosis H37Rv
gcacauugguguccaccaccgg

SEQ ID NO: 1307948 - RNA, 17 nt, Mycobacterium tuberculosis H37Rv
gcacauugguguccacc

SEQ ID NO: 1307949 - RNA, 15 nt, Mycobacterium tuberculosis H37Rv
gcaccaacgccaccg

SEQ ID NO: 1307950 - RNA, 14 nt, Mycobacterium tuberculosis H37Rv
gcacaguucgccgg

SEQ ID NO: 1307951 - RNA, 19 nt, Mycobacterium tuberculosis H37Rv
gcacaguucgccggaucga

SEQ ID NO: 1307952 - RNA, 18 nt, Mycobacterium tuberculosis H37Rv
gcacauccugcagcucgg

SEQ ID NO: 1307953 - RNA, 12 nt, Mycobacterium tuberculosis H37Rv
gcacaucgcaca

SEQ ID NO: 1307954 - RNA, 20 nt, Mycobacterium tuberculosis H37Rv
gcacaugcugccgcugcgaa

SEQ ID NO: 1307955 - RNA, 19 nt, Mycobacterium tuberculosis H37Rv
gcaccagaucgucgggcac

SEQ ID NO: 1307956 - RNA, 16 nt, Mycobacterium tuberculosis H37Rv
gcaccacgucgaccaa

SEQ ID NO: 1307957 - RNA, 23 nt, Mycobacterium tuberculosis H37Rv
gcaccacggcggucaacggucuc

SEQ ID NO: 1307958 - RNA, 18 nt, Mycobacterium tuberculosis H37Rv
gcaccacggcggucaacg

SEQ ID NO: 1307959 - RNA, 19 nt, Mycobacterium tuberculosis H37Rv
gcaccacgcugugcucgac

SEQ ID NO: 1307960 - RNA, 21 nt, Mycobacterium tuberculosis H37Rv
gcaccacgccagcccguccgg

SEQ ID NO: 1307961 - RNA, 17 nt, Mycobacterium tuberculosis H37Rv
gcaccacgagcagccga

SEQ ID NO: 1307962 - RNA, 20 nt, Mycobacterium tuberculosis H37Rv
gcaccaccccagcggccacc

SEQ ID NO: 1307963 - RNA, 16 nt, Mycobacterium tuberculosis H37Rv
gcaccaccgagccgau

SEQ ID NO: 1307964 - RNA, 12 nt, Mycobacterium tuberculosis H37Rv
gcaccaccggaa

SEQ ID NO: 1307965 - RNA, 13 nt, Mycobacterium tuberculosis H37Rv
gcaccaccggcuc

SEQ ID NO: 1307966 - RNA, 12 nt, Mycobacterium tuberculosis H37Rv
gcaccaccgucu

SEQ ID NO: 1307967 - RNA, 17 nt, Mycobacterium tuberculosis H37Rv
gcaccaccgucucgccg

SEQ ID NO: 1307968 - RNA, 17 nt, Mycobacterium tuberculosis H37Rv
gcaccaccuccccgauc

SEQ ID NO: 1307969 - RNA, 17 nt, Mycobacterium tuberculosis H37Rv
gcacgagugcggcgacc

SEQ ID NO: 1307970 - RNA, 19 nt, Mycobacterium tuberculosis H37Rv
gcacgcccucgucgaucgc

SEQ ID NO: 1307971 - RNA, 17 nt, Mycobacterium tuberculosis H37Rv
gcacgccuacgaugacg

SEQ ID NO: 1307972 - RNA, 16 nt, Mycobacterium tuberculosis H37Rv
gcacgccgguggucac

SEQ ID NO: 1307973 - RNA, 21 nt, Mycobacterium tuberculosis H37Rv
gcacgccgguggucacgccgu

SEQ ID NO: 1307974 - RNA, 22 nt, Mycobacterium tuberculosis H37Rv
gcacgccgguggucacgccgug

SEQ ID NO: 1307975 - RNA, 14 nt, Mycobacterium tuberculosis H37Rv
gcacgccguccagg

SEQ ID NO: 1307976 - RNA, 18 nt, Mycobacterium tuberculosis H37Rv
gcacgcgcaacucgccac

SEQ ID NO: 1307977 - RNA, 17 nt, Mycobacterium tuberculosis H37Rv
gcacgcgaggcgcucac

SEQ ID NO: 1307978 - RNA, 20 nt, Mycobacterium tuberculosis H37Rv
gcacgauagccaccgacgac

SEQ ID NO: 1307979 - RNA, 20 nt, Mycobacterium tuberculosis H37Rv
gcacgacaucgucgcgacga

SEQ ID NO: 1307980 - RNA, 18 nt, Mycobacterium tuberculosis H37Rv
gcacgacaucgucgcgac

SEQ ID NO: 1307981 - RNA, 17 nt, Mycobacterium tuberculosis H37Rv
gcacgacaucgucgcga

SEQ ID NO: 1307982 - RNA, 13 nt, Mycobacterium tuberculosis H37Rv
gcacgaauccccc

SEQ ID NO: 1307983 - RNA, 18 nt, Mycobacterium tuberculosis H37Rv
gcacgacaacuucgccgg

SEQ ID NO: 1307984 - RNA, 14 nt, Mycobacterium tuberculosis H37Rv
gcacgacaccucga

SEQ ID NO: 1307985 - RNA, 18 nt, Mycobacterium tuberculosis H37Rv
gcacgaacgccugcucgu

SEQ ID NO: 1307986 - RNA, 19 nt, Mycobacterium tuberculosis H37Rv
gcacgaaguccuggcagac

SEQ ID NO: 1307987 - RNA, 12 nt, Mycobacterium tuberculosis H37Rv
gcaccggccgcu

SEQ ID NO: 1307988 - RNA, 17 nt, Mycobacterium tuberculosis H37Rv
gcacggucaacgauccc

SEQ ID NO: 1307989 - RNA, 19 nt, Mycobacterium tuberculosis H37Rv
gcacggccgucgacgauca

SEQ ID NO: 1307990 - RNA, 16 nt, Mycobacterium tuberculosis H37Rv
gcacggcggccagggu

SEQ ID NO: 1307991 - RNA, 18 nt, Mycobacterium tuberculosis H37Rv
gcacgguccacgguggcg

SEQ ID NO: 1307992 - RNA, 19 nt, Mycobacterium tuberculosis H37Rv
gcacggucgcccgaucggc

SEQ ID NO: 1307993 - RNA, 23 nt, Mycobacterium tuberculosis H37Rv
gcacggucugggucuuggauccg

SEQ ID NO: 1307994 - RNA, 13 nt, Mycobacterium tuberculosis H37Rv
gcacguacgggca

SEQ ID NO: 1307995 - RNA, 19 nt, Mycobacterium tuberculosis H37Rv
gcacguauccacggucgac

SEQ ID NO: 1307996 - RNA, 16 nt, Mycobacterium tuberculosis H37Rv
gcacgucggcugccgc

SEQ ID NO: 1307997 - RNA, 19 nt, Mycobacterium tuberculosis H37Rv
gcacgucggcugccgcaaa

SEQ ID NO: 1307998 - RNA, 24 nt, Mycobacterium tuberculosis H37Rv
gcacgucgcggccguggaugucgc

SEQ ID NO: 1307999 - RNA, 16 nt, Mycobacterium tuberculosis H37Rv
gcacggaugucgccca

SEQ ID NO: 1308000 - RNA, 13 nt, Mycobacterium tuberculosis H37Rv
gcacgcugaccac

SEQ ID NO: 1308001 - RNA, 14 nt, Mycobacterium tuberculosis H37Rv
gcacggcgccgacc

SEQ ID NO: 1308002 - RNA, 18 nt, Mycobacterium tuberculosis H37Rv
gcacggccgggacggcga

SEQ ID NO: 1308003 - RNA, 17 nt, Mycobacterium tuberculosis H37Rv
gcacggccuccggaccg

SEQ ID NO: 1308004 - RNA, 16 nt, Mycobacterium tuberculosis H37Rv
gcacggccccugccac

SEQ ID NO: 1308005 - RNA, 17 nt, Mycobacterium tuberculosis H37Rv
gcacggccgcagccgau

SEQ ID NO: 1308006 - RNA, 13 nt, Mycobacterium tuberculosis H37Rv
gcacugaacgucg

SEQ ID NO: 1308007 - RNA, 13 nt, Mycobacterium tuberculosis H37Rv
gcacugaaauggc

SEQ ID NO: 1308008 - RNA, 16 nt, Mycobacterium tuberculosis H37Rv
gcacucgaugcggugc

SEQ ID NO: 1308009 - RNA, 21 nt, Mycobacterium tuberculosis H37Rv
gcacugaugucacccgcccga

SEQ ID NO: 1308010 - RNA, 22 nt, Mycobacterium tuberculosis H37Rv
gcacugaucugcguugcggcaa

SEQ ID NO: 1308011 - RNA, 15 nt, Mycobacterium tuberculosis H37Rv
gcacugccccgcauc

SEQ ID NO: 1308012 - RNA, 17 nt, Mycobacterium tuberculosis H37Rv
gcacugccccgcaucgc

SEQ ID NO: 1308013 - RNA, 20 nt, Mycobacterium tuberculosis H37Rv
gcacggugugcacggcgaau

SEQ ID NO: 1308014 - RNA, 15 nt, Mycobacterium tuberculosis H37Rv
gcacgugcacggcga

SEQ ID NO: 1308015 - RNA, 18 nt, Mycobacterium tuberculosis H37Rv
gcacgugaaagccgacca

SEQ ID NO: 1308016 - RNA, 20 nt, Mycobacterium tuberculosis H37Rv
gcacugugaggucauuggcg

SEQ ID NO: 1308017 - RNA, 15 nt, Mycobacterium tuberculosis H37Rv
gcacuggggaggcca

SEQ ID NO: 1308018 - RNA, 23 nt, Mycobacterium tuberculosis H37Rv
gcacugggaugaguucgucgugg

SEQ ID NO: 1308019 - RNA, 15 nt, Mycobacterium tuberculosis H37Rv
gcacugggaugaguu

SEQ ID NO: 1308020 - RNA, 22 nt, Mycobacterium tuberculosis H37Rv
gcacuugggaaggauggucgaa

SEQ ID NO: 1308021 - RNA, 15 nt, Mycobacterium tuberculosis H37Rv
gcacuugcguggcgu

SEQ ID NO: 1308022 - RNA, 19 nt, Mycobacterium tuberculosis H37Rv
gcagaaagucgcgcgcgaa

SEQ ID NO: 1308023 - RNA, 19 nt, Mycobacterium tuberculosis H37Rv
gcagaaaccauucggcgag

SEQ ID NO: 1308024 - RNA, 22 nt, Mycobacterium tuberculosis H37Rv
gcagaguucccugaugggcgaa

SEQ ID NO: 1308025 - RNA, 20 nt, Mycobacterium tuberculosis H37Rv
gcagaacaguaucgccggag

SEQ ID NO: 1308026 - RNA, 18 nt, Mycobacterium tuberculosis H37Rv
gcagaacggaccucggcg

SEQ ID NO: 1308027 - RNA, 21 nt, Mycobacterium tuberculosis H37Rv
gcagacaucggagaucauggc

SEQ ID NO: 1308028 - RNA, 19 nt, Mycobacterium tuberculosis H37Rv
gcagacacgaccccgucga

SEQ ID NO: 1308029 - RNA, 19 nt, Mycobacterium tuberculosis H37Rv
gcagacacagaaucgccca

SEQ ID NO: 1308030 - RNA, 18 nt, Mycobacterium tuberculosis H37Rv
gcagacacgagucgccag

SEQ ID NO: 1308031 - RNA, 20 nt, Mycobacterium tuberculosis H37Rv
gcagaccaagcccgucgucg

SEQ ID NO: 1308032 - RNA, 15 nt, Mycobacterium tuberculosis H37Rv
gcagacccaguccgg

SEQ ID NO: 1308033 - RNA, 17 nt, Mycobacterium tuberculosis H37Rv
gcagauuugcuccagcg

SEQ ID NO: 1308034 - RNA, 17 nt, Mycobacterium tuberculosis H37Rv
gcagcaaaaaccagcgu

SEQ ID NO: 1308035 - RNA, 23 nt, Mycobacterium tuberculosis H37Rv
gcagauuccucuucaggcccucg

SEQ ID NO: 1308036 - RNA, 19 nt, Mycobacterium tuberculosis H37Rv
gcagauaugacggcagacc

SEQ ID NO: 1308037 - RNA, 14 nt, Mycobacterium tuberculosis H37Rv
gcagauggugaacg

SEQ ID NO: 1308038 - RNA, 16 nt, Mycobacterium tuberculosis H37Rv
gcagauacucggcgac

SEQ ID NO: 1308039 - RNA, 23 nt, Mycobacterium tuberculosis H37Rv
gcagcaacaucuugccgucggcc

SEQ ID NO: 1308040 - RNA, 21 nt, Mycobacterium tuberculosis H37Rv
gcagcaacgcggugccgggau

SEQ ID NO: 1308041 - RNA, 18 nt, Mycobacterium tuberculosis H37Rv
gcagcaacgacgucgucg

SEQ ID NO: 1308042 - RNA, 22 nt, Mycobacterium tuberculosis H37Rv
gcagcaacgacccgaagccgac

SEQ ID NO: 1308043 - RNA, 15 nt, Mycobacterium tuberculosis H37Rv
gcagcaacucgacgu

SEQ ID NO: 1308044 - RNA, 18 nt, Mycobacterium tuberculosis H37Rv
gcagcaacugggcggccu

SEQ ID NO: 1308045 - RNA, 18 nt, Mycobacterium tuberculosis H37Rv
gcagcaaucagccgccuu

SEQ ID NO: 1308046 - RNA, 13 nt, Mycobacterium tuberculosis H37Rv
gcagcaccgacgu

SEQ ID NO: 1308047 - RNA, 23 nt, Mycobacterium tuberculosis H37Rv
gcagcugaaaauaggccgggcag

SEQ ID NO: 1308048 - RNA, 18 nt, Mycobacterium tuberculosis H37Rv
gcagcugggcaucaccgc

SEQ ID NO: 1308049 - RNA, 15 nt, Mycobacterium tuberculosis H37Rv
gcagcugguagguca

SEQ ID NO: 1308050 - RNA, 21 nt, Mycobacterium tuberculosis H37Rv
gcagcugggugcgccauugcg

SEQ ID NO: 1308051 - RNA, 17 nt, Mycobacterium tuberculosis H37Rv
gcagcugguuugcggug

SEQ ID NO: 1308052 - RNA, 18 nt, Mycobacterium tuberculosis H37Rv
gcagcugacgucaccacg

SEQ ID NO: 1308053 - RNA, 21 nt, Mycobacterium tuberculosis H37Rv
gcagcugacgucaccacgauc

SEQ ID NO: 1308054 - RNA, 14 nt, Mycobacterium tuberculosis H37Rv
gcagcuugacaucg

SEQ ID NO: 1308055 - RNA, 17 nt, Mycobacterium tuberculosis H37Rv
gcagcuuggccucagcc

SEQ ID NO: 1308056 - RNA, 17 nt, Mycobacterium tuberculosis H37Rv
gcagcuuggacucaucg

SEQ ID NO: 1308057 - RNA, 21 nt, Mycobacterium tuberculosis H37Rv
gcagcuuguuuuccaccagcg

SEQ ID NO: 1308058 - RNA, 12 nt, Mycobacterium tuberculosis H37Rv
gcaggacucgcg

SEQ ID NO: 1308059 - RNA, 12 nt, Mycobacterium tuberculosis H37Rv
gcaggacgcugc

SEQ ID NO: 1308060 - RNA, 23 nt, Mycobacterium tuberculosis H37Rv
gcagcuuugacgcccucggcgac

SEQ ID NO: 1308061 - RNA, 20 nt, Mycobacterium tuberculosis H37Rv
gcaggaaggcuucggugacc

SEQ ID NO: 1308062 - RNA, 15 nt, Mycobacterium tuberculosis H37Rv
gcaggaauucgccau

SEQ ID NO: 1308063 - RNA, 12 nt, Mycobacterium tuberculosis H37Rv
gcaggaccagca

SEQ ID NO: 1308064 - RNA, 15 nt, Mycobacterium tuberculosis H37Rv
gcaggaccagcaccg

SEQ ID NO: 1308065 - RNA, 20 nt, Mycobacterium tuberculosis H37Rv
gcagcuccccgaccgaaccg

SEQ ID NO: 1308066 - RNA, 18 nt, Mycobacterium tuberculosis H37Rv
gcagcuccccgaccgaac

SEQ ID NO: 1308067 - RNA, 16 nt, Mycobacterium tuberculosis H37Rv
gcagcguuggccgcug

SEQ ID NO: 1308068 - RNA, 20 nt, Mycobacterium tuberculosis H37Rv
gcagcguuggccgcugucgu

SEQ ID NO: 1308069 - RNA, 21 nt, Mycobacterium tuberculosis H37Rv
gcagcgugugcucgugggcga

SEQ ID NO: 1308070 - RNA, 15 nt, Mycobacterium tuberculosis H37Rv
gcagcguugacgguc

SEQ ID NO: 1308071 - RNA, 15 nt, Mycobacterium tuberculosis H37Rv
gcagcucguccagcg

SEQ ID NO: 1308072 - RNA, 17 nt, Mycobacterium tuberculosis H37Rv
gcagcucgguggcaucg

SEQ ID NO: 1308073 - RNA, 12 nt, Mycobacterium tuberculosis H37Rv
gcagcucgguca

SEQ ID NO: 1308074 - RNA, 14 nt, Mycobacterium tuberculosis H37Rv
gcagcucgaccagg

SEQ ID NO: 1308075 - RNA, 21 nt, Mycobacterium tuberculosis H37Rv
gcagcucgcacucguugccga

SEQ ID NO: 1308076 - RNA, 16 nt, Mycobacterium tuberculosis H37Rv
gcagcucgccggcacg

SEQ ID NO: 1308077 - RNA, 17 nt, Mycobacterium tuberculosis H37Rv
gcagcgucgucgacgac

SEQ ID NO: 1308078 - RNA, 20 nt, Mycobacterium tuberculosis H37Rv
gcagcguccgaaccaccugu

SEQ ID NO: 1308079 - RNA, 19 nt, Mycobacterium tuberculosis H37Rv
gcagcgugggcagcgcgau

SEQ ID NO: 1308080 - RNA, 20 nt, Mycobacterium tuberculosis H37Rv
gcagcgugaaaugcacgauc

SEQ ID NO: 1308081 - RNA, 23 nt, Mycobacterium tuberculosis H37Rv
gcagcgggcuccccggauuccuc

SEQ ID NO: 1308082 - RNA, 22 nt, Mycobacterium tuberculosis H37Rv
gcagcgguaagcgcaucgagca

SEQ ID NO: 1308083 - RNA, 15 nt, Mycobacterium tuberculosis H37Rv
gcagcgguggucggc

SEQ ID NO: 1308084 - RNA, 15 nt, Mycobacterium tuberculosis H37Rv
gcagcgggcgcgcua

SEQ ID NO: 1308085 - RNA, 17 nt, Mycobacterium tuberculosis H37Rv
gcagcggguccgucagc

SEQ ID NO: 1308086 - RNA, 21 nt, Mycobacterium tuberculosis H37Rv
gcagcggcacgucggcgccga

SEQ ID NO: 1308087 - RNA, 14 nt, Mycobacterium tuberculosis H37Rv
gcagcgcuggcuac

SEQ ID NO: 1308088 - RNA, 22 nt, Mycobacterium tuberculosis H37Rv
gcagcggcgaccgcggucgcca

SEQ ID NO: 1308089 - RNA, 14 nt, Mycobacterium tuberculosis H37Rv
gcagcggcgcgcug

SEQ ID NO: 1308090 - RNA, 18 nt, Mycobacterium tuberculosis H37Rv
gcagcggccugaccggcu

SEQ ID NO: 1308091 - RNA, 21 nt, Mycobacterium tuberculosis H37Rv
gcagcggcauccacaccgacc

SEQ ID NO: 1308092 - RNA, 19 nt, Mycobacterium tuberculosis H37Rv
gcagcggcgucgucgucga

SEQ ID NO: 1308093 - RNA, 14 nt, Mycobacterium tuberculosis H37Rv
gcagcggcgggcga

SEQ ID NO: 1308094 - RNA, 13 nt, Mycobacterium tuberculosis H37Rv
gcagcggcgcggu

SEQ ID NO: 1308095 - RNA, 17 nt, Mycobacterium tuberculosis H37Rv
gcagcgccgcguucagg

SEQ ID NO: 1308096 - RNA, 15 nt, Mycobacterium tuberculosis H37Rv
gcagcgccggcaccg

SEQ ID NO: 1308097 - RNA, 18 nt, Mycobacterium tuberculosis H37Rv
gcagcgccggcaccgaca

SEQ ID NO: 1308098 - RNA, 13 nt, Mycobacterium tuberculosis H37Rv
gcagcgcgacccg

SEQ ID NO: 1308099 - RNA, 15 nt, Mycobacterium tuberculosis H37Rv
gcagcgcgaucaccg

SEQ ID NO: 1308100 - RNA, 14 nt, Mycobacterium tuberculosis H37Rv
gcagcgcgacgguu

SEQ ID NO: 1308101 - RNA, 16 nt, Mycobacterium tuberculosis H37Rv
gcagcgcgaucaccga

SEQ ID NO: 1308102 - RNA, 17 nt, Mycobacterium tuberculosis H37Rv
gcagcgcgacccguagc

SEQ ID NO: 1308103 - RNA, 14 nt, Mycobacterium tuberculosis H37Rv
gcagcgccgcgugg

SEQ ID NO: 1308104 - RNA, 15 nt, Mycobacterium tuberculosis H37Rv
gcagcgcgucgccga

SEQ ID NO: 1308105 - RNA, 22 nt, Mycobacterium tuberculosis H37Rv
gcagcgcgucgccgaaagccuu

SEQ ID NO: 1308106 - RNA, 14 nt, Mycobacterium tuberculosis H37Rv
gcagcgcgggaucu

SEQ ID NO: 1308107 - RNA, 21 nt, Mycobacterium tuberculosis H37Rv
gcagcgcggaugucggcaucg

SEQ ID NO: 1308108 - RNA, 14 nt, Mycobacterium tuberculosis H37Rv
gcagcgcgaucugc

SEQ ID NO: 1308109 - RNA, 20 nt, Mycobacterium tuberculosis H37Rv
gcagcaccgacgugauggug

SEQ ID NO: 1308110 - RNA, 22 nt, Mycobacterium tuberculosis H37Rv
gcagcccauuucgagcucgaag

SEQ ID NO: 1308111 - RNA, 18 nt, Mycobacterium tuberculosis H37Rv
gcagccccuccgcgccga

SEQ ID NO: 1308112 - RNA, 15 nt, Mycobacterium tuberculosis H37Rv
gcagccccugccgau

SEQ ID NO: 1308113 - RNA, 16 nt, Mycobacterium tuberculosis H37Rv
gcagcccgccggaucc

SEQ ID NO: 1308114 - RNA, 15 nt, Mycobacterium tuberculosis H37Rv
gcagccgcucgacgg

SEQ ID NO: 1308115 - RNA, 22 nt, Mycobacterium tuberculosis H37Rv
gcagccgcgcggugauggucac

SEQ ID NO: 1308116 - RNA, 17 nt, Mycobacterium tuberculosis H37Rv
gcagcccggcgaugagc

SEQ ID NO: 1308117 - RNA, 14 nt, Mycobacterium tuberculosis H37Rv
gcagccccucgucg

SEQ ID NO: 1308118 - RNA, 20 nt, Mycobacterium tuberculosis H37Rv
gcagcgaaacaccggccagc

SEQ ID NO: 1308119 - RNA, 22 nt, Mycobacterium tuberculosis H37Rv
gcagcgaaaaccgucgcagaaa

SEQ ID NO: 1308120 - RNA, 17 nt, Mycobacterium tuberculosis H37Rv
gcagcgaagaccagcgg

SEQ ID NO: 1308121 - RNA, 15 nt, Mycobacterium tuberculosis H37Rv
gcagcgaagccgggu

SEQ ID NO: 1308122 - RNA, 15 nt, Mycobacterium tuberculosis H37Rv
gcagcgacacguugg

SEQ ID NO: 1308123 - RNA, 18 nt, Mycobacterium tuberculosis H37Rv
gcagccgggcgucgcugg

SEQ ID NO: 1308124 - RNA, 19 nt, Mycobacterium tuberculosis H37Rv
gcagcgcaaacaucuuguc

SEQ ID NO: 1308125 - RNA, 17 nt, Mycobacterium tuberculosis H37Rv
gcagcgcaaacaucuug

SEQ ID NO: 1308126 - RNA, 16 nt, Mycobacterium tuberculosis H37Rv
gcagcgaugacgacca

SEQ ID NO: 1308127 - RNA, 19 nt, Mycobacterium tuberculosis H37Rv
gcagcgagucgacgucgau

SEQ ID NO: 1308128 - RNA, 16 nt, Mycobacterium tuberculosis H37Rv
gcagcgaccgucgucc

SEQ ID NO: 1308129 - RNA, 13 nt, Mycobacterium tuberculosis H37Rv
gcagcgacgcgau

SEQ ID NO: 1308130 - RNA, 16 nt, Mycobacterium tuberculosis H37Rv
gcagcgacgcugccgc

SEQ ID NO: 1308131 - RNA, 15 nt, Mycobacterium tuberculosis H37Rv
gcagcgccacccgau

SEQ ID NO: 1308132 - RNA, 17 nt, Mycobacterium tuberculosis H37Rv
gcagcgcaaugcaucgc

SEQ ID NO: 1308133 - RNA, 21 nt, Mycobacterium tuberculosis H37Rv
gcagcgcacugcccggggugc

SEQ ID NO: 1308134 - RNA, 15 nt, Mycobacterium tuberculosis H37Rv
gcagcgcaacaucga

SEQ ID NO: 1308135 - RNA, 19 nt, Mycobacterium tuberculosis H37Rv
gcaggccuccaagcccgcc

SEQ ID NO: 1308136 - RNA, 15 nt, Mycobacterium tuberculosis H37Rv
gcaggccgcgcucgu

SEQ ID NO: 1308137 - RNA, 16 nt, Mycobacterium tuberculosis H37Rv
gcaggcccacccgggc

SEQ ID NO: 1308138 - RNA, 19 nt, Mycobacterium tuberculosis H37Rv
gcaggccccacuggugcag

SEQ ID NO: 1308139 - RNA, 18 nt, Mycobacterium tuberculosis H37Rv
gcaggcccuucaguucga

SEQ ID NO: 1308140 - RNA, 18 nt, Mycobacterium tuberculosis H37Rv
gcaggcauggcgccguug

SEQ ID NO: 1308141 - RNA, 23 nt, Mycobacterium tuberculosis H37Rv
gcaggcagguuggccaccgccca

SEQ ID NO: 1308142 - RNA, 18 nt, Mycobacterium tuberculosis H37Rv
gcaggauucggcggucgc

SEQ ID NO: 1308143 - RNA, 14 nt, Mycobacterium tuberculosis H37Rv
gcaggcacaucgcg

SEQ ID NO: 1308144 - RNA, 16 nt, Mycobacterium tuberculosis H37Rv
gcaggcaccccgauca

SEQ ID NO: 1308145 - RNA, 19 nt, Mycobacterium tuberculosis H37Rv
gcaggcaccccgaucaccc

SEQ ID NO: 1308146 - RNA, 17 nt, Mycobacterium tuberculosis H37Rv
gcaggaugaugaccgcc

SEQ ID NO: 1308147 - RNA, 18 nt, Mycobacterium tuberculosis H37Rv
gcaggaucuccgggucga

SEQ ID NO: 1308148 - RNA, 17 nt, Mycobacterium tuberculosis H37Rv
gcaggcuggcugccacg

SEQ ID NO: 1308149 - RNA, 21 nt, Mycobacterium tuberculosis H37Rv
gcaggcuuucauugacacugu

SEQ ID NO: 1308150 - RNA, 16 nt, Mycobacterium tuberculosis H37Rv
gcagggaucaccccgg

SEQ ID NO: 1308151 - RNA, 20 nt, Mycobacterium tuberculosis H37Rv
gcaggcgucccagccgauca

SEQ ID NO: 1308152 - RNA, 15 nt, Mycobacterium tuberculosis H37Rv
gcaggcggcucaacc

SEQ ID NO: 1308153 - RNA, 14 nt, Mycobacterium tuberculosis H37Rv
gcaggcgaacacca

SEQ ID NO: 1308154 - RNA, 19 nt, Mycobacterium tuberculosis H37Rv
gcaggcgaguuaggccgcc

SEQ ID NO: 1308155 - RNA, 22 nt, Mycobacterium tuberculosis H37Rv
gcaggcgaguuaggccgccagc

SEQ ID NO: 1308156 - RNA, 15 nt, Mycobacterium tuberculosis H37Rv
gcagggcgcgcaucu

SEQ ID NO: 1308157 - RNA, 18 nt, Mycobacterium tuberculosis H37Rv
gcagggccucggucgcca

SEQ ID NO: 1308158 - RNA, 18 nt, Mycobacterium tuberculosis H37Rv
gcagggccagcggcagcc

SEQ ID NO: 1308159 - RNA, 19 nt, Mycobacterium tuberculosis H37Rv
gcagggccacuggccgguu

SEQ ID NO: 1308160 - RNA, 22 nt, Mycobacterium tuberculosis H37Rv
gcagggccacuggccgguucgc

SEQ ID NO: 1308161 - RNA, 22 nt, Mycobacterium tuberculosis H37Rv
gcagggcauugcggcccgcgau

SEQ ID NO: 1308162 - RNA, 22 nt, Mycobacterium tuberculosis H37Rv
gcagggcgucggcgaauuccuc

SEQ ID NO: 1308163 - RNA, 17 nt, Mycobacterium tuberculosis H37Rv
gcagggcgucggcgaau

SEQ ID NO: 1308164 - RNA, 13 nt, Mycobacterium tuberculosis H37Rv
gcagggcggcgaa

SEQ ID NO: 1308165 - RNA, 13 nt, Mycobacterium tuberculosis H37Rv
gcaggggacgacc

SEQ ID NO: 1308166 - RNA, 20 nt, Mycobacterium tuberculosis H37Rv
gcagguacgccucgacagcg

SEQ ID NO: 1308167 - RNA, 14 nt, Mycobacterium tuberculosis H37Rv
gcaggguuccccau

SEQ ID NO: 1308168 - RNA, 15 nt, Mycobacterium tuberculosis H37Rv
gcagguagucgacga

SEQ ID NO: 1308169 - RNA, 15 nt, Mycobacterium tuberculosis H37Rv
gcagguaggcgcgau

SEQ ID NO: 1308170 - RNA, 14 nt, Mycobacterium tuberculosis H37Rv
gcagguaccaccgc

SEQ ID NO: 1308171 - RNA, 13 nt, Mycobacterium tuberculosis H37Rv
gcagguagcucgu

SEQ ID NO: 1308172 - RNA, 21 nt, Mycobacterium tuberculosis H37Rv
gcagguagccaucggugcgca

SEQ ID NO: 1308173 - RNA, 21 nt, Mycobacterium tuberculosis H37Rv
gcagguccaggguggucgucg

SEQ ID NO: 1308174 - RNA, 13 nt, Mycobacterium tuberculosis H37Rv
gcaggucgccugc

SEQ ID NO: 1308175 - RNA, 12 nt, Mycobacterium tuberculosis H37Rv
gcaggucgaugc

SEQ ID NO: 1308176 - RNA, 12 nt, Mycobacterium tuberculosis H37Rv
gcaggucgcacc

SEQ ID NO: 1308177 - RNA, 22 nt, Mycobacterium tuberculosis H37Rv
gcagguuggauacggugcgacg

SEQ ID NO: 1308178 - RNA, 18 nt, Mycobacterium tuberculosis H37Rv
gcagguuccgcacgauca

SEQ ID NO: 1308179 - RNA, 19 nt, Mycobacterium tuberculosis H37Rv
gcagguuggccaccgccca

SEQ ID NO: 1308180 - RNA, 13 nt, Mycobacterium tuberculosis H37Rv
gcagguuuccggc

SEQ ID NO: 1308181 - RNA, 21 nt, Mycobacterium tuberculosis H37Rv
gcaguauucacagucgcucgc

SEQ ID NO: 1308182 - RNA, 13 nt, Mycobacterium tuberculosis H37Rv
gcagguggucgau

SEQ ID NO: 1308183 - RNA, 15 nt, Mycobacterium tuberculosis H37Rv
gcagguggugacacg

SEQ ID NO: 1308184 - RNA, 17 nt, Mycobacterium tuberculosis H37Rv
gcaggugggcguuggcg

SEQ ID NO: 1308185 - RNA, 16 nt, Mycobacterium tuberculosis H37Rv
gcaggugccuuucggc

SEQ ID NO: 1308186 - RNA, 17 nt, Mycobacterium tuberculosis H37Rv
gcaggugauguucagcg

SEQ ID NO: 1308187 - RNA, 14 nt, Mycobacterium tuberculosis H37Rv
gcaggugagugcgg

SEQ ID NO: 1308188 - RNA, 22 nt, Mycobacterium tuberculosis H37Rv
gcaggugacauguugccgcuga

SEQ ID NO: 1308189 - RNA, 19 nt, Mycobacterium tuberculosis H37Rv
gcaggugagccaguuggcc

SEQ ID NO: 1308190 - RNA, 20 nt, Mycobacterium tuberculosis H37Rv
aagaacucaaagacccgacg

SEQ ID NO: 1308191 - RNA, 21 nt, Mycobacterium tuberculosis H37Rv
gcaggucgucguaccggccuu

SEQ ID NO: 1308192 - RNA, 13 nt, Mycobacterium tuberculosis H37Rv
gaggucggagagc

SEQ ID NO: 1308193 - RNA, 16 nt, Mycobacterium tuberculosis H37Rv
gaggucggccagcagc

SEQ ID NO: 1308194 - RNA, 22 nt, Mycobacterium tuberculosis H37Rv
gagguucuccgccuccugcggg

SEQ ID NO: 1308195 - RNA, 15 nt, Mycobacterium tuberculosis H37Rv
gaggucggucagcca

SEQ ID NO: 1308196 - RNA, 20 nt, Mycobacterium tuberculosis H37Rv
gaggucggucagccaccuga

SEQ ID NO: 1308197 - RNA, 16 nt, Mycobacterium tuberculosis H37Rv
gagguuggagcgccag

SEQ ID NO: 1308198 - RNA, 16 nt, Mycobacterium tuberculosis H37Rv
gagguugggccgguug

SEQ ID NO: 1308199 - RNA, 16 nt, Mycobacterium tuberculosis H37Rv
gaggucccggcuggga

SEQ ID NO: 1308200 - RNA, 15 nt, Mycobacterium tuberculosis H37Rv
gaggucgaaccgccg

SEQ ID NO: 1308201 - RNA, 19 nt, Mycobacterium tuberculosis H37Rv
gaggucaacgccacgccga

SEQ ID NO: 1308202 - RNA, 19 nt, Mycobacterium tuberculosis H37Rv
gaggucaaggucgucgugg

SEQ ID NO: 1308203 - RNA, 22 nt, Mycobacterium tuberculosis H37Rv
gaggucacccaucaacgccggc

SEQ ID NO: 1308204 - RNA, 22 nt, Mycobacterium tuberculosis H37Rv
gaggucagagaaagccaauagc

SEQ ID NO: 1308205 - RNA, 16 nt, Mycobacterium tuberculosis H37Rv
gaggguggaccggucg

SEQ ID NO: 1308206 - RNA, 22 nt, Mycobacterium tuberculosis H37Rv
gagguagaccugguugaccucg

SEQ ID NO: 1308207 - RNA, 15 nt, Mycobacterium tuberculosis H37Rv
gagguaauucgcggc

SEQ ID NO: 1308208 - RNA, 17 nt, Mycobacterium tuberculosis H37Rv
gagguacaacgggcacg

SEQ ID NO: 1308209 - RNA, 13 nt, Mycobacterium tuberculosis H37Rv
gagggugcccgag

SEQ ID NO: 1308210 - RNA, 12 nt, Mycobacterium tuberculosis H37Rv
gaggggacccag

SEQ ID NO: 1308211 - RNA, 21 nt, Mycobacterium tuberculosis H37Rv
gagggggguguugaggccggu

SEQ ID NO: 1308212 - RNA, 12 nt, Mycobacterium tuberculosis H37Rv
gagggcucggug

SEQ ID NO: 1308213 - RNA, 14 nt, Mycobacterium tuberculosis H37Rv
gagggaaucuccgg

SEQ ID NO: 1308214 - RNA, 16 nt, Mycobacterium tuberculosis H37Rv
gaggcuggucugcagg

SEQ ID NO: 1308215 - RNA, 13 nt, Mycobacterium tuberculosis H37Rv
gaggccaccgcga

SEQ ID NO: 1308216 - RNA, 14 nt, Mycobacterium tuberculosis H37Rv
gaggcccgcggugg

SEQ ID NO: 1308217 - RNA, 14 nt, Mycobacterium tuberculosis H37Rv
gagcucaucgacga

SEQ ID NO: 1308218 - RNA, 16 nt, Mycobacterium tuberculosis H37Rv
gagcucaacacgagcg

SEQ ID NO: 1308219 - RNA, 16 nt, Mycobacterium tuberculosis H37Rv
gagcuacucacgguga

SEQ ID NO: 1308220 - RNA, 14 nt, Mycobacterium tuberculosis H37Rv
gagcuaugcuggca

SEQ ID NO: 1308221 - RNA, 16 nt, Mycobacterium tuberculosis H37Rv
gagcucgaaguuggcu

SEQ ID NO: 1308222 - RNA, 16 nt, Mycobacterium tuberculosis H37Rv
gagcuccucacggauc

SEQ ID NO: 1308223 - RNA, 18 nt, Mycobacterium tuberculosis H37Rv
gagcuccucacggauccg

SEQ ID NO: 1308224 - RNA, 18 nt, Mycobacterium tuberculosis H37Rv
gagcgugaaccuggcgac

SEQ ID NO: 1308225 - RNA, 14 nt, Mycobacterium tuberculosis H37Rv
gagcuacgacgagu

SEQ ID NO: 1308226 - RNA, 16 nt, Mycobacterium tuberculosis H37Rv
gagcugccaacgcccg

SEQ ID NO: 1308227 - RNA, 15 nt, Mycobacterium tuberculosis H37Rv
gagcugcacgccgau

SEQ ID NO: 1308228 - RNA, 17 nt, Mycobacterium tuberculosis H37Rv
gagcucggucaccacgg

SEQ ID NO: 1308229 - RNA, 20 nt, Mycobacterium tuberculosis H37Rv
gagcucggucaccacggcgg

SEQ ID NO: 1308230 - RNA, 20 nt, Mycobacterium tuberculosis H37Rv
gagcucguagaggucaucag

SEQ ID NO: 1308231 - RNA, 16 nt, Mycobacterium tuberculosis H37Rv
gagcucguugaccagg

SEQ ID NO: 1308232 - RNA, 23 nt, Mycobacterium tuberculosis H37Rv
gagcuggugcagaauucggcgcg

SEQ ID NO: 1308233 - RNA, 20 nt, Mycobacterium tuberculosis H37Rv
gagcugucgcaacgcaucga

SEQ ID NO: 1308234 - RNA, 17 nt, Mycobacterium tuberculosis H37Rv
gagcugguugacggcga

SEQ ID NO: 1308235 - RNA, 19 nt, Mycobacterium tuberculosis H37Rv
gagcuguggucacccgugu

SEQ ID NO: 1308236 - RNA, 23 nt, Mycobacterium tuberculosis H37Rv
gagcugucgcaacgcaucgaugc

SEQ ID NO: 1308237 - RNA, 20 nt, Mycobacterium tuberculosis H37Rv
gagcuuggccagcagcagcg

SEQ ID NO: 1308238 - RNA, 19 nt, Mycobacterium tuberculosis H37Rv
gagcuugguggccaccacg

SEQ ID NO: 1308239 - RNA, 23 nt, Mycobacterium tuberculosis H37Rv
gagcuugguggccaccacggcgc

SEQ ID NO: 1308240 - RNA, 22 nt, Mycobacterium tuberculosis H37Rv
gaggacccgugcacgaucgcgg

SEQ ID NO: 1308241 - RNA, 13 nt, Mycobacterium tuberculosis H37Rv
gaggacgacgauc

SEQ ID NO: 1308242 - RNA, 20 nt, Mycobacterium tuberculosis H37Rv
gaggaccucgucaccgguca

SEQ ID NO: 1308243 - RNA, 16 nt, Mycobacterium tuberculosis H37Rv
gaggagggccgcgauc

SEQ ID NO: 1308244 - RNA, 20 nt, Mycobacterium tuberculosis H37Rv
gaggacgcugauccacgaua

SEQ ID NO: 1308245 - RNA, 15 nt, Mycobacterium tuberculosis H37Rv
gaggacggcggccag

SEQ ID NO: 1308246 - RNA, 13 nt, Mycobacterium tuberculosis H37Rv
gagccgccgcgac

SEQ ID NO: 1308247 - RNA, 20 nt, Mycobacterium tuberculosis H37Rv
gacgguuugcagcgggauca

SEQ ID NO: 1308248 - RNA, 12 nt, Mycobacterium tuberculosis H37Rv
gagccgccguug

SEQ ID NO: 1308249 - RNA, 19 nt, Mycobacterium tuberculosis H37Rv
gagccgcgaaaucaccgcu

SEQ ID NO: 1308250 - RNA, 14 nt, Mycobacterium tuberculosis H37Rv
gagccgcgcccaau

SEQ ID NO: 1308251 - RNA, 23 nt, Mycobacterium tuberculosis H37Rv
gagccgcuacguuacgccgagau

SEQ ID NO: 1308252 - RNA, 22 nt, Mycobacterium tuberculosis H37Rv
gagccgcguucgcgcaaaugcc

SEQ ID NO: 1308253 - RNA, 16 nt, Mycobacterium tuberculosis H37Rv
gagccgcuuucccggc

SEQ ID NO: 1308254 - RNA, 16 nt, Mycobacterium tuberculosis H37Rv
gagccgcucuagcguc

SEQ ID NO: 1308255 - RNA, 18 nt, Mycobacterium tuberculosis H37Rv
gagccgcucgcugaaccg

SEQ ID NO: 1308256 - RNA, 21 nt, Mycobacterium tuberculosis H37Rv
gagccugcucgcagcgggcga

SEQ ID NO: 1308257 - RNA, 19 nt, Mycobacterium tuberculosis H37Rv
gagccucgcgcgccacggu

SEQ ID NO: 1308258 - RNA, 22 nt, Mycobacterium tuberculosis H37Rv
gagccgugccucgaggacggcg

SEQ ID NO: 1308259 - RNA, 16 nt, Mycobacterium tuberculosis H37Rv
gagccgggcaaccagc

SEQ ID NO: 1308260 - RNA, 20 nt, Mycobacterium tuberculosis H37Rv
gagccggaugcggccgaacu

SEQ ID NO: 1308261 - RNA, 15 nt, Mycobacterium tuberculosis H37Rv
gagcgcccgcagcgc

SEQ ID NO: 1308262 - RNA, 19 nt, Mycobacterium tuberculosis H37Rv
gagcgccacgccgaggcgu

SEQ ID NO: 1308263 - RNA, 21 nt, Mycobacterium tuberculosis H37Rv
gagcgcaccugaaggcggcga

SEQ ID NO: 1308264 - RNA, 15 nt, Mycobacterium tuberculosis H37Rv
gagcgcaaucgacca

SEQ ID NO: 1308265 - RNA, 20 nt, Mycobacterium tuberculosis H37Rv
gagcgcucgaucacggcggg

SEQ ID NO: 1308266 - RNA, 14 nt, Mycobacterium tuberculosis H37Rv
gagcgcuaucaccg

SEQ ID NO: 1308267 - RNA, 16 nt, Mycobacterium tuberculosis H37Rv
gagcggagccgccgac

SEQ ID NO: 1308268 - RNA, 15 nt, Mycobacterium tuberculosis H37Rv
gagcggacucgaguc

SEQ ID NO: 1308269 - RNA, 21 nt, Mycobacterium tuberculosis H37Rv
gagcggaauggaggccgccga

SEQ ID NO: 1308270 - RNA, 14 nt, Mycobacterium tuberculosis H37Rv
gagcgcgucgguca

SEQ ID NO: 1308271 - RNA, 18 nt, Mycobacterium tuberculosis H37Rv
gagcgcggcgacggcggu

SEQ ID NO: 1308272 - RNA, 15 nt, Mycobacterium tuberculosis H37Rv
aacucguccagcagu

SEQ ID NO: 1308273 - RNA, 17 nt, Mycobacterium tuberculosis H37Rv
aacucgcgaagcaucgc

SEQ ID NO: 1308274 - RNA, 22 nt, Mycobacterium tuberculosis H37Rv
gagcggcuugguguauucgcgg

SEQ ID NO: 1308275 - RNA, 15 nt, Mycobacterium tuberculosis H37Rv
aacucgcgcgucguc

SEQ ID NO: 1308276 - RNA, 20 nt, Mycobacterium tuberculosis H37Rv
gagcggccuccagcacccgg

SEQ ID NO: 1308277 - RNA, 15 nt, Mycobacterium tuberculosis H37Rv
gagcggccuccagca

SEQ ID NO: 1308278 - RNA, 21 nt, Mycobacterium tuberculosis H37Rv
gagcggcgaacucgggcgacu

SEQ ID NO: 1308279 - RNA, 12 nt, Mycobacterium tuberculosis H37Rv
gagcggcugcgg

SEQ ID NO: 1308280 - RNA, 22 nt, Mycobacterium tuberculosis H37Rv
gagcggauccgugucgcagauc

SEQ ID NO: 1308281 - RNA, 18 nt, Mycobacterium tuberculosis H37Rv
gagcggauuccuggggug

SEQ ID NO: 1308282 - RNA, 15 nt, Mycobacterium tuberculosis H37Rv
gagcggcaucgguca

SEQ ID NO: 1308283 - RNA, 18 nt, Mycobacterium tuberculosis H37Rv
gagcggaugaaaucggca

SEQ ID NO: 1308284 - RNA, 22 nt, Mycobacterium tuberculosis H37Rv
gagcggccaggucggucauccg

SEQ ID NO: 1308285 - RNA, 15 nt, Mycobacterium tuberculosis H37Rv
gagcggccaggucgg

SEQ ID NO: 1308286 - RNA, 18 nt, Mycobacterium tuberculosis H37Rv
gagcggucaacgaguugc

SEQ ID NO: 1308287 - RNA, 16 nt, Mycobacterium tuberculosis H37Rv
gagcgguugccuucuu

SEQ ID NO: 1308288 - RNA, 23 nt, Mycobacterium tuberculosis H37Rv
gagcggucagcgucgaucgugcg

SEQ ID NO: 1308289 - RNA, 22 nt, Mycobacterium tuberculosis H37Rv
gagcggggaaguuggcugagca

SEQ ID NO: 1308290 - RNA, 17 nt, Mycobacterium tuberculosis H37Rv
aacugacccgcauaccg

SEQ ID NO: 1308291 - RNA, 16 nt, Mycobacterium tuberculosis H37Rv
aacugcccgcggcgga

SEQ ID NO: 1308292 - RNA, 18 nt, Mycobacterium tuberculosis H37Rv
aacugccgcgccgacgcc

SEQ ID NO: 1308293 - RNA, 13 nt, Mycobacterium tuberculosis H37Rv
gagcgggaucggg

SEQ ID NO: 1308294 - RNA, 13 nt, Mycobacterium tuberculosis H37Rv
gaucaccggcaug

SEQ ID NO: 1308295 - RNA, 13 nt, Mycobacterium tuberculosis H37Rv
gaucaccgucgua

SEQ ID NO: 1308296 - RNA, 23 nt, Mycobacterium tuberculosis H37Rv
gaucaccaugaucagcgccgugg

SEQ ID NO: 1308297 - RNA, 23 nt, Mycobacterium tuberculosis H37Rv
gaucaccuuggcaagcacgcgac

SEQ ID NO: 1308298 - RNA, 16 nt, Mycobacterium tuberculosis H37Rv
gaucaauccgcccuug

SEQ ID NO: 1308299 - RNA, 15 nt, Mycobacterium tuberculosis H37Rv
gaucaaaccggccuu

SEQ ID NO: 1308300 - RNA, 14 nt, Mycobacterium tuberculosis H37Rv
gaucaccaacccgu

SEQ ID NO: 1308301 - RNA, 17 nt, Mycobacterium tuberculosis H37Rv
gaucacacccacgucga

SEQ ID NO: 1308302 - RNA, 13 nt, Mycobacterium tuberculosis H37Rv
gauagccugcggc

SEQ ID NO: 1308303 - RNA, 18 nt, Mycobacterium tuberculosis H37Rv
gauagcggcgcagcguga

SEQ ID NO: 1308304 - RNA, 18 nt, Mycobacterium tuberculosis H37Rv
gaguacggcgaugcgguc

SEQ ID NO: 1308305 - RNA, 22 nt, Mycobacterium tuberculosis H37Rv
gaguccgucggggacauccgcu

SEQ ID NO: 1308306 - RNA, 17 nt, Mycobacterium tuberculosis H37Rv
gaguacggccugccgcu

SEQ ID NO: 1308307 - RNA, 18 nt, Mycobacterium tuberculosis H37Rv
gaguacaacagcgucugg

SEQ ID NO: 1308308 - RNA, 15 nt, Mycobacterium tuberculosis H37Rv
gagucgcacgugggc

SEQ ID NO: 1308309 - RNA, 22 nt, Mycobacterium tuberculosis H37Rv
gagucgaaccagguaaucaccu

SEQ ID NO: 1308310 - RNA, 14 nt, Mycobacterium tuberculosis H37Rv
gagucgcacugcgc

SEQ ID NO: 1308311 - RNA, 15 nt, Mycobacterium tuberculosis H37Rv
gauaacccaaccgcg

SEQ ID NO: 1308312 - RNA, 21 nt, Mycobacterium tuberculosis H37Rv
gauacccagcgcccggccacu

SEQ ID NO: 1308313 - RNA, 15 nt, Mycobacterium tuberculosis H37Rv
gauacccagcgcccg

SEQ ID NO: 1308314 - RNA, 15 nt, Mycobacterium tuberculosis H37Rv
gauaccgaccaucgg

SEQ ID NO: 1308315 - RNA, 14 nt, Mycobacterium tuberculosis H37Rv
gauaccgaccaucg

SEQ ID NO: 1308316 - RNA, 17 nt, Mycobacterium tuberculosis H37Rv
gauacggugcgacgauc

SEQ ID NO: 1308317 - RNA, 14 nt, Mycobacterium tuberculosis H37Rv
gauacucgucgucg

SEQ ID NO: 1308318 - RNA, 16 nt, Mycobacterium tuberculosis H37Rv
gaucaucaccggcaua

SEQ ID NO: 1308319 - RNA, 24 nt, Mycobacterium tuberculosis H37Rv
gaucaggcgcucgaaggccgcacu

SEQ ID NO: 1308320 - RNA, 14 nt, Mycobacterium tuberculosis H37Rv
gaucaggacgcgau

SEQ ID NO: 1308321 - RNA, 21 nt, Mycobacterium tuberculosis H37Rv
gaucaggccgacgucgaccac

SEQ ID NO: 1308322 - RNA, 23 nt, Mycobacterium tuberculosis H37Rv
gaucaucgggguggccaccagcg

SEQ ID NO: 1308323 - RNA, 18 nt, Mycobacterium tuberculosis H37Rv
gauccagaacaacggcgc

SEQ ID NO: 1308324 - RNA, 15 nt, Mycobacterium tuberculosis H37Rv
gauccagcccgacgc

SEQ ID NO: 1308325 - RNA, 21 nt, Mycobacterium tuberculosis H37Rv
gauccagcaggccgucgauca

SEQ ID NO: 1308326 - RNA, 15 nt, Mycobacterium tuberculosis H37Rv
gaucagccagaccaa

SEQ ID NO: 1308327 - RNA, 15 nt, Mycobacterium tuberculosis H37Rv
gaucagcaggaucgg

SEQ ID NO: 1308328 - RNA, 14 nt, Mycobacterium tuberculosis H37Rv
gaucagcccggacg

SEQ ID NO: 1308329 - RNA, 21 nt, Mycobacterium tuberculosis H37Rv
gaucagccguggcagucgcac

SEQ ID NO: 1308330 - RNA, 19 nt, Mycobacterium tuberculosis H37Rv
gaucagcguggcgcccgug

SEQ ID NO: 1308331 - RNA, 21 nt, Mycobacterium tuberculosis H37Rv
gaucagcucgcgcacgucgac

SEQ ID NO: 1308332 - RNA, 13 nt, Mycobacterium tuberculosis H37Rv
gaucagcggcgaa

SEQ ID NO: 1308333 - RNA, 21 nt, Mycobacterium tuberculosis H37Rv
gaucgacaguugcgccagcgu

SEQ ID NO: 1308334 - RNA, 16 nt, Mycobacterium tuberculosis H37Rv
gaucgaccgccagcgc

SEQ ID NO: 1308335 - RNA, 15 nt, Mycobacterium tuberculosis H37Rv
gaucgacaucguugg

SEQ ID NO: 1308336 - RNA, 16 nt, Mycobacterium tuberculosis H37Rv
gaucgacaccgugacc

SEQ ID NO: 1308337 - RNA, 17 nt, Mycobacterium tuberculosis H37Rv
gaucgaguuccgcaucg

SEQ ID NO: 1308338 - RNA, 18 nt, Mycobacterium tuberculosis H37Rv
gaucgaguuccgcaucgg

SEQ ID NO: 1308339 - RNA, 16 nt, Mycobacterium tuberculosis H37Rv
gaucgaccgcuggauc

SEQ ID NO: 1308340 - RNA, 14 nt, Mycobacterium tuberculosis H37Rv
gauccuucgcguug

SEQ ID NO: 1308341 - RNA, 17 nt, Mycobacterium tuberculosis H37Rv
gauccgugucgcagauc

SEQ ID NO: 1308342 - RNA, 20 nt, Mycobacterium tuberculosis H37Rv
gauccguccgcuggugguca

SEQ ID NO: 1308343 - RNA, 15 nt, Mycobacterium tuberculosis H37Rv
gauccggucggccag

SEQ ID NO: 1308344 - RNA, 15 nt, Mycobacterium tuberculosis H37Rv
gauccgggcgccgau

SEQ ID NO: 1308345 - RNA, 22 nt, Mycobacterium tuberculosis H37Rv
gauccgauacagugcgcggauc

SEQ ID NO: 1308346 - RNA, 21 nt, Mycobacterium tuberculosis H37Rv
gauccgcaccacgcccgacga

SEQ ID NO: 1308347 - RNA, 13 nt, Mycobacterium tuberculosis H37Rv
gauccgauccgcu

SEQ ID NO: 1308348 - RNA, 17 nt, Mycobacterium tuberculosis H37Rv
gauccagggucaccucg

SEQ ID NO: 1308349 - RNA, 15 nt, Mycobacterium tuberculosis H37Rv
gauccgccgacagcc

SEQ ID NO: 1308350 - RNA, 23 nt, Mycobacterium tuberculosis H37Rv
gauccgcacccggccgcgcaccc

SEQ ID NO: 1308351 - RNA, 14 nt, Mycobacterium tuberculosis H37Rv
gauccgccgacagc

SEQ ID NO: 1308352 - RNA, 17 nt, Mycobacterium tuberculosis H37Rv
gaugucagcggccgcga

SEQ ID NO: 1308353 - RNA, 12 nt, Mycobacterium tuberculosis H37Rv
gaugucgccgau

SEQ ID NO: 1308354 - RNA, 18 nt, Mycobacterium tuberculosis H37Rv
gauguaugacaggucacg

SEQ ID NO: 1308355 - RNA, 13 nt, Mycobacterium tuberculosis H37Rv
gauguaguuggcg

SEQ ID NO: 1308356 - RNA, 20 nt, Mycobacterium tuberculosis H37Rv
gauggucccgagggcggcag

SEQ ID NO: 1308357 - RNA, 16 nt, Mycobacterium tuberculosis H37Rv
gaugguccgccagauc

SEQ ID NO: 1308358 - RNA, 22 nt, Mycobacterium tuberculosis H37Rv
gauggucuccggacgcacgauc

SEQ ID NO: 1308359 - RNA, 17 nt, Mycobacterium tuberculosis H37Rv
gauggucuccucgguca

SEQ ID NO: 1308360 - RNA, 14 nt, Mycobacterium tuberculosis H37Rv
gauguacccggcga

SEQ ID NO: 1308361 - RNA, 22 nt, Mycobacterium tuberculosis H37Rv
gauggugaugggggagccggug

SEQ ID NO: 1308362 - RNA, 15 nt, Mycobacterium tuberculosis H37Rv
gauguagcggcguuc

SEQ ID NO: 1308363 - RNA, 15 nt, Mycobacterium tuberculosis H37Rv
gauggccgucagcca

SEQ ID NO: 1308364 - RNA, 19 nt, Mycobacterium tuberculosis H37Rv
gauggccguccgaccgaua

SEQ ID NO: 1308365 - RNA, 17 nt, Mycobacterium tuberculosis H37Rv
gauggcggccaccagcg

SEQ ID NO: 1308366 - RNA, 14 nt, Mycobacterium tuberculosis H37Rv
gauggcgcugcacc

SEQ ID NO: 1308367 - RNA, 17 nt, Mycobacterium tuberculosis H37Rv
gauggcgcggucgcuga

SEQ ID NO: 1308368 - RNA, 13 nt, Mycobacterium tuberculosis H37Rv
gauggcucgccga

SEQ ID NO: 1308369 - RNA, 22 nt, Mycobacterium tuberculosis H37Rv
gauggcucacaugcccgcaccg

SEQ ID NO: 1308370 - RNA, 20 nt, Mycobacterium tuberculosis H37Rv
gaugggaccuugaucgagca

SEQ ID NO: 1308371 - RNA, 23 nt, Mycobacterium tuberculosis H37Rv
gaugcugccagaucggucggcca

SEQ ID NO: 1308372 - RNA, 20 nt, Mycobacterium tuberculosis H37Rv
gauggcaagggccgacgucg

SEQ ID NO: 1308373 - RNA, 15 nt, Mycobacterium tuberculosis H37Rv
gauggacggcagcca

SEQ ID NO: 1308374 - RNA, 16 nt, Mycobacterium tuberculosis H37Rv
gauggcauugcgccca

SEQ ID NO: 1308375 - RNA, 16 nt, Mycobacterium tuberculosis H37Rv
gaugcgcgucucgagc

SEQ ID NO: 1308376 - RNA, 15 nt, Mycobacterium tuberculosis H37Rv
gaugcgcucggccug

SEQ ID NO: 1308377 - RNA, 12 nt, Mycobacterium tuberculosis H37Rv
gaugcgcggugc

SEQ ID NO: 1308378 - RNA, 15 nt, Mycobacterium tuberculosis H37Rv
gaugcgcccggcgug

SEQ ID NO: 1308379 - RNA, 19 nt, Mycobacterium tuberculosis H37Rv
gaugcgcccggcgugguga

SEQ ID NO: 1308380 - RNA, 18 nt, Mycobacterium tuberculosis H37Rv
gcaacacgauaucgggcu

SEQ ID NO: 1308381 - RNA, 21 nt, Mycobacterium tuberculosis H37Rv
gcaacagcgcgguguucgcgg

SEQ ID NO: 1308382 - RNA, 12 nt, Mycobacterium tuberculosis H37Rv
gcaaaucaagca

SEQ ID NO: 1308383 - RNA, 18 nt, Mycobacterium tuberculosis H37Rv
gcaaacguaccgucaugg

SEQ ID NO: 1308384 - RNA, 19 nt, Mycobacterium tuberculosis H37Rv
gauuuugcgucugcucacg

SEQ ID NO: 1308385 - RNA, 20 nt, Mycobacterium tuberculosis H37Rv
gauuuugcgucugcucgcca

SEQ ID NO: 1308386 - RNA, 20 nt, Mycobacterium tuberculosis H37Rv
gauuuucucggugcuggcga

SEQ ID NO: 1308387 - RNA, 17 nt, Mycobacterium tuberculosis H37Rv
gauuuccucugggcugu

SEQ ID NO: 1308388 - RNA, 13 nt, Mycobacterium tuberculosis H37Rv
gauucauggcggc

SEQ ID NO: 1308389 - RNA, 16 nt, Mycobacterium tuberculosis H37Rv
gauuccaauugggcga

SEQ ID NO: 1308390 - RNA, 18 nt, Mycobacterium tuberculosis H37Rv
gauucaucaacacgacgu

SEQ ID NO: 1308391 - RNA, 20 nt, Mycobacterium tuberculosis H37Rv
gauucaucaacacgacguca

SEQ ID NO: 1308392 - RNA, 14 nt, Mycobacterium tuberculosis H37Rv
gauuccaccgccga

SEQ ID NO: 1308393 - RNA, 17 nt, Mycobacterium tuberculosis H37Rv
gauucggcgacgacggg

SEQ ID NO: 1308394 - RNA, 19 nt, Mycobacterium tuberculosis H37Rv
gauucggccugagcggcca

SEQ ID NO: 1308395 - RNA, 22 nt, Mycobacterium tuberculosis H37Rv
gaugucggacacauggucgcga

SEQ ID NO: 1308396 - RNA, 20 nt, Mycobacterium tuberculosis H37Rv
gauguggcgcuccggcgugc

SEQ ID NO: 1308397 - RNA, 22 nt, Mycobacterium tuberculosis H37Rv
gaugugcucaggucgcagacca

SEQ ID NO: 1308398 - RNA, 17 nt, Mycobacterium tuberculosis H37Rv
gaugugguccaucgcgc

SEQ ID NO: 1308399 - RNA, 17 nt, Mycobacterium tuberculosis H37Rv
gaucucgacggccucgu

SEQ ID NO: 1308400 - RNA, 23 nt, Mycobacterium tuberculosis H37Rv
gaucucgaccguauugaccagcg

SEQ ID NO: 1308401 - RNA, 14 nt, Mycobacterium tuberculosis H37Rv
gaucgccucgacgc

SEQ ID NO: 1308402 - RNA, 22 nt, Mycobacterium tuberculosis H37Rv
gaucucccagugagcaugcgac

SEQ ID NO: 1308403 - RNA, 20 nt, Mycobacterium tuberculosis H37Rv
gaucgccgaaucggcaguug

SEQ ID NO: 1308404 - RNA, 16 nt, Mycobacterium tuberculosis H37Rv
gaucgccgaaucggca

SEQ ID NO: 1308405 - RNA, 17 nt, Mycobacterium tuberculosis H37Rv
gaucgccgacgccagaa

SEQ ID NO: 1308406 - RNA, 22 nt, Mycobacterium tuberculosis H37Rv
gaucgccgaggcagcgucgucg

SEQ ID NO: 1308407 - RNA, 21 nt, Mycobacterium tuberculosis H37Rv
gaucgccgagcaggucggcaa

SEQ ID NO: 1308408 - RNA, 21 nt, Mycobacterium tuberculosis H37Rv
gaucgccggccugcucggcga

SEQ ID NO: 1308409 - RNA, 19 nt, Mycobacterium tuberculosis H37Rv
gaucgccgcuaacgcaccu

SEQ ID NO: 1308410 - RNA, 15 nt, Mycobacterium tuberculosis H37Rv
gaucgccggcuucgc

SEQ ID NO: 1308411 - RNA, 20 nt, Mycobacterium tuberculosis H37Rv
gaucgccggccugcucggcg

SEQ ID NO: 1308412 - RNA, 22 nt, Mycobacterium tuberculosis H37Rv
gaucuugccgccgcgccggcag

SEQ ID NO: 1308413 - RNA, 12 nt, Mycobacterium tuberculosis H37Rv
gaucuugccgcc

SEQ ID NO: 1308414 - RNA, 15 nt, Mycobacterium tuberculosis H37Rv
gaucuugccggccag

SEQ ID NO: 1308415 - RNA, 17 nt, Mycobacterium tuberculosis H37Rv
gaucugacggcgccguc

SEQ ID NO: 1308416 - RNA, 20 nt, Mycobacterium tuberculosis H37Rv
gaucugggcugcggccgcga

SEQ ID NO: 1308417 - RNA, 13 nt, Mycobacterium tuberculosis H37Rv
gaucugccucucg

SEQ ID NO: 1308418 - RNA, 14 nt, Mycobacterium tuberculosis H37Rv
gaucugggcgguga

SEQ ID NO: 1308419 - RNA, 15 nt, Mycobacterium tuberculosis H37Rv
gaugaggaucaucga

SEQ ID NO: 1308420 - RNA, 13 nt, Mycobacterium tuberculosis H37Rv
gaugagcgguacc

SEQ ID NO: 1308421 - RNA, 14 nt, Mycobacterium tuberculosis H37Rv
gaugagcgcggcga

SEQ ID NO: 1308422 - RNA, 23 nt, Mycobacterium tuberculosis H37Rv
gaugacgcccagggcgucggcga

SEQ ID NO: 1308423 - RNA, 18 nt, Mycobacterium tuberculosis H37Rv
gaugacguugcagccggc

SEQ ID NO: 1308424 - RNA, 18 nt, Mycobacterium tuberculosis H37Rv
gaugaccaugaugaccgg

SEQ ID NO: 1308425 - RNA, 17 nt, Mycobacterium tuberculosis H37Rv
gaugaccaggucgguca

SEQ ID NO: 1308426 - RNA, 13 nt, Mycobacterium tuberculosis H37Rv
gaugaccgccauc

SEQ ID NO: 1308427 - RNA, 24 nt, Mycobacterium tuberculosis H37Rv
gaugacccggaaucccgagucugc

SEQ ID NO: 1308428 - RNA, 15 nt, Mycobacterium tuberculosis H37Rv
gaugacccggaaucc

SEQ ID NO: 1308429 - RNA, 15 nt, Mycobacterium tuberculosis H37Rv
gaugacgaccgaucg

SEQ ID NO: 1308430 - RNA, 20 nt, Mycobacterium tuberculosis H37Rv
gaugacgacgccgucggaca

SEQ ID NO: 1308431 - RNA, 18 nt, Mycobacterium tuberculosis H37Rv
gaugacgaucgcguccgc

SEQ ID NO: 1308432 - RNA, 17 nt, Mycobacterium tuberculosis H37Rv
gaugaccuugcccacca

SEQ ID NO: 1308433 - RNA, 20 nt, Mycobacterium tuberculosis H37Rv
gaugacaaagaaguggucgg

SEQ ID NO: 1308434 - RNA, 18 nt, Mycobacterium tuberculosis H37Rv
aacugcuugcgcaucgcc

SEQ ID NO: 1308435 - RNA, 14 nt, Mycobacterium tuberculosis H37Rv
gaugaccaccgguu

SEQ ID NO: 1308436 - RNA, 18 nt, Mycobacterium tuberculosis H37Rv
aacuggacggggaagccc

SEQ ID NO: 1308437 - RNA, 23 nt, Mycobacterium tuberculosis H37Rv
aacugcugaugaaacgccgucgc

SEQ ID NO: 1308438 - RNA, 15 nt, Mycobacterium tuberculosis H37Rv
gaugaacaccggcgc

SEQ ID NO: 1308439 - RNA, 13 nt, Mycobacterium tuberculosis H37Rv
gaugaaccaggcg

SEQ ID NO: 1308440 - RNA, 14 nt, Mycobacterium tuberculosis H37Rv
gaugaagcgcgguu

SEQ ID NO: 1308441 - RNA, 18 nt, Mycobacterium tuberculosis H37Rv
gaugccggugugcgccaa

SEQ ID NO: 1308442 - RNA, 20 nt, Mycobacterium tuberculosis H37Rv
gaugccgugcugggccgacg

SEQ ID NO: 1308443 - RNA, 22 nt, Mycobacterium tuberculosis H37Rv
gaugccguaggcggccaguugc

SEQ ID NO: 1308444 - RNA, 17 nt, Mycobacterium tuberculosis H37Rv
gaugccggucggcgucg

SEQ ID NO: 1308445 - RNA, 13 nt, Mycobacterium tuberculosis H37Rv
gaugccggcguug

SEQ ID NO: 1308446 - RNA, 20 nt, Mycobacterium tuberculosis H37Rv
gaugcgcagugcaccgcguc

SEQ ID NO: 1308447 - RNA, 13 nt, Mycobacterium tuberculosis H37Rv
gaugcgacgaacc

SEQ ID NO: 1308448 - RNA, 14 nt, Mycobacterium tuberculosis H37Rv
gaugcgaucgacga

SEQ ID NO: 1308449 - RNA, 16 nt, Mycobacterium tuberculosis H37Rv
gaugccuuccgacgac

SEQ ID NO: 1308450 - RNA, 22 nt, Mycobacterium tuberculosis H37Rv
gaugccugcuagcagcagcccg

SEQ ID NO: 1308451 - RNA, 17 nt, Mycobacterium tuberculosis H37Rv
gaugcccucgauggcca

SEQ ID NO: 1308452 - RNA, 19 nt, Mycobacterium tuberculosis H37Rv
gaugcccggcaucgcgauc

SEQ ID NO: 1308453 - RNA, 15 nt, Mycobacterium tuberculosis H37Rv
gaugccgacggcggg

SEQ ID NO: 1308454 - RNA, 23 nt, Mycobacterium tuberculosis H37Rv
gaugccgaccuuuugcggcaagc

SEQ ID NO: 1308455 - RNA, 19 nt, Mycobacterium tuberculosis H37Rv
gaugccgacggcgggcgau

SEQ ID NO: 1308456 - RNA, 15 nt, Mycobacterium tuberculosis H37Rv
gaugccgaaccgcug

SEQ ID NO: 1308457 - RNA, 19 nt, Mycobacterium tuberculosis H37Rv
gaugccggacagcucgcgc

SEQ ID NO: 1308458 - RNA, 15 nt, Mycobacterium tuberculosis H37Rv
gaugccggcgagggc

SEQ ID NO: 1308459 - RNA, 15 nt, Mycobacterium tuberculosis H37Rv
gaugccggacgccau

SEQ ID NO: 1308460 - RNA, 23 nt, Mycobacterium tuberculosis H37Rv
gaugccgcacccgaucgacgguc

SEQ ID NO: 1308461 - RNA, 16 nt, Mycobacterium tuberculosis H37Rv
gaugccgaugcgacgc

SEQ ID NO: 1308462 - RNA, 22 nt, Mycobacterium tuberculosis H37Rv
gaugagugacgguccguucgau

SEQ ID NO: 1308463 - RNA, 22 nt, Mycobacterium tuberculosis H37Rv
gaugaucaugaacgccagcagc

SEQ ID NO: 1308464 - RNA, 21 nt, Mycobacterium tuberculosis H37Rv
aacugggcaccggcggucugc

SEQ ID NO: 1308465 - RNA, 15 nt, Mycobacterium tuberculosis H37Rv
gaugauuucgccgag

SEQ ID NO: 1308466 - RNA, 14 nt, Mycobacterium tuberculosis H37Rv
aacuggucgacgcc

SEQ ID NO: 1308467 - RNA, 22 nt, Mycobacterium tuberculosis H37Rv
gaugcaugucuugugguggaaa

SEQ ID NO: 1308468 - RNA, 22 nt, Mycobacterium tuberculosis H37Rv
gaugcauggcuugcucugcgca

SEQ ID NO: 1308469 - RNA, 19 nt, Mycobacterium tuberculosis H37Rv
gaugccagugcaucgguca

SEQ ID NO: 1308470 - RNA, 12 nt, Mycobacterium tuberculosis H37Rv
gaugcacgucga

SEQ ID NO: 1308471 - RNA, 21 nt, Mycobacterium tuberculosis H37Rv
gaugcaccucgcccugcagac

SEQ ID NO: 1308472 - RNA, 14 nt, Mycobacterium tuberculosis H37Rv
gaugcagccacaua

SEQ ID NO: 1308473 - RNA, 21 nt, Mycobacterium tuberculosis H37Rv
cuggcgcagcgccucgguaaa

SEQ ID NO: 1308474 - RNA, 19 nt, Mycobacterium tuberculosis H37Rv
cuggcgaucucuaccagcc

SEQ ID NO: 1308475 - RNA, 20 nt, Mycobacterium tuberculosis H37Rv
cuggcgauaaccgacgauca

SEQ ID NO: 1308476 - RNA, 19 nt, Mycobacterium tuberculosis H37Rv
cuggcgauacagcgacagg

SEQ ID NO: 1308477 - RNA, 17 nt, Mycobacterium tuberculosis H37Rv
cuggccgaacgacgggu

SEQ ID NO: 1308478 - RNA, 23 nt, Mycobacterium tuberculosis H37Rv
cuggccgcuauccaggccgucag

SEQ ID NO: 1308479 - RNA, 15 nt, Mycobacterium tuberculosis H37Rv
cuggcgacgcgacac

SEQ ID NO: 1308480 - RNA, 19 nt, Mycobacterium tuberculosis H37Rv
cuggcgacgacgacaccgc

SEQ ID NO: 1308481 - RNA, 22 nt, Mycobacterium tuberculosis H37Rv
cuggcgacgacgacaccgcgca

SEQ ID NO: 1308482 - RNA, 15 nt, Mycobacterium tuberculosis H37Rv
cuggcgaaccagagu

SEQ ID NO: 1308483 - RNA, 23 nt, Mycobacterium tuberculosis H37Rv
cuggcgaaccagaguucggccag

SEQ ID NO: 1308484 - RNA, 16 nt, Mycobacterium tuberculosis H37Rv
cuggccuuggcagucc

SEQ ID NO: 1308485 - RNA, 20 nt, Mycobacterium tuberculosis H37Rv
cuggcccggcuacgacggcg

SEQ ID NO: 1308486 - RNA, 23 nt, Mycobacterium tuberculosis H37Rv
cuggcccgccacgaugucgucga

SEQ ID NO: 1308487 - RNA, 18 nt, Mycobacterium tuberculosis H37Rv
cuggccccgccagcggca

SEQ ID NO: 1308488 - RNA, 20 nt, Mycobacterium tuberculosis H37Rv
cuggcccccgguaccgcccg

SEQ ID NO: 1308489 - RNA, 15 nt, Mycobacterium tuberculosis H37Rv
cuggccagcaggguu

SEQ ID NO: 1308490 - RNA, 14 nt, Mycobacterium tuberculosis H37Rv
cuggccagcacacc

SEQ ID NO: 1308491 - RNA, 21 nt, Mycobacterium tuberculosis H37Rv
cuggccagcacaccgucgacg

SEQ ID NO: 1308492 - RNA, 13 nt, Mycobacterium tuberculosis H37Rv
cuggcaccgccag

SEQ ID NO: 1308493 - RNA, 14 nt, Mycobacterium tuberculosis H37Rv
cuggcaccgccagc

SEQ ID NO: 1308494 - RNA, 21 nt, Mycobacterium tuberculosis H37Rv
cuggccacggcuuugcggcgc

SEQ ID NO: 1308495 - RNA, 15 nt, Mycobacterium tuberculosis H37Rv
cuggccacgauccgc

SEQ ID NO: 1308496 - RNA, 15 nt, Mycobacterium tuberculosis H37Rv
cuggccaccgcaucg

SEQ ID NO: 1308497 - RNA, 16 nt, Mycobacterium tuberculosis H37Rv
cugccgaagcggccac

SEQ ID NO: 1308498 - RNA, 16 nt, Mycobacterium tuberculosis H37Rv
cuggagcagcuaccga

SEQ ID NO: 1308499 - RNA, 21 nt, Mycobacterium tuberculosis H37Rv
cuggaguucgucaccguuggc

SEQ ID NO: 1308500 - RNA, 16 nt, Mycobacterium tuberculosis H37Rv
cuggaguucgucaccg

SEQ ID NO: 1308501 - RNA, 13 nt, Mycobacterium tuberculosis H37Rv
cuggaggccacca

SEQ ID NO: 1308502 - RNA, 14 nt, Mycobacterium tuberculosis H37Rv
cuggcaacgacacg

SEQ ID NO: 1308503 - RNA, 15 nt, Mycobacterium tuberculosis H37Rv
cuggaucacgucgau

SEQ ID NO: 1308504 - RNA, 14 nt, Mycobacterium tuberculosis H37Rv
cugggugaccagga

SEQ ID NO: 1308505 - RNA, 21 nt, Mycobacterium tuberculosis H37Rv
cugggugaugagcgcuucgag

SEQ ID NO: 1308506 - RNA, 12 nt, Mycobacterium tuberculosis H37Rv
cuggucaaccgc

SEQ ID NO: 1308507 - RNA, 18 nt, Mycobacterium tuberculosis H37Rv
cuggucacccguaucggg

SEQ ID NO: 1308508 - RNA, 14 nt, Mycobacterium tuberculosis H37Rv
cuggguggcgucgc

SEQ ID NO: 1308509 - RNA, 15 nt, Mycobacterium tuberculosis H37Rv
cuggcgucgaugucg

SEQ ID NO: 1308510 - RNA, 16 nt, Mycobacterium tuberculosis H37Rv
cuggcugacgauuucc

SEQ ID NO: 1308511 - RNA, 15 nt, Mycobacterium tuberculosis H37Rv
cuggcucaucgaagc

SEQ ID NO: 1308512 - RNA, 22 nt, Mycobacterium tuberculosis H37Rv
cuggcguuguugacgaucaccc

SEQ ID NO: 1308513 - RNA, 15 nt, Mycobacterium tuberculosis H37Rv
cuggcgcugaucgcc

SEQ ID NO: 1308514 - RNA, 14 nt, Mycobacterium tuberculosis H37Rv
cuggcggauggccg

SEQ ID NO: 1308515 - RNA, 15 nt, Mycobacterium tuberculosis H37Rv
cuggcgcugcuggca

SEQ ID NO: 1308516 - RNA, 18 nt, Mycobacterium tuberculosis H37Rv
cuggcggcugcagccgac

SEQ ID NO: 1308517 - RNA, 15 nt, Mycobacterium tuberculosis H37Rv
cuggcggugccggcg

SEQ ID NO: 1308518 - RNA, 23 nt, Mycobacterium tuberculosis H37Rv
cuggcgggcagcuguucggccaa

SEQ ID NO: 1308519 - RNA, 13 nt, Mycobacterium tuberculosis H37Rv
cuggcggcgcgac

SEQ ID NO: 1308520 - RNA, 14 nt, Mycobacterium tuberculosis H37Rv
cuggcggcgcagcg

SEQ ID NO: 1308521 - RNA, 20 nt, Mycobacterium tuberculosis H37Rv
cuucgauugcgcugcaccgg

SEQ ID NO: 1308522 - RNA, 14 nt, Mycobacterium tuberculosis H37Rv
cuucgccacaccau

SEQ ID NO: 1308523 - RNA, 23 nt, Mycobacterium tuberculosis H37Rv
cuucgcccagagccgcugcggca

SEQ ID NO: 1308524 - RNA, 16 nt, Mycobacterium tuberculosis H37Rv
cuucgcccuugccgca

SEQ ID NO: 1308525 - RNA, 19 nt, Mycobacterium tuberculosis H37Rv
cuucgcguuggcccgccug

SEQ ID NO: 1308526 - RNA, 19 nt, Mycobacterium tuberculosis H37Rv
cuucgcuauggcggcuucg

SEQ ID NO: 1308527 - RNA, 12 nt, Mycobacterium tuberculosis H37Rv
cuucggaccggc

SEQ ID NO: 1308528 - RNA, 20 nt, Mycobacterium tuberculosis H37Rv
cuucggcggccgagcgcacc

SEQ ID NO: 1308529 - RNA, 17 nt, Mycobacterium tuberculosis H37Rv
cuucgggugcagccaga

SEQ ID NO: 1308530 - RNA, 16 nt, Mycobacterium tuberculosis H37Rv
cuucggggucaccggc

SEQ ID NO: 1308531 - RNA, 16 nt, Mycobacterium tuberculosis H37Rv
cuuccaggagcgccgu

SEQ ID NO: 1308532 - RNA, 13 nt, Mycobacterium tuberculosis H37Rv
cuucgacagcggc

SEQ ID NO: 1308533 - RNA, 15 nt, Mycobacterium tuberculosis H37Rv
cuucgacagcgcgca

SEQ ID NO: 1308534 - RNA, 14 nt, Mycobacterium tuberculosis H37Rv
cuuaugcacgacgg

SEQ ID NO: 1308535 - RNA, 18 nt, Mycobacterium tuberculosis H37Rv
cuuaugcgucugcucgcc

SEQ ID NO: 1308536 - RNA, 20 nt, Mycobacterium tuberculosis H37Rv
cuuaugcgucugcucgcccu

SEQ ID NO: 1308537 - RNA, 15 nt, Mycobacterium tuberculosis H37Rv
cugucgcgcaccgga

SEQ ID NO: 1308538 - RNA, 22 nt, Mycobacterium tuberculosis H37Rv
cugucgccuuugagggcgacga

SEQ ID NO: 1308539 - RNA, 16 nt, Mycobacterium tuberculosis H37Rv
cugucgcccucgaucg

SEQ ID NO: 1308540 - RNA, 22 nt, Mycobacterium tuberculosis H37Rv
cugucagaaggaucagcgcacu

SEQ ID NO: 1308541 - RNA, 17 nt, Mycobacterium tuberculosis H37Rv
cugucggcaugccgguc

SEQ ID NO: 1308542 - RNA, 14 nt, Mycobacterium tuberculosis H37Rv
cugucgcgccggug

SEQ ID NO: 1308543 - RNA, 19 nt, Mycobacterium tuberculosis H37Rv
cugugccgccggcgccacc

SEQ ID NO: 1308544 - RNA, 13 nt, Mycobacterium tuberculosis H37Rv
cugugcgacccgc

SEQ ID NO: 1308545 - RNA, 14 nt, Mycobacterium tuberculosis H37Rv
cugugcgcagacau

SEQ ID NO: 1308546 - RNA, 12 nt, Mycobacterium tuberculosis H37Rv
cugugcgccgca

SEQ ID NO: 1308547 - RNA, 14 nt, Mycobacterium tuberculosis H37Rv
cugugcggcgggca

SEQ ID NO: 1308548 - RNA, 18 nt, Mycobacterium tuberculosis H37Rv
cugugcggucgucaccgu

SEQ ID NO: 1308549 - RNA, 19 nt, Mycobacterium tuberculosis H37Rv
cugguccaaucgcgacagu

SEQ ID NO: 1308550 - RNA, 13 nt, Mycobacterium tuberculosis H37Rv
cuggucaugcgga

SEQ ID NO: 1308551 - RNA, 22 nt, Mycobacterium tuberculosis H37Rv
cugguccaggcccuggccagcc

SEQ ID NO: 1308552 - RNA, 16 nt, Mycobacterium tuberculosis H37Rv
cuguaccgggcgacac

SEQ ID NO: 1308553 - RNA, 18 nt, Mycobacterium tuberculosis H37Rv
cugucaagcgggcuggcg

SEQ ID NO: 1308554 - RNA, 14 nt, Mycobacterium tuberculosis H37Rv
cuguagggcuucca

SEQ ID NO: 1308555 - RNA, 15 nt, Mycobacterium tuberculosis H37Rv
cuguagcgucgcacc

SEQ ID NO: 1308556 - RNA, 14 nt, Mycobacterium tuberculosis H37Rv
cuguggcucgacga

SEQ ID NO: 1308557 - RNA, 20 nt, Mycobacterium tuberculosis H37Rv
cugugcuauggccgcaccga

SEQ ID NO: 1308558 - RNA, 14 nt, Mycobacterium tuberculosis H37Rv
cugugcucacggcg

SEQ ID NO: 1308559 - RNA, 19 nt, Mycobacterium tuberculosis H37Rv
cugugcuucguugucggcg

SEQ ID NO: 1308560 - RNA, 14 nt, Mycobacterium tuberculosis H37Rv
cuguuguugccccg

SEQ ID NO: 1308561 - RNA, 14 nt, Mycobacterium tuberculosis H37Rv
cuguuacuccgacg

SEQ ID NO: 1308562 - RNA, 18 nt, Mycobacterium tuberculosis H37Rv
cugugucguacccggcaa

SEQ ID NO: 1308563 - RNA, 17 nt, Mycobacterium tuberculosis H37Rv
cugugucccgucgaugu

SEQ ID NO: 1308564 - RNA, 22 nt, Mycobacterium tuberculosis H37Rv
cuguguuugcggcuucggcaga

SEQ ID NO: 1308565 - RNA, 18 nt, Mycobacterium tuberculosis H37Rv
aaccggccgcgacgacac

SEQ ID NO: 1308566 - RNA, 14 nt, Mycobacterium tuberculosis H37Rv
aaccggccgcgacg

SEQ ID NO: 1308567 - RNA, 16 nt, Mycobacterium tuberculosis H37Rv
aaccggcgugcagcac

SEQ ID NO: 1308568 - RNA, 22 nt, Mycobacterium tuberculosis H37Rv
cuugucgccggcauacaccgug

SEQ ID NO: 1308569 - RNA, 15 nt, Mycobacterium tuberculosis H37Rv
cuugucgggcaccgg

SEQ ID NO: 1308570 - RNA, 18 nt, Mycobacterium tuberculosis H37Rv
cuuuagugucugcucgcg

SEQ ID NO: 1308571 - RNA, 21 nt, Mycobacterium tuberculosis H37Rv
aaccgguuggcgauccgcggc

SEQ ID NO: 1308572 - RNA, 14 nt, Mycobacterium tuberculosis H37Rv
aaccgucagcgcgc

SEQ ID NO: 1308573 - RNA, 17 nt, Mycobacterium tuberculosis H37Rv
cuugggcggugucgucg

SEQ ID NO: 1308574 - RNA, 14 nt, Mycobacterium tuberculosis H37Rv
cuugggcuugcgcc

SEQ ID NO: 1308575 - RNA, 22 nt, Mycobacterium tuberculosis H37Rv
cuuggucgccgccuucuuggcg

SEQ ID NO: 1308576 - RNA, 22 nt, Mycobacterium tuberculosis H37Rv
cuuggucgccgcuuucuuggcg

SEQ ID NO: 1308577 - RNA, 21 nt, Mycobacterium tuberculosis H37Rv
cuuggguggcgccguugucgg

SEQ ID NO: 1308578 - RNA, 23 nt, Mycobacterium tuberculosis H37Rv
cuuggguggcgccguugucggcg

SEQ ID NO: 1308579 - RNA, 19 nt, Mycobacterium tuberculosis H37Rv
cuuggucaccuucuuggcg

SEQ ID NO: 1308580 - RNA, 16 nt, Mycobacterium tuberculosis H37Rv
cuuggcugccuccauc

SEQ ID NO: 1308581 - RNA, 14 nt, Mycobacterium tuberculosis H37Rv
cuugggaccgcgcc

SEQ ID NO: 1308582 - RNA, 16 nt, Mycobacterium tuberculosis H37Rv
cuugggcgaucgucag

SEQ ID NO: 1308583 - RNA, 12 nt, Mycobacterium tuberculosis H37Rv
cuugggccggug

SEQ ID NO: 1308584 - RNA, 11 nt, Mycobacterium tuberculosis H37Rv
cuuggccagca

SEQ ID NO: 1308585 - RNA, 19 nt, Mycobacterium tuberculosis H37Rv
cuuggcguauccuugcgac

SEQ ID NO: 1308586 - RNA, 16 nt, Mycobacterium tuberculosis H37Rv
cuuggagaugucggug

SEQ ID NO: 1308587 - RNA, 17 nt, Mycobacterium tuberculosis H37Rv
cuugcgugcccguuggu

SEQ ID NO: 1308588 - RNA, 16 nt, Mycobacterium tuberculosis H37Rv
cuugcguggcguuggu

SEQ ID NO: 1308589 - RNA, 16 nt, Mycobacterium tuberculosis H37Rv
cuucgucgguguccuc

SEQ ID NO: 1308590 - RNA, 15 nt, Mycobacterium tuberculosis H37Rv
cuugcguagcucacg

SEQ ID NO: 1308591 - RNA, 17 nt, Mycobacterium tuberculosis H37Rv
cuucggugucgccgaac

SEQ ID NO: 1308592 - RNA, 14 nt, Mycobacterium tuberculosis H37Rv
cuuucugcggucaa

SEQ ID NO: 1308593 - RNA, 18 nt, Mycobacterium tuberculosis H37Rv
cuuucgcgucugcucgcg

SEQ ID NO: 1308594 - RNA, 18 nt, Mycobacterium tuberculosis H37Rv
cuuucggguccgacagcc

SEQ ID NO: 1308595 - RNA, 14 nt, Mycobacterium tuberculosis H37Rv
cuuuccagaguucc

SEQ ID NO: 1308596 - RNA, 14 nt, Mycobacterium tuberculosis H37Rv
cuuuccggcggugg

SEQ ID NO: 1308597 - RNA, 23 nt, Mycobacterium tuberculosis H37Rv
cuuugcguucccaucccucggug

SEQ ID NO: 1308598 - RNA, 23 nt, Mycobacterium tuberculosis H37Rv
cuuuggucgccggaccagagcca

SEQ ID NO: 1308599 - RNA, 18 nt, Mycobacterium tuberculosis H37Rv
cuuugguacccagcgcgg

SEQ ID NO: 1308600 - RNA, 17 nt, Mycobacterium tuberculosis H37Rv
cuuuggccgcgaccggc

SEQ ID NO: 1308601 - RNA, 14 nt, Mycobacterium tuberculosis H37Rv
cuuugcacagcggc

SEQ ID NO: 1308602 - RNA, 19 nt, Mycobacterium tuberculosis H37Rv
cuuugcccgccgcgucacc

SEQ ID NO: 1308603 - RNA, 22 nt, Mycobacterium tuberculosis H37Rv
cuuugcccccggugucugcaaa

SEQ ID NO: 1308604 - RNA, 17 nt, Mycobacterium tuberculosis H37Rv
cuuugacgcccucggcg

SEQ ID NO: 1308605 - RNA, 14 nt, Mycobacterium tuberculosis H37Rv
gaaaacauugcggc

SEQ ID NO: 1308606 - RNA, 14 nt, Mycobacterium tuberculosis H37Rv
gaaaaccgcaccgu

SEQ ID NO: 1308607 - RNA, 19 nt, Mycobacterium tuberculosis H37Rv
gaaaaccucggacugcagc

SEQ ID NO: 1308608 - RNA, 14 nt, Mycobacterium tuberculosis H37Rv
gaaaaagcccgaca

SEQ ID NO: 1308609 - RNA, 14 nt, Mycobacterium tuberculosis H37Rv
gaacgaucgaugac

SEQ ID NO: 1308610 - RNA, 22 nt, Mycobacterium tuberculosis H37Rv
gaacgcgaauaccagaccggcc

SEQ ID NO: 1308611 - RNA, 21 nt, Mycobacterium tuberculosis H37Rv
gaacgcgaaugucgcgcuguu

SEQ ID NO: 1308612 - RNA, 19 nt, Mycobacterium tuberculosis H37Rv
gaacggaauucagcgacgc

SEQ ID NO: 1308613 - RNA, 15 nt, Mycobacterium tuberculosis H37Rv
gaacggauaccuggg

SEQ ID NO: 1308614 - RNA, 15 nt, Mycobacterium tuberculosis H37Rv
gaacggauucccgcc

SEQ ID NO: 1308615 - RNA, 19 nt, Mycobacterium tuberculosis H37Rv
gaacgggcuuccgacauga

SEQ ID NO: 1308616 - RNA, 22 nt, Mycobacterium tuberculosis H37Rv
gaacgcuagcgccaaauccggc

SEQ ID NO: 1308617 - RNA, 17 nt, Mycobacterium tuberculosis H37Rv
gaacgcuccaggccuag

SEQ ID NO: 1308618 - RNA, 15 nt, Mycobacterium tuberculosis H37Rv
gaacgcucgucgaca

SEQ ID NO: 1308619 - RNA, 16 nt, Mycobacterium tuberculosis H37Rv
gaacgcuucaccucgu

SEQ ID NO: 1308620 - RNA, 23 nt, Mycobacterium tuberculosis H37Rv
gaacuccggguggcggcggcgga

SEQ ID NO: 1308621 - RNA, 20 nt, Mycobacterium tuberculosis H37Rv
gaacgugccuuccucgccgg

SEQ ID NO: 1308622 - RNA, 20 nt, Mycobacterium tuberculosis H37Rv
gaacgugaugcggucgcgga

SEQ ID NO: 1308623 - RNA, 19 nt, Mycobacterium tuberculosis H37Rv
gaacgguagcacugucgag

SEQ ID NO: 1308624 - RNA, 18 nt, Mycobacterium tuberculosis H37Rv
gaacgggucggcgaccac

SEQ ID NO: 1308625 - RNA, 14 nt, Mycobacterium tuberculosis H37Rv
gaacggugccgauc

SEQ ID NO: 1308626 - RNA, 12 nt, Mycobacterium tuberculosis H37Rv
gaacggugccga

SEQ ID NO: 1308627 - RNA, 14 nt, Mycobacterium tuberculosis H37Rv
gaacgucacugcga

SEQ ID NO: 1308628 - RNA, 14 nt, Mycobacterium tuberculosis H37Rv
gaacgucacguggu

SEQ ID NO: 1308629 - RNA, 15 nt, Mycobacterium tuberculosis H37Rv
gaacguccgcgccga

SEQ ID NO: 1308630 - RNA, 16 nt, Mycobacterium tuberculosis H37Rv
gaacguccgcgccgag

SEQ ID NO: 1308631 - RNA, 18 nt, Mycobacterium tuberculosis H37Rv
gaacguccgcgccgagcc

SEQ ID NO: 1308632 - RNA, 20 nt, Mycobacterium tuberculosis H37Rv
gaacgugaacucacggcggu

SEQ ID NO: 1308633 - RNA, 19 nt, Mycobacterium tuberculosis H37Rv
gaacgugaacucacggcgg

SEQ ID NO: 1308634 - RNA, 17 nt, Mycobacterium tuberculosis H37Rv
gaacagcgaaccgccgg

SEQ ID NO: 1308635 - RNA, 13 nt, Mycobacterium tuberculosis H37Rv
gaacagcgaaccg

SEQ ID NO: 1308636 - RNA, 20 nt, Mycobacterium tuberculosis H37Rv
gaacagcgaaccgccggcac

SEQ ID NO: 1308637 - RNA, 21 nt, Mycobacterium tuberculosis H37Rv
gaacacguuauucaugcccau

SEQ ID NO: 1308638 - RNA, 22 nt, Mycobacterium tuberculosis H37Rv
gaacacguugacucgucgcauc

SEQ ID NO: 1308639 - RNA, 14 nt, Mycobacterium tuberculosis H37Rv
gaaccagucgaccc

SEQ ID NO: 1308640 - RNA, 17 nt, Mycobacterium tuberculosis H37Rv
gaaccauugcccgacga

SEQ ID NO: 1308641 - RNA, 22 nt, Mycobacterium tuberculosis H37Rv
gaaccagaguucggccagcgug

SEQ ID NO: 1308642 - RNA, 22 nt, Mycobacterium tuberculosis H37Rv
gaaccagcggucggcgaccacc

SEQ ID NO: 1308643 - RNA, 14 nt, Mycobacterium tuberculosis H37Rv
gaacgacauccggc

SEQ ID NO: 1308644 - RNA, 23 nt, Mycobacterium tuberculosis H37Rv
gaacgacagcagaaucucggguc

SEQ ID NO: 1308645 - RNA, 17 nt, Mycobacterium tuberculosis H37Rv
gaaccgguagucgccgu

SEQ ID NO: 1308646 - RNA, 17 nt, Mycobacterium tuberculosis H37Rv
gaaccggucgaucccca

SEQ ID NO: 1308647 - RNA, 22 nt, Mycobacterium tuberculosis H37Rv
gaaccggcgcauucccuugucg

SEQ ID NO: 1308648 - RNA, 22 nt, Mycobacterium tuberculosis H37Rv
gaaccgggcaaaucaagcacag

SEQ ID NO: 1308649 - RNA, 16 nt, Mycobacterium tuberculosis H37Rv
gaaccggccgcgacga

SEQ ID NO: 1308650 - RNA, 14 nt, Mycobacterium tuberculosis H37Rv
gaaccggccgcgac

SEQ ID NO: 1308651 - RNA, 14 nt, Mycobacterium tuberculosis H37Rv
gaaccggccgucga

SEQ ID NO: 1308652 - RNA, 16 nt, Mycobacterium tuberculosis H37Rv
gaaccgcagucaacgc

SEQ ID NO: 1308653 - RNA, 18 nt, Mycobacterium tuberculosis H37Rv
gaaccggaucaucgccgc

SEQ ID NO: 1308654 - RNA, 14 nt, Mycobacterium tuberculosis H37Rv
gaaccggcaccagc

SEQ ID NO: 1308655 - RNA, 19 nt, Mycobacterium tuberculosis H37Rv
gaaccggccgacgaacagc

SEQ ID NO: 1308656 - RNA, 14 nt, Mycobacterium tuberculosis H37Rv
gaaccggccgacga

SEQ ID NO: 1308657 - RNA, 20 nt, Mycobacterium tuberculosis H37Rv
gaaccggccaucgaccgucc

SEQ ID NO: 1308658 - RNA, 19 nt, Mycobacterium tuberculosis H37Rv
gaaccgcagacccucgucg

SEQ ID NO: 1308659 - RNA, 19 nt, Mycobacterium tuberculosis H37Rv
gaaccgauaccucgccauc

SEQ ID NO: 1308660 - RNA, 21 nt, Mycobacterium tuberculosis H37Rv
gaaccgaucaucauauccgcc

SEQ ID NO: 1308661 - RNA, 13 nt, Mycobacterium tuberculosis H37Rv
gaaccgacggcca

SEQ ID NO: 1308662 - RNA, 18 nt, Mycobacterium tuberculosis H37Rv
gaacccgcgagcaucgac

SEQ ID NO: 1308663 - RNA, 18 nt, Mycobacterium tuberculosis H37Rv
gaacccccagcugcaggg

SEQ ID NO: 1308664 - RNA, 21 nt, Mycobacterium tuberculosis H37Rv
gaacccccagcugcagggcgu

SEQ ID NO: 1308665 - RNA, 23 nt, Mycobacterium tuberculosis H37Rv
gaaccccagcuuggcgucgaugc

SEQ ID NO: 1308666 - RNA, 17 nt, Mycobacterium tuberculosis H37Rv
gaaccccgaccgcuggu

SEQ ID NO: 1308667 - RNA, 14 nt, Mycobacterium tuberculosis H37Rv
aaccugcgcaucac

SEQ ID NO: 1308668 - RNA, 13 nt, Mycobacterium tuberculosis H37Rv
aaccucgaccguc

SEQ ID NO: 1308669 - RNA, 21 nt, Mycobacterium tuberculosis H37Rv
gaaaagccacggcugcccaug

SEQ ID NO: 1308670 - RNA, 14 nt, Mycobacterium tuberculosis H37Rv
gaaaagaacccggg

SEQ ID NO: 1308671 - RNA, 18 nt, Mycobacterium tuberculosis H37Rv
gaaaagaacccgggaucg

SEQ ID NO: 1308672 - RNA, 18 nt, Mycobacterium tuberculosis H37Rv
gaaaagcccggaaucgcg

SEQ ID NO: 1308673 - RNA, 20 nt, Mycobacterium tuberculosis H37Rv
aacgaaaauuugacgacggc

SEQ ID NO: 1308674 - RNA, 19 nt, Mycobacterium tuberculosis H37Rv
gaaaaugccgcucucggcg

SEQ ID NO: 1308675 - RNA, 14 nt, Mycobacterium tuberculosis H37Rv
gaaacagcgaucgc

SEQ ID NO: 1308676 - RNA, 15 nt, Mycobacterium tuberculosis H37Rv
gaaacagcacgcccg

SEQ ID NO: 1308677 - RNA, 20 nt, Mycobacterium tuberculosis H37Rv
gaaacagugguuagucggcc

SEQ ID NO: 1308678 - RNA, 15 nt, Mycobacterium tuberculosis H37Rv
gaaaccauucggcga

SEQ ID NO: 1308679 - RNA, 20 nt, Mycobacterium tuberculosis H37Rv
gaaaccacugcacccgaucg

SEQ ID NO: 1308680 - RNA, 18 nt, Mycobacterium tuberculosis H37Rv
gaacacgcacacgaucgc

SEQ ID NO: 1308681 - RNA, 18 nt, Mycobacterium tuberculosis H37Rv
gaacacgaauccggccac

SEQ ID NO: 1308682 - RNA, 17 nt, Mycobacterium tuberculosis H37Rv
gaacacgucgacaccga

SEQ ID NO: 1308683 - RNA, 13 nt, Mycobacterium tuberculosis H37Rv
gaacacgucggcc

SEQ ID NO: 1308684 - RNA, 21 nt, Mycobacterium tuberculosis H37Rv
gaacaacgggauccgcgcgcu

SEQ ID NO: 1308685 - RNA, 16 nt, Mycobacterium tuberculosis H37Rv
gaaaugguucgcacac

SEQ ID NO: 1308686 - RNA, 13 nt, Mycobacterium tuberculosis H37Rv
gaaauugagccgg

SEQ ID NO: 1308687 - RNA, 18 nt, Mycobacterium tuberculosis H37Rv
gaaacuacucccccgcga

SEQ ID NO: 1308688 - RNA, 22 nt, Mycobacterium tuberculosis H37Rv
gaaacgucugccacgucggcga

SEQ ID NO: 1308689 - RNA, 15 nt, Mycobacterium tuberculosis H37Rv
gaaacccgccgcgau

SEQ ID NO: 1308690 - RNA, 17 nt, Mycobacterium tuberculosis H37Rv
gaaacccgccgcgauga

SEQ ID NO: 1308691 - RNA, 21 nt, Mycobacterium tuberculosis H37Rv
gaaacccgaaguagaacgggu

SEQ ID NO: 1308692 - RNA, 18 nt, Mycobacterium tuberculosis H37Rv
gaaaccgaguugucgcgc

SEQ ID NO: 1308693 - RNA, 20 nt, Mycobacterium tuberculosis H37Rv
gaaaccgaguugucgcgcua

SEQ ID NO: 1308694 - RNA, 15 nt, Mycobacterium tuberculosis H37Rv
gaaacgcgcggaucg

SEQ ID NO: 1308695 - RNA, 17 nt, Mycobacterium tuberculosis H37Rv
gaaacggugucucgccc

SEQ ID NO: 1308696 - RNA, 18 nt, Mycobacterium tuberculosis H37Rv
gaaacggugucucgccca

SEQ ID NO: 1308697 - RNA, 19 nt, Mycobacterium tuberculosis H37Rv
gaaacggugucucgcccac

SEQ ID NO: 1308698 - RNA, 17 nt, Mycobacterium tuberculosis H37Rv
gaaacggauuggucgac

SEQ ID NO: 1308699 - RNA, 17 nt, Mycobacterium tuberculosis H37Rv
gaaacggcaccggaucc

SEQ ID NO: 1308700 - RNA, 19 nt, Mycobacterium tuberculosis H37Rv
gaaacggaccuccucgccc

SEQ ID NO: 1308701 - RNA, 16 nt, Mycobacterium tuberculosis H37Rv
gacgccggccagucgu

SEQ ID NO: 1308702 - RNA, 23 nt, Mycobacterium tuberculosis H37Rv
gacgccgcuggagaucacgccga

SEQ ID NO: 1308703 - RNA, 22 nt, Mycobacterium tuberculosis H37Rv
gacgccgguggcagagccgccg

SEQ ID NO: 1308704 - RNA, 16 nt, Mycobacterium tuberculosis H37Rv
gacgccgucgacgucg

SEQ ID NO: 1308705 - RNA, 23 nt, Mycobacterium tuberculosis H37Rv
gacgccggggaaccuugaccgac

SEQ ID NO: 1308706 - RNA, 12 nt, Mycobacterium tuberculosis H37Rv
gacgccucgaca

SEQ ID NO: 1308707 - RNA, 15 nt, Mycobacterium tuberculosis H37Rv
gacgccgugugcauc

SEQ ID NO: 1308708 - RNA, 13 nt, Mycobacterium tuberculosis H37Rv
gacgccgucggac

SEQ ID NO: 1308709 - RNA, 23 nt, Mycobacterium tuberculosis H37Rv
gacgccgucgacgucgauggugc

SEQ ID NO: 1308710 - RNA, 13 nt, Mycobacterium tuberculosis H37Rv
gacgccguccucg

SEQ ID NO: 1308711 - RNA, 15 nt, Mycobacterium tuberculosis H37Rv
gacgcgaaauccccc

SEQ ID NO: 1308712 - RNA, 16 nt, Mycobacterium tuberculosis H37Rv
gacgccuugcacaagc

SEQ ID NO: 1308713 - RNA, 21 nt, Mycobacterium tuberculosis H37Rv
gacgccuugucggcgugucgc

SEQ ID NO: 1308714 - RNA, 21 nt, Mycobacterium tuberculosis H37Rv
gacgccuugaucggcgagguc

SEQ ID NO: 1308715 - RNA, 15 nt, Mycobacterium tuberculosis H37Rv
gacgccgcucccgca

SEQ ID NO: 1308716 - RNA, 21 nt, Mycobacterium tuberculosis H37Rv
gacgccgccgcugccgcccuu

SEQ ID NO: 1308717 - RNA, 17 nt, Mycobacterium tuberculosis H37Rv
gacgccgaacgcgaggu

SEQ ID NO: 1308718 - RNA, 17 nt, Mycobacterium tuberculosis H37Rv
gacgcccggcgcaccau

SEQ ID NO: 1308719 - RNA, 19 nt, Mycobacterium tuberculosis H37Rv
gacgcccgacgaugugcac

SEQ ID NO: 1308720 - RNA, 22 nt, Mycobacterium tuberculosis H37Rv
gacgaugcccuccucgaccgcg

SEQ ID NO: 1308721 - RNA, 20 nt, Mycobacterium tuberculosis H37Rv
gacgaugcggucaacgcuga

SEQ ID NO: 1308722 - RNA, 17 nt, Mycobacterium tuberculosis H37Rv
gacgaugccucggcggc

SEQ ID NO: 1308723 - RNA, 21 nt, Mycobacterium tuberculosis H37Rv
gacgaugccucggcggccucg

SEQ ID NO: 1308724 - RNA, 14 nt, Mycobacterium tuberculosis H37Rv
gacgauucggcggc

SEQ ID NO: 1308725 - RNA, 17 nt, Mycobacterium tuberculosis H37Rv
gacgauuccgcccacau

SEQ ID NO: 1308726 - RNA, 23 nt, Mycobacterium tuberculosis H37Rv
gacgaugucggucggaucggcgc

SEQ ID NO: 1308727 - RNA, 17 nt, Mycobacterium tuberculosis H37Rv
gacgaugugccaggugc

SEQ ID NO: 1308728 - RNA, 21 nt, Mycobacterium tuberculosis H37Rv
gacgcagaaucgcacgcgaaa

SEQ ID NO: 1308729 - RNA, 20 nt, Mycobacterium tuberculosis H37Rv
gacgccagcugcccgacguu

SEQ ID NO: 1308730 - RNA, 17 nt, Mycobacterium tuberculosis H37Rv
gacgccacgaccgccga

SEQ ID NO: 1308731 - RNA, 15 nt, Mycobacterium tuberculosis H37Rv
gacgccaugcccgca

SEQ ID NO: 1308732 - RNA, 16 nt, Mycobacterium tuberculosis H37Rv
gacgccaaaucggcca

SEQ ID NO: 1308733 - RNA, 21 nt, Mycobacterium tuberculosis H37Rv
gacgcaugucgggccaggcga

SEQ ID NO: 1308734 - RNA, 19 nt, Mycobacterium tuberculosis H37Rv
gacgcaugcgugacccgac

SEQ ID NO: 1308735 - RNA, 19 nt, Mycobacterium tuberculosis H37Rv
gacgcaggugaacgccggu

SEQ ID NO: 1308736 - RNA, 17 nt, Mycobacterium tuberculosis H37Rv
gacgcagaccguccagc

SEQ ID NO: 1308737 - RNA, 16 nt, Mycobacterium tuberculosis H37Rv
gacgcagaaucgccca

SEQ ID NO: 1308738 - RNA, 17 nt, Mycobacterium tuberculosis H37Rv
gacgaugacgcgcgaaa

SEQ ID NO: 1308739 - RNA, 20 nt, Mycobacterium tuberculosis H37Rv
aacgucacgucgacggcggc

SEQ ID NO: 1308740 - RNA, 23 nt, Mycobacterium tuberculosis H37Rv
aacgucaccgccgggaugccggc

SEQ ID NO: 1308741 - RNA, 14 nt, Mycobacterium tuberculosis H37Rv
aacgguugcucguc

SEQ ID NO: 1308742 - RNA, 12 nt, Mycobacterium tuberculosis H37Rv
gacgaucgccag

SEQ ID NO: 1308743 - RNA, 23 nt, Mycobacterium tuberculosis H37Rv
gacgaucuccacccgccggccgu

SEQ ID NO: 1308744 - RNA, 19 nt, Mycobacterium tuberculosis H37Rv
gacgaucucgccggcgaag

SEQ ID NO: 1308745 - RNA, 21 nt, Mycobacterium tuberculosis H37Rv
gacgauccagggucaccucgu

SEQ ID NO: 1308746 - RNA, 18 nt, Mycobacterium tuberculosis H37Rv
gacgaucgagcugacgau

SEQ ID NO: 1308747 - RNA, 20 nt, Mycobacterium tuberculosis H37Rv
gacgaguuccucgugggucc

SEQ ID NO: 1308748 - RNA, 20 nt, Mycobacterium tuberculosis H37Rv
gacgagcgucagauccggcc

SEQ ID NO: 1308749 - RNA, 19 nt, Mycobacterium tuberculosis H37Rv
gacgagcgucagauccggc

SEQ ID NO: 1308750 - RNA, 17 nt, Mycobacterium tuberculosis H37Rv
gacgagccgagccucgc

SEQ ID NO: 1308751 - RNA, 14 nt, Mycobacterium tuberculosis H37Rv
gacgagcacgccga

SEQ ID NO: 1308752 - RNA, 16 nt, Mycobacterium tuberculosis H37Rv
gacgagcacgccgacc

SEQ ID NO: 1308753 - RNA, 21 nt, Mycobacterium tuberculosis H37Rv
gacgagcagcuagcccggcag

SEQ ID NO: 1308754 - RNA, 17 nt, Mycobacterium tuberculosis H37Rv
gacgagcccaccgucgc

SEQ ID NO: 1308755 - RNA, 16 nt, Mycobacterium tuberculosis H37Rv
gacgagccgagccucg

SEQ ID NO: 1308756 - RNA, 13 nt, Mycobacterium tuberculosis H37Rv
gacgaaugcagca

SEQ ID NO: 1308757 - RNA, 15 nt, Mycobacterium tuberculosis H37Rv
gacgacgggcgccaa

SEQ ID NO: 1308758 - RNA, 15 nt, Mycobacterium tuberculosis H37Rv
gacgagacggcagga

SEQ ID NO: 1308759 - RNA, 20 nt, Mycobacterium tuberculosis H37Rv
gacgacuggaaggcgggcag

SEQ ID NO: 1308760 - RNA, 20 nt, Mycobacterium tuberculosis H37Rv
gacgagcacaugcucgacgc

SEQ ID NO: 1308761 - RNA, 19 nt, Mycobacterium tuberculosis H37Rv
gacgacguccucgacgauc

SEQ ID NO: 1308762 - RNA, 19 nt, Mycobacterium tuberculosis H37Rv
gacgacguagauggugguc

SEQ ID NO: 1308763 - RNA, 20 nt, Mycobacterium tuberculosis H37Rv
gacgacggguuggcgucgcu

SEQ ID NO: 1308764 - RNA, 16 nt, Mycobacterium tuberculosis H37Rv
gaccuguccggugauc

SEQ ID NO: 1308765 - RNA, 13 nt, Mycobacterium tuberculosis H37Rv
gaccuguccggua

SEQ ID NO: 1308766 - RNA, 16 nt, Mycobacterium tuberculosis H37Rv
gaccugguaugccgcc

SEQ ID NO: 1308767 - RNA, 21 nt, Mycobacterium tuberculosis H37Rv
gaccugguaugccgcccgcag

SEQ ID NO: 1308768 - RNA, 16 nt, Mycobacterium tuberculosis H37Rv
gaccugcgcgagguug

SEQ ID NO: 1308769 - RNA, 23 nt, Mycobacterium tuberculosis H37Rv
gaccugauggcgcugcaccguag

SEQ ID NO: 1308770 - RNA, 13 nt, Mycobacterium tuberculosis H37Rv
aacggcagcacgg

SEQ ID NO: 1308771 - RNA, 23 nt, Mycobacterium tuberculosis H37Rv
gaccuucgcuauggcggcuucga

SEQ ID NO: 1308772 - RNA, 16 nt, Mycobacterium tuberculosis H37Rv
gacgacaaacggcgac

SEQ ID NO: 1308773 - RNA, 20 nt, Mycobacterium tuberculosis H37Rv
gacgaaggucuccggcaagc

SEQ ID NO: 1308774 - RNA, 14 nt, Mycobacterium tuberculosis H37Rv
gacgcuaccgccgg

SEQ ID NO: 1308775 - RNA, 18 nt, Mycobacterium tuberculosis H37Rv
gacgcuaacgucgaucuc

SEQ ID NO: 1308776 - RNA, 20 nt, Mycobacterium tuberculosis H37Rv
gacgcguucaacaccgccga

SEQ ID NO: 1308777 - RNA, 16 nt, Mycobacterium tuberculosis H37Rv
gacgcgucggcgacgc

SEQ ID NO: 1308778 - RNA, 17 nt, Mycobacterium tuberculosis H37Rv
gacgcguagcacggcga

SEQ ID NO: 1308779 - RNA, 18 nt, Mycobacterium tuberculosis H37Rv
gacgcgucagcggcgagc

SEQ ID NO: 1308780 - RNA, 20 nt, Mycobacterium tuberculosis H37Rv
gacgcgguccucgagccgau

SEQ ID NO: 1308781 - RNA, 14 nt, Mycobacterium tuberculosis H37Rv
gacgcggucgacga

SEQ ID NO: 1308782 - RNA, 16 nt, Mycobacterium tuberculosis H37Rv
gacgcgggccgcgaaa

SEQ ID NO: 1308783 - RNA, 19 nt, Mycobacterium tuberculosis H37Rv
gacgcgggcuaucgguuca

SEQ ID NO: 1308784 - RNA, 17 nt, Mycobacterium tuberculosis H37Rv
gacgcgguccucgagcc

SEQ ID NO: 1308785 - RNA, 20 nt, Mycobacterium tuberculosis H37Rv
gacgcgaugaucaugaacgc

SEQ ID NO: 1308786 - RNA, 14 nt, Mycobacterium tuberculosis H37Rv
gacgcgauggccgc

SEQ ID NO: 1308787 - RNA, 16 nt, Mycobacterium tuberculosis H37Rv
gacgcgaucggcguca

SEQ ID NO: 1308788 - RNA, 16 nt, Mycobacterium tuberculosis H37Rv
gacgcggcgaccgucg

SEQ ID NO: 1308789 - RNA, 13 nt, Mycobacterium tuberculosis H37Rv
gacgcgcucgcgc

SEQ ID NO: 1308790 - RNA, 12 nt, Mycobacterium tuberculosis H37Rv
gacgcgcugcac

SEQ ID NO: 1308791 - RNA, 15 nt, Mycobacterium tuberculosis H37Rv
gacgcgcggccagcc

SEQ ID NO: 1308792 - RNA, 24 nt, Mycobacterium tuberculosis H37Rv
gacgcgcgagaacacccgugccuu

SEQ ID NO: 1308793 - RNA, 12 nt, Mycobacterium tuberculosis H37Rv
gacgcugccgca

SEQ ID NO: 1308794 - RNA, 14 nt, Mycobacterium tuberculosis H37Rv
gacgcucggucgcc

SEQ ID NO: 1308795 - RNA, 20 nt, Mycobacterium tuberculosis H37Rv
gacgcugacacccacggcgc

SEQ ID NO: 1308796 - RNA, 18 nt, Mycobacterium tuberculosis H37Rv
gacggagguguggucgag

SEQ ID NO: 1308797 - RNA, 16 nt, Mycobacterium tuberculosis H37Rv
gacgcuuucccgauga

SEQ ID NO: 1308798 - RNA, 18 nt, Mycobacterium tuberculosis H37Rv
gacgcuguggcucgacga

SEQ ID NO: 1308799 - RNA, 16 nt, Mycobacterium tuberculosis H37Rv
gacgcuguggcucgac

SEQ ID NO: 1308800 - RNA, 13 nt, Mycobacterium tuberculosis H37Rv
gacgcuggucggc

SEQ ID NO: 1308801 - RNA, 14 nt, Mycobacterium tuberculosis H37Rv
gacggcccgccguc

SEQ ID NO: 1308802 - RNA, 18 nt, Mycobacterium tuberculosis H37Rv
gacggcauuucagcgcgc

SEQ ID NO: 1308803 - RNA, 18 nt, Mycobacterium tuberculosis H37Rv
gacggccaccccgucggg

SEQ ID NO: 1308804 - RNA, 15 nt, Mycobacterium tuberculosis H37Rv
gacggccaccggggu

SEQ ID NO: 1308805 - RNA, 20 nt, Mycobacterium tuberculosis H37Rv
gacggcauguaccgaccgcg

SEQ ID NO: 1308806 - RNA, 18 nt, Mycobacterium tuberculosis H37Rv
gacggccaucgccagccu

SEQ ID NO: 1308807 - RNA, 16 nt, Mycobacterium tuberculosis H37Rv
gacggcacgaucaucg

SEQ ID NO: 1308808 - RNA, 21 nt, Mycobacterium tuberculosis H37Rv
gacggcacccgacucgucggc

SEQ ID NO: 1308809 - RNA, 22 nt, Mycobacterium tuberculosis H37Rv
gacggcauagcagccagcgucc

SEQ ID NO: 1308810 - RNA, 19 nt, Mycobacterium tuberculosis H37Rv
gacggcaaaccaguuggcg

SEQ ID NO: 1308811 - RNA, 16 nt, Mycobacterium tuberculosis H37Rv
gacggcacccgacucg

SEQ ID NO: 1308812 - RNA, 14 nt, Mycobacterium tuberculosis H37Rv
gacgggagcgacgu

SEQ ID NO: 1308813 - RNA, 15 nt, Mycobacterium tuberculosis H37Rv
gacgggccacgaugc

SEQ ID NO: 1308814 - RNA, 17 nt, Mycobacterium tuberculosis H37Rv
gacgggccgucgccguc

SEQ ID NO: 1308815 - RNA, 13 nt, Mycobacterium tuberculosis H37Rv
gacgguacgccag

SEQ ID NO: 1308816 - RNA, 16 nt, Mycobacterium tuberculosis H37Rv
gacgggggcuguccac

SEQ ID NO: 1308817 - RNA, 23 nt, Mycobacterium tuberculosis H37Rv
gacggguccgggccaaugccguu

SEQ ID NO: 1308818 - RNA, 17 nt, Mycobacterium tuberculosis H37Rv
gacgggguacugcggcu

SEQ ID NO: 1308819 - RNA, 16 nt, Mycobacterium tuberculosis H37Rv
gacggggcugaccgcc

SEQ ID NO: 1308820 - RNA, 21 nt, Mycobacterium tuberculosis H37Rv
gacggugagggcgucgucgag

SEQ ID NO: 1308821 - RNA, 17 nt, Mycobacterium tuberculosis H37Rv
gacggugccgguuuucg

SEQ ID NO: 1308822 - RNA, 17 nt, Mycobacterium tuberculosis H37Rv
gacggucuggcccgcga

SEQ ID NO: 1308823 - RNA, 15 nt, Mycobacterium tuberculosis H37Rv
gacgguccacgacgu

SEQ ID NO: 1308824 - RNA, 21 nt, Mycobacterium tuberculosis H37Rv
gacgguccacgacgucgagcg

SEQ ID NO: 1308825 - RNA, 13 nt, Mycobacterium tuberculosis H37Rv
gacgguccggucg

SEQ ID NO: 1308826 - RNA, 13 nt, Mycobacterium tuberculosis H37Rv
gacggucgccgug

SEQ ID NO: 1308827 - RNA, 17 nt, Mycobacterium tuberculosis H37Rv
gacggucgcucggcaug

SEQ ID NO: 1308828 - RNA, 18 nt, Mycobacterium tuberculosis H37Rv
gacgguugccccggcgac

SEQ ID NO: 1308829 - RNA, 14 nt, Mycobacterium tuberculosis H37Rv
gacgguuccggcuu

SEQ ID NO: 1308830 - RNA, 16 nt, Mycobacterium tuberculosis H37Rv
gacgguuccggucggg

SEQ ID NO: 1308831 - RNA, 19 nt, Mycobacterium tuberculosis H37Rv
gacggugucaugaacgacc

SEQ ID NO: 1308832 - RNA, 21 nt, Mycobacterium tuberculosis H37Rv
gacgguguugccuagguucgc

SEQ ID NO: 1308833 - RNA, 18 nt, Mycobacterium tuberculosis H37Rv
gacgguggggucgccguc

SEQ ID NO: 1308834 - RNA, 16 nt, Mycobacterium tuberculosis H37Rv
gacgguggcgcugauc

SEQ ID NO: 1308835 - RNA, 21 nt, Mycobacterium tuberculosis H37Rv
gacggcgacgaugucgacucg

SEQ ID NO: 1308836 - RNA, 13 nt, Mycobacterium tuberculosis H37Rv
aacgucgagaucc

SEQ ID NO: 1308837 - RNA, 18 nt, Mycobacterium tuberculosis H37Rv
gacggcgaacccgccgau

SEQ ID NO: 1308838 - RNA, 17 nt, Mycobacterium tuberculosis H37Rv
gacggcgaacccgccga

SEQ ID NO: 1308839 - RNA, 15 nt, Mycobacterium tuberculosis H37Rv
gacggcgaacccgcc

SEQ ID NO: 1308840 - RNA, 23 nt, Mycobacterium tuberculosis H37Rv
gacggcgaaaucgacagcagcgc

SEQ ID NO: 1308841 - RNA, 19 nt, Mycobacterium tuberculosis H37Rv
gacggccuuggcgacgucg

SEQ ID NO: 1308842 - RNA, 15 nt, Mycobacterium tuberculosis H37Rv
gacggccuuggcgac

SEQ ID NO: 1308843 - RNA, 16 nt, Mycobacterium tuberculosis H37Rv
gacggccucgucgaug

SEQ ID NO: 1308844 - RNA, 22 nt, Mycobacterium tuberculosis H37Rv
gacggccguggaaagccggcgu

SEQ ID NO: 1308845 - RNA, 20 nt, Mycobacterium tuberculosis H37Rv
aacgugcgcaacgcgucguc

SEQ ID NO: 1308846 - RNA, 15 nt, Mycobacterium tuberculosis H37Rv
gacggcgauggcgcg

SEQ ID NO: 1308847 - RNA, 12 nt, Mycobacterium tuberculosis H37Rv
aacgucugccac

SEQ ID NO: 1308848 - RNA, 15 nt, Mycobacterium tuberculosis H37Rv
gacggcgcccauagc

SEQ ID NO: 1308849 - RNA, 13 nt, Mycobacterium tuberculosis H37Rv
gacggcgccgcuc

SEQ ID NO: 1308850 - RNA, 12 nt, Mycobacterium tuberculosis H37Rv
gacggcgccguc

SEQ ID NO: 1308851 - RNA, 15 nt, Mycobacterium tuberculosis H37Rv
gacggcgcucggcga

SEQ ID NO: 1308852 - RNA, 16 nt, Mycobacterium tuberculosis H37Rv
gacggcgucgaccucg

SEQ ID NO: 1308853 - RNA, 23 nt, Mycobacterium tuberculosis H37Rv
gacggcuccuccgguaucggcga

SEQ ID NO: 1308854 - RNA, 17 nt, Mycobacterium tuberculosis H37Rv
gacggcucuaccggucc

SEQ ID NO: 1308855 - RNA, 14 nt, Mycobacterium tuberculosis H37Rv
gacggcuaccaccg

SEQ ID NO: 1308856 - RNA, 15 nt, Mycobacterium tuberculosis H37Rv
gacggcguugucgac

SEQ ID NO: 1308857 - RNA, 18 nt, Mycobacterium tuberculosis H37Rv
gacggcugccgucagccg

SEQ ID NO: 1308858 - RNA, 17 nt, Mycobacterium tuberculosis H37Rv
gacggcugccgucagcc

SEQ ID NO: 1308859 - RNA, 12 nt, Mycobacterium tuberculosis H37Rv
gacggcgucggg

SEQ ID NO: 1308860 - RNA, 22 nt, Mycobacterium tuberculosis H37Rv
gacggcgggcgaucuuggcgac

SEQ ID NO: 1308861 - RNA, 18 nt, Mycobacterium tuberculosis H37Rv
gacggcggccaggaccaa

SEQ ID NO: 1308862 - RNA, 21 nt, Mycobacterium tuberculosis H37Rv
gacggcggccacguggucggc

SEQ ID NO: 1308863 - RNA, 14 nt, Mycobacterium tuberculosis H37Rv
gacggcggcaucgg

SEQ ID NO: 1308864 - RNA, 15 nt, Mycobacterium tuberculosis H37Rv
gacggcggccaaggu

SEQ ID NO: 1308865 - RNA, 16 nt, Mycobacterium tuberculosis H37Rv
gacggcgcucggcgag

SEQ ID NO: 1308866 - RNA, 19 nt, Mycobacterium tuberculosis H37Rv
gacggcggauaaccggcau

SEQ ID NO: 1308867 - RNA, 22 nt, Mycobacterium tuberculosis H37Rv
gaccgcgggucgugccagcagc

SEQ ID NO: 1308868 - RNA, 21 nt, Mycobacterium tuberculosis H37Rv
gaccgcgggcuccccgcacau

SEQ ID NO: 1308869 - RNA, 17 nt, Mycobacterium tuberculosis H37Rv
gaccgcggcgcguccgg

SEQ ID NO: 1308870 - RNA, 15 nt, Mycobacterium tuberculosis H37Rv
gaccgcggcggcauc

SEQ ID NO: 1308871 - RNA, 16 nt, Mycobacterium tuberculosis H37Rv
gaccgcgucggcguuc

SEQ ID NO: 1308872 - RNA, 18 nt, Mycobacterium tuberculosis H37Rv
gaccgcuaugaugccgcc

SEQ ID NO: 1308873 - RNA, 21 nt, Mycobacterium tuberculosis H37Rv
gaccgcuacccgcgcgaccug

SEQ ID NO: 1308874 - RNA, 21 nt, Mycobacterium tuberculosis H37Rv
gaccgcguuccgggccggcga

SEQ ID NO: 1308875 - RNA, 23 nt, Mycobacterium tuberculosis H37Rv
gaccgcguuccgggccggcgagc

SEQ ID NO: 1308876 - RNA, 20 nt, Mycobacterium tuberculosis H37Rv
gaccgcguuguccgcggcca

SEQ ID NO: 1308877 - RNA, 20 nt, Mycobacterium tuberculosis H37Rv
gaccgcgccgaucaccaccg

SEQ ID NO: 1308878 - RNA, 20 nt, Mycobacterium tuberculosis H37Rv
gaccgcgaugaucgcaucga

SEQ ID NO: 1308879 - RNA, 13 nt, Mycobacterium tuberculosis H37Rv
gaccgcgccgauc

SEQ ID NO: 1308880 - RNA, 17 nt, Mycobacterium tuberculosis H37Rv
gaccgcgaugucacgga

SEQ ID NO: 1308881 - RNA, 19 nt, Mycobacterium tuberculosis H37Rv
gaccgcgcacggcuggcgu

SEQ ID NO: 1308882 - RNA, 13 nt, Mycobacterium tuberculosis H37Rv
gaccgcgacggca

SEQ ID NO: 1308883 - RNA, 20 nt, Mycobacterium tuberculosis H37Rv
gaccgcgagcaucugggguc

SEQ ID NO: 1308884 - RNA, 17 nt, Mycobacterium tuberculosis H37Rv
gaccgcgauccccacga

SEQ ID NO: 1308885 - RNA, 12 nt, Mycobacterium tuberculosis H37Rv
gaccgcgagggc

SEQ ID NO: 1308886 - RNA, 18 nt, Mycobacterium tuberculosis H37Rv
gaccgcgaugggauaccg

SEQ ID NO: 1308887 - RNA, 15 nt, Mycobacterium tuberculosis H37Rv
gaccgccgacgccgu

SEQ ID NO: 1308888 - RNA, 23 nt, Mycobacterium tuberculosis H37Rv
gaccgccgauacuucaucggcac

SEQ ID NO: 1308889 - RNA, 20 nt, Mycobacterium tuberculosis H37Rv
gaccgaucggcgcgucgauc

SEQ ID NO: 1308890 - RNA, 13 nt, Mycobacterium tuberculosis H37Rv
gaccgaucggcgc

SEQ ID NO: 1308891 - RNA, 18 nt, Mycobacterium tuberculosis H37Rv
gaccgaugacgaucggcg

SEQ ID NO: 1308892 - RNA, 16 nt, Mycobacterium tuberculosis H37Rv
gaccgaucuuggccac

SEQ ID NO: 1308893 - RNA, 13 nt, Mycobacterium tuberculosis H37Rv
gaccgcgacccgg

SEQ ID NO: 1308894 - RNA, 12 nt, Mycobacterium tuberculosis H37Rv
gaccgcgaccgc

SEQ ID NO: 1308895 - RNA, 12 nt, Mycobacterium tuberculosis H37Rv
gaccgccgcgag

SEQ ID NO: 1308896 - RNA, 16 nt, Mycobacterium tuberculosis H37Rv
gaccgccgacgccguu

SEQ ID NO: 1308897 - RNA, 22 nt, Mycobacterium tuberculosis H37Rv
gaccgacaggugcucgucaucc

SEQ ID NO: 1308898 - RNA, 17 nt, Mycobacterium tuberculosis H37Rv
aacggcaccucgacguc

SEQ ID NO: 1308899 - RNA, 15 nt, Mycobacterium tuberculosis H37Rv
aacggaugguucugg

SEQ ID NO: 1308900 - RNA, 22 nt, Mycobacterium tuberculosis H37Rv
gacccugaucgugaacacgucg

SEQ ID NO: 1308901 - RNA, 18 nt, Mycobacterium tuberculosis H37Rv
gacccuccagcacgccgu

SEQ ID NO: 1308902 - RNA, 23 nt, Mycobacterium tuberculosis H37Rv
gacccguuccacgccggcaucgu

SEQ ID NO: 1308903 - RNA, 18 nt, Mycobacterium tuberculosis H37Rv
aacgcuccaggccuaguc

SEQ ID NO: 1308904 - RNA, 20 nt, Mycobacterium tuberculosis H37Rv
aacgcguugaccaucacgcc

SEQ ID NO: 1308905 - RNA, 16 nt, Mycobacterium tuberculosis H37Rv
aacgcguugcacagca

SEQ ID NO: 1308906 - RNA, 16 nt, Mycobacterium tuberculosis H37Rv
gacccggcggugccgu

SEQ ID NO: 1308907 - RNA, 16 nt, Mycobacterium tuberculosis H37Rv
gacccgggcggcguug

SEQ ID NO: 1308908 - RNA, 18 nt, Mycobacterium tuberculosis H37Rv
gacccgggucggcacgac

SEQ ID NO: 1308909 - RNA, 15 nt, Mycobacterium tuberculosis H37Rv
gacccgggucggcac

SEQ ID NO: 1308910 - RNA, 14 nt, Mycobacterium tuberculosis H37Rv
gacccggucgacgg

SEQ ID NO: 1308911 - RNA, 14 nt, Mycobacterium tuberculosis H37Rv
gacccggguggucg

SEQ ID NO: 1308912 - RNA, 16 nt, Mycobacterium tuberculosis H37Rv
gacccggguggucgau

SEQ ID NO: 1308913 - RNA, 13 nt, Mycobacterium tuberculosis H37Rv
aacgcggcgucga

SEQ ID NO: 1308914 - RNA, 14 nt, Mycobacterium tuberculosis H37Rv
aacgcggcgcgcug

SEQ ID NO: 1308915 - RNA, 13 nt, Mycobacterium tuberculosis H37Rv
aacgcgucgcgcg

SEQ ID NO: 1308916 - RNA, 16 nt, Mycobacterium tuberculosis H37Rv
gacccggcgcagcaac

SEQ ID NO: 1308917 - RNA, 14 nt, Mycobacterium tuberculosis H37Rv
gacccggagccgcc

SEQ ID NO: 1308918 - RNA, 20 nt, Mycobacterium tuberculosis H37Rv
gacccgcugggccgcaucgg

SEQ ID NO: 1308919 - RNA, 17 nt, Mycobacterium tuberculosis H37Rv
gacccggaccugggcga

SEQ ID NO: 1308920 - RNA, 18 nt, Mycobacterium tuberculosis H37Rv
gacccggaccugggcgac

SEQ ID NO: 1308921 - RNA, 16 nt, Mycobacterium tuberculosis H37Rv
gacccggaaucccgag

SEQ ID NO: 1308922 - RNA, 14 nt, Mycobacterium tuberculosis H37Rv
gacccggaugucgu

SEQ ID NO: 1308923 - RNA, 17 nt, Mycobacterium tuberculosis H37Rv
gacccgcucgcggcgac

SEQ ID NO: 1308924 - RNA, 16 nt, Mycobacterium tuberculosis H37Rv
gacccgcuacgacggu

SEQ ID NO: 1308925 - RNA, 15 nt, Mycobacterium tuberculosis H37Rv
gacaugcccgccaau

SEQ ID NO: 1308926 - RNA, 22 nt, Mycobacterium tuberculosis H37Rv
gaccaccgcgaaagcaccgagc

SEQ ID NO: 1308927 - RNA, 17 nt, Mycobacterium tuberculosis H37Rv
aacgaucgcgcgagcga

SEQ ID NO: 1308928 - RNA, 18 nt, Mycobacterium tuberculosis H37Rv
aacgaucgcgccgucguc

SEQ ID NO: 1308929 - RNA, 14 nt, Mycobacterium tuberculosis H37Rv
gaccacgccgacgu

SEQ ID NO: 1308930 - RNA, 16 nt, Mycobacterium tuberculosis H37Rv
gacaucgucgccaggg

SEQ ID NO: 1308931 - RNA, 18 nt, Mycobacterium tuberculosis H37Rv
gacaucguaggccggcau

SEQ ID NO: 1308932 - RNA, 15 nt, Mycobacterium tuberculosis H37Rv
gacaucgucgacgac

SEQ ID NO: 1308933 - RNA, 19 nt, Mycobacterium tuberculosis H37Rv
gacaucgggccgccgagcu

SEQ ID NO: 1308934 - RNA, 14 nt, Mycobacterium tuberculosis H37Rv
gacaucguaggccg

SEQ ID NO: 1308935 - RNA, 17 nt, Mycobacterium tuberculosis H37Rv
gacaucguaggccggca

SEQ ID NO: 1308936 - RNA, 15 nt, Mycobacterium tuberculosis H37Rv
gacaucggugacggu

SEQ ID NO: 1308937 - RNA, 15 nt, Mycobacterium tuberculosis H37Rv
gacaucgcugcgacu

SEQ ID NO: 1308938 - RNA, 14 nt, Mycobacterium tuberculosis H37Rv
gacaugagcgccac

SEQ ID NO: 1308939 - RNA, 18 nt, Mycobacterium tuberculosis H37Rv
gacaucguuggccgggca

SEQ ID NO: 1308940 - RNA, 15 nt, Mycobacterium tuberculosis H37Rv
gacaugaaccggucg

SEQ ID NO: 1308941 - RNA, 12 nt, Mycobacterium tuberculosis H37Rv
aacgccgcucau

SEQ ID NO: 1308942 - RNA, 15 nt, Mycobacterium tuberculosis H37Rv
gaccacuugcagcac

SEQ ID NO: 1308943 - RNA, 16 nt, Mycobacterium tuberculosis H37Rv
gaccacuucgauggcg

SEQ ID NO: 1308944 - RNA, 23 nt, Mycobacterium tuberculosis H37Rv
gaccacuuagcuggcgggggucc

SEQ ID NO: 1308945 - RNA, 21 nt, Mycobacterium tuberculosis H37Rv
gaccacucggcggccaccucg

SEQ ID NO: 1308946 - RNA, 18 nt, Mycobacterium tuberculosis H37Rv
gaccacugcccggggucc

SEQ ID NO: 1308947 - RNA, 15 nt, Mycobacterium tuberculosis H37Rv
aacgccauuuccugg

SEQ ID NO: 1308948 - RNA, 16 nt, Mycobacterium tuberculosis H37Rv
aacgccagucgagcac

SEQ ID NO: 1308949 - RNA, 14 nt, Mycobacterium tuberculosis H37Rv
aacgccaugccggg

SEQ ID NO: 1308950 - RNA, 21 nt, Mycobacterium tuberculosis H37Rv
aacgaugguggcgaucaucgg

SEQ ID NO: 1308951 - RNA, 14 nt, Mycobacterium tuberculosis H37Rv
aacgauguccgcgc

SEQ ID NO: 1308952 - RNA, 19 nt, Mycobacterium tuberculosis H37Rv
aacgccacugcgccgugac

SEQ ID NO: 1308953 - RNA, 14 nt, Mycobacterium tuberculosis H37Rv
aacgccagcagcgc

SEQ ID NO: 1308954 - RNA, 15 nt, Mycobacterium tuberculosis H37Rv
gaccaggcgcggcga

SEQ ID NO: 1308955 - RNA, 22 nt, Mycobacterium tuberculosis H37Rv
gaccagggcggugcucuucggc

SEQ ID NO: 1308956 - RNA, 20 nt, Mycobacterium tuberculosis H37Rv
gaccaucuuaacgucggcaa

SEQ ID NO: 1308957 - RNA, 15 nt, Mycobacterium tuberculosis H37Rv
aacgccgucgccugc

SEQ ID NO: 1308958 - RNA, 20 nt, Mycobacterium tuberculosis H37Rv
gaccagccgaucaucaccgg

SEQ ID NO: 1308959 - RNA, 19 nt, Mycobacterium tuberculosis H37Rv
gaccagcgccccggcgcgu

SEQ ID NO: 1308960 - RNA, 21 nt, Mycobacterium tuberculosis H37Rv
gaccagcgccgauaccagcca

SEQ ID NO: 1308961 - RNA, 14 nt, Mycobacterium tuberculosis H37Rv
gaccaugaccgggc

SEQ ID NO: 1308962 - RNA, 16 nt, Mycobacterium tuberculosis H37Rv
gacccaagucgccgag

SEQ ID NO: 1308963 - RNA, 16 nt, Mycobacterium tuberculosis H37Rv
gacccaccaccgcaac

SEQ ID NO: 1308964 - RNA, 15 nt, Mycobacterium tuberculosis H37Rv
gacccagcgcggcaa

SEQ ID NO: 1308965 - RNA, 23 nt, Mycobacterium tuberculosis H37Rv
gacccagcauggggucagcucgc

SEQ ID NO: 1308966 - RNA, 15 nt, Mycobacterium tuberculosis H37Rv
gacccauacgaacuc

SEQ ID NO: 1308967 - RNA, 21 nt, Mycobacterium tuberculosis H37Rv
gacccaguccgguagcagcgc

SEQ ID NO: 1308968 - RNA, 18 nt, Mycobacterium tuberculosis H37Rv
gacccagcacccgagcga

SEQ ID NO: 1308969 - RNA, 20 nt, Mycobacterium tuberculosis H37Rv
gacccagcucgucgacgucg

SEQ ID NO: 1308970 - RNA, 16 nt, Mycobacterium tuberculosis H37Rv
gacccagcgcggcaac

SEQ ID NO: 1308971 - RNA, 18 nt, Mycobacterium tuberculosis H37Rv
gacccagcucgucgacgu

SEQ ID NO: 1308972 - RNA, 18 nt, Mycobacterium tuberculosis H37Rv
gacccaucaccagcggcu

SEQ ID NO: 1308973 - RNA, 22 nt, Mycobacterium tuberculosis H37Rv
gacccaucaccagcggcugcag

SEQ ID NO: 1308974 - RNA, 14 nt, Mycobacterium tuberculosis H37Rv
gacccgcauaccgu

SEQ ID NO: 1308975 - RNA, 17 nt, Mycobacterium tuberculosis H37Rv
gacccgccgacgaccgc

SEQ ID NO: 1308976 - RNA, 20 nt, Mycobacterium tuberculosis H37Rv
gacccgccagggcacguggc

SEQ ID NO: 1308977 - RNA, 15 nt, Mycobacterium tuberculosis H37Rv
gacccaucaccagcg

SEQ ID NO: 1308978 - RNA, 18 nt, Mycobacterium tuberculosis H37Rv
gacccgcauccacgucgc

SEQ ID NO: 1308979 - RNA, 21 nt, Mycobacterium tuberculosis H37Rv
gacccgccgcgcccggcgcaa

SEQ ID NO: 1308980 - RNA, 15 nt, Mycobacterium tuberculosis H37Rv
gacccgccggcgacu

SEQ ID NO: 1308981 - RNA, 21 nt, Mycobacterium tuberculosis H37Rv
gaaugcgccgucggugggugc

SEQ ID NO: 1308982 - RNA, 21 nt, Mycobacterium tuberculosis H37Rv
gaaugcggugaguccgcugag

SEQ ID NO: 1308983 - RNA, 18 nt, Mycobacterium tuberculosis H37Rv
gaaugcgguccucgaucg

SEQ ID NO: 1308984 - RNA, 20 nt, Mycobacterium tuberculosis H37Rv
gaauggcaacacaccgaaca

SEQ ID NO: 1308985 - RNA, 18 nt, Mycobacterium tuberculosis H37Rv
gacaaaccgggcggccaa

SEQ ID NO: 1308986 - RNA, 21 nt, Mycobacterium tuberculosis H37Rv
gacaaacguguugaccggguc

SEQ ID NO: 1308987 - RNA, 22 nt, Mycobacterium tuberculosis H37Rv
gacaaaucgaugaccgucgcac

SEQ ID NO: 1308988 - RNA, 19 nt, Mycobacterium tuberculosis H37Rv
gacaacaaacccggccucg

SEQ ID NO: 1308989 - RNA, 15 nt, Mycobacterium tuberculosis H37Rv
gacaacaaacccggc

SEQ ID NO: 1308990 - RNA, 22 nt, Mycobacterium tuberculosis H37Rv
gacaacagcaagauuauggcga

SEQ ID NO: 1308991 - RNA, 22 nt, Mycobacterium tuberculosis H37Rv
gacaacacgccgucgaccggcg

SEQ ID NO: 1308992 - RNA, 22 nt, Mycobacterium tuberculosis H37Rv
gacaacgacugcguuccgaucg

SEQ ID NO: 1308993 - RNA, 14 nt, Mycobacterium tuberculosis H37Rv
gacaacgccgucga

SEQ ID NO: 1308994 - RNA, 21 nt, Mycobacterium tuberculosis H37Rv
gacaacccggcgucgacgauu

SEQ ID NO: 1308995 - RNA, 16 nt, Mycobacterium tuberculosis H37Rv
gacaacagucgacaau

SEQ ID NO: 1308996 - RNA, 16 nt, Mycobacterium tuberculosis H37Rv
gacaacugcccgauga

SEQ ID NO: 1308997 - RNA, 13 nt, Mycobacterium tuberculosis H37Rv
gacaagccgagcc

SEQ ID NO: 1308998 - RNA, 18 nt, Mycobacterium tuberculosis H37Rv
gacaagucggcaccggug

SEQ ID NO: 1308999 - RNA, 14 nt, Mycobacterium tuberculosis H37Rv
gacaauacgugcga

SEQ ID NO: 1309000 - RNA, 13 nt, Mycobacterium tuberculosis H37Rv
gacaaucucggcg

SEQ ID NO: 1309001 - RNA, 15 nt, Mycobacterium tuberculosis H37Rv
gaaucgcaucggcgg

SEQ ID NO: 1309002 - RNA, 19 nt, Mycobacterium tuberculosis H37Rv
gaaucgcccauuucggcac

SEQ ID NO: 1309003 - RNA, 17 nt, Mycobacterium tuberculosis H37Rv
gaaugccgucgccggau

SEQ ID NO: 1309004 - RNA, 17 nt, Mycobacterium tuberculosis H37Rv
gaauccucucgaucaga

SEQ ID NO: 1309005 - RNA, 23 nt, Mycobacterium tuberculosis H37Rv
gaauccggucgaugaccucguca

SEQ ID NO: 1309006 - RNA, 22 nt, Mycobacterium tuberculosis H37Rv
gaauagguccggaagcggcguu

SEQ ID NO: 1309007 - RNA, 20 nt, Mycobacterium tuberculosis H37Rv
gaacucgaguugcucgacac

SEQ ID NO: 1309008 - RNA, 16 nt, Mycobacterium tuberculosis H37Rv
gaacugggccucagac

SEQ ID NO: 1309009 - RNA, 20 nt, Mycobacterium tuberculosis H37Rv
gaagugcucacauccgguca

SEQ ID NO: 1309010 - RNA, 22 nt, Mycobacterium tuberculosis H37Rv
gaaguggagccccgacugcuga

SEQ ID NO: 1309011 - RNA, 21 nt, Mycobacterium tuberculosis H37Rv
gaacuggacaagcuccucgcg

SEQ ID NO: 1309012 - RNA, 22 nt, Mycobacterium tuberculosis H37Rv
gaacugcgcaacaccgugcacc

SEQ ID NO: 1309013 - RNA, 22 nt, Mycobacterium tuberculosis H37Rv
gaaguucggguagccgggaacg

SEQ ID NO: 1309014 - RNA, 16 nt, Mycobacterium tuberculosis H37Rv
gaaguucucggugcgc

SEQ ID NO: 1309015 - RNA, 16 nt, Mycobacterium tuberculosis H37Rv
gaaguugacaccaggg

SEQ ID NO: 1309016 - RNA, 15 nt, Mycobacterium tuberculosis H37Rv
gaaguugccggucag

SEQ ID NO: 1309017 - RNA, 17 nt, Mycobacterium tuberculosis H37Rv
gacacaccgcgucggcc

SEQ ID NO: 1309018 - RNA, 17 nt, Mycobacterium tuberculosis H37Rv
gacaauuuucgcaccua

SEQ ID NO: 1309019 - RNA, 16 nt, Mycobacterium tuberculosis H37Rv
gacaauuccuggaucg

SEQ ID NO: 1309020 - RNA, 21 nt, Mycobacterium tuberculosis H37Rv
gacaccacggcgcgcagcgac

SEQ ID NO: 1309021 - RNA, 20 nt, Mycobacterium tuberculosis H37Rv
gacacccaccucgccaucga

SEQ ID NO: 1309022 - RNA, 22 nt, Mycobacterium tuberculosis H37Rv
gacaccaucuccgccgucgcca

SEQ ID NO: 1309023 - RNA, 15 nt, Mycobacterium tuberculosis H37Rv
gacaccccggaaucc

SEQ ID NO: 1309024 - RNA, 23 nt, Mycobacterium tuberculosis H37Rv
gacacccguugagcauaugacgu

SEQ ID NO: 1309025 - RNA, 22 nt, Mycobacterium tuberculosis H37Rv
gacaccgaaccgccgcugccgc

SEQ ID NO: 1309026 - RNA, 21 nt, Mycobacterium tuberculosis H37Rv
gacaccgauccggccgccgau

SEQ ID NO: 1309027 - RNA, 15 nt, Mycobacterium tuberculosis H37Rv
gacaccgaccggguc

SEQ ID NO: 1309028 - RNA, 17 nt, Mycobacterium tuberculosis H37Rv
gacaccgaggucggcca

SEQ ID NO: 1309029 - RNA, 20 nt, Mycobacterium tuberculosis H37Rv
gacaccgagccacgacccag

SEQ ID NO: 1309030 - RNA, 15 nt, Mycobacterium tuberculosis H37Rv
gacaccgcggacccg

SEQ ID NO: 1309031 - RNA, 16 nt, Mycobacterium tuberculosis H37Rv
gacaccgcgaucacca

SEQ ID NO: 1309032 - RNA, 12 nt, Mycobacterium tuberculosis H37Rv
gacaccgcccga

SEQ ID NO: 1309033 - RNA, 22 nt, Mycobacterium tuberculosis H37Rv
gacaccgcccgacccaucacca

SEQ ID NO: 1309034 - RNA, 19 nt, Mycobacterium tuberculosis H37Rv
gacaccgccaccacgccgu

SEQ ID NO: 1309035 - RNA, 13 nt, Mycobacterium tuberculosis H37Rv
gacaccgaucugc

SEQ ID NO: 1309036 - RNA, 14 nt, Mycobacterium tuberculosis H37Rv
gacaccuaccgaga

SEQ ID NO: 1309037 - RNA, 19 nt, Mycobacterium tuberculosis H37Rv
gacaccguggaucggcagc

SEQ ID NO: 1309038 - RNA, 16 nt, Mycobacterium tuberculosis H37Rv
gacaccguccagcagc

SEQ ID NO: 1309039 - RNA, 17 nt, Mycobacterium tuberculosis H37Rv
gacaccggcggcaucga

SEQ ID NO: 1309040 - RNA, 14 nt, Mycobacterium tuberculosis H37Rv
gacaccggucggca

SEQ ID NO: 1309041 - RNA, 15 nt, Mycobacterium tuberculosis H37Rv
gacaccggucggcag

SEQ ID NO: 1309042 - RNA, 16 nt, Mycobacterium tuberculosis H37Rv
gacacgaccccgucga

SEQ ID NO: 1309043 - RNA, 15 nt, Mycobacterium tuberculosis H37Rv
gacacgcgcugcguc

SEQ ID NO: 1309044 - RNA, 13 nt, Mycobacterium tuberculosis H37Rv
gacacgcgcgcuc

SEQ ID NO: 1309045 - RNA, 20 nt, Mycobacterium tuberculosis H37Rv
gacacgcgcgcucgcggguu

SEQ ID NO: 1309046 - RNA, 15 nt, Mycobacterium tuberculosis H37Rv
gacacgccgaugccg

SEQ ID NO: 1309047 - RNA, 12 nt, Mycobacterium tuberculosis H37Rv
gacacgccgaug

SEQ ID NO: 1309048 - RNA, 16 nt, Mycobacterium tuberculosis H37Rv
gacacugggaucccga

SEQ ID NO: 1309049 - RNA, 19 nt, Mycobacterium tuberculosis H37Rv
gacacugggaucccgacga

SEQ ID NO: 1309050 - RNA, 19 nt, Mycobacterium tuberculosis H37Rv
gacagaaucgaccgccgcu

SEQ ID NO: 1309051 - RNA, 19 nt, Mycobacterium tuberculosis H37Rv
gacacugcgaaggaccaga

SEQ ID NO: 1309052 - RNA, 23 nt, Mycobacterium tuberculosis H37Rv
gacagauggucggucgcuucagc

SEQ ID NO: 1309053 - RNA, 16 nt, Mycobacterium tuberculosis H37Rv
gacagaugcauccagc

SEQ ID NO: 1309054 - RNA, 20 nt, Mycobacterium tuberculosis H37Rv
gacagcacccaaugccaccg

SEQ ID NO: 1309055 - RNA, 18 nt, Mycobacterium tuberculosis H37Rv
gacagcggcgacaugauc

SEQ ID NO: 1309056 - RNA, 23 nt, Mycobacterium tuberculosis H37Rv
gacagcggcgacaugaucugcca

SEQ ID NO: 1309057 - RNA, 22 nt, Mycobacterium tuberculosis H37Rv
gacagcgucucgccgggaaaca

SEQ ID NO: 1309058 - RNA, 14 nt, Mycobacterium tuberculosis H37Rv
gacagcugccugac

SEQ ID NO: 1309059 - RNA, 17 nt, Mycobacterium tuberculosis H37Rv
gacagcgggagcagcac

SEQ ID NO: 1309060 - RNA, 19 nt, Mycobacterium tuberculosis H37Rv
gacaggccaccgcagacgc

SEQ ID NO: 1309061 - RNA, 16 nt, Mycobacterium tuberculosis H37Rv
aacgacccgaagccga

SEQ ID NO: 1309062 - RNA, 14 nt, Mycobacterium tuberculosis H37Rv
aacgacggccgaca

SEQ ID NO: 1309063 - RNA, 13 nt, Mycobacterium tuberculosis H37Rv
aacgacgccaccg

SEQ ID NO: 1309064 - RNA, 18 nt, Mycobacterium tuberculosis H37Rv
gacaucaccgaacggcga

SEQ ID NO: 1309065 - RNA, 18 nt, Mycobacterium tuberculosis H37Rv
gacauccucgauggaccg

SEQ ID NO: 1309066 - RNA, 15 nt, Mycobacterium tuberculosis H37Rv
gacauccgcuuacgg

SEQ ID NO: 1309067 - RNA, 17 nt, Mycobacterium tuberculosis H37Rv
gacauccgggccgagcg

SEQ ID NO: 1309068 - RNA, 21 nt, Mycobacterium tuberculosis H37Rv
gacaucccugacgaaggucuc

SEQ ID NO: 1309069 - RNA, 23 nt, Mycobacterium tuberculosis H37Rv
gacaucaccaccgcacgggaucg

SEQ ID NO: 1309070 - RNA, 20 nt, Mycobacterium tuberculosis H37Rv
gacaucacgaaggcguucgc

SEQ ID NO: 1309071 - RNA, 11 nt, Mycobacterium tuberculosis H37Rv
gacaucaccgg

SEQ ID NO: 1309072 - RNA, 18 nt, Mycobacterium tuberculosis H37Rv
cgucgaccgugucaccgc

SEQ ID NO: 1309073 - RNA, 16 nt, Mycobacterium tuberculosis H37Rv
cgucgaccucggcaac

SEQ ID NO: 1309074 - RNA, 23 nt, Mycobacterium tuberculosis H37Rv
cgucgaccucgcgggcgaucggc

SEQ ID NO: 1309075 - RNA, 13 nt, Mycobacterium tuberculosis H37Rv
cgucgacgaucag

SEQ ID NO: 1309076 - RNA, 17 nt, Mycobacterium tuberculosis H37Rv
cgucgacgaucagcgag

SEQ ID NO: 1309077 - RNA, 14 nt, Mycobacterium tuberculosis H37Rv
cgucgagcgcgcca

SEQ ID NO: 1309078 - RNA, 15 nt, Mycobacterium tuberculosis H37Rv
cgucgagccgaccgc

SEQ ID NO: 1309079 - RNA, 17 nt, Mycobacterium tuberculosis H37Rv
cgucgagccgaccgcgg

SEQ ID NO: 1309080 - RNA, 20 nt, Mycobacterium tuberculosis H37Rv
cgucgagcacguccucgacc

SEQ ID NO: 1309081 - RNA, 15 nt, Mycobacterium tuberculosis H37Rv
cgucgagcagcgcca

SEQ ID NO: 1309082 - RNA, 22 nt, Mycobacterium tuberculosis H37Rv
cgucgagcaacgugacccggau

SEQ ID NO: 1309083 - RNA, 22 nt, Mycobacterium tuberculosis H37Rv
cgucgagguggcgcacaucgcg

SEQ ID NO: 1309084 - RNA, 23 nt, Mycobacterium tuberculosis H37Rv
cgucgaucagaacgugacggucc

SEQ ID NO: 1309085 - RNA, 21 nt, Mycobacterium tuberculosis H37Rv
cgucgagguccucgucgucga

SEQ ID NO: 1309086 - RNA, 19 nt, Mycobacterium tuberculosis H37Rv
cgucgagguccucgucguc

SEQ ID NO: 1309087 - RNA, 15 nt, Mycobacterium tuberculosis H37Rv
cgucgagcgcggugc

SEQ ID NO: 1309088 - RNA, 13 nt, Mycobacterium tuberculosis H37Rv
cgucgaggcggca

SEQ ID NO: 1309089 - RNA, 22 nt, Mycobacterium tuberculosis H37Rv
cgucgagcucguccucgucuuc

SEQ ID NO: 1309090 - RNA, 16 nt, Mycobacterium tuberculosis H37Rv
cgucgauggucuccgg

SEQ ID NO: 1309091 - RNA, 17 nt, Mycobacterium tuberculosis H37Rv
cgucgaucuugccgcgc

SEQ ID NO: 1309092 - RNA, 23 nt, Mycobacterium tuberculosis H37Rv
cgucgauguccccggcggcagca

SEQ ID NO: 1309093 - RNA, 14 nt, Mycobacterium tuberculosis H37Rv
cgucgaugucgacg

SEQ ID NO: 1309094 - RNA, 18 nt, Mycobacterium tuberculosis H37Rv
cgucgaugucgacgucgc

SEQ ID NO: 1309095 - RNA, 15 nt, Mycobacterium tuberculosis H37Rv
cgucgaugucgccgc

SEQ ID NO: 1309096 - RNA, 19 nt, Mycobacterium tuberculosis H37Rv
cgucgaugucguuggccac

SEQ ID NO: 1309097 - RNA, 14 nt, Mycobacterium tuberculosis H37Rv
cgucgaucagcggc

SEQ ID NO: 1309098 - RNA, 23 nt, Mycobacterium tuberculosis H37Rv
cgucgagguggcgcacaucgcga

SEQ ID NO: 1309099 - RNA, 16 nt, Mycobacterium tuberculosis H37Rv
cgucgaucgacucaca

SEQ ID NO: 1309100 - RNA, 18 nt, Mycobacterium tuberculosis H37Rv
cgucgaucccggucggug

SEQ ID NO: 1309101 - RNA, 17 nt, Mycobacterium tuberculosis H37Rv
cgucgaucucggcgcag

SEQ ID NO: 1309102 - RNA, 23 nt, Mycobacterium tuberculosis H37Rv
cgucgccauuccaucgcgcaccg

SEQ ID NO: 1309103 - RNA, 18 nt, Mycobacterium tuberculosis H37Rv
cgucgccagggccgccga

SEQ ID NO: 1309104 - RNA, 20 nt, Mycobacterium tuberculosis H37Rv
cgucgccagauagguccgau

SEQ ID NO: 1309105 - RNA, 22 nt, Mycobacterium tuberculosis H37Rv
cgucgccagggccgccgaagcu

SEQ ID NO: 1309106 - RNA, 21 nt, Mycobacterium tuberculosis H37Rv
cgucgauguggcgcuccggcg

SEQ ID NO: 1309107 - RNA, 16 nt, Mycobacterium tuberculosis H37Rv
cgucgauuucgacgac

SEQ ID NO: 1309108 - RNA, 20 nt, Mycobacterium tuberculosis H37Rv
cgucgauuagcccacccaug

SEQ ID NO: 1309109 - RNA, 14 nt, Mycobacterium tuberculosis H37Rv
cgucgccaccaucg

SEQ ID NO: 1309110 - RNA, 15 nt, Mycobacterium tuberculosis H37Rv
cgucgccaccgguac

SEQ ID NO: 1309111 - RNA, 14 nt, Mycobacterium tuberculosis H37Rv
cgucgccaccgaug

SEQ ID NO: 1309112 - RNA, 15 nt, Mycobacterium tuberculosis H37Rv
cgucgccgcgguaga

SEQ ID NO: 1309113 - RNA, 21 nt, Mycobacterium tuberculosis H37Rv
cgucgccgcggcggcagcggc

SEQ ID NO: 1309114 - RNA, 14 nt, Mycobacterium tuberculosis H37Rv
cgucgccgccguug

SEQ ID NO: 1309115 - RNA, 14 nt, Mycobacterium tuberculosis H37Rv
cgucgccgccguua

SEQ ID NO: 1309116 - RNA, 19 nt, Mycobacterium tuberculosis H37Rv
cgucgccgggcggcggugc

SEQ ID NO: 1309117 - RNA, 15 nt, Mycobacterium tuberculosis H37Rv
cgucgccggacgaca

SEQ ID NO: 1309118 - RNA, 14 nt, Mycobacterium tuberculosis H37Rv
cgucggagucggug

SEQ ID NO: 1309119 - RNA, 13 nt, Mycobacterium tuberculosis H37Rv
cgucgcugaccgc

SEQ ID NO: 1309120 - RNA, 18 nt, Mycobacterium tuberculosis H37Rv
cgucgcugaacagacggc

SEQ ID NO: 1309121 - RNA, 15 nt, Mycobacterium tuberculosis H37Rv
cgucgcugagcagcg

SEQ ID NO: 1309122 - RNA, 15 nt, Mycobacterium tuberculosis H37Rv
cgucgcggcggcacu

SEQ ID NO: 1309123 - RNA, 16 nt, Mycobacterium tuberculosis H37Rv
cgucgcuagaucccag

SEQ ID NO: 1309124 - RNA, 16 nt, Mycobacterium tuberculosis H37Rv
cgucgcgcucgcacca

SEQ ID NO: 1309125 - RNA, 22 nt, Mycobacterium tuberculosis H37Rv
cgucgcggccgagacggcguug

SEQ ID NO: 1309126 - RNA, 18 nt, Mycobacterium tuberculosis H37Rv
cgucgcggccgagacggc

SEQ ID NO: 1309127 - RNA, 15 nt, Mycobacterium tuberculosis H37Rv
cgucgcggccgucgc

SEQ ID NO: 1309128 - RNA, 22 nt, Mycobacterium tuberculosis H37Rv
cgucgcggccguggaugucgcg

SEQ ID NO: 1309129 - RNA, 16 nt, Mycobacterium tuberculosis H37Rv
cgucgcggcacgccca

SEQ ID NO: 1309130 - RNA, 17 nt, Mycobacterium tuberculosis H37Rv
cgucgcgccaggcgcga

SEQ ID NO: 1309131 - RNA, 23 nt, Mycobacterium tuberculosis H37Rv
cgucgcgcaucgccuccucgacg

SEQ ID NO: 1309132 - RNA, 21 nt, Mycobacterium tuberculosis H37Rv
cgucgcgcgccuuggccagcg

SEQ ID NO: 1309133 - RNA, 21 nt, Mycobacterium tuberculosis H37Rv
cguccaucucggaccacaucu

SEQ ID NO: 1309134 - RNA, 16 nt, Mycobacterium tuberculosis H37Rv
cgucauuuccacaucc

SEQ ID NO: 1309135 - RNA, 14 nt, Mycobacterium tuberculosis H37Rv
cguccagcaggacg

SEQ ID NO: 1309136 - RNA, 14 nt, Mycobacterium tuberculosis H37Rv
cgucacgccaccgc

SEQ ID NO: 1309137 - RNA, 17 nt, Mycobacterium tuberculosis H37Rv
cgucaucgccggguagc

SEQ ID NO: 1309138 - RNA, 17 nt, Mycobacterium tuberculosis H37Rv
cgucaugggcggcuucg

SEQ ID NO: 1309139 - RNA, 19 nt, Mycobacterium tuberculosis H37Rv
cgucaugaugucgacaucg

SEQ ID NO: 1309140 - RNA, 20 nt, Mycobacterium tuberculosis H37Rv
cgucaugaacgaucggacca

SEQ ID NO: 1309141 - RNA, 16 nt, Mycobacterium tuberculosis H37Rv
cgucaugaacgaucgg

SEQ ID NO: 1309142 - RNA, 22 nt, Mycobacterium tuberculosis H37Rv
cgucgaacuuugucgcgcugcu

SEQ ID NO: 1309143 - RNA, 18 nt, Mycobacterium tuberculosis H37Rv
cgucgaagacgaacgugu

SEQ ID NO: 1309144 - RNA, 20 nt, Mycobacterium tuberculosis H37Rv
cguccucggucacgaucacg

SEQ ID NO: 1309145 - RNA, 13 nt, Mycobacterium tuberculosis H37Rv
cguccuccucggu

SEQ ID NO: 1309146 - RNA, 14 nt, Mycobacterium tuberculosis H37Rv
cguccucgacccgg

SEQ ID NO: 1309147 - RNA, 12 nt, Mycobacterium tuberculosis H37Rv
cguccucgacga

SEQ ID NO: 1309148 - RNA, 16 nt, Mycobacterium tuberculosis H37Rv
cgucgacaacgaucgc

SEQ ID NO: 1309149 - RNA, 21 nt, Mycobacterium tuberculosis H37Rv
cgucgacacacccacuggacc

SEQ ID NO: 1309150 - RNA, 23 nt, Mycobacterium tuberculosis H37Rv
cgucgacacccaccaacacccgg

SEQ ID NO: 1309151 - RNA, 17 nt, Mycobacterium tuberculosis H37Rv
cgucgacaccgcggacc

SEQ ID NO: 1309152 - RNA, 16 nt, Mycobacterium tuberculosis H37Rv
cgucgacacggugauc

SEQ ID NO: 1309153 - RNA, 22 nt, Mycobacterium tuberculosis H37Rv
cgucgacagcgucucgccggga

SEQ ID NO: 1309154 - RNA, 12 nt, Mycobacterium tuberculosis H37Rv
cgucgaccgaac

SEQ ID NO: 1309155 - RNA, 15 nt, Mycobacterium tuberculosis H37Rv
cgucgaccgacgggu

SEQ ID NO: 1309156 - RNA, 19 nt, Mycobacterium tuberculosis H37Rv
cgucgaaggugaccaggcg

SEQ ID NO: 1309157 - RNA, 23 nt, Mycobacterium tuberculosis H37Rv
cgucgaaggugaugaacaccggc

SEQ ID NO: 1309158 - RNA, 19 nt, Mycobacterium tuberculosis H37Rv
cgucgaagcgaacacccgg

SEQ ID NO: 1309159 - RNA, 14 nt, Mycobacterium tuberculosis H37Rv
cgucccagcgccgc

SEQ ID NO: 1309160 - RNA, 15 nt, Mycobacterium tuberculosis H37Rv
cgucccagcgccgca

SEQ ID NO: 1309161 - RNA, 22 nt, Mycobacterium tuberculosis H37Rv
cgucccagcgcgguguagagcg

SEQ ID NO: 1309162 - RNA, 21 nt, Mycobacterium tuberculosis H37Rv
cguccgcgggcggaggccgcc

SEQ ID NO: 1309163 - RNA, 21 nt, Mycobacterium tuberculosis H37Rv
cguccgcgggggaccgcccga

SEQ ID NO: 1309164 - RNA, 14 nt, Mycobacterium tuberculosis H37Rv
cguccgcgguguug

SEQ ID NO: 1309165 - RNA, 19 nt, Mycobacterium tuberculosis H37Rv
cguccgcugacccgccaau

SEQ ID NO: 1309166 - RNA, 12 nt, Mycobacterium tuberculosis H37Rv
cguccggcgaug

SEQ ID NO: 1309167 - RNA, 24 nt, Mycobacterium tuberculosis H37Rv
cguccggagaauuccgcuagguca

SEQ ID NO: 1309168 - RNA, 17 nt, Mycobacterium tuberculosis H37Rv
cguccggagaauuccgc

SEQ ID NO: 1309169 - RNA, 17 nt, Mycobacterium tuberculosis H37Rv
cguccggccacgguccg

SEQ ID NO: 1309170 - RNA, 19 nt, Mycobacterium tuberculosis H37Rv
cgguuaccucaccgaaaga

SEQ ID NO: 1309171 - RNA, 17 nt, Mycobacterium tuberculosis H37Rv
cggucgaguagccguag

SEQ ID NO: 1309172 - RNA, 17 nt, Mycobacterium tuberculosis H37Rv
cggucgccaagaucggg

SEQ ID NO: 1309173 - RNA, 13 nt, Mycobacterium tuberculosis H37Rv
cggucgccaccgc

SEQ ID NO: 1309174 - RNA, 13 nt, Mycobacterium tuberculosis H37Rv
cggucgccaccgu

SEQ ID NO: 1309175 - RNA, 15 nt, Mycobacterium tuberculosis H37Rv
cggucgccaccgccg

SEQ ID NO: 1309176 - RNA, 21 nt, Mycobacterium tuberculosis H37Rv
cggucgcagcagaccacaacg

SEQ ID NO: 1309177 - RNA, 15 nt, Mycobacterium tuberculosis H37Rv
cggucgcauggucga

SEQ ID NO: 1309178 - RNA, 16 nt, Mycobacterium tuberculosis H37Rv
cggucgcauggucgac

SEQ ID NO: 1309179 - RNA, 18 nt, Mycobacterium tuberculosis H37Rv
cggucgcagugcacccgg

SEQ ID NO: 1309180 - RNA, 16 nt, Mycobacterium tuberculosis H37Rv
cggucgcagugcaccc

SEQ ID NO: 1309181 - RNA, 21 nt, Mycobacterium tuberculosis H37Rv
cgguuagggcacgucgagcgu

SEQ ID NO: 1309182 - RNA, 20 nt, Mycobacterium tuberculosis H37Rv
cgguuagggcacgucgagcg

SEQ ID NO: 1309183 - RNA, 23 nt, Mycobacterium tuberculosis H37Rv
cgguucgccccugcacagcaggc

SEQ ID NO: 1309184 - RNA, 22 nt, Mycobacterium tuberculosis H37Rv
cgguucgaugacaggcuuggca

SEQ ID NO: 1309185 - RNA, 16 nt, Mycobacterium tuberculosis H37Rv
cgguuugcacgcacca

SEQ ID NO: 1309186 - RNA, 17 nt, Mycobacterium tuberculosis H37Rv
cgguuuccuccggcagc

SEQ ID NO: 1309187 - RNA, 19 nt, Mycobacterium tuberculosis H37Rv
cgguuuuggucgcgaugac

SEQ ID NO: 1309188 - RNA, 15 nt, Mycobacterium tuberculosis H37Rv
cgguugccacgccgc

SEQ ID NO: 1309189 - RNA, 22 nt, Mycobacterium tuberculosis H37Rv
cgguugaugcggccgcggcagc

SEQ ID NO: 1309190 - RNA, 15 nt, Mycobacterium tuberculosis H37Rv
cgguugaucggccac

SEQ ID NO: 1309191 - RNA, 20 nt, Mycobacterium tuberculosis H37Rv
cgguugaucgcguagcuggc

SEQ ID NO: 1309192 - RNA, 21 nt, Mycobacterium tuberculosis H37Rv
cgguucgcugcggcgguaugc

SEQ ID NO: 1309193 - RNA, 17 nt, Mycobacterium tuberculosis H37Rv
cguacccacgacgggcc

SEQ ID NO: 1309194 - RNA, 19 nt, Mycobacterium tuberculosis H37Rv
cguaccagcuggccacuuu

SEQ ID NO: 1309195 - RNA, 16 nt, Mycobacterium tuberculosis H37Rv
cguaacggucggugaa

SEQ ID NO: 1309196 - RNA, 14 nt, Mycobacterium tuberculosis H37Rv
cguaaccacgacga

SEQ ID NO: 1309197 - RNA, 20 nt, Mycobacterium tuberculosis H37Rv
cguaaccggcagcgguaagc

SEQ ID NO: 1309198 - RNA, 23 nt, Mycobacterium tuberculosis H37Rv
cguaagaccugaguugguucgaa

SEQ ID NO: 1309199 - RNA, 13 nt, Mycobacterium tuberculosis H37Rv
cguacaacgccgg

SEQ ID NO: 1309200 - RNA, 19 nt, Mycobacterium tuberculosis H37Rv
cguacuucgacagcggcga

SEQ ID NO: 1309201 - RNA, 21 nt, Mycobacterium tuberculosis H37Rv
cguacugucgucgcccugaca

SEQ ID NO: 1309202 - RNA, 15 nt, Mycobacterium tuberculosis H37Rv
cguacgccggcggug

SEQ ID NO: 1309203 - RNA, 20 nt, Mycobacterium tuberculosis H37Rv
cguacgcauggcggaauuca

SEQ ID NO: 1309204 - RNA, 15 nt, Mycobacterium tuberculosis H37Rv
cguacggggucgccg

SEQ ID NO: 1309205 - RNA, 11 nt, Mycobacterium tuberculosis H37Rv
cguacgccgua

SEQ ID NO: 1309206 - RNA, 14 nt, Mycobacterium tuberculosis H37Rv
cguacccgaucagc

SEQ ID NO: 1309207 - RNA, 14 nt, Mycobacterium tuberculosis H37Rv
cguacccggcaacg

SEQ ID NO: 1309208 - RNA, 11 nt, Mycobacterium tuberculosis H37Rv
cguaccgcgcg

SEQ ID NO: 1309209 - RNA, 16 nt, Mycobacterium tuberculosis H37Rv
cguaccgauuccaugc

SEQ ID NO: 1309210 - RNA, 15 nt, Mycobacterium tuberculosis H37Rv
cguaccguucgggcc

SEQ ID NO: 1309211 - RNA, 24 nt, Mycobacterium tuberculosis H37Rv
cguagccguggagcacagcacggc

SEQ ID NO: 1309212 - RNA, 14 nt, Mycobacterium tuberculosis H37Rv
cguagccggcggug

SEQ ID NO: 1309213 - RNA, 16 nt, Mycobacterium tuberculosis H37Rv
cguagcccaugccgau

SEQ ID NO: 1309214 - RNA, 16 nt, Mycobacterium tuberculosis H37Rv
cguagcaggucgacgg

SEQ ID NO: 1309215 - RNA, 19 nt, Mycobacterium tuberculosis H37Rv
cguagcagguguaggugcc

SEQ ID NO: 1309216 - RNA, 15 nt, Mycobacterium tuberculosis H37Rv
cguagcaggucgacg

SEQ ID NO: 1309217 - RNA, 18 nt, Mycobacterium tuberculosis H37Rv
cguagcccacccgggugg

SEQ ID NO: 1309218 - RNA, 15 nt, Mycobacterium tuberculosis H37Rv
cguagcaucgggcga

SEQ ID NO: 1309219 - RNA, 19 nt, Mycobacterium tuberculosis H37Rv
cguagaucaucuggcuggu

SEQ ID NO: 1309220 - RNA, 15 nt, Mycobacterium tuberculosis H37Rv
cguagcaccacaucg

SEQ ID NO: 1309221 - RNA, 15 nt, Mycobacterium tuberculosis H37Rv
cguagcaacccagga

SEQ ID NO: 1309222 - RNA, 17 nt, Mycobacterium tuberculosis H37Rv
cguagaugguggucacc

SEQ ID NO: 1309223 - RNA, 18 nt, Mycobacterium tuberculosis H37Rv
cguagaaggaccgcucgu

SEQ ID NO: 1309224 - RNA, 16 nt, Mycobacterium tuberculosis H37Rv
cguagaaucggcucag

SEQ ID NO: 1309225 - RNA, 21 nt, Mycobacterium tuberculosis H37Rv
cguagaccaggcccaggucaa

SEQ ID NO: 1309226 - RNA, 13 nt, Mycobacterium tuberculosis H37Rv
cguagaccaggcc

SEQ ID NO: 1309227 - RNA, 16 nt, Mycobacterium tuberculosis H37Rv
cguagacggggugagc

SEQ ID NO: 1309228 - RNA, 19 nt, Mycobacterium tuberculosis H37Rv
cguagacgguccggucgcu

SEQ ID NO: 1309229 - RNA, 21 nt, Mycobacterium tuberculosis H37Rv
aacccaugucggcgcgccgca

SEQ ID NO: 1309230 - RNA, 20 nt, Mycobacterium tuberculosis H37Rv
aacccagcaucgggugagau

SEQ ID NO: 1309231 - RNA, 17 nt, Mycobacterium tuberculosis H37Rv
aacccagaucggcgacg

SEQ ID NO: 1309232 - RNA, 15 nt, Mycobacterium tuberculosis H37Rv
cguagcgcggccgau

SEQ ID NO: 1309233 - RNA, 15 nt, Mycobacterium tuberculosis H37Rv
cguagcuggucccac

SEQ ID NO: 1309234 - RNA, 15 nt, Mycobacterium tuberculosis H37Rv
cguagcucagcggua

SEQ ID NO: 1309235 - RNA, 20 nt, Mycobacterium tuberculosis H37Rv
cguagcucuuugagugccgu

SEQ ID NO: 1309236 - RNA, 22 nt, Mycobacterium tuberculosis H37Rv
cguaggcaggaucgccugagcg

SEQ ID NO: 1309237 - RNA, 17 nt, Mycobacterium tuberculosis H37Rv
cguagcggcgauaccgg

SEQ ID NO: 1309238 - RNA, 17 nt, Mycobacterium tuberculosis H37Rv
cguagcggucuccccag

SEQ ID NO: 1309239 - RNA, 14 nt, Mycobacterium tuberculosis H37Rv
cguagcggucccgc

SEQ ID NO: 1309240 - RNA, 15 nt, Mycobacterium tuberculosis H37Rv
cguaguacagcgcga

SEQ ID NO: 1309241 - RNA, 17 nt, Mycobacterium tuberculosis H37Rv
cguaguagcgaugcacc

SEQ ID NO: 1309242 - RNA, 16 nt, Mycobacterium tuberculosis H37Rv
cguaguaguggccgcc

SEQ ID NO: 1309243 - RNA, 14 nt, Mycobacterium tuberculosis H37Rv
cguagguggccagc

SEQ ID NO: 1309244 - RNA, 13 nt, Mycobacterium tuberculosis H37Rv
cguaggcgaugag

SEQ ID NO: 1309245 - RNA, 18 nt, Mycobacterium tuberculosis H37Rv
cguagguggccagcgcgg

SEQ ID NO: 1309246 - RNA, 21 nt, Mycobacterium tuberculosis H37Rv
cguaggccgcuaugcagguca

SEQ ID NO: 1309247 - RNA, 14 nt, Mycobacterium tuberculosis H37Rv
cguaucgccucgag

SEQ ID NO: 1309248 - RNA, 15 nt, Mycobacterium tuberculosis H37Rv
cguaucggggcacca

SEQ ID NO: 1309249 - RNA, 18 nt, Mycobacterium tuberculosis H37Rv
cguagugaacggcucggg

SEQ ID NO: 1309250 - RNA, 15 nt, Mycobacterium tuberculosis H37Rv
cgucaccacgaucgc

SEQ ID NO: 1309251 - RNA, 16 nt, Mycobacterium tuberculosis H37Rv
cgucaccacgaucgca

SEQ ID NO: 1309252 - RNA, 13 nt, Mycobacterium tuberculosis H37Rv
cgucaccaucggg

SEQ ID NO: 1309253 - RNA, 13 nt, Mycobacterium tuberculosis H37Rv
cgucaccgaucga

SEQ ID NO: 1309254 - RNA, 13 nt, Mycobacterium tuberculosis H37Rv
cgucaccguuggc

SEQ ID NO: 1309255 - RNA, 17 nt, Mycobacterium tuberculosis H37Rv
cgucaccgccggcaccg

SEQ ID NO: 1309256 - RNA, 21 nt, Mycobacterium tuberculosis H37Rv
cgucaccgccgucaccgccau

SEQ ID NO: 1309257 - RNA, 20 nt, Mycobacterium tuberculosis H37Rv
cgucaccggaauccccccug

SEQ ID NO: 1309258 - RNA, 16 nt, Mycobacterium tuberculosis H37Rv
aacccgccgaugccgc

SEQ ID NO: 1309259 - RNA, 13 nt, Mycobacterium tuberculosis H37Rv
aacccggaaguug

SEQ ID NO: 1309260 - RNA, 17 nt, Mycobacterium tuberculosis H37Rv
cgucaccaccgccgcca

SEQ ID NO: 1309261 - RNA, 18 nt, Mycobacterium tuberculosis H37Rv
cgucaccaaacccgaugg

SEQ ID NO: 1309262 - RNA, 15 nt, Mycobacterium tuberculosis H37Rv
cgucaccaccgccgc

SEQ ID NO: 1309263 - RNA, 15 nt, Mycobacterium tuberculosis H37Rv
cguggucggccaccc

SEQ ID NO: 1309264 - RNA, 16 nt, Mycobacterium tuberculosis H37Rv
cguggucggccucgag

SEQ ID NO: 1309265 - RNA, 14 nt, Mycobacterium tuberculosis H37Rv
cguggucggccacc

SEQ ID NO: 1309266 - RNA, 15 nt, Mycobacterium tuberculosis H37Rv
cguggucggagcggg

SEQ ID NO: 1309267 - RNA, 18 nt, Mycobacterium tuberculosis H37Rv
cguggucucggucagccc

SEQ ID NO: 1309268 - RNA, 23 nt, Mycobacterium tuberculosis H37Rv
cgugggccacuugaugcucgaug

SEQ ID NO: 1309269 - RNA, 15 nt, Mycobacterium tuberculosis H37Rv
cguggcggaucgcga

SEQ ID NO: 1309270 - RNA, 16 nt, Mycobacterium tuberculosis H37Rv
cgugggcaugcggauu

SEQ ID NO: 1309271 - RNA, 20 nt, Mycobacterium tuberculosis H37Rv
cgugggcagcgcgaucaccg

SEQ ID NO: 1309272 - RNA, 19 nt, Mycobacterium tuberculosis H37Rv
cgugggcagcgcgaucacc

SEQ ID NO: 1309273 - RNA, 13 nt, Mycobacterium tuberculosis H37Rv
cguggcggcagcg

SEQ ID NO: 1309274 - RNA, 19 nt, Mycobacterium tuberculosis H37Rv
cguggcgcucggcgagcaa

SEQ ID NO: 1309275 - RNA, 21 nt, Mycobacterium tuberculosis H37Rv
cguggcgaaugacggccaguu

SEQ ID NO: 1309276 - RNA, 20 nt, Mycobacterium tuberculosis H37Rv
cguggcgaaugacggccagu

SEQ ID NO: 1309277 - RNA, 13 nt, Mycobacterium tuberculosis H37Rv
cguggcgaccggc

SEQ ID NO: 1309278 - RNA, 15 nt, Mycobacterium tuberculosis H37Rv
cguggacaagcacag

SEQ ID NO: 1309279 - RNA, 16 nt, Mycobacterium tuberculosis H37Rv
aaccgccggcaccgcc

SEQ ID NO: 1309280 - RNA, 18 nt, Mycobacterium tuberculosis H37Rv
aaccgccaacauugguga

SEQ ID NO: 1309281 - RNA, 15 nt, Mycobacterium tuberculosis H37Rv
aaccgcgaacccgau

SEQ ID NO: 1309282 - RNA, 18 nt, Mycobacterium tuberculosis H37Rv
cguggaacuccguccgcc

SEQ ID NO: 1309283 - RNA, 21 nt, Mycobacterium tuberculosis H37Rv
aaccgcgcguaggccgcuaug

SEQ ID NO: 1309284 - RNA, 23 nt, Mycobacterium tuberculosis H37Rv
cguggaagauguugccgccgguc

SEQ ID NO: 1309285 - RNA, 14 nt, Mycobacterium tuberculosis H37Rv
cguggaagccgacg

SEQ ID NO: 1309286 - RNA, 19 nt, Mycobacterium tuberculosis H37Rv
cgugcugccauugccgcau

SEQ ID NO: 1309287 - RNA, 21 nt, Mycobacterium tuberculosis H37Rv
cgugcugccgccuuggucgcg

SEQ ID NO: 1309288 - RNA, 20 nt, Mycobacterium tuberculosis H37Rv
cgugcugccggagacacccg

SEQ ID NO: 1309289 - RNA, 12 nt, Mycobacterium tuberculosis H37Rv
aaccgcagucgc

SEQ ID NO: 1309290 - RNA, 22 nt, Mycobacterium tuberculosis H37Rv
cgugcgggggacgggucgccgc

SEQ ID NO: 1309291 - RNA, 20 nt, Mycobacterium tuberculosis H37Rv
cgugcgggcgggcguccacg

SEQ ID NO: 1309292 - RNA, 14 nt, Mycobacterium tuberculosis H37Rv
cgugcucggccugu

SEQ ID NO: 1309293 - RNA, 18 nt, Mycobacterium tuberculosis H37Rv
cgugcucggaggcgauca

SEQ ID NO: 1309294 - RNA, 20 nt, Mycobacterium tuberculosis H37Rv
cgugcugaacuccgccgcga

SEQ ID NO: 1309295 - RNA, 14 nt, Mycobacterium tuberculosis H37Rv
cgugcggcggcugc

SEQ ID NO: 1309296 - RNA, 23 nt, Mycobacterium tuberculosis H37Rv
cgugcgccacuagcccugagcga

SEQ ID NO: 1309297 - RNA, 18 nt, Mycobacterium tuberculosis H37Rv
cgugccgcccucaccgcc

SEQ ID NO: 1309298 - RNA, 16 nt, Mycobacterium tuberculosis H37Rv
cgugccgcccggucgg

SEQ ID NO: 1309299 - RNA, 15 nt, Mycobacterium tuberculosis H37Rv
cgugccgggaccggu

SEQ ID NO: 1309300 - RNA, 22 nt, Mycobacterium tuberculosis H37Rv
cgugccgguggcgccgccgcca

SEQ ID NO: 1309301 - RNA, 17 nt, Mycobacterium tuberculosis H37Rv
cgugccggggcugccga

SEQ ID NO: 1309302 - RNA, 15 nt, Mycobacterium tuberculosis H37Rv
cgugccgucggcgug

SEQ ID NO: 1309303 - RNA, 17 nt, Mycobacterium tuberculosis H37Rv
cgugccugcuuggccac

SEQ ID NO: 1309304 - RNA, 22 nt, Mycobacterium tuberculosis H37Rv
cgugccucggacaaagccgucg

SEQ ID NO: 1309305 - RNA, 20 nt, Mycobacterium tuberculosis H37Rv
cgugccgucggcgugcagca

SEQ ID NO: 1309306 - RNA, 18 nt, Mycobacterium tuberculosis H37Rv
cgugcgaaucgagacggc

SEQ ID NO: 1309307 - RNA, 17 nt, Mycobacterium tuberculosis H37Rv
cgugccuuccucgccgg

SEQ ID NO: 1309308 - RNA, 14 nt, Mycobacterium tuberculosis H37Rv
cgugcgcaucgucg

SEQ ID NO: 1309309 - RNA, 20 nt, Mycobacterium tuberculosis H37Rv
cgugcgauuuugugucugcu

SEQ ID NO: 1309310 - RNA, 19 nt, Mycobacterium tuberculosis H37Rv
cguugacucugcguccacc

SEQ ID NO: 1309311 - RNA, 12 nt, Mycobacterium tuberculosis H37Rv
cguugacgucaa

SEQ ID NO: 1309312 - RNA, 13 nt, Mycobacterium tuberculosis H37Rv
cguugacccggcg

SEQ ID NO: 1309313 - RNA, 13 nt, Mycobacterium tuberculosis H37Rv
cguugaacucgag

SEQ ID NO: 1309314 - RNA, 18 nt, Mycobacterium tuberculosis H37Rv
cguugaacggcaccagcg

SEQ ID NO: 1309315 - RNA, 15 nt, Mycobacterium tuberculosis H37Rv
cguugaacgcgugcu

SEQ ID NO: 1309316 - RNA, 15 nt, Mycobacterium tuberculosis H37Rv
cguugcccucggcgg

SEQ ID NO: 1309317 - RNA, 14 nt, Mycobacterium tuberculosis H37Rv
cguugccgaucugc

SEQ ID NO: 1309318 - RNA, 24 nt, Mycobacterium tuberculosis H37Rv
cguugaugccgccggagucgaaca

SEQ ID NO: 1309319 - RNA, 16 nt, Mycobacterium tuberculosis H37Rv
cguugaugucggccag

SEQ ID NO: 1309320 - RNA, 17 nt, Mycobacterium tuberculosis H37Rv
cguugaugaccaggucg

SEQ ID NO: 1309321 - RNA, 14 nt, Mycobacterium tuberculosis H37Rv
cguucggcgagcag

SEQ ID NO: 1309322 - RNA, 13 nt, Mycobacterium tuberculosis H37Rv
cguuccgcucgag

SEQ ID NO: 1309323 - RNA, 21 nt, Mycobacterium tuberculosis H37Rv
cguuccgcgacagcggcgucg

SEQ ID NO: 1309324 - RNA, 17 nt, Mycobacterium tuberculosis H37Rv
cguucccaucccucggu

SEQ ID NO: 1309325 - RNA, 19 nt, Mycobacterium tuberculosis H37Rv
cguucccgccauugccgcc

SEQ ID NO: 1309326 - RNA, 13 nt, Mycobacterium tuberculosis H37Rv
cguucccgcucgg

SEQ ID NO: 1309327 - RNA, 14 nt, Mycobacterium tuberculosis H37Rv
cguucgucgcgggu

SEQ ID NO: 1309328 - RNA, 15 nt, Mycobacterium tuberculosis H37Rv
cguucggugaucucg

SEQ ID NO: 1309329 - RNA, 13 nt, Mycobacterium tuberculosis H37Rv
cguucgggugagc

SEQ ID NO: 1309330 - RNA, 19 nt, Mycobacterium tuberculosis H37Rv
cguggugggcgcagaguca

SEQ ID NO: 1309331 - RNA, 17 nt, Mycobacterium tuberculosis H37Rv
cgugguggcguaucggg

SEQ ID NO: 1309332 - RNA, 19 nt, Mycobacterium tuberculosis H37Rv
cgugguggacgcagaguca

SEQ ID NO: 1309333 - RNA, 19 nt, Mycobacterium tuberculosis H37Rv
cguggugcuagcgccgcca

SEQ ID NO: 1309334 - RNA, 16 nt, Mycobacterium tuberculosis H37Rv
cguggugaagucggug

SEQ ID NO: 1309335 - RNA, 16 nt, Mycobacterium tuberculosis H37Rv
cguguucugaucggug

SEQ ID NO: 1309336 - RNA, 17 nt, Mycobacterium tuberculosis H37Rv
cguguucgacggcaagc

SEQ ID NO: 1309337 - RNA, 17 nt, Mycobacterium tuberculosis H37Rv
cguguucugaucggugg

SEQ ID NO: 1309338 - RNA, 20 nt, Mycobacterium tuberculosis H37Rv
cguguucgccacacccgugu

SEQ ID NO: 1309339 - RNA, 17 nt, Mycobacterium tuberculosis H37Rv
cguguuguagaaaccgg

SEQ ID NO: 1309340 - RNA, 15 nt, Mycobacterium tuberculosis H37Rv
cguucaccacgaucg

SEQ ID NO: 1309341 - RNA, 16 nt, Mycobacterium tuberculosis H37Rv
cguucaccugcgucgg

SEQ ID NO: 1309342 - RNA, 17 nt, Mycobacterium tuberculosis H37Rv
cguucaccgcagcgggu

SEQ ID NO: 1309343 - RNA, 17 nt, Mycobacterium tuberculosis H37Rv
cguucagggcauugacg

SEQ ID NO: 1309344 - RNA, 21 nt, Mycobacterium tuberculosis H37Rv
cguuaucgucggcuugcugcc

SEQ ID NO: 1309345 - RNA, 20 nt, Mycobacterium tuberculosis H37Rv
cgugccgaaaaucgcagcca

SEQ ID NO: 1309346 - RNA, 14 nt, Mycobacterium tuberculosis H37Rv
cgugccgcagcggc

SEQ ID NO: 1309347 - RNA, 15 nt, Mycobacterium tuberculosis H37Rv
cgugccgcacagcgg

SEQ ID NO: 1309348 - RNA, 15 nt, Mycobacterium tuberculosis H37Rv
cgugcccgccaccgg

SEQ ID NO: 1309349 - RNA, 17 nt, Mycobacterium tuberculosis H37Rv
cgugccacagcucgccg

SEQ ID NO: 1309350 - RNA, 13 nt, Mycobacterium tuberculosis H37Rv
cgugccacucgau

SEQ ID NO: 1309351 - RNA, 20 nt, Mycobacterium tuberculosis H37Rv
cgugcaugggacauccagau

SEQ ID NO: 1309352 - RNA, 20 nt, Mycobacterium tuberculosis H37Rv
cgugccagcaggggacgggc

SEQ ID NO: 1309353 - RNA, 18 nt, Mycobacterium tuberculosis H37Rv
cgugcagcggcgccgcca

SEQ ID NO: 1309354 - RNA, 20 nt, Mycobacterium tuberculosis H37Rv
cgugcagcggcgggcgauga

SEQ ID NO: 1309355 - RNA, 18 nt, Mycobacterium tuberculosis H37Rv
cgugcagcucggucagcg

SEQ ID NO: 1309356 - RNA, 14 nt, Mycobacterium tuberculosis H37Rv
cgugcagcucgguc

SEQ ID NO: 1309357 - RNA, 24 nt, Mycobacterium tuberculosis H37Rv
cgugcaggcgcaagguggcaugcg

SEQ ID NO: 1309358 - RNA, 20 nt, Mycobacterium tuberculosis H37Rv
cgugcagaauccguucgacg

SEQ ID NO: 1309359 - RNA, 18 nt, Mycobacterium tuberculosis H37Rv
cgugcagccauugacggu

SEQ ID NO: 1309360 - RNA, 23 nt, Mycobacterium tuberculosis H37Rv
cgugcagcacuuccaagccgacc

SEQ ID NO: 1309361 - RNA, 18 nt, Mycobacterium tuberculosis H37Rv
cgugcacgaucgcgguga

SEQ ID NO: 1309362 - RNA, 17 nt, Mycobacterium tuberculosis H37Rv
cgugcacgacgacaucg

SEQ ID NO: 1309363 - RNA, 21 nt, Mycobacterium tuberculosis H37Rv
cgugcaccagguugcaaccuu

SEQ ID NO: 1309364 - RNA, 12 nt, Mycobacterium tuberculosis H37Rv
cgugcaccagcu

SEQ ID NO: 1309365 - RNA, 21 nt, Mycobacterium tuberculosis H37Rv
cgugcaccgagccgucgucga

SEQ ID NO: 1309366 - RNA, 19 nt, Mycobacterium tuberculosis H37Rv
cgugcaccgcgaccgcgca

SEQ ID NO: 1309367 - RNA, 16 nt, Mycobacterium tuberculosis H37Rv
cgugacucggccgacg

SEQ ID NO: 1309368 - RNA, 23 nt, Mycobacterium tuberculosis H37Rv
cgugagcaguucguuccagauga

SEQ ID NO: 1309369 - RNA, 14 nt, Mycobacterium tuberculosis H37Rv
cgugacgucgucgg

SEQ ID NO: 1309370 - RNA, 20 nt, Mycobacterium tuberculosis H37Rv
cgugacgucguggcgcucgg

SEQ ID NO: 1309371 - RNA, 15 nt, Mycobacterium tuberculosis H37Rv
cgugacucggccgac

SEQ ID NO: 1309372 - RNA, 13 nt, Mycobacterium tuberculosis H37Rv
cgugacucggccg

SEQ ID NO: 1309373 - RNA, 13 nt, Mycobacterium tuberculosis H37Rv
cgugaccggcaau

SEQ ID NO: 1309374 - RNA, 21 nt, Mycobacterium tuberculosis H37Rv
cgugaccggcaaccgccgugu

SEQ ID NO: 1309375 - RNA, 12 nt, Mycobacterium tuberculosis H37Rv
cgugaccgucgg

SEQ ID NO: 1309376 - RNA, 16 nt, Mycobacterium tuberculosis H37Rv
cgugacgauucgagca

SEQ ID NO: 1309377 - RNA, 22 nt, Mycobacterium tuberculosis H37Rv
cgugauguggucggacagcguc

SEQ ID NO: 1309378 - RNA, 13 nt, Mycobacterium tuberculosis H37Rv
cgugaugucaacg

SEQ ID NO: 1309379 - RNA, 20 nt, Mycobacterium tuberculosis H37Rv
cgugaugaauucgcuugcag

SEQ ID NO: 1309380 - RNA, 20 nt, Mycobacterium tuberculosis H37Rv
cgugauggugacuucggugg

SEQ ID NO: 1309381 - RNA, 18 nt, Mycobacterium tuberculosis H37Rv
cgugagugccggcgugcg

SEQ ID NO: 1309382 - RNA, 16 nt, Mycobacterium tuberculosis H37Rv
cgugagugccggcgug

SEQ ID NO: 1309383 - RNA, 17 nt, Mycobacterium tuberculosis H37Rv
cgugauacagcucggug

SEQ ID NO: 1309384 - RNA, 22 nt, Mycobacterium tuberculosis H37Rv
cgugaucaacuuccgcagcgcc

SEQ ID NO: 1309385 - RNA, 23 nt, Mycobacterium tuberculosis H37Rv
cgugauauccuuugccgccgaac

SEQ ID NO: 1309386 - RNA, 18 nt, Mycobacterium tuberculosis H37Rv
cgugaucuucggcgaucg

SEQ ID NO: 1309387 - RNA, 17 nt, Mycobacterium tuberculosis H37Rv
cgugaucgcuggcgacc

SEQ ID NO: 1309388 - RNA, 20 nt, Mycobacterium tuberculosis H37Rv
cgugaucgaggcggcggucg

SEQ ID NO: 1309389 - RNA, 16 nt, Mycobacterium tuberculosis H37Rv
cgugaucgacgaccgu

SEQ ID NO: 1309390 - RNA, 15 nt, Mycobacterium tuberculosis H37Rv
cgugagucacccggc

SEQ ID NO: 1309391 - RNA, 13 nt, Mycobacterium tuberculosis H37Rv
cgugaucgacgac

SEQ ID NO: 1309392 - RNA, 21 nt, Mycobacterium tuberculosis H37Rv
cgucgucgcccaggcgugucg

SEQ ID NO: 1309393 - RNA, 15 nt, Mycobacterium tuberculosis H37Rv
cgucgucgaccacga

SEQ ID NO: 1309394 - RNA, 19 nt, Mycobacterium tuberculosis H37Rv
cgucgucgacacggugauc

SEQ ID NO: 1309395 - RNA, 19 nt, Mycobacterium tuberculosis H37Rv
cgucggcaaccauuagcgc

SEQ ID NO: 1309396 - RNA, 14 nt, Mycobacterium tuberculosis H37Rv
cgucggcaccagca

SEQ ID NO: 1309397 - RNA, 14 nt, Mycobacterium tuberculosis H37Rv
cgucggcagcagcg

SEQ ID NO: 1309398 - RNA, 14 nt, Mycobacterium tuberculosis H37Rv
cgucggcaucgacg

SEQ ID NO: 1309399 - RNA, 15 nt, Mycobacterium tuberculosis H37Rv
cgucguggucggcga

SEQ ID NO: 1309400 - RNA, 18 nt, Mycobacterium tuberculosis H37Rv
cgucgugguggccacgga

SEQ ID NO: 1309401 - RNA, 17 nt, Mycobacterium tuberculosis H37Rv
cgucguggggacuggca

SEQ ID NO: 1309402 - RNA, 20 nt, Mycobacterium tuberculosis H37Rv
cgucguggcgguggccgucg

SEQ ID NO: 1309403 - RNA, 21 nt, Mycobacterium tuberculosis H37Rv
cgucgugucgccgccguugcc

SEQ ID NO: 1309404 - RNA, 16 nt, Mycobacterium tuberculosis H37Rv
cgucgugaugggucac

SEQ ID NO: 1309405 - RNA, 23 nt, Mycobacterium tuberculosis H37Rv
cgucgucgccgucggugccgccg

SEQ ID NO: 1309406 - RNA, 15 nt, Mycobacterium tuberculosis H37Rv
cgucugcucggcgua

SEQ ID NO: 1309407 - RNA, 18 nt, Mycobacterium tuberculosis H37Rv
cgucuggccguugcccga

SEQ ID NO: 1309408 - RNA, 16 nt, Mycobacterium tuberculosis H37Rv
cgucugcucgccaggc

SEQ ID NO: 1309409 - RNA, 12 nt, Mycobacterium tuberculosis H37Rv
cgucugcucgcg

SEQ ID NO: 1309410 - RNA, 14 nt, Mycobacterium tuberculosis H37Rv
cgucugcucgcgca

SEQ ID NO: 1309411 - RNA, 15 nt, Mycobacterium tuberculosis H37Rv
cgucugcucggcgcu

SEQ ID NO: 1309412 - RNA, 15 nt, Mycobacterium tuberculosis H37Rv
cgucugcucaccagc

SEQ ID NO: 1309413 - RNA, 13 nt, Mycobacterium tuberculosis H37Rv
cgucugcucacca

SEQ ID NO: 1309414 - RNA, 18 nt, Mycobacterium tuberculosis H37Rv
cgucugcgaucccgaucg

SEQ ID NO: 1309415 - RNA, 22 nt, Mycobacterium tuberculosis H37Rv
cgucugcccaguguccggcgac

SEQ ID NO: 1309416 - RNA, 20 nt, Mycobacterium tuberculosis H37Rv
cgucguucaaugucguugcc

SEQ ID NO: 1309417 - RNA, 16 nt, Mycobacterium tuberculosis H37Rv
cgucguguuggccggg

SEQ ID NO: 1309418 - RNA, 19 nt, Mycobacterium tuberculosis H37Rv
cgucgugugguucacucuc

SEQ ID NO: 1309419 - RNA, 18 nt, Mycobacterium tuberculosis H37Rv
cgucguugcccgacccgc

SEQ ID NO: 1309420 - RNA, 18 nt, Mycobacterium tuberculosis H37Rv
cgucguugaggaagcccg

SEQ ID NO: 1309421 - RNA, 20 nt, Mycobacterium tuberculosis H37Rv
cgucguugagcaucaccgua

SEQ ID NO: 1309422 - RNA, 16 nt, Mycobacterium tuberculosis H37Rv
cgucugacaucgucga

SEQ ID NO: 1309423 - RNA, 15 nt, Mycobacterium tuberculosis H37Rv
cgucugacaucgucg

SEQ ID NO: 1309424 - RNA, 21 nt, Mycobacterium tuberculosis H37Rv
cgucguugggcaugucgccga

SEQ ID NO: 1309425 - RNA, 22 nt, Mycobacterium tuberculosis H37Rv
cgucguucuccauccgcacugc

SEQ ID NO: 1309426 - RNA, 13 nt, Mycobacterium tuberculosis H37Rv
cgucucggugauc

SEQ ID NO: 1309427 - RNA, 17 nt, Mycobacterium tuberculosis H37Rv
cgucuuccucggccacc

SEQ ID NO: 1309428 - RNA, 17 nt, Mycobacterium tuberculosis H37Rv
cgucuuaucggcgucgu

SEQ ID NO: 1309429 - RNA, 16 nt, Mycobacterium tuberculosis H37Rv
cgucuuaucggcgucg

SEQ ID NO: 1309430 - RNA, 21 nt, Mycobacterium tuberculosis H37Rv
cgucuucgggcucguccagca

SEQ ID NO: 1309431 - RNA, 18 nt, Mycobacterium tuberculosis H37Rv
cgucuuuggugccgagca

SEQ ID NO: 1309432 - RNA, 20 nt, Mycobacterium tuberculosis H37Rv
cgucuugcugcacgcucugc

SEQ ID NO: 1309433 - RNA, 17 nt, Mycobacterium tuberculosis H37Rv
cgucuuggcggcggugc

SEQ ID NO: 1309434 - RNA, 18 nt, Mycobacterium tuberculosis H37Rv
cgugacagcggcgaucuc

SEQ ID NO: 1309435 - RNA, 16 nt, Mycobacterium tuberculosis H37Rv
cgugacagugaccugg

SEQ ID NO: 1309436 - RNA, 16 nt, Mycobacterium tuberculosis H37Rv
cgugaaucgagcaccg

SEQ ID NO: 1309437 - RNA, 15 nt, Mycobacterium tuberculosis H37Rv
cgugaaucgagcacc

SEQ ID NO: 1309438 - RNA, 18 nt, Mycobacterium tuberculosis H37Rv
aacccguuaccgauuggc

SEQ ID NO: 1309439 - RNA, 14 nt, Mycobacterium tuberculosis H37Rv
aacccucagccgcg

SEQ ID NO: 1309440 - RNA, 19 nt, Mycobacterium tuberculosis H37Rv
cgugacccccagcagggug

SEQ ID NO: 1309441 - RNA, 21 nt, Mycobacterium tuberculosis H37Rv
cgugacccggauaucgaccac

SEQ ID NO: 1309442 - RNA, 14 nt, Mycobacterium tuberculosis H37Rv
aaccgaccgcgcug

SEQ ID NO: 1309443 - RNA, 17 nt, Mycobacterium tuberculosis H37Rv
aaccgagauggaauggc

SEQ ID NO: 1309444 - RNA, 16 nt, Mycobacterium tuberculosis H37Rv
cugcacguacucggcc

SEQ ID NO: 1309445 - RNA, 17 nt, Mycobacterium tuberculosis H37Rv
cugcacguacucggcca

SEQ ID NO: 1309446 - RNA, 21 nt, Mycobacterium tuberculosis H37Rv
cugcacuugaaauugagccgg

SEQ ID NO: 1309447 - RNA, 15 nt, Mycobacterium tuberculosis H37Rv
cugcagcccugcgca

SEQ ID NO: 1309448 - RNA, 23 nt, Mycobacterium tuberculosis H37Rv
cugcagccauucuucgaucagcg

SEQ ID NO: 1309449 - RNA, 15 nt, Mycobacterium tuberculosis H37Rv
cugcagcgccucgau

SEQ ID NO: 1309450 - RNA, 12 nt, Mycobacterium tuberculosis H37Rv
cugcaccgucac

SEQ ID NO: 1309451 - RNA, 14 nt, Mycobacterium tuberculosis H37Rv
cugcaccgauucgg

SEQ ID NO: 1309452 - RNA, 18 nt, Mycobacterium tuberculosis H37Rv
cugcaccgucagcccgac

SEQ ID NO: 1309453 - RNA, 21 nt, Mycobacterium tuberculosis H37Rv
cugcaccguuuccggcgcucc

SEQ ID NO: 1309454 - RNA, 13 nt, Mycobacterium tuberculosis H37Rv
cugcacagcagcg

SEQ ID NO: 1309455 - RNA, 13 nt, Mycobacterium tuberculosis H37Rv
cugcacagcaggc

SEQ ID NO: 1309456 - RNA, 15 nt, Mycobacterium tuberculosis H37Rv
cugcaaugccucgac

SEQ ID NO: 1309457 - RNA, 20 nt, Mycobacterium tuberculosis H37Rv
cugaugguguacacgucgcg

SEQ ID NO: 1309458 - RNA, 23 nt, Mycobacterium tuberculosis H37Rv
cugaugcguugauacgcgucgau

SEQ ID NO: 1309459 - RNA, 16 nt, Mycobacterium tuberculosis H37Rv
cugaugagcucaccgg

SEQ ID NO: 1309460 - RNA, 19 nt, Mycobacterium tuberculosis H37Rv
cugaucuuccccucggccg

SEQ ID NO: 1309461 - RNA, 14 nt, Mycobacterium tuberculosis H37Rv
cugaucugagaccu

SEQ ID NO: 1309462 - RNA, 23 nt, Mycobacterium tuberculosis H37Rv
cugauccggguggcgucaccgcc

SEQ ID NO: 1309463 - RNA, 14 nt, Mycobacterium tuberculosis H37Rv
cugaucagagcguu

SEQ ID NO: 1309464 - RNA, 17 nt, Mycobacterium tuberculosis H37Rv
cugaucgagcgccagcg

SEQ ID NO: 1309465 - RNA, 15 nt, Mycobacterium tuberculosis H37Rv
cugaucgccacccgg

SEQ ID NO: 1309466 - RNA, 17 nt, Mycobacterium tuberculosis H37Rv
cugaugucgccgguguc

SEQ ID NO: 1309467 - RNA, 17 nt, Mycobacterium tuberculosis H37Rv
cugauuaccgacaccgu

SEQ ID NO: 1309468 - RNA, 14 nt, Mycobacterium tuberculosis H37Rv
cugauugaagcccc

SEQ ID NO: 1309469 - RNA, 13 nt, Mycobacterium tuberculosis H37Rv
cugauucgcaggc

SEQ ID NO: 1309470 - RNA, 18 nt, Mycobacterium tuberculosis H37Rv
cugcccgcggugugcacg

SEQ ID NO: 1309471 - RNA, 13 nt, Mycobacterium tuberculosis H37Rv
cugcccgccagcg

SEQ ID NO: 1309472 - RNA, 16 nt, Mycobacterium tuberculosis H37Rv
cugcccgacgaccauu

SEQ ID NO: 1309473 - RNA, 18 nt, Mycobacterium tuberculosis H37Rv
cugcccgauguuacggcc

SEQ ID NO: 1309474 - RNA, 23 nt, Mycobacterium tuberculosis H37Rv
cugccccgcaucgcccaagccgu

SEQ ID NO: 1309475 - RNA, 12 nt, Mycobacterium tuberculosis H37Rv
cugcccagcaga

SEQ ID NO: 1309476 - RNA, 23 nt, Mycobacterium tuberculosis H37Rv
cugcccccggcgcggcggaccgu

SEQ ID NO: 1309477 - RNA, 13 nt, Mycobacterium tuberculosis H37Rv
cugccccagcaca

SEQ ID NO: 1309478 - RNA, 16 nt, Mycobacterium tuberculosis H37Rv
cugcccaaccggucaa

SEQ ID NO: 1309479 - RNA, 22 nt, Mycobacterium tuberculosis H37Rv
cugcccaguguccggcgacgcg

SEQ ID NO: 1309480 - RNA, 15 nt, Mycobacterium tuberculosis H37Rv
cugccagccauggcc

SEQ ID NO: 1309481 - RNA, 22 nt, Mycobacterium tuberculosis H37Rv
cugccagcguugcggagaugcc

SEQ ID NO: 1309482 - RNA, 18 nt, Mycobacterium tuberculosis H37Rv
cugccaucccgaucccgg

SEQ ID NO: 1309483 - RNA, 15 nt, Mycobacterium tuberculosis H37Rv
cugccaucacgcgcu

SEQ ID NO: 1309484 - RNA, 16 nt, Mycobacterium tuberculosis H37Rv
cugcagcgcgacccgu

SEQ ID NO: 1309485 - RNA, 21 nt, Mycobacterium tuberculosis H37Rv
cugcaggaaggcuucggugac

SEQ ID NO: 1309486 - RNA, 21 nt, Mycobacterium tuberculosis H37Rv
cugcaggcccaggcuguccga

SEQ ID NO: 1309487 - RNA, 17 nt, Mycobacterium tuberculosis H37Rv
cugcauaggcgcgguca

SEQ ID NO: 1309488 - RNA, 20 nt, Mycobacterium tuberculosis H37Rv
cugcagugacucgaucacca

SEQ ID NO: 1309489 - RNA, 14 nt, Mycobacterium tuberculosis H37Rv
cugcaguacggcca

SEQ ID NO: 1309490 - RNA, 15 nt, Mycobacterium tuberculosis H37Rv
cugcagggucgaguu

SEQ ID NO: 1309491 - RNA, 22 nt, Mycobacterium tuberculosis H37Rv
cugcagggccaauuccaugacg

SEQ ID NO: 1309492 - RNA, 16 nt, Mycobacterium tuberculosis H37Rv
cugcaucacgccgucg

SEQ ID NO: 1309493 - RNA, 18 nt, Mycobacterium tuberculosis H37Rv
cugcaugguggcgccgac

SEQ ID NO: 1309494 - RNA, 18 nt, Mycobacterium tuberculosis H37Rv
cugccacguugaucccga

SEQ ID NO: 1309495 - RNA, 19 nt, Mycobacterium tuberculosis H37Rv
cugccacguugaucccgaa

SEQ ID NO: 1309496 - RNA, 18 nt, Mycobacterium tuberculosis H37Rv
cugccaaugcugcagguu

SEQ ID NO: 1309497 - RNA, 17 nt, Mycobacterium tuberculosis H37Rv
cugccaaaagggcggca

SEQ ID NO: 1309498 - RNA, 22 nt, Mycobacterium tuberculosis H37Rv
cugccaaaagggcggcagcgag

SEQ ID NO: 1309499 - RNA, 14 nt, Mycobacterium tuberculosis H37Rv
cugccaagcgaccu

SEQ ID NO: 1309500 - RNA, 20 nt, Mycobacterium tuberculosis H37Rv
cugagcgggcaacugcagca

SEQ ID NO: 1309501 - RNA, 15 nt, Mycobacterium tuberculosis H37Rv
cugagcugccgagcg

SEQ ID NO: 1309502 - RNA, 22 nt, Mycobacterium tuberculosis H37Rv
cugagcguccgacaacgacugc

SEQ ID NO: 1309503 - RNA, 17 nt, Mycobacterium tuberculosis H37Rv
cugagcguccgacaacg

SEQ ID NO: 1309504 - RNA, 16 nt, Mycobacterium tuberculosis H37Rv
cugagcggccaucggg

SEQ ID NO: 1309505 - RNA, 16 nt, Mycobacterium tuberculosis H37Rv
cugagcgccggcaucg

SEQ ID NO: 1309506 - RNA, 16 nt, Mycobacterium tuberculosis H37Rv
cugaggaaagucaccg

SEQ ID NO: 1309507 - RNA, 13 nt, Mycobacterium tuberculosis H37Rv
cugagaugaugcg

SEQ ID NO: 1309508 - RNA, 21 nt, Mycobacterium tuberculosis H37Rv
cugagaucgcuucccggaagc

SEQ ID NO: 1309509 - RNA, 22 nt, Mycobacterium tuberculosis H37Rv
cugagccgcgaaaucaccgcug

SEQ ID NO: 1309510 - RNA, 16 nt, Mycobacterium tuberculosis H37Rv
cugagcgacugcagcg

SEQ ID NO: 1309511 - RNA, 17 nt, Mycobacterium tuberculosis H37Rv
cugagccggugcacucg

SEQ ID NO: 1309512 - RNA, 16 nt, Mycobacterium tuberculosis H37Rv
cugauccgccugccga

SEQ ID NO: 1309513 - RNA, 17 nt, Mycobacterium tuberculosis H37Rv
cugauauccggaaccgg

SEQ ID NO: 1309514 - RNA, 15 nt, Mycobacterium tuberculosis H37Rv
cugaggugcugccaa

SEQ ID NO: 1309515 - RNA, 22 nt, Mycobacterium tuberculosis H37Rv
cugagguaggacucacgcagcg

SEQ ID NO: 1309516 - RNA, 15 nt, Mycobacterium tuberculosis H37Rv
cugagucgguucagc

SEQ ID NO: 1309517 - RNA, 16 nt, Mycobacterium tuberculosis H37Rv
cugauaccaauccggc

SEQ ID NO: 1309518 - RNA, 22 nt, Mycobacterium tuberculosis H37Rv
cugacgaaucgccuaccggccu

SEQ ID NO: 1309519 - RNA, 15 nt, Mycobacterium tuberculosis H37Rv
cugacgacugggcgc

SEQ ID NO: 1309520 - RNA, 22 nt, Mycobacterium tuberculosis H37Rv
cugacgacgagggccagcagcc

SEQ ID NO: 1309521 - RNA, 14 nt, Mycobacterium tuberculosis H37Rv
cugacgauggccag

SEQ ID NO: 1309522 - RNA, 17 nt, Mycobacterium tuberculosis H37Rv
cugaccggucacccgug

SEQ ID NO: 1309523 - RNA, 22 nt, Mycobacterium tuberculosis H37Rv
cugaccggggcgcccggccagg

SEQ ID NO: 1309524 - RNA, 21 nt, Mycobacterium tuberculosis H37Rv
cugaccgucugcgacccgggc

SEQ ID NO: 1309525 - RNA, 16 nt, Mycobacterium tuberculosis H37Rv
cugacccggcgccgaa

SEQ ID NO: 1309526 - RNA, 15 nt, Mycobacterium tuberculosis H37Rv
cugagacucgucgau

SEQ ID NO: 1309527 - RNA, 14 nt, Mycobacterium tuberculosis H37Rv
cugagacucgucga

SEQ ID NO: 1309528 - RNA, 17 nt, Mycobacterium tuberculosis H37Rv
cugacuagggucaccga

SEQ ID NO: 1309529 - RNA, 22 nt, Mycobacterium tuberculosis H37Rv
cugacuagggucaccgacacgg

SEQ ID NO: 1309530 - RNA, 14 nt, Mycobacterium tuberculosis H37Rv
cugacuaccgucau

SEQ ID NO: 1309531 - RNA, 17 nt, Mycobacterium tuberculosis H37Rv
cugacuaccgucaucga

SEQ ID NO: 1309532 - RNA, 18 nt, Mycobacterium tuberculosis H37Rv
cugacuccugcggcaccg

SEQ ID NO: 1309533 - RNA, 20 nt, Mycobacterium tuberculosis H37Rv
cugacuccugcggcaccgcu

SEQ ID NO: 1309534 - RNA, 15 nt, Mycobacterium tuberculosis H37Rv
cugacggcaaacgac

SEQ ID NO: 1309535 - RNA, 22 nt, Mycobacterium tuberculosis H37Rv
cugacgcgcccgacgaacagcg

SEQ ID NO: 1309536 - RNA, 17 nt, Mycobacterium tuberculosis H37Rv
cugacgucacguucggc

SEQ ID NO: 1309537 - RNA, 23 nt, Mycobacterium tuberculosis H37Rv
cugacgguuugcggagcaagagc

SEQ ID NO: 1309538 - RNA, 21 nt, Mycobacterium tuberculosis H37Rv
cugacgucgaacucccacugc

SEQ ID NO: 1309539 - RNA, 13 nt, Mycobacterium tuberculosis H37Rv
cucugcaaugccu

SEQ ID NO: 1309540 - RNA, 20 nt, Mycobacterium tuberculosis H37Rv
cucuaucagacgauucggcg

SEQ ID NO: 1309541 - RNA, 16 nt, Mycobacterium tuberculosis H37Rv
cucucacggcgguagc

SEQ ID NO: 1309542 - RNA, 18 nt, Mycobacterium tuberculosis H37Rv
cucggcguccgcccagca

SEQ ID NO: 1309543 - RNA, 21 nt, Mycobacterium tuberculosis H37Rv
cucggcggccaccucgaaugc

SEQ ID NO: 1309544 - RNA, 18 nt, Mycobacterium tuberculosis H37Rv
cucggcgucgaguucggu

SEQ ID NO: 1309545 - RNA, 17 nt, Mycobacterium tuberculosis H37Rv
cugaaccgcugggacaa

SEQ ID NO: 1309546 - RNA, 14 nt, Mycobacterium tuberculosis H37Rv
cugaaggcggcgau

SEQ ID NO: 1309547 - RNA, 15 nt, Mycobacterium tuberculosis H37Rv
cugaaggccgguagc

SEQ ID NO: 1309548 - RNA, 13 nt, Mycobacterium tuberculosis H37Rv
cugaaggccagcc

SEQ ID NO: 1309549 - RNA, 12 nt, Mycobacterium tuberculosis H37Rv
cugaagccagcg

SEQ ID NO: 1309550 - RNA, 15 nt, Mycobacterium tuberculosis H37Rv
cugaagccgcgcugc

SEQ ID NO: 1309551 - RNA, 22 nt, Mycobacterium tuberculosis H37Rv
cugaagccgucguaugcgguga

SEQ ID NO: 1309552 - RNA, 18 nt, Mycobacterium tuberculosis H37Rv
cugacaccgauccggccg

SEQ ID NO: 1309553 - RNA, 14 nt, Mycobacterium tuberculosis H37Rv
cugacaacggccac

SEQ ID NO: 1309554 - RNA, 18 nt, Mycobacterium tuberculosis H37Rv
cugaaucguucucggucc

SEQ ID NO: 1309555 - RNA, 15 nt, Mycobacterium tuberculosis H37Rv
cucggacacgcugua

SEQ ID NO: 1309556 - RNA, 18 nt, Mycobacterium tuberculosis H37Rv
cucggagggggaccucuu

SEQ ID NO: 1309557 - RNA, 20 nt, Mycobacterium tuberculosis H37Rv
cucggagagguagggcucca

SEQ ID NO: 1309558 - RNA, 20 nt, Mycobacterium tuberculosis H37Rv
cucggagaucgagaucaccu

SEQ ID NO: 1309559 - RNA, 23 nt, Mycobacterium tuberculosis H37Rv
cucggacaaagccgucgcgacgu

SEQ ID NO: 1309560 - RNA, 15 nt, Mycobacterium tuberculosis H37Rv
cucgcuucaggcacc

SEQ ID NO: 1309561 - RNA, 15 nt, Mycobacterium tuberculosis H37Rv
cucgcuguucgggac

SEQ ID NO: 1309562 - RNA, 16 nt, Mycobacterium tuberculosis H37Rv
cucgcuguugaagccg

SEQ ID NO: 1309563 - RNA, 14 nt, Mycobacterium tuberculosis H37Rv
cucgcgggcgaucg

SEQ ID NO: 1309564 - RNA, 18 nt, Mycobacterium tuberculosis H37Rv
cucggaucggcucgccac

SEQ ID NO: 1309565 - RNA, 15 nt, Mycobacterium tuberculosis H37Rv
cucggaucgccaggc

SEQ ID NO: 1309566 - RNA, 19 nt, Mycobacterium tuberculosis H37Rv
cucggauaacgucacaccg

SEQ ID NO: 1309567 - RNA, 22 nt, Mycobacterium tuberculosis H37Rv
cucggcaggcccggaggguucg

SEQ ID NO: 1309568 - RNA, 19 nt, Mycobacterium tuberculosis H37Rv
cucggcaggaaggacaucg

SEQ ID NO: 1309569 - RNA, 22 nt, Mycobacterium tuberculosis H37Rv
cucggcacggucgcccgaucgg

SEQ ID NO: 1309570 - RNA, 14 nt, Mycobacterium tuberculosis H37Rv
cucggccgacgaga

SEQ ID NO: 1309571 - RNA, 13 nt, Mycobacterium tuberculosis H37Rv
cucggccgccagc

SEQ ID NO: 1309572 - RNA, 17 nt, Mycobacterium tuberculosis H37Rv
cucggccaucagaaccu

SEQ ID NO: 1309573 - RNA, 22 nt, Mycobacterium tuberculosis H37Rv
cucggccugcugcugcagcgau

SEQ ID NO: 1309574 - RNA, 13 nt, Mycobacterium tuberculosis H37Rv
cucggccugguca

SEQ ID NO: 1309575 - RNA, 23 nt, Mycobacterium tuberculosis H37Rv
cucggccgugugcucgaaggacc

SEQ ID NO: 1309576 - RNA, 21 nt, Mycobacterium tuberculosis H37Rv
cucggccgugaccgagccgcg

SEQ ID NO: 1309577 - RNA, 15 nt, Mycobacterium tuberculosis H37Rv
cucggcggccagcgc

SEQ ID NO: 1309578 - RNA, 14 nt, Mycobacterium tuberculosis H37Rv
cucggcggccagcu

SEQ ID NO: 1309579 - RNA, 19 nt, Mycobacterium tuberculosis H37Rv
cucggcggccagcucccgc

SEQ ID NO: 1309580 - RNA, 14 nt, Mycobacterium tuberculosis H37Rv
cucggcggccagcg

SEQ ID NO: 1309581 - RNA, 18 nt, Mycobacterium tuberculosis H37Rv
cucggcggugccgcggcu

SEQ ID NO: 1309582 - RNA, 22 nt, Mycobacterium tuberculosis H37Rv
cucggcgcucaugggcgccauc

SEQ ID NO: 1309583 - RNA, 17 nt, Mycobacterium tuberculosis H37Rv
cucggcgcugcgcaccg

SEQ ID NO: 1309584 - RNA, 14 nt, Mycobacterium tuberculosis H37Rv
cucggcggaagacc

SEQ ID NO: 1309585 - RNA, 18 nt, Mycobacterium tuberculosis H37Rv
cucggcggacccggugac

SEQ ID NO: 1309586 - RNA, 17 nt, Mycobacterium tuberculosis H37Rv
cucggcggacccgguga

SEQ ID NO: 1309587 - RNA, 22 nt, Mycobacterium tuberculosis H37Rv
cucgccgggaaacaccggcuug

SEQ ID NO: 1309588 - RNA, 15 nt, Mycobacterium tuberculosis H37Rv
cucgccggucagcgu

SEQ ID NO: 1309589 - RNA, 16 nt, Mycobacterium tuberculosis H37Rv
cucgccggugcgcgcu

SEQ ID NO: 1309590 - RNA, 19 nt, Mycobacterium tuberculosis H37Rv
cucgccggugcgcgcugac

SEQ ID NO: 1309591 - RNA, 14 nt, Mycobacterium tuberculosis H37Rv
cucgccggugacgg

SEQ ID NO: 1309592 - RNA, 18 nt, Mycobacterium tuberculosis H37Rv
cucgccguaagcaccagc

SEQ ID NO: 1309593 - RNA, 16 nt, Mycobacterium tuberculosis H37Rv
cucgccugagcgcucg

SEQ ID NO: 1309594 - RNA, 15 nt, Mycobacterium tuberculosis H37Rv
cucgcgcaccgucau

SEQ ID NO: 1309595 - RNA, 13 nt, Mycobacterium tuberculosis H37Rv
cucgccgugacca

SEQ ID NO: 1309596 - RNA, 17 nt, Mycobacterium tuberculosis H37Rv
cucgcgcacgucgacga

SEQ ID NO: 1309597 - RNA, 20 nt, Mycobacterium tuberculosis H37Rv
cucgcgcaccugaucgguca

SEQ ID NO: 1309598 - RNA, 16 nt, Mycobacterium tuberculosis H37Rv
cucgcggccggcgucg

SEQ ID NO: 1309599 - RNA, 21 nt, Mycobacterium tuberculosis H37Rv
cucgcgccaggucggugacga

SEQ ID NO: 1309600 - RNA, 12 nt, Mycobacterium tuberculosis H37Rv
cucgcggcguuc

SEQ ID NO: 1309601 - RNA, 22 nt, Mycobacterium tuberculosis H37Rv
cucgcgggcagggccucggucg

SEQ ID NO: 1309602 - RNA, 23 nt, Mycobacterium tuberculosis H37Rv
cucgccgaccagcuugaccgacc

SEQ ID NO: 1309603 - RNA, 21 nt, Mycobacterium tuberculosis H37Rv
cucgccgagcugugcgcagac

SEQ ID NO: 1309604 - RNA, 20 nt, Mycobacterium tuberculosis H37Rv
cucgccgaaaucggccagcu

SEQ ID NO: 1309605 - RNA, 13 nt, Mycobacterium tuberculosis H37Rv
cucgccgaccagc

SEQ ID NO: 1309606 - RNA, 21 nt, Mycobacterium tuberculosis H37Rv
cucgcauaugccgccggcagc

SEQ ID NO: 1309607 - RNA, 23 nt, Mycobacterium tuberculosis H37Rv
cucgcccugacgucacguucggc

SEQ ID NO: 1309608 - RNA, 23 nt, Mycobacterium tuberculosis H37Rv
cucgccggcgaagaccgccggga

SEQ ID NO: 1309609 - RNA, 14 nt, Mycobacterium tuberculosis H37Rv
cucgccggccaacu

SEQ ID NO: 1309610 - RNA, 23 nt, Mycobacterium tuberculosis H37Rv
cucgcaccgugaguacucgguca

SEQ ID NO: 1309611 - RNA, 21 nt, Mycobacterium tuberculosis H37Rv
cucgcacgacaccucgaaggc

SEQ ID NO: 1309612 - RNA, 20 nt, Mycobacterium tuberculosis H37Rv
cucgcagcauguccgcagcg

SEQ ID NO: 1309613 - RNA, 12 nt, Mycobacterium tuberculosis H37Rv
cucgaucggcag

SEQ ID NO: 1309614 - RNA, 17 nt, Mycobacterium tuberculosis H37Rv
cucgaucgcguucugca

SEQ ID NO: 1309615 - RNA, 12 nt, Mycobacterium tuberculosis H37Rv
cucgaucgucga

SEQ ID NO: 1309616 - RNA, 13 nt, Mycobacterium tuberculosis H37Rv
cucgaucgucgac

SEQ ID NO: 1309617 - RNA, 19 nt, Mycobacterium tuberculosis H37Rv
cucgaucaucgggagccgc

SEQ ID NO: 1309618 - RNA, 15 nt, Mycobacterium tuberculosis H37Rv
cucgacguaggccag

SEQ ID NO: 1309619 - RNA, 17 nt, Mycobacterium tuberculosis H37Rv
cucgacguagucgcgca

SEQ ID NO: 1309620 - RNA, 19 nt, Mycobacterium tuberculosis H37Rv
cucgaggacggcguagacg

SEQ ID NO: 1309621 - RNA, 13 nt, Mycobacterium tuberculosis H37Rv
cucgaggaccacc

SEQ ID NO: 1309622 - RNA, 17 nt, Mycobacterium tuberculosis H37Rv
cucgacacccagccgca

SEQ ID NO: 1309623 - RNA, 15 nt, Mycobacterium tuberculosis H37Rv
cucgacggugaccgg

SEQ ID NO: 1309624 - RNA, 12 nt, Mycobacterium tuberculosis H37Rv
cucgacggugac

SEQ ID NO: 1309625 - RNA, 14 nt, Mycobacterium tuberculosis H37Rv
cucgacggucaucg

SEQ ID NO: 1309626 - RNA, 16 nt, Mycobacterium tuberculosis H37Rv
cucgacggcccgccgu

SEQ ID NO: 1309627 - RNA, 14 nt, Mycobacterium tuberculosis H37Rv
cucgaccgcgacgg

SEQ ID NO: 1309628 - RNA, 22 nt, Mycobacterium tuberculosis H37Rv
cucgaccgccagcccggugaug

SEQ ID NO: 1309629 - RNA, 12 nt, Mycobacterium tuberculosis H37Rv
cucgacaaccgc

SEQ ID NO: 1309630 - RNA, 12 nt, Mycobacterium tuberculosis H37Rv
cucgaccgcguc

SEQ ID NO: 1309631 - RNA, 16 nt, Mycobacterium tuberculosis H37Rv
cucgaccugaggcacc

SEQ ID NO: 1309632 - RNA, 17 nt, Mycobacterium tuberculosis H37Rv
cucgaccgucaccggaa

SEQ ID NO: 1309633 - RNA, 14 nt, Mycobacterium tuberculosis H37Rv
cucccaugaucgcc

SEQ ID NO: 1309634 - RNA, 21 nt, Mycobacterium tuberculosis H37Rv
cuccggagcccacacgcucac

SEQ ID NO: 1309635 - RNA, 14 nt, Mycobacterium tuberculosis H37Rv
cuccgggaccaggc

SEQ ID NO: 1309636 - RNA, 16 nt, Mycobacterium tuberculosis H37Rv
cuccggcaagcacacc

SEQ ID NO: 1309637 - RNA, 20 nt, Mycobacterium tuberculosis H37Rv
cucccaucccaugucgagga

SEQ ID NO: 1309638 - RNA, 21 nt, Mycobacterium tuberculosis H37Rv
cucccagugagcaugcgacgu

SEQ ID NO: 1309639 - RNA, 16 nt, Mycobacterium tuberculosis H37Rv
cucccagccaacccgu

SEQ ID NO: 1309640 - RNA, 22 nt, Mycobacterium tuberculosis H37Rv
cucccacagguagaccgucucc

SEQ ID NO: 1309641 - RNA, 17 nt, Mycobacterium tuberculosis H37Rv
cuccaugauccagccau

SEQ ID NO: 1309642 - RNA, 20 nt, Mycobacterium tuberculosis H37Rv
cuccuggcggguggcgauga

SEQ ID NO: 1309643 - RNA, 14 nt, Mycobacterium tuberculosis H37Rv
cuccucgaccgugg

SEQ ID NO: 1309644 - RNA, 21 nt, Mycobacterium tuberculosis H37Rv
cuccucgaauucgcgcucugg

SEQ ID NO: 1309645 - RNA, 22 nt, Mycobacterium tuberculosis H37Rv
cuccucgauagcggcgccugac

SEQ ID NO: 1309646 - RNA, 15 nt, Mycobacterium tuberculosis H37Rv
cuccgggcgcucggu

SEQ ID NO: 1309647 - RNA, 19 nt, Mycobacterium tuberculosis H37Rv
cuccggguauggcggcgac

SEQ ID NO: 1309648 - RNA, 17 nt, Mycobacterium tuberculosis H37Rv
cuccggguuggcgacga

SEQ ID NO: 1309649 - RNA, 19 nt, Mycobacterium tuberculosis H37Rv
cuccgggaugaagcucgac

SEQ ID NO: 1309650 - RNA, 14 nt, Mycobacterium tuberculosis H37Rv
cuccgggucgacga

SEQ ID NO: 1309651 - RNA, 15 nt, Mycobacterium tuberculosis H37Rv
cuccuccccgaccgc

SEQ ID NO: 1309652 - RNA, 14 nt, Mycobacterium tuberculosis H37Rv
cuccuccggcacca

SEQ ID NO: 1309653 - RNA, 20 nt, Mycobacterium tuberculosis H37Rv
cuccguugcccccauugccg

SEQ ID NO: 1309654 - RNA, 16 nt, Mycobacterium tuberculosis H37Rv
cuaucgcagaacggac

SEQ ID NO: 1309655 - RNA, 15 nt, Mycobacterium tuberculosis H37Rv
cuauccggcggccag

SEQ ID NO: 1309656 - RNA, 17 nt, Mycobacterium tuberculosis H37Rv
cuaugucauagcgcacc

SEQ ID NO: 1309657 - RNA, 23 nt, Mycobacterium tuberculosis H37Rv
cuauuccgaauuaccuugcgguu

SEQ ID NO: 1309658 - RNA, 17 nt, Mycobacterium tuberculosis H37Rv
cuauggucaaccgcgcc

SEQ ID NO: 1309659 - RNA, 20 nt, Mycobacterium tuberculosis H37Rv
cuaugggucguugucggggu

SEQ ID NO: 1309660 - RNA, 22 nt, Mycobacterium tuberculosis H37Rv
cuauggcggcuucgacgucggc

SEQ ID NO: 1309661 - RNA, 24 nt, Mycobacterium tuberculosis H37Rv
cucaaccagcagacgccguagccg

SEQ ID NO: 1309662 - RNA, 20 nt, Mycobacterium tuberculosis H37Rv
cucaacgggaccgaucuugg

SEQ ID NO: 1309663 - RNA, 20 nt, Mycobacterium tuberculosis H37Rv
cucaagguccagcgauccgg

SEQ ID NO: 1309664 - RNA, 12 nt, Mycobacterium tuberculosis H37Rv
cucaaggcggcc

SEQ ID NO: 1309665 - RNA, 18 nt, Mycobacterium tuberculosis H37Rv
cucaaguugggcguucag

SEQ ID NO: 1309666 - RNA, 19 nt, Mycobacterium tuberculosis H37Rv
cucaaguugguucaccgcg

SEQ ID NO: 1309667 - RNA, 18 nt, Mycobacterium tuberculosis H37Rv
cucaagcgaagagcgcac

SEQ ID NO: 1309668 - RNA, 14 nt, Mycobacterium tuberculosis H37Rv
cucaacaccagcaa

SEQ ID NO: 1309669 - RNA, 21 nt, Mycobacterium tuberculosis H37Rv
cuauuucgcggauuucucgcc

SEQ ID NO: 1309670 - RNA, 20 nt, Mycobacterium tuberculosis H37Rv
cuauugcuauuccgcggcac

SEQ ID NO: 1309671 - RNA, 22 nt, Mycobacterium tuberculosis H37Rv
cuacggggaucuauuggaugcg

SEQ ID NO: 1309672 - RNA, 21 nt, Mycobacterium tuberculosis H37Rv
cuacgucggcucgucgcucga

SEQ ID NO: 1309673 - RNA, 20 nt, Mycobacterium tuberculosis H37Rv
cguugccgcggucggcgacg

SEQ ID NO: 1309674 - RNA, 16 nt, Mycobacterium tuberculosis H37Rv
cguugccggugccgcc

SEQ ID NO: 1309675 - RNA, 23 nt, Mycobacterium tuberculosis H37Rv
cguugccgccaucaccgccguua

SEQ ID NO: 1309676 - RNA, 16 nt, Mycobacterium tuberculosis H37Rv
cguugccgccgucccc

SEQ ID NO: 1309677 - RNA, 22 nt, Mycobacterium tuberculosis H37Rv
cguugccgccggugccacccuu

SEQ ID NO: 1309678 - RNA, 18 nt, Mycobacterium tuberculosis H37Rv
cguugccgccaucaccgc

SEQ ID NO: 1309679 - RNA, 20 nt, Mycobacterium tuberculosis H37Rv
cguugccgaucugcucgccg

SEQ ID NO: 1309680 - RNA, 16 nt, Mycobacterium tuberculosis H37Rv
cguugccgaccgucac

SEQ ID NO: 1309681 - RNA, 14 nt, Mycobacterium tuberculosis H37Rv
cguugccgcagacg

SEQ ID NO: 1309682 - RNA, 23 nt, Mycobacterium tuberculosis H37Rv
cguugccgccacgggcggccacc

SEQ ID NO: 1309683 - RNA, 19 nt, Mycobacterium tuberculosis H37Rv
cuagccgacagcucaucga

SEQ ID NO: 1309684 - RNA, 13 nt, Mycobacterium tuberculosis H37Rv
cuagcaccgcgcc

SEQ ID NO: 1309685 - RNA, 16 nt, Mycobacterium tuberculosis H37Rv
cuagaucgccgagcgu

SEQ ID NO: 1309686 - RNA, 21 nt, Mycobacterium tuberculosis H37Rv
cuagccccugaaggccagcca

SEQ ID NO: 1309687 - RNA, 20 nt, Mycobacterium tuberculosis H37Rv
cuagcagcagcccgacagug

SEQ ID NO: 1309688 - RNA, 22 nt, Mycobacterium tuberculosis H37Rv
cuagccagggaucagccgugcg

SEQ ID NO: 1309689 - RNA, 20 nt, Mycobacterium tuberculosis H37Rv
cucagcuccggcgacucugu

SEQ ID NO: 1309690 - RNA, 18 nt, Mycobacterium tuberculosis H37Rv
cucagcccgucagccgau

SEQ ID NO: 1309691 - RNA, 22 nt, Mycobacterium tuberculosis H37Rv
cucacguggacugaccucguca

SEQ ID NO: 1309692 - RNA, 22 nt, Mycobacterium tuberculosis H37Rv
cucacguugugagccacgcgca

SEQ ID NO: 1309693 - RNA, 17 nt, Mycobacterium tuberculosis H37Rv
cucaccaaggucggcga

SEQ ID NO: 1309694 - RNA, 20 nt, Mycobacterium tuberculosis H37Rv
cucaccacgucgaccgaacc

SEQ ID NO: 1309695 - RNA, 18 nt, Mycobacterium tuberculosis H37Rv
cucaccacccagauugcc

SEQ ID NO: 1309696 - RNA, 17 nt, Mycobacterium tuberculosis H37Rv
cucaccagccgucagcg

SEQ ID NO: 1309697 - RNA, 20 nt, Mycobacterium tuberculosis H37Rv
cucacgaggcacaaucaccg

SEQ ID NO: 1309698 - RNA, 19 nt, Mycobacterium tuberculosis H37Rv
cucacgccaaguccgcuca

SEQ ID NO: 1309699 - RNA, 16 nt, Mycobacterium tuberculosis H37Rv
cucacgaagaccgcgu

SEQ ID NO: 1309700 - RNA, 20 nt, Mycobacterium tuberculosis H37Rv
cucaccgggcccgacgacga

SEQ ID NO: 1309701 - RNA, 11 nt, Mycobacterium tuberculosis H37Rv
cucaccgccgc

SEQ ID NO: 1309702 - RNA, 18 nt, Mycobacterium tuberculosis H37Rv
cucaccgaucucgaccag

SEQ ID NO: 1309703 - RNA, 18 nt, Mycobacterium tuberculosis H37Rv
cuccacuuucugcgguca

SEQ ID NO: 1309704 - RNA, 23 nt, Mycobacterium tuberculosis H37Rv
cuccacggucaggcguagguccu

SEQ ID NO: 1309705 - RNA, 19 nt, Mycobacterium tuberculosis H37Rv
cuccacggcgggaacggug

SEQ ID NO: 1309706 - RNA, 13 nt, Mycobacterium tuberculosis H37Rv
cuccacgaucggc

SEQ ID NO: 1309707 - RNA, 16 nt, Mycobacterium tuberculosis H37Rv
cuccacgccguugauc

SEQ ID NO: 1309708 - RNA, 15 nt, Mycobacterium tuberculosis H37Rv
cuccaccgucgccgc

SEQ ID NO: 1309709 - RNA, 16 nt, Mycobacterium tuberculosis H37Rv
cuccaacugaucccgu

SEQ ID NO: 1309710 - RNA, 16 nt, Mycobacterium tuberculosis H37Rv
cuccaauugcgcugaa

SEQ ID NO: 1309711 - RNA, 21 nt, Mycobacterium tuberculosis H37Rv
cuccaagccgggugggagcag

SEQ ID NO: 1309712 - RNA, 21 nt, Mycobacterium tuberculosis H37Rv
cuccaagcgcgguugcgcuac

SEQ ID NO: 1309713 - RNA, 17 nt, Mycobacterium tuberculosis H37Rv
cuccaaggcggucacca

SEQ ID NO: 1309714 - RNA, 19 nt, Mycobacterium tuberculosis H37Rv
cucauugccguucucgucg

SEQ ID NO: 1309715 - RNA, 22 nt, Mycobacterium tuberculosis H37Rv
cuccacuuuuccgccggccagg

SEQ ID NO: 1309716 - RNA, 21 nt, Mycobacterium tuberculosis H37Rv
cuccaggaucucuucucggcu

SEQ ID NO: 1309717 - RNA, 14 nt, Mycobacterium tuberculosis H37Rv
cuccagcucggcca

SEQ ID NO: 1309718 - RNA, 21 nt, Mycobacterium tuberculosis H37Rv
cuccaguagccggugccggcg

SEQ ID NO: 1309719 - RNA, 17 nt, Mycobacterium tuberculosis H37Rv
cuccaguagccggugcc

SEQ ID NO: 1309720 - RNA, 17 nt, Mycobacterium tuberculosis H37Rv
cuccaggccuaguccgg

SEQ ID NO: 1309721 - RNA, 17 nt, Mycobacterium tuberculosis H37Rv
cuccaggggcuggugcu

SEQ ID NO: 1309722 - RNA, 16 nt, Mycobacterium tuberculosis H37Rv
acgcaacucgacgcgu

SEQ ID NO: 1309723 - RNA, 20 nt, Mycobacterium tuberculosis H37Rv
acgcaaaaucgcccaauuuc

SEQ ID NO: 1309724 - RNA, 19 nt, Mycobacterium tuberculosis H37Rv
acgcaaaaucgcccaauuc

SEQ ID NO: 1309725 - RNA, 17 nt, Mycobacterium tuberculosis H37Rv
acgcaaaaucgcacggu

SEQ ID NO: 1309726 - RNA, 14 nt, Mycobacterium tuberculosis H37Rv
acgauuucggccca

SEQ ID NO: 1309727 - RNA, 18 nt, Mycobacterium tuberculosis H37Rv
acgcacaauacggucagc

SEQ ID NO: 1309728 - RNA, 21 nt, Mycobacterium tuberculosis H37Rv
acgcacacaccguaccgacga

SEQ ID NO: 1309729 - RNA, 14 nt, Mycobacterium tuberculosis H37Rv
acgcaaucgucgcc

SEQ ID NO: 1309730 - RNA, 17 nt, Mycobacterium tuberculosis H37Rv
acgcaccacgagcagcc

SEQ ID NO: 1309731 - RNA, 22 nt, Mycobacterium tuberculosis H37Rv
acgcacucggggcugucggcga

SEQ ID NO: 1309732 - RNA, 17 nt, Mycobacterium tuberculosis H37Rv
acgcacgucgaggcggc

SEQ ID NO: 1309733 - RNA, 18 nt, Mycobacterium tuberculosis H37Rv
acgcacgcccgccugcag

SEQ ID NO: 1309734 - RNA, 21 nt, Mycobacterium tuberculosis H37Rv
acgcacgacugugcgccgcag

SEQ ID NO: 1309735 - RNA, 21 nt, Mycobacterium tuberculosis H37Rv
acgcaccgaugccuugaccgc

SEQ ID NO: 1309736 - RNA, 17 nt, Mycobacterium tuberculosis H37Rv
acgcaccgaaacgccga

SEQ ID NO: 1309737 - RNA, 19 nt, Mycobacterium tuberculosis H37Rv
acgaucgccaggccgagcc

SEQ ID NO: 1309738 - RNA, 18 nt, Mycobacterium tuberculosis H37Rv
acgaucccgugauccgcc

SEQ ID NO: 1309739 - RNA, 23 nt, Mycobacterium tuberculosis H37Rv
acgaucgagcccggagcggucag

SEQ ID NO: 1309740 - RNA, 20 nt, Mycobacterium tuberculosis H37Rv
acgauagcggcccgaucacc

SEQ ID NO: 1309741 - RNA, 22 nt, Mycobacterium tuberculosis H37Rv
acgaucauugcacccaccccga

SEQ ID NO: 1309742 - RNA, 14 nt, Mycobacterium tuberculosis H37Rv
acgauccacggcga

SEQ ID NO: 1309743 - RNA, 13 nt, Mycobacterium tuberculosis H37Rv
acgauagcggccc

SEQ ID NO: 1309744 - RNA, 16 nt, Mycobacterium tuberculosis H37Rv
acgaugucgucgauga

SEQ ID NO: 1309745 - RNA, 14 nt, Mycobacterium tuberculosis H37Rv
acgauguccucgau

SEQ ID NO: 1309746 - RNA, 17 nt, Mycobacterium tuberculosis H37Rv
acgaugguggcgaucau

SEQ ID NO: 1309747 - RNA, 19 nt, Mycobacterium tuberculosis H37Rv
acgaugugguccaucgcgc

SEQ ID NO: 1309748 - RNA, 15 nt, Mycobacterium tuberculosis H37Rv
acgaugugcccgcca

SEQ ID NO: 1309749 - RNA, 14 nt, Mycobacterium tuberculosis H37Rv
acgaugugcacggu

SEQ ID NO: 1309750 - RNA, 15 nt, Mycobacterium tuberculosis H37Rv
acgagaagacaccgc

SEQ ID NO: 1309751 - RNA, 21 nt, Mycobacterium tuberculosis H37Rv
acgacugcguuccgaucggca

SEQ ID NO: 1309752 - RNA, 22 nt, Mycobacterium tuberculosis H37Rv
acgacugcggcaaacgugauca

SEQ ID NO: 1309753 - RNA, 22 nt, Mycobacterium tuberculosis H37Rv
acgacgucggccgcaucgccca

SEQ ID NO: 1309754 - RNA, 14 nt, Mycobacterium tuberculosis H37Rv
acgacgucggcguu

SEQ ID NO: 1309755 - RNA, 19 nt, Mycobacterium tuberculosis H37Rv
acgacgucggugaacgcgu

SEQ ID NO: 1309756 - RNA, 14 nt, Mycobacterium tuberculosis H37Rv
acgacgucgucgcc

SEQ ID NO: 1309757 - RNA, 15 nt, Mycobacterium tuberculosis H37Rv
acgaguagccggucg

SEQ ID NO: 1309758 - RNA, 15 nt, Mycobacterium tuberculosis H37Rv
acgaggcuugcggca

SEQ ID NO: 1309759 - RNA, 18 nt, Mycobacterium tuberculosis H37Rv
acgagggccagcagccgc

SEQ ID NO: 1309760 - RNA, 22 nt, Mycobacterium tuberculosis H37Rv
acgaggcguucaccacgaucgc

SEQ ID NO: 1309761 - RNA, 15 nt, Mycobacterium tuberculosis H37Rv
acgagacgacgaccg

SEQ ID NO: 1309762 - RNA, 15 nt, Mycobacterium tuberculosis H37Rv
acgagcuuccacgcc

SEQ ID NO: 1309763 - RNA, 18 nt, Mycobacterium tuberculosis H37Rv
acgagcuguacuugggau

SEQ ID NO: 1309764 - RNA, 14 nt, Mycobacterium tuberculosis H37Rv
acgaggacgucacc

SEQ ID NO: 1309765 - RNA, 16 nt, Mycobacterium tuberculosis H37Rv
acgaggaugucgauga

SEQ ID NO: 1309766 - RNA, 21 nt, Mycobacterium tuberculosis H37Rv
acgacguagaugguggucacc

SEQ ID NO: 1309767 - RNA, 19 nt, Mycobacterium tuberculosis H37Rv
acgacguccucgacgauca

SEQ ID NO: 1309768 - RNA, 23 nt, Mycobacterium tuberculosis H37Rv
acgacgggccgaguucgucagcg

SEQ ID NO: 1309769 - RNA, 22 nt, Mycobacterium tuberculosis H37Rv
acgacgggaaccagcggucggc

SEQ ID NO: 1309770 - RNA, 19 nt, Mycobacterium tuberculosis H37Rv
acgacgccggccuggccgc

SEQ ID NO: 1309771 - RNA, 20 nt, Mycobacterium tuberculosis H37Rv
acgaccuccucgaugaccgg

SEQ ID NO: 1309772 - RNA, 13 nt, Mycobacterium tuberculosis H37Rv
acgacgacaccgc

SEQ ID NO: 1309773 - RNA, 19 nt, Mycobacterium tuberculosis H37Rv
acgacgacccgacguagcc

SEQ ID NO: 1309774 - RNA, 22 nt, Mycobacterium tuberculosis H37Rv
acgacgaucaagccuucgucga

SEQ ID NO: 1309775 - RNA, 13 nt, Mycobacterium tuberculosis H37Rv
acgaccgccgaua

SEQ ID NO: 1309776 - RNA, 17 nt, Mycobacterium tuberculosis H37Rv
acgacccgaagccgacc

SEQ ID NO: 1309777 - RNA, 16 nt, Mycobacterium tuberculosis H37Rv
acgacccgacguagcc

SEQ ID NO: 1309778 - RNA, 20 nt, Mycobacterium tuberculosis H37Rv
acgacccgggucggcacgac

SEQ ID NO: 1309779 - RNA, 16 nt, Mycobacterium tuberculosis H37Rv
acgacaggcgcccaca

SEQ ID NO: 1309780 - RNA, 16 nt, Mycobacterium tuberculosis H37Rv
acgacaccagaucguu

SEQ ID NO: 1309781 - RNA, 15 nt, Mycobacterium tuberculosis H37Rv
acgacaccucgaagg

SEQ ID NO: 1309782 - RNA, 15 nt, Mycobacterium tuberculosis H37Rv
acgaaugaucguccc

SEQ ID NO: 1309783 - RNA, 17 nt, Mycobacterium tuberculosis H37Rv
acgaauguccgcagacg

SEQ ID NO: 1309784 - RNA, 22 nt, Mycobacterium tuberculosis H37Rv
acgaauaacgcggucggcagcg

SEQ ID NO: 1309785 - RNA, 20 nt, Mycobacterium tuberculosis H37Rv
acgaagucgacgaacucgcc

SEQ ID NO: 1309786 - RNA, 22 nt, Mycobacterium tuberculosis H37Rv
acgaagggaaggacgcgcagca

SEQ ID NO: 1309787 - RNA, 14 nt, Mycobacterium tuberculosis H37Rv
accuugaucgagca

SEQ ID NO: 1309788 - RNA, 18 nt, Mycobacterium tuberculosis H37Rv
accugcagcgcauccggu

SEQ ID NO: 1309789 - RNA, 15 nt, Mycobacterium tuberculosis H37Rv
accuuguggacccgc

SEQ ID NO: 1309790 - RNA, 23 nt, Mycobacterium tuberculosis H37Rv
accuuggcugggcccgccgucac

SEQ ID NO: 1309791 - RNA, 13 nt, Mycobacterium tuberculosis H37Rv
accuuggucgcca

SEQ ID NO: 1309792 - RNA, 18 nt, Mycobacterium tuberculosis H37Rv
acgaaccggaucaucgcc

SEQ ID NO: 1309793 - RNA, 21 nt, Mycobacterium tuberculosis H37Rv
acgaaccgggacaaccgcgcc

SEQ ID NO: 1309794 - RNA, 17 nt, Mycobacterium tuberculosis H37Rv
acgaacgccgucgacgc

SEQ ID NO: 1309795 - RNA, 21 nt, Mycobacterium tuberculosis H37Rv
acgaacgcgccggucagcaau

SEQ ID NO: 1309796 - RNA, 22 nt, Mycobacterium tuberculosis H37Rv
acgaacgggugaaggaugcggc

SEQ ID NO: 1309797 - RNA, 23 nt, Mycobacterium tuberculosis H37Rv
acgaagaacaccuugggcagcuu

SEQ ID NO: 1309798 - RNA, 13 nt, Mycobacterium tuberculosis H37Rv
acgaacucaccgc

SEQ ID NO: 1309799 - RNA, 17 nt, Mycobacterium tuberculosis H37Rv
acgaagaucuucaccgg

SEQ ID NO: 1309800 - RNA, 20 nt, Mycobacterium tuberculosis H37Rv
acgaagaucgcgugccacag

SEQ ID NO: 1309801 - RNA, 16 nt, Mycobacterium tuberculosis H37Rv
acgaacagcgucaacc

SEQ ID NO: 1309802 - RNA, 22 nt, Mycobacterium tuberculosis H37Rv
acgaaauugggcgauucugcgu

SEQ ID NO: 1309803 - RNA, 16 nt, Mycobacterium tuberculosis H37Rv
accggugcgcauccgu

SEQ ID NO: 1309804 - RNA, 22 nt, Mycobacterium tuberculosis H37Rv
accggugcucgucgagcaugcg

SEQ ID NO: 1309805 - RNA, 16 nt, Mycobacterium tuberculosis H37Rv
accggucuggcgauga

SEQ ID NO: 1309806 - RNA, 17 nt, Mycobacterium tuberculosis H37Rv
accggugaccucgguau

SEQ ID NO: 1309807 - RNA, 15 nt, Mycobacterium tuberculosis H37Rv
accggugagcaccgg

SEQ ID NO: 1309808 - RNA, 15 nt, Mycobacterium tuberculosis H37Rv
accgguucggugagc

SEQ ID NO: 1309809 - RNA, 16 nt, Mycobacterium tuberculosis H37Rv
accgguugcggucauc

SEQ ID NO: 1309810 - RNA, 17 nt, Mycobacterium tuberculosis H37Rv
accgguggccaucgcgc

SEQ ID NO: 1309811 - RNA, 22 nt, Mycobacterium tuberculosis H37Rv
accgguggcagccugcugcaca

SEQ ID NO: 1309812 - RNA, 16 nt, Mycobacterium tuberculosis H37Rv
accgguggcagccugc

SEQ ID NO: 1309813 - RNA, 21 nt, Mycobacterium tuberculosis H37Rv
accggugcugucgacgucggc

SEQ ID NO: 1309814 - RNA, 17 nt, Mycobacterium tuberculosis H37Rv
accggugguagcgacga

SEQ ID NO: 1309815 - RNA, 13 nt, Mycobacterium tuberculosis H37Rv
accgguagucgcc

SEQ ID NO: 1309816 - RNA, 15 nt, Mycobacterium tuberculosis H37Rv
accgguagucgccgu

SEQ ID NO: 1309817 - RNA, 19 nt, Mycobacterium tuberculosis H37Rv
accgggugugcgucgaggu

SEQ ID NO: 1309818 - RNA, 12 nt, Mycobacterium tuberculosis H37Rv
accgguacccgu

SEQ ID NO: 1309819 - RNA, 20 nt, Mycobacterium tuberculosis H37Rv
accgguaccgaucagcaggg

SEQ ID NO: 1309820 - RNA, 16 nt, Mycobacterium tuberculosis H37Rv
accgguaucgccaaau

SEQ ID NO: 1309821 - RNA, 18 nt, Mycobacterium tuberculosis H37Rv
accggucagcgcgcggcu

SEQ ID NO: 1309822 - RNA, 14 nt, Mycobacterium tuberculosis H37Rv
accggucaccgcgc

SEQ ID NO: 1309823 - RNA, 13 nt, Mycobacterium tuberculosis H37Rv
accggucaacgug

SEQ ID NO: 1309824 - RNA, 21 nt, Mycobacterium tuberculosis H37Rv
accggucgaagagguggggca

SEQ ID NO: 1309825 - RNA, 12 nt, Mycobacterium tuberculosis H37Rv
accggucggcca

SEQ ID NO: 1309826 - RNA, 23 nt, Mycobacterium tuberculosis H37Rv
accggcaccggccgugccgccga

SEQ ID NO: 1309827 - RNA, 12 nt, Mycobacterium tuberculosis H37Rv
accggcaccgcc

SEQ ID NO: 1309828 - RNA, 18 nt, Mycobacterium tuberculosis H37Rv
accggcacccccgucgcc

SEQ ID NO: 1309829 - RNA, 17 nt, Mycobacterium tuberculosis H37Rv
accggcaccagcggcac

SEQ ID NO: 1309830 - RNA, 23 nt, Mycobacterium tuberculosis H37Rv
accggcacccgcuggcgguaagc

SEQ ID NO: 1309831 - RNA, 19 nt, Mycobacterium tuberculosis H37Rv
accggcacccgcggcgaac

SEQ ID NO: 1309832 - RNA, 20 nt, Mycobacterium tuberculosis H37Rv
accgggucgggcaccgcgcg

SEQ ID NO: 1309833 - RNA, 16 nt, Mycobacterium tuberculosis H37Rv
accgggucguagccga

SEQ ID NO: 1309834 - RNA, 21 nt, Mycobacterium tuberculosis H37Rv
accggguccggugaacccgau

SEQ ID NO: 1309835 - RNA, 19 nt, Mycobacterium tuberculosis H37Rv
accgggcuccaauugcggc

SEQ ID NO: 1309836 - RNA, 17 nt, Mycobacterium tuberculosis H37Rv
accgggcggcggcgacu

SEQ ID NO: 1309837 - RNA, 19 nt, Mycobacterium tuberculosis H37Rv
accgggcgggacucggcga

SEQ ID NO: 1309838 - RNA, 17 nt, Mycobacterium tuberculosis H37Rv
accggggacgucgacuu

SEQ ID NO: 1309839 - RNA, 12 nt, Mycobacterium tuberculosis H37Rv
accguccgucgg

SEQ ID NO: 1309840 - RNA, 22 nt, Mycobacterium tuberculosis H37Rv
accguccucggucacgaucacg

SEQ ID NO: 1309841 - RNA, 21 nt, Mycobacterium tuberculosis H37Rv
accguccgggucaccagcgca

SEQ ID NO: 1309842 - RNA, 16 nt, Mycobacterium tuberculosis H37Rv
accgucgagccggaca

SEQ ID NO: 1309843 - RNA, 13 nt, Mycobacterium tuberculosis H37Rv
accgucgaagaug

SEQ ID NO: 1309844 - RNA, 15 nt, Mycobacterium tuberculosis H37Rv
accgucgcgcucgca

SEQ ID NO: 1309845 - RNA, 22 nt, Mycobacterium tuberculosis H37Rv
accgucggaacugaccacgucg

SEQ ID NO: 1309846 - RNA, 19 nt, Mycobacterium tuberculosis H37Rv
accgucgggauggacggca

SEQ ID NO: 1309847 - RNA, 16 nt, Mycobacterium tuberculosis H37Rv
accgucgggacggcca

SEQ ID NO: 1309848 - RNA, 18 nt, Mycobacterium tuberculosis H37Rv
accgucgggacggccaac

SEQ ID NO: 1309849 - RNA, 19 nt, Mycobacterium tuberculosis H37Rv
accgucgggacggccaaca

SEQ ID NO: 1309850 - RNA, 15 nt, Mycobacterium tuberculosis H37Rv
accgucguggcggug

SEQ ID NO: 1309851 - RNA, 18 nt, Mycobacterium tuberculosis H37Rv
accgucucgcaccgcguu

SEQ ID NO: 1309852 - RNA, 17 nt, Mycobacterium tuberculosis H37Rv
accgucggggaugccga

SEQ ID NO: 1309853 - RNA, 16 nt, Mycobacterium tuberculosis H37Rv
accgucggcagcagcg

SEQ ID NO: 1309854 - RNA, 18 nt, Mycobacterium tuberculosis H37Rv
accgucgucgugcaggcg

SEQ ID NO: 1309855 - RNA, 15 nt, Mycobacterium tuberculosis H37Rv
accgugaacucgcgc

SEQ ID NO: 1309856 - RNA, 16 nt, Mycobacterium tuberculosis H37Rv
accgugacagcggcau

SEQ ID NO: 1309857 - RNA, 20 nt, Mycobacterium tuberculosis H37Rv
accgugacauaccaagggau

SEQ ID NO: 1309858 - RNA, 23 nt, Mycobacterium tuberculosis H37Rv
accgucuggaguucgucaccguu

SEQ ID NO: 1309859 - RNA, 14 nt, Mycobacterium tuberculosis H37Rv
accgucugcuggcc

SEQ ID NO: 1309860 - RNA, 15 nt, Mycobacterium tuberculosis H37Rv
accgguuucgucggu

SEQ ID NO: 1309861 - RNA, 19 nt, Mycobacterium tuberculosis H37Rv
accgguuggguagcaccga

SEQ ID NO: 1309862 - RNA, 19 nt, Mycobacterium tuberculosis H37Rv
accgguuuggagcucaucg

SEQ ID NO: 1309863 - RNA, 19 nt, Mycobacterium tuberculosis H37Rv
accgguuucgucggucugc

SEQ ID NO: 1309864 - RNA, 22 nt, Mycobacterium tuberculosis H37Rv
accgguuuucgccggcuccgca

SEQ ID NO: 1309865 - RNA, 23 nt, Mycobacterium tuberculosis H37Rv
accguagccagcaggaacgccgu

SEQ ID NO: 1309866 - RNA, 17 nt, Mycobacterium tuberculosis H37Rv
accguagagcaugccgc

SEQ ID NO: 1309867 - RNA, 21 nt, Mycobacterium tuberculosis H37Rv
accguaguaguucagccaggc

SEQ ID NO: 1309868 - RNA, 13 nt, Mycobacterium tuberculosis H37Rv
accguaguccaca

SEQ ID NO: 1309869 - RNA, 22 nt, Mycobacterium tuberculosis H37Rv
accguagugaacggcucgggca

SEQ ID NO: 1309870 - RNA, 23 nt, Mycobacterium tuberculosis H37Rv
accgucacaagucgacacgccga

SEQ ID NO: 1309871 - RNA, 16 nt, Mycobacterium tuberculosis H37Rv
accgucauggcgggug

SEQ ID NO: 1309872 - RNA, 19 nt, Mycobacterium tuberculosis H37Rv
accgucaugaaaucgauga

SEQ ID NO: 1309873 - RNA, 15 nt, Mycobacterium tuberculosis H37Rv
accguccagcagcuc

SEQ ID NO: 1309874 - RNA, 14 nt, Mycobacterium tuberculosis H37Rv
accguccagcaaca

SEQ ID NO: 1309875 - RNA, 21 nt, Mycobacterium tuberculosis H37Rv
accgucagcccgaaccguuug

SEQ ID NO: 1309876 - RNA, 15 nt, Mycobacterium tuberculosis H37Rv
accgucagcccgacg

SEQ ID NO: 1309877 - RNA, 14 nt, Mycobacterium tuberculosis H37Rv
accgucaccgccgu

SEQ ID NO: 1309878 - RNA, 14 nt, Mycobacterium tuberculosis H37Rv
accgucacccccga

SEQ ID NO: 1309879 - RNA, 16 nt, Mycobacterium tuberculosis H37Rv
accgucaccgccggca

SEQ ID NO: 1309880 - RNA, 21 nt, Mycobacterium tuberculosis H37Rv
accgugguggacgaccgcgcg

SEQ ID NO: 1309881 - RNA, 19 nt, Mycobacterium tuberculosis H37Rv
accgugguggucgggcgca

SEQ ID NO: 1309882 - RNA, 13 nt, Mycobacterium tuberculosis H37Rv
accgugucaccgc

SEQ ID NO: 1309883 - RNA, 14 nt, Mycobacterium tuberculosis H37Rv
accguuaccgccgu

SEQ ID NO: 1309884 - RNA, 20 nt, Mycobacterium tuberculosis H37Rv
accguugaccucuucgggca

SEQ ID NO: 1309885 - RNA, 17 nt, Mycobacterium tuberculosis H37Rv
accguugaggucgauca

SEQ ID NO: 1309886 - RNA, 15 nt, Mycobacterium tuberculosis H37Rv
accgugcaccagcuc

SEQ ID NO: 1309887 - RNA, 16 nt, Mycobacterium tuberculosis H37Rv
accgugcggaucgcgc

SEQ ID NO: 1309888 - RNA, 20 nt, Mycobacterium tuberculosis H37Rv
accgugcugggcgccgcgcu

SEQ ID NO: 1309889 - RNA, 13 nt, Mycobacterium tuberculosis H37Rv
accgugcugggca

SEQ ID NO: 1309890 - RNA, 19 nt, Mycobacterium tuberculosis H37Rv
accgugcggggggcagcuc

SEQ ID NO: 1309891 - RNA, 16 nt, Mycobacterium tuberculosis H37Rv
accguggucggaggug

SEQ ID NO: 1309892 - RNA, 14 nt, Mycobacterium tuberculosis H37Rv
accgugguggacga

SEQ ID NO: 1309893 - RNA, 19 nt, Mycobacterium tuberculosis H37Rv
accguggcggaucgcgagc

SEQ ID NO: 1309894 - RNA, 14 nt, Mycobacterium tuberculosis H37Rv
accguugcugcgca

SEQ ID NO: 1309895 - RNA, 14 nt, Mycobacterium tuberculosis H37Rv
accguugucgucca

SEQ ID NO: 1309896 - RNA, 14 nt, Mycobacterium tuberculosis H37Rv
accuagcaccgcgc

SEQ ID NO: 1309897 - RNA, 16 nt, Mycobacterium tuberculosis H37Rv
accuaccgucgaccac

SEQ ID NO: 1309898 - RNA, 17 nt, Mycobacterium tuberculosis H37Rv
accuagcaccgcgccga

SEQ ID NO: 1309899 - RNA, 21 nt, Mycobacterium tuberculosis H37Rv
accuagucaccuugaccgggu

SEQ ID NO: 1309900 - RNA, 14 nt, Mycobacterium tuberculosis H37Rv
accuauuugcgacc

SEQ ID NO: 1309901 - RNA, 13 nt, Mycobacterium tuberculosis H37Rv
accucaaacgccu

SEQ ID NO: 1309902 - RNA, 16 nt, Mycobacterium tuberculosis H37Rv
accucaacaccaggcc

SEQ ID NO: 1309903 - RNA, 19 nt, Mycobacterium tuberculosis H37Rv
accucaccugacacgcccg

SEQ ID NO: 1309904 - RNA, 21 nt, Mycobacterium tuberculosis H37Rv
accuccgggaugucgaagucg

SEQ ID NO: 1309905 - RNA, 11 nt, Mycobacterium tuberculosis H37Rv
accuccucgaa

SEQ ID NO: 1309906 - RNA, 14 nt, Mycobacterium tuberculosis H37Rv
accucccgcggcac

SEQ ID NO: 1309907 - RNA, 18 nt, Mycobacterium tuberculosis H37Rv
accucggcgaagucacgc

SEQ ID NO: 1309908 - RNA, 14 nt, Mycobacterium tuberculosis H37Rv
accucggcgaucaa

SEQ ID NO: 1309909 - RNA, 23 nt, Mycobacterium tuberculosis H37Rv
accucggcgacgaugucgagcgc

SEQ ID NO: 1309910 - RNA, 19 nt, Mycobacterium tuberculosis H37Rv
accucgcgggugcugguca

SEQ ID NO: 1309911 - RNA, 16 nt, Mycobacterium tuberculosis H37Rv
accucgcgggcgaucg

SEQ ID NO: 1309912 - RNA, 12 nt, Mycobacterium tuberculosis H37Rv
accugaccguug

SEQ ID NO: 1309913 - RNA, 19 nt, Mycobacterium tuberculosis H37Rv
accugacuaccgucaucga

SEQ ID NO: 1309914 - RNA, 22 nt, Mycobacterium tuberculosis H37Rv
accugacgcucggucgccaccg

SEQ ID NO: 1309915 - RNA, 23 nt, Mycobacterium tuberculosis H37Rv
accucuugcccuucuucgaccgc

SEQ ID NO: 1309916 - RNA, 15 nt, Mycobacterium tuberculosis H37Rv
accugaacggcaacg

SEQ ID NO: 1309917 - RNA, 14 nt, Mycobacterium tuberculosis H37Rv
accugaaugcggcc

SEQ ID NO: 1309918 - RNA, 20 nt, Mycobacterium tuberculosis H37Rv
accucggugcggaacaccgc

SEQ ID NO: 1309919 - RNA, 20 nt, Mycobacterium tuberculosis H37Rv
accucggcggugucgaccuc

SEQ ID NO: 1309920 - RNA, 14 nt, Mycobacterium tuberculosis H37Rv
accucgucaccggu

SEQ ID NO: 1309921 - RNA, 13 nt, Mycobacterium tuberculosis H37Rv
accucgucgaucg

SEQ ID NO: 1309922 - RNA, 14 nt, Mycobacterium tuberculosis H37Rv
accucgucgaucgc

SEQ ID NO: 1309923 - RNA, 12 nt, Mycobacterium tuberculosis H37Rv
accucggugcgg

SEQ ID NO: 1309924 - RNA, 20 nt, Mycobacterium tuberculosis H37Rv
accucgucggccgacaccgc

SEQ ID NO: 1309925 - RNA, 16 nt, Mycobacterium tuberculosis H37Rv
accucgucgucaucga

SEQ ID NO: 1309926 - RNA, 17 nt, Mycobacterium tuberculosis H37Rv
accucgugguucugcag

SEQ ID NO: 1309927 - RNA, 22 nt, Mycobacterium tuberculosis H37Rv
accucgucggccgacaccgcca

SEQ ID NO: 1309928 - RNA, 19 nt, Mycobacterium tuberculosis H37Rv
accggaucgucgaacagca

SEQ ID NO: 1309929 - RNA, 19 nt, Mycobacterium tuberculosis H37Rv
accggagucgucggcaacg

SEQ ID NO: 1309930 - RNA, 19 nt, Mycobacterium tuberculosis H37Rv
accggauacagccacgcaa

SEQ ID NO: 1309931 - RNA, 13 nt, Mycobacterium tuberculosis H37Rv
accggaucaccgc

SEQ ID NO: 1309932 - RNA, 16 nt, Mycobacterium tuberculosis H37Rv
accggcaacaucagca

SEQ ID NO: 1309933 - RNA, 21 nt, Mycobacterium tuberculosis H37Rv
accggauccacggagaccggc

SEQ ID NO: 1309934 - RNA, 16 nt, Mycobacterium tuberculosis H37Rv
accggacgcccucacg

SEQ ID NO: 1309935 - RNA, 13 nt, Mycobacterium tuberculosis H37Rv
accggacgaucag

SEQ ID NO: 1309936 - RNA, 17 nt, Mycobacterium tuberculosis H37Rv
accggacgagcgucaga

SEQ ID NO: 1309937 - RNA, 22 nt, Mycobacterium tuberculosis H37Rv
accgcugccggcacgcaugccg

SEQ ID NO: 1309938 - RNA, 19 nt, Mycobacterium tuberculosis H37Rv
accgcugccggcacgcaug

SEQ ID NO: 1309939 - RNA, 17 nt, Mycobacterium tuberculosis H37Rv
accgcugauagcggucg

SEQ ID NO: 1309940 - RNA, 15 nt, Mycobacterium tuberculosis H37Rv
accgcugauagcggu

SEQ ID NO: 1309941 - RNA, 19 nt, Mycobacterium tuberculosis H37Rv
accgcugggacaacgugcc

SEQ ID NO: 1309942 - RNA, 18 nt, Mycobacterium tuberculosis H37Rv
accgcugcuccucgcggu

SEQ ID NO: 1309943 - RNA, 14 nt, Mycobacterium tuberculosis H37Rv
accgcgucggcguu

SEQ ID NO: 1309944 - RNA, 15 nt, Mycobacterium tuberculosis H37Rv
accgcgugcgucagc

SEQ ID NO: 1309945 - RNA, 20 nt, Mycobacterium tuberculosis H37Rv
accgcgugcucgagcaccuc

SEQ ID NO: 1309946 - RNA, 13 nt, Mycobacterium tuberculosis H37Rv
accgcugaccgca

SEQ ID NO: 1309947 - RNA, 17 nt, Mycobacterium tuberculosis H37Rv
accgcugagccggugca

SEQ ID NO: 1309948 - RNA, 21 nt, Mycobacterium tuberculosis H37Rv
accgcucgucguccggccacg

SEQ ID NO: 1309949 - RNA, 15 nt, Mycobacterium tuberculosis H37Rv
accgcguugaugacc

SEQ ID NO: 1309950 - RNA, 22 nt, Mycobacterium tuberculosis H37Rv
accgcguucugguuguugccga

SEQ ID NO: 1309951 - RNA, 19 nt, Mycobacterium tuberculosis H37Rv
accgcguggucggcgaacg

SEQ ID NO: 1309952 - RNA, 21 nt, Mycobacterium tuberculosis H37Rv
accgcgcuguugccaucgacg

SEQ ID NO: 1309953 - RNA, 18 nt, Mycobacterium tuberculosis H37Rv
accgcgcguuguggcgau

SEQ ID NO: 1309954 - RNA, 12 nt, Mycobacterium tuberculosis H37Rv
accgcggucagc

SEQ ID NO: 1309955 - RNA, 17 nt, Mycobacterium tuberculosis H37Rv
accgcgggcggcaucgc

SEQ ID NO: 1309956 - RNA, 19 nt, Mycobacterium tuberculosis H37Rv
accgcgguacgccggucgg

SEQ ID NO: 1309957 - RNA, 23 nt, Mycobacterium tuberculosis H37Rv
accgcggucugcgcgucgcgugg

SEQ ID NO: 1309958 - RNA, 16 nt, Mycobacterium tuberculosis H37Rv
accgcggugacccgga

SEQ ID NO: 1309959 - RNA, 22 nt, Mycobacterium tuberculosis H37Rv
accgcggucgccaagaucgggu

SEQ ID NO: 1309960 - RNA, 13 nt, Mycobacterium tuberculosis H37Rv
accgcggucgcca

SEQ ID NO: 1309961 - RNA, 20 nt, Mycobacterium tuberculosis H37Rv
accgccggcgcccaggccga

SEQ ID NO: 1309962 - RNA, 23 nt, Mycobacterium tuberculosis H37Rv
accgccggcgcccaggccgauca

SEQ ID NO: 1309963 - RNA, 20 nt, Mycobacterium tuberculosis H37Rv
accgccggcgccgccgucgc

SEQ ID NO: 1309964 - RNA, 15 nt, Mycobacterium tuberculosis H37Rv
accgccgcugccauc

SEQ ID NO: 1309965 - RNA, 21 nt, Mycobacterium tuberculosis H37Rv
accgccgcuaccccagccggc

SEQ ID NO: 1309966 - RNA, 16 nt, Mycobacterium tuberculosis H37Rv
accgccgcugccggua

SEQ ID NO: 1309967 - RNA, 23 nt, Mycobacterium tuberculosis H37Rv
accgccgcugccgguagcacagc

SEQ ID NO: 1309968 - RNA, 16 nt, Mycobacterium tuberculosis H37Rv
accgccggcaccgcca

SEQ ID NO: 1309969 - RNA, 17 nt, Mycobacterium tuberculosis H37Rv
accgccggcaccgccag

SEQ ID NO: 1309970 - RNA, 17 nt, Mycobacterium tuberculosis H37Rv
accgccgacaggccggc

SEQ ID NO: 1309971 - RNA, 19 nt, Mycobacterium tuberculosis H37Rv
accgccgaccggaccgggg

SEQ ID NO: 1309972 - RNA, 20 nt, Mycobacterium tuberculosis H37Rv
accgcccgcgccaccggcac

SEQ ID NO: 1309973 - RNA, 15 nt, Mycobacterium tuberculosis H37Rv
accgcccgcaccgug

SEQ ID NO: 1309974 - RNA, 18 nt, Mycobacterium tuberculosis H37Rv
accgcccgcaccguggac

SEQ ID NO: 1309975 - RNA, 18 nt, Mycobacterium tuberculosis H37Rv
accgcccgcccuugcggc

SEQ ID NO: 1309976 - RNA, 21 nt, Mycobacterium tuberculosis H37Rv
accgccgccgccgacgccgcc

SEQ ID NO: 1309977 - RNA, 13 nt, Mycobacterium tuberculosis H37Rv
accgccgccggca

SEQ ID NO: 1309978 - RNA, 18 nt, Mycobacterium tuberculosis H37Rv
accgccgccggcaccgcc

SEQ ID NO: 1309979 - RNA, 22 nt, Mycobacterium tuberculosis H37Rv
accgccgccggaucgccgguga

SEQ ID NO: 1309980 - RNA, 19 nt, Mycobacterium tuberculosis H37Rv
accgccgcgaccgccucgc

SEQ ID NO: 1309981 - RNA, 12 nt, Mycobacterium tuberculosis H37Rv
accgccgcguca

SEQ ID NO: 1309982 - RNA, 13 nt, Mycobacterium tuberculosis H37Rv
accgccugcaaca

SEQ ID NO: 1309983 - RNA, 14 nt, Mycobacterium tuberculosis H37Rv
accgccuccucgau

SEQ ID NO: 1309984 - RNA, 13 nt, Mycobacterium tuberculosis H37Rv
accgccgcgcgac

SEQ ID NO: 1309985 - RNA, 12 nt, Mycobacterium tuberculosis H37Rv
accgcgaucacc

SEQ ID NO: 1309986 - RNA, 17 nt, Mycobacterium tuberculosis H37Rv
accgcgaucaccaccgg

SEQ ID NO: 1309987 - RNA, 12 nt, Mycobacterium tuberculosis H37Rv
accgcgcacgac

SEQ ID NO: 1309988 - RNA, 16 nt, Mycobacterium tuberculosis H37Rv
accgcgcacggcuggc

SEQ ID NO: 1309989 - RNA, 20 nt, Mycobacterium tuberculosis H37Rv
accgcgcccuucagcacggu

SEQ ID NO: 1309990 - RNA, 22 nt, Mycobacterium tuberculosis H37Rv
accgcgcaacccggacgaacgc

SEQ ID NO: 1309991 - RNA, 18 nt, Mycobacterium tuberculosis H37Rv
accgcgaugggauaccgc

SEQ ID NO: 1309992 - RNA, 16 nt, Mycobacterium tuberculosis H37Rv
accgcgaugucacgga

SEQ ID NO: 1309993 - RNA, 17 nt, Mycobacterium tuberculosis H37Rv
accgcgauccccacgau

SEQ ID NO: 1309994 - RNA, 14 nt, Mycobacterium tuberculosis H37Rv
accgcgaucgccga

SEQ ID NO: 1309995 - RNA, 19 nt, Mycobacterium tuberculosis H37Rv
accgcgaugacgacgaacc

SEQ ID NO: 1309996 - RNA, 21 nt, Mycobacterium tuberculosis H37Rv
accgcagacgugguagccggc

SEQ ID NO: 1309997 - RNA, 19 nt, Mycobacterium tuberculosis H37Rv
accgcacggaugucgccca

SEQ ID NO: 1309998 - RNA, 19 nt, Mycobacterium tuberculosis H37Rv
accgcagacccucgucguc

SEQ ID NO: 1309999 - RNA, 14 nt, Mycobacterium tuberculosis H37Rv
accgcagacgccgu

SEQ ID NO: 1310000 - RNA, 13 nt, Mycobacterium tuberculosis H37Rv
accgcaucgccga

SEQ ID NO: 1310001 - RNA, 17 nt, Mycobacterium tuberculosis H37Rv
accgccagccgcgagcc

SEQ ID NO: 1310002 - RNA, 18 nt, Mycobacterium tuberculosis H37Rv
accgcccgacccaucacc

SEQ ID NO: 1310003 - RNA, 23 nt, Mycobacterium tuberculosis H37Rv
accgccagccaccacaucgcggg

SEQ ID NO: 1310004 - RNA, 15 nt, Mycobacterium tuberculosis H37Rv
accgccagcgucgac

SEQ ID NO: 1310005 - RNA, 23 nt, Mycobacterium tuberculosis H37Rv
accgccagcggccgcuccaccuc

SEQ ID NO: 1310006 - RNA, 14 nt, Mycobacterium tuberculosis H37Rv
accgccagcggcaa

SEQ ID NO: 1310007 - RNA, 23 nt, Mycobacterium tuberculosis H37Rv
accgaugacgcguucaacaccgc

SEQ ID NO: 1310008 - RNA, 12 nt, Mycobacterium tuberculosis H37Rv
accgaucggcag

SEQ ID NO: 1310009 - RNA, 15 nt, Mycobacterium tuberculosis H37Rv
accgaucaauccgcc

SEQ ID NO: 1310010 - RNA, 19 nt, Mycobacterium tuberculosis H37Rv
accgaucaucauauccgcc

SEQ ID NO: 1310011 - RNA, 23 nt, Mycobacterium tuberculosis H37Rv
accgaugugggcgccgucgccgu

SEQ ID NO: 1310012 - RNA, 20 nt, Mycobacterium tuberculosis H37Rv
accgaugguugagcaucgau

SEQ ID NO: 1310013 - RNA, 15 nt, Mycobacterium tuberculosis H37Rv
accgauucggcgacg

SEQ ID NO: 1310014 - RNA, 15 nt, Mycobacterium tuberculosis H37Rv
accgcaacucgccga

SEQ ID NO: 1310015 - RNA, 22 nt, Mycobacterium tuberculosis H37Rv
accgcaacgcguauucggcauc

SEQ ID NO: 1310016 - RNA, 18 nt, Mycobacterium tuberculosis H37Rv
accgcaccaaagcgaaau

SEQ ID NO: 1310017 - RNA, 12 nt, Mycobacterium tuberculosis H37Rv
accgcaccaggu

SEQ ID NO: 1310018 - RNA, 20 nt, Mycobacterium tuberculosis H37Rv
accgcacccgcucgucggua

SEQ ID NO: 1310019 - RNA, 17 nt, Mycobacterium tuberculosis H37Rv
accgcacgcuggcgggc

SEQ ID NO: 1310020 - RNA, 19 nt, Mycobacterium tuberculosis H37Rv
accgacaccgugucgccgg

SEQ ID NO: 1310021 - RNA, 21 nt, Mycobacterium tuberculosis H37Rv
accgacacugggaucccgacg

SEQ ID NO: 1310022 - RNA, 13 nt, Mycobacterium tuberculosis H37Rv
accgacagcaccc

SEQ ID NO: 1310023 - RNA, 13 nt, Mycobacterium tuberculosis H37Rv
accgaauaccgcc

SEQ ID NO: 1310024 - RNA, 20 nt, Mycobacterium tuberculosis H37Rv
accgaauuguuguaacccgu

SEQ ID NO: 1310025 - RNA, 14 nt, Mycobacterium tuberculosis H37Rv
acccggagccgcca

SEQ ID NO: 1310026 - RNA, 18 nt, Mycobacterium tuberculosis H37Rv
accgaagagcgcgcgcaa

SEQ ID NO: 1310027 - RNA, 15 nt, Mycobacterium tuberculosis H37Rv
accgaacuugcggac

SEQ ID NO: 1310028 - RNA, 22 nt, Mycobacterium tuberculosis H37Rv
accgaacgcggccaccgaccgc

SEQ ID NO: 1310029 - RNA, 19 nt, Mycobacterium tuberculosis H37Rv
accgaacccgccaccgcga

SEQ ID NO: 1310030 - RNA, 22 nt, Mycobacterium tuberculosis H37Rv
accgaacgcaccgaaacgccga

SEQ ID NO: 1310031 - RNA, 17 nt, Mycobacterium tuberculosis H37Rv
accgaacgcgaugcgcc

SEQ ID NO: 1310032 - RNA, 17 nt, Mycobacterium tuberculosis H37Rv
acccgcuggucgaugcc

SEQ ID NO: 1310033 - RNA, 14 nt, Mycobacterium tuberculosis H37Rv
acccgcuucgcccg

SEQ ID NO: 1310034 - RNA, 16 nt, Mycobacterium tuberculosis H37Rv
acccggaaccagccgc

SEQ ID NO: 1310035 - RNA, 21 nt, Mycobacterium tuberculosis H37Rv
acccgcuucgcccggcugcgc

SEQ ID NO: 1310036 - RNA, 16 nt, Mycobacterium tuberculosis H37Rv
accgagcugacgccga

SEQ ID NO: 1310037 - RNA, 17 nt, Mycobacterium tuberculosis H37Rv
accgagcugagcggcca

SEQ ID NO: 1310038 - RNA, 15 nt, Mycobacterium tuberculosis H37Rv
accgaggaucucgcg

SEQ ID NO: 1310039 - RNA, 12 nt, Mycobacterium tuberculosis H37Rv
accgacgccggu

SEQ ID NO: 1310040 - RNA, 14 nt, Mycobacterium tuberculosis H37Rv
accgacgcgaacgc

SEQ ID NO: 1310041 - RNA, 17 nt, Mycobacterium tuberculosis H37Rv
accgacgcgaacgcggc

SEQ ID NO: 1310042 - RNA, 16 nt, Mycobacterium tuberculosis H37Rv
accgacgcagaacggc

SEQ ID NO: 1310043 - RNA, 13 nt, Mycobacterium tuberculosis H37Rv
accgacgccgaua

SEQ ID NO: 1310044 - RNA, 23 nt, Mycobacterium tuberculosis H37Rv
accgaccuacugcggucgcccag

SEQ ID NO: 1310045 - RNA, 19 nt, Mycobacterium tuberculosis H37Rv
accgaccgggccgcacggu

SEQ ID NO: 1310046 - RNA, 15 nt, Mycobacterium tuberculosis H37Rv
accgaccgaaagccg

SEQ ID NO: 1310047 - RNA, 14 nt, Mycobacterium tuberculosis H37Rv
accgaccgcauggu

SEQ ID NO: 1310048 - RNA, 17 nt, Mycobacterium tuberculosis H37Rv
accgauaccucgccauc

SEQ ID NO: 1310049 - RNA, 13 nt, Mycobacterium tuberculosis H37Rv
accgagucgacgu

SEQ ID NO: 1310050 - RNA, 20 nt, Mycobacterium tuberculosis H37Rv
accgaguaccgauagccugc

SEQ ID NO: 1310051 - RNA, 14 nt, Mycobacterium tuberculosis H37Rv
accgauaucgcugc

SEQ ID NO: 1310052 - RNA, 17 nt, Mycobacterium tuberculosis H37Rv
accgauaucgcugcgga

SEQ ID NO: 1310053 - RNA, 13 nt, Mycobacterium tuberculosis H37Rv
accgaucaauccg

SEQ ID NO: 1310054 - RNA, 13 nt, Mycobacterium tuberculosis H37Rv
accgaucaccggu

SEQ ID NO: 1310055 - RNA, 20 nt, Mycobacterium tuberculosis H37Rv
accgaggucgagcgacccca

SEQ ID NO: 1310056 - RNA, 16 nt, Mycobacterium tuberculosis H37Rv
accaguucguggguca

SEQ ID NO: 1310057 - RNA, 20 nt, Mycobacterium tuberculosis H37Rv
accaguuggcgaucaaccgc

SEQ ID NO: 1310058 - RNA, 23 nt, Mycobacterium tuberculosis H37Rv
accauaagcucguagagcaccgc

SEQ ID NO: 1310059 - RNA, 12 nt, Mycobacterium tuberculosis H37Rv
accauagcucag

SEQ ID NO: 1310060 - RNA, 16 nt, Mycobacterium tuberculosis H37Rv
accagugaucagcgca

SEQ ID NO: 1310061 - RNA, 15 nt, Mycobacterium tuberculosis H37Rv
accagugcagcucga

SEQ ID NO: 1310062 - RNA, 20 nt, Mycobacterium tuberculosis H37Rv
accagugcaucgaucaccgc

SEQ ID NO: 1310063 - RNA, 16 nt, Mycobacterium tuberculosis H37Rv
accaguuauucggugc

SEQ ID NO: 1310064 - RNA, 18 nt, Mycobacterium tuberculosis H37Rv
accaugaugccuaccggg

SEQ ID NO: 1310065 - RNA, 20 nt, Mycobacterium tuberculosis H37Rv
accaucgcuugcgcacggau

SEQ ID NO: 1310066 - RNA, 23 nt, Mycobacterium tuberculosis H37Rv
accaucgggucgucggcgucggu

SEQ ID NO: 1310067 - RNA, 20 nt, Mycobacterium tuberculosis H37Rv
accaucgccucggcgcugcg

SEQ ID NO: 1310068 - RNA, 14 nt, Mycobacterium tuberculosis H37Rv
accaucgcgaucug

SEQ ID NO: 1310069 - RNA, 20 nt, Mycobacterium tuberculosis H37Rv
accaucgaggcgaucaccgc

SEQ ID NO: 1310070 - RNA, 17 nt, Mycobacterium tuberculosis H37Rv
accaucgaggcgaucac

SEQ ID NO: 1310071 - RNA, 22 nt, Mycobacterium tuberculosis H37Rv
accaucaucaccucucgcuugc

SEQ ID NO: 1310072 - RNA, 14 nt, Mycobacterium tuberculosis H37Rv
accaucaccgcgcc

SEQ ID NO: 1310073 - RNA, 20 nt, Mycobacterium tuberculosis H37Rv
accaggccgcgcgcaccggu

SEQ ID NO: 1310074 - RNA, 18 nt, Mycobacterium tuberculosis H37Rv
acaguuuaccgugccgcc

SEQ ID NO: 1310075 - RNA, 17 nt, Mycobacterium tuberculosis H37Rv
accaggccggcccgcaa

SEQ ID NO: 1310076 - RNA, 13 nt, Mycobacterium tuberculosis H37Rv
accaggccgguga

SEQ ID NO: 1310077 - RNA, 15 nt, Mycobacterium tuberculosis H37Rv
accagggccucgacc

SEQ ID NO: 1310078 - RNA, 17 nt, Mycobacterium tuberculosis H37Rv
accagggccucgaccgc

SEQ ID NO: 1310079 - RNA, 16 nt, Mycobacterium tuberculosis H37Rv
accagguaaucaccug

SEQ ID NO: 1310080 - RNA, 13 nt, Mycobacterium tuberculosis H37Rv
accaggggcgcgu

SEQ ID NO: 1310081 - RNA, 15 nt, Mycobacterium tuberculosis H37Rv
accaggucggucagg

SEQ ID NO: 1310082 - RNA, 19 nt, Mycobacterium tuberculosis H37Rv
accaggucggucaggucga

SEQ ID NO: 1310083 - RNA, 24 nt, Mycobacterium tuberculosis H37Rv
accaggucggugugcaucgccggc

SEQ ID NO: 1310084 - RNA, 12 nt, Mycobacterium tuberculosis H37Rv
accagucgaccc

SEQ ID NO: 1310085 - RNA, 12 nt, Mycobacterium tuberculosis H37Rv
accagugaccgc

SEQ ID NO: 1310086 - RNA, 15 nt, Mycobacterium tuberculosis H37Rv
accagugaccgcagu

SEQ ID NO: 1310087 - RNA, 20 nt, Mycobacterium tuberculosis H37Rv
accaguaauacugccguucg

SEQ ID NO: 1310088 - RNA, 20 nt, Mycobacterium tuberculosis H37Rv
accaguaccgucaucgcggu

SEQ ID NO: 1310089 - RNA, 23 nt, Mycobacterium tuberculosis H37Rv
acccagcgacgcggccagcggca

SEQ ID NO: 1310090 - RNA, 14 nt, Mycobacterium tuberculosis H37Rv
acccagccggccug

SEQ ID NO: 1310091 - RNA, 17 nt, Mycobacterium tuberculosis H37Rv
acccagccgcgccagcu

SEQ ID NO: 1310092 - RNA, 23 nt, Mycobacterium tuberculosis H37Rv
acccagccggaaccggacagcgu

SEQ ID NO: 1310093 - RNA, 14 nt, Mycobacterium tuberculosis H37Rv
acccagccgcagcc

SEQ ID NO: 1310094 - RNA, 12 nt, Mycobacterium tuberculosis H37Rv
acccagcgcggc

SEQ ID NO: 1310095 - RNA, 14 nt, Mycobacterium tuberculosis H37Rv
acccagcgcggcca

SEQ ID NO: 1310096 - RNA, 14 nt, Mycobacterium tuberculosis H37Rv
acccaucaccgcca

SEQ ID NO: 1310097 - RNA, 14 nt, Mycobacterium tuberculosis H37Rv
acccagcggaaccg

SEQ ID NO: 1310098 - RNA, 18 nt, Mycobacterium tuberculosis H37Rv
acccagcucgucgacguc

SEQ ID NO: 1310099 - RNA, 15 nt, Mycobacterium tuberculosis H37Rv
acccagcucgucgac

SEQ ID NO: 1310100 - RNA, 16 nt, Mycobacterium tuberculosis H37Rv
acccaucucgaaggug

SEQ ID NO: 1310101 - RNA, 14 nt, Mycobacterium tuberculosis H37Rv
acccaucucgaagg

SEQ ID NO: 1310102 - RNA, 21 nt, Mycobacterium tuberculosis H37Rv
acccaucccguucagcgacca

SEQ ID NO: 1310103 - RNA, 14 nt, Mycobacterium tuberculosis H37Rv
accaugugcuccgc

SEQ ID NO: 1310104 - RNA, 20 nt, Mycobacterium tuberculosis H37Rv
accaugucggccacccggac

SEQ ID NO: 1310105 - RNA, 16 nt, Mycobacterium tuberculosis H37Rv
acccagccagcagcgg

SEQ ID NO: 1310106 - RNA, 19 nt, Mycobacterium tuberculosis H37Rv
accccggcauacaacuggu

SEQ ID NO: 1310107 - RNA, 16 nt, Mycobacterium tuberculosis H37Rv
accccgaggccgaccu

SEQ ID NO: 1310108 - RNA, 14 nt, Mycobacterium tuberculosis H37Rv
accccggaccgcgg

SEQ ID NO: 1310109 - RNA, 14 nt, Mycobacterium tuberculosis H37Rv
accccgagcugcca

SEQ ID NO: 1310110 - RNA, 13 nt, Mycobacterium tuberculosis H37Rv
accccgaggccga

SEQ ID NO: 1310111 - RNA, 12 nt, Mycobacterium tuberculosis H37Rv
accccgaccgcu

SEQ ID NO: 1310112 - RNA, 14 nt, Mycobacterium tuberculosis H37Rv
accccgacggcaau

SEQ ID NO: 1310113 - RNA, 12 nt, Mycobacterium tuberculosis H37Rv
acccccgucgcc

SEQ ID NO: 1310114 - RNA, 14 nt, Mycobacterium tuberculosis H37Rv
acccccggcaggcu

SEQ ID NO: 1310115 - RNA, 24 nt, Mycobacterium tuberculosis H37Rv
accccgaagaugccugcuagcagc

SEQ ID NO: 1310116 - RNA, 16 nt, Mycobacterium tuberculosis H37Rv
accccgacgaugcgca

SEQ ID NO: 1310117 - RNA, 14 nt, Mycobacterium tuberculosis H37Rv
acccccgacaccgc

SEQ ID NO: 1310118 - RNA, 18 nt, Mycobacterium tuberculosis H37Rv
acccccgacaccgccgac

SEQ ID NO: 1310119 - RNA, 17 nt, Mycobacterium tuberculosis H37Rv
acccccgauagcgaccg

SEQ ID NO: 1310120 - RNA, 12 nt, Mycobacterium tuberculosis H37Rv
acccccgaucag

SEQ ID NO: 1310121 - RNA, 18 nt, Mycobacterium tuberculosis H37Rv
acccccgauggcgucgcc

SEQ ID NO: 1310122 - RNA, 18 nt, Mycobacterium tuberculosis H37Rv
acccaucgucgagccgcc

SEQ ID NO: 1310123 - RNA, 16 nt, Mycobacterium tuberculosis H37Rv
accccaaguccagcag

SEQ ID NO: 1310124 - RNA, 20 nt, Mycobacterium tuberculosis H37Rv
accccaaguccagcagcgac

SEQ ID NO: 1310125 - RNA, 20 nt, Mycobacterium tuberculosis H37Rv
accccaacgaccggcacggu

SEQ ID NO: 1310126 - RNA, 14 nt, Mycobacterium tuberculosis H37Rv
accccacacgccga

SEQ ID NO: 1310127 - RNA, 19 nt, Mycobacterium tuberculosis H37Rv
acccgccguugccaccggu

SEQ ID NO: 1310128 - RNA, 23 nt, Mycobacterium tuberculosis H37Rv
acccgccgugaguagguccacgu

SEQ ID NO: 1310129 - RNA, 17 nt, Mycobacterium tuberculosis H37Rv
acccgccgucaccgcgc

SEQ ID NO: 1310130 - RNA, 18 nt, Mycobacterium tuberculosis H37Rv
acccgccgucaccgcgcg

SEQ ID NO: 1310131 - RNA, 14 nt, Mycobacterium tuberculosis H37Rv
acccgcgaagccgc

SEQ ID NO: 1310132 - RNA, 20 nt, Mycobacterium tuberculosis H37Rv
acccgcgagguugaccacca

SEQ ID NO: 1310133 - RNA, 15 nt, Mycobacterium tuberculosis H37Rv
acccgcgcaaccggc

SEQ ID NO: 1310134 - RNA, 19 nt, Mycobacterium tuberculosis H37Rv
acccgccuguaccggcguu

SEQ ID NO: 1310135 - RNA, 13 nt, Mycobacterium tuberculosis H37Rv
acccgcucggcgc

SEQ ID NO: 1310136 - RNA, 24 nt, Mycobacterium tuberculosis H37Rv
acccgcuccauaucgucgggcguc

SEQ ID NO: 1310137 - RNA, 18 nt, Mycobacterium tuberculosis H37Rv
acccgcggaauccgcggc

SEQ ID NO: 1310138 - RNA, 14 nt, Mycobacterium tuberculosis H37Rv
acccgcgcgucgcc

SEQ ID NO: 1310139 - RNA, 16 nt, Mycobacterium tuberculosis H37Rv
acccgcgguagcggac

SEQ ID NO: 1310140 - RNA, 13 nt, Mycobacterium tuberculosis H37Rv
acccgcgucaguc

SEQ ID NO: 1310141 - RNA, 16 nt, Mycobacterium tuberculosis H37Rv
acccgcccacggcacc

SEQ ID NO: 1310142 - RNA, 20 nt, Mycobacterium tuberculosis H37Rv
acccgccacaucguggcguc

SEQ ID NO: 1310143 - RNA, 20 nt, Mycobacterium tuberculosis H37Rv
acccgcauccacgucgccca

SEQ ID NO: 1310144 - RNA, 17 nt, Mycobacterium tuberculosis H37Rv
acccgcauggacgcgau

SEQ ID NO: 1310145 - RNA, 19 nt, Mycobacterium tuberculosis H37Rv
acccgcaacgaggcaaacg

SEQ ID NO: 1310146 - RNA, 23 nt, Mycobacterium tuberculosis H37Rv
acccgaucagguacgccaggugc

SEQ ID NO: 1310147 - RNA, 19 nt, Mycobacterium tuberculosis H37Rv
acccgaguuauagaagccg

SEQ ID NO: 1310148 - RNA, 14 nt, Mycobacterium tuberculosis H37Rv
acggcggccgccac

SEQ ID NO: 1310149 - RNA, 20 nt, Mycobacterium tuberculosis H37Rv
acggcggcagucgcgguacc

SEQ ID NO: 1310150 - RNA, 14 nt, Mycobacterium tuberculosis H37Rv
acggcggcaucggg

SEQ ID NO: 1310151 - RNA, 16 nt, Mycobacterium tuberculosis H37Rv
acggcggccgcgaugg

SEQ ID NO: 1310152 - RNA, 21 nt, Mycobacterium tuberculosis H37Rv
acggcgggcgauuucggcgcc

SEQ ID NO: 1310153 - RNA, 19 nt, Mycobacterium tuberculosis H37Rv
acggcgggaacggugccga

SEQ ID NO: 1310154 - RNA, 21 nt, Mycobacterium tuberculosis H37Rv
acggcgggccgcgcggcgaca

SEQ ID NO: 1310155 - RNA, 16 nt, Mycobacterium tuberculosis H37Rv
acggcggcgucgauga

SEQ ID NO: 1310156 - RNA, 16 nt, Mycobacterium tuberculosis H37Rv
acggcggcgucgcggu

SEQ ID NO: 1310157 - RNA, 14 nt, Mycobacterium tuberculosis H37Rv
acggcggcuaggca

SEQ ID NO: 1310158 - RNA, 20 nt, Mycobacterium tuberculosis H37Rv
acggccagugucagcacgac

SEQ ID NO: 1310159 - RNA, 21 nt, Mycobacterium tuberculosis H37Rv
acggccaugaucacaccgcug

SEQ ID NO: 1310160 - RNA, 15 nt, Mycobacterium tuberculosis H37Rv
acggcggcagcggcg

SEQ ID NO: 1310161 - RNA, 20 nt, Mycobacterium tuberculosis H37Rv
acgggaccgaucuuggccac

SEQ ID NO: 1310162 - RNA, 20 nt, Mycobacterium tuberculosis H37Rv
acggcguacgccggacccgg

SEQ ID NO: 1310163 - RNA, 17 nt, Mycobacterium tuberculosis H37Rv
acgggaaacuccgcggc

SEQ ID NO: 1310164 - RNA, 12 nt, Mycobacterium tuberculosis H37Rv
acgggaacgucc

SEQ ID NO: 1310165 - RNA, 22 nt, Mycobacterium tuberculosis H37Rv
acggcgggccgcgcggcgacag

SEQ ID NO: 1310166 - RNA, 18 nt, Mycobacterium tuberculosis H37Rv
acggcggggcggcggugg

SEQ ID NO: 1310167 - RNA, 20 nt, Mycobacterium tuberculosis H37Rv
acggcguagacguccgcggu

SEQ ID NO: 1310168 - RNA, 14 nt, Mycobacterium tuberculosis H37Rv
acggcguaaucggg

SEQ ID NO: 1310169 - RNA, 15 nt, Mycobacterium tuberculosis H37Rv
acgggcgaucgcggu

SEQ ID NO: 1310170 - RNA, 13 nt, Mycobacterium tuberculosis H37Rv
acgggugcuggca

SEQ ID NO: 1310171 - RNA, 15 nt, Mycobacterium tuberculosis H37Rv
acgguagccaagcga

SEQ ID NO: 1310172 - RNA, 23 nt, Mycobacterium tuberculosis H37Rv
acgguaucggugcuggucgccgc

SEQ ID NO: 1310173 - RNA, 18 nt, Mycobacterium tuberculosis H37Rv
acggucagcgcgcacgac

SEQ ID NO: 1310174 - RNA, 12 nt, Mycobacterium tuberculosis H37Rv
acggucaccggc

SEQ ID NO: 1310175 - RNA, 15 nt, Mycobacterium tuberculosis H37Rv
acggucaaucccggc

SEQ ID NO: 1310176 - RNA, 19 nt, Mycobacterium tuberculosis H37Rv
acggucagcagacugccga

SEQ ID NO: 1310177 - RNA, 19 nt, Mycobacterium tuberculosis H37Rv
acggucagccguacgccgu

SEQ ID NO: 1310178 - RNA, 12 nt, Mycobacterium tuberculosis H37Rv
acgggucgcggu

SEQ ID NO: 1310179 - RNA, 12 nt, Mycobacterium tuberculosis H37Rv
acgggucgccgc

SEQ ID NO: 1310180 - RNA, 16 nt, Mycobacterium tuberculosis H37Rv
acggguuggcgaucau

SEQ ID NO: 1310181 - RNA, 23 nt, Mycobacterium tuberculosis H37Rv
acgggugucgggcgcgcugccca

SEQ ID NO: 1310182 - RNA, 16 nt, Mycobacterium tuberculosis H37Rv
acgguguaccccgcga

SEQ ID NO: 1310183 - RNA, 20 nt, Mycobacterium tuberculosis H37Rv
acggugguaagacgccgaac

SEQ ID NO: 1310184 - RNA, 15 nt, Mycobacterium tuberculosis H37Rv
acgguugccgcgauc

SEQ ID NO: 1310185 - RNA, 23 nt, Mycobacterium tuberculosis H37Rv
acgguuccggucggguuggccgg

SEQ ID NO: 1310186 - RNA, 18 nt, Mycobacterium tuberculosis H37Rv
acgguucgcccgucgcga

SEQ ID NO: 1310187 - RNA, 13 nt, Mycobacterium tuberculosis H37Rv
acggugucgucga

SEQ ID NO: 1310188 - RNA, 15 nt, Mycobacterium tuberculosis H37Rv
acggucguuggucgg

SEQ ID NO: 1310189 - RNA, 11 nt, Mycobacterium tuberculosis H37Rv
acggucgccgu

SEQ ID NO: 1310190 - RNA, 14 nt, Mycobacterium tuberculosis H37Rv
acgguugagauggu

SEQ ID NO: 1310191 - RNA, 22 nt, Mycobacterium tuberculosis H37Rv
acgguugguccgccgucgacca

SEQ ID NO: 1310192 - RNA, 19 nt, Mycobacterium tuberculosis H37Rv
acgguugguccgccgucga

SEQ ID NO: 1310193 - RNA, 18 nt, Mycobacterium tuberculosis H37Rv
acgugcaugagcguucag

SEQ ID NO: 1310194 - RNA, 23 nt, Mycobacterium tuberculosis H37Rv
acgugcucguagacuugcugcuc

SEQ ID NO: 1310195 - RNA, 17 nt, Mycobacterium tuberculosis H37Rv
acguggcccuccucggu

SEQ ID NO: 1310196 - RNA, 16 nt, Mycobacterium tuberculosis H37Rv
acguggaugucucgau

SEQ ID NO: 1310197 - RNA, 14 nt, Mycobacterium tuberculosis H37Rv
acgugggccaugcu

SEQ ID NO: 1310198 - RNA, 22 nt, Mycobacterium tuberculosis H37Rv
acguggcuugaguuucggcgca

SEQ ID NO: 1310199 - RNA, 19 nt, Mycobacterium tuberculosis H37Rv
acguggcgcuggaccgggu

SEQ ID NO: 1310200 - RNA, 23 nt, Mycobacterium tuberculosis H37Rv
acgucguuuggccucagcccggc

SEQ ID NO: 1310201 - RNA, 17 nt, Mycobacterium tuberculosis H37Rv
acgucuccaccgcgaug

SEQ ID NO: 1310202 - RNA, 14 nt, Mycobacterium tuberculosis H37Rv
acgugauagccgga

SEQ ID NO: 1310203 - RNA, 20 nt, Mycobacterium tuberculosis H37Rv
acgugauauccuuugccgcc

SEQ ID NO: 1310204 - RNA, 22 nt, Mycobacterium tuberculosis H37Rv
acgugauauccuuugccgccga

SEQ ID NO: 1310205 - RNA, 19 nt, Mycobacterium tuberculosis H37Rv
acguuuggauggcuggcca

SEQ ID NO: 1310206 - RNA, 22 nt, Mycobacterium tuberculosis H37Rv
acguuguucagcccgccgacga

SEQ ID NO: 1310207 - RNA, 19 nt, Mycobacterium tuberculosis H37Rv
acguugucgccaacccggu

SEQ ID NO: 1310208 - RNA, 17 nt, Mycobacterium tuberculosis H37Rv
acguuucgcuguccgac

SEQ ID NO: 1310209 - RNA, 23 nt, Mycobacterium tuberculosis H37Rv
acguuggcgugcaccgcaucggg

SEQ ID NO: 1310210 - RNA, 18 nt, Mycobacterium tuberculosis H37Rv
acguuggcggccagcgca

SEQ ID NO: 1310211 - RNA, 20 nt, Mycobacterium tuberculosis H37Rv
acguuggccaggcccgaguu

SEQ ID NO: 1310212 - RNA, 15 nt, Mycobacterium tuberculosis H37Rv
acguuaccgaccgcg

SEQ ID NO: 1310213 - RNA, 17 nt, Mycobacterium tuberculosis H37Rv
acuacggccuggccacc

SEQ ID NO: 1310214 - RNA, 16 nt, Mycobacterium tuberculosis H37Rv
acuaggcccagcacgg

SEQ ID NO: 1310215 - RNA, 17 nt, Mycobacterium tuberculosis H37Rv
acuagcauugucgccgg

SEQ ID NO: 1310216 - RNA, 14 nt, Mycobacterium tuberculosis H37Rv
acuacuccgguccc

SEQ ID NO: 1310217 - RNA, 17 nt, Mycobacterium tuberculosis H37Rv
acgcggaguccgucgac

SEQ ID NO: 1310218 - RNA, 22 nt, Mycobacterium tuberculosis H37Rv
acgcggaguccgucgacaccgc

SEQ ID NO: 1310219 - RNA, 17 nt, Mycobacterium tuberculosis H37Rv
acgcggaaaccaucgcc

SEQ ID NO: 1310220 - RNA, 20 nt, Mycobacterium tuberculosis H37Rv
acgcgggcuaucgguucagc

SEQ ID NO: 1310221 - RNA, 16 nt, Mycobacterium tuberculosis H37Rv
acgcggcuuugacgcc

SEQ ID NO: 1310222 - RNA, 20 nt, Mycobacterium tuberculosis H37Rv
acgcggcugcgucgucugca

SEQ ID NO: 1310223 - RNA, 18 nt, Mycobacterium tuberculosis H37Rv
acgcgggugccgacgucg

SEQ ID NO: 1310224 - RNA, 17 nt, Mycobacterium tuberculosis H37Rv
acgcggguugcgcggcu

SEQ ID NO: 1310225 - RNA, 21 nt, Mycobacterium tuberculosis H37Rv
acgcggggaugucgaccgcga

SEQ ID NO: 1310226 - RNA, 18 nt, Mycobacterium tuberculosis H37Rv
acgcgggagucaucgcgg

SEQ ID NO: 1310227 - RNA, 13 nt, Mycobacterium tuberculosis H37Rv
acgcggucugcuc

SEQ ID NO: 1310228 - RNA, 18 nt, Mycobacterium tuberculosis H37Rv
acgcgguccucgagccga

SEQ ID NO: 1310229 - RNA, 19 nt, Mycobacterium tuberculosis H37Rv
acgcgguccucgagccgau

SEQ ID NO: 1310230 - RNA, 20 nt, Mycobacterium tuberculosis H37Rv
acgcggucccacucgucguc

SEQ ID NO: 1310231 - RNA, 12 nt, Mycobacterium tuberculosis H37Rv
acgcucggcgug

SEQ ID NO: 1310232 - RNA, 11 nt, Mycobacterium tuberculosis H37Rv
acgcucggcgu

SEQ ID NO: 1310233 - RNA, 15 nt, Mycobacterium tuberculosis H37Rv
acgcugagccggucg

SEQ ID NO: 1310234 - RNA, 16 nt, Mycobacterium tuberculosis H37Rv
acgcucggcggccagc

SEQ ID NO: 1310235 - RNA, 21 nt, Mycobacterium tuberculosis H37Rv
acgcucggcggggaccgcggu

SEQ ID NO: 1310236 - RNA, 11 nt, Mycobacterium tuberculosis H37Rv
acgcucggcgg

SEQ ID NO: 1310237 - RNA, 18 nt, Mycobacterium tuberculosis H37Rv
acgcucgcgaagccgguu

SEQ ID NO: 1310238 - RNA, 15 nt, Mycobacterium tuberculosis H37Rv
acgcucgcugcagca

SEQ ID NO: 1310239 - RNA, 21 nt, Mycobacterium tuberculosis H37Rv
acgcucccuacgagcccacgc

SEQ ID NO: 1310240 - RNA, 14 nt, Mycobacterium tuberculosis H37Rv
acgcggucgacgac

SEQ ID NO: 1310241 - RNA, 16 nt, Mycobacterium tuberculosis H37Rv
acgcucacccggcguc

SEQ ID NO: 1310242 - RNA, 20 nt, Mycobacterium tuberculosis H37Rv
acgcgaccaucucgacgucg

SEQ ID NO: 1310243 - RNA, 15 nt, Mycobacterium tuberculosis H37Rv
acgcgaccgcgaugg

SEQ ID NO: 1310244 - RNA, 14 nt, Mycobacterium tuberculosis H37Rv
acgcgaccgcgauc

SEQ ID NO: 1310245 - RNA, 16 nt, Mycobacterium tuberculosis H37Rv
acgcgacacacgccgc

SEQ ID NO: 1310246 - RNA, 16 nt, Mycobacterium tuberculosis H37Rv
acgcgauuucgucguc

SEQ ID NO: 1310247 - RNA, 17 nt, Mycobacterium tuberculosis H37Rv
acgcgcagagcguuccg

SEQ ID NO: 1310248 - RNA, 18 nt, Mycobacterium tuberculosis H37Rv
acgcgcagcaucggcgac

SEQ ID NO: 1310249 - RNA, 13 nt, Mycobacterium tuberculosis H37Rv
acgcgcaggccga

SEQ ID NO: 1310250 - RNA, 17 nt, Mycobacterium tuberculosis H37Rv
acgcgcggaucggcggc

SEQ ID NO: 1310251 - RNA, 15 nt, Mycobacterium tuberculosis H37Rv
acgcgaacagcucgu

SEQ ID NO: 1310252 - RNA, 22 nt, Mycobacterium tuberculosis H37Rv
acgcgaauaccagaccggccga

SEQ ID NO: 1310253 - RNA, 14 nt, Mycobacterium tuberculosis H37Rv
acgcgaacccgcga

SEQ ID NO: 1310254 - RNA, 16 nt, Mycobacterium tuberculosis H37Rv
acgccuugucggcgug

SEQ ID NO: 1310255 - RNA, 17 nt, Mycobacterium tuberculosis H37Rv
acgccuugacugaacuc

SEQ ID NO: 1310256 - RNA, 20 nt, Mycobacterium tuberculosis H37Rv
acgcagaaucgcccaauuuc

SEQ ID NO: 1310257 - RNA, 15 nt, Mycobacterium tuberculosis H37Rv
acgcagaccguccag

SEQ ID NO: 1310258 - RNA, 16 nt, Mycobacterium tuberculosis H37Rv
acgcagaagcccccaa

SEQ ID NO: 1310259 - RNA, 23 nt, Mycobacterium tuberculosis H37Rv
acgccuugcacaagcugaacuac

SEQ ID NO: 1310260 - RNA, 19 nt, Mycobacterium tuberculosis H37Rv
acgcuguccgcgugaaucc

SEQ ID NO: 1310261 - RNA, 15 nt, Mycobacterium tuberculosis H37Rv
acgcuguggcucgac

SEQ ID NO: 1310262 - RNA, 13 nt, Mycobacterium tuberculosis H37Rv
acgcugucaauca

SEQ ID NO: 1310263 - RNA, 21 nt, Mycobacterium tuberculosis H37Rv
acgcugugggcuuugccgucg

SEQ ID NO: 1310264 - RNA, 17 nt, Mycobacterium tuberculosis H37Rv
acgcuguggcucgacga

SEQ ID NO: 1310265 - RNA, 17 nt, Mycobacterium tuberculosis H37Rv
acgcuggcaaguccggu

SEQ ID NO: 1310266 - RNA, 20 nt, Mycobacterium tuberculosis H37Rv
acgcugcuggcaugcaggug

SEQ ID NO: 1310267 - RNA, 13 nt, Mycobacterium tuberculosis H37Rv
acgcugccgagcc

SEQ ID NO: 1310268 - RNA, 21 nt, Mycobacterium tuberculosis H37Rv
acgcugcccaaaagcgcggca

SEQ ID NO: 1310269 - RNA, 17 nt, Mycobacterium tuberculosis H37Rv
acggagaccggccgggu

SEQ ID NO: 1310270 - RNA, 22 nt, Mycobacterium tuberculosis H37Rv
acggagaccggccgggugaacc

SEQ ID NO: 1310271 - RNA, 12 nt, Mycobacterium tuberculosis H37Rv
acggaccgccac

SEQ ID NO: 1310272 - RNA, 18 nt, Mycobacterium tuberculosis H37Rv
acggaccuccucgcccau

SEQ ID NO: 1310273 - RNA, 11 nt, Mycobacterium tuberculosis H37Rv
acggaccgcca

SEQ ID NO: 1310274 - RNA, 16 nt, Mycobacterium tuberculosis H37Rv
acggaagaccgcggga

SEQ ID NO: 1310275 - RNA, 20 nt, Mycobacterium tuberculosis H37Rv
acggaaucgguuucgaccug

SEQ ID NO: 1310276 - RNA, 17 nt, Mycobacterium tuberculosis H37Rv
acgcuucugccugcgca

SEQ ID NO: 1310277 - RNA, 14 nt, Mycobacterium tuberculosis H37Rv
acgcuuucccgaug

SEQ ID NO: 1310278 - RNA, 22 nt, Mycobacterium tuberculosis H37Rv
acggcagcgcccagaucgccga

SEQ ID NO: 1310279 - RNA, 20 nt, Mycobacterium tuberculosis H37Rv
acggcagcgccaccgaccga

SEQ ID NO: 1310280 - RNA, 13 nt, Mycobacterium tuberculosis H37Rv
acggcagccaccg

SEQ ID NO: 1310281 - RNA, 13 nt, Mycobacterium tuberculosis H37Rv
acggcagcaccgg

SEQ ID NO: 1310282 - RNA, 16 nt, Mycobacterium tuberculosis H37Rv
acggcagaucccacgc

SEQ ID NO: 1310283 - RNA, 17 nt, Mycobacterium tuberculosis H37Rv
acggccacaccgucacg

SEQ ID NO: 1310284 - RNA, 19 nt, Mycobacterium tuberculosis H37Rv
acggccacaccgucacgcc

SEQ ID NO: 1310285 - RNA, 22 nt, Mycobacterium tuberculosis H37Rv
acggccacguaagcgguugucc

SEQ ID NO: 1310286 - RNA, 16 nt, Mycobacterium tuberculosis H37Rv
acggcauucgaccuca

SEQ ID NO: 1310287 - RNA, 20 nt, Mycobacterium tuberculosis H37Rv
acggcauguaccgaccgcgu

SEQ ID NO: 1310288 - RNA, 22 nt, Mycobacterium tuberculosis H37Rv
acggaugugcucaggucgcaga

SEQ ID NO: 1310289 - RNA, 14 nt, Mycobacterium tuberculosis H37Rv
acggaugccggucg

SEQ ID NO: 1310290 - RNA, 19 nt, Mycobacterium tuberculosis H37Rv
acggauaauucaacagcac

SEQ ID NO: 1310291 - RNA, 22 nt, Mycobacterium tuberculosis H37Rv
acggauaauucaacagcaccgc

SEQ ID NO: 1310292 - RNA, 19 nt, Mycobacterium tuberculosis H37Rv
acggcaagccauucacgag

SEQ ID NO: 1310293 - RNA, 21 nt, Mycobacterium tuberculosis H37Rv
acggcaagggcauacagcaug

SEQ ID NO: 1310294 - RNA, 16 nt, Mycobacterium tuberculosis H37Rv
acggcaagucuggcgg

SEQ ID NO: 1310295 - RNA, 16 nt, Mycobacterium tuberculosis H37Rv
acggcaccaccaagcu

SEQ ID NO: 1310296 - RNA, 14 nt, Mycobacterium tuberculosis H37Rv
acggcacaaucggc

SEQ ID NO: 1310297 - RNA, 16 nt, Mycobacterium tuberculosis H37Rv
acggcacaaucggcgc

SEQ ID NO: 1310298 - RNA, 15 nt, Mycobacterium tuberculosis H37Rv
acggcaaucaacgca

SEQ ID NO: 1310299 - RNA, 17 nt, Mycobacterium tuberculosis H37Rv
acggcacccugcggcac

SEQ ID NO: 1310300 - RNA, 16 nt, Mycobacterium tuberculosis H37Rv
acggcaccucgacguc

SEQ ID NO: 1310301 - RNA, 17 nt, Mycobacterium tuberculosis H37Rv
acggcaccucgacgucg

SEQ ID NO: 1310302 - RNA, 13 nt, Mycobacterium tuberculosis H37Rv
acggcacccccga

SEQ ID NO: 1310303 - RNA, 19 nt, Mycobacterium tuberculosis H37Rv
acugucuugggggccaacc

SEQ ID NO: 1310304 - RNA, 17 nt, Mycobacterium tuberculosis H37Rv
acugugaguagcccgcg

SEQ ID NO: 1310305 - RNA, 19 nt, Mycobacterium tuberculosis H37Rv
acugugaguagcccgcguc

SEQ ID NO: 1310306 - RNA, 15 nt, Mycobacterium tuberculosis H37Rv
acugugcguuccuga

SEQ ID NO: 1310307 - RNA, 16 nt, Mycobacterium tuberculosis H37Rv
acugugcuauggccgc

SEQ ID NO: 1310308 - RNA, 22 nt, Mycobacterium tuberculosis H37Rv
acuggucgacgucgguguaacc

SEQ ID NO: 1310309 - RNA, 12 nt, Mycobacterium tuberculosis H37Rv
acuggucgacgc

SEQ ID NO: 1310310 - RNA, 15 nt, Mycobacterium tuberculosis H37Rv
acuggucgacgccga

SEQ ID NO: 1310311 - RNA, 14 nt, Mycobacterium tuberculosis H37Rv
acuggugacccuga

SEQ ID NO: 1310312 - RNA, 18 nt, Mycobacterium tuberculosis H37Rv
acuuagcccgauggugcc

SEQ ID NO: 1310313 - RNA, 16 nt, Mycobacterium tuberculosis H37Rv
acugccgcgcucgcgc

SEQ ID NO: 1310314 - RNA, 14 nt, Mycobacterium tuberculosis H37Rv
acugcggaagccac

SEQ ID NO: 1310315 - RNA, 20 nt, Mycobacterium tuberculosis H37Rv
acugcgcgcguugcggucaa

SEQ ID NO: 1310316 - RNA, 14 nt, Mycobacterium tuberculosis H37Rv
acugcggucgccca

SEQ ID NO: 1310317 - RNA, 23 nt, Mycobacterium tuberculosis H37Rv
acuggccguuucggcgccgucgc

SEQ ID NO: 1310318 - RNA, 13 nt, Mycobacterium tuberculosis H37Rv
acugggucgccuc

SEQ ID NO: 1310319 - RNA, 17 nt, Mycobacterium tuberculosis H37Rv
acuggccgcgucgcuga

SEQ ID NO: 1310320 - RNA, 17 nt, Mycobacterium tuberculosis H37Rv
acuggccguuucggcgc

SEQ ID NO: 1310321 - RNA, 20 nt, Mycobacterium tuberculosis H37Rv
acuggcccggacaugcgggc

SEQ ID NO: 1310322 - RNA, 20 nt, Mycobacterium tuberculosis H37Rv
acuggcccccacaccacgcu

SEQ ID NO: 1310323 - RNA, 16 nt, Mycobacterium tuberculosis H37Rv
acugcagcgaagccgg

SEQ ID NO: 1310324 - RNA, 15 nt, Mycobacterium tuberculosis H37Rv
acugaugucacccgc

SEQ ID NO: 1310325 - RNA, 19 nt, Mycobacterium tuberculosis H37Rv
acugaucguuggcaucggc

SEQ ID NO: 1310326 - RNA, 19 nt, Mycobacterium tuberculosis H37Rv
acugcccugauugaagccc

SEQ ID NO: 1310327 - RNA, 18 nt, Mycobacterium tuberculosis H37Rv
acugccccgcaucgccca

SEQ ID NO: 1310328 - RNA, 19 nt, Mycobacterium tuberculosis H37Rv
acugccccgcaucgcccaa

SEQ ID NO: 1310329 - RNA, 22 nt, Mycobacterium tuberculosis H37Rv
acugcccgcguuugcgaagccc

SEQ ID NO: 1310330 - RNA, 18 nt, Mycobacterium tuberculosis H37Rv
acugcaugguggcgccga

SEQ ID NO: 1310331 - RNA, 21 nt, Mycobacterium tuberculosis H37Rv
acugcaugaacugcucgccga

SEQ ID NO: 1310332 - RNA, 18 nt, Mycobacterium tuberculosis H37Rv
acugcagugaucgugacc

SEQ ID NO: 1310333 - RNA, 21 nt, Mycobacterium tuberculosis H37Rv
acugcaucacgccgucgcaga

SEQ ID NO: 1310334 - RNA, 13 nt, Mycobacterium tuberculosis H37Rv
acugcagcgcggc

SEQ ID NO: 1310335 - RNA, 22 nt, Mycobacterium tuberculosis H37Rv
acugcagcgccucgauccgcau

SEQ ID NO: 1310336 - RNA, 21 nt, Mycobacterium tuberculosis H37Rv
acugaauuuggugaagccgua

SEQ ID NO: 1310337 - RNA, 15 nt, Mycobacterium tuberculosis H37Rv
acugacgucgaacuc

SEQ ID NO: 1310338 - RNA, 20 nt, Mycobacterium tuberculosis H37Rv
acuaucggccgccggaucag

SEQ ID NO: 1310339 - RNA, 19 nt, Mycobacterium tuberculosis H37Rv
acuaucgucgugucgccgc

SEQ ID NO: 1310340 - RNA, 23 nt, Mycobacterium tuberculosis H37Rv
acugaagccgcgagcgcgcgacu

SEQ ID NO: 1310341 - RNA, 15 nt, Mycobacterium tuberculosis H37Rv
acuuugguugcccgc

SEQ ID NO: 1310342 - RNA, 17 nt, Mycobacterium tuberculosis H37Rv
agaaacgccgagcgcca

SEQ ID NO: 1310343 - RNA, 12 nt, Mycobacterium tuberculosis H37Rv
agaacaccaccg

SEQ ID NO: 1310344 - RNA, 16 nt, Mycobacterium tuberculosis H37Rv
agaaguucgugagcga

SEQ ID NO: 1310345 - RNA, 13 nt, Mycobacterium tuberculosis H37Rv
agaaggccgcacc

SEQ ID NO: 1310346 - RNA, 15 nt, Mycobacterium tuberculosis H37Rv
agaagcccgaagacg

SEQ ID NO: 1310347 - RNA, 12 nt, Mycobacterium tuberculosis H37Rv
agaacucguuga

SEQ ID NO: 1310348 - RNA, 19 nt, Mycobacterium tuberculosis H37Rv
agaacggaugccggucggc

SEQ ID NO: 1310349 - RNA, 14 nt, Mycobacterium tuberculosis H37Rv
agaacggcgaucac

SEQ ID NO: 1310350 - RNA, 14 nt, Mycobacterium tuberculosis H37Rv
agaacggcgggcga

SEQ ID NO: 1310351 - RNA, 15 nt, Mycobacterium tuberculosis H37Rv
agaacguagcgccca

SEQ ID NO: 1310352 - RNA, 16 nt, Mycobacterium tuberculosis H37Rv
agaacgcgucguagcg

SEQ ID NO: 1310353 - RNA, 17 nt, Mycobacterium tuberculosis H37Rv
agaaccggucgcagugc

SEQ ID NO: 1310354 - RNA, 19 nt, Mycobacterium tuberculosis H37Rv
agacgaacagcacgacugc

SEQ ID NO: 1310355 - RNA, 19 nt, Mycobacterium tuberculosis H37Rv
agacgauggcaacggcauc

SEQ ID NO: 1310356 - RNA, 20 nt, Mycobacterium tuberculosis H37Rv
agacgcaaaagcuccuaaau

SEQ ID NO: 1310357 - RNA, 18 nt, Mycobacterium tuberculosis H37Rv
agacgcagaagcccccaa

SEQ ID NO: 1310358 - RNA, 14 nt, Mycobacterium tuberculosis H37Rv
agacgcagagucgc

SEQ ID NO: 1310359 - RNA, 22 nt, Mycobacterium tuberculosis H37Rv
agacgccgccgcugccgcccuu

SEQ ID NO: 1310360 - RNA, 18 nt, Mycobacterium tuberculosis H37Rv
agacgccggcgaugccgg

SEQ ID NO: 1310361 - RNA, 14 nt, Mycobacterium tuberculosis H37Rv
agacgccgccgcug

SEQ ID NO: 1310362 - RNA, 19 nt, Mycobacterium tuberculosis H37Rv
agacgcaaaaucgcccaau

SEQ ID NO: 1310363 - RNA, 15 nt, Mycobacterium tuberculosis H37Rv
agaccgggcaacggc

SEQ ID NO: 1310364 - RNA, 12 nt, Mycobacterium tuberculosis H37Rv
agaccgcgagca

SEQ ID NO: 1310365 - RNA, 15 nt, Mycobacterium tuberculosis H37Rv
agaccgcagucgcug

SEQ ID NO: 1310366 - RNA, 23 nt, Mycobacterium tuberculosis H37Rv
agaccgcuacccgcgcgaccuga

SEQ ID NO: 1310367 - RNA, 19 nt, Mycobacterium tuberculosis H37Rv
agaccaugccgacgacggg

SEQ ID NO: 1310368 - RNA, 12 nt, Mycobacterium tuberculosis H37Rv
agacccggcacc

SEQ ID NO: 1310369 - RNA, 21 nt, Mycobacterium tuberculosis H37Rv
agaccacaacgccucgccauc

SEQ ID NO: 1310370 - RNA, 17 nt, Mycobacterium tuberculosis H37Rv
agacgugguagccggcg

SEQ ID NO: 1310371 - RNA, 17 nt, Mycobacterium tuberculosis H37Rv
agacucgucgaugcggu

SEQ ID NO: 1310372 - RNA, 21 nt, Mycobacterium tuberculosis H37Rv
agacguugccaacaccggcga

SEQ ID NO: 1310373 - RNA, 13 nt, Mycobacterium tuberculosis H37Rv
agacguccgcggu

SEQ ID NO: 1310374 - RNA, 15 nt, Mycobacterium tuberculosis H37Rv
agacggucgaucaca

SEQ ID NO: 1310375 - RNA, 15 nt, Mycobacterium tuberculosis H37Rv
agacgguccggucgc

SEQ ID NO: 1310376 - RNA, 17 nt, Mycobacterium tuberculosis H37Rv
agacggcacccccgacg

SEQ ID NO: 1310377 - RNA, 12 nt, Mycobacterium tuberculosis H37Rv
agacggccaccg

SEQ ID NO: 1310378 - RNA, 16 nt, Mycobacterium tuberculosis H37Rv
agacggcugccacgcg

SEQ ID NO: 1310379 - RNA, 22 nt, Mycobacterium tuberculosis H37Rv
agacgcuaaagcccccgcacgc

SEQ ID NO: 1310380 - RNA, 16 nt, Mycobacterium tuberculosis H37Rv
agacgccgucggcgcc

SEQ ID NO: 1310381 - RNA, 14 nt, Mycobacterium tuberculosis H37Rv
agacgccggggaac

SEQ ID NO: 1310382 - RNA, 12 nt, Mycobacterium tuberculosis H37Rv
agacgccgucga

SEQ ID NO: 1310383 - RNA, 17 nt, Mycobacterium tuberculosis H37Rv
agagauuucuugaccgc

SEQ ID NO: 1310384 - RNA, 21 nt, Mycobacterium tuberculosis H37Rv
agagcauucgggcgcccucau

SEQ ID NO: 1310385 - RNA, 21 nt, Mycobacterium tuberculosis H37Rv
agagccccggcaagcgcagac

SEQ ID NO: 1310386 - RNA, 15 nt, Mycobacterium tuberculosis H37Rv
agagcggcaccagau

SEQ ID NO: 1310387 - RNA, 14 nt, Mycobacterium tuberculosis H37Rv
agagcgcaccgcga

SEQ ID NO: 1310388 - RNA, 21 nt, Mycobacterium tuberculosis H37Rv
agacuuccucggauugcagcg

SEQ ID NO: 1310389 - RNA, 19 nt, Mycobacterium tuberculosis H37Rv
agaucuucgagcgcaucag

SEQ ID NO: 1310390 - RNA, 13 nt, Mycobacterium tuberculosis H37Rv
agaucuugcgcaa

SEQ ID NO: 1310391 - RNA, 20 nt, Mycobacterium tuberculosis H37Rv
agaucggguggcgggucagc

SEQ ID NO: 1310392 - RNA, 14 nt, Mycobacterium tuberculosis H37Rv
agaucguuccaggc

SEQ ID NO: 1310393 - RNA, 22 nt, Mycobacterium tuberculosis H37Rv
agaucguuccaggccgcgucga

SEQ ID NO: 1310394 - RNA, 22 nt, Mycobacterium tuberculosis H37Rv
agaucguugccucgucgccgcg

SEQ ID NO: 1310395 - RNA, 22 nt, Mycobacterium tuberculosis H37Rv
agaucgugaaaguaagccgcgc

SEQ ID NO: 1310396 - RNA, 20 nt, Mycobacterium tuberculosis H37Rv
agaucggcgaaucgggcaaa

SEQ ID NO: 1310397 - RNA, 13 nt, Mycobacterium tuberculosis H37Rv
agaucgcugcgaa

SEQ ID NO: 1310398 - RNA, 14 nt, Mycobacterium tuberculosis H37Rv
agaucgcugcgaag

SEQ ID NO: 1310399 - RNA, 20 nt, Mycobacterium tuberculosis H37Rv
agaucgaacgcagccagcgc

SEQ ID NO: 1310400 - RNA, 22 nt, Mycobacterium tuberculosis H37Rv
agaucauuucgguaauggccgc

SEQ ID NO: 1310401 - RNA, 20 nt, Mycobacterium tuberculosis H37Rv
agauguuguacggcccgcau

SEQ ID NO: 1310402 - RNA, 16 nt, Mycobacterium tuberculosis H37Rv
agaugugguaccagcc

SEQ ID NO: 1310403 - RNA, 14 nt, Mycobacterium tuberculosis H37Rv
agaugcugcacccg

SEQ ID NO: 1310404 - RNA, 16 nt, Mycobacterium tuberculosis H37Rv
agaugcguuccgcgac

SEQ ID NO: 1310405 - RNA, 16 nt, Mycobacterium tuberculosis H37Rv
agaugcggaacgccga

SEQ ID NO: 1310406 - RNA, 16 nt, Mycobacterium tuberculosis H37Rv
agaugcccgcgaucau

SEQ ID NO: 1310407 - RNA, 12 nt, Mycobacterium tuberculosis H37Rv
agauacggccac

SEQ ID NO: 1310408 - RNA, 17 nt, Mycobacterium tuberculosis H37Rv
agauaccaccgccgcug

SEQ ID NO: 1310409 - RNA, 24 nt, Mycobacterium tuberculosis H37Rv
agaucaccgccaccaccagggcaa

SEQ ID NO: 1310410 - RNA, 13 nt, Mycobacterium tuberculosis H37Rv
agaucagcaccgu

SEQ ID NO: 1310411 - RNA, 21 nt, Mycobacterium tuberculosis H37Rv
agaucagcaccgacagcccga

SEQ ID NO: 1310412 - RNA, 23 nt, Mycobacterium tuberculosis H37Rv
agagcuccgucgcggccgagacg

SEQ ID NO: 1310413 - RNA, 15 nt, Mycobacterium tuberculosis H37Rv
agagguagagcagau

SEQ ID NO: 1310414 - RNA, 21 nt, Mycobacterium tuberculosis H37Rv
agaguucgcgcgccgcgacga

SEQ ID NO: 1310415 - RNA, 13 nt, Mycobacterium tuberculosis H37Rv
agaguucccgaaa

SEQ ID NO: 1310416 - RNA, 15 nt, Mycobacterium tuberculosis H37Rv
agagucgcacugcgc

SEQ ID NO: 1310417 - RNA, 14 nt, Mycobacterium tuberculosis H37Rv
agagucgcccgcac

SEQ ID NO: 1310418 - RNA, 15 nt, Mycobacterium tuberculosis H37Rv
aacuccaugccgcug

SEQ ID NO: 1310419 - RNA, 23 nt, Mycobacterium tuberculosis H37Rv
aacuccgccaccaucgccucggc

SEQ ID NO: 1310420 - RNA, 22 nt, Mycobacterium tuberculosis H37Rv
aacucccccgcuacgcgcgcuc

SEQ ID NO: 1310421 - RNA, 19 nt, Mycobacterium tuberculosis H37Rv
aacuccucgcugucgauca

SEQ ID NO: 1310422 - RNA, 17 nt, Mycobacterium tuberculosis H37Rv
aacuccuuaucgucgac

SEQ ID NO: 1310423 - RNA, 17 nt, Mycobacterium tuberculosis H37Rv
aacucgaguagucgcug

SEQ ID NO: 1310424 - RNA, 23 nt, Mycobacterium tuberculosis H37Rv
aacugacguuaccgccgcauucg

SEQ ID NO: 1310425 - RNA, 12 nt, Mycobacterium tuberculosis H37Rv
aacugcgccguu

SEQ ID NO: 1310426 - RNA, 16 nt, Mycobacterium tuberculosis H37Rv
aacugccggacuaccg

SEQ ID NO: 1310427 - RNA, 14 nt, Mycobacterium tuberculosis H37Rv
aacugccgcggcac

SEQ ID NO: 1310428 - RNA, 17 nt, Mycobacterium tuberculosis H37Rv
aacucguccagcagugc

SEQ ID NO: 1310429 - RNA, 16 nt, Mycobacterium tuberculosis H37Rv
aacucgucgcugccca

SEQ ID NO: 1310430 - RNA, 20 nt, Mycobacterium tuberculosis H37Rv
aacucgagaguggccucguc

SEQ ID NO: 1310431 - RNA, 15 nt, Mycobacterium tuberculosis H37Rv
aacucgccccgcgug

SEQ ID NO: 1310432 - RNA, 15 nt, Mycobacterium tuberculosis H37Rv
aacucgggggcugca

SEQ ID NO: 1310433 - RNA, 13 nt, Mycobacterium tuberculosis H37Rv
aacucggcgucgu

SEQ ID NO: 1310434 - RNA, 17 nt, Mycobacterium tuberculosis H37Rv
aagaccgaacagcggca

SEQ ID NO: 1310435 - RNA, 12 nt, Mycobacterium tuberculosis H37Rv
aagaaugccgcc

SEQ ID NO: 1310436 - RNA, 14 nt, Mycobacterium tuberculosis H37Rv
aacugggcaaugac

SEQ ID NO: 1310437 - RNA, 14 nt, Mycobacterium tuberculosis H37Rv
aacuggaccggugc

SEQ ID NO: 1310438 - RNA, 23 nt, Mycobacterium tuberculosis H37Rv
aacuggacgggguacugcggcuc

SEQ ID NO: 1310439 - RNA, 17 nt, Mycobacterium tuberculosis H37Rv
aacuuccauuuucgcca

SEQ ID NO: 1310440 - RNA, 17 nt, Mycobacterium tuberculosis H37Rv
aacuucgccagcggccc

SEQ ID NO: 1310441 - RNA, 23 nt, Mycobacterium tuberculosis H37Rv
aacacgaugcccaagcccucgac

SEQ ID NO: 1310442 - RNA, 17 nt, Mycobacterium tuberculosis H37Rv
aacaccucauacgccaa

SEQ ID NO: 1310443 - RNA, 15 nt, Mycobacterium tuberculosis H37Rv
aaccgcuuugaauug

SEQ ID NO: 1310444 - RNA, 22 nt, Mycobacterium tuberculosis H37Rv
aaccgcugccggugugcggcgu

SEQ ID NO: 1310445 - RNA, 16 nt, Mycobacterium tuberculosis H37Rv
aaccggacgcccucac

SEQ ID NO: 1310446 - RNA, 20 nt, Mycobacterium tuberculosis H37Rv
aaccggccaucgaccguccg

SEQ ID NO: 1310447 - RNA, 21 nt, Mycobacterium tuberculosis H37Rv
aaccggccaugucuccgacau

SEQ ID NO: 1310448 - RNA, 14 nt, Mycobacterium tuberculosis H37Rv
aaccggcagcggua

SEQ ID NO: 1310449 - RNA, 21 nt, Mycobacterium tuberculosis H37Rv
aaccggagucgucggcaacgc

SEQ ID NO: 1310450 - RNA, 20 nt, Mycobacterium tuberculosis H37Rv
aaccggcgcuaaaccgucgc

SEQ ID NO: 1310451 - RNA, 13 nt, Mycobacterium tuberculosis H37Rv
aaccggucagcac

SEQ ID NO: 1310452 - RNA, 14 nt, Mycobacterium tuberculosis H37Rv
aaccgguucgucga

SEQ ID NO: 1310453 - RNA, 21 nt, Mycobacterium tuberculosis H37Rv
aaccguugcugcgcagcggca

SEQ ID NO: 1310454 - RNA, 19 nt, Mycobacterium tuberculosis H37Rv
aaccgugcacgucagcgga

SEQ ID NO: 1310455 - RNA, 22 nt, Mycobacterium tuberculosis H37Rv
aaccgugucgccgccgcgacug

SEQ ID NO: 1310456 - RNA, 22 nt, Mycobacterium tuberculosis H37Rv
aaccuccucggguucgucaguc

SEQ ID NO: 1310457 - RNA, 21 nt, Mycobacterium tuberculosis H37Rv
aaccucgguuugggaauccgc

SEQ ID NO: 1310458 - RNA, 21 nt, Mycobacterium tuberculosis H37Rv
aaccuggggugaacuccauga

SEQ ID NO: 1310459 - RNA, 12 nt, Mycobacterium tuberculosis H37Rv
aaccugcuggga

SEQ ID NO: 1310460 - RNA, 20 nt, Mycobacterium tuberculosis H37Rv
aacgcugcgcccggaccacu

SEQ ID NO: 1310461 - RNA, 14 nt, Mycobacterium tuberculosis H37Rv
aacgcggacaccgc

SEQ ID NO: 1310462 - RNA, 14 nt, Mycobacterium tuberculosis H37Rv
aacgcggccucguc

SEQ ID NO: 1310463 - RNA, 19 nt, Mycobacterium tuberculosis H37Rv
aacgcgggaacgaugccgc

SEQ ID NO: 1310464 - RNA, 20 nt, Mycobacterium tuberculosis H37Rv
aacgcguauucggcaucgcc

SEQ ID NO: 1310465 - RNA, 22 nt, Mycobacterium tuberculosis H37Rv
aacgcgucccgccgcaccgccg

SEQ ID NO: 1310466 - RNA, 14 nt, Mycobacterium tuberculosis H37Rv
aacgcgucggucga

SEQ ID NO: 1310467 - RNA, 15 nt, Mycobacterium tuberculosis H37Rv
aacgcgucgcccgca

SEQ ID NO: 1310468 - RNA, 16 nt, Mycobacterium tuberculosis H37Rv
aacgccggguucgccg

SEQ ID NO: 1310469 - RNA, 15 nt, Mycobacterium tuberculosis H37Rv
aacgccgugccguac

SEQ ID NO: 1310470 - RNA, 16 nt, Mycobacterium tuberculosis H37Rv
aacgacucgagagcga

SEQ ID NO: 1310471 - RNA, 19 nt, Mycobacterium tuberculosis H37Rv
aacgacgggucguucuccg

SEQ ID NO: 1310472 - RNA, 23 nt, Mycobacterium tuberculosis H37Rv
aacgacuguggcgccgccggcac

SEQ ID NO: 1310473 - RNA, 13 nt, Mycobacterium tuberculosis H37Rv
aacgacgacgaca

SEQ ID NO: 1310474 - RNA, 14 nt, Mycobacterium tuberculosis H37Rv
aaggcucaccaggc

SEQ ID NO: 1310475 - RNA, 15 nt, Mycobacterium tuberculosis H37Rv
aaggcucaccaggcg

SEQ ID NO: 1310476 - RNA, 19 nt, Mycobacterium tuberculosis H37Rv
aaggucgcugcuugcgggc

SEQ ID NO: 1310477 - RNA, 14 nt, Mycobacterium tuberculosis H37Rv
aaggucaccgucga

SEQ ID NO: 1310478 - RNA, 18 nt, Mycobacterium tuberculosis H37Rv
aaggccggagucgacgac

SEQ ID NO: 1310479 - RNA, 15 nt, Mycobacterium tuberculosis H37Rv
aaggccgcaccgcca

SEQ ID NO: 1310480 - RNA, 16 nt, Mycobacterium tuberculosis H37Rv
aaggccgccaaccguu

SEQ ID NO: 1310481 - RNA, 14 nt, Mycobacterium tuberculosis H37Rv
aaggccgcaccgcc

SEQ ID NO: 1310482 - RNA, 13 nt, Mycobacterium tuberculosis H37Rv
aaggcgacucggu

SEQ ID NO: 1310483 - RNA, 13 nt, Mycobacterium tuberculosis H37Rv
aagcggccucgac

SEQ ID NO: 1310484 - RNA, 12 nt, Mycobacterium tuberculosis H37Rv
aagccgcccgag

SEQ ID NO: 1310485 - RNA, 15 nt, Mycobacterium tuberculosis H37Rv
aagccgccgcgacca

SEQ ID NO: 1310486 - RNA, 23 nt, Mycobacterium tuberculosis H37Rv
aagcccucgacguccaucccggc

SEQ ID NO: 1310487 - RNA, 16 nt, Mycobacterium tuberculosis H37Rv
aagccguguucgaccg

SEQ ID NO: 1310488 - RNA, 22 nt, Mycobacterium tuberculosis H37Rv
aagccguucgcgucgccgauga

SEQ ID NO: 1310489 - RNA, 14 nt, Mycobacterium tuberculosis H37Rv
aagccggccacgca

SEQ ID NO: 1310490 - RNA, 20 nt, Mycobacterium tuberculosis H37Rv
aagccagaucgcuaggaccg

SEQ ID NO: 1310491 - RNA, 22 nt, Mycobacterium tuberculosis H37Rv
aagacgcggucgacgacgcccu

SEQ ID NO: 1310492 - RNA, 19 nt, Mycobacterium tuberculosis H37Rv
aagaccugaguugguucga

SEQ ID NO: 1310493 - RNA, 15 nt, Mycobacterium tuberculosis H37Rv
aagacggauuguccg

SEQ ID NO: 1310494 - RNA, 18 nt, Mycobacterium tuberculosis H37Rv
aaguucgugagcgaacgg

SEQ ID NO: 1310495 - RNA, 23 nt, Mycobacterium tuberculosis H37Rv
aagugucuccggcaacagcacca

SEQ ID NO: 1310496 - RNA, 16 nt, Mycobacterium tuberculosis H37Rv
aaguggaucuggcgca

SEQ ID NO: 1310497 - RNA, 19 nt, Mycobacterium tuberculosis H37Rv
aaguggcgucagugcagaa

SEQ ID NO: 1310498 - RNA, 14 nt, Mycobacterium tuberculosis H37Rv
aaggugccgaccgu

SEQ ID NO: 1310499 - RNA, 22 nt, Mycobacterium tuberculosis H37Rv
aagucgucauauucuuggucga

SEQ ID NO: 1310500 - RNA, 13 nt, Mycobacterium tuberculosis H37Rv
aagucgccgguga

SEQ ID NO: 1310501 - RNA, 14 nt, Mycobacterium tuberculosis H37Rv
aaguugcccaggug

SEQ ID NO: 1310502 - RNA, 18 nt, Mycobacterium tuberculosis H37Rv
aaguuggcugagcagcgc

SEQ ID NO: 1310503 - RNA, 19 nt, Mycobacterium tuberculosis H37Rv
aaguuguagacgucgaccg

SEQ ID NO: 1310504 - RNA, 20 nt, Mycobacterium tuberculosis H37Rv
aauacgugcgaaucgagacg

SEQ ID NO: 1310505 - RNA, 17 nt, Mycobacterium tuberculosis H37Rv
aauaucggggccacuga

SEQ ID NO: 1310506 - RNA, 18 nt, Mycobacterium tuberculosis H37Rv
acagcaucacgcccacga

SEQ ID NO: 1310507 - RNA, 19 nt, Mycobacterium tuberculosis H37Rv
acagcgaaccggcugggcg

SEQ ID NO: 1310508 - RNA, 13 nt, Mycobacterium tuberculosis H37Rv
acagcgacagcgu

SEQ ID NO: 1310509 - RNA, 20 nt, Mycobacterium tuberculosis H37Rv
acagcggcggcgucgacggc

SEQ ID NO: 1310510 - RNA, 20 nt, Mycobacterium tuberculosis H37Rv
acagcggaauuagucgccgc

SEQ ID NO: 1310511 - RNA, 19 nt, Mycobacterium tuberculosis H37Rv
acagcggccauaucgccca

SEQ ID NO: 1310512 - RNA, 18 nt, Mycobacterium tuberculosis H37Rv
acagcgggggcagcgcga

SEQ ID NO: 1310513 - RNA, 21 nt, Mycobacterium tuberculosis H37Rv
acagcguaugcacaugauccc

SEQ ID NO: 1310514 - RNA, 18 nt, Mycobacterium tuberculosis H37Rv
acagcgucaaccggucca

SEQ ID NO: 1310515 - RNA, 13 nt, Mycobacterium tuberculosis H37Rv
acaggacgucggc

SEQ ID NO: 1310516 - RNA, 15 nt, Mycobacterium tuberculosis H37Rv
acaggacgucggcga

SEQ ID NO: 1310517 - RNA, 14 nt, Mycobacterium tuberculosis H37Rv
acaggccggccacc

SEQ ID NO: 1310518 - RNA, 12 nt, Mycobacterium tuberculosis H37Rv
acaggccgucga

SEQ ID NO: 1310519 - RNA, 21 nt, Mycobacterium tuberculosis H37Rv
acaggccuaggucgacgccga

SEQ ID NO: 1310520 - RNA, 22 nt, Mycobacterium tuberculosis H37Rv
acaggaagucgcggacgucgcc

SEQ ID NO: 1310521 - RNA, 14 nt, Mycobacterium tuberculosis H37Rv
acaggaagcgaccg

SEQ ID NO: 1310522 - RNA, 22 nt, Mycobacterium tuberculosis H37Rv
acagcuucuucguauaggcgau

SEQ ID NO: 1310523 - RNA, 17 nt, Mycobacterium tuberculosis H37Rv
acaggcguccaucgcca

SEQ ID NO: 1310524 - RNA, 15 nt, Mycobacterium tuberculosis H37Rv
acagguagucgccgg

SEQ ID NO: 1310525 - RNA, 13 nt, Mycobacterium tuberculosis H37Rv
acagguagucgcc

SEQ ID NO: 1310526 - RNA, 13 nt, Mycobacterium tuberculosis H37Rv
acaggucggccca

SEQ ID NO: 1310527 - RNA, 17 nt, Mycobacterium tuberculosis H37Rv
acaggcggcggccuggc

SEQ ID NO: 1310528 - RNA, 19 nt, Mycobacterium tuberculosis H37Rv
acaggucgcccaacaccgc

SEQ ID NO: 1310529 - RNA, 15 nt, Mycobacterium tuberculosis H37Rv
acagacgacgucggc

SEQ ID NO: 1310530 - RNA, 17 nt, Mycobacterium tuberculosis H37Rv
acagacggggucgcccg

SEQ ID NO: 1310531 - RNA, 19 nt, Mycobacterium tuberculosis H37Rv
acagaccgaacagcaccga

SEQ ID NO: 1310532 - RNA, 16 nt, Mycobacterium tuberculosis H37Rv
acagaccuagcaccgc

SEQ ID NO: 1310533 - RNA, 15 nt, Mycobacterium tuberculosis H37Rv
acagaccgaacagca

SEQ ID NO: 1310534 - RNA, 15 nt, Mycobacterium tuberculosis H37Rv
acagagucaccgcgc

SEQ ID NO: 1310535 - RNA, 22 nt, Mycobacterium tuberculosis H37Rv
acagauacuucaaugcugggau

SEQ ID NO: 1310536 - RNA, 18 nt, Mycobacterium tuberculosis H37Rv
acagaucuggguucccga

SEQ ID NO: 1310537 - RNA, 19 nt, Mycobacterium tuberculosis H37Rv
acagcacccagacgauggc

SEQ ID NO: 1310538 - RNA, 14 nt, Mycobacterium tuberculosis H37Rv
acagcaauccgcaa

SEQ ID NO: 1310539 - RNA, 17 nt, Mycobacterium tuberculosis H37Rv
acacggugcugccguug

SEQ ID NO: 1310540 - RNA, 17 nt, Mycobacterium tuberculosis H37Rv
acacggucgucgcgagc

SEQ ID NO: 1310541 - RNA, 21 nt, Mycobacterium tuberculosis H37Rv
acacgguacugugggcgaucg

SEQ ID NO: 1310542 - RNA, 21 nt, Mycobacterium tuberculosis H37Rv
acacguccggcgaugaccaga

SEQ ID NO: 1310543 - RNA, 14 nt, Mycobacterium tuberculosis H37Rv
acacguucggcguc

SEQ ID NO: 1310544 - RNA, 15 nt, Mycobacterium tuberculosis H37Rv
acacguucucaccac

SEQ ID NO: 1310545 - RNA, 21 nt, Mycobacterium tuberculosis H37Rv
acacguugccgaucccggcga

SEQ ID NO: 1310546 - RNA, 18 nt, Mycobacterium tuberculosis H37Rv
acaccacgauggcggcca

SEQ ID NO: 1310547 - RNA, 15 nt, Mycobacterium tuberculosis H37Rv
acaccacgacgcgau

SEQ ID NO: 1310548 - RNA, 19 nt, Mycobacterium tuberculosis H37Rv
acaccacggaccagcgccg

SEQ ID NO: 1310549 - RNA, 21 nt, Mycobacterium tuberculosis H37Rv
acaccacgcuuaacagcgggu

SEQ ID NO: 1310550 - RNA, 20 nt, Mycobacterium tuberculosis H37Rv
acacauccaguaaccguccg

SEQ ID NO: 1310551 - RNA, 22 nt, Mycobacterium tuberculosis H37Rv
acaccaucaaggacucggacgc

SEQ ID NO: 1310552 - RNA, 20 nt, Mycobacterium tuberculosis H37Rv
acaccaugguggugaugcca

SEQ ID NO: 1310553 - RNA, 12 nt, Mycobacterium tuberculosis H37Rv
acaccagcgggc

SEQ ID NO: 1310554 - RNA, 22 nt, Mycobacterium tuberculosis H37Rv
acaccagcucgagguccucagc

SEQ ID NO: 1310555 - RNA, 14 nt, Mycobacterium tuberculosis H37Rv
acacccagccgcag

SEQ ID NO: 1310556 - RNA, 19 nt, Mycobacterium tuberculosis H37Rv
acacccuccacagcggcca

SEQ ID NO: 1310557 - RNA, 12 nt, Mycobacterium tuberculosis H37Rv
acacccgagggc

SEQ ID NO: 1310558 - RNA, 15 nt, Mycobacterium tuberculosis H37Rv
acaccgccagcauga

SEQ ID NO: 1310559 - RNA, 15 nt, Mycobacterium tuberculosis H37Rv
acaccgccagcggca

SEQ ID NO: 1310560 - RNA, 19 nt, Mycobacterium tuberculosis H37Rv
acaccgcccgacccaucac

SEQ ID NO: 1310561 - RNA, 15 nt, Mycobacterium tuberculosis H37Rv
acaccgccgcgucga

SEQ ID NO: 1310562 - RNA, 17 nt, Mycobacterium tuberculosis H37Rv
acaccgcgcccgccgau

SEQ ID NO: 1310563 - RNA, 20 nt, Mycobacterium tuberculosis H37Rv
acaccgcgcccgccgauccu

SEQ ID NO: 1310564 - RNA, 14 nt, Mycobacterium tuberculosis H37Rv
acaccgcgaucacc

SEQ ID NO: 1310565 - RNA, 21 nt, Mycobacterium tuberculosis H37Rv
acaccggcaagccacgccggu

SEQ ID NO: 1310566 - RNA, 18 nt, Mycobacterium tuberculosis H37Rv
acaccgugaccagccggu

SEQ ID NO: 1310567 - RNA, 16 nt, Mycobacterium tuberculosis H37Rv
acaccucaaacgccug

SEQ ID NO: 1310568 - RNA, 17 nt, Mycobacterium tuberculosis H37Rv
acaccucauacgccaau

SEQ ID NO: 1310569 - RNA, 17 nt, Mycobacterium tuberculosis H37Rv
acaccggggacgucgac

SEQ ID NO: 1310570 - RNA, 22 nt, Mycobacterium tuberculosis H37Rv
acaccggggacgucgacuucgc

SEQ ID NO: 1310571 - RNA, 13 nt, Mycobacterium tuberculosis H37Rv
acaccgucacgcc

SEQ ID NO: 1310572 - RNA, 19 nt, Mycobacterium tuberculosis H37Rv
acaccgucggcagcagcgg

SEQ ID NO: 1310573 - RNA, 13 nt, Mycobacterium tuberculosis H37Rv
acaccgucgcguu

SEQ ID NO: 1310574 - RNA, 12 nt, Mycobacterium tuberculosis H37Rv
acaccgucagcg

SEQ ID NO: 1310575 - RNA, 12 nt, Mycobacterium tuberculosis H37Rv
acaccugcggcg

SEQ ID NO: 1310576 - RNA, 16 nt, Mycobacterium tuberculosis H37Rv
acaccugcggcgucaa

SEQ ID NO: 1310577 - RNA, 12 nt, Mycobacterium tuberculosis H37Rv
acaccugcggcu

SEQ ID NO: 1310578 - RNA, 22 nt, Mycobacterium tuberculosis H37Rv
acaccugcggcugcuuggucgc

SEQ ID NO: 1310579 - RNA, 13 nt, Mycobacterium tuberculosis H37Rv
acaccuccucgag

SEQ ID NO: 1310580 - RNA, 13 nt, Mycobacterium tuberculosis H37Rv
acaccucgggguu

SEQ ID NO: 1310581 - RNA, 15 nt, Mycobacterium tuberculosis H37Rv
acacgacugucccgc

SEQ ID NO: 1310582 - RNA, 14 nt, Mycobacterium tuberculosis H37Rv
acacgcacacgauc

SEQ ID NO: 1310583 - RNA, 15 nt, Mycobacterium tuberculosis H37Rv
acacgcccucgacgc

SEQ ID NO: 1310584 - RNA, 15 nt, Mycobacterium tuberculosis H37Rv
acacggucgucgcga

SEQ ID NO: 1310585 - RNA, 17 nt, Mycobacterium tuberculosis H37Rv
acacggggccgccagcu

SEQ ID NO: 1310586 - RNA, 19 nt, Mycobacterium tuberculosis H37Rv
acacggcgacauacccgau

SEQ ID NO: 1310587 - RNA, 19 nt, Mycobacterium tuberculosis H37Rv
aauuucggcgccucguugc

SEQ ID NO: 1310588 - RNA, 20 nt, Mycobacterium tuberculosis H37Rv
acaaaucggccaucaugagc

SEQ ID NO: 1310589 - RNA, 16 nt, Mycobacterium tuberculosis H37Rv
acaaagccgucgacgc

SEQ ID NO: 1310590 - RNA, 14 nt, Mycobacterium tuberculosis H37Rv
acaacaaacccggc

SEQ ID NO: 1310591 - RNA, 12 nt, Mycobacterium tuberculosis H37Rv
acaacagcuugg

SEQ ID NO: 1310592 - RNA, 18 nt, Mycobacterium tuberculosis H37Rv
acaacagcggcaacgccu

SEQ ID NO: 1310593 - RNA, 13 nt, Mycobacterium tuberculosis H37Rv
acaaccgacgggu

SEQ ID NO: 1310594 - RNA, 19 nt, Mycobacterium tuberculosis H37Rv
acaaccgacgggucgcggu

SEQ ID NO: 1310595 - RNA, 23 nt, Mycobacterium tuberculosis H37Rv
acaacuaucgucgugucgccgcc

SEQ ID NO: 1310596 - RNA, 19 nt, Mycobacterium tuberculosis H37Rv
acaacgggauccgcgcgcu

SEQ ID NO: 1310597 - RNA, 20 nt, Mycobacterium tuberculosis H37Rv
acaacggccacaugccacag

SEQ ID NO: 1310598 - RNA, 20 nt, Mycobacterium tuberculosis H37Rv
acaacugcgccggugccggc

SEQ ID NO: 1310599 - RNA, 22 nt, Mycobacterium tuberculosis H37Rv
acaacucgcgaagcaucgcguu

SEQ ID NO: 1310600 - RNA, 13 nt, Mycobacterium tuberculosis H37Rv
acaaccuuggcga

SEQ ID NO: 1310601 - RNA, 16 nt, Mycobacterium tuberculosis H37Rv
acaacgcgacgccgcu

SEQ ID NO: 1310602 - RNA, 13 nt, Mycobacterium tuberculosis H37Rv
acaacgccgucga

SEQ ID NO: 1310603 - RNA, 12 nt, Mycobacterium tuberculosis H37Rv
acaagcacagcg

SEQ ID NO: 1310604 - RNA, 23 nt, Mycobacterium tuberculosis H37Rv
acaagccgugcagcucggucagc

SEQ ID NO: 1310605 - RNA, 21 nt, Mycobacterium tuberculosis H37Rv
acaagccuuaccccgcagcuc

SEQ ID NO: 1310606 - RNA, 14 nt, Mycobacterium tuberculosis H37Rv
acaagucgacacgc

SEQ ID NO: 1310607 - RNA, 18 nt, Mycobacterium tuberculosis H37Rv
acaagucgacacgccgaa

SEQ ID NO: 1310608 - RNA, 19 nt, Mycobacterium tuberculosis H37Rv
acaauuccuggaucgcggu

SEQ ID NO: 1310609 - RNA, 16 nt, Mycobacterium tuberculosis H37Rv
acacacugaagaucgc

SEQ ID NO: 1310610 - RNA, 20 nt, Mycobacterium tuberculosis H37Rv
acacacccacuggaccaccg

SEQ ID NO: 1310611 - RNA, 16 nt, Mycobacterium tuberculosis H37Rv
acacaccgcgucggcc

SEQ ID NO: 1310612 - RNA, 23 nt, Mycobacterium tuberculosis H37Rv
acacagcguccgucgucggcguc

SEQ ID NO: 1310613 - RNA, 13 nt, Mycobacterium tuberculosis H37Rv
acaaugucggcga

SEQ ID NO: 1310614 - RNA, 22 nt, Mycobacterium tuberculosis H37Rv
acaauggcucugaggucaccgg

SEQ ID NO: 1310615 - RNA, 20 nt, Mycobacterium tuberculosis H37Rv
acaauccgguguugagaucg

SEQ ID NO: 1310616 - RNA, 20 nt, Mycobacterium tuberculosis H37Rv
acaaucucggcguugccgcc

SEQ ID NO: 1310617 - RNA, 16 nt, Mycobacterium tuberculosis H37Rv
aaugacucggccgcac

SEQ ID NO: 1310618 - RNA, 21 nt, Mycobacterium tuberculosis H37Rv
aaugacuugcgacccgucgaa

SEQ ID NO: 1310619 - RNA, 22 nt, Mycobacterium tuberculosis H37Rv
aauggcgccuuggguuccgugg

SEQ ID NO: 1310620 - RNA, 16 nt, Mycobacterium tuberculosis H37Rv
aaugcgcugucgcccu

SEQ ID NO: 1310621 - RNA, 16 nt, Mycobacterium tuberculosis H37Rv
aaucaccggagcgccg

SEQ ID NO: 1310622 - RNA, 15 nt, Mycobacterium tuberculosis H37Rv
aauugcguucgccgc

SEQ ID NO: 1310623 - RNA, 14 nt, Mycobacterium tuberculosis H37Rv
aauugucgacuguu

SEQ ID NO: 1310624 - RNA, 21 nt, Mycobacterium tuberculosis H37Rv
aaugggggcuggucgccguac

SEQ ID NO: 1310625 - RNA, 14 nt, Mycobacterium tuberculosis H37Rv
aauggcguucgucg

SEQ ID NO: 1310626 - RNA, 11 nt, Mycobacterium tuberculosis H37Rv
aauuccgcgag

SEQ ID NO: 1310627 - RNA, 13 nt, Mycobacterium tuberculosis H37Rv
aaagcagcagcgg

SEQ ID NO: 1310628 - RNA, 21 nt, Mycobacterium tuberculosis H37Rv
aaaggucggggaacgcggcga

SEQ ID NO: 1310629 - RNA, 14 nt, Mycobacterium tuberculosis H37Rv
aaagccgcaccaga

SEQ ID NO: 1310630 - RNA, 13 nt, Mycobacterium tuberculosis H37Rv
aaagcgagcaccg

SEQ ID NO: 1310631 - RNA, 20 nt, Mycobacterium tuberculosis H37Rv
aaacagcuugcugcgcacca

SEQ ID NO: 1310632 - RNA, 16 nt, Mycobacterium tuberculosis H37Rv
aaacagguaagcagcc

SEQ ID NO: 1310633 - RNA, 23 nt, Mycobacterium tuberculosis H37Rv
aaaccagggagcgcccggcugau

SEQ ID NO: 1310634 - RNA, 13 nt, Mycobacterium tuberculosis H37Rv
aaaccagccacca

SEQ ID NO: 1310635 - RNA, 22 nt, Mycobacterium tuberculosis H37Rv
aaaccuggcuaucgcagaacgg

SEQ ID NO: 1310636 - RNA, 21 nt, Mycobacterium tuberculosis H37Rv
aaaccggaccugaccgguggc

SEQ ID NO: 1310637 - RNA, 14 nt, Mycobacterium tuberculosis H37Rv
aaaucgcacagcgc

SEQ ID NO: 1310638 - RNA, 22 nt, Mycobacterium tuberculosis H37Rv
aaaucgucgauggucuccggac

SEQ ID NO: 1310639 - RNA, 15 nt, Mycobacterium tuberculosis H37Rv
aaaacauaucggugc

SEQ ID NO: 1310640 - RNA, 16 nt, Mycobacterium tuberculosis H37Rv
aaaaccacgcgucgcu

SEQ ID NO: 1310641 - RNA, 13 nt, Mycobacterium tuberculosis H37Rv
aacaacagcggca

SEQ ID NO: 1310642 - RNA, 16 nt, Mycobacterium tuberculosis H37Rv
aacaacaccaccgccg

SEQ ID NO: 1310643 - RNA, 16 nt, Mycobacterium tuberculosis H37Rv
aacacagccgucgcac

SEQ ID NO: 1310644 - RNA, 21 nt, Mycobacterium tuberculosis H37Rv
aacaccacaccgagcaccuga

SEQ ID NO: 1310645 - RNA, 16 nt, Mycobacterium tuberculosis H37Rv
aacaccaucagcgaca

SEQ ID NO: 1310646 - RNA, 22 nt, Mycobacterium tuberculosis H37Rv
aacaccagcgaggccagcggua

SEQ ID NO: 1310647 - RNA, 11 nt, Mycobacterium tuberculosis H37Rv
aacaccgccag

SEQ ID NO: 1310648 - RNA, 18 nt, Mycobacterium tuberculosis H37Rv
aacaccgacgucaggcuc

SEQ ID NO: 1310649 - RNA, 23 nt, Mycobacterium tuberculosis H37Rv
aaaagcccccgcacgcucggcgu

SEQ ID NO: 1310650 - RNA, 16 nt, Mycobacterium tuberculosis H37Rv
aaaagguaccgcgugc

SEQ ID NO: 1310651 - RNA, 24 nt, Mycobacterium tuberculosis H37Rv
aaaauucaggcgccgucucgcggu

SEQ ID NO: 1310652 - RNA, 21 nt, Mycobacterium tuberculosis H37Rv
aaaacccggaaucgucgcggc

SEQ ID NO: 1310653 - RNA, 22 nt, Mycobacterium tuberculosis H37Rv
uuuucgagguacaacgggcacg

SEQ ID NO: 1310654 - RNA, 20 nt, Mycobacterium tuberculosis H37Rv
uuuucgaucgcuugccccgc

SEQ ID NO: 1310655 - RNA, 21 nt, Mycobacterium tuberculosis H37Rv
uuuuccgcguguacggcggcu

SEQ ID NO: 1310656 - RNA, 14 nt, Mycobacterium tuberculosis H37Rv
uuuugucaggauau

SEQ ID NO: 1310657 - RNA, 22 nt, Mycobacterium tuberculosis H37Rv
uucgucgcggguguuccacacc

SEQ ID NO: 1310658 - RNA, 18 nt, Mycobacterium tuberculosis H37Rv
uucgucguaguccaggcc

SEQ ID NO: 1310659 - RNA, 17 nt, Mycobacterium tuberculosis H37Rv
uucgucguggagcucac

SEQ ID NO: 1310660 - RNA, 15 nt, Mycobacterium tuberculosis H37Rv
uucguggccuugaca

SEQ ID NO: 1310661 - RNA, 13 nt, Mycobacterium tuberculosis H37Rv
uucggugucgccg

SEQ ID NO: 1310662 - RNA, 14 nt, Mycobacterium tuberculosis H37Rv
uucgguggcggcag

SEQ ID NO: 1310663 - RNA, 21 nt, Mycobacterium tuberculosis H37Rv
uucggccugagcggccaucgg

SEQ ID NO: 1310664 - RNA, 12 nt, Mycobacterium tuberculosis H37Rv
uucggccugugc

SEQ ID NO: 1310665 - RNA, 18 nt, Mycobacterium tuberculosis H37Rv
uucggccugugcgggcag

SEQ ID NO: 1310666 - RNA, 16 nt, Mycobacterium tuberculosis H37Rv
uucggugcuguugucg

SEQ ID NO: 1310667 - RNA, 12 nt, Mycobacterium tuberculosis H37Rv
uucguccccaga

SEQ ID NO: 1310668 - RNA, 17 nt, Mycobacterium tuberculosis H37Rv
uucggccaacccgggcc

SEQ ID NO: 1310669 - RNA, 16 nt, Mycobacterium tuberculosis H37Rv
uucggcagccaugcgg

SEQ ID NO: 1310670 - RNA, 22 nt, Mycobacterium tuberculosis H37Rv
uucggcccgaggugccggggcc

SEQ ID NO: 1310671 - RNA, 12 nt, Mycobacterium tuberculosis H37Rv
uucuagcccguu

SEQ ID NO: 1310672 - RNA, 16 nt, Mycobacterium tuberculosis H37Rv
uucuccucgugcagca

SEQ ID NO: 1310673 - RNA, 17 nt, Mycobacterium tuberculosis H37Rv
uucucgguccacgggcc

SEQ ID NO: 1310674 - RNA, 21 nt, Mycobacterium tuberculosis H37Rv
uucuggaaccccgagcugcca

SEQ ID NO: 1310675 - RNA, 16 nt, Mycobacterium tuberculosis H37Rv
uucugacggcuugcgu

SEQ ID NO: 1310676 - RNA, 13 nt, Mycobacterium tuberculosis H37Rv
uucuucagcagcg

SEQ ID NO: 1310677 - RNA, 18 nt, Mycobacterium tuberculosis H37Rv
uucuucaccgccuugguc

SEQ ID NO: 1310678 - RNA, 11 nt, Mycobacterium tuberculosis H37Rv
uugaccucuuc

SEQ ID NO: 1310679 - RNA, 15 nt, Mycobacterium tuberculosis H37Rv
uugaacucuggugac

SEQ ID NO: 1310680 - RNA, 14 nt, Mycobacterium tuberculosis H37Rv
uugaacguucccuc

SEQ ID NO: 1310681 - RNA, 14 nt, Mycobacterium tuberculosis H37Rv
uugaagaggcgcac

SEQ ID NO: 1310682 - RNA, 17 nt, Mycobacterium tuberculosis H37Rv
uugaaccagucgaccca

SEQ ID NO: 1310683 - RNA, 22 nt, Mycobacterium tuberculosis H37Rv
uucuuggcaggugccuucuucg

SEQ ID NO: 1310684 - RNA, 21 nt, Mycobacterium tuberculosis H37Rv
uucuuggcgggcgccuugguc

SEQ ID NO: 1310685 - RNA, 21 nt, Mycobacterium tuberculosis H37Rv
uucuuugccggcgccuugguc

SEQ ID NO: 1310686 - RNA, 21 nt, Mycobacterium tuberculosis H37Rv
uugaucgcccgguucagcgcu

SEQ ID NO: 1310687 - RNA, 9 nt, Mycobacterium tuberculosis H37Rv
uugagcccg

SEQ ID NO: 1310688 - RNA, 12 nt, Mycobacterium tuberculosis H37Rv
uugagccgccgc

SEQ ID NO: 1310689 - RNA, 22 nt, Mycobacterium tuberculosis H37Rv
uugagccgggcaaccagcagca

SEQ ID NO: 1310690 - RNA, 14 nt, Mycobacterium tuberculosis H37Rv
uugagcauaugacg

SEQ ID NO: 1310691 - RNA, 16 nt, Mycobacterium tuberculosis H37Rv
uugagcucgcugauca

SEQ ID NO: 1310692 - RNA, 22 nt, Mycobacterium tuberculosis H37Rv
uugaucuccaccuucuggucca

SEQ ID NO: 1310693 - RNA, 22 nt, Mycobacterium tuberculosis H37Rv
uugaugaagauggcgcgcagcu

SEQ ID NO: 1310694 - RNA, 12 nt, Mycobacterium tuberculosis H37Rv
uugauugaccaa

SEQ ID NO: 1310695 - RNA, 14 nt, Mycobacterium tuberculosis H37Rv
uugauugaccugcu

SEQ ID NO: 1310696 - RNA, 23 nt, Mycobacterium tuberculosis H37Rv
uugcagccggcauagcggcccau

SEQ ID NO: 1310697 - RNA, 18 nt, Mycobacterium tuberculosis H37Rv
uugcggggugcucagcga

SEQ ID NO: 1310698 - RNA, 23 nt, Mycobacterium tuberculosis H37Rv
uugcuccuggacuuccgguucau

SEQ ID NO: 1310699 - RNA, 23 nt, Mycobacterium tuberculosis H37Rv
uugcgcaggauguucaaucccuc

SEQ ID NO: 1310700 - RNA, 20 nt, Mycobacterium tuberculosis H37Rv
uugcgaucggcacuuagccc

SEQ ID NO: 1310701 - RNA, 17 nt, Mycobacterium tuberculosis H37Rv
uugccggcguugccgcc

SEQ ID NO: 1310702 - RNA, 16 nt, Mycobacterium tuberculosis H37Rv
uugccucccuuuucca

SEQ ID NO: 1310703 - RNA, 17 nt, Mycobacterium tuberculosis H37Rv
uugccucccuuuuccaa

SEQ ID NO: 1310704 - RNA, 20 nt, Mycobacterium tuberculosis H37Rv
uugccguuaccgccaaacgc

SEQ ID NO: 1310705 - RNA, 19 nt, Mycobacterium tuberculosis H37Rv
uugccaucaaggccaccuc

SEQ ID NO: 1310706 - RNA, 19 nt, Mycobacterium tuberculosis H37Rv
uugcccaagcgcguuguug

SEQ ID NO: 1310707 - RNA, 14 nt, Mycobacterium tuberculosis H37Rv
uugccggcgccuug

SEQ ID NO: 1310708 - RNA, 13 nt, Mycobacterium tuberculosis H37Rv
uugccggccagga

SEQ ID NO: 1310709 - RNA, 17 nt, Mycobacterium tuberculosis H37Rv
uugcccacaaagauccg

SEQ ID NO: 1310710 - RNA, 15 nt, Mycobacterium tuberculosis H37Rv
uugcccacaaagauc

SEQ ID NO: 1310711 - RNA, 19 nt, Mycobacterium tuberculosis H37Rv
uugcaggcccgaguuguug

SEQ ID NO: 1310712 - RNA, 19 nt, Mycobacterium tuberculosis H37Rv
uugcaguggcgacgagcaa

SEQ ID NO: 1310713 - RNA, 23 nt, Mycobacterium tuberculosis H37Rv
uugccaggugcuguuugguugcg

SEQ ID NO: 1310714 - RNA, 23 nt, Mycobacterium tuberculosis H37Rv
uugccaccgcuguucuuggugac

SEQ ID NO: 1310715 - RNA, 15 nt, Mycobacterium tuberculosis H37Rv
uuggaucccagcccg

SEQ ID NO: 1310716 - RNA, 15 nt, Mycobacterium tuberculosis H37Rv
uuggaucgccaccgg

SEQ ID NO: 1310717 - RNA, 23 nt, Mycobacterium tuberculosis H37Rv
uuggcaaagccgaaaucacugag

SEQ ID NO: 1310718 - RNA, 15 nt, Mycobacterium tuberculosis H37Rv
uuggcaagcacggcg

SEQ ID NO: 1310719 - RNA, 15 nt, Mycobacterium tuberculosis H37Rv
uugcuugcagggcca

SEQ ID NO: 1310720 - RNA, 14 nt, Mycobacterium tuberculosis H37Rv
uugcuugcagggcc

SEQ ID NO: 1310721 - RNA, 17 nt, Mycobacterium tuberculosis H37Rv
uuggaaaucccuggccu

SEQ ID NO: 1310722 - RNA, 15 nt, Mycobacterium tuberculosis H37Rv
uuggggcugugcagg

SEQ ID NO: 1310723 - RNA, 10 nt, Mycobacterium tuberculosis H37Rv
uuggcugccg

SEQ ID NO: 1310724 - RNA, 17 nt, Mycobacterium tuberculosis H37Rv
uuggcugccuccaucaa

SEQ ID NO: 1310725 - RNA, 15 nt, Mycobacterium tuberculosis H37Rv
uuggccggcuugucg

SEQ ID NO: 1310726 - RNA, 16 nt, Mycobacterium tuberculosis H37Rv
uuggccggcgcugccc

SEQ ID NO: 1310727 - RNA, 15 nt, Mycobacterium tuberculosis H37Rv
uuggccgggcacgcg

SEQ ID NO: 1310728 - RNA, 21 nt, Mycobacterium tuberculosis H37Rv
uuggccucgagcgcuguggcc

SEQ ID NO: 1310729 - RNA, 15 nt, Mycobacterium tuberculosis H37Rv
uuggcucgggccaga

SEQ ID NO: 1310730 - RNA, 15 nt, Mycobacterium tuberculosis H37Rv
uuggcucgcugggac

SEQ ID NO: 1310731 - RNA, 16 nt, Mycobacterium tuberculosis H37Rv
uuggccgucaucuccg

SEQ ID NO: 1310732 - RNA, 14 nt, Mycobacterium tuberculosis H37Rv
uuggcccaccgccg

SEQ ID NO: 1310733 - RNA, 18 nt, Mycobacterium tuberculosis H37Rv
uuggccccgcggagcgca

SEQ ID NO: 1310734 - RNA, 11 nt, Mycobacterium tuberculosis H37Rv
uuggccgccac

SEQ ID NO: 1310735 - RNA, 18 nt, Mycobacterium tuberculosis H37Rv
uuggccgccacaccgccg

SEQ ID NO: 1310736 - RNA, 16 nt, Mycobacterium tuberculosis H37Rv
uuggccgauguuguug

SEQ ID NO: 1310737 - RNA, 21 nt, Mycobacterium tuberculosis H37Rv
uugggugcgccgucagcccag

SEQ ID NO: 1310738 - RNA, 18 nt, Mycobacterium tuberculosis H37Rv
uuggguuuuguuuggaga

SEQ ID NO: 1310739 - RNA, 13 nt, Mycobacterium tuberculosis H37Rv
uuggucgccggcg

SEQ ID NO: 1310740 - RNA, 18 nt, Mycobacterium tuberculosis H37Rv
uuggucgccgcuuucuug

SEQ ID NO: 1310741 - RNA, 17 nt, Mycobacterium tuberculosis H37Rv
uuguagacggcaccccc

SEQ ID NO: 1310742 - RNA, 15 nt, Mycobacterium tuberculosis H37Rv
uuguccucccggacu

SEQ ID NO: 1310743 - RNA, 22 nt, Mycobacterium tuberculosis H37Rv
uugucgaucagaaucugccucu

SEQ ID NO: 1310744 - RNA, 13 nt, Mycobacterium tuberculosis H37Rv
uugucgcagcgca

SEQ ID NO: 1310745 - RNA, 16 nt, Mycobacterium tuberculosis H37Rv
uugugggugguccagc

SEQ ID NO: 1310746 - RNA, 17 nt, Mycobacterium tuberculosis H37Rv
uugugacggugaauuca

SEQ ID NO: 1310747 - RNA, 23 nt, Mycobacterium tuberculosis H37Rv
uuguugccgacgaucgacgccgc

SEQ ID NO: 1310748 - RNA, 13 nt, Mycobacterium tuberculosis H37Rv
uuguugaagcccg

SEQ ID NO: 1310749 - RNA, 13 nt, Mycobacterium tuberculosis H37Rv
uuguucuuggcca

SEQ ID NO: 1310750 - RNA, 11 nt, Mycobacterium tuberculosis H37Rv
uuccucagcgg

SEQ ID NO: 1310751 - RNA, 16 nt, Mycobacterium tuberculosis H37Rv
uuccguggauggacca

SEQ ID NO: 1310752 - RNA, 22 nt, Mycobacterium tuberculosis H37Rv
uuccggucgacuccagcaccag

SEQ ID NO: 1310753 - RNA, 16 nt, Mycobacterium tuberculosis H37Rv
uuccggcggccacgcc

SEQ ID NO: 1310754 - RNA, 18 nt, Mycobacterium tuberculosis H37Rv
uuccuggcgggcgccuug

SEQ ID NO: 1310755 - RNA, 21 nt, Mycobacterium tuberculosis H37Rv
uuccuggcgggcgccuugguc

SEQ ID NO: 1310756 - RNA, 18 nt, Mycobacterium tuberculosis H37Rv
uuccugcgccgguaacug

SEQ ID NO: 1310757 - RNA, 21 nt, Mycobacterium tuberculosis H37Rv
uucgccaccgcaagaaucagc

SEQ ID NO: 1310758 - RNA, 14 nt, Mycobacterium tuberculosis H37Rv
uucgccaacuucaa

SEQ ID NO: 1310759 - RNA, 18 nt, Mycobacterium tuberculosis H37Rv
uucgccccugcacagcag

SEQ ID NO: 1310760 - RNA, 18 nt, Mycobacterium tuberculosis H37Rv
uucgcccacagcuugccc

SEQ ID NO: 1310761 - RNA, 22 nt, Mycobacterium tuberculosis H37Rv
uucgcccgcccgucuuccagcc

SEQ ID NO: 1310762 - RNA, 12 nt, Mycobacterium tuberculosis H37Rv
uucgccgagcgu

SEQ ID NO: 1310763 - RNA, 19 nt, Mycobacterium tuberculosis H37Rv
uucgccggaacgcacgccc

SEQ ID NO: 1310764 - RNA, 13 nt, Mycobacterium tuberculosis H37Rv
uucgcucaucugu

SEQ ID NO: 1310765 - RNA, 15 nt, Mycobacterium tuberculosis H37Rv
uucgcgaagcugugc

SEQ ID NO: 1310766 - RNA, 18 nt, Mycobacterium tuberculosis H37Rv
uucgcgguagccgcggcc

SEQ ID NO: 1310767 - RNA, 15 nt, Mycobacterium tuberculosis H37Rv
uucgaugccagugca

SEQ ID NO: 1310768 - RNA, 13 nt, Mycobacterium tuberculosis H37Rv
uucgaugggugca

SEQ ID NO: 1310769 - RNA, 17 nt, Mycobacterium tuberculosis H37Rv
uucgcagccgcaccggg

SEQ ID NO: 1310770 - RNA, 13 nt, Mycobacterium tuberculosis H37Rv
uucgacccagcgg

SEQ ID NO: 1310771 - RNA, 21 nt, Mycobacterium tuberculosis H37Rv
uucgacggcggccaaggucga

SEQ ID NO: 1310772 - RNA, 20 nt, Mycobacterium tuberculosis H37Rv
uuccgccgccgccaucgccg

SEQ ID NO: 1310773 - RNA, 16 nt, Mycobacterium tuberculosis H37Rv
uuccgcuaccgcacag

SEQ ID NO: 1310774 - RNA, 18 nt, Mycobacterium tuberculosis H37Rv
uuccgcaaugaccuggcc

SEQ ID NO: 1310775 - RNA, 14 nt, Mycobacterium tuberculosis H37Rv
uuccgcagcgccac

SEQ ID NO: 1310776 - RNA, 22 nt, Mycobacterium tuberculosis H37Rv
uuccgcagucccgaacaauuca

SEQ ID NO: 1310777 - RNA, 16 nt, Mycobacterium tuberculosis H37Rv
uuccgauagccgacca

SEQ ID NO: 1310778 - RNA, 23 nt, Mycobacterium tuberculosis H37Rv
uucccgccauugccgccgucgcc

SEQ ID NO: 1310779 - RNA, 17 nt, Mycobacterium tuberculosis H37Rv
uucccgccauugccgcc

SEQ ID NO: 1310780 - RNA, 12 nt, Mycobacterium tuberculosis H37Rv
uucccggcucga

SEQ ID NO: 1310781 - RNA, 17 nt, Mycobacterium tuberculosis H37Rv
uuccaugcgacuucauc

SEQ ID NO: 1310782 - RNA, 18 nt, Mycobacterium tuberculosis H37Rv
uucccaccaccaccgccg

SEQ ID NO: 1310783 - RNA, 12 nt, Mycobacterium tuberculosis H37Rv
uucccaccacca

SEQ ID NO: 1310784 - RNA, 14 nt, Mycobacterium tuberculosis H37Rv
uucccgaaacccga

SEQ ID NO: 1310785 - RNA, 18 nt, Mycobacterium tuberculosis H37Rv
uuccccgcccuugccgcc

SEQ ID NO: 1310786 - RNA, 19 nt, Mycobacterium tuberculosis H37Rv
uuccaaaaucaucugcaca

SEQ ID NO: 1310787 - RNA, 20 nt, Mycobacterium tuberculosis H37Rv
uuccaaagggaguguuuggg

SEQ ID NO: 1310788 - RNA, 20 nt, Mycobacterium tuberculosis H37Rv
uuccaagucagaacggcggc

SEQ ID NO: 1310789 - RNA, 19 nt, Mycobacterium tuberculosis H37Rv
uuccaacuccugcagcccg

SEQ ID NO: 1310790 - RNA, 19 nt, Mycobacterium tuberculosis H37Rv
uuccacaggggccagcgcg

SEQ ID NO: 1310791 - RNA, 15 nt, Mycobacterium tuberculosis H37Rv
uuccacaccaggccg

SEQ ID NO: 1310792 - RNA, 11 nt, Mycobacterium tuberculosis H37Rv
uuccaccgccg

SEQ ID NO: 1310793 - RNA, 20 nt, Mycobacterium tuberculosis H37Rv
uuccacggguggugccaggu

SEQ ID NO: 1310794 - RNA, 14 nt, Mycobacterium tuberculosis H37Rv
uuccagccggugcc

SEQ ID NO: 1310795 - RNA, 14 nt, Mycobacterium tuberculosis H37Rv
uuccagccaggccu

SEQ ID NO: 1310796 - RNA, 15 nt, Mycobacterium tuberculosis H37Rv
uuccagccacagccc

SEQ ID NO: 1310797 - RNA, 22 nt, Mycobacterium tuberculosis H37Rv
uuccagaguucccgaaacccga

SEQ ID NO: 1310798 - RNA, 20 nt, Mycobacterium tuberculosis H37Rv
uuccagguacacguaccggu

SEQ ID NO: 1310799 - RNA, 16 nt, Mycobacterium tuberculosis H37Rv
uuccauacagccgccg

SEQ ID NO: 1310800 - RNA, 21 nt, Mycobacterium tuberculosis H37Rv
uucaggucggggucagaucca

SEQ ID NO: 1310801 - RNA, 17 nt, Mycobacterium tuberculosis H37Rv
uucaggcccugccgacg

SEQ ID NO: 1310802 - RNA, 20 nt, Mycobacterium tuberculosis H37Rv
uucagggcgucgaacucauc

SEQ ID NO: 1310803 - RNA, 20 nt, Mycobacterium tuberculosis H37Rv
uucagcgcauuucggaucuc

SEQ ID NO: 1310804 - RNA, 10 nt, Mycobacterium tuberculosis H37Rv
uucagcgcca

SEQ ID NO: 1310805 - RNA, 14 nt, Mycobacterium tuberculosis H37Rv
uucagcgccagcgc

SEQ ID NO: 1310806 - RNA, 17 nt, Mycobacterium tuberculosis H37Rv
uucagcugcgccaggaa

SEQ ID NO: 1310807 - RNA, 16 nt, Mycobacterium tuberculosis H37Rv
uucaguuccaccgcgc

SEQ ID NO: 1310808 - RNA, 19 nt, Mycobacterium tuberculosis H37Rv
uucauguagcagcgcggcu

SEQ ID NO: 1310809 - RNA, 16 nt, Mycobacterium tuberculosis H37Rv
uucaccaguccaaucu

SEQ ID NO: 1310810 - RNA, 22 nt, Mycobacterium tuberculosis H37Rv
uucaauaauggcaaccagcuuc

SEQ ID NO: 1310811 - RNA, 20 nt, Mycobacterium tuberculosis H37Rv
uucagaggucuccacgugcu

SEQ ID NO: 1310812 - RNA, 16 nt, Mycobacterium tuberculosis H37Rv
uucacgcaccacaaac

SEQ ID NO: 1310813 - RNA, 18 nt, Mycobacterium tuberculosis H37Rv
uucaccgcgauuagcaaa

SEQ ID NO: 1310814 - RNA, 21 nt, Mycobacterium tuberculosis H37Rv
uucacguucggcgacgcgccg

SEQ ID NO: 1310815 - RNA, 22 nt, Mycobacterium tuberculosis H37Rv
uucacgugcgacgaaguucucu

SEQ ID NO: 1310816 - RNA, 21 nt, Mycobacterium tuberculosis H37Rv
uucacucguugaccggccgga

SEQ ID NO: 1310817 - RNA, 18 nt, Mycobacterium tuberculosis H37Rv
uucacugugccgcugcau

SEQ ID NO: 1310818 - RNA, 11 nt, Mycobacterium tuberculosis H37Rv
uggcgugcaga

SEQ ID NO: 1310819 - RNA, 22 nt, Mycobacterium tuberculosis H37Rv
uggcgucggugaaugccgucgc

SEQ ID NO: 1310820 - RNA, 15 nt, Mycobacterium tuberculosis H37Rv
uggcgucagugcaga

SEQ ID NO: 1310821 - RNA, 19 nt, Mycobacterium tuberculosis H37Rv
uggcgucacguaauucccc

SEQ ID NO: 1310822 - RNA, 15 nt, Mycobacterium tuberculosis H37Rv
uggcgucagcagcaa

SEQ ID NO: 1310823 - RNA, 22 nt, Mycobacterium tuberculosis H37Rv
uggcgucgaaccagucgaagaa

SEQ ID NO: 1310824 - RNA, 20 nt, Mycobacterium tuberculosis H37Rv
uggcuaacaccgcaggcaca

SEQ ID NO: 1310825 - RNA, 20 nt, Mycobacterium tuberculosis H37Rv
uggcguggucucggucagcc

SEQ ID NO: 1310826 - RNA, 14 nt, Mycobacterium tuberculosis H37Rv
uggcguuguugacg

SEQ ID NO: 1310827 - RNA, 14 nt, Mycobacterium tuberculosis H37Rv
uggcguugggcagc

SEQ ID NO: 1310828 - RNA, 21 nt, Mycobacterium tuberculosis H37Rv
uggcguugaggacguggacuu

SEQ ID NO: 1310829 - RNA, 18 nt, Mycobacterium tuberculosis H37Rv
uggcucccuuuuccaaag

SEQ ID NO: 1310830 - RNA, 20 nt, Mycobacterium tuberculosis H37Rv
uggcucgcggaugcucguug

SEQ ID NO: 1310831 - RNA, 14 nt, Mycobacterium tuberculosis H37Rv
uggcucggcauccc

SEQ ID NO: 1310832 - RNA, 15 nt, Mycobacterium tuberculosis H37Rv
uggcucggcgcagca

SEQ ID NO: 1310833 - RNA, 19 nt, Mycobacterium tuberculosis H37Rv
uggcugaaauaagggccgg

SEQ ID NO: 1310834 - RNA, 19 nt, Mycobacterium tuberculosis H37Rv
uggcuacgccccacugccg

SEQ ID NO: 1310835 - RNA, 22 nt, Mycobacterium tuberculosis H37Rv
uggcuaguugggugggugcagc

SEQ ID NO: 1310836 - RNA, 16 nt, Mycobacterium tuberculosis H37Rv
uggcgcuucggccacu

SEQ ID NO: 1310837 - RNA, 18 nt, Mycobacterium tuberculosis H37Rv
uggcgcggguccagccac

SEQ ID NO: 1310838 - RNA, 16 nt, Mycobacterium tuberculosis H37Rv
uggcgcgguccuccag

SEQ ID NO: 1310839 - RNA, 22 nt, Mycobacterium tuberculosis H37Rv
uggcgcggccgaaagagccagc

SEQ ID NO: 1310840 - RNA, 21 nt, Mycobacterium tuberculosis H37Rv
uggcgcgccgcaucggcgaac

SEQ ID NO: 1310841 - RNA, 22 nt, Mycobacterium tuberculosis H37Rv
uggcgcgcccacagcccgggcg

SEQ ID NO: 1310842 - RNA, 20 nt, Mycobacterium tuberculosis H37Rv
uggaaaaucgggucacacuc

SEQ ID NO: 1310843 - RNA, 18 nt, Mycobacterium tuberculosis H37Rv
uggcgcuugcugcauguc

SEQ ID NO: 1310844 - RNA, 18 nt, Mycobacterium tuberculosis H37Rv
uggcggcgagcggacaca

SEQ ID NO: 1310845 - RNA, 23 nt, Mycobacterium tuberculosis H37Rv
uggcggcgaucaacucgggcagc

SEQ ID NO: 1310846 - RNA, 17 nt, Mycobacterium tuberculosis H37Rv
uggcggcgguggccagc

SEQ ID NO: 1310847 - RNA, 13 nt, Mycobacterium tuberculosis H37Rv
uggcggcgggggc

SEQ ID NO: 1310848 - RNA, 22 nt, Mycobacterium tuberculosis H37Rv
uggcgggugacuucguggccuu

SEQ ID NO: 1310849 - RNA, 16 nt, Mycobacterium tuberculosis H37Rv
uggcgggcgccuuggu

SEQ ID NO: 1310850 - RNA, 13 nt, Mycobacterium tuberculosis H37Rv
uggcgucaccgcc

SEQ ID NO: 1310851 - RNA, 17 nt, Mycobacterium tuberculosis H37Rv
uggcgguaagcgaaaca

SEQ ID NO: 1310852 - RNA, 20 nt, Mycobacterium tuberculosis H37Rv
uggcggucggcagaccgacc

SEQ ID NO: 1310853 - RNA, 18 nt, Mycobacterium tuberculosis H37Rv
uggcggucccgcauaucc

SEQ ID NO: 1310854 - RNA, 21 nt, Mycobacterium tuberculosis H37Rv
uggcgguguugcucccggccg

SEQ ID NO: 1310855 - RNA, 15 nt, Mycobacterium tuberculosis H37Rv
uggcgguuccggccg

SEQ ID NO: 1310856 - RNA, 17 nt, Mycobacterium tuberculosis H37Rv
uggcggugaacaccgcc

SEQ ID NO: 1310857 - RNA, 17 nt, Mycobacterium tuberculosis H37Rv
uggcuugacgcccgggc

SEQ ID NO: 1310858 - RNA, 22 nt, Mycobacterium tuberculosis H37Rv
uggcuucucccgccacugcugg

SEQ ID NO: 1310859 - RNA, 18 nt, Mycobacterium tuberculosis H37Rv
uggcuugggccagcgcau

SEQ ID NO: 1310860 - RNA, 15 nt, Mycobacterium tuberculosis H37Rv
ugggaaccaccagca

SEQ ID NO: 1310861 - RNA, 21 nt, Mycobacterium tuberculosis H37Rv
ugggaaucagugaagacacca

SEQ ID NO: 1310862 - RNA, 19 nt, Mycobacterium tuberculosis H37Rv
uggcugaucccggccaggc

SEQ ID NO: 1310863 - RNA, 19 nt, Mycobacterium tuberculosis H37Rv
uggcugcuguugguauuag

SEQ ID NO: 1310864 - RNA, 18 nt, Mycobacterium tuberculosis H37Rv
ugggcggcucgucgauug

SEQ ID NO: 1310865 - RNA, 14 nt, Mycobacterium tuberculosis H37Rv
ugggcgguagcuuc

SEQ ID NO: 1310866 - RNA, 16 nt, Mycobacterium tuberculosis H37Rv
ugggcgggauggccgc

SEQ ID NO: 1310867 - RNA, 16 nt, Mycobacterium tuberculosis H37Rv
ugggcggcccaccggc

SEQ ID NO: 1310868 - RNA, 13 nt, Mycobacterium tuberculosis H37Rv
ugggcgcggcgcc

SEQ ID NO: 1310869 - RNA, 22 nt, Mycobacterium tuberculosis H37Rv
ugggcgcugucacguagcgagc

SEQ ID NO: 1310870 - RNA, 17 nt, Mycobacterium tuberculosis H37Rv
ugggcgcccgcgguccg

SEQ ID NO: 1310871 - RNA, 22 nt, Mycobacterium tuberculosis H37Rv
ugggcgccgcaaccgccgcguc

SEQ ID NO: 1310872 - RNA, 18 nt, Mycobacterium tuberculosis H37Rv
uggggacccgcuccaagc

SEQ ID NO: 1310873 - RNA, 15 nt, Mycobacterium tuberculosis H37Rv
ugggcguggcugguc

SEQ ID NO: 1310874 - RNA, 16 nt, Mycobacterium tuberculosis H37Rv
ugggcgugcaggcugg

SEQ ID NO: 1310875 - RNA, 15 nt, Mycobacterium tuberculosis H37Rv
ugggcgugagcgcgc

SEQ ID NO: 1310876 - RNA, 14 nt, Mycobacterium tuberculosis H37Rv
ugggcuuucagcac

SEQ ID NO: 1310877 - RNA, 16 nt, Mycobacterium tuberculosis H37Rv
ugggccaccggcgccg

SEQ ID NO: 1310878 - RNA, 14 nt, Mycobacterium tuberculosis H37Rv
ugggaggcggcgcc

SEQ ID NO: 1310879 - RNA, 11 nt, Mycobacterium tuberculosis H37Rv
ugggagcagcc

SEQ ID NO: 1310880 - RNA, 21 nt, Mycobacterium tuberculosis H37Rv
ugggacaaagacgccgucggc

SEQ ID NO: 1310881 - RNA, 22 nt, Mycobacterium tuberculosis H37Rv
ugggaccgggcguuucccugcc

SEQ ID NO: 1310882 - RNA, 21 nt, Mycobacterium tuberculosis H37Rv
ugggaccagugcgguggcagg

SEQ ID NO: 1310883 - RNA, 14 nt, Mycobacterium tuberculosis H37Rv
ugggacuggcguga

SEQ ID NO: 1310884 - RNA, 20 nt, Mycobacterium tuberculosis H37Rv
ugggccagugaaaccaccgg

SEQ ID NO: 1310885 - RNA, 23 nt, Mycobacterium tuberculosis H37Rv
ugggccaugcuaggaccaccagc

SEQ ID NO: 1310886 - RNA, 13 nt, Mycobacterium tuberculosis H37Rv
ugggccagcagca

SEQ ID NO: 1310887 - RNA, 15 nt, Mycobacterium tuberculosis H37Rv
ugggccagcuccuga

SEQ ID NO: 1310888 - RNA, 15 nt, Mycobacterium tuberculosis H37Rv
ugggccccgccgaug

SEQ ID NO: 1310889 - RNA, 21 nt, Mycobacterium tuberculosis H37Rv
ugggccgacugggcgcgaccc

SEQ ID NO: 1310890 - RNA, 21 nt, Mycobacterium tuberculosis H37Rv
ugggcccugcacagcagcguc

SEQ ID NO: 1310891 - RNA, 21 nt, Mycobacterium tuberculosis H37Rv
ugggcccccaaucagugcagc

SEQ ID NO: 1310892 - RNA, 16 nt, Mycobacterium tuberculosis H37Rv
uggugggccagcagca

SEQ ID NO: 1310893 - RNA, 17 nt, Mycobacterium tuberculosis H37Rv
uggugggccagcagcaa

SEQ ID NO: 1310894 - RNA, 12 nt, Mycobacterium tuberculosis H37Rv
ugguggucagca

SEQ ID NO: 1310895 - RNA, 13 nt, Mycobacterium tuberculosis H37Rv
ugguggugcccgg

SEQ ID NO: 1310896 - RNA, 14 nt, Mycobacterium tuberculosis H37Rv
ugguggugccaacc

SEQ ID NO: 1310897 - RNA, 18 nt, Mycobacterium tuberculosis H37Rv
uggugggaucgcagcgcc

SEQ ID NO: 1310898 - RNA, 14 nt, Mycobacterium tuberculosis H37Rv
ugguggaacuccgg

SEQ ID NO: 1310899 - RNA, 23 nt, Mycobacterium tuberculosis H37Rv
uggugggaggggacccagcggcg

SEQ ID NO: 1310900 - RNA, 14 nt, Mycobacterium tuberculosis H37Rv
uggugcagcgcagg

SEQ ID NO: 1310901 - RNA, 22 nt, Mycobacterium tuberculosis H37Rv
uggugccaacgggcagguaggu

SEQ ID NO: 1310902 - RNA, 16 nt, Mycobacterium tuberculosis H37Rv
uggugcagcgugcagc

SEQ ID NO: 1310903 - RNA, 16 nt, Mycobacterium tuberculosis H37Rv
uggugccgccaccacc

SEQ ID NO: 1310904 - RNA, 12 nt, Mycobacterium tuberculosis H37Rv
uggugccagguc

SEQ ID NO: 1310905 - RNA, 23 nt, Mycobacterium tuberculosis H37Rv
uggugcccaaggcagacccccag

SEQ ID NO: 1310906 - RNA, 14 nt, Mycobacterium tuberculosis H37Rv
uggugccgagcagc

SEQ ID NO: 1310907 - RNA, 17 nt, Mycobacterium tuberculosis H37Rv
uggugccgcggccaccg

SEQ ID NO: 1310908 - RNA, 16 nt, Mycobacterium tuberculosis H37Rv
uggugccgcggccacc

SEQ ID NO: 1310909 - RNA, 15 nt, Mycobacterium tuberculosis H37Rv
uggugccgccugugc

SEQ ID NO: 1310910 - RNA, 14 nt, Mycobacterium tuberculosis H37Rv
uggugccgcggcca

SEQ ID NO: 1310911 - RNA, 20 nt, Mycobacterium tuberculosis H37Rv
uggugcguagcccacccggg

SEQ ID NO: 1310912 - RNA, 19 nt, Mycobacterium tuberculosis H37Rv
uggugcggucuggcgacuc

SEQ ID NO: 1310913 - RNA, 21 nt, Mycobacterium tuberculosis H37Rv
uggucccgagggcggcagcua

SEQ ID NO: 1310914 - RNA, 19 nt, Mycobacterium tuberculosis H37Rv
uggucccgaugaccuugcc

SEQ ID NO: 1310915 - RNA, 14 nt, Mycobacterium tuberculosis H37Rv
uggucgccgggcag

SEQ ID NO: 1310916 - RNA, 13 nt, Mycobacterium tuberculosis H37Rv
uggucgccccgau

SEQ ID NO: 1310917 - RNA, 18 nt, Mycobacterium tuberculosis H37Rv
uggucgcgguggcggcgg

SEQ ID NO: 1310918 - RNA, 13 nt, Mycobacterium tuberculosis H37Rv
uggucgcggcugc

SEQ ID NO: 1310919 - RNA, 12 nt, Mycobacterium tuberculosis H37Rv
uggucugccaaa

SEQ ID NO: 1310920 - RNA, 20 nt, Mycobacterium tuberculosis H37Rv
uggucggcuacggccagugc

SEQ ID NO: 1310921 - RNA, 16 nt, Mycobacterium tuberculosis H37Rv
uggugaaggcaaacac

SEQ ID NO: 1310922 - RNA, 16 nt, Mycobacterium tuberculosis H37Rv
uggucuggacugcagc

SEQ ID NO: 1310923 - RNA, 18 nt, Mycobacterium tuberculosis H37Rv
uggucacacccagcgcgc

SEQ ID NO: 1310924 - RNA, 17 nt, Mycobacterium tuberculosis H37Rv
uggucaaugcgcuggcg

SEQ ID NO: 1310925 - RNA, 19 nt, Mycobacterium tuberculosis H37Rv
uggucaagacccgcaucca

SEQ ID NO: 1310926 - RNA, 16 nt, Mycobacterium tuberculosis H37Rv
uggucaagaucagcgg

SEQ ID NO: 1310927 - RNA, 22 nt, Mycobacterium tuberculosis H37Rv
ugguagguuacgccgggguaga

SEQ ID NO: 1310928 - RNA, 16 nt, Mycobacterium tuberculosis H37Rv
ugguccauaccugaau

SEQ ID NO: 1310929 - RNA, 18 nt, Mycobacterium tuberculosis H37Rv
ugguccaggcccuggcca

SEQ ID NO: 1310930 - RNA, 16 nt, Mycobacterium tuberculosis H37Rv
uggucauccagccagc

SEQ ID NO: 1310931 - RNA, 23 nt, Mycobacterium tuberculosis H37Rv
uggucaccaggccgaaauccaga

SEQ ID NO: 1310932 - RNA, 15 nt, Mycobacterium tuberculosis H37Rv
uggucaccaccauca

SEQ ID NO: 1310933 - RNA, 13 nt, Mycobacterium tuberculosis H37Rv
uggucaccagcca

SEQ ID NO: 1310934 - RNA, 14 nt, Mycobacterium tuberculosis H37Rv
ugguacaccaggcc

SEQ ID NO: 1310935 - RNA, 16 nt, Mycobacterium tuberculosis H37Rv
ugggggcaucaggguc

SEQ ID NO: 1310936 - RNA, 21 nt, Mycobacterium tuberculosis H37Rv
ugggggucaaucggguuuguc

SEQ ID NO: 1310937 - RNA, 13 nt, Mycobacterium tuberculosis H37Rv
ugguuggcucgcu

SEQ ID NO: 1310938 - RNA, 18 nt, Mycobacterium tuberculosis H37Rv
ugguugcgccaggaaccg

SEQ ID NO: 1310939 - RNA, 15 nt, Mycobacterium tuberculosis H37Rv
ugguuggugcuggcc

SEQ ID NO: 1310940 - RNA, 13 nt, Mycobacterium tuberculosis H37Rv
ugguucgcacacc

SEQ ID NO: 1310941 - RNA, 19 nt, Mycobacterium tuberculosis H37Rv
ugguucgcacaccuccucg

SEQ ID NO: 1310942 - RNA, 18 nt, Mycobacterium tuberculosis H37Rv
ugguucggguuggagaag

SEQ ID NO: 1310943 - RNA, 17 nt, Mycobacterium tuberculosis H37Rv
ugguuccggcgugcagc

SEQ ID NO: 1310944 - RNA, 19 nt, Mycobacterium tuberculosis H37Rv
ugguucccgacgucggccu

SEQ ID NO: 1310945 - RNA, 19 nt, Mycobacterium tuberculosis H37Rv
ugguguagccgagcacggg

SEQ ID NO: 1310946 - RNA, 13 nt, Mycobacterium tuberculosis H37Rv
ugguguagcuucg

SEQ ID NO: 1310947 - RNA, 14 nt, Mycobacterium tuberculosis H37Rv
ugguuagguggcug

SEQ ID NO: 1310948 - RNA, 22 nt, Mycobacterium tuberculosis H37Rv
ugguuagaggauggucagcagc

SEQ ID NO: 1310949 - RNA, 17 nt, Mycobacterium tuberculosis H37Rv
ugguuagaggaugguca

SEQ ID NO: 1310950 - RNA, 21 nt, Mycobacterium tuberculosis H37Rv
uguacaggcuguccagcagcg

SEQ ID NO: 1310951 - RNA, 18 nt, Mycobacterium tuberculosis H37Rv
uguaugacaggucacggu

SEQ ID NO: 1310952 - RNA, 19 nt, Mycobacterium tuberculosis H37Rv
ugucaggauauuucuaaau

SEQ ID NO: 1310953 - RNA, 14 nt, Mycobacterium tuberculosis H37Rv
ugucaguucccgcu

SEQ ID NO: 1310954 - RNA, 13 nt, Mycobacterium tuberculosis H37Rv
ugucaaaggugca

SEQ ID NO: 1310955 - RNA, 23 nt, Mycobacterium tuberculosis H37Rv
ugucaagcgaugucccaucgcgu

SEQ ID NO: 1310956 - RNA, 14 nt, Mycobacterium tuberculosis H37Rv
uguccaagcccucg

SEQ ID NO: 1310957 - RNA, 20 nt, Mycobacterium tuberculosis H37Rv
uguccauauagaucacugcu

SEQ ID NO: 1310958 - RNA, 15 nt, Mycobacterium tuberculosis H37Rv
uguccagcaugcccg

SEQ ID NO: 1310959 - RNA, 13 nt, Mycobacterium tuberculosis H37Rv
uguccaccaccgg

SEQ ID NO: 1310960 - RNA, 17 nt, Mycobacterium tuberculosis H37Rv
uguccacguccagcccg

SEQ ID NO: 1310961 - RNA, 13 nt, Mycobacterium tuberculosis H37Rv
uguccacugccac

SEQ ID NO: 1310962 - RNA, 22 nt, Mycobacterium tuberculosis H37Rv
uguccagcgcgacguccaccag

SEQ ID NO: 1310963 - RNA, 13 nt, Mycobacterium tuberculosis H37Rv
uguccauguucuc

SEQ ID NO: 1310964 - RNA, 15 nt, Mycobacterium tuberculosis H37Rv
ugucccaacgccacu

SEQ ID NO: 1310965 - RNA, 23 nt, Mycobacterium tuberculosis H37Rv
uguccccggcggcagcauauccg

SEQ ID NO: 1310966 - RNA, 11 nt, Mycobacterium tuberculosis H37Rv
uguccccgacg

SEQ ID NO: 1310967 - RNA, 14 nt, Mycobacterium tuberculosis H37Rv
uguccgcagcaccg

SEQ ID NO: 1310968 - RNA, 22 nt, Mycobacterium tuberculosis H37Rv
uguccggcccuacgcagcgcgg

SEQ ID NO: 1310969 - RNA, 15 nt, Mycobacterium tuberculosis H37Rv
uguccgucgcguccg

SEQ ID NO: 1310970 - RNA, 14 nt, Mycobacterium tuberculosis H37Rv
uguccucccauccc

SEQ ID NO: 1310971 - RNA, 13 nt, Mycobacterium tuberculosis H37Rv
uguccucacaugc

SEQ ID NO: 1310972 - RNA, 16 nt, Mycobacterium tuberculosis H37Rv
uguccuacuuuuccac

SEQ ID NO: 1310973 - RNA, 21 nt, Mycobacterium tuberculosis H37Rv
ugucgccgaguaccggccagc

SEQ ID NO: 1310974 - RNA, 22 nt, Mycobacterium tuberculosis H37Rv
ugucgccacaccggggcggccg

SEQ ID NO: 1310975 - RNA, 22 nt, Mycobacterium tuberculosis H37Rv
ugucgaucagaaucugccucuc

SEQ ID NO: 1310976 - RNA, 19 nt, Mycobacterium tuberculosis H37Rv
ugucgauagcccgccaccc

SEQ ID NO: 1310977 - RNA, 22 nt, Mycobacterium tuberculosis H37Rv
ugucgacgacaacgaugucacc

SEQ ID NO: 1310978 - RNA, 21 nt, Mycobacterium tuberculosis H37Rv
ugucgacgacaacgaugucac

SEQ ID NO: 1310979 - RNA, 23 nt, Mycobacterium tuberculosis H37Rv
ugucgaccgccacguaauucccc

SEQ ID NO: 1310980 - RNA, 19 nt, Mycobacterium tuberculosis H37Rv
uguccuugaaccagcgcgu

SEQ ID NO: 1310981 - RNA, 16 nt, Mycobacterium tuberculosis H37Rv
uguccuuugccaccuc

SEQ ID NO: 1310982 - RNA, 15 nt, Mycobacterium tuberculosis H37Rv
ugucgaagaaccggc

SEQ ID NO: 1310983 - RNA, 13 nt, Mycobacterium tuberculosis H37Rv
ugucgacaucggc

SEQ ID NO: 1310984 - RNA, 16 nt, Mycobacterium tuberculosis H37Rv
ugucggccacccggac

SEQ ID NO: 1310985 - RNA, 22 nt, Mycobacterium tuberculosis H37Rv
ugucgcugcggcgcuggccagc

SEQ ID NO: 1310986 - RNA, 17 nt, Mycobacterium tuberculosis H37Rv
ugucgcugccgccgccg

SEQ ID NO: 1310987 - RNA, 15 nt, Mycobacterium tuberculosis H37Rv
ugucgcugcggcgcu

SEQ ID NO: 1310988 - RNA, 19 nt, Mycobacterium tuberculosis H37Rv
ugucgcgccgguggucagg

SEQ ID NO: 1310989 - RNA, 17 nt, Mycobacterium tuberculosis H37Rv
ugucgcggucgcccgcu

SEQ ID NO: 1310990 - RNA, 17 nt, Mycobacterium tuberculosis H37Rv
ugucggugguaccggcg

SEQ ID NO: 1310991 - RNA, 15 nt, Mycobacterium tuberculosis H37Rv
ugucgguacugacag

SEQ ID NO: 1310992 - RNA, 16 nt, Mycobacterium tuberculosis H37Rv
ugucggggauucgucg

SEQ ID NO: 1310993 - RNA, 22 nt, Mycobacterium tuberculosis H37Rv
ugucggggccgcaggccagggu

SEQ ID NO: 1310994 - RNA, 21 nt, Mycobacterium tuberculosis H37Rv
ugucgggaacgaguacgggca

SEQ ID NO: 1310995 - RNA, 24 nt, Mycobacterium tuberculosis H37Rv
ugucgggcaccgguuugacgucca

SEQ ID NO: 1310996 - RNA, 22 nt, Mycobacterium tuberculosis H37Rv
ugucgguguacagucgcgcgcu

SEQ ID NO: 1310997 - RNA, 14 nt, Mycobacterium tuberculosis H37Rv
ugucgucgcggccg

SEQ ID NO: 1310998 - RNA, 18 nt, Mycobacterium tuberculosis H37Rv
ugucgugcaaugcuucca

SEQ ID NO: 1310999 - RNA, 23 nt, Mycobacterium tuberculosis H37Rv
ugucgucggcggcgaacagcccc

SEQ ID NO: 1311000 - RNA, 22 nt, Mycobacterium tuberculosis H37Rv
ugucguucgcgucacaccagcg

SEQ ID NO: 1311001 - RNA, 17 nt, Mycobacterium tuberculosis H37Rv
ugucuacgccgggaauu

SEQ ID NO: 1311002 - RNA, 19 nt, Mycobacterium tuberculosis H37Rv
ugucuagcugguggugcgg

SEQ ID NO: 1311003 - RNA, 17 nt, Mycobacterium tuberculosis H37Rv
ugucucccuugccgcca

SEQ ID NO: 1311004 - RNA, 15 nt, Mycobacterium tuberculosis H37Rv
ugucucccuugccgc

SEQ ID NO: 1311005 - RNA, 21 nt, Mycobacterium tuberculosis H37Rv
ugucucggcaccacagugaaa

SEQ ID NO: 1311006 - RNA, 13 nt, Mycobacterium tuberculosis H37Rv
ugugaguccagcc

SEQ ID NO: 1311007 - RNA, 15 nt, Mycobacterium tuberculosis H37Rv
ugugaacugucccac

SEQ ID NO: 1311008 - RNA, 12 nt, Mycobacterium tuberculosis H37Rv
ugucugcccgag

SEQ ID NO: 1311009 - RNA, 15 nt, Mycobacterium tuberculosis H37Rv
ugucugcucgcgccg

SEQ ID NO: 1311010 - RNA, 19 nt, Mycobacterium tuberculosis H37Rv
ugucuuagccagcagcaca

SEQ ID NO: 1311011 - RNA, 11 nt, Mycobacterium tuberculosis H37Rv
ugugccgccgg

SEQ ID NO: 1311012 - RNA, 20 nt, Mycobacterium tuberculosis H37Rv
ugugccgaucggccaacagg

SEQ ID NO: 1311013 - RNA, 19 nt, Mycobacterium tuberculosis H37Rv
ugugccgauuggccugcca

SEQ ID NO: 1311014 - RNA, 21 nt, Mycobacterium tuberculosis H37Rv
ugugcccggcuccuccccggc

SEQ ID NO: 1311015 - RNA, 21 nt, Mycobacterium tuberculosis H37Rv
ugugcccucaacgucccagcc

SEQ ID NO: 1311016 - RNA, 22 nt, Mycobacterium tuberculosis H37Rv
uguggacgcccgaguugaagaa

SEQ ID NO: 1311017 - RNA, 18 nt, Mycobacterium tuberculosis H37Rv
uguggacccgccagggca

SEQ ID NO: 1311018 - RNA, 12 nt, Mycobacterium tuberculosis H37Rv
uguggacccgcc

SEQ ID NO: 1311019 - RNA, 15 nt, Mycobacterium tuberculosis H37Rv
uguggugacagagcg

SEQ ID NO: 1311020 - RNA, 16 nt, Mycobacterium tuberculosis H37Rv
uguggucgcugcugcc

SEQ ID NO: 1311021 - RNA, 18 nt, Mycobacterium tuberculosis H37Rv
ugugguuggugcuggccu

SEQ ID NO: 1311022 - RNA, 19 nt, Mycobacterium tuberculosis H37Rv
ugugugcgauccagggccg

SEQ ID NO: 1311023 - RNA, 15 nt, Mycobacterium tuberculosis H37Rv
ugugugcggcgguaa

SEQ ID NO: 1311024 - RNA, 13 nt, Mycobacterium tuberculosis H37Rv
uguguggcagccc

SEQ ID NO: 1311025 - RNA, 21 nt, Mycobacterium tuberculosis H37Rv
uguucuugagccggacguucu

SEQ ID NO: 1311026 - RNA, 22 nt, Mycobacterium tuberculosis H37Rv
uguugaaauugaugaucugcag

SEQ ID NO: 1311027 - RNA, 22 nt, Mycobacterium tuberculosis H37Rv
uguucuuggccacccccgucag

SEQ ID NO: 1311028 - RNA, 21 nt, Mycobacterium tuberculosis H37Rv
uguugaagaggcgcaccuccu

SEQ ID NO: 1311029 - RNA, 15 nt, Mycobacterium tuberculosis H37Rv
uguugccccggucgg

SEQ ID NO: 1311030 - RNA, 19 nt, Mycobacterium tuberculosis H37Rv
uguugccccuccaggggcu

SEQ ID NO: 1311031 - RNA, 15 nt, Mycobacterium tuberculosis H37Rv
uguugaugggcagcc

SEQ ID NO: 1311032 - RNA, 18 nt, Mycobacterium tuberculosis H37Rv
uguugagcuggaccuccg

SEQ ID NO: 1311033 - RNA, 13 nt, Mycobacterium tuberculosis H37Rv
uguucaucaucug

SEQ ID NO: 1311034 - RNA, 15 nt, Mycobacterium tuberculosis H37Rv
uguuccaacacuggg

SEQ ID NO: 1311035 - RNA, 18 nt, Mycobacterium tuberculosis H37Rv
uguucuggauacccagcg

SEQ ID NO: 1311036 - RNA, 13 nt, Mycobacterium tuberculosis H37Rv
uuacgucugcucg

SEQ ID NO: 1311037 - RNA, 21 nt, Mycobacterium tuberculosis H37Rv
uuacgcucgcgggccaaagcc

SEQ ID NO: 1311038 - RNA, 21 nt, Mycobacterium tuberculosis H37Rv
uuacgaugcucagcuggucgg

SEQ ID NO: 1311039 - RNA, 21 nt, Mycobacterium tuberculosis H37Rv
uuacgcaccgaugccuugacc

SEQ ID NO: 1311040 - RNA, 14 nt, Mycobacterium tuberculosis H37Rv
uuacgccgagcaca

SEQ ID NO: 1311041 - RNA, 17 nt, Mycobacterium tuberculosis H37Rv
uuacaugucacacccac

SEQ ID NO: 1311042 - RNA, 14 nt, Mycobacterium tuberculosis H37Rv
uuacaugucacacc

SEQ ID NO: 1311043 - RNA, 17 nt, Mycobacterium tuberculosis H37Rv
uuacauagaccaccggc

SEQ ID NO: 1311044 - RNA, 22 nt, Mycobacterium tuberculosis H37Rv
uuaagcgaacccgagccgccgu

SEQ ID NO: 1311045 - RNA, 15 nt, Mycobacterium tuberculosis H37Rv
uuauugagucggcug

SEQ ID NO: 1311046 - RNA, 18 nt, Mycobacterium tuberculosis H37Rv
uuauucacccgguaggug

SEQ ID NO: 1311047 - RNA, 22 nt, Mycobacterium tuberculosis H37Rv
uuauucggugcgcgguugcugg

SEQ ID NO: 1311048 - RNA, 15 nt, Mycobacterium tuberculosis H37Rv
uuauccggccaguga

SEQ ID NO: 1311049 - RNA, 20 nt, Mycobacterium tuberculosis H37Rv
ugcauggcuugcucugcgca

SEQ ID NO: 1311050 - RNA, 22 nt, Mycobacterium tuberculosis H37Rv
ugcaugcccagaaaaccgccgc

SEQ ID NO: 1311051 - RNA, 20 nt, Mycobacterium tuberculosis H37Rv
ugcaucauggccgugaacug

SEQ ID NO: 1311052 - RNA, 18 nt, Mycobacterium tuberculosis H37Rv
ugcaucaugccgcccauc

SEQ ID NO: 1311053 - RNA, 20 nt, Mycobacterium tuberculosis H37Rv
ugcaucaugccgcccaucac

SEQ ID NO: 1311054 - RNA, 20 nt, Mycobacterium tuberculosis H37Rv
ugcaucgcggcggcgcucuu

SEQ ID NO: 1311055 - RNA, 16 nt, Mycobacterium tuberculosis H37Rv
ugcaucgccugcgccu

SEQ ID NO: 1311056 - RNA, 17 nt, Mycobacterium tuberculosis H37Rv
ugcaucggucagcgccg

SEQ ID NO: 1311057 - RNA, 17 nt, Mycobacterium tuberculosis H37Rv
ugcaucggugcagcccg

SEQ ID NO: 1311058 - RNA, 15 nt, Mycobacterium tuberculosis H37Rv
ugcaucugaucaggc

SEQ ID NO: 1311059 - RNA, 17 nt, Mycobacterium tuberculosis H37Rv
ugcaucugaucaggcca

SEQ ID NO: 1311060 - RNA, 14 nt, Mycobacterium tuberculosis H37Rv
ugcacuacaggguu

SEQ ID NO: 1311061 - RNA, 15 nt, Mycobacterium tuberculosis H37Rv
ugcacuacaggguug

SEQ ID NO: 1311062 - RNA, 17 nt, Mycobacterium tuberculosis H37Rv
ugcagugccgcacccag

SEQ ID NO: 1311063 - RNA, 21 nt, Mycobacterium tuberculosis H37Rv
ugcacugcugguugaugaagg

SEQ ID NO: 1311064 - RNA, 15 nt, Mycobacterium tuberculosis H37Rv
ugcacugcugguuga

SEQ ID NO: 1311065 - RNA, 23 nt, Mycobacterium tuberculosis H37Rv
ugcagugccguguccagcaugcc

SEQ ID NO: 1311066 - RNA, 13 nt, Mycobacterium tuberculosis H37Rv
ugcaguuccuugc

SEQ ID NO: 1311067 - RNA, 19 nt, Mycobacterium tuberculosis H37Rv
ugcauagcaauccgcacag

SEQ ID NO: 1311068 - RNA, 21 nt, Mycobacterium tuberculosis H37Rv
ugcauagcaauccgcacagcg

SEQ ID NO: 1311069 - RNA, 16 nt, Mycobacterium tuberculosis H37Rv
ugcauucccgccuucu

SEQ ID NO: 1311070 - RNA, 17 nt, Mycobacterium tuberculosis H37Rv
ugccacguucgcgggcg

SEQ ID NO: 1311071 - RNA, 15 nt, Mycobacterium tuberculosis H37Rv
ugccacggccuucag

SEQ ID NO: 1311072 - RNA, 23 nt, Mycobacterium tuberculosis H37Rv
ugccacgacgaacaccagcgcgc

SEQ ID NO: 1311073 - RNA, 23 nt, Mycobacterium tuberculosis H37Rv
ugccacgaacgcuuccagcgugu

SEQ ID NO: 1311074 - RNA, 22 nt, Mycobacterium tuberculosis H37Rv
ugccaccgcuugaccccuggcc

SEQ ID NO: 1311075 - RNA, 12 nt, Mycobacterium tuberculosis H37Rv
ugccaccgugca

SEQ ID NO: 1311076 - RNA, 14 nt, Mycobacterium tuberculosis H37Rv
ugccaccgccgccg

SEQ ID NO: 1311077 - RNA, 21 nt, Mycobacterium tuberculosis H37Rv
ugccaccugacuaccgucauc

SEQ ID NO: 1311078 - RNA, 15 nt, Mycobacterium tuberculosis H37Rv
ugccacccuugccgc

SEQ ID NO: 1311079 - RNA, 12 nt, Mycobacterium tuberculosis H37Rv
ugccacagaccg

SEQ ID NO: 1311080 - RNA, 22 nt, Mycobacterium tuberculosis H37Rv
ugccaacaaaggccggguggcc

SEQ ID NO: 1311081 - RNA, 21 nt, Mycobacterium tuberculosis H37Rv
ugccaacaccggcgaucaccg

SEQ ID NO: 1311082 - RNA, 16 nt, Mycobacterium tuberculosis H37Rv
ugccaaugcugcaggu

SEQ ID NO: 1311083 - RNA, 18 nt, Mycobacterium tuberculosis H37Rv
ugccagaucggcgggugg

SEQ ID NO: 1311084 - RNA, 13 nt, Mycobacterium tuberculosis H37Rv
ugccagccgugca

SEQ ID NO: 1311085 - RNA, 21 nt, Mycobacterium tuberculosis H37Rv
ugccagccgucgucagguggc

SEQ ID NO: 1311086 - RNA, 16 nt, Mycobacterium tuberculosis H37Rv
ugccagcggcacaccc

SEQ ID NO: 1311087 - RNA, 11 nt, Mycobacterium tuberculosis H37Rv
ugccagcggca

SEQ ID NO: 1311088 - RNA, 16 nt, Mycobacterium tuberculosis H37Rv
ugccagcggccgggcg

SEQ ID NO: 1311089 - RNA, 20 nt, Mycobacterium tuberculosis H37Rv
ugccagggugcgccgguccu

SEQ ID NO: 1311090 - RNA, 17 nt, Mycobacterium tuberculosis H37Rv
ugccauggauguaggcu

SEQ ID NO: 1311091 - RNA, 22 nt, Mycobacterium tuberculosis H37Rv
ugccaucgggcgcgguaaccac

SEQ ID NO: 1311092 - RNA, 19 nt, Mycobacterium tuberculosis H37Rv
ugccaucgggcgcgguaac

SEQ ID NO: 1311093 - RNA, 22 nt, Mycobacterium tuberculosis H37Rv
ugccaucgcggcguugugaccg

SEQ ID NO: 1311094 - RNA, 18 nt, Mycobacterium tuberculosis H37Rv
ugccaucgggaccgggga

SEQ ID NO: 1311095 - RNA, 18 nt, Mycobacterium tuberculosis H37Rv
ugccaggugcuguuuggu

SEQ ID NO: 1311096 - RNA, 15 nt, Mycobacterium tuberculosis H37Rv
ugccaggugggugaa

SEQ ID NO: 1311097 - RNA, 16 nt, Mycobacterium tuberculosis H37Rv
ugccaguacucggcca

SEQ ID NO: 1311098 - RNA, 19 nt, Mycobacterium tuberculosis H37Rv
ugccgccgagggcgccggg

SEQ ID NO: 1311099 - RNA, 20 nt, Mycobacterium tuberculosis H37Rv
ugccgccgaugccgccggca

SEQ ID NO: 1311100 - RNA, 20 nt, Mycobacterium tuberculosis H37Rv
ugccgccgguuccgccggcc

SEQ ID NO: 1311101 - RNA, 23 nt, Mycobacterium tuberculosis H37Rv
ugccgccgguggugccggcgccg

SEQ ID NO: 1311102 - RNA, 14 nt, Mycobacterium tuberculosis H37Rv
ugccgccggugccg

SEQ ID NO: 1311103 - RNA, 13 nt, Mycobacterium tuberculosis H37Rv
ugccgccggugcc

SEQ ID NO: 1311104 - RNA, 17 nt, Mycobacterium tuberculosis H37Rv
ugccgccgcagaugggc

SEQ ID NO: 1311105 - RNA, 22 nt, Mycobacterium tuberculosis H37Rv
ugccgccgggugcaacggcguu

SEQ ID NO: 1311106 - RNA, 14 nt, Mycobacterium tuberculosis H37Rv
ugccgccguuaccg

SEQ ID NO: 1311107 - RNA, 19 nt, Mycobacterium tuberculosis H37Rv
ugccgccgucgccgccgcu

SEQ ID NO: 1311108 - RNA, 17 nt, Mycobacterium tuberculosis H37Rv
ugccgccguugccgcca

SEQ ID NO: 1311109 - RNA, 23 nt, Mycobacterium tuberculosis H37Rv
ugccgccguugccgccggcgccg

SEQ ID NO: 1311110 - RNA, 19 nt, Mycobacterium tuberculosis H37Rv
ugccgccgucgccgccguu

SEQ ID NO: 1311111 - RNA, 21 nt, Mycobacterium tuberculosis H37Rv
ugccgccgguuccgccggccc

SEQ ID NO: 1311112 - RNA, 17 nt, Mycobacterium tuberculosis H37Rv
ugccgccguugccaccg

SEQ ID NO: 1311113 - RNA, 17 nt, Mycobacterium tuberculosis H37Rv
ugccgccugcgccgcca

SEQ ID NO: 1311114 - RNA, 12 nt, Mycobacterium tuberculosis H37Rv
ugccgcagugac

SEQ ID NO: 1311115 - RNA, 16 nt, Mycobacterium tuberculosis H37Rv
ugccgcauacgcggcu

SEQ ID NO: 1311116 - RNA, 13 nt, Mycobacterium tuberculosis H37Rv
ugccgcagcggcg

SEQ ID NO: 1311117 - RNA, 17 nt, Mycobacterium tuberculosis H37Rv
ugccgcccgcgccuccg

SEQ ID NO: 1311118 - RNA, 17 nt, Mycobacterium tuberculosis H37Rv
ugccgcccgcgccgccc

SEQ ID NO: 1311119 - RNA, 17 nt, Mycobacterium tuberculosis H37Rv
ugccgccccgcagcugc

SEQ ID NO: 1311120 - RNA, 17 nt, Mycobacterium tuberculosis H37Rv
ugccgcccuugccgccc

SEQ ID NO: 1311121 - RNA, 15 nt, Mycobacterium tuberculosis H37Rv
ugccgcccucaccgc

SEQ ID NO: 1311122 - RNA, 17 nt, Mycobacterium tuberculosis H37Rv
ugccgaguuccugcacg

SEQ ID NO: 1311123 - RNA, 22 nt, Mycobacterium tuberculosis H37Rv
ugccgaucaaccccccgggccc

SEQ ID NO: 1311124 - RNA, 15 nt, Mycobacterium tuberculosis H37Rv
ugccgauagcgcggc

SEQ ID NO: 1311125 - RNA, 15 nt, Mycobacterium tuberculosis H37Rv
ugccgcacccagacc

SEQ ID NO: 1311126 - RNA, 13 nt, Mycobacterium tuberculosis H37Rv
ugccgauccccag

SEQ ID NO: 1311127 - RNA, 14 nt, Mycobacterium tuberculosis H37Rv
ugccgaucagcagu

SEQ ID NO: 1311128 - RNA, 16 nt, Mycobacterium tuberculosis H37Rv
ugccgaucagcagugg

SEQ ID NO: 1311129 - RNA, 17 nt, Mycobacterium tuberculosis H37Rv
ugccgaucagcccggcc

SEQ ID NO: 1311130 - RNA, 20 nt, Mycobacterium tuberculosis H37Rv
ugcccugcgcucgggcugcc

SEQ ID NO: 1311131 - RNA, 21 nt, Mycobacterium tuberculosis H37Rv
ugcccugcacuucgggauaag

SEQ ID NO: 1311132 - RNA, 14 nt, Mycobacterium tuberculosis H37Rv
ugcccugcccgaag

SEQ ID NO: 1311133 - RNA, 16 nt, Mycobacterium tuberculosis H37Rv
ugcccugauugaagcc

SEQ ID NO: 1311134 - RNA, 18 nt, Mycobacterium tuberculosis H37Rv
ugcccugacgccccgcca

SEQ ID NO: 1311135 - RNA, 12 nt, Mycobacterium tuberculosis H37Rv
ugcccucggccg

SEQ ID NO: 1311136 - RNA, 20 nt, Mycobacterium tuberculosis H37Rv
ugcccggacucuccccuggc

SEQ ID NO: 1311137 - RNA, 19 nt, Mycobacterium tuberculosis H37Rv
ugcccgcguugccaaagcc

SEQ ID NO: 1311138 - RNA, 14 nt, Mycobacterium tuberculosis H37Rv
ugcccgcguugcca

SEQ ID NO: 1311139 - RNA, 18 nt, Mycobacterium tuberculosis H37Rv
ugcccgcguugccaaagc

SEQ ID NO: 1311140 - RNA, 19 nt, Mycobacterium tuberculosis H37Rv
ugcccgcugaucagauccu

SEQ ID NO: 1311141 - RNA, 16 nt, Mycobacterium tuberculosis H37Rv
ugcccguucugcccag

SEQ ID NO: 1311142 - RNA, 22 nt, Mycobacterium tuberculosis H37Rv
ugcccguucaugcggcggcgcu

SEQ ID NO: 1311143 - RNA, 16 nt, Mycobacterium tuberculosis H37Rv
ugcccguggugauggu

SEQ ID NO: 1311144 - RNA, 22 nt, Mycobacterium tuberculosis H37Rv
ugcccguguuaaagaagccuga

SEQ ID NO: 1311145 - RNA, 15 nt, Mycobacterium tuberculosis H37Rv
ugcccccgccggccg

SEQ ID NO: 1311146 - RNA, 23 nt, Mycobacterium tuberculosis H37Rv
ugcccgacaccgccccgccgcga

SEQ ID NO: 1311147 - RNA, 18 nt, Mycobacterium tuberculosis H37Rv
ugcccgagcccagcgccu

SEQ ID NO: 1311148 - RNA, 21 nt, Mycobacterium tuberculosis H37Rv
ugcccgagcccagcgccucca

SEQ ID NO: 1311149 - RNA, 24 nt, Mycobacterium tuberculosis H37Rv
ugcccgcggugacgagcacaugcu

SEQ ID NO: 1311150 - RNA, 21 nt, Mycobacterium tuberculosis H37Rv
ugcccgaugguacccgcgccg

SEQ ID NO: 1311151 - RNA, 13 nt, Mycobacterium tuberculosis H37Rv
ugcccgcgcggcg

SEQ ID NO: 1311152 - RNA, 20 nt, Mycobacterium tuberculosis H37Rv
ugcccgcgaacgaucccgcc

SEQ ID NO: 1311153 - RNA, 15 nt, Mycobacterium tuberculosis H37Rv
ugcccgaucagccgu

SEQ ID NO: 1311154 - RNA, 17 nt, Mycobacterium tuberculosis H37Rv
ugccccagggcagugcg

SEQ ID NO: 1311155 - RNA, 16 nt, Mycobacterium tuberculosis H37Rv
ugcccccggcgcggcg

SEQ ID NO: 1311156 - RNA, 17 nt, Mycobacterium tuberculosis H37Rv
ugcccgaaccaccaccg

SEQ ID NO: 1311157 - RNA, 21 nt, Mycobacterium tuberculosis H37Rv
ugcccgaagagcacgucaaca

SEQ ID NO: 1311158 - RNA, 16 nt, Mycobacterium tuberculosis H37Rv
ugccccacccgcggcg

SEQ ID NO: 1311159 - RNA, 15 nt, Mycobacterium tuberculosis H37Rv
ugccggacaaccugg

SEQ ID NO: 1311160 - RNA, 14 nt, Mycobacterium tuberculosis H37Rv
ugccggaccaccgg

SEQ ID NO: 1311161 - RNA, 16 nt, Mycobacterium tuberculosis H37Rv
ugccggacaaccuggg

SEQ ID NO: 1311162 - RNA, 19 nt, Mycobacterium tuberculosis H37Rv
ugccggacagccacgcaca

SEQ ID NO: 1311163 - RNA, 12 nt, Mycobacterium tuberculosis H37Rv
ugccggcccugc

SEQ ID NO: 1311164 - RNA, 13 nt, Mycobacterium tuberculosis H37Rv
ugccgggccgcgc

SEQ ID NO: 1311165 - RNA, 18 nt, Mycobacterium tuberculosis H37Rv
ugccgggcaccaccacac

SEQ ID NO: 1311166 - RNA, 13 nt, Mycobacterium tuberculosis H37Rv
ugccgggcaccac

SEQ ID NO: 1311167 - RNA, 14 nt, Mycobacterium tuberculosis H37Rv
ugccgggcccagca

SEQ ID NO: 1311168 - RNA, 16 nt, Mycobacterium tuberculosis H37Rv
ugccggggcugccgcc

SEQ ID NO: 1311169 - RNA, 15 nt, Mycobacterium tuberculosis H37Rv
ugccgggaucgccgu

SEQ ID NO: 1311170 - RNA, 17 nt, Mycobacterium tuberculosis H37Rv
ugccggcgcaccacacc

SEQ ID NO: 1311171 - RNA, 20 nt, Mycobacterium tuberculosis H37Rv
ugccggcgauguuggccagc

SEQ ID NO: 1311172 - RNA, 22 nt, Mycobacterium tuberculosis H37Rv
ugccggcgaaccccagcgcauc

SEQ ID NO: 1311173 - RNA, 19 nt, Mycobacterium tuberculosis H37Rv
ugccggcgaacucgcgccg

SEQ ID NO: 1311174 - RNA, 19 nt, Mycobacterium tuberculosis H37Rv
ugccggcgagggccacggc

SEQ ID NO: 1311175 - RNA, 16 nt, Mycobacterium tuberculosis H37Rv
ugccggcgagggccac

SEQ ID NO: 1311176 - RNA, 16 nt, Mycobacterium tuberculosis H37Rv
ugccgcugagcccugc

SEQ ID NO: 1311177 - RNA, 23 nt, Mycobacterium tuberculosis H37Rv
ugccgcguagguggccagcgcgg

SEQ ID NO: 1311178 - RNA, 17 nt, Mycobacterium tuberculosis H37Rv
ugccgcgggcagcgugu

SEQ ID NO: 1311179 - RNA, 20 nt, Mycobacterium tuberculosis H37Rv
ugccgcgggacaucaccgca

SEQ ID NO: 1311180 - RNA, 19 nt, Mycobacterium tuberculosis H37Rv
ugccgcguagguggccagc

SEQ ID NO: 1311181 - RNA, 19 nt, Mycobacterium tuberculosis H37Rv
ugccgcgccguagagccgc

SEQ ID NO: 1311182 - RNA, 17 nt, Mycobacterium tuberculosis H37Rv
ugccgcggccaccgccg

SEQ ID NO: 1311183 - RNA, 21 nt, Mycobacterium tuberculosis H37Rv
ugccgcggccaccgccgccgc

SEQ ID NO: 1311184 - RNA, 20 nt, Mycobacterium tuberculosis H37Rv
ugccgcggcuaggccaagcc

SEQ ID NO: 1311185 - RNA, 16 nt, Mycobacterium tuberculosis H37Rv
ugccgcgcagcugccg

SEQ ID NO: 1311186 - RNA, 19 nt, Mycobacterium tuberculosis H37Rv
ugccgcgcagcugccgcac

SEQ ID NO: 1311187 - RNA, 16 nt, Mycobacterium tuberculosis H37Rv
ugccgccuugcuugcg

SEQ ID NO: 1311188 - RNA, 14 nt, Mycobacterium tuberculosis H37Rv
ugccgcgcagcugc

SEQ ID NO: 1311189 - RNA, 14 nt, Mycobacterium tuberculosis H37Rv
ugccggucauacca

SEQ ID NO: 1311190 - RNA, 17 nt, Mycobacterium tuberculosis H37Rv
ugccggucauccgggcg

SEQ ID NO: 1311191 - RNA, 20 nt, Mycobacterium tuberculosis H37Rv
ugccgguagcacagcagcaa

SEQ ID NO: 1311192 - RNA, 13 nt, Mycobacterium tuberculosis H37Rv
ugccggucaggca

SEQ ID NO: 1311193 - RNA, 21 nt, Mycobacterium tuberculosis H37Rv
ugccgguguuguaggccgggc

SEQ ID NO: 1311194 - RNA, 19 nt, Mycobacterium tuberculosis H37Rv
ugccggugugcgccaaggu

SEQ ID NO: 1311195 - RNA, 17 nt, Mycobacterium tuberculosis H37Rv
ugccgguggcgccgccg

SEQ ID NO: 1311196 - RNA, 20 nt, Mycobacterium tuberculosis H37Rv
ugccgguuuugccgugccac

SEQ ID NO: 1311197 - RNA, 23 nt, Mycobacterium tuberculosis H37Rv
ugccgugcugaacuccgccgcga

SEQ ID NO: 1311198 - RNA, 13 nt, Mycobacterium tuberculosis H37Rv
ugccguuccggcu

SEQ ID NO: 1311199 - RNA, 23 nt, Mycobacterium tuberculosis H37Rv
ugccguucaugccauggauguag

SEQ ID NO: 1311200 - RNA, 13 nt, Mycobacterium tuberculosis H37Rv
ugccguugcgauc

SEQ ID NO: 1311201 - RNA, 21 nt, Mycobacterium tuberculosis H37Rv
ugccucgcgggaagucccgag

SEQ ID NO: 1311202 - RNA, 14 nt, Mycobacterium tuberculosis H37Rv
ugccucggcggccu

SEQ ID NO: 1311203 - RNA, 16 nt, Mycobacterium tuberculosis H37Rv
ugccucgauggucucc

SEQ ID NO: 1311204 - RNA, 12 nt, Mycobacterium tuberculosis H37Rv
ugccuccaucaa

SEQ ID NO: 1311205 - RNA, 17 nt, Mycobacterium tuberculosis H37Rv
ugccuccggcgccgccc

SEQ ID NO: 1311206 - RNA, 16 nt, Mycobacterium tuberculosis H37Rv
ugccugcuagcagcag

SEQ ID NO: 1311207 - RNA, 15 nt, Mycobacterium tuberculosis H37Rv
ugccugcuagcagca

SEQ ID NO: 1311208 - RNA, 14 nt, Mycobacterium tuberculosis H37Rv
ugccugggcggccg

SEQ ID NO: 1311209 - RNA, 12 nt, Mycobacterium tuberculosis H37Rv
ugccuucuuugc

SEQ ID NO: 1311210 - RNA, 21 nt, Mycobacterium tuberculosis H37Rv
ugccuucuuugccggcgccuu

SEQ ID NO: 1311211 - RNA, 16 nt, Mycobacterium tuberculosis H37Rv
ugcgccaccguggccg

SEQ ID NO: 1311212 - RNA, 17 nt, Mycobacterium tuberculosis H37Rv
ugccuucguagcggccg

SEQ ID NO: 1311213 - RNA, 18 nt, Mycobacterium tuberculosis H37Rv
ugcgccacgaccgcggcg

SEQ ID NO: 1311214 - RNA, 20 nt, Mycobacterium tuberculosis H37Rv
ugcgccagaucaccgucgac

SEQ ID NO: 1311215 - RNA, 21 nt, Mycobacterium tuberculosis H37Rv
ugcgcccauagcugccggccc

SEQ ID NO: 1311216 - RNA, 19 nt, Mycobacterium tuberculosis H37Rv
ugcgccauucgcccggccg

SEQ ID NO: 1311217 - RNA, 13 nt, Mycobacterium tuberculosis H37Rv
ugcgcccagcacg

SEQ ID NO: 1311218 - RNA, 19 nt, Mycobacterium tuberculosis H37Rv
ugcgcccaccgaaaccggu

SEQ ID NO: 1311219 - RNA, 22 nt, Mycobacterium tuberculosis H37Rv
ugcgcccagcgacccggccagc

SEQ ID NO: 1311220 - RNA, 23 nt, Mycobacterium tuberculosis H37Rv
ugcgccaucacaucggccucuga

SEQ ID NO: 1311221 - RNA, 18 nt, Mycobacterium tuberculosis H37Rv
ugcgccgacaccgggccc

SEQ ID NO: 1311222 - RNA, 20 nt, Mycobacterium tuberculosis H37Rv
ugcgccgaacgcuccaggcc

SEQ ID NO: 1311223 - RNA, 16 nt, Mycobacterium tuberculosis H37Rv
ugcgcccugagcagau

SEQ ID NO: 1311224 - RNA, 19 nt, Mycobacterium tuberculosis H37Rv
ugcgccgcacgccgaccgg

SEQ ID NO: 1311225 - RNA, 23 nt, Mycobacterium tuberculosis H37Rv
ugcgccgcacgccgaccggcccg

SEQ ID NO: 1311226 - RNA, 16 nt, Mycobacterium tuberculosis H37Rv
ugcgccgcacacucuc

SEQ ID NO: 1311227 - RNA, 16 nt, Mycobacterium tuberculosis H37Rv
ugcgccgaucccgccc

SEQ ID NO: 1311228 - RNA, 16 nt, Mycobacterium tuberculosis H37Rv
ugcgccgccggcgcgu

SEQ ID NO: 1311229 - RNA, 19 nt, Mycobacterium tuberculosis H37Rv
ugcgccgccagcgccgccg

SEQ ID NO: 1311230 - RNA, 15 nt, Mycobacterium tuberculosis H37Rv
ugcgccgccacagca

SEQ ID NO: 1311231 - RNA, 16 nt, Mycobacterium tuberculosis H37Rv
ugcgccgcgcgcggcg

SEQ ID NO: 1311232 - RNA, 17 nt, Mycobacterium tuberculosis H37Rv
ugcgccuggcuggccag

SEQ ID NO: 1311233 - RNA, 15 nt, Mycobacterium tuberculosis H37Rv
ugcgccuugaccaca

SEQ ID NO: 1311234 - RNA, 16 nt, Mycobacterium tuberculosis H37Rv
ugcgcgaccgaccagc

SEQ ID NO: 1311235 - RNA, 17 nt, Mycobacterium tuberculosis H37Rv
ugcgcgaccgaccagcc

SEQ ID NO: 1311236 - RNA, 15 nt, Mycobacterium tuberculosis H37Rv
ugcgcgaccacccgc

SEQ ID NO: 1311237 - RNA, 15 nt, Mycobacterium tuberculosis H37Rv
ugcgccuccgggacg

SEQ ID NO: 1311238 - RNA, 20 nt, Mycobacterium tuberculosis H37Rv
ugcgccguguuccagguaca

SEQ ID NO: 1311239 - RNA, 17 nt, Mycobacterium tuberculosis H37Rv
ugcgccggcuggcggcc

SEQ ID NO: 1311240 - RNA, 22 nt, Mycobacterium tuberculosis H37Rv
ugcgccgucggugggugccagc

SEQ ID NO: 1311241 - RNA, 15 nt, Mycobacterium tuberculosis H37Rv
ugcgccguugccgcc

SEQ ID NO: 1311242 - RNA, 15 nt, Mycobacterium tuberculosis H37Rv
ugcgccgggcucgcg

SEQ ID NO: 1311243 - RNA, 16 nt, Mycobacterium tuberculosis H37Rv
ugcgccgucagcccag

SEQ ID NO: 1311244 - RNA, 19 nt, Mycobacterium tuberculosis H37Rv
ugcgcgggcaucgucgucg

SEQ ID NO: 1311245 - RNA, 16 nt, Mycobacterium tuberculosis H37Rv
ugcgcggucgcgcgau

SEQ ID NO: 1311246 - RNA, 16 nt, Mycobacterium tuberculosis H37Rv
ugcgcggcuugucgcg

SEQ ID NO: 1311247 - RNA, 15 nt, Mycobacterium tuberculosis H37Rv
ugcgcgcggccgcgc

SEQ ID NO: 1311248 - RNA, 16 nt, Mycobacterium tuberculosis H37Rv
ugcgcgcucggccagc

SEQ ID NO: 1311249 - RNA, 16 nt, Mycobacterium tuberculosis H37Rv
ugcgcgcugacccgcc

SEQ ID NO: 1311250 - RNA, 14 nt, Mycobacterium tuberculosis H37Rv
ugcgcucacugcag

SEQ ID NO: 1311251 - RNA, 14 nt, Mycobacterium tuberculosis H37Rv
ugcgcucacuggcg

SEQ ID NO: 1311252 - RNA, 17 nt, Mycobacterium tuberculosis H37Rv
ugcggaaacccggccgc

SEQ ID NO: 1311253 - RNA, 17 nt, Mycobacterium tuberculosis H37Rv
ugcggaaaccgcugggg

SEQ ID NO: 1311254 - RNA, 16 nt, Mycobacterium tuberculosis H37Rv
ugcggaaacccggccg

SEQ ID NO: 1311255 - RNA, 19 nt, Mycobacterium tuberculosis H37Rv
ugcggaaagccccuccggc

SEQ ID NO: 1311256 - RNA, 13 nt, Mycobacterium tuberculosis H37Rv
ugcggaaaucgga

SEQ ID NO: 1311257 - RNA, 14 nt, Mycobacterium tuberculosis H37Rv
ugcggaacaccgcc

SEQ ID NO: 1311258 - RNA, 21 nt, Mycobacterium tuberculosis H37Rv
ugcggaacaccgcccggcccg

SEQ ID NO: 1311259 - RNA, 23 nt, Mycobacterium tuberculosis H37Rv
ugcggaacaccgcccggcccggc

SEQ ID NO: 1311260 - RNA, 16 nt, Mycobacterium tuberculosis H37Rv
ugcgcguggcagugca

SEQ ID NO: 1311261 - RNA, 20 nt, Mycobacterium tuberculosis H37Rv
ugcgcgucucgagcgcgccg

SEQ ID NO: 1311262 - RNA, 17 nt, Mycobacterium tuberculosis H37Rv
ugcgcgugacgaccagc

SEQ ID NO: 1311263 - RNA, 17 nt, Mycobacterium tuberculosis H37Rv
ugcgcgucgagcgaccc

SEQ ID NO: 1311264 - RNA, 21 nt, Mycobacterium tuberculosis H37Rv
ugcgcguuacccaucgccaca

SEQ ID NO: 1311265 - RNA, 19 nt, Mycobacterium tuberculosis H37Rv
ugcggacuggcauccgccc

SEQ ID NO: 1311266 - RNA, 23 nt, Mycobacterium tuberculosis H37Rv
ugcggaucacucccccacacacc

SEQ ID NO: 1311267 - RNA, 21 nt, Mycobacterium tuberculosis H37Rv
ugcggccgcugaucaacagac

SEQ ID NO: 1311268 - RNA, 19 nt, Mycobacterium tuberculosis H37Rv
ugcggccgaauuccucaag

SEQ ID NO: 1311269 - RNA, 11 nt, Mycobacterium tuberculosis H37Rv
ugcggccaggg

SEQ ID NO: 1311270 - RNA, 15 nt, Mycobacterium tuberculosis H37Rv
ugcggccagcgcggc

SEQ ID NO: 1311271 - RNA, 21 nt, Mycobacterium tuberculosis H37Rv
ugcggcccacaccagcgcagc

SEQ ID NO: 1311272 - RNA, 15 nt, Mycobacterium tuberculosis H37Rv
ugcggcccgggcucg

SEQ ID NO: 1311273 - RNA, 19 nt, Mycobacterium tuberculosis H37Rv
ugcggcccggguggcccgg

SEQ ID NO: 1311274 - RNA, 16 nt, Mycobacterium tuberculosis H37Rv
ugcggcgcuggccagc

SEQ ID NO: 1311275 - RNA, 22 nt, Mycobacterium tuberculosis H37Rv
ugcggcgcccggucgagccagc

SEQ ID NO: 1311276 - RNA, 19 nt, Mycobacterium tuberculosis H37Rv
ugcggcgaggacgcgcccg

SEQ ID NO: 1311277 - RNA, 19 nt, Mycobacterium tuberculosis H37Rv
ugcgggccgugacccucag

SEQ ID NO: 1311278 - RNA, 23 nt, Mycobacterium tuberculosis H37Rv
ugcgggccuccugcuggcccugc

SEQ ID NO: 1311279 - RNA, 15 nt, Mycobacterium tuberculosis H37Rv
ugcgggcccacgccc

SEQ ID NO: 1311280 - RNA, 15 nt, Mycobacterium tuberculosis H37Rv
ugcgggccgccaggc

SEQ ID NO: 1311281 - RNA, 16 nt, Mycobacterium tuberculosis H37Rv
ugcgggccgccaggcg

SEQ ID NO: 1311282 - RNA, 17 nt, Mycobacterium tuberculosis H37Rv
ugcgggguugaccgugg

SEQ ID NO: 1311283 - RNA, 19 nt, Mycobacterium tuberculosis H37Rv
ugcggucagacgccggccg

SEQ ID NO: 1311284 - RNA, 14 nt, Mycobacterium tuberculosis H37Rv
ugcggugaguccgc

SEQ ID NO: 1311285 - RNA, 15 nt, Mycobacterium tuberculosis H37Rv
ugcggucucgaccgu

SEQ ID NO: 1311286 - RNA, 17 nt, Mycobacterium tuberculosis H37Rv
ugcggugccggcccugc

SEQ ID NO: 1311287 - RNA, 18 nt, Mycobacterium tuberculosis H37Rv
ugcggucgcggcugacaa

SEQ ID NO: 1311288 - RNA, 15 nt, Mycobacterium tuberculosis H37Rv
ugcggucgcccaggc

SEQ ID NO: 1311289 - RNA, 16 nt, Mycobacterium tuberculosis H37Rv
ugcggucgcccaggcc

SEQ ID NO: 1311290 - RNA, 16 nt, Mycobacterium tuberculosis H37Rv
ugcgugcauaggccgc

SEQ ID NO: 1311291 - RNA, 16 nt, Mycobacterium tuberculosis H37Rv
ugcgucugcucgcccu

SEQ ID NO: 1311292 - RNA, 15 nt, Mycobacterium tuberculosis H37Rv
ugcgucugcucgccc

SEQ ID NO: 1311293 - RNA, 13 nt, Mycobacterium tuberculosis H37Rv
ugcgugccgaccc

SEQ ID NO: 1311294 - RNA, 19 nt, Mycobacterium tuberculosis H37Rv
ugcgugccgacccgcuucg

SEQ ID NO: 1311295 - RNA, 14 nt, Mycobacterium tuberculosis H37Rv
ugcgugccggcagc

SEQ ID NO: 1311296 - RNA, 15 nt, Mycobacterium tuberculosis H37Rv
ugcguucgggcucca

SEQ ID NO: 1311297 - RNA, 19 nt, Mycobacterium tuberculosis H37Rv
ugcguucgggcuccagcag

SEQ ID NO: 1311298 - RNA, 12 nt, Mycobacterium tuberculosis H37Rv
ugcgucucggug

SEQ ID NO: 1311299 - RNA, 14 nt, Mycobacterium tuberculosis H37Rv
ugcggugggugaag

SEQ ID NO: 1311300 - RNA, 15 nt, Mycobacterium tuberculosis H37Rv
ugcggugggccaggu

SEQ ID NO: 1311301 - RNA, 22 nt, Mycobacterium tuberculosis H37Rv
ugcggugguaggacgccagcaa

SEQ ID NO: 1311302 - RNA, 21 nt, Mycobacterium tuberculosis H37Rv
ugcgguucggacacacaggcg

SEQ ID NO: 1311303 - RNA, 20 nt, Mycobacterium tuberculosis H37Rv
ugcugccaacgggccauggg

SEQ ID NO: 1311304 - RNA, 12 nt, Mycobacterium tuberculosis H37Rv
ugcugcaccugg

SEQ ID NO: 1311305 - RNA, 21 nt, Mycobacterium tuberculosis H37Rv
ugcugcagacccguucgccgu

SEQ ID NO: 1311306 - RNA, 17 nt, Mycobacterium tuberculosis H37Rv
ugcugcagaucggccgg

SEQ ID NO: 1311307 - RNA, 17 nt, Mycobacterium tuberculosis H37Rv
ugcugcagcaauugcac

SEQ ID NO: 1311308 - RNA, 13 nt, Mycobacterium tuberculosis H37Rv
ugcugauggauca

SEQ ID NO: 1311309 - RNA, 13 nt, Mycobacterium tuberculosis H37Rv
ugcugaucuugcc

SEQ ID NO: 1311310 - RNA, 15 nt, Mycobacterium tuberculosis H37Rv
ugcugaugcccuugc

SEQ ID NO: 1311311 - RNA, 12 nt, Mycobacterium tuberculosis H37Rv
ugcugcaaggaa

SEQ ID NO: 1311312 - RNA, 17 nt, Mycobacterium tuberculosis H37Rv
ugcugagcguaggccag

SEQ ID NO: 1311313 - RNA, 15 nt, Mycobacterium tuberculosis H37Rv
ugcugagucgguuca

SEQ ID NO: 1311314 - RNA, 20 nt, Mycobacterium tuberculosis H37Rv
ugcugacggugcaggaccag

SEQ ID NO: 1311315 - RNA, 12 nt, Mycobacterium tuberculosis H37Rv
ugcugacggugc

SEQ ID NO: 1311316 - RNA, 22 nt, Mycobacterium tuberculosis H37Rv
ugcugacgacgagggccagcag

SEQ ID NO: 1311317 - RNA, 14 nt, Mycobacterium tuberculosis H37Rv
ugcucguguuguug

SEQ ID NO: 1311318 - RNA, 17 nt, Mycobacterium tuberculosis H37Rv
ugcucgucgagccgacc

SEQ ID NO: 1311319 - RNA, 16 nt, Mycobacterium tuberculosis H37Rv
ugcucgucgagcaugc

SEQ ID NO: 1311320 - RNA, 14 nt, Mycobacterium tuberculosis H37Rv
ugcucguccaagcc

SEQ ID NO: 1311321 - RNA, 22 nt, Mycobacterium tuberculosis H37Rv
ugcucguaggugccgaagauga

SEQ ID NO: 1311322 - RNA, 22 nt, Mycobacterium tuberculosis H37Rv
ugcucgucauccauccgggccg

SEQ ID NO: 1311323 - RNA, 23 nt, Mycobacterium tuberculosis H37Rv
ugcucgucauccauccgggccgc

SEQ ID NO: 1311324 - RNA, 22 nt, Mycobacterium tuberculosis H37Rv
ugcucgucggcgccggcggccg

SEQ ID NO: 1311325 - RNA, 21 nt, Mycobacterium tuberculosis H37Rv
ugcucgucggccaccgcggcg

SEQ ID NO: 1311326 - RNA, 19 nt, Mycobacterium tuberculosis H37Rv
ugcucgucggcgccggcgg

SEQ ID NO: 1311327 - RNA, 16 nt, Mycobacterium tuberculosis H37Rv
ugcguuguccaccauc

SEQ ID NO: 1311328 - RNA, 14 nt, Mycobacterium tuberculosis H37Rv
ugcguuggaugaag

SEQ ID NO: 1311329 - RNA, 21 nt, Mycobacterium tuberculosis H37Rv
ugcguugggaucccagcgcag

SEQ ID NO: 1311330 - RNA, 15 nt, Mycobacterium tuberculosis H37Rv
ugcguuggccccagg

SEQ ID NO: 1311331 - RNA, 20 nt, Mycobacterium tuberculosis H37Rv
ugcguuggcgccggccaaca

SEQ ID NO: 1311332 - RNA, 19 nt, Mycobacterium tuberculosis H37Rv
ugcucaccagacgcugcca

SEQ ID NO: 1311333 - RNA, 17 nt, Mycobacterium tuberculosis H37Rv
ugcucccggccgccgag

SEQ ID NO: 1311334 - RNA, 17 nt, Mycobacterium tuberculosis H37Rv
ugcuccugguggcagaa

SEQ ID NO: 1311335 - RNA, 20 nt, Mycobacterium tuberculosis H37Rv
ugcuccgguuggcgcgggcg

SEQ ID NO: 1311336 - RNA, 15 nt, Mycobacterium tuberculosis H37Rv
ugcuccuugggucgg

SEQ ID NO: 1311337 - RNA, 20 nt, Mycobacterium tuberculosis H37Rv
ugcucgacaaccgcccgcca

SEQ ID NO: 1311338 - RNA, 23 nt, Mycobacterium tuberculosis H37Rv
ugcucgacaaccgcccgccaggc

SEQ ID NO: 1311339 - RNA, 15 nt, Mycobacterium tuberculosis H37Rv
ugcucggucucgucg

SEQ ID NO: 1311340 - RNA, 20 nt, Mycobacterium tuberculosis H37Rv
ugcucgggggccgaccaguc

SEQ ID NO: 1311341 - RNA, 19 nt, Mycobacterium tuberculosis H37Rv
ugcucgccgaccagcuuga

SEQ ID NO: 1311342 - RNA, 21 nt, Mycobacterium tuberculosis H37Rv
ugcucgccggacggagguccu

SEQ ID NO: 1311343 - RNA, 16 nt, Mycobacterium tuberculosis H37Rv
ugcucgauccacugcc

SEQ ID NO: 1311344 - RNA, 22 nt, Mycobacterium tuberculosis H37Rv
ugcucguagacuugcugcuccu

SEQ ID NO: 1311345 - RNA, 16 nt, Mycobacterium tuberculosis H37Rv
ugcucguaggugccga

SEQ ID NO: 1311346 - RNA, 14 nt, Mycobacterium tuberculosis H37Rv
ugcucgccaggcaa

SEQ ID NO: 1311347 - RNA, 22 nt, Mycobacterium tuberculosis H37Rv
ugcucgccaggcaagccagcac

SEQ ID NO: 1311348 - RNA, 13 nt, Mycobacterium tuberculosis H37Rv
ugcucgccaggcc

SEQ ID NO: 1311349 - RNA, 18 nt, Mycobacterium tuberculosis H37Rv
ugcucgccaggccuaggc

SEQ ID NO: 1311350 - RNA, 15 nt, Mycobacterium tuberculosis H37Rv
ugcucgauguccucg

SEQ ID NO: 1311351 - RNA, 22 nt, Mycobacterium tuberculosis H37Rv
ugcucgcaaucguuggccaugc

SEQ ID NO: 1311352 - RNA, 19 nt, Mycobacterium tuberculosis H37Rv
ugcucgagcaccucggccu

SEQ ID NO: 1311353 - RNA, 20 nt, Mycobacterium tuberculosis H37Rv
ugcucgagcagaucagcacg

SEQ ID NO: 1311354 - RNA, 16 nt, Mycobacterium tuberculosis H37Rv
ugcucgacggcuccga

SEQ ID NO: 1311355 - RNA, 17 nt, Mycobacterium tuberculosis H37Rv
ugcucgacgaggccacg

SEQ ID NO: 1311356 - RNA, 16 nt, Mycobacterium tuberculosis H37Rv
ugcuggcgcaaccaau

SEQ ID NO: 1311357 - RNA, 19 nt, Mycobacterium tuberculosis H37Rv
ugcuggcgcgccugugcca

SEQ ID NO: 1311358 - RNA, 19 nt, Mycobacterium tuberculosis H37Rv
ugcugcuucaacgcguccg

SEQ ID NO: 1311359 - RNA, 20 nt, Mycobacterium tuberculosis H37Rv
ugcugccgcacacgcgugca

SEQ ID NO: 1311360 - RNA, 18 nt, Mycobacterium tuberculosis H37Rv
ugcugccgauagcgcggc

SEQ ID NO: 1311361 - RNA, 15 nt, Mycobacterium tuberculosis H37Rv
ugcugccgcacacgc

SEQ ID NO: 1311362 - RNA, 21 nt, Mycobacterium tuberculosis H37Rv
ugcugccggagacacccgcca

SEQ ID NO: 1311363 - RNA, 12 nt, Mycobacterium tuberculosis H37Rv
ugcuuacgugau

SEQ ID NO: 1311364 - RNA, 19 nt, Mycobacterium tuberculosis H37Rv
ugcuucaacgcguccgcca

SEQ ID NO: 1311365 - RNA, 14 nt, Mycobacterium tuberculosis H37Rv
ugcuugcagggcca

SEQ ID NO: 1311366 - RNA, 15 nt, Mycobacterium tuberculosis H37Rv
ugcuugcagggccac

SEQ ID NO: 1311367 - RNA, 18 nt, Mycobacterium tuberculosis H37Rv
ugagucgaaaacagcgau

SEQ ID NO: 1311368 - RNA, 13 nt, Mycobacterium tuberculosis H37Rv
ugagcaugcccag

SEQ ID NO: 1311369 - RNA, 16 nt, Mycobacterium tuberculosis H37Rv
ugagcauggcuagggc

SEQ ID NO: 1311370 - RNA, 14 nt, Mycobacterium tuberculosis H37Rv
ugaguccagccggc

SEQ ID NO: 1311371 - RNA, 15 nt, Mycobacterium tuberculosis H37Rv
ugaguucggccacca

SEQ ID NO: 1311372 - RNA, 18 nt, Mycobacterium tuberculosis H37Rv
ugaucaggccccacacga

SEQ ID NO: 1311373 - RNA, 17 nt, Mycobacterium tuberculosis H37Rv
ugaucagugccaggugg

SEQ ID NO: 1311374 - RNA, 13 nt, Mycobacterium tuberculosis H37Rv
ugaucaccaaccc

SEQ ID NO: 1311375 - RNA, 16 nt, Mycobacterium tuberculosis H37Rv
ugaucuuggcccgggc

SEQ ID NO: 1311376 - RNA, 24 nt, Mycobacterium tuberculosis H37Rv
ugaucuucggcgaucgucucggug

SEQ ID NO: 1311377 - RNA, 17 nt, Mycobacterium tuberculosis H37Rv
ugaucguccagcccaga

SEQ ID NO: 1311378 - RNA, 13 nt, Mycobacterium tuberculosis H37Rv
ugaucuggccacg

SEQ ID NO: 1311379 - RNA, 16 nt, Mycobacterium tuberculosis H37Rv
ugaucugugccgcuag

SEQ ID NO: 1311380 - RNA, 22 nt, Mycobacterium tuberculosis H37Rv
ugauugcgaccgcgccaacaga

SEQ ID NO: 1311381 - RNA, 15 nt, Mycobacterium tuberculosis H37Rv
ugauuggggccaggu

SEQ ID NO: 1311382 - RNA, 22 nt, Mycobacterium tuberculosis H37Rv
ugauucugguucagccauucua

SEQ ID NO: 1311383 - RNA, 11 nt, Mycobacterium tuberculosis H37Rv
ugauuccaggu

SEQ ID NO: 1311384 - RNA, 13 nt, Mycobacterium tuberculosis H37Rv
ugauugacugcuu

SEQ ID NO: 1311385 - RNA, 22 nt, Mycobacterium tuberculosis H37Rv
ugauugacugcuugguggucuu

SEQ ID NO: 1311386 - RNA, 16 nt, Mycobacterium tuberculosis H37Rv
ugaugcgccccggagc

SEQ ID NO: 1311387 - RNA, 21 nt, Mycobacterium tuberculosis H37Rv
ugaugccguucggacccaccu

SEQ ID NO: 1311388 - RNA, 18 nt, Mycobacterium tuberculosis H37Rv
ugaugccggcgccggccc

SEQ ID NO: 1311389 - RNA, 16 nt, Mycobacterium tuberculosis H37Rv
ugcaccgaagauggcc

SEQ ID NO: 1311390 - RNA, 13 nt, Mycobacterium tuberculosis H37Rv
ugcacccgggccg

SEQ ID NO: 1311391 - RNA, 15 nt, Mycobacterium tuberculosis H37Rv
ugcacccgccagggc

SEQ ID NO: 1311392 - RNA, 22 nt, Mycobacterium tuberculosis H37Rv
ugcacccagccgugcccaagcu

SEQ ID NO: 1311393 - RNA, 18 nt, Mycobacterium tuberculosis H37Rv
ugcacccggagaaucggu

SEQ ID NO: 1311394 - RNA, 22 nt, Mycobacterium tuberculosis H37Rv
ugcacccaggcaucggugagcc

SEQ ID NO: 1311395 - RNA, 20 nt, Mycobacterium tuberculosis H37Rv
ugcacccacaucaccaaaaa

SEQ ID NO: 1311396 - RNA, 23 nt, Mycobacterium tuberculosis H37Rv
ugcaccagcucggugaucaccau

SEQ ID NO: 1311397 - RNA, 20 nt, Mycobacterium tuberculosis H37Rv
ugcaccagcucacccggagc

SEQ ID NO: 1311398 - RNA, 13 nt, Mycobacterium tuberculosis H37Rv
ugcaccagcucac

SEQ ID NO: 1311399 - RNA, 21 nt, Mycobacterium tuberculosis H37Rv
ugcaauuucagccuuguugcc

SEQ ID NO: 1311400 - RNA, 14 nt, Mycobacterium tuberculosis H37Rv
ugcaauuucagccu

SEQ ID NO: 1311401 - RNA, 20 nt, Mycobacterium tuberculosis H37Rv
ugcacgcgggcguuggccag

SEQ ID NO: 1311402 - RNA, 22 nt, Mycobacterium tuberculosis H37Rv
ugcacgcucugcgccacagcag

SEQ ID NO: 1311403 - RNA, 15 nt, Mycobacterium tuberculosis H37Rv
ugcacgcacagcccg

SEQ ID NO: 1311404 - RNA, 19 nt, Mycobacterium tuberculosis H37Rv
ugcacgcggacaugacagc

SEQ ID NO: 1311405 - RNA, 16 nt, Mycobacterium tuberculosis H37Rv
ugcacgccggcgcugg

SEQ ID NO: 1311406 - RNA, 16 nt, Mycobacterium tuberculosis H37Rv
ugcaccguuguaugcu

SEQ ID NO: 1311407 - RNA, 12 nt, Mycobacterium tuberculosis H37Rv
ugcaccgucguc

SEQ ID NO: 1311408 - RNA, 20 nt, Mycobacterium tuberculosis H37Rv
ugcaccuccgacggccgcgg

SEQ ID NO: 1311409 - RNA, 19 nt, Mycobacterium tuberculosis H37Rv
ugcaccugcgaggugccgg

SEQ ID NO: 1311410 - RNA, 19 nt, Mycobacterium tuberculosis H37Rv
ugcaccucguguccgggga

SEQ ID NO: 1311411 - RNA, 15 nt, Mycobacterium tuberculosis H37Rv
ugcaccuccagguag

SEQ ID NO: 1311412 - RNA, 17 nt, Mycobacterium tuberculosis H37Rv
ugcaccuccgacggccg

SEQ ID NO: 1311413 - RNA, 20 nt, Mycobacterium tuberculosis H37Rv
ugcaccgcauuguugaagaa

SEQ ID NO: 1311414 - RNA, 20 nt, Mycobacterium tuberculosis H37Rv
ugcaccggcuugggccaggc

SEQ ID NO: 1311415 - RNA, 13 nt, Mycobacterium tuberculosis H37Rv
ugcaccgcggcca

SEQ ID NO: 1311416 - RNA, 15 nt, Mycobacterium tuberculosis H37Rv
ugcaacucggcagau

SEQ ID NO: 1311417 - RNA, 21 nt, Mycobacterium tuberculosis H37Rv
ugcaaccgugccgcaucaccc

SEQ ID NO: 1311418 - RNA, 18 nt, Mycobacterium tuberculosis H37Rv
ugcaaccgccggugccga

SEQ ID NO: 1311419 - RNA, 21 nt, Mycobacterium tuberculosis H37Rv
ugcaacccggucggcagcugg

SEQ ID NO: 1311420 - RNA, 19 nt, Mycobacterium tuberculosis H37Rv
ugcaacgauugaacucugg

SEQ ID NO: 1311421 - RNA, 15 nt, Mycobacterium tuberculosis H37Rv
ugcaacgccaaaaug

SEQ ID NO: 1311422 - RNA, 13 nt, Mycobacterium tuberculosis H37Rv
ugcaacgcgccuu

SEQ ID NO: 1311423 - RNA, 12 nt, Mycobacterium tuberculosis H37Rv
ugcaacacaccg

SEQ ID NO: 1311424 - RNA, 15 nt, Mycobacterium tuberculosis H37Rv
ugacguuagcauuga

SEQ ID NO: 1311425 - RNA, 12 nt, Mycobacterium tuberculosis H37Rv
ugacgugguggg

SEQ ID NO: 1311426 - RNA, 20 nt, Mycobacterium tuberculosis H37Rv
ugacgucgucggugcgccac

SEQ ID NO: 1311427 - RNA, 15 nt, Mycobacterium tuberculosis H37Rv
ugacgucgccgggcg

SEQ ID NO: 1311428 - RNA, 14 nt, Mycobacterium tuberculosis H37Rv
ugacguugugccuu

SEQ ID NO: 1311429 - RNA, 15 nt, Mycobacterium tuberculosis H37Rv
ugacguugugccuua

SEQ ID NO: 1311430 - RNA, 20 nt, Mycobacterium tuberculosis H37Rv
ugacguagucgucuucguca

SEQ ID NO: 1311431 - RNA, 12 nt, Mycobacterium tuberculosis H37Rv
ugacguccaaca

SEQ ID NO: 1311432 - RNA, 15 nt, Mycobacterium tuberculosis H37Rv
ugacggugcaggacc

SEQ ID NO: 1311433 - RNA, 20 nt, Mycobacterium tuberculosis H37Rv
ugacgguuugcggagcaaga

SEQ ID NO: 1311434 - RNA, 18 nt, Mycobacterium tuberculosis H37Rv
ugacgguacagcuccaca

SEQ ID NO: 1311435 - RNA, 20 nt, Mycobacterium tuberculosis H37Rv
ugacggugaauucacgaugc

SEQ ID NO: 1311436 - RNA, 13 nt, Mycobacterium tuberculosis H37Rv
ugacgggccgcug

SEQ ID NO: 1311437 - RNA, 18 nt, Mycobacterium tuberculosis H37Rv
ugacucugcguccaccac

SEQ ID NO: 1311438 - RNA, 22 nt, Mycobacterium tuberculosis H37Rv
ugagaccucagccggcggcugg

SEQ ID NO: 1311439 - RNA, 20 nt, Mycobacterium tuberculosis H37Rv
ugagcaaguccugcagcugg

SEQ ID NO: 1311440 - RNA, 19 nt, Mycobacterium tuberculosis H37Rv
ugagcacaccgacagcacc

SEQ ID NO: 1311441 - RNA, 14 nt, Mycobacterium tuberculosis H37Rv
ugagcaaguccugc

SEQ ID NO: 1311442 - RNA, 16 nt, Mycobacterium tuberculosis H37Rv
ugagcaaguccugcag

SEQ ID NO: 1311443 - RNA, 16 nt, Mycobacterium tuberculosis H37Rv
ugagacgccggggaac

SEQ ID NO: 1311444 - RNA, 22 nt, Mycobacterium tuberculosis H37Rv
ugagacugccgccgcuuucgcc

SEQ ID NO: 1311445 - RNA, 16 nt, Mycobacterium tuberculosis H37Rv
ugagacugggcgcugg

SEQ ID NO: 1311446 - RNA, 15 nt, Mycobacterium tuberculosis H37Rv
ugacccucagcaccg

SEQ ID NO: 1311447 - RNA, 21 nt, Mycobacterium tuberculosis H37Rv
ugacccuugugccccgagcug

SEQ ID NO: 1311448 - RNA, 17 nt, Mycobacterium tuberculosis H37Rv
ugaccgaagucugcaga

SEQ ID NO: 1311449 - RNA, 14 nt, Mycobacterium tuberculosis H37Rv
ugaccgaagaagcc

SEQ ID NO: 1311450 - RNA, 23 nt, Mycobacterium tuberculosis H37Rv
ugacccguacccacgacgggccg

SEQ ID NO: 1311451 - RNA, 13 nt, Mycobacterium tuberculosis H37Rv
ugaccgaguugaa

SEQ ID NO: 1311452 - RNA, 18 nt, Mycobacterium tuberculosis H37Rv
ugaccgccaucgccaaca

SEQ ID NO: 1311453 - RNA, 19 nt, Mycobacterium tuberculosis H37Rv
ugaccagcaaccaccccag

SEQ ID NO: 1311454 - RNA, 23 nt, Mycobacterium tuberculosis H37Rv
ugaccagggugacggaguuggcc

SEQ ID NO: 1311455 - RNA, 21 nt, Mycobacterium tuberculosis H37Rv
ugaccaggccgagcucguugc

SEQ ID NO: 1311456 - RNA, 11 nt, Mycobacterium tuberculosis H37Rv
ugaccaggugc

SEQ ID NO: 1311457 - RNA, 15 nt, Mycobacterium tuberculosis H37Rv
ugacccggcagcccg

SEQ ID NO: 1311458 - RNA, 13 nt, Mycobacterium tuberculosis H37Rv
ugacacaacaccg

SEQ ID NO: 1311459 - RNA, 20 nt, Mycobacterium tuberculosis H37Rv
ugacauccuugacgcggcca

SEQ ID NO: 1311460 - RNA, 15 nt, Mycobacterium tuberculosis H37Rv
ugacaucggucagca

SEQ ID NO: 1311461 - RNA, 20 nt, Mycobacterium tuberculosis H37Rv
ugacaucgucgccagggccg

SEQ ID NO: 1311462 - RNA, 14 nt, Mycobacterium tuberculosis H37Rv
ugacgaacaagaaa

SEQ ID NO: 1311463 - RNA, 14 nt, Mycobacterium tuberculosis H37Rv
ugacgaaucgccua

SEQ ID NO: 1311464 - RNA, 22 nt, Mycobacterium tuberculosis H37Rv
ugacgacaaacggcgacccagc

SEQ ID NO: 1311465 - RNA, 15 nt, Mycobacterium tuberculosis H37Rv
ugacgaaagcgccca

SEQ ID NO: 1311466 - RNA, 18 nt, Mycobacterium tuberculosis H37Rv
ugaccuuggccgugcccg

SEQ ID NO: 1311467 - RNA, 18 nt, Mycobacterium tuberculosis H37Rv
ugaccgcggucugcgcgu

SEQ ID NO: 1311468 - RNA, 19 nt, Mycobacterium tuberculosis H37Rv
ugaccgcggucuucuucac

SEQ ID NO: 1311469 - RNA, 21 nt, Mycobacterium tuberculosis H37Rv
ugaccgcggugacucggccuc

SEQ ID NO: 1311470 - RNA, 21 nt, Mycobacterium tuberculosis H37Rv
ugaccgcguagagcagcagau

SEQ ID NO: 1311471 - RNA, 17 nt, Mycobacterium tuberculosis H37Rv
ugaccuguuuggggcug

SEQ ID NO: 1311472 - RNA, 13 nt, Mycobacterium tuberculosis H37Rv
ugaccuguuuggg

SEQ ID NO: 1311473 - RNA, 17 nt, Mycobacterium tuberculosis H37Rv
ugaccugggcgccccag

SEQ ID NO: 1311474 - RNA, 16 nt, Mycobacterium tuberculosis H37Rv
ugacgcagucgcccac

SEQ ID NO: 1311475 - RNA, 14 nt, Mycobacterium tuberculosis H37Rv
ugacgccgagcugg

SEQ ID NO: 1311476 - RNA, 17 nt, Mycobacterium tuberculosis H37Rv
ugacgacgagggcggga

SEQ ID NO: 1311477 - RNA, 17 nt, Mycobacterium tuberculosis H37Rv
ugacgacgagggccagc

SEQ ID NO: 1311478 - RNA, 17 nt, Mycobacterium tuberculosis H37Rv
ugacgacgucgccgccg

SEQ ID NO: 1311479 - RNA, 24 nt, Mycobacterium tuberculosis H37Rv
ugacgcgcaacgccgccagccugg

SEQ ID NO: 1311480 - RNA, 18 nt, Mycobacterium tuberculosis H37Rv
ugacgcgcgccggauaca

SEQ ID NO: 1311481 - RNA, 23 nt, Mycobacterium tuberculosis H37Rv
ugacggcgucgaccucgcgggcg

SEQ ID NO: 1311482 - RNA, 15 nt, Mycobacterium tuberculosis H37Rv
ugacgcggccgggcg

SEQ ID NO: 1311483 - RNA, 14 nt, Mycobacterium tuberculosis H37Rv
ugaacggcaccagc

SEQ ID NO: 1311484 - RNA, 14 nt, Mycobacterium tuberculosis H37Rv
ugaacgcugcccaa

SEQ ID NO: 1311485 - RNA, 16 nt, Mycobacterium tuberculosis H37Rv
ugaacgcccgcuucag

SEQ ID NO: 1311486 - RNA, 14 nt, Mycobacterium tuberculosis H37Rv
ugaacuccaugaag

SEQ ID NO: 1311487 - RNA, 11 nt, Mycobacterium tuberculosis H37Rv
ugaagaagccg

SEQ ID NO: 1311488 - RNA, 15 nt, Mycobacterium tuberculosis H37Rv
ugaagacaccaggcc

SEQ ID NO: 1311489 - RNA, 16 nt, Mycobacterium tuberculosis H37Rv
ugaagacaccggcguc

SEQ ID NO: 1311490 - RNA, 13 nt, Mycobacterium tuberculosis H37Rv
ugaagagaagucu

SEQ ID NO: 1311491 - RNA, 18 nt, Mycobacterium tuberculosis H37Rv
ugaaggcaaacaccagcc

SEQ ID NO: 1311492 - RNA, 22 nt, Mycobacterium tuberculosis H37Rv
ugaagggccgccucgcggauga

SEQ ID NO: 1311493 - RNA, 15 nt, Mycobacterium tuberculosis H37Rv
ugaagguguccgcug

SEQ ID NO: 1311494 - RNA, 15 nt, Mycobacterium tuberculosis H37Rv
ugaagccgcgcugcg

SEQ ID NO: 1311495 - RNA, 13 nt, Mycobacterium tuberculosis H37Rv
ugaagcaguuggc

SEQ ID NO: 1311496 - RNA, 19 nt, Mycobacterium tuberculosis H37Rv
ugaagccagcgcagcaccg

SEQ ID NO: 1311497 - RNA, 20 nt, Mycobacterium tuberculosis H37Rv
ugaagcacacuguucccaca

SEQ ID NO: 1311498 - RNA, 16 nt, Mycobacterium tuberculosis H37Rv
ugaagauaagguauuc

SEQ ID NO: 1311499 - RNA, 13 nt, Mycobacterium tuberculosis H37Rv
ugaaguggcacaa

SEQ ID NO: 1311500 - RNA, 21 nt, Mycobacterium tuberculosis H37Rv
ugaaguggcgucagugcagaa

SEQ ID NO: 1311501 - RNA, 19 nt, Mycobacterium tuberculosis H37Rv
ugaagucggugccgagcgc

SEQ ID NO: 1311502 - RNA, 15 nt, Mycobacterium tuberculosis H37Rv
ugaagucuaaguguu

SEQ ID NO: 1311503 - RNA, 15 nt, Mycobacterium tuberculosis H37Rv
ugaaguuggcguggu

SEQ ID NO: 1311504 - RNA, 20 nt, Mycobacterium tuberculosis H37Rv
ugaaugcuugcgcagcaccg

SEQ ID NO: 1311505 - RNA, 15 nt, Mycobacterium tuberculosis H37Rv
ugaauguugccgccg

SEQ ID NO: 1311506 - RNA, 16 nt, Mycobacterium tuberculosis H37Rv
ugaaugugcauagcaa

SEQ ID NO: 1311507 - RNA, 17 nt, Mycobacterium tuberculosis H37Rv
ugaauuucgaugaggug

SEQ ID NO: 1311508 - RNA, 13 nt, Mycobacterium tuberculosis H37Rv
uccuucaccagcu

SEQ ID NO: 1311509 - RNA, 14 nt, Mycobacterium tuberculosis H37Rv
uccuuccuggguug

SEQ ID NO: 1311510 - RNA, 17 nt, Mycobacterium tuberculosis H37Rv
uccuugcgguccaggcc

SEQ ID NO: 1311511 - RNA, 19 nt, Mycobacterium tuberculosis H37Rv
uccuugaggucacccauca

SEQ ID NO: 1311512 - RNA, 21 nt, Mycobacterium tuberculosis H37Rv
uccuucuccagauccacgccg

SEQ ID NO: 1311513 - RNA, 18 nt, Mycobacterium tuberculosis H37Rv
uccuucgcguuggcccgc

SEQ ID NO: 1311514 - RNA, 13 nt, Mycobacterium tuberculosis H37Rv
uccugcagcuggc

SEQ ID NO: 1311515 - RNA, 16 nt, Mycobacterium tuberculosis H37Rv
ucagcgaugcggcccu

SEQ ID NO: 1311516 - RNA, 16 nt, Mycobacterium tuberculosis H37Rv
ucagcgaguggucccg

SEQ ID NO: 1311517 - RNA, 18 nt, Mycobacterium tuberculosis H37Rv
ucagcgaguagccgcuag

SEQ ID NO: 1311518 - RNA, 22 nt, Mycobacterium tuberculosis H37Rv
ucagcgaccucacugcggcgcc

SEQ ID NO: 1311519 - RNA, 18 nt, Mycobacterium tuberculosis H37Rv
ucagcgacuugcggugcu

SEQ ID NO: 1311520 - RNA, 17 nt, Mycobacterium tuberculosis H37Rv
uccugcggcaccgcuga

SEQ ID NO: 1311521 - RNA, 20 nt, Mycobacterium tuberculosis H37Rv
uccuggaugaaguguuuggc

SEQ ID NO: 1311522 - RNA, 20 nt, Mycobacterium tuberculosis H37Rv
uccuggaaaggacggccggc

SEQ ID NO: 1311523 - RNA, 17 nt, Mycobacterium tuberculosis H37Rv
uccuggccacucccagc

SEQ ID NO: 1311524 - RNA, 13 nt, Mycobacterium tuberculosis H37Rv
ucgaaguaauagc

SEQ ID NO: 1311525 - RNA, 14 nt, Mycobacterium tuberculosis H37Rv
ucgaacgcugagga

SEQ ID NO: 1311526 - RNA, 15 nt, Mycobacterium tuberculosis H37Rv
ucgaacgcugaggaa

SEQ ID NO: 1311527 - RNA, 20 nt, Mycobacterium tuberculosis H37Rv
ucgaacgcagccagcgccau

SEQ ID NO: 1311528 - RNA, 16 nt, Mycobacterium tuberculosis H37Rv
ucgaacuucagcggcg

SEQ ID NO: 1311529 - RNA, 19 nt, Mycobacterium tuberculosis H37Rv
ucgaacaccguccaauugg

SEQ ID NO: 1311530 - RNA, 15 nt, Mycobacterium tuberculosis H37Rv
ucgaacagcaccgcc

SEQ ID NO: 1311531 - RNA, 16 nt, Mycobacterium tuberculosis H37Rv
ucgaacagcaccgccg

SEQ ID NO: 1311532 - RNA, 13 nt, Mycobacterium tuberculosis H37Rv
ucgaacaccgucc

SEQ ID NO: 1311533 - RNA, 17 nt, Mycobacterium tuberculosis H37Rv
ucgaacaucaucggguc

SEQ ID NO: 1311534 - RNA, 15 nt, Mycobacterium tuberculosis H37Rv
ucgaacaggccggcc

SEQ ID NO: 1311535 - RNA, 14 nt, Mycobacterium tuberculosis H37Rv
ucgaccgccgcgag

SEQ ID NO: 1311536 - RNA, 20 nt, Mycobacterium tuberculosis H37Rv
ucgacccggccaagggugcu

SEQ ID NO: 1311537 - RNA, 21 nt, Mycobacterium tuberculosis H37Rv
ucgacccgcccauucccauau

SEQ ID NO: 1311538 - RNA, 17 nt, Mycobacterium tuberculosis H37Rv
ucgacccccugccacag

SEQ ID NO: 1311539 - RNA, 13 nt, Mycobacterium tuberculosis H37Rv
ucgaccgcggccc

SEQ ID NO: 1311540 - RNA, 22 nt, Mycobacterium tuberculosis H37Rv
ucgaccgcggccggguggcccg

SEQ ID NO: 1311541 - RNA, 22 nt, Mycobacterium tuberculosis H37Rv
ucgaccgcgccauagcagagcc

SEQ ID NO: 1311542 - RNA, 18 nt, Mycobacterium tuberculosis H37Rv
ucgaccgcggccuuggcg

SEQ ID NO: 1311543 - RNA, 19 nt, Mycobacterium tuberculosis H37Rv
ucgaccggacaaagcugcu

SEQ ID NO: 1311544 - RNA, 22 nt, Mycobacterium tuberculosis H37Rv
ucgaccucagacagcugcacac

SEQ ID NO: 1311545 - RNA, 20 nt, Mycobacterium tuberculosis H37Rv
ucgaccguccgggucaccag

SEQ ID NO: 1311546 - RNA, 18 nt, Mycobacterium tuberculosis H37Rv
ucgaccgugucaccgccg

SEQ ID NO: 1311547 - RNA, 15 nt, Mycobacterium tuberculosis H37Rv
ucgacaaccgcugcc

SEQ ID NO: 1311548 - RNA, 14 nt, Mycobacterium tuberculosis H37Rv
ucgacacgccgaac

SEQ ID NO: 1311549 - RNA, 18 nt, Mycobacterium tuberculosis H37Rv
ucgacaccgagccacgac

SEQ ID NO: 1311550 - RNA, 12 nt, Mycobacterium tuberculosis H37Rv
ucgacaccgccc

SEQ ID NO: 1311551 - RNA, 20 nt, Mycobacterium tuberculosis H37Rv
ucgacaccgaggaccucguc

SEQ ID NO: 1311552 - RNA, 18 nt, Mycobacterium tuberculosis H37Rv
ucgaaaaggugcaccauu

SEQ ID NO: 1311553 - RNA, 13 nt, Mycobacterium tuberculosis H37Rv
uccuugucggccc

SEQ ID NO: 1311554 - RNA, 22 nt, Mycobacterium tuberculosis H37Rv
uccuugucggccccggccgcgu

SEQ ID NO: 1311555 - RNA, 17 nt, Mycobacterium tuberculosis H37Rv
uccuugggcgucaagca

SEQ ID NO: 1311556 - RNA, 16 nt, Mycobacterium tuberculosis H37Rv
ucgaggccacgccagc

SEQ ID NO: 1311557 - RNA, 16 nt, Mycobacterium tuberculosis H37Rv
ucgaggccagcagcug

SEQ ID NO: 1311558 - RNA, 23 nt, Mycobacterium tuberculosis H37Rv
ucgaggcaggccucggcgccgcc

SEQ ID NO: 1311559 - RNA, 19 nt, Mycobacterium tuberculosis H37Rv
ucgaggaaggugugcgucu

SEQ ID NO: 1311560 - RNA, 14 nt, Mycobacterium tuberculosis H37Rv
ucgaggaccaccac

SEQ ID NO: 1311561 - RNA, 21 nt, Mycobacterium tuberculosis H37Rv
ucgagguacaacgggcacgcu

SEQ ID NO: 1311562 - RNA, 22 nt, Mycobacterium tuberculosis H37Rv
ucgaggguuuccauggcgugcc

SEQ ID NO: 1311563 - RNA, 15 nt, Mycobacterium tuberculosis H37Rv
ucgagggugaccccc

SEQ ID NO: 1311564 - RNA, 16 nt, Mycobacterium tuberculosis H37Rv
ucgagggggacgcuga

SEQ ID NO: 1311565 - RNA, 20 nt, Mycobacterium tuberculosis H37Rv
ucgagggcagccgcccaccc

SEQ ID NO: 1311566 - RNA, 18 nt, Mycobacterium tuberculosis H37Rv
ucgaggcugaccguggcg

SEQ ID NO: 1311567 - RNA, 21 nt, Mycobacterium tuberculosis H37Rv
ucgaggcgaaagauggccuca

SEQ ID NO: 1311568 - RNA, 19 nt, Mycobacterium tuberculosis H37Rv
ucgagcucguccucgucuu

SEQ ID NO: 1311569 - RNA, 14 nt, Mycobacterium tuberculosis H37Rv
ucgacgcggcaggc

SEQ ID NO: 1311570 - RNA, 15 nt, Mycobacterium tuberculosis H37Rv
ucgacgcauuccucg

SEQ ID NO: 1311571 - RNA, 20 nt, Mycobacterium tuberculosis H37Rv
ucgacgccccaggacaccuu

SEQ ID NO: 1311572 - RNA, 18 nt, Mycobacterium tuberculosis H37Rv
ucgacgccgccacccggc

SEQ ID NO: 1311573 - RNA, 16 nt, Mycobacterium tuberculosis H37Rv
ucgacgccgcgcagcc

SEQ ID NO: 1311574 - RNA, 22 nt, Mycobacterium tuberculosis H37Rv
ucgaguccugguaccccagcac

SEQ ID NO: 1311575 - RNA, 17 nt, Mycobacterium tuberculosis H37Rv
ucgaguccaccaccugg

SEQ ID NO: 1311576 - RNA, 19 nt, Mycobacterium tuberculosis H37Rv
ucgaguagucgcuggccag

SEQ ID NO: 1311577 - RNA, 18 nt, Mycobacterium tuberculosis H37Rv
ucgaguaacaccccgaca

SEQ ID NO: 1311578 - RNA, 17 nt, Mycobacterium tuberculosis H37Rv
ucgagguccuugaggau

SEQ ID NO: 1311579 - RNA, 22 nt, Mycobacterium tuberculosis H37Rv
ucgagguguagcccuccgagca

SEQ ID NO: 1311580 - RNA, 18 nt, Mycobacterium tuberculosis H37Rv
ucgaguucgcagucgaug

SEQ ID NO: 1311581 - RNA, 19 nt, Mycobacterium tuberculosis H37Rv
ucgaguugcucgacacugg

SEQ ID NO: 1311582 - RNA, 14 nt, Mycobacterium tuberculosis H37Rv
ucgaguuuggccag

SEQ ID NO: 1311583 - RNA, 11 nt, Mycobacterium tuberculosis H37Rv
ucgauaucagu

SEQ ID NO: 1311584 - RNA, 18 nt, Mycobacterium tuberculosis H37Rv
ucgaucagaaucugccuc

SEQ ID NO: 1311585 - RNA, 19 nt, Mycobacterium tuberculosis H37Rv
ucgaucagaaucugccucu

SEQ ID NO: 1311586 - RNA, 12 nt, Mycobacterium tuberculosis H37Rv
ucgaucaccgac

SEQ ID NO: 1311587 - RNA, 13 nt, Mycobacterium tuberculosis H37Rv
ucgaucaccugca

SEQ ID NO: 1311588 - RNA, 22 nt, Mycobacterium tuberculosis H37Rv
ucgcaacccggccuggagcagc

SEQ ID NO: 1311589 - RNA, 23 nt, Mycobacterium tuberculosis H37Rv
ucgcaacgauuuuagcggcugcc

SEQ ID NO: 1311590 - RNA, 14 nt, Mycobacterium tuberculosis H37Rv
ucgaucuccaggcc

SEQ ID NO: 1311591 - RNA, 18 nt, Mycobacterium tuberculosis H37Rv
ucgaucugcacgagugcg

SEQ ID NO: 1311592 - RNA, 19 nt, Mycobacterium tuberculosis H37Rv
ucgaugaccccgguggucu

SEQ ID NO: 1311593 - RNA, 14 nt, Mycobacterium tuberculosis H37Rv
ucgauugucgccgc

SEQ ID NO: 1311594 - RNA, 15 nt, Mycobacterium tuberculosis H37Rv
ucgauuguggccagc

SEQ ID NO: 1311595 - RNA, 14 nt, Mycobacterium tuberculosis H37Rv
ucgcacccugcgaa

SEQ ID NO: 1311596 - RNA, 13 nt, Mycobacterium tuberculosis H37Rv
ucgcacagcgcga

SEQ ID NO: 1311597 - RNA, 21 nt, Mycobacterium tuberculosis H37Rv
ucgcaccaccacgugaucaga

SEQ ID NO: 1311598 - RNA, 20 nt, Mycobacterium tuberculosis H37Rv
ucgcaauggucguagggugg

SEQ ID NO: 1311599 - RNA, 19 nt, Mycobacterium tuberculosis H37Rv
ucgcaaucguuggccaugc

SEQ ID NO: 1311600 - RNA, 15 nt, Mycobacterium tuberculosis H37Rv
ucgcaaucagcuggu

SEQ ID NO: 1311601 - RNA, 21 nt, Mycobacterium tuberculosis H37Rv
ucgcagacggcugccacgcgu

SEQ ID NO: 1311602 - RNA, 14 nt, Mycobacterium tuberculosis H37Rv
ucgcacgagccaac

SEQ ID NO: 1311603 - RNA, 15 nt, Mycobacterium tuberculosis H37Rv
ucgcacggaugaugc

SEQ ID NO: 1311604 - RNA, 16 nt, Mycobacterium tuberculosis H37Rv
ucgcaccgugggcccu

SEQ ID NO: 1311605 - RNA, 18 nt, Mycobacterium tuberculosis H37Rv
ucgcacggugccgccguc

SEQ ID NO: 1311606 - RNA, 20 nt, Mycobacterium tuberculosis H37Rv
ucgccccugcacagcaggcu

SEQ ID NO: 1311607 - RNA, 14 nt, Mycobacterium tuberculosis H37Rv
ucgcccgcacacag

SEQ ID NO: 1311608 - RNA, 20 nt, Mycobacterium tuberculosis H37Rv
ucgcccgaguugaagaagcc

SEQ ID NO: 1311609 - RNA, 17 nt, Mycobacterium tuberculosis H37Rv
ucgcccgccgccaccag

SEQ ID NO: 1311610 - RNA, 19 nt, Mycobacterium tuberculosis H37Rv
ucgcccgccgccaccagcu

SEQ ID NO: 1311611 - RNA, 15 nt, Mycobacterium tuberculosis H37Rv
ucgcccugacaccca

SEQ ID NO: 1311612 - RNA, 19 nt, Mycobacterium tuberculosis H37Rv
ucgcccugacccggagccg

SEQ ID NO: 1311613 - RNA, 15 nt, Mycobacterium tuberculosis H37Rv
ucgcccauuggccag

SEQ ID NO: 1311614 - RNA, 17 nt, Mycobacterium tuberculosis H37Rv
ucgcccauuggccaggu

SEQ ID NO: 1311615 - RNA, 21 nt, Mycobacterium tuberculosis H37Rv
ucgcccccuggauggcgcccu

SEQ ID NO: 1311616 - RNA, 23 nt, Mycobacterium tuberculosis H37Rv
ucgcccaggccaagguggccacc

SEQ ID NO: 1311617 - RNA, 11 nt, Mycobacterium tuberculosis H37Rv
ucgcccaggcg

SEQ ID NO: 1311618 - RNA, 13 nt, Mycobacterium tuberculosis H37Rv
ucgcccaggcgcg

SEQ ID NO: 1311619 - RNA, 18 nt, Mycobacterium tuberculosis H37Rv
ucgccaaugcccaggugu

SEQ ID NO: 1311620 - RNA, 20 nt, Mycobacterium tuberculosis H37Rv
ucgccaaggccgucgaccca

SEQ ID NO: 1311621 - RNA, 19 nt, Mycobacterium tuberculosis H37Rv
ucgccacaacgcgcgguac

SEQ ID NO: 1311622 - RNA, 20 nt, Mycobacterium tuberculosis H37Rv
ucgccaacgacucacccacc

SEQ ID NO: 1311623 - RNA, 18 nt, Mycobacterium tuberculosis H37Rv
ucgccaacgccagcacca

SEQ ID NO: 1311624 - RNA, 17 nt, Mycobacterium tuberculosis H37Rv
ucgccaaauaccgugag

SEQ ID NO: 1311625 - RNA, 18 nt, Mycobacterium tuberculosis H37Rv
ucgcauagugcggcugca

SEQ ID NO: 1311626 - RNA, 21 nt, Mycobacterium tuberculosis H37Rv
ucgcagggaucaccccggccg

SEQ ID NO: 1311627 - RNA, 14 nt, Mycobacterium tuberculosis H37Rv
ucgccgcgcggaac

SEQ ID NO: 1311628 - RNA, 20 nt, Mycobacterium tuberculosis H37Rv
ucgccgauguuggcagggcc

SEQ ID NO: 1311629 - RNA, 22 nt, Mycobacterium tuberculosis H37Rv
ucgccgaugauguuuuccccgc

SEQ ID NO: 1311630 - RNA, 16 nt, Mycobacterium tuberculosis H37Rv
ucgccgcacagcggcc

SEQ ID NO: 1311631 - RNA, 19 nt, Mycobacterium tuberculosis H37Rv
ucgccggacugcggcccga

SEQ ID NO: 1311632 - RNA, 19 nt, Mycobacterium tuberculosis H37Rv
ucgccggaauacaccagcg

SEQ ID NO: 1311633 - RNA, 23 nt, Mycobacterium tuberculosis H37Rv
ucgccgcguccucgcccuggccg

SEQ ID NO: 1311634 - RNA, 20 nt, Mycobacterium tuberculosis H37Rv
ucgccgcggcggcagcggcg

SEQ ID NO: 1311635 - RNA, 16 nt, Mycobacterium tuberculosis H37Rv
ucgccgaagcgccgcu

SEQ ID NO: 1311636 - RNA, 15 nt, Mycobacterium tuberculosis H37Rv
ucgcccuugccgcag

SEQ ID NO: 1311637 - RNA, 21 nt, Mycobacterium tuberculosis H37Rv
ucgccgaguaccggccagccg

SEQ ID NO: 1311638 - RNA, 21 nt, Mycobacterium tuberculosis H37Rv
ucgccgaggccucggccagcg

SEQ ID NO: 1311639 - RNA, 20 nt, Mycobacterium tuberculosis H37Rv
ucgccgacagcgccuuguug

SEQ ID NO: 1311640 - RNA, 17 nt, Mycobacterium tuberculosis H37Rv
ucgccgaaucgcugacc

SEQ ID NO: 1311641 - RNA, 17 nt, Mycobacterium tuberculosis H37Rv
ucgccgaagccggaccg

SEQ ID NO: 1311642 - RNA, 14 nt, Mycobacterium tuberculosis H37Rv
ucgccgacgcgaag

SEQ ID NO: 1311643 - RNA, 15 nt, Mycobacterium tuberculosis H37Rv
ucgccgacagcgccu

SEQ ID NO: 1311644 - RNA, 17 nt, Mycobacterium tuberculosis H37Rv
ucgccgaccgucacuga

SEQ ID NO: 1311645 - RNA, 15 nt, Mycobacterium tuberculosis H37Rv
ucgccgucgcggcac

SEQ ID NO: 1311646 - RNA, 15 nt, Mycobacterium tuberculosis H37Rv
ucgccugcacgcccg

SEQ ID NO: 1311647 - RNA, 16 nt, Mycobacterium tuberculosis H37Rv
ucgccguaagcaccag

SEQ ID NO: 1311648 - RNA, 18 nt, Mycobacterium tuberculosis H37Rv
ucgccggaucuugccgcu

SEQ ID NO: 1311649 - RNA, 16 nt, Mycobacterium tuberculosis H37Rv
ucgccggaccagagcc

SEQ ID NO: 1311650 - RNA, 22 nt, Mycobacterium tuberculosis H37Rv
ucgcgcaccggaucgccgucgc

SEQ ID NO: 1311651 - RNA, 14 nt, Mycobacterium tuberculosis H37Rv
ucgcgcacccagcc

SEQ ID NO: 1311652 - RNA, 12 nt, Mycobacterium tuberculosis H37Rv
ucgccuggaaga

SEQ ID NO: 1311653 - RNA, 14 nt, Mycobacterium tuberculosis H37Rv
ucggccgcaaggcg

SEQ ID NO: 1311654 - RNA, 15 nt, Mycobacterium tuberculosis H37Rv
ucggccgcaaggcgc

SEQ ID NO: 1311655 - RNA, 15 nt, Mycobacterium tuberculosis H37Rv
ucggccgcaccagca

SEQ ID NO: 1311656 - RNA, 20 nt, Mycobacterium tuberculosis H37Rv
ucggccgcgagacgcauguc

SEQ ID NO: 1311657 - RNA, 20 nt, Mycobacterium tuberculosis H37Rv
ucggccgccggguccggaac

SEQ ID NO: 1311658 - RNA, 11 nt, Mycobacterium tuberculosis H37Rv
ucggccgccag

SEQ ID NO: 1311659 - RNA, 20 nt, Mycobacterium tuberculosis H37Rv
ucggccgacaccgccaccac

SEQ ID NO: 1311660 - RNA, 17 nt, Mycobacterium tuberculosis H37Rv
ucggccgacaccgccac

SEQ ID NO: 1311661 - RNA, 20 nt, Mycobacterium tuberculosis H37Rv
ucggccggagccgccggccc

SEQ ID NO: 1311662 - RNA, 20 nt, Mycobacterium tuberculosis H37Rv
ucggccggguuaucggcagc

SEQ ID NO: 1311663 - RNA, 21 nt, Mycobacterium tuberculosis H37Rv
ucggccgugaauucgccgaac

SEQ ID NO: 1311664 - RNA, 16 nt, Mycobacterium tuberculosis H37Rv
ucggccggggccaccc

SEQ ID NO: 1311665 - RNA, 21 nt, Mycobacterium tuberculosis H37Rv
ucggcgaacggauucccgccc

SEQ ID NO: 1311666 - RNA, 18 nt, Mycobacterium tuberculosis H37Rv
ucggccuggcaggguggg

SEQ ID NO: 1311667 - RNA, 18 nt, Mycobacterium tuberculosis H37Rv
ucggccugcugcugcagc

SEQ ID NO: 1311668 - RNA, 19 nt, Mycobacterium tuberculosis H37Rv
ucggccuguucggcggcug

SEQ ID NO: 1311669 - RNA, 16 nt, Mycobacterium tuberculosis H37Rv
ucggccugccggcagc

SEQ ID NO: 1311670 - RNA, 16 nt, Mycobacterium tuberculosis H37Rv
ucggccugcgccggcg

SEQ ID NO: 1311671 - RNA, 19 nt, Mycobacterium tuberculosis H37Rv
ucggcgaccugccggaccg

SEQ ID NO: 1311672 - RNA, 24 nt, Mycobacterium tuberculosis H37Rv
ucggcgaccgccugcgcggcugcc

SEQ ID NO: 1311673 - RNA, 14 nt, Mycobacterium tuberculosis H37Rv
ucggcgaccggccg

SEQ ID NO: 1311674 - RNA, 13 nt, Mycobacterium tuberculosis H37Rv
ucggcgacgccgu

SEQ ID NO: 1311675 - RNA, 22 nt, Mycobacterium tuberculosis H37Rv
ucggcgaacgccguggugcgca

SEQ ID NO: 1311676 - RNA, 16 nt, Mycobacterium tuberculosis H37Rv
ucggcgaacggcacca

SEQ ID NO: 1311677 - RNA, 15 nt, Mycobacterium tuberculosis H37Rv
ucggcgaccaccagc

SEQ ID NO: 1311678 - RNA, 16 nt, Mycobacterium tuberculosis H37Rv
ucggcgaccaccagcg

SEQ ID NO: 1311679 - RNA, 16 nt, Mycobacterium tuberculosis H37Rv
ucggcgaccagcugug

SEQ ID NO: 1311680 - RNA, 20 nt, Mycobacterium tuberculosis H37Rv
ucggcgaauccgccgccuag

SEQ ID NO: 1311681 - RNA, 13 nt, Mycobacterium tuberculosis H37Rv
ucggccaggauga

SEQ ID NO: 1311682 - RNA, 17 nt, Mycobacterium tuberculosis H37Rv
ucggccagcagcagugc

SEQ ID NO: 1311683 - RNA, 21 nt, Mycobacterium tuberculosis H37Rv
ucggcccccaagcucugcguc

SEQ ID NO: 1311684 - RNA, 15 nt, Mycobacterium tuberculosis H37Rv
ucggcccagcgcgcc

SEQ ID NO: 1311685 - RNA, 20 nt, Mycobacterium tuberculosis H37Rv
ucggccaucguccagcagga

SEQ ID NO: 1311686 - RNA, 21 nt, Mycobacterium tuberculosis H37Rv
ucggccaucagaaccuccucg

SEQ ID NO: 1311687 - RNA, 13 nt, Mycobacterium tuberculosis H37Rv
ucggccacccggu

SEQ ID NO: 1311688 - RNA, 15 nt, Mycobacterium tuberculosis H37Rv
ucggccaccggcguc

SEQ ID NO: 1311689 - RNA, 19 nt, Mycobacterium tuberculosis H37Rv
ucggccaccggcgucugcc

SEQ ID NO: 1311690 - RNA, 14 nt, Mycobacterium tuberculosis H37Rv
ucggccaccaucgc

SEQ ID NO: 1311691 - RNA, 12 nt, Mycobacterium tuberculosis H37Rv
ucggccaccauc

SEQ ID NO: 1311692 - RNA, 15 nt, Mycobacterium tuberculosis H37Rv
ucggccaccagcgcc

SEQ ID NO: 1311693 - RNA, 20 nt, Mycobacterium tuberculosis H37Rv
ucggaugucucggcaccaca

SEQ ID NO: 1311694 - RNA, 22 nt, Mycobacterium tuberculosis H37Rv
ucgcuguaggccagcccggcgu

SEQ ID NO: 1311695 - RNA, 18 nt, Mycobacterium tuberculosis H37Rv
ucgcuggguggcgggccg

SEQ ID NO: 1311696 - RNA, 20 nt, Mycobacterium tuberculosis H37Rv
ucgcuguaggccagcccggc

SEQ ID NO: 1311697 - RNA, 17 nt, Mycobacterium tuberculosis H37Rv
ucgcugugcgcuggucg

SEQ ID NO: 1311698 - RNA, 19 nt, Mycobacterium tuberculosis H37Rv
ucgcugcggcgcuggccag

SEQ ID NO: 1311699 - RNA, 19 nt, Mycobacterium tuberculosis H37Rv
ucgcugcggugggccaggu

SEQ ID NO: 1311700 - RNA, 21 nt, Mycobacterium tuberculosis H37Rv
ucgcugcgaagccgagcauca

SEQ ID NO: 1311701 - RNA, 13 nt, Mycobacterium tuberculosis H37Rv
ucggauagccccg

SEQ ID NO: 1311702 - RNA, 19 nt, Mycobacterium tuberculosis H37Rv
ucggagcgggcuccggcuc

SEQ ID NO: 1311703 - RNA, 21 nt, Mycobacterium tuberculosis H37Rv
ucggaggcccgccacaacggc

SEQ ID NO: 1311704 - RNA, 13 nt, Mycobacterium tuberculosis H37Rv
ucggaggcgacca

SEQ ID NO: 1311705 - RNA, 21 nt, Mycobacterium tuberculosis H37Rv
ucggcggccgagcgcaccgcu

SEQ ID NO: 1311706 - RNA, 19 nt, Mycobacterium tuberculosis H37Rv
ucggcggccgagcgcaccg

SEQ ID NO: 1311707 - RNA, 19 nt, Mycobacterium tuberculosis H37Rv
ucggcggcguccagcagcg

SEQ ID NO: 1311708 - RNA, 18 nt, Mycobacterium tuberculosis H37Rv
ucggcggcgucuucgucg

SEQ ID NO: 1311709 - RNA, 16 nt, Mycobacterium tuberculosis H37Rv
ucggcggcggcgccuu

SEQ ID NO: 1311710 - RNA, 17 nt, Mycobacterium tuberculosis H37Rv
ucggcgcgccgcacacg

SEQ ID NO: 1311711 - RNA, 17 nt, Mycobacterium tuberculosis H37Rv
ucggcgcgcggguuguc

SEQ ID NO: 1311712 - RNA, 16 nt, Mycobacterium tuberculosis H37Rv
ucggcgcuagcugcug

SEQ ID NO: 1311713 - RNA, 16 nt, Mycobacterium tuberculosis H37Rv
ucggcgcugcgcaccg

SEQ ID NO: 1311714 - RNA, 18 nt, Mycobacterium tuberculosis H37Rv
ucggcgcugcgcaccgcc

SEQ ID NO: 1311715 - RNA, 21 nt, Mycobacterium tuberculosis H37Rv
ucggcgaucaacgcgcacgcg

SEQ ID NO: 1311716 - RNA, 20 nt, Mycobacterium tuberculosis H37Rv
ucggcgagccgugcuaccca

SEQ ID NO: 1311717 - RNA, 14 nt, Mycobacterium tuberculosis H37Rv
ucggcgagcgcggc

SEQ ID NO: 1311718 - RNA, 15 nt, Mycobacterium tuberculosis H37Rv
ucggcgaggacggcg

SEQ ID NO: 1311719 - RNA, 22 nt, Mycobacterium tuberculosis H37Rv
ucggcgaggacggcggccagga

SEQ ID NO: 1311720 - RNA, 16 nt, Mycobacterium tuberculosis H37Rv
ucggcgaugcgcacca

SEQ ID NO: 1311721 - RNA, 19 nt, Mycobacterium tuberculosis H37Rv
ucggcgaugcgcaccagca

SEQ ID NO: 1311722 - RNA, 12 nt, Mycobacterium tuberculosis H37Rv
ucggcgcaggcg

SEQ ID NO: 1311723 - RNA, 12 nt, Mycobacterium tuberculosis H37Rv
ucggcgccagau

SEQ ID NO: 1311724 - RNA, 13 nt, Mycobacterium tuberculosis H37Rv
ucggcgcgcaccu

SEQ ID NO: 1311725 - RNA, 21 nt, Mycobacterium tuberculosis H37Rv
ucggcgcgcaccucggcgaag

SEQ ID NO: 1311726 - RNA, 20 nt, Mycobacterium tuberculosis H37Rv
ucggcgccucggaccagacc

SEQ ID NO: 1311727 - RNA, 12 nt, Mycobacterium tuberculosis H37Rv
ucggcgccgaag

SEQ ID NO: 1311728 - RNA, 19 nt, Mycobacterium tuberculosis H37Rv
ucggcguagcgagcgggug

SEQ ID NO: 1311729 - RNA, 19 nt, Mycobacterium tuberculosis H37Rv
ucggcguccuugcgcagca

SEQ ID NO: 1311730 - RNA, 20 nt, Mycobacterium tuberculosis H37Rv
ucggcgucgugguggccacg

SEQ ID NO: 1311731 - RNA, 20 nt, Mycobacterium tuberculosis H37Rv
ucggcgggagcugccgggag

SEQ ID NO: 1311732 - RNA, 22 nt, Mycobacterium tuberculosis H37Rv
ucggcggcuucgauugcgcugc

SEQ ID NO: 1311733 - RNA, 17 nt, Mycobacterium tuberculosis H37Rv
ucggcgggucaggccag

SEQ ID NO: 1311734 - RNA, 22 nt, Mycobacterium tuberculosis H37Rv
ucggcggugucgaccucauguu

SEQ ID NO: 1311735 - RNA, 21 nt, Mycobacterium tuberculosis H37Rv
ucggcggugccgcggcuaggc

SEQ ID NO: 1311736 - RNA, 13 nt, Mycobacterium tuberculosis H37Rv
ucggcggugcaga

SEQ ID NO: 1311737 - RNA, 23 nt, Mycobacterium tuberculosis H37Rv
ucggcggugaaaucgcacagcgc

SEQ ID NO: 1311738 - RNA, 12 nt, Mycobacterium tuberculosis H37Rv
ucggcuggcccg

SEQ ID NO: 1311739 - RNA, 18 nt, Mycobacterium tuberculosis H37Rv
ucggcugccgcggcugcc

SEQ ID NO: 1311740 - RNA, 14 nt, Mycobacterium tuberculosis H37Rv
ucggcuggacggcg

SEQ ID NO: 1311741 - RNA, 20 nt, Mycobacterium tuberculosis H37Rv
ucggcguggucgcgcggcac

SEQ ID NO: 1311742 - RNA, 18 nt, Mycobacterium tuberculosis H37Rv
ucggcguguccgccgaac

SEQ ID NO: 1311743 - RNA, 23 nt, Mycobacterium tuberculosis H37Rv
ucggcuagcaacgggucgauguc

SEQ ID NO: 1311744 - RNA, 12 nt, Mycobacterium tuberculosis H37Rv
ucggcucagcaa

SEQ ID NO: 1311745 - RNA, 11 nt, Mycobacterium tuberculosis H37Rv
ucgggagauga

SEQ ID NO: 1311746 - RNA, 22 nt, Mycobacterium tuberculosis H37Rv
ucgggaccggggacgcgcccca

SEQ ID NO: 1311747 - RNA, 15 nt, Mycobacterium tuberculosis H37Rv
ucgggacgaaaaaau

SEQ ID NO: 1311748 - RNA, 19 nt, Mycobacterium tuberculosis H37Rv
ucgggagucuucggcgaca

SEQ ID NO: 1311749 - RNA, 17 nt, Mycobacterium tuberculosis H37Rv
ucgggaucggccggcgg

SEQ ID NO: 1311750 - RNA, 14 nt, Mycobacterium tuberculosis H37Rv
ucggcuuggcugug

SEQ ID NO: 1311751 - RNA, 15 nt, Mycobacterium tuberculosis H37Rv
ucgggaugcaaggaa

SEQ ID NO: 1311752 - RNA, 17 nt, Mycobacterium tuberculosis H37Rv
ucgggaucugggcucgg

SEQ ID NO: 1311753 - RNA, 20 nt, Mycobacterium tuberculosis H37Rv
ucgggcaccccgaccaccag

SEQ ID NO: 1311754 - RNA, 16 nt, Mycobacterium tuberculosis H37Rv
ucgggauggacaccac

SEQ ID NO: 1311755 - RNA, 17 nt, Mycobacterium tuberculosis H37Rv
ucgggcaacggcagccc

SEQ ID NO: 1311756 - RNA, 18 nt, Mycobacterium tuberculosis H37Rv
ucgggcccagcagcgcaa

SEQ ID NO: 1311757 - RNA, 17 nt, Mycobacterium tuberculosis H37Rv
ucgggcccuccggcgca

SEQ ID NO: 1311758 - RNA, 15 nt, Mycobacterium tuberculosis H37Rv
ucgggcauggucgcc

SEQ ID NO: 1311759 - RNA, 14 nt, Mycobacterium tuberculosis H37Rv
ucgggcagcgcggc

SEQ ID NO: 1311760 - RNA, 15 nt, Mycobacterium tuberculosis H37Rv
ucgggcagcgcggcc

SEQ ID NO: 1311761 - RNA, 11 nt, Mycobacterium tuberculosis H37Rv
ucgggcaccug

SEQ ID NO: 1311762 - RNA, 12 nt, Mycobacterium tuberculosis H37Rv
ucgggugcagcc

SEQ ID NO: 1311763 - RNA, 16 nt, Mycobacterium tuberculosis H37Rv
ucggguguggucacca

SEQ ID NO: 1311764 - RNA, 21 nt, Mycobacterium tuberculosis H37Rv
ucgggugagcacccagcggcg

SEQ ID NO: 1311765 - RNA, 13 nt, Mycobacterium tuberculosis H37Rv
ucgggucagcacc

SEQ ID NO: 1311766 - RNA, 15 nt, Mycobacterium tuberculosis H37Rv
ucggggugcacaccg

SEQ ID NO: 1311767 - RNA, 21 nt, Mycobacterium tuberculosis H37Rv
ucggggggccggacugaagcc

SEQ ID NO: 1311768 - RNA, 22 nt, Mycobacterium tuberculosis H37Rv
ucggggucgaacaugauccgcc

SEQ ID NO: 1311769 - RNA, 13 nt, Mycobacterium tuberculosis H37Rv
ucgggguugcgga

SEQ ID NO: 1311770 - RNA, 19 nt, Mycobacterium tuberculosis H37Rv
ucgggcuugacccuugggc

SEQ ID NO: 1311771 - RNA, 19 nt, Mycobacterium tuberculosis H37Rv
ucgggcuugcgcagcagcg

SEQ ID NO: 1311772 - RNA, 17 nt, Mycobacterium tuberculosis H37Rv
ucgggcugccaggagca

SEQ ID NO: 1311773 - RNA, 17 nt, Mycobacterium tuberculosis H37Rv
ucgggcugccgcaugcg

SEQ ID NO: 1311774 - RNA, 16 nt, Mycobacterium tuberculosis H37Rv
ucgggcucguccagca

SEQ ID NO: 1311775 - RNA, 17 nt, Mycobacterium tuberculosis H37Rv
ucgggcucggggaguuc

SEQ ID NO: 1311776 - RNA, 16 nt, Mycobacterium tuberculosis H37Rv
ucggggagcugcggcg

SEQ ID NO: 1311777 - RNA, 21 nt, Mycobacterium tuberculosis H37Rv
ucggggaguucgcgcagcacc

SEQ ID NO: 1311778 - RNA, 19 nt, Mycobacterium tuberculosis H37Rv
ucggggccgcaggccaggg

SEQ ID NO: 1311779 - RNA, 13 nt, Mycobacterium tuberculosis H37Rv
ucgggcgacugga

SEQ ID NO: 1311780 - RNA, 15 nt, Mycobacterium tuberculosis H37Rv
ucgggcgacuggacc

SEQ ID NO: 1311781 - RNA, 19 nt, Mycobacterium tuberculosis H37Rv
ucgggccguccucccacag

SEQ ID NO: 1311782 - RNA, 17 nt, Mycobacterium tuberculosis H37Rv
ucgggcgcgguaaccac

SEQ ID NO: 1311783 - RNA, 19 nt, Mycobacterium tuberculosis H37Rv
ucgggcgcggggcggccug

SEQ ID NO: 1311784 - RNA, 16 nt, Mycobacterium tuberculosis H37Rv
ucgggcgugaucccgc

SEQ ID NO: 1311785 - RNA, 20 nt, Mycobacterium tuberculosis H37Rv
ucgguggcaucggcggccug

SEQ ID NO: 1311786 - RNA, 22 nt, Mycobacterium tuberculosis H37Rv
ucggugggcuugccgcgcacca

SEQ ID NO: 1311787 - RNA, 22 nt, Mycobacterium tuberculosis H37Rv
ucggugguacgugcgagcccac

SEQ ID NO: 1311788 - RNA, 15 nt, Mycobacterium tuberculosis H37Rv
ucggugcgcgcggcg

SEQ ID NO: 1311789 - RNA, 23 nt, Mycobacterium tuberculosis H37Rv
ucggugccggggcugccgccguu

SEQ ID NO: 1311790 - RNA, 22 nt, Mycobacterium tuberculosis H37Rv
ucggugccggggcugccgccgu

SEQ ID NO: 1311791 - RNA, 14 nt, Mycobacterium tuberculosis H37Rv
ucggugcagcagcg

SEQ ID NO: 1311792 - RNA, 20 nt, Mycobacterium tuberculosis H37Rv
ucggugacggucaaaugaau

SEQ ID NO: 1311793 - RNA, 15 nt, Mycobacterium tuberculosis H37Rv
ucggugagccgugcc

SEQ ID NO: 1311794 - RNA, 16 nt, Mycobacterium tuberculosis H37Rv
ucggugacgaagagca

SEQ ID NO: 1311795 - RNA, 22 nt, Mycobacterium tuberculosis H37Rv
ucggugacgaagagcaccgcgc

SEQ ID NO: 1311796 - RNA, 19 nt, Mycobacterium tuberculosis H37Rv
ucggugaacccgccggcaa

SEQ ID NO: 1311797 - RNA, 14 nt, Mycobacterium tuberculosis H37Rv
ucggugucggccgc

SEQ ID NO: 1311798 - RNA, 22 nt, Mycobacterium tuberculosis H37Rv
ucgguguagagagccauguccu

SEQ ID NO: 1311799 - RNA, 16 nt, Mycobacterium tuberculosis H37Rv
ucggucgccaccgccg

SEQ ID NO: 1311800 - RNA, 21 nt, Mycobacterium tuberculosis H37Rv
ucggucuuggcgauccaggcc

SEQ ID NO: 1311801 - RNA, 15 nt, Mycobacterium tuberculosis H37Rv
ucggucguccggauc

SEQ ID NO: 1311802 - RNA, 15 nt, Mycobacterium tuberculosis H37Rv
ucggucgucucgggc

SEQ ID NO: 1311803 - RNA, 19 nt, Mycobacterium tuberculosis H37Rv
ucggucagccaccugacaa

SEQ ID NO: 1311804 - RNA, 19 nt, Mycobacterium tuberculosis H37Rv
ucggucacgacggcacgcc

SEQ ID NO: 1311805 - RNA, 19 nt, Mycobacterium tuberculosis H37Rv
ucggucagcgccgacucca

SEQ ID NO: 1311806 - RNA, 15 nt, Mycobacterium tuberculosis H37Rv
ucggucagcugugcg

SEQ ID NO: 1311807 - RNA, 17 nt, Mycobacterium tuberculosis H37Rv
ucgguacgguggguggu

SEQ ID NO: 1311808 - RNA, 18 nt, Mycobacterium tuberculosis H37Rv
ucgguaccgacggcacca

SEQ ID NO: 1311809 - RNA, 19 nt, Mycobacterium tuberculosis H37Rv
ucgguacgaauugggcucu

SEQ ID NO: 1311810 - RNA, 19 nt, Mycobacterium tuberculosis H37Rv
ucgguaccccagcgcuguc

SEQ ID NO: 1311811 - RNA, 20 nt, Mycobacterium tuberculosis H37Rv
ucguaaucggcaaugagcua

SEQ ID NO: 1311812 - RNA, 22 nt, Mycobacterium tuberculosis H37Rv
ucguaccuaaggcucaccaggc

SEQ ID NO: 1311813 - RNA, 22 nt, Mycobacterium tuberculosis H37Rv
ucguacucccaggccgccgcca

SEQ ID NO: 1311814 - RNA, 21 nt, Mycobacterium tuberculosis H37Rv
ucguauucgaugccguaggcg

SEQ ID NO: 1311815 - RNA, 15 nt, Mycobacterium tuberculosis H37Rv
ucguauugauccagg

SEQ ID NO: 1311816 - RNA, 21 nt, Mycobacterium tuberculosis H37Rv
ucguccagcgaucccggugag

SEQ ID NO: 1311817 - RNA, 17 nt, Mycobacterium tuberculosis H37Rv
ucguccacgaccccggc

SEQ ID NO: 1311818 - RNA, 16 nt, Mycobacterium tuberculosis H37Rv
ucgucggcaacgcugg

SEQ ID NO: 1311819 - RNA, 13 nt, Mycobacterium tuberculosis H37Rv
ucgucgccgaccg

SEQ ID NO: 1311820 - RNA, 22 nt, Mycobacterium tuberculosis H37Rv
ucgucgcccaggcgugucgucg

SEQ ID NO: 1311821 - RNA, 20 nt, Mycobacterium tuberculosis H37Rv
ucgucgccccguucacgcuc

SEQ ID NO: 1311822 - RNA, 13 nt, Mycobacterium tuberculosis H37Rv
ucguccgcugacc

SEQ ID NO: 1311823 - RNA, 16 nt, Mycobacterium tuberculosis H37Rv
ucguccggugcgaucc

SEQ ID NO: 1311824 - RNA, 11 nt, Mycobacterium tuberculosis H37Rv
ucguccccaga

SEQ ID NO: 1311825 - RNA, 21 nt, Mycobacterium tuberculosis H37Rv
ucgucccgcggcgcggagagc

SEQ ID NO: 1311826 - RNA, 20 nt, Mycobacterium tuberculosis H37Rv
ucgucccggcgaccgggucc

SEQ ID NO: 1311827 - RNA, 15 nt, Mycobacterium tuberculosis H37Rv
ucgucgguugccacg

SEQ ID NO: 1311828 - RNA, 17 nt, Mycobacterium tuberculosis H37Rv
ucgucgugucgccgccg

SEQ ID NO: 1311829 - RNA, 20 nt, Mycobacterium tuberculosis H37Rv
ucgucguguuggccgggucg

SEQ ID NO: 1311830 - RNA, 14 nt, Mycobacterium tuberculosis H37Rv
ucgucgugucgccg

SEQ ID NO: 1311831 - RNA, 20 nt, Mycobacterium tuberculosis H37Rv
ucgucgucggcguagucgcu

SEQ ID NO: 1311832 - RNA, 18 nt, Mycobacterium tuberculosis H37Rv
ucgucguaguccaggccg

SEQ ID NO: 1311833 - RNA, 17 nt, Mycobacterium tuberculosis H37Rv
ucgucguacaugggcag

SEQ ID NO: 1311834 - RNA, 16 nt, Mycobacterium tuberculosis H37Rv
ucgucgguuccgggcg

SEQ ID NO: 1311835 - RNA, 21 nt, Mycobacterium tuberculosis H37Rv
ucgucggucaaaccggugccg

SEQ ID NO: 1311836 - RNA, 17 nt, Mycobacterium tuberculosis H37Rv
ucgucgggacgccgccc

SEQ ID NO: 1311837 - RNA, 22 nt, Mycobacterium tuberculosis H37Rv
ucgucggcggcgaacagcccca

SEQ ID NO: 1311838 - RNA, 18 nt, Mycobacterium tuberculosis H37Rv
ucgucggcgggcugcagu

SEQ ID NO: 1311839 - RNA, 20 nt, Mycobacterium tuberculosis H37Rv
ucgucggcgcggcugucgug

SEQ ID NO: 1311840 - RNA, 23 nt, Mycobacterium tuberculosis H37Rv
ucguugucagcgaacggccagga

SEQ ID NO: 1311841 - RNA, 16 nt, Mycobacterium tuberculosis H37Rv
ucguuguccagcgucu

SEQ ID NO: 1311842 - RNA, 15 nt, Mycobacterium tuberculosis H37Rv
ucguuggcucgugcc

SEQ ID NO: 1311843 - RNA, 18 nt, Mycobacterium tuberculosis H37Rv
ucguucagcgccagcgcc

SEQ ID NO: 1311844 - RNA, 12 nt, Mycobacterium tuberculosis H37Rv
ucguucaauguc

SEQ ID NO: 1311845 - RNA, 18 nt, Mycobacterium tuberculosis H37Rv
ucguucgcgucacaccag

SEQ ID NO: 1311846 - RNA, 21 nt, Mycobacterium tuberculosis H37Rv
ucgugacguuguaggagaacg

SEQ ID NO: 1311847 - RNA, 23 nt, Mycobacterium tuberculosis H37Rv
ucgugacguuguaggagaacguc

SEQ ID NO: 1311848 - RNA, 14 nt, Mycobacterium tuberculosis H37Rv
ucgugagacugggc

SEQ ID NO: 1311849 - RNA, 23 nt, Mycobacterium tuberculosis H37Rv
ucgugagacugggcgcuggaggc

SEQ ID NO: 1311850 - RNA, 14 nt, Mycobacterium tuberculosis H37Rv
ucgugaucagcagg

SEQ ID NO: 1311851 - RNA, 19 nt, Mycobacterium tuberculosis H37Rv
ucgugagcuuuaucugcau

SEQ ID NO: 1311852 - RNA, 13 nt, Mycobacterium tuberculosis H37Rv
ucguuaccaggcg

SEQ ID NO: 1311853 - RNA, 11 nt, Mycobacterium tuberculosis H37Rv
ucugaagcccg

SEQ ID NO: 1311854 - RNA, 17 nt, Mycobacterium tuberculosis H37Rv
ucugaagucuaaguguu

SEQ ID NO: 1311855 - RNA, 18 nt, Mycobacterium tuberculosis H37Rv
ucucugagcgggcgggcc

SEQ ID NO: 1311856 - RNA, 18 nt, Mycobacterium tuberculosis H37Rv
ucucguuggugccuucac

SEQ ID NO: 1311857 - RNA, 17 nt, Mycobacterium tuberculosis H37Rv
ucucguggaucugccuc

SEQ ID NO: 1311858 - RNA, 22 nt, Mycobacterium tuberculosis H37Rv
ucucgucgucgauuagcccacc

SEQ ID NO: 1311859 - RNA, 17 nt, Mycobacterium tuberculosis H37Rv
ucucgucgucgcggccg

SEQ ID NO: 1311860 - RNA, 18 nt, Mycobacterium tuberculosis H37Rv
ucucggugguccagcgcu

SEQ ID NO: 1311861 - RNA, 14 nt, Mycobacterium tuberculosis H37Rv
ucucgguggugagu

SEQ ID NO: 1311862 - RNA, 14 nt, Mycobacterium tuberculosis H37Rv
ucucgucaaccugc

SEQ ID NO: 1311863 - RNA, 19 nt, Mycobacterium tuberculosis H37Rv
ucucgaccguauugaccag

SEQ ID NO: 1311864 - RNA, 14 nt, Mycobacterium tuberculosis H37Rv
ucucgaguccaggc

SEQ ID NO: 1311865 - RNA, 15 nt, Mycobacterium tuberculosis H37Rv
ucucgaguccaggca

SEQ ID NO: 1311866 - RNA, 15 nt, Mycobacterium tuberculosis H37Rv
ucuccugcccuccgu

SEQ ID NO: 1311867 - RNA, 22 nt, Mycobacterium tuberculosis H37Rv
ucuccuggaaaggacggccggc

SEQ ID NO: 1311868 - RNA, 15 nt, Mycobacterium tuberculosis H37Rv
ucucgacaaagcggc

SEQ ID NO: 1311869 - RNA, 21 nt, Mycobacterium tuberculosis H37Rv
ucucggaaacggaccuccucg

SEQ ID NO: 1311870 - RNA, 18 nt, Mycobacterium tuberculosis H37Rv
ucucgcuguugaagccgc

SEQ ID NO: 1311871 - RNA, 16 nt, Mycobacterium tuberculosis H37Rv
ucucgcagcaacggcg

SEQ ID NO: 1311872 - RNA, 12 nt, Mycobacterium tuberculosis H37Rv
ucucggccggcg

SEQ ID NO: 1311873 - RNA, 16 nt, Mycobacterium tuberculosis H37Rv
ucucggcgagcaccac

SEQ ID NO: 1311874 - RNA, 23 nt, Mycobacterium tuberculosis H37Rv
ucucggaccacaucuggucacgg

SEQ ID NO: 1311875 - RNA, 15 nt, Mycobacterium tuberculosis H37Rv
ucucggucagcccca

SEQ ID NO: 1311876 - RNA, 22 nt, Mycobacterium tuberculosis H37Rv
ucucgguaccaccggcacggug

SEQ ID NO: 1311877 - RNA, 16 nt, Mycobacterium tuberculosis H37Rv
ucucggcguugccgcc

SEQ ID NO: 1311878 - RNA, 19 nt, Mycobacterium tuberculosis H37Rv
ucucggcguugccgccguu

SEQ ID NO: 1311879 - RNA, 11 nt, Mycobacterium tuberculosis H37Rv
ucucccuugcc

SEQ ID NO: 1311880 - RNA, 14 nt, Mycobacterium tuberculosis H37Rv
ucucccuugccgcc

SEQ ID NO: 1311881 - RNA, 16 nt, Mycobacterium tuberculosis H37Rv
ucucccggccgcaccc

SEQ ID NO: 1311882 - RNA, 18 nt, Mycobacterium tuberculosis H37Rv
ucucccggcugaugccug

SEQ ID NO: 1311883 - RNA, 23 nt, Mycobacterium tuberculosis H37Rv
ucucccguuuggcugucugcccg

SEQ ID NO: 1311884 - RNA, 17 nt, Mycobacterium tuberculosis H37Rv
ucuccucuugcaccagg

SEQ ID NO: 1311885 - RNA, 14 nt, Mycobacterium tuberculosis H37Rv
ucuccucgugcagc

SEQ ID NO: 1311886 - RNA, 10 nt, Mycobacterium tuberculosis H37Rv
ucuccuccug

SEQ ID NO: 1311887 - RNA, 14 nt, Mycobacterium tuberculosis H37Rv
ucuccagauguccg

SEQ ID NO: 1311888 - RNA, 17 nt, Mycobacterium tuberculosis H37Rv
ucuccagcaccaaaagg

SEQ ID NO: 1311889 - RNA, 18 nt, Mycobacterium tuberculosis H37Rv
ucucaugcaucugcuucu

SEQ ID NO: 1311890 - RNA, 16 nt, Mycobacterium tuberculosis H37Rv
ucugucauugcugccc

SEQ ID NO: 1311891 - RNA, 18 nt, Mycobacterium tuberculosis H37Rv
ucugugugacggaggucg

SEQ ID NO: 1311892 - RNA, 17 nt, Mycobacterium tuberculosis H37Rv
ucugugucccgucgaug

SEQ ID NO: 1311893 - RNA, 15 nt, Mycobacterium tuberculosis H37Rv
ucuguaaccuccucg

SEQ ID NO: 1311894 - RNA, 19 nt, Mycobacterium tuberculosis H37Rv
ucuggcuccggccagggga

SEQ ID NO: 1311895 - RNA, 14 nt, Mycobacterium tuberculosis H37Rv
ucuggcucgcgaac

SEQ ID NO: 1311896 - RNA, 16 nt, Mycobacterium tuberculosis H37Rv
ucuggaaccccgagcu

SEQ ID NO: 1311897 - RNA, 20 nt, Mycobacterium tuberculosis H37Rv
ucugguguuucaggcagcgg

SEQ ID NO: 1311898 - RNA, 18 nt, Mycobacterium tuberculosis H37Rv
ucuggcuggaccacucgc

SEQ ID NO: 1311899 - RNA, 16 nt, Mycobacterium tuberculosis H37Rv
ucugcaccggcaggcg

SEQ ID NO: 1311900 - RNA, 22 nt, Mycobacterium tuberculosis H37Rv
ucugcacguugauccgcgcaac

SEQ ID NO: 1311901 - RNA, 13 nt, Mycobacterium tuberculosis H37Rv
ucugcagcacgcg

SEQ ID NO: 1311902 - RNA, 21 nt, Mycobacterium tuberculosis H37Rv
ucugcagcacgcgugguucgg

SEQ ID NO: 1311903 - RNA, 14 nt, Mycobacterium tuberculosis H37Rv
ucugcgcgcggaag

SEQ ID NO: 1311904 - RNA, 20 nt, Mycobacterium tuberculosis H37Rv
ucugcgcggugcccgcgaac

SEQ ID NO: 1311905 - RNA, 19 nt, Mycobacterium tuberculosis H37Rv
ucugcgccuucgccagcgg

SEQ ID NO: 1311906 - RNA, 21 nt, Mycobacterium tuberculosis H37Rv
ucugcgccuucgccagcggcg

SEQ ID NO: 1311907 - RNA, 13 nt, Mycobacterium tuberculosis H37Rv
ucugcggccacgc

SEQ ID NO: 1311908 - RNA, 21 nt, Mycobacterium tuberculosis H37Rv
ucugcggccgcgugccgcccg

SEQ ID NO: 1311909 - RNA, 18 nt, Mycobacterium tuberculosis H37Rv
ucugcggggugagugacc

SEQ ID NO: 1311910 - RNA, 12 nt, Mycobacterium tuberculosis H37Rv
ucugcgggccgg

SEQ ID NO: 1311911 - RNA, 17 nt, Mycobacterium tuberculosis H37Rv
ucugcgucugcucggcg

SEQ ID NO: 1311912 - RNA, 21 nt, Mycobacterium tuberculosis H37Rv
ucuggaaccccgagcugccaa

SEQ ID NO: 1311913 - RNA, 23 nt, Mycobacterium tuberculosis H37Rv
ucugcugggcacgauggcucuca

SEQ ID NO: 1311914 - RNA, 23 nt, Mycobacterium tuberculosis H37Rv
ucugcuggccgaaccgguagucg

SEQ ID NO: 1311915 - RNA, 15 nt, Mycobacterium tuberculosis H37Rv
ucugcucgccagcgg

SEQ ID NO: 1311916 - RNA, 18 nt, Mycobacterium tuberculosis H37Rv
ucugcucgccgggcagcu

SEQ ID NO: 1311917 - RNA, 13 nt, Mycobacterium tuberculosis H37Rv
ucugcucgccagc

SEQ ID NO: 1311918 - RNA, 17 nt, Mycobacterium tuberculosis H37Rv
ucugcucgccagccggc

SEQ ID NO: 1311919 - RNA, 13 nt, Mycobacterium tuberculosis H37Rv
ucugcuccaggcg

SEQ ID NO: 1311920 - RNA, 23 nt, Mycobacterium tuberculosis H37Rv
ucuucaacgucgagauccucguc

SEQ ID NO: 1311921 - RNA, 22 nt, Mycobacterium tuberculosis H37Rv
ucuucaacgucgagauccucgu

SEQ ID NO: 1311922 - RNA, 15 nt, Mycobacterium tuberculosis H37Rv
ucuuggguuucgucg

SEQ ID NO: 1311923 - RNA, 23 nt, Mycobacterium tuberculosis H37Rv
ucuugggccgggaugaagccacc

SEQ ID NO: 1311924 - RNA, 19 nt, Mycobacterium tuberculosis H37Rv
ucuuggcgcccgccggcaa

SEQ ID NO: 1311925 - RNA, 20 nt, Mycobacterium tuberculosis H37Rv
ucuuggcgcgguccuccaga

SEQ ID NO: 1311926 - RNA, 23 nt, Mycobacterium tuberculosis H37Rv
ucuuggcgggagccuugguagcc

SEQ ID NO: 1311927 - RNA, 19 nt, Mycobacterium tuberculosis H37Rv
ucuuggcgaggauguaguu

SEQ ID NO: 1311928 - RNA, 13 nt, Mycobacterium tuberculosis H37Rv
ucuuggccagcag

SEQ ID NO: 1311929 - RNA, 19 nt, Mycobacterium tuberculosis H37Rv
ucuuguugugcugcaccgu

SEQ ID NO: 1311930 - RNA, 15 nt, Mycobacterium tuberculosis H37Rv
ucuuccagccaggcc

SEQ ID NO: 1311931 - RNA, 16 nt, Mycobacterium tuberculosis H37Rv
ucuuggacagcagcag

SEQ ID NO: 1311932 - RNA, 23 nt, Mycobacterium tuberculosis H37Rv
ucuuucgaaaugaggucuuugcu

SEQ ID NO: 1311933 - RNA, 17 nt, Mycobacterium tuberculosis H37Rv
ucuuucccgccaccaaa

SEQ ID NO: 1311934 - RNA, 12 nt, Mycobacterium tuberculosis H37Rv
ucuuugagugcc

SEQ ID NO: 1311935 - RNA, 22 nt, Mycobacterium tuberculosis H37Rv
ucuuugcucucggucugcaugc

SEQ ID NO: 1311936 - RNA, 16 nt, Mycobacterium tuberculosis H37Rv
ucuuugccggcgccuu

SEQ ID NO: 1311937 - RNA, 16 nt, Mycobacterium tuberculosis H37Rv
ugaaacguccuugaac

SEQ ID NO: 1311938 - RNA, 15 nt, Mycobacterium tuberculosis H37Rv
ugaaaguucaugcca

SEQ ID NO: 1311939 - RNA, 14 nt, Mycobacterium tuberculosis H37Rv
ugaaaaagcaucaa

SEQ ID NO: 1311940 - RNA, 21 nt, Mycobacterium tuberculosis H37Rv
ugaaaauaggccgggcagugc

SEQ ID NO: 1311941 - RNA, 15 nt, Mycobacterium tuberculosis H37Rv
ugaaccgggacacca

SEQ ID NO: 1311942 - RNA, 15 nt, Mycobacterium tuberculosis H37Rv
ugaaccagaugggug

SEQ ID NO: 1311943 - RNA, 23 nt, Mycobacterium tuberculosis H37Rv
ugaacgcacccgaauuugucggc

SEQ ID NO: 1311944 - RNA, 13 nt, Mycobacterium tuberculosis H37Rv
ugaacgcaccaac

SEQ ID NO: 1311945 - RNA, 14 nt, Mycobacterium tuberculosis H37Rv
ugaacgcaccaacg

SEQ ID NO: 1311946 - RNA, 16 nt, Mycobacterium tuberculosis H37Rv
ugaacgagaugccgcg

SEQ ID NO: 1311947 - RNA, 15 nt, Mycobacterium tuberculosis H37Rv
ugaacgagaugccgc

SEQ ID NO: 1311948 - RNA, 16 nt, Mycobacterium tuberculosis H37Rv
ugaacaccggcgccuc

SEQ ID NO: 1311949 - RNA, 17 nt, Mycobacterium tuberculosis H37Rv
ugaacaguugcacaccg

SEQ ID NO: 1311950 - RNA, 19 nt, Mycobacterium tuberculosis H37Rv
ugaacauacgaaacaugcg

SEQ ID NO: 1311951 - RNA, 16 nt, Mycobacterium tuberculosis H37Rv
ugaaaucgaugaccgc

SEQ ID NO: 1311952 - RNA, 18 nt, Mycobacterium tuberculosis H37Rv
ugaaaucuguugauacac

SEQ ID NO: 1311953 - RNA, 18 nt, Mycobacterium tuberculosis H37Rv
gggacacgucgcgccagg

SEQ ID NO: 1311954 - RNA, 21 nt, Mycobacterium tuberculosis H37Rv
gggacagauggcggccgaggu

SEQ ID NO: 1311955 - RNA, 20 nt, Mycobacterium tuberculosis H37Rv
gggacagauggcggccgagg

SEQ ID NO: 1311956 - RNA, 17 nt, Mycobacterium tuberculosis H37Rv
gggacaccaucuccgcc

SEQ ID NO: 1311957 - RNA, 15 nt, Mycobacterium tuberculosis H37Rv
gggacaccaaaagga

SEQ ID NO: 1311958 - RNA, 12 nt, Mycobacterium tuberculosis H37Rv
gggacaccaucu

SEQ ID NO: 1311959 - RNA, 21 nt, Mycobacterium tuberculosis H37Rv
gggaccgggcguuucccugcc

SEQ ID NO: 1311960 - RNA, 21 nt, Mycobacterium tuberculosis H37Rv
gggaccgcgaacccgugggcg

SEQ ID NO: 1311961 - RNA, 17 nt, Mycobacterium tuberculosis H37Rv
gggaccccgccagccgg

SEQ ID NO: 1311962 - RNA, 16 nt, Mycobacterium tuberculosis H37Rv
gggacagauggcggcc

SEQ ID NO: 1311963 - RNA, 16 nt, Mycobacterium tuberculosis H37Rv
gggacugugggggcgc

SEQ ID NO: 1311964 - RNA, 13 nt, Mycobacterium tuberculosis H37Rv
gggacgggcggcc

SEQ ID NO: 1311965 - RNA, 18 nt, Mycobacterium tuberculosis H37Rv
gggacggucgcucggcau

SEQ ID NO: 1311966 - RNA, 21 nt, Mycobacterium tuberculosis H37Rv
gggacgccuugaucggcgagg

SEQ ID NO: 1311967 - RNA, 17 nt, Mycobacterium tuberculosis H37Rv
gggacccgagcagugga

SEQ ID NO: 1311968 - RNA, 24 nt, Mycobacterium tuberculosis H37Rv
gggacgacgccaccugacgugcgg

SEQ ID NO: 1311969 - RNA, 23 nt, Mycobacterium tuberculosis H37Rv
gggaccgugacguaucgccgcgg

SEQ ID NO: 1311970 - RNA, 16 nt, Mycobacterium tuberculosis H37Rv
ggcuuugccgcuguga

SEQ ID NO: 1311971 - RNA, 19 nt, Mycobacterium tuberculosis H37Rv
ggcuuuugcgcccagcacg

SEQ ID NO: 1311972 - RNA, 18 nt, Mycobacterium tuberculosis H37Rv
ggcuuuuacgucugcucg

SEQ ID NO: 1311973 - RNA, 17 nt, Mycobacterium tuberculosis H37Rv
ggcuuuggacaggucaa

SEQ ID NO: 1311974 - RNA, 21 nt, Mycobacterium tuberculosis H37Rv
gggaagccguuuucgaaacug

SEQ ID NO: 1311975 - RNA, 22 nt, Mycobacterium tuberculosis H37Rv
gggaagcccggcagaugcagcg

SEQ ID NO: 1311976 - RNA, 16 nt, Mycobacterium tuberculosis H37Rv
gggaagcccggcagau

SEQ ID NO: 1311977 - RNA, 23 nt, Mycobacterium tuberculosis H37Rv
gggaaggaaccgggcaaaucaag

SEQ ID NO: 1311978 - RNA, 18 nt, Mycobacterium tuberculosis H37Rv
ggccgcacgccgaccagc

SEQ ID NO: 1311979 - RNA, 21 nt, Mycobacterium tuberculosis H37Rv
ggccgcacuuucuuccucggg

SEQ ID NO: 1311980 - RNA, 15 nt, Mycobacterium tuberculosis H37Rv
ggccgcacugggugc

SEQ ID NO: 1311981 - RNA, 20 nt, Mycobacterium tuberculosis H37Rv
ggccgcacuuucuuccucgg

SEQ ID NO: 1311982 - RNA, 19 nt, Mycobacterium tuberculosis H37Rv
ggccgcacgccggccagcg

SEQ ID NO: 1311983 - RNA, 13 nt, Mycobacterium tuberculosis H37Rv
ggccgccagcgca

SEQ ID NO: 1311984 - RNA, 22 nt, Mycobacterium tuberculosis H37Rv
ggccgccauccccuggccagca

SEQ ID NO: 1311985 - RNA, 21 nt, Mycobacterium tuberculosis H37Rv
ggccgccauccccuggccagc

SEQ ID NO: 1311986 - RNA, 13 nt, Mycobacterium tuberculosis H37Rv
ggccgcagggccu

SEQ ID NO: 1311987 - RNA, 13 nt, Mycobacterium tuberculosis H37Rv
ggccgccaucccc

SEQ ID NO: 1311988 - RNA, 15 nt, Mycobacterium tuberculosis H37Rv
ggccgccaggcggcc

SEQ ID NO: 1311989 - RNA, 18 nt, Mycobacterium tuberculosis H37Rv
ggccgccaggcggccggg

SEQ ID NO: 1311990 - RNA, 15 nt, Mycobacterium tuberculosis H37Rv
ggccgccccaggcug

SEQ ID NO: 1311991 - RNA, 21 nt, Mycobacterium tuberculosis H37Rv
ggcugucacaagccugccggc

SEQ ID NO: 1311992 - RNA, 14 nt, Mycobacterium tuberculosis H37Rv
ggcugucacaagcc

SEQ ID NO: 1311993 - RNA, 18 nt, Mycobacterium tuberculosis H37Rv
ggcugucacaagccugcc

SEQ ID NO: 1311994 - RNA, 14 nt, Mycobacterium tuberculosis H37Rv
ggcuguccaccgag

SEQ ID NO: 1311995 - RNA, 17 nt, Mycobacterium tuberculosis H37Rv
ggcugugaacagcgcgu

SEQ ID NO: 1311996 - RNA, 23 nt, Mycobacterium tuberculosis H37Rv
ggcugucgugccucucgggggcc

SEQ ID NO: 1311997 - RNA, 19 nt, Mycobacterium tuberculosis H37Rv
ggcugucgugccucucggg

SEQ ID NO: 1311998 - RNA, 22 nt, Mycobacterium tuberculosis H37Rv
ggcugugauguuguucagcagg

SEQ ID NO: 1311999 - RNA, 14 nt, Mycobacterium tuberculosis H37Rv
ggcuguccuccuga

SEQ ID NO: 1312000 - RNA, 19 nt, Mycobacterium tuberculosis H37Rv
ggcuuccaacucggcggcc

SEQ ID NO: 1312001 - RNA, 13 nt, Mycobacterium tuberculosis H37Rv
ggcuucaucuggc

SEQ ID NO: 1312002 - RNA, 21 nt, Mycobacterium tuberculosis H37Rv
ggcuuaugcgucugcucgccc

SEQ ID NO: 1312003 - RNA, 13 nt, Mycobacterium tuberculosis H37Rv
ggcuuagcggcuu

SEQ ID NO: 1312004 - RNA, 15 nt, Mycobacterium tuberculosis H37Rv
ggcuguggccagcau

SEQ ID NO: 1312005 - RNA, 17 nt, Mycobacterium tuberculosis H37Rv
ggcuguggcgcgcaugg

SEQ ID NO: 1312006 - RNA, 19 nt, Mycobacterium tuberculosis H37Rv
ggcuucacccaaccccgcc

SEQ ID NO: 1312007 - RNA, 21 nt, Mycobacterium tuberculosis H37Rv
ggcugucguuugacgagccga

SEQ ID NO: 1312008 - RNA, 16 nt, Mycobacterium tuberculosis H37Rv
ggcuugcgcagcagcg

SEQ ID NO: 1312009 - RNA, 17 nt, Mycobacterium tuberculosis H37Rv
ggcuugcgcgagcagac

SEQ ID NO: 1312010 - RNA, 14 nt, Mycobacterium tuberculosis H37Rv
ggcuugccccgccg

SEQ ID NO: 1312011 - RNA, 12 nt, Mycobacterium tuberculosis H37Rv
gggccagccgcu

SEQ ID NO: 1312012 - RNA, 13 nt, Mycobacterium tuberculosis H37Rv
gggccagccgcuc

SEQ ID NO: 1312013 - RNA, 14 nt, Mycobacterium tuberculosis H37Rv
gggccagcggcagc

SEQ ID NO: 1312014 - RNA, 16 nt, Mycobacterium tuberculosis H37Rv
gggccagcgucaccuc

SEQ ID NO: 1312015 - RNA, 13 nt, Mycobacterium tuberculosis H37Rv
gggccagcagccg

SEQ ID NO: 1312016 - RNA, 18 nt, Mycobacterium tuberculosis H37Rv
gggcagcuccaccaggac

SEQ ID NO: 1312017 - RNA, 17 nt, Mycobacterium tuberculosis H37Rv
gggcagcgcgugcugug

SEQ ID NO: 1312018 - RNA, 21 nt, Mycobacterium tuberculosis H37Rv
gggcagcgcgugcuguggaug

SEQ ID NO: 1312019 - RNA, 11 nt, Mycobacterium tuberculosis H37Rv
gggcagccugc

SEQ ID NO: 1312020 - RNA, 23 nt, Mycobacterium tuberculosis H37Rv
gggcagcgaucuugguggccuca

SEQ ID NO: 1312021 - RNA, 14 nt, Mycobacterium tuberculosis H37Rv
gggcagcgccucca

SEQ ID NO: 1312022 - RNA, 15 nt, Mycobacterium tuberculosis H37Rv
gggccaggcccagcu

SEQ ID NO: 1312023 - RNA, 17 nt, Mycobacterium tuberculosis H37Rv
gggccaggucagccgcg

SEQ ID NO: 1312024 - RNA, 20 nt, Mycobacterium tuberculosis H37Rv
gggccaucgcauccccagca

SEQ ID NO: 1312025 - RNA, 23 nt, Mycobacterium tuberculosis H37Rv
gggccagugaaaccaccggccgu

SEQ ID NO: 1312026 - RNA, 18 nt, Mycobacterium tuberculosis H37Rv
gggccauggguagccgcc

SEQ ID NO: 1312027 - RNA, 15 nt, Mycobacterium tuberculosis H37Rv
gggcccagccggacc

SEQ ID NO: 1312028 - RNA, 15 nt, Mycobacterium tuberculosis H37Rv
gggcccagcgcgcgg

SEQ ID NO: 1312029 - RNA, 16 nt, Mycobacterium tuberculosis H37Rv
gggcccagcgcgcgga

SEQ ID NO: 1312030 - RNA, 22 nt, Mycobacterium tuberculosis H37Rv
gggcccuucacuguugcccuug

SEQ ID NO: 1312031 - RNA, 20 nt, Mycobacterium tuberculosis H37Rv
gggcccucuaugcgggcagc

SEQ ID NO: 1312032 - RNA, 21 nt, Mycobacterium tuberculosis H37Rv
gggcccucuaugcgggcagcg

SEQ ID NO: 1312033 - RNA, 19 nt, Mycobacterium tuberculosis H37Rv
gggcccuggcggcccgggu

SEQ ID NO: 1312034 - RNA, 21 nt, Mycobacterium tuberculosis H37Rv
gggccgacagcacgccaggca

SEQ ID NO: 1312035 - RNA, 12 nt, Mycobacterium tuberculosis H37Rv
gggccgagcgca

SEQ ID NO: 1312036 - RNA, 16 nt, Mycobacterium tuberculosis H37Rv
gggccgagcgcgccgu

SEQ ID NO: 1312037 - RNA, 23 nt, Mycobacterium tuberculosis H37Rv
gggccgacugggcgcgaccccag

SEQ ID NO: 1312038 - RNA, 14 nt, Mycobacterium tuberculosis H37Rv
gggccgaccagagc

SEQ ID NO: 1312039 - RNA, 22 nt, Mycobacterium tuberculosis H37Rv
gggccgcacggucagcgcgcac

SEQ ID NO: 1312040 - RNA, 17 nt, Mycobacterium tuberculosis H37Rv
gggccgaguucgucagc

SEQ ID NO: 1312041 - RNA, 23 nt, Mycobacterium tuberculosis H37Rv
gggccgguggaaaagccacggcu

SEQ ID NO: 1312042 - RNA, 13 nt, Mycobacterium tuberculosis H37Rv
gggccgguccggg

SEQ ID NO: 1312043 - RNA, 19 nt, Mycobacterium tuberculosis H37Rv
gggccgguccggggcaacg

SEQ ID NO: 1312044 - RNA, 13 nt, Mycobacterium tuberculosis H37Rv
gggccgggcggug

SEQ ID NO: 1312045 - RNA, 22 nt, Mycobacterium tuberculosis H37Rv
gggccgggcgaucgccugggcu

SEQ ID NO: 1312046 - RNA, 23 nt, Mycobacterium tuberculosis H37Rv
gggccgcgcgcagagcguacagg

SEQ ID NO: 1312047 - RNA, 12 nt, Mycobacterium tuberculosis H37Rv
gggccgccaggc

SEQ ID NO: 1312048 - RNA, 13 nt, Mycobacterium tuberculosis H37Rv
gggccgccgcccu

SEQ ID NO: 1312049 - RNA, 22 nt, Mycobacterium tuberculosis H37Rv
gggccgccgcccugguccaggc

SEQ ID NO: 1312050 - RNA, 16 nt, Mycobacterium tuberculosis H37Rv
gggccgccgccccggc

SEQ ID NO: 1312051 - RNA, 17 nt, Mycobacterium tuberculosis H37Rv
gggccgccgagcggacc

SEQ ID NO: 1312052 - RNA, 16 nt, Mycobacterium tuberculosis H37Rv
gggccgcgaaacccug

SEQ ID NO: 1312053 - RNA, 14 nt, Mycobacterium tuberculosis H37Rv
gggcaacugcagca

SEQ ID NO: 1312054 - RNA, 15 nt, Mycobacterium tuberculosis H37Rv
gggcaaggcggcggc

SEQ ID NO: 1312055 - RNA, 17 nt, Mycobacterium tuberculosis H37Rv
gggcaaggcggcggcca

SEQ ID NO: 1312056 - RNA, 19 nt, Mycobacterium tuberculosis H37Rv
gggcaauacguagucgccg

SEQ ID NO: 1312057 - RNA, 16 nt, Mycobacterium tuberculosis H37Rv
gggcaaucacaucaaa

SEQ ID NO: 1312058 - RNA, 14 nt, Mycobacterium tuberculosis H37Rv
gggcaacgccucga

SEQ ID NO: 1312059 - RNA, 21 nt, Mycobacterium tuberculosis H37Rv
gggcaaccgaaccgguccacu

SEQ ID NO: 1312060 - RNA, 22 nt, Mycobacterium tuberculosis H37Rv
gggcaaaucaagcacagcccgg

SEQ ID NO: 1312061 - RNA, 20 nt, Mycobacterium tuberculosis H37Rv
gggcagaccgaucggcaggc

SEQ ID NO: 1312062 - RNA, 19 nt, Mycobacterium tuberculosis H37Rv
gggcacuccgggcucggcg

SEQ ID NO: 1312063 - RNA, 21 nt, Mycobacterium tuberculosis H37Rv
gggcagaaucggugggcgggc

SEQ ID NO: 1312064 - RNA, 17 nt, Mycobacterium tuberculosis H37Rv
gggcagaaucggugggc

SEQ ID NO: 1312065 - RNA, 14 nt, Mycobacterium tuberculosis H37Rv
gggcacugguggcg

SEQ ID NO: 1312066 - RNA, 12 nt, Mycobacterium tuberculosis H37Rv
gggcagcaaaaa

SEQ ID NO: 1312067 - RNA, 14 nt, Mycobacterium tuberculosis H37Rv
gggcagcagcuggu

SEQ ID NO: 1312068 - RNA, 15 nt, Mycobacterium tuberculosis H37Rv
gggcagccgcccgcc

SEQ ID NO: 1312069 - RNA, 11 nt, Mycobacterium tuberculosis H37Rv
gggcagccgca

SEQ ID NO: 1312070 - RNA, 13 nt, Mycobacterium tuberculosis H37Rv
gggaucccccgcg

SEQ ID NO: 1312071 - RNA, 14 nt, Mycobacterium tuberculosis H37Rv
gggaucgaccaugg

SEQ ID NO: 1312072 - RNA, 15 nt, Mycobacterium tuberculosis H37Rv
gggauccgcgcgcug

SEQ ID NO: 1312073 - RNA, 16 nt, Mycobacterium tuberculosis H37Rv
gggaucaggcugggca

SEQ ID NO: 1312074 - RNA, 21 nt, Mycobacterium tuberculosis H37Rv
gggaucaccggcugcugagga

SEQ ID NO: 1312075 - RNA, 20 nt, Mycobacterium tuberculosis H37Rv
gggagcacuaccccacaagc

SEQ ID NO: 1312076 - RNA, 19 nt, Mycobacterium tuberculosis H37Rv
gggagcaccgaccagggcc

SEQ ID NO: 1312077 - RNA, 13 nt, Mycobacterium tuberculosis H37Rv
gggagccaccggc

SEQ ID NO: 1312078 - RNA, 14 nt, Mycobacterium tuberculosis H37Rv
gggauucggccaga

SEQ ID NO: 1312079 - RNA, 14 nt, Mycobacterium tuberculosis H37Rv
gggaucgcugccag

SEQ ID NO: 1312080 - RNA, 21 nt, Mycobacterium tuberculosis H37Rv
gggaucgagagccgaccgggu

SEQ ID NO: 1312081 - RNA, 13 nt, Mycobacterium tuberculosis H37Rv
gggaucgcccagg

SEQ ID NO: 1312082 - RNA, 19 nt, Mycobacterium tuberculosis H37Rv
gggaucgccguccagcaau

SEQ ID NO: 1312083 - RNA, 17 nt, Mycobacterium tuberculosis H37Rv
gggaucgguggcggcac

SEQ ID NO: 1312084 - RNA, 19 nt, Mycobacterium tuberculosis H37Rv
gggauucgucgugcgggcg

SEQ ID NO: 1312085 - RNA, 13 nt, Mycobacterium tuberculosis H37Rv
gggauucuggaug

SEQ ID NO: 1312086 - RNA, 19 nt, Mycobacterium tuberculosis H37Rv
gggauugcgggccugcacg

SEQ ID NO: 1312087 - RNA, 16 nt, Mycobacterium tuberculosis H37Rv
gggauuggaggcgggc

SEQ ID NO: 1312088 - RNA, 12 nt, Mycobacterium tuberculosis H37Rv
ggggcgcccggc

SEQ ID NO: 1312089 - RNA, 14 nt, Mycobacterium tuberculosis H37Rv
ggggcgcagcgcgg

SEQ ID NO: 1312090 - RNA, 23 nt, Mycobacterium tuberculosis H37Rv
ggggcgccuuaggcguccgagcg

SEQ ID NO: 1312091 - RNA, 14 nt, Mycobacterium tuberculosis H37Rv
ggggcgccugaugc

SEQ ID NO: 1312092 - RNA, 23 nt, Mycobacterium tuberculosis H37Rv
ggggcgccggauauggcaguguc

SEQ ID NO: 1312093 - RNA, 11 nt, Mycobacterium tuberculosis H37Rv
ggggcgcgugg

SEQ ID NO: 1312094 - RNA, 17 nt, Mycobacterium tuberculosis H37Rv
ggggcgcgugggcgugc

SEQ ID NO: 1312095 - RNA, 19 nt, Mycobacterium tuberculosis H37Rv
ggggcgcucgcgcgcuggg

SEQ ID NO: 1312096 - RNA, 12 nt, Mycobacterium tuberculosis H37Rv
ggggcgcgccgg

SEQ ID NO: 1312097 - RNA, 17 nt, Mycobacterium tuberculosis H37Rv
ggggcgcgccggcuagg

SEQ ID NO: 1312098 - RNA, 16 nt, Mycobacterium tuberculosis H37Rv
ggggcguacugugagu

SEQ ID NO: 1312099 - RNA, 14 nt, Mycobacterium tuberculosis H37Rv
ggggcgucgccgcc

SEQ ID NO: 1312100 - RNA, 24 nt, Mycobacterium tuberculosis H37Rv
ggggcgucgcaacccggccuggag

SEQ ID NO: 1312101 - RNA, 13 nt, Mycobacterium tuberculosis H37Rv
ggggcgucguucg

SEQ ID NO: 1312102 - RNA, 17 nt, Mycobacterium tuberculosis H37Rv
ggggcggcggugggcgc

SEQ ID NO: 1312103 - RNA, 21 nt, Mycobacterium tuberculosis H37Rv
ggggcggucggccggcucguc

SEQ ID NO: 1312104 - RNA, 20 nt, Mycobacterium tuberculosis H37Rv
ggggcgcuuccguggcccaa

SEQ ID NO: 1312105 - RNA, 15 nt, Mycobacterium tuberculosis H37Rv
ggggcucagcggugg

SEQ ID NO: 1312106 - RNA, 20 nt, Mycobacterium tuberculosis H37Rv
ggggcugcugcucggccugg

SEQ ID NO: 1312107 - RNA, 16 nt, Mycobacterium tuberculosis H37Rv
ggggcugccgccguug

SEQ ID NO: 1312108 - RNA, 20 nt, Mycobacterium tuberculosis H37Rv
ggggcuacuaggcccagcac

SEQ ID NO: 1312109 - RNA, 18 nt, Mycobacterium tuberculosis H37Rv
ggggcguuguugggcgag

SEQ ID NO: 1312110 - RNA, 19 nt, Mycobacterium tuberculosis H37Rv
ggggcucagcgguggcgug

SEQ ID NO: 1312111 - RNA, 17 nt, Mycobacterium tuberculosis H37Rv
ggggcguuucggcgggc

SEQ ID NO: 1312112 - RNA, 14 nt, Mycobacterium tuberculosis H37Rv
ggggcugugcaggc

SEQ ID NO: 1312113 - RNA, 19 nt, Mycobacterium tuberculosis H37Rv
ggggcugggcgccaugcgc

SEQ ID NO: 1312114 - RNA, 21 nt, Mycobacterium tuberculosis H37Rv
ggggcugucggcgauggagcg

SEQ ID NO: 1312115 - RNA, 22 nt, Mycobacterium tuberculosis H37Rv
ggggcuuuugcgucugcucgcc

SEQ ID NO: 1312116 - RNA, 16 nt, Mycobacterium tuberculosis H37Rv
gggggauccagcaggc

SEQ ID NO: 1312117 - RNA, 13 nt, Mycobacterium tuberculosis H37Rv
gggggagcgaacg

SEQ ID NO: 1312118 - RNA, 12 nt, Mycobacterium tuberculosis H37Rv
ggggguggcagc

SEQ ID NO: 1312119 - RNA, 17 nt, Mycobacterium tuberculosis H37Rv
gggggucuugccgagca

SEQ ID NO: 1312120 - RNA, 17 nt, Mycobacterium tuberculosis H37Rv
ggggguucuggccguag

SEQ ID NO: 1312121 - RNA, 19 nt, Mycobacterium tuberculosis H37Rv
ggggguugcggcagcuggc

SEQ ID NO: 1312122 - RNA, 21 nt, Mycobacterium tuberculosis H37Rv
gggguagaccuucucgccgcc

SEQ ID NO: 1312123 - RNA, 21 nt, Mycobacterium tuberculosis H37Rv
gggggcuuaugcgucugcucg

SEQ ID NO: 1312124 - RNA, 17 nt, Mycobacterium tuberculosis H37Rv
ggggguccggcggccgc

SEQ ID NO: 1312125 - RNA, 19 nt, Mycobacterium tuberculosis H37Rv
gggggccucguugaccaga

SEQ ID NO: 1312126 - RNA, 12 nt, Mycobacterium tuberculosis H37Rv
gggggccgagcc

SEQ ID NO: 1312127 - RNA, 18 nt, Mycobacterium tuberculosis H37Rv
ggggcuuaugcgucugcu

SEQ ID NO: 1312128 - RNA, 20 nt, Mycobacterium tuberculosis H37Rv
gggggauccggcgcagcgaa

SEQ ID NO: 1312129 - RNA, 22 nt, Mycobacterium tuberculosis H37Rv
gggguaucgacccuccagcacg

SEQ ID NO: 1312130 - RNA, 18 nt, Mycobacterium tuberculosis H37Rv
gggguaucaaccggccgg

SEQ ID NO: 1312131 - RNA, 14 nt, Mycobacterium tuberculosis H37Rv
gggguaggggucga

SEQ ID NO: 1312132 - RNA, 18 nt, Mycobacterium tuberculosis H37Rv
ggggucgcugugcagcgg

SEQ ID NO: 1312133 - RNA, 14 nt, Mycobacterium tuberculosis H37Rv
gggguccagcgucc

SEQ ID NO: 1312134 - RNA, 13 nt, Mycobacterium tuberculosis H37Rv
gggguccggcggc

SEQ ID NO: 1312135 - RNA, 17 nt, Mycobacterium tuberculosis H37Rv
ggggugcccggccgcca

SEQ ID NO: 1312136 - RNA, 22 nt, Mycobacterium tuberculosis H37Rv
ggggugcacgccuugagccgag

SEQ ID NO: 1312137 - RNA, 12 nt, Mycobacterium tuberculosis H37Rv
ggggugccggcg

SEQ ID NO: 1312138 - RNA, 22 nt, Mycobacterium tuberculosis H37Rv
gggugaucugggcggugaaggc

SEQ ID NO: 1312139 - RNA, 15 nt, Mycobacterium tuberculosis H37Rv
gggucggcacgaccc

SEQ ID NO: 1312140 - RNA, 18 nt, Mycobacterium tuberculosis H37Rv
gggucggcacgacccggg

SEQ ID NO: 1312141 - RNA, 18 nt, Mycobacterium tuberculosis H37Rv
gggugcagaucgccccag

SEQ ID NO: 1312142 - RNA, 19 nt, Mycobacterium tuberculosis H37Rv
gggugcagcacggcgccgc

SEQ ID NO: 1312143 - RNA, 21 nt, Mycobacterium tuberculosis H37Rv
gggugccagcccguugcagga

SEQ ID NO: 1312144 - RNA, 13 nt, Mycobacterium tuberculosis H37Rv
gggugcagugacc

SEQ ID NO: 1312145 - RNA, 22 nt, Mycobacterium tuberculosis H37Rv
gggugccagaucggcggguggc

SEQ ID NO: 1312146 - RNA, 18 nt, Mycobacterium tuberculosis H37Rv
gggugcccggcggccaac

SEQ ID NO: 1312147 - RNA, 22 nt, Mycobacterium tuberculosis H37Rv
gggugccgcgccguagagccgc

SEQ ID NO: 1312148 - RNA, 11 nt, Mycobacterium tuberculosis H37Rv
ggguggcggcg

SEQ ID NO: 1312149 - RNA, 15 nt, Mycobacterium tuberculosis H37Rv
gggugccggcgccgc

SEQ ID NO: 1312150 - RNA, 17 nt, Mycobacterium tuberculosis H37Rv
gggucgaccccggccag

SEQ ID NO: 1312151 - RNA, 19 nt, Mycobacterium tuberculosis H37Rv
gggucgaccccggccagga

SEQ ID NO: 1312152 - RNA, 13 nt, Mycobacterium tuberculosis H37Rv
gggucaggccagg

SEQ ID NO: 1312153 - RNA, 14 nt, Mycobacterium tuberculosis H37Rv
gggucaggccgacg

SEQ ID NO: 1312154 - RNA, 21 nt, Mycobacterium tuberculosis H37Rv
gggucgcgggguaggcccagc

SEQ ID NO: 1312155 - RNA, 15 nt, Mycobacterium tuberculosis H37Rv
gggucgcgagcccgc

SEQ ID NO: 1312156 - RNA, 16 nt, Mycobacterium tuberculosis H37Rv
gggucgcgagcccgcc

SEQ ID NO: 1312157 - RNA, 22 nt, Mycobacterium tuberculosis H37Rv
gggucgccgccaucagcccuuc

SEQ ID NO: 1312158 - RNA, 14 nt, Mycobacterium tuberculosis H37Rv
gggucgccggcacc

SEQ ID NO: 1312159 - RNA, 18 nt, Mycobacterium tuberculosis H37Rv
gggucgaucaccgacacc

SEQ ID NO: 1312160 - RNA, 12 nt, Mycobacterium tuberculosis H37Rv
gggucacccccg

SEQ ID NO: 1312161 - RNA, 23 nt, Mycobacterium tuberculosis H37Rv
gggucaccagcgcaucggccagc

SEQ ID NO: 1312162 - RNA, 21 nt, Mycobacterium tuberculosis H37Rv
gggucaccucgucgccuagcc

SEQ ID NO: 1312163 - RNA, 20 nt, Mycobacterium tuberculosis H37Rv
gggucaaugcuggcagcggc

SEQ ID NO: 1312164 - RNA, 19 nt, Mycobacterium tuberculosis H37Rv
gggucacaaacccagcauc

SEQ ID NO: 1312165 - RNA, 19 nt, Mycobacterium tuberculosis H37Rv
ggguacgacaccgcagcgg

SEQ ID NO: 1312166 - RNA, 24 nt, Mycobacterium tuberculosis H37Rv
ggguacgacaccgcagcgggcggu

SEQ ID NO: 1312167 - RNA, 11 nt, Mycobacterium tuberculosis H37Rv
ggguaccuccc

SEQ ID NO: 1312168 - RNA, 12 nt, Mycobacterium tuberculosis H37Rv
ggguaacguguu

SEQ ID NO: 1312169 - RNA, 11 nt, Mycobacterium tuberculosis H37Rv
ggggugguggu

SEQ ID NO: 1312170 - RNA, 19 nt, Mycobacterium tuberculosis H37Rv
gggguggcgcgggccggcg

SEQ ID NO: 1312171 - RNA, 15 nt, Mycobacterium tuberculosis H37Rv
gggguggcagcgcgg

SEQ ID NO: 1312172 - RNA, 20 nt, Mycobacterium tuberculosis H37Rv
gggguggccaccagcggcau

SEQ ID NO: 1312173 - RNA, 18 nt, Mycobacterium tuberculosis H37Rv
gggguguugaggccggug

SEQ ID NO: 1312174 - RNA, 23 nt, Mycobacterium tuberculosis H37Rv
ggggugugcgggguugggcggag

SEQ ID NO: 1312175 - RNA, 22 nt, Mycobacterium tuberculosis H37Rv
ggggugucaaucacccagccgg

SEQ ID NO: 1312176 - RNA, 17 nt, Mycobacterium tuberculosis H37Rv
gggguugcggcagcugg

SEQ ID NO: 1312177 - RNA, 13 nt, Mycobacterium tuberculosis H37Rv
gggcggaucgccg

SEQ ID NO: 1312178 - RNA, 22 nt, Mycobacterium tuberculosis H37Rv
gggcggccaaccccgaugaggc

SEQ ID NO: 1312179 - RNA, 14 nt, Mycobacterium tuberculosis H37Rv
gggcggccaggcgc

SEQ ID NO: 1312180 - RNA, 18 nt, Mycobacterium tuberculosis H37Rv
gggcggcccaccggccac

SEQ ID NO: 1312181 - RNA, 12 nt, Mycobacterium tuberculosis H37Rv
gggcggccagga

SEQ ID NO: 1312182 - RNA, 22 nt, Mycobacterium tuberculosis H37Rv
gggcgcuugcaccaggggcgcg

SEQ ID NO: 1312183 - RNA, 12 nt, Mycobacterium tuberculosis H37Rv
gggcggaaaaga

SEQ ID NO: 1312184 - RNA, 16 nt, Mycobacterium tuberculosis H37Rv
gggcggaacgccggca

SEQ ID NO: 1312185 - RNA, 23 nt, Mycobacterium tuberculosis H37Rv
gggcgcugccaauccgaucgagg

SEQ ID NO: 1312186 - RNA, 12 nt, Mycobacterium tuberculosis H37Rv
gggccuccugcu

SEQ ID NO: 1312187 - RNA, 17 nt, Mycobacterium tuberculosis H37Rv
gggccucgaccgccagc

SEQ ID NO: 1312188 - RNA, 19 nt, Mycobacterium tuberculosis H37Rv
gggccucgaucagcgccgg

SEQ ID NO: 1312189 - RNA, 21 nt, Mycobacterium tuberculosis H37Rv
gggccguuuguagaucugggc

SEQ ID NO: 1312190 - RNA, 15 nt, Mycobacterium tuberculosis H37Rv
gggccugcacgccgg

SEQ ID NO: 1312191 - RNA, 17 nt, Mycobacterium tuberculosis H37Rv
gggccugacgcgucagc

SEQ ID NO: 1312192 - RNA, 23 nt, Mycobacterium tuberculosis H37Rv
gggccucguugaccagaaccugg

SEQ ID NO: 1312193 - RNA, 22 nt, Mycobacterium tuberculosis H37Rv
gggccguccggcuuggcggcga

SEQ ID NO: 1312194 - RNA, 23 nt, Mycobacterium tuberculosis H37Rv
gggccguccggcgccugcugcgg

SEQ ID NO: 1312195 - RNA, 21 nt, Mycobacterium tuberculosis H37Rv
gggccguccggcuuggcggcg

SEQ ID NO: 1312196 - RNA, 13 nt, Mycobacterium tuberculosis H37Rv
gggccguccgggu

SEQ ID NO: 1312197 - RNA, 16 nt, Mycobacterium tuberculosis H37Rv
gggccgucgccgucca

SEQ ID NO: 1312198 - RNA, 22 nt, Mycobacterium tuberculosis H37Rv
gggccgucuugccggccaggau

SEQ ID NO: 1312199 - RNA, 21 nt, Mycobacterium tuberculosis H37Rv
gggccuaucccgaaucucacc

SEQ ID NO: 1312200 - RNA, 16 nt, Mycobacterium tuberculosis H37Rv
gggcguuucggcgggc

SEQ ID NO: 1312201 - RNA, 17 nt, Mycobacterium tuberculosis H37Rv
gggcguuucggcgggcg

SEQ ID NO: 1312202 - RNA, 15 nt, Mycobacterium tuberculosis H37Rv
gggcgggucugggug

SEQ ID NO: 1312203 - RNA, 18 nt, Mycobacterium tuberculosis H37Rv
gggcggguucggacgagg

SEQ ID NO: 1312204 - RNA, 23 nt, Mycobacterium tuberculosis H37Rv
gggcggcuucgaugucguaccgg

SEQ ID NO: 1312205 - RNA, 18 nt, Mycobacterium tuberculosis H37Rv
gggcuacuaggcccagca

SEQ ID NO: 1312206 - RNA, 18 nt, Mycobacterium tuberculosis H37Rv
gggcggcggcgcgaucga

SEQ ID NO: 1312207 - RNA, 19 nt, Mycobacterium tuberculosis H37Rv
gggcggcugcgggcccggc

SEQ ID NO: 1312208 - RNA, 20 nt, Mycobacterium tuberculosis H37Rv
gggcggcgaccucggcggcg

SEQ ID NO: 1312209 - RNA, 12 nt, Mycobacterium tuberculosis H37Rv
gggcggcgccgg

SEQ ID NO: 1312210 - RNA, 14 nt, Mycobacterium tuberculosis H37Rv
gggcggcgccggcg

SEQ ID NO: 1312211 - RNA, 13 nt, Mycobacterium tuberculosis H37Rv
gggcuagucgggg

SEQ ID NO: 1312212 - RNA, 15 nt, Mycobacterium tuberculosis H37Rv
gggcucaagucuccc

SEQ ID NO: 1312213 - RNA, 22 nt, Mycobacterium tuberculosis H37Rv
gggcuccccggauuccucguca

SEQ ID NO: 1312214 - RNA, 14 nt, Mycobacterium tuberculosis H37Rv
gggcuccaacaggu

SEQ ID NO: 1312215 - RNA, 14 nt, Mycobacterium tuberculosis H37Rv
gggcuccagcagcg

SEQ ID NO: 1312216 - RNA, 14 nt, Mycobacterium tuberculosis H37Rv
gggcucuggccagu

SEQ ID NO: 1312217 - RNA, 17 nt, Mycobacterium tuberculosis H37Rv
gggcucuggccaguccg

SEQ ID NO: 1312218 - RNA, 19 nt, Mycobacterium tuberculosis H37Rv
gggcucucgaguccaggca

SEQ ID NO: 1312219 - RNA, 19 nt, Mycobacterium tuberculosis H37Rv
gggcucuacucgcggccgg

SEQ ID NO: 1312220 - RNA, 19 nt, Mycobacterium tuberculosis H37Rv
gggcucguaggugggcucg

SEQ ID NO: 1312221 - RNA, 18 nt, Mycobacterium tuberculosis H37Rv
gggcucgcucgccgagcu

SEQ ID NO: 1312222 - RNA, 20 nt, Mycobacterium tuberculosis H37Rv
gggcucgcuucaggcaccgg

SEQ ID NO: 1312223 - RNA, 13 nt, Mycobacterium tuberculosis H37Rv
gggcucggcggcc

SEQ ID NO: 1312224 - RNA, 17 nt, Mycobacterium tuberculosis H37Rv
gggcucggcggcccggc

SEQ ID NO: 1312225 - RNA, 18 nt, Mycobacterium tuberculosis H37Rv
gggcucggcggcccggcc

SEQ ID NO: 1312226 - RNA, 22 nt, Mycobacterium tuberculosis H37Rv
ggggccgucgucggucaccgac

SEQ ID NO: 1312227 - RNA, 19 nt, Mycobacterium tuberculosis H37Rv
ggggccgucucgccgugga

SEQ ID NO: 1312228 - RNA, 20 nt, Mycobacterium tuberculosis H37Rv
ggggccucguugaccagaac

SEQ ID NO: 1312229 - RNA, 15 nt, Mycobacterium tuberculosis H37Rv
ggggcgcaccgagcg

SEQ ID NO: 1312230 - RNA, 23 nt, Mycobacterium tuberculosis H37Rv
ggggcgcacgauggugugcagca

SEQ ID NO: 1312231 - RNA, 20 nt, Mycobacterium tuberculosis H37Rv
ggggccggggucggcccgcc

SEQ ID NO: 1312232 - RNA, 18 nt, Mycobacterium tuberculosis H37Rv
ggggccggcggcucgggu

SEQ ID NO: 1312233 - RNA, 14 nt, Mycobacterium tuberculosis H37Rv
ggggccggcagcgg

SEQ ID NO: 1312234 - RNA, 15 nt, Mycobacterium tuberculosis H37Rv
ggggccgcuggggcg

SEQ ID NO: 1312235 - RNA, 15 nt, Mycobacterium tuberculosis H37Rv
ggggccggccggcaa

SEQ ID NO: 1312236 - RNA, 13 nt, Mycobacterium tuberculosis H37Rv
ggggccggauguc

SEQ ID NO: 1312237 - RNA, 14 nt, Mycobacterium tuberculosis H37Rv
ggggccgcuggggc

SEQ ID NO: 1312238 - RNA, 17 nt, Mycobacterium tuberculosis H37Rv
ggggccgccgcggccgg

SEQ ID NO: 1312239 - RNA, 13 nt, Mycobacterium tuberculosis H37Rv
ggggccccaugcc

SEQ ID NO: 1312240 - RNA, 16 nt, Mycobacterium tuberculosis H37Rv
ggggcccgaccugucc

SEQ ID NO: 1312241 - RNA, 20 nt, Mycobacterium tuberculosis H37Rv
ggggccccgcgccggccgca

SEQ ID NO: 1312242 - RNA, 15 nt, Mycobacterium tuberculosis H37Rv
ggggccgagccgaca

SEQ ID NO: 1312243 - RNA, 22 nt, Mycobacterium tuberculosis H37Rv
ggggccgagccgacaucgaugu

SEQ ID NO: 1312244 - RNA, 22 nt, Mycobacterium tuberculosis H37Rv
ggggccgaauccgauagcccgg

SEQ ID NO: 1312245 - RNA, 24 nt, Mycobacterium tuberculosis H37Rv
ggggcccaguuccgcugcggugcc

SEQ ID NO: 1312246 - RNA, 20 nt, Mycobacterium tuberculosis H37Rv
ggggcacgacgccggccugg

SEQ ID NO: 1312247 - RNA, 23 nt, Mycobacterium tuberculosis H37Rv
ggggcagcacgucacgcaaccgg

SEQ ID NO: 1312248 - RNA, 18 nt, Mycobacterium tuberculosis H37Rv
ggggcacuuccagcccgg

SEQ ID NO: 1312249 - RNA, 17 nt, Mycobacterium tuberculosis H37Rv
ggggcaccacgccagcc

SEQ ID NO: 1312250 - RNA, 20 nt, Mycobacterium tuberculosis H37Rv
ggggcaccagcgaauccagc

SEQ ID NO: 1312251 - RNA, 19 nt, Mycobacterium tuberculosis H37Rv
ggggcaucggugcgguucg

SEQ ID NO: 1312252 - RNA, 18 nt, Mycobacterium tuberculosis H37Rv
gggcuguccgaccucgcc

SEQ ID NO: 1312253 - RNA, 18 nt, Mycobacterium tuberculosis H37Rv
gggcuguacucgcggcgc

SEQ ID NO: 1312254 - RNA, 14 nt, Mycobacterium tuberculosis H37Rv
gggcugaggcggcg

SEQ ID NO: 1312255 - RNA, 21 nt, Mycobacterium tuberculosis H37Rv
gggcuggucuacccgcggcgc

SEQ ID NO: 1312256 - RNA, 14 nt, Mycobacterium tuberculosis H37Rv
gggcuucggccaga

SEQ ID NO: 1312257 - RNA, 16 nt, Mycobacterium tuberculosis H37Rv
gggcuugccgcgcacc

SEQ ID NO: 1312258 - RNA, 19 nt, Mycobacterium tuberculosis H37Rv
gggcuuccaacaggccggu

SEQ ID NO: 1312259 - RNA, 17 nt, Mycobacterium tuberculosis H37Rv
gggcuuaggccgcggca

SEQ ID NO: 1312260 - RNA, 15 nt, Mycobacterium tuberculosis H37Rv
gggcuguugacgcca

SEQ ID NO: 1312261 - RNA, 16 nt, Mycobacterium tuberculosis H37Rv
ggggcaauccccugga

SEQ ID NO: 1312262 - RNA, 21 nt, Mycobacterium tuberculosis H37Rv
ggggaugccgaaccgcugcgg

SEQ ID NO: 1312263 - RNA, 23 nt, Mycobacterium tuberculosis H37Rv
ggggauucgucgugcgggcgggc

SEQ ID NO: 1312264 - RNA, 18 nt, Mycobacterium tuberculosis H37Rv
ggggauguuuuuggccgc

SEQ ID NO: 1312265 - RNA, 21 nt, Mycobacterium tuberculosis H37Rv
ggggaugacgguuugcagcgg

SEQ ID NO: 1312266 - RNA, 19 nt, Mycobacterium tuberculosis H37Rv
ggggauccagcaggccggg

SEQ ID NO: 1312267 - RNA, 19 nt, Mycobacterium tuberculosis H37Rv
ggggaucgcuggccgcgag

SEQ ID NO: 1312268 - RNA, 15 nt, Mycobacterium tuberculosis H37Rv
ggggauaccgcuggg

SEQ ID NO: 1312269 - RNA, 18 nt, Mycobacterium tuberculosis H37Rv
ggggaucaccggcugcug

SEQ ID NO: 1312270 - RNA, 14 nt, Mycobacterium tuberculosis H37Rv
ggggaucagcgagu

SEQ ID NO: 1312271 - RNA, 17 nt, Mycobacterium tuberculosis H37Rv
ggggaguaguggugggc

SEQ ID NO: 1312272 - RNA, 12 nt, Mycobacterium tuberculosis H37Rv
ggguggcggcgg

SEQ ID NO: 1312273 - RNA, 16 nt, Mycobacterium tuberculosis H37Rv
ggguggcggcggcgga

SEQ ID NO: 1312274 - RNA, 21 nt, Mycobacterium tuberculosis H37Rv
ggguggugccaggucggcggg

SEQ ID NO: 1312275 - RNA, 13 nt, Mycobacterium tuberculosis H37Rv
gggugguggugga

SEQ ID NO: 1312276 - RNA, 19 nt, Mycobacterium tuberculosis H37Rv
ggguggugucgcggccgcc

SEQ ID NO: 1312277 - RNA, 22 nt, Mycobacterium tuberculosis H37Rv
gggugguucaccucggcgacga

SEQ ID NO: 1312278 - RNA, 16 nt, Mycobacterium tuberculosis H37Rv
gggugucgaagagcag

SEQ ID NO: 1312279 - RNA, 21 nt, Mycobacterium tuberculosis H37Rv
ggguggucucgauaucaguga

SEQ ID NO: 1312280 - RNA, 16 nt, Mycobacterium tuberculosis H37Rv
ggguguugaggccggu

SEQ ID NO: 1312281 - RNA, 15 nt, Mycobacterium tuberculosis H37Rv
gggugucgggcgcgc

SEQ ID NO: 1312282 - RNA, 14 nt, Mycobacterium tuberculosis H37Rv
gggugugcgggcgg

SEQ ID NO: 1312283 - RNA, 13 nt, Mycobacterium tuberculosis H37Rv
gguagccgcggcc

SEQ ID NO: 1312284 - RNA, 16 nt, Mycobacterium tuberculosis H37Rv
gguagccgcggccaca

SEQ ID NO: 1312285 - RNA, 16 nt, Mycobacterium tuberculosis H37Rv
gguagccauccgugaa

SEQ ID NO: 1312286 - RNA, 21 nt, Mycobacterium tuberculosis H37Rv
gguagccaaccugaagccagc

SEQ ID NO: 1312287 - RNA, 12 nt, Mycobacterium tuberculosis H37Rv
gguagcggcggc

SEQ ID NO: 1312288 - RNA, 21 nt, Mycobacterium tuberculosis H37Rv
gguagcgcggguggcucgggu

SEQ ID NO: 1312289 - RNA, 14 nt, Mycobacterium tuberculosis H37Rv
gguagccugaccag

SEQ ID NO: 1312290 - RNA, 16 nt, Mycobacterium tuberculosis H37Rv
gguagccgucgauccc

SEQ ID NO: 1312291 - RNA, 14 nt, Mycobacterium tuberculosis H37Rv
ggucacaaacggca

SEQ ID NO: 1312292 - RNA, 19 nt, Mycobacterium tuberculosis H37Rv
ggucaagucccucggcggc

SEQ ID NO: 1312293 - RNA, 22 nt, Mycobacterium tuberculosis H37Rv
ggucaacgcuagcgucgugucg

SEQ ID NO: 1312294 - RNA, 14 nt, Mycobacterium tuberculosis H37Rv
ggucaacggcagau

SEQ ID NO: 1312295 - RNA, 14 nt, Mycobacterium tuberculosis H37Rv
ggucaagacccgca

SEQ ID NO: 1312296 - RNA, 18 nt, Mycobacterium tuberculosis H37Rv
gguaucgagggcagccgc

SEQ ID NO: 1312297 - RNA, 17 nt, Mycobacterium tuberculosis H37Rv
gguaucgagggcagccg

SEQ ID NO: 1312298 - RNA, 16 nt, Mycobacterium tuberculosis H37Rv
gguaucgagggcagcc

SEQ ID NO: 1312299 - RNA, 18 nt, Mycobacterium tuberculosis H37Rv
ggucauccagccagcaag

SEQ ID NO: 1312300 - RNA, 15 nt, Mycobacterium tuberculosis H37Rv
ggucaucgagcugac

SEQ ID NO: 1312301 - RNA, 13 nt, Mycobacterium tuberculosis H37Rv
ggucacucuggcg

SEQ ID NO: 1312302 - RNA, 20 nt, Mycobacterium tuberculosis H37Rv
ggucagauguuguacggccc

SEQ ID NO: 1312303 - RNA, 15 nt, Mycobacterium tuberculosis H37Rv
ggucaguccgacacc

SEQ ID NO: 1312304 - RNA, 16 nt, Mycobacterium tuberculosis H37Rv
ggucaguucccagacc

SEQ ID NO: 1312305 - RNA, 14 nt, Mycobacterium tuberculosis H37Rv
ggucaguuccucua

SEQ ID NO: 1312306 - RNA, 21 nt, Mycobacterium tuberculosis H37Rv
ggucaguccgacaccggcggc

SEQ ID NO: 1312307 - RNA, 21 nt, Mycobacterium tuberculosis H37Rv
ggucagcacgcugaccacaac

SEQ ID NO: 1312308 - RNA, 14 nt, Mycobacterium tuberculosis H37Rv
ggucagcaccacca

SEQ ID NO: 1312309 - RNA, 15 nt, Mycobacterium tuberculosis H37Rv
ggucccgcauauccg

SEQ ID NO: 1312310 - RNA, 15 nt, Mycobacterium tuberculosis H37Rv
ggucccggcagcugg

SEQ ID NO: 1312311 - RNA, 14 nt, Mycobacterium tuberculosis H37Rv
ggucccccgcagcc

SEQ ID NO: 1312312 - RNA, 21 nt, Mycobacterium tuberculosis H37Rv
gguccccucggugccacugcc

SEQ ID NO: 1312313 - RNA, 17 nt, Mycobacterium tuberculosis H37Rv
gguccccacauggcccg

SEQ ID NO: 1312314 - RNA, 14 nt, Mycobacterium tuberculosis H37Rv
gguccagcggccgc

SEQ ID NO: 1312315 - RNA, 13 nt, Mycobacterium tuberculosis H37Rv
gguccaggcccug

SEQ ID NO: 1312316 - RNA, 15 nt, Mycobacterium tuberculosis H37Rv
gguccaggcccuggc

SEQ ID NO: 1312317 - RNA, 23 nt, Mycobacterium tuberculosis H37Rv
gguccagccgguccagacccagc

SEQ ID NO: 1312318 - RNA, 16 nt, Mycobacterium tuberculosis H37Rv
gguccacagccggcgg

SEQ ID NO: 1312319 - RNA, 17 nt, Mycobacterium tuberculosis H37Rv
gguccaagugggccggc

SEQ ID NO: 1312320 - RNA, 18 nt, Mycobacterium tuberculosis H37Rv
gguccaagugggccggcg

SEQ ID NO: 1312321 - RNA, 22 nt, Mycobacterium tuberculosis H37Rv
gguccaagugcuuccggccauu

SEQ ID NO: 1312322 - RNA, 17 nt, Mycobacterium tuberculosis H37Rv
gguccagacccagcucg

SEQ ID NO: 1312323 - RNA, 18 nt, Mycobacterium tuberculosis H37Rv
gguccaccggcccucgcc

SEQ ID NO: 1312324 - RNA, 19 nt, Mycobacterium tuberculosis H37Rv
gguccaacagcgccaguag

SEQ ID NO: 1312325 - RNA, 19 nt, Mycobacterium tuberculosis H37Rv
gguccaaccacgagcauca

SEQ ID NO: 1312326 - RNA, 18 nt, Mycobacterium tuberculosis H37Rv
gguccaaccgggccggcu

SEQ ID NO: 1312327 - RNA, 15 nt, Mycobacterium tuberculosis H37Rv
ggucaugucgaucag

SEQ ID NO: 1312328 - RNA, 12 nt, Mycobacterium tuberculosis H37Rv
ggugaccaacac

SEQ ID NO: 1312329 - RNA, 18 nt, Mycobacterium tuberculosis H37Rv
ggugaccaacaccccccc

SEQ ID NO: 1312330 - RNA, 17 nt, Mycobacterium tuberculosis H37Rv
ggugacccccgagaucc

SEQ ID NO: 1312331 - RNA, 16 nt, Mycobacterium tuberculosis H37Rv
ggugaccagcaggccg

SEQ ID NO: 1312332 - RNA, 16 nt, Mycobacterium tuberculosis H37Rv
ggugacccgcuauucg

SEQ ID NO: 1312333 - RNA, 16 nt, Mycobacterium tuberculosis H37Rv
ggugacccugguggug

SEQ ID NO: 1312334 - RNA, 14 nt, Mycobacterium tuberculosis H37Rv
ggugagaccagguu

SEQ ID NO: 1312335 - RNA, 15 nt, Mycobacterium tuberculosis H37Rv
ggugaggaagcggcc

SEQ ID NO: 1312336 - RNA, 16 nt, Mycobacterium tuberculosis H37Rv
ggugagcugcacgccg

SEQ ID NO: 1312337 - RNA, 23 nt, Mycobacterium tuberculosis H37Rv
ggugagggaacccacaguggcuc

SEQ ID NO: 1312338 - RNA, 13 nt, Mycobacterium tuberculosis H37Rv
ggugagccgagcc

SEQ ID NO: 1312339 - RNA, 23 nt, Mycobacterium tuberculosis H37Rv
ggugagcaccugggcgcgcuggc

SEQ ID NO: 1312340 - RNA, 15 nt, Mycobacterium tuberculosis H37Rv
ggugagcgagcgcgc

SEQ ID NO: 1312341 - RNA, 18 nt, Mycobacterium tuberculosis H37Rv
ggugagccucggcgagcc

SEQ ID NO: 1312342 - RNA, 23 nt, Mycobacterium tuberculosis H37Rv
ggucugcuauugguugaggaggu

SEQ ID NO: 1312343 - RNA, 20 nt, Mycobacterium tuberculosis H37Rv
ggugaaucgacaccgcccga

SEQ ID NO: 1312344 - RNA, 16 nt, Mycobacterium tuberculosis H37Rv
ggugacaaauggggug

SEQ ID NO: 1312345 - RNA, 19 nt, Mycobacterium tuberculosis H37Rv
ggugaaguagugcucgcag

SEQ ID NO: 1312346 - RNA, 18 nt, Mycobacterium tuberculosis H37Rv
ggucuggcaggccagcau

SEQ ID NO: 1312347 - RNA, 23 nt, Mycobacterium tuberculosis H37Rv
ggugccacugccguugccgccgg

SEQ ID NO: 1312348 - RNA, 19 nt, Mycobacterium tuberculosis H37Rv
ggugccagcacuccaccgc

SEQ ID NO: 1312349 - RNA, 19 nt, Mycobacterium tuberculosis H37Rv
ggugccacguucgcgggcg

SEQ ID NO: 1312350 - RNA, 17 nt, Mycobacterium tuberculosis H37Rv
ggugccacgaucggcgg

SEQ ID NO: 1312351 - RNA, 20 nt, Mycobacterium tuberculosis H37Rv
ggugccacccuugccgccgg

SEQ ID NO: 1312352 - RNA, 13 nt, Mycobacterium tuberculosis H37Rv
ggugccaacugcg

SEQ ID NO: 1312353 - RNA, 21 nt, Mycobacterium tuberculosis H37Rv
ggugccaccagugagcccgcu

SEQ ID NO: 1312354 - RNA, 17 nt, Mycobacterium tuberculosis H37Rv
ggugcaggugagugcgg

SEQ ID NO: 1312355 - RNA, 16 nt, Mycobacterium tuberculosis H37Rv
ggugaugggccaggcg

SEQ ID NO: 1312356 - RNA, 19 nt, Mycobacterium tuberculosis H37Rv
ggugaguccgcugagcggg

SEQ ID NO: 1312357 - RNA, 17 nt, Mycobacterium tuberculosis H37Rv
ggugaguccgcugagcg

SEQ ID NO: 1312358 - RNA, 20 nt, Mycobacterium tuberculosis H37Rv
ggugaugaucgcgccgggcu

SEQ ID NO: 1312359 - RNA, 22 nt, Mycobacterium tuberculosis H37Rv
ggugcagcuccccgccggaacu

SEQ ID NO: 1312360 - RNA, 20 nt, Mycobacterium tuberculosis H37Rv
ggugcaggauucggcggucg

SEQ ID NO: 1312361 - RNA, 13 nt, Mycobacterium tuberculosis H37Rv
ggugaugguggcg

SEQ ID NO: 1312362 - RNA, 17 nt, Mycobacterium tuberculosis H37Rv
ggugauggugaccagca

SEQ ID NO: 1312363 - RNA, 16 nt, Mycobacterium tuberculosis H37Rv
ggucgcgucggcugcc

SEQ ID NO: 1312364 - RNA, 13 nt, Mycobacterium tuberculosis H37Rv
ggucgcggcugcc

SEQ ID NO: 1312365 - RNA, 15 nt, Mycobacterium tuberculosis H37Rv
ggucggugacugugc

SEQ ID NO: 1312366 - RNA, 14 nt, Mycobacterium tuberculosis H37Rv
ggucgggcagcacu

SEQ ID NO: 1312367 - RNA, 17 nt, Mycobacterium tuberculosis H37Rv
ggucgggguccgcggca

SEQ ID NO: 1312368 - RNA, 23 nt, Mycobacterium tuberculosis H37Rv
ggucucccagaggucgagcgccu

SEQ ID NO: 1312369 - RNA, 15 nt, Mycobacterium tuberculosis H37Rv
ggucucacucaucgg

SEQ ID NO: 1312370 - RNA, 18 nt, Mycobacterium tuberculosis H37Rv
ggucguugucgggguugc

SEQ ID NO: 1312371 - RNA, 21 nt, Mycobacterium tuberculosis H37Rv
ggucggugauggucagcuggc

SEQ ID NO: 1312372 - RNA, 12 nt, Mycobacterium tuberculosis H37Rv
ggucggucaggu

SEQ ID NO: 1312373 - RNA, 13 nt, Mycobacterium tuberculosis H37Rv
ggucuacgccacc

SEQ ID NO: 1312374 - RNA, 17 nt, Mycobacterium tuberculosis H37Rv
ggucuccggaucgccga

SEQ ID NO: 1312375 - RNA, 11 nt, Mycobacterium tuberculosis H37Rv
ggucucggccg

SEQ ID NO: 1312376 - RNA, 15 nt, Mycobacterium tuberculosis H37Rv
gguccggugaacccg

SEQ ID NO: 1312377 - RNA, 21 nt, Mycobacterium tuberculosis H37Rv
gguccggcguacgccguaccc

SEQ ID NO: 1312378 - RNA, 19 nt, Mycobacterium tuberculosis H37Rv
gguccgggaagucgcugaa

SEQ ID NO: 1312379 - RNA, 13 nt, Mycobacterium tuberculosis H37Rv
gguccgcgugcug

SEQ ID NO: 1312380 - RNA, 18 nt, Mycobacterium tuberculosis H37Rv
gguccgcacgaucugcag

SEQ ID NO: 1312381 - RNA, 22 nt, Mycobacterium tuberculosis H37Rv
gguccgaugcgugccgacccgc

SEQ ID NO: 1312382 - RNA, 15 nt, Mycobacterium tuberculosis H37Rv
gguccgacagccccg

SEQ ID NO: 1312383 - RNA, 16 nt, Mycobacterium tuberculosis H37Rv
gguccgaccagcggcc

SEQ ID NO: 1312384 - RNA, 21 nt, Mycobacterium tuberculosis H37Rv
ggucccuuuguggggccgggc

SEQ ID NO: 1312385 - RNA, 17 nt, Mycobacterium tuberculosis H37Rv
ggucccuuuguggggcc

SEQ ID NO: 1312386 - RNA, 21 nt, Mycobacterium tuberculosis H37Rv
ggucccgccgccuggaaaaag

SEQ ID NO: 1312387 - RNA, 22 nt, Mycobacterium tuberculosis H37Rv
ggucccgugcgcgcgcagcuga

SEQ ID NO: 1312388 - RNA, 21 nt, Mycobacterium tuberculosis H37Rv
ggucccguugccgcccacuag

SEQ ID NO: 1312389 - RNA, 22 nt, Mycobacterium tuberculosis H37Rv
gguccguuuuaccucggccgcc

SEQ ID NO: 1312390 - RNA, 14 nt, Mycobacterium tuberculosis H37Rv
gguccucgcggagc

SEQ ID NO: 1312391 - RNA, 15 nt, Mycobacterium tuberculosis H37Rv
gguccucgucgucga

SEQ ID NO: 1312392 - RNA, 21 nt, Mycobacterium tuberculosis H37Rv
gguccucgagguccucgucgg

SEQ ID NO: 1312393 - RNA, 15 nt, Mycobacterium tuberculosis H37Rv
gguccucgucggcga

SEQ ID NO: 1312394 - RNA, 17 nt, Mycobacterium tuberculosis H37Rv
gguccugcggucgcgga

SEQ ID NO: 1312395 - RNA, 13 nt, Mycobacterium tuberculosis H37Rv
ggucgcggcgguc

SEQ ID NO: 1312396 - RNA, 22 nt, Mycobacterium tuberculosis H37Rv
ggucgcggucccacggccggcc

SEQ ID NO: 1312397 - RNA, 15 nt, Mycobacterium tuberculosis H37Rv
ggucgcgcgacggcc

SEQ ID NO: 1312398 - RNA, 18 nt, Mycobacterium tuberculosis H37Rv
ggucgcggaucucaucgg

SEQ ID NO: 1312399 - RNA, 19 nt, Mycobacterium tuberculosis H37Rv
gguccugcucgcacagcac

SEQ ID NO: 1312400 - RNA, 19 nt, Mycobacterium tuberculosis H37Rv
ggucgcgagcccgccacag

SEQ ID NO: 1312401 - RNA, 19 nt, Mycobacterium tuberculosis H37Rv
ggugugcgucuccagcugg

SEQ ID NO: 1312402 - RNA, 16 nt, Mycobacterium tuberculosis H37Rv
gguguggacugggcca

SEQ ID NO: 1312403 - RNA, 17 nt, Mycobacterium tuberculosis H37Rv
gguguucgaugggugca

SEQ ID NO: 1312404 - RNA, 22 nt, Mycobacterium tuberculosis H37Rv
gguguguuuggcauggucaggc

SEQ ID NO: 1312405 - RNA, 20 nt, Mycobacterium tuberculosis H37Rv
gguguggucaccaggccgaa

SEQ ID NO: 1312406 - RNA, 14 nt, Mycobacterium tuberculosis H37Rv
gguguacagucgcg

SEQ ID NO: 1312407 - RNA, 23 nt, Mycobacterium tuberculosis H37Rv
gguguacagucgcgcgcucgcgg

SEQ ID NO: 1312408 - RNA, 23 nt, Mycobacterium tuberculosis H37Rv
gguguaccagacgaacgaccagg

SEQ ID NO: 1312409 - RNA, 13 nt, Mycobacterium tuberculosis H37Rv
gguguacugcugc

SEQ ID NO: 1312410 - RNA, 14 nt, Mycobacterium tuberculosis H37Rv
gguguagcccagcc

SEQ ID NO: 1312411 - RNA, 20 nt, Mycobacterium tuberculosis H37Rv
gguguagcccaucggcagca

SEQ ID NO: 1312412 - RNA, 20 nt, Mycobacterium tuberculosis H37Rv
gguguagcaagucgccgagg

SEQ ID NO: 1312413 - RNA, 20 nt, Mycobacterium tuberculosis H37Rv
gguguaggccucggcagcaa

SEQ ID NO: 1312414 - RNA, 15 nt, Mycobacterium tuberculosis H37Rv
ggugugcggcagccc

SEQ ID NO: 1312415 - RNA, 21 nt, Mycobacterium tuberculosis H37Rv
ggugugcgggguugggcggag

SEQ ID NO: 1312416 - RNA, 15 nt, Mycobacterium tuberculosis H37Rv
ggugggcgggugcgc

SEQ ID NO: 1312417 - RNA, 11 nt, Mycobacterium tuberculosis H37Rv
ggugggggcgg

SEQ ID NO: 1312418 - RNA, 17 nt, Mycobacterium tuberculosis H37Rv
ggugguacagggugugc

SEQ ID NO: 1312419 - RNA, 16 nt, Mycobacterium tuberculosis H37Rv
ggugguaagacgccga

SEQ ID NO: 1312420 - RNA, 14 nt, Mycobacterium tuberculosis H37Rv
ggugggucggggcg

SEQ ID NO: 1312421 - RNA, 18 nt, Mycobacterium tuberculosis H37Rv
ggugguaccggcgccacc

SEQ ID NO: 1312422 - RNA, 15 nt, Mycobacterium tuberculosis H37Rv
gguguaacggcggcu

SEQ ID NO: 1312423 - RNA, 19 nt, Mycobacterium tuberculosis H37Rv
gguguacaccgcgcccgcc

SEQ ID NO: 1312424 - RNA, 20 nt, Mycobacterium tuberculosis H37Rv
ggugcuggugaucugcuggg

SEQ ID NO: 1312425 - RNA, 15 nt, Mycobacterium tuberculosis H37Rv
ggugcuggucgccgc

SEQ ID NO: 1312426 - RNA, 16 nt, Mycobacterium tuberculosis H37Rv
ggugcugguggcggca

SEQ ID NO: 1312427 - RNA, 19 nt, Mycobacterium tuberculosis H37Rv
ggugcugaucuugccgccg

SEQ ID NO: 1312428 - RNA, 22 nt, Mycobacterium tuberculosis H37Rv
ggugcugaccccgccggcugcg

SEQ ID NO: 1312429 - RNA, 22 nt, Mycobacterium tuberculosis H37Rv
ggugcccaagcaguccacgagc

SEQ ID NO: 1312430 - RNA, 20 nt, Mycobacterium tuberculosis H37Rv
ggugcccccugguacaccag

SEQ ID NO: 1312431 - RNA, 14 nt, Mycobacterium tuberculosis H37Rv
ggugcccggcggcc

SEQ ID NO: 1312432 - RNA, 17 nt, Mycobacterium tuberculosis H37Rv
ggugcccggccgccagc

SEQ ID NO: 1312433 - RNA, 15 nt, Mycobacterium tuberculosis H37Rv
ggugcucgggcggcg

SEQ ID NO: 1312434 - RNA, 24 nt, Mycobacterium tuberculosis H37Rv
ggugcucgucaccaaacccgaugg

SEQ ID NO: 1312435 - RNA, 13 nt, Mycobacterium tuberculosis H37Rv
gguggcagcgcac

SEQ ID NO: 1312436 - RNA, 14 nt, Mycobacterium tuberculosis H37Rv
gguggcagcacagc

SEQ ID NO: 1312437 - RNA, 20 nt, Mycobacterium tuberculosis H37Rv
gguggcaucggcggccugcu

SEQ ID NO: 1312438 - RNA, 16 nt, Mycobacterium tuberculosis H37Rv
gguggccagcacgugc

SEQ ID NO: 1312439 - RNA, 15 nt, Mycobacterium tuberculosis H37Rv
gguggcacgcugagc

SEQ ID NO: 1312440 - RNA, 16 nt, Mycobacterium tuberculosis H37Rv
gguggcacggccccug

SEQ ID NO: 1312441 - RNA, 15 nt, Mycobacterium tuberculosis H37Rv
gguggccggggugcc

SEQ ID NO: 1312442 - RNA, 23 nt, Mycobacterium tuberculosis H37Rv
gguggccaggccguaguggccgg

SEQ ID NO: 1312443 - RNA, 14 nt, Mycobacterium tuberculosis H37Rv
gguggccagcaggc

SEQ ID NO: 1312444 - RNA, 22 nt, Mycobacterium tuberculosis H37Rv
gguggccaucgcgcggaccaga

SEQ ID NO: 1312445 - RNA, 17 nt, Mycobacterium tuberculosis H37Rv
gguggccaugacggcuc

SEQ ID NO: 1312446 - RNA, 14 nt, Mycobacterium tuberculosis H37Rv
gguucgaguccugg

SEQ ID NO: 1312447 - RNA, 17 nt, Mycobacterium tuberculosis H37Rv
gguucgcacaccuccuc

SEQ ID NO: 1312448 - RNA, 20 nt, Mycobacterium tuberculosis H37Rv
gguuccgcugucgagccggu

SEQ ID NO: 1312449 - RNA, 16 nt, Mycobacterium tuberculosis H37Rv
gguuccguggauggac

SEQ ID NO: 1312450 - RNA, 22 nt, Mycobacterium tuberculosis H37Rv
gguuccgaucgcguuagccagg

SEQ ID NO: 1312451 - RNA, 18 nt, Mycobacterium tuberculosis H37Rv
gguuccgaucucaagggc

SEQ ID NO: 1312452 - RNA, 14 nt, Mycobacterium tuberculosis H37Rv
gguucccgggcagc

SEQ ID NO: 1312453 - RNA, 19 nt, Mycobacterium tuberculosis H37Rv
gguucccgggcagccgcac

SEQ ID NO: 1312454 - RNA, 15 nt, Mycobacterium tuberculosis H37Rv
gguuccacggccagg

SEQ ID NO: 1312455 - RNA, 19 nt, Mycobacterium tuberculosis H37Rv
gguucacuuccgggcagcu

SEQ ID NO: 1312456 - RNA, 21 nt, Mycobacterium tuberculosis H37Rv
gguucaucgccggcgcgccga

SEQ ID NO: 1312457 - RNA, 19 nt, Mycobacterium tuberculosis H37Rv
gguucaucgccggcgcgcc

SEQ ID NO: 1312458 - RNA, 20 nt, Mycobacterium tuberculosis H37Rv
gguucagcgcuggcaggccg

SEQ ID NO: 1312459 - RNA, 15 nt, Mycobacterium tuberculosis H37Rv
gguuaucggcagcag

SEQ ID NO: 1312460 - RNA, 20 nt, Mycobacterium tuberculosis H37Rv
gguucaaagcagcgcaccaa

SEQ ID NO: 1312461 - RNA, 11 nt, Mycobacterium tuberculosis H37Rv
gguucaaagca

SEQ ID NO: 1312462 - RNA, 17 nt, Mycobacterium tuberculosis H37Rv
gguuaucgucgggucac

SEQ ID NO: 1312463 - RNA, 13 nt, Mycobacterium tuberculosis H37Rv
gguuagcgcggcc

SEQ ID NO: 1312464 - RNA, 18 nt, Mycobacterium tuberculosis H37Rv
gguguuguaggccgggcc

SEQ ID NO: 1312465 - RNA, 15 nt, Mycobacterium tuberculosis H37Rv
gguguuguacuggcu

SEQ ID NO: 1312466 - RNA, 19 nt, Mycobacterium tuberculosis H37Rv
gguguugaugggcagccgc

SEQ ID NO: 1312467 - RNA, 17 nt, Mycobacterium tuberculosis H37Rv
gguuuucccgucgccgc

SEQ ID NO: 1312468 - RNA, 18 nt, Mycobacterium tuberculosis H37Rv
gguugagcgugucgagcg

SEQ ID NO: 1312469 - RNA, 15 nt, Mycobacterium tuberculosis H37Rv
gguugaucuuguccu

SEQ ID NO: 1312470 - RNA, 11 nt, Mycobacterium tuberculosis H37Rv
gguugccaacc

SEQ ID NO: 1312471 - RNA, 18 nt, Mycobacterium tuberculosis H37Rv
gguugccaacgaaccgcu

SEQ ID NO: 1312472 - RNA, 18 nt, Mycobacterium tuberculosis H37Rv
gguugauggaguggcugu

SEQ ID NO: 1312473 - RNA, 17 nt, Mycobacterium tuberculosis H37Rv
gguugaucaccgacacc

SEQ ID NO: 1312474 - RNA, 18 nt, Mycobacterium tuberculosis H37Rv
gguugaacgaccucugca

SEQ ID NO: 1312475 - RNA, 22 nt, Mycobacterium tuberculosis H37Rv
gguugaccgccaccccggucgg

SEQ ID NO: 1312476 - RNA, 24 nt, Mycobacterium tuberculosis H37Rv
gguucgccccugcacagcaggcuc

SEQ ID NO: 1312477 - RNA, 13 nt, Mycobacterium tuberculosis H37Rv
gguucgcccagcc

SEQ ID NO: 1312478 - RNA, 20 nt, Mycobacterium tuberculosis H37Rv
gguucgccccugcacagcag

SEQ ID NO: 1312479 - RNA, 15 nt, Mycobacterium tuberculosis H37Rv
gguucgcgguugucc

SEQ ID NO: 1312480 - RNA, 21 nt, Mycobacterium tuberculosis H37Rv
gguucggacacacaggcggcg

SEQ ID NO: 1312481 - RNA, 17 nt, Mycobacterium tuberculosis H37Rv
gguucuuccacagcgcg

SEQ ID NO: 1312482 - RNA, 23 nt, Mycobacterium tuberculosis H37Rv
gguucuguuccagaaggccgcac

SEQ ID NO: 1312483 - RNA, 15 nt, Mycobacterium tuberculosis H37Rv
gguugccggcggcga

SEQ ID NO: 1312484 - RNA, 14 nt, Mycobacterium tuberculosis H37Rv
gguugccggcggcg

SEQ ID NO: 1312485 - RNA, 14 nt, Mycobacterium tuberculosis H37Rv
gguugccugugcgg

SEQ ID NO: 1312486 - RNA, 16 nt, Mycobacterium tuberculosis H37Rv
gguugcccccagggcc

SEQ ID NO: 1312487 - RNA, 19 nt, Mycobacterium tuberculosis H37Rv
gguugcggcagcuggcgca

SEQ ID NO: 1312488 - RNA, 15 nt, Mycobacterium tuberculosis H37Rv
gguuggaugccugcc

SEQ ID NO: 1312489 - RNA, 20 nt, Mycobacterium tuberculosis H37Rv
gguuggagcgccagccgcug

SEQ ID NO: 1312490 - RNA, 15 nt, Mycobacterium tuberculosis H37Rv
gguuggucggugcug

SEQ ID NO: 1312491 - RNA, 15 nt, Mycobacterium tuberculosis H37Rv
gguuggccgggcugg

SEQ ID NO: 1312492 - RNA, 13 nt, Mycobacterium tuberculosis H37Rv
gguugguccucgg

SEQ ID NO: 1312493 - RNA, 13 nt, Mycobacterium tuberculosis H37Rv
gguuguccucggc

SEQ ID NO: 1312494 - RNA, 12 nt, Mycobacterium tuberculosis H37Rv
gguugggugugc

SEQ ID NO: 1312495 - RNA, 19 nt, Mycobacterium tuberculosis H37Rv
gguugggguggcggugccg

SEQ ID NO: 1312496 - RNA, 22 nt, Mycobacterium tuberculosis H37Rv
gguuggcggcugcacgcugcgg

SEQ ID NO: 1312497 - RNA, 20 nt, Mycobacterium tuberculosis H37Rv
guaauccacacacagccggu

SEQ ID NO: 1312498 - RNA, 17 nt, Mycobacterium tuberculosis H37Rv
guaauccgagcgcggcg

SEQ ID NO: 1312499 - RNA, 21 nt, Mycobacterium tuberculosis H37Rv
guacacguaccgguccagugu

SEQ ID NO: 1312500 - RNA, 18 nt, Mycobacterium tuberculosis H37Rv
guacacccgcucgcccgc

SEQ ID NO: 1312501 - RNA, 17 nt, Mycobacterium tuberculosis H37Rv
guacaccagggugccgg

SEQ ID NO: 1312502 - RNA, 13 nt, Mycobacterium tuberculosis H37Rv
guacagacacgcg

SEQ ID NO: 1312503 - RNA, 17 nt, Mycobacterium tuberculosis H37Rv
guacagacacgcgcgcu

SEQ ID NO: 1312504 - RNA, 18 nt, Mycobacterium tuberculosis H37Rv
guacagacacgcgcgcuc

SEQ ID NO: 1312505 - RNA, 21 nt, Mycobacterium tuberculosis H37Rv
guacagaucgagggggacgcu

SEQ ID NO: 1312506 - RNA, 14 nt, Mycobacterium tuberculosis H37Rv
guacagcggcggcg

SEQ ID NO: 1312507 - RNA, 15 nt, Mycobacterium tuberculosis H37Rv
guacaggcuguccag

SEQ ID NO: 1312508 - RNA, 22 nt, Mycobacterium tuberculosis H37Rv
guacacauaggugcggggccgg

SEQ ID NO: 1312509 - RNA, 13 nt, Mycobacterium tuberculosis H37Rv
guacacagacccg

SEQ ID NO: 1312510 - RNA, 16 nt, Mycobacterium tuberculosis H37Rv
guacaacgacacgccg

SEQ ID NO: 1312511 - RNA, 22 nt, Mycobacterium tuberculosis H37Rv
guaccagggugucgucuugcgu

SEQ ID NO: 1312512 - RNA, 13 nt, Mycobacterium tuberculosis H37Rv
guaccagcuggcc

SEQ ID NO: 1312513 - RNA, 15 nt, Mycobacterium tuberculosis H37Rv
guaccagcccgccgu

SEQ ID NO: 1312514 - RNA, 16 nt, Mycobacterium tuberculosis H37Rv
guaccagcccagcggc

SEQ ID NO: 1312515 - RNA, 20 nt, Mycobacterium tuberculosis H37Rv
guaccagcccagcggcuggu

SEQ ID NO: 1312516 - RNA, 18 nt, Mycobacterium tuberculosis H37Rv
guacgaucgugagacgcc

SEQ ID NO: 1312517 - RNA, 23 nt, Mycobacterium tuberculosis H37Rv
guacgacccccgaucaggccgac

SEQ ID NO: 1312518 - RNA, 17 nt, Mycobacterium tuberculosis H37Rv
guacgaacugcugauga

SEQ ID NO: 1312519 - RNA, 19 nt, Mycobacterium tuberculosis H37Rv
guacgccaggugcagcacc

SEQ ID NO: 1312520 - RNA, 17 nt, Mycobacterium tuberculosis H37Rv
guacucggcauccaggc

SEQ ID NO: 1312521 - RNA, 14 nt, Mycobacterium tuberculosis H37Rv
guagcgggggagcg

SEQ ID NO: 1312522 - RNA, 16 nt, Mycobacterium tuberculosis H37Rv
guagcggcgccgcccu

SEQ ID NO: 1312523 - RNA, 22 nt, Mycobacterium tuberculosis H37Rv
guagcgggcaaacgaacgggug

SEQ ID NO: 1312524 - RNA, 13 nt, Mycobacterium tuberculosis H37Rv
guagccggccgcu

SEQ ID NO: 1312525 - RNA, 15 nt, Mycobacterium tuberculosis H37Rv
guagccgcccucccu

SEQ ID NO: 1312526 - RNA, 17 nt, Mycobacterium tuberculosis H37Rv
guagccgaccggcagcg

SEQ ID NO: 1312527 - RNA, 14 nt, Mycobacterium tuberculosis H37Rv
guagccgcugcacg

SEQ ID NO: 1312528 - RNA, 14 nt, Mycobacterium tuberculosis H37Rv
guagcccagccggg

SEQ ID NO: 1312529 - RNA, 22 nt, Mycobacterium tuberculosis H37Rv
guagccauucgguguggccgug

SEQ ID NO: 1312530 - RNA, 14 nt, Mycobacterium tuberculosis H37Rv
guagccacgcccac

SEQ ID NO: 1312531 - RNA, 19 nt, Mycobacterium tuberculosis H37Rv
guagccaagcgagcggucg

SEQ ID NO: 1312532 - RNA, 15 nt, Mycobacterium tuberculosis H37Rv
guagcagcgccagca

SEQ ID NO: 1312533 - RNA, 14 nt, Mycobacterium tuberculosis H37Rv
guagcaacccagga

SEQ ID NO: 1312534 - RNA, 18 nt, Mycobacterium tuberculosis H37Rv
guagacaggaccgguggg

SEQ ID NO: 1312535 - RNA, 19 nt, Mycobacterium tuberculosis H37Rv
guagacauuggcuccgaac

SEQ ID NO: 1312536 - RNA, 21 nt, Mycobacterium tuberculosis H37Rv
guagaaugcgccgucgguggg

SEQ ID NO: 1312537 - RNA, 13 nt, Mycobacterium tuberculosis H37Rv
guagaagcgggcg

SEQ ID NO: 1312538 - RNA, 18 nt, Mycobacterium tuberculosis H37Rv
guagaacgcuagcgccaa

SEQ ID NO: 1312539 - RNA, 15 nt, Mycobacterium tuberculosis H37Rv
guagaagcccaggac

SEQ ID NO: 1312540 - RNA, 19 nt, Mycobacterium tuberculosis H37Rv
guauagcucacgguggccg

SEQ ID NO: 1312541 - RNA, 18 nt, Mycobacterium tuberculosis H37Rv
guauagcgcacugccggg

SEQ ID NO: 1312542 - RNA, 14 nt, Mycobacterium tuberculosis H37Rv
guauagaccaggua

SEQ ID NO: 1312543 - RNA, 23 nt, Mycobacterium tuberculosis H37Rv
guaucaacagauuucauuguccc

SEQ ID NO: 1312544 - RNA, 22 nt, Mycobacterium tuberculosis H37Rv
guagcuggugcguagcccaccc

SEQ ID NO: 1312545 - RNA, 12 nt, Mycobacterium tuberculosis H37Rv
guagcugcgcag

SEQ ID NO: 1312546 - RNA, 16 nt, Mycobacterium tuberculosis H37Rv
guagcugcgcagcgca

SEQ ID NO: 1312547 - RNA, 22 nt, Mycobacterium tuberculosis H37Rv
guaggacaccaccguggccucg

SEQ ID NO: 1312548 - RNA, 20 nt, Mycobacterium tuberculosis H37Rv
guauccaugucgcgccaggc

SEQ ID NO: 1312549 - RNA, 14 nt, Mycobacterium tuberculosis H37Rv
guauccgacuggcc

SEQ ID NO: 1312550 - RNA, 19 nt, Mycobacterium tuberculosis H37Rv
guauccgacuggccccgcc

SEQ ID NO: 1312551 - RNA, 20 nt, Mycobacterium tuberculosis H37Rv
guauccggcagaccggugcu

SEQ ID NO: 1312552 - RNA, 16 nt, Mycobacterium tuberculosis H37Rv
guauggccgccaccgc

SEQ ID NO: 1312553 - RNA, 14 nt, Mycobacterium tuberculosis H37Rv
guaugucccggugc

SEQ ID NO: 1312554 - RNA, 20 nt, Mycobacterium tuberculosis H37Rv
guaugauucacgcucggcgu

SEQ ID NO: 1312555 - RNA, 19 nt, Mycobacterium tuberculosis H37Rv
guaugccgccaaccgcgug

SEQ ID NO: 1312556 - RNA, 15 nt, Mycobacterium tuberculosis H37Rv
guaucgacggcggcc

SEQ ID NO: 1312557 - RNA, 13 nt, Mycobacterium tuberculosis H37Rv
guaucucggcucc

SEQ ID NO: 1312558 - RNA, 16 nt, Mycobacterium tuberculosis H37Rv
gucacgaucgugccgg

SEQ ID NO: 1312559 - RNA, 15 nt, Mycobacterium tuberculosis H37Rv
gucaccuuggccggg

SEQ ID NO: 1312560 - RNA, 16 nt, Mycobacterium tuberculosis H37Rv
gucaccggucaccgcg

SEQ ID NO: 1312561 - RNA, 21 nt, Mycobacterium tuberculosis H37Rv
gucaccggucaccgcgcagcg

SEQ ID NO: 1312562 - RNA, 23 nt, Mycobacterium tuberculosis H37Rv
gucaccugcaucgucgccaagcc

SEQ ID NO: 1312563 - RNA, 17 nt, Mycobacterium tuberculosis H37Rv
gucaccguuggccgcgc

SEQ ID NO: 1312564 - RNA, 19 nt, Mycobacterium tuberculosis H37Rv
gucaccgucugcaccggca

SEQ ID NO: 1312565 - RNA, 19 nt, Mycobacterium tuberculosis H37Rv
gucaccacgaucgcagugg

SEQ ID NO: 1312566 - RNA, 21 nt, Mycobacterium tuberculosis H37Rv
gucaccaggccgaaauccaga

SEQ ID NO: 1312567 - RNA, 13 nt, Mycobacterium tuberculosis H37Rv
gucaccagccacc

SEQ ID NO: 1312568 - RNA, 16 nt, Mycobacterium tuberculosis H37Rv
gucaccagccaccgcg

SEQ ID NO: 1312569 - RNA, 15 nt, Mycobacterium tuberculosis H37Rv
gucacaguucugccu

SEQ ID NO: 1312570 - RNA, 15 nt, Mycobacterium tuberculosis H37Rv
gucacauagcucaac

SEQ ID NO: 1312571 - RNA, 18 nt, Mycobacterium tuberculosis H37Rv
gucacauccgacagcagc

SEQ ID NO: 1312572 - RNA, 13 nt, Mycobacterium tuberculosis H37Rv
gucacagcucacc

SEQ ID NO: 1312573 - RNA, 15 nt, Mycobacterium tuberculosis H37Rv
gucacagcucaccau

SEQ ID NO: 1312574 - RNA, 23 nt, Mycobacterium tuberculosis H37Rv
gucacaacgcgugaccagggccu

SEQ ID NO: 1312575 - RNA, 16 nt, Mycobacterium tuberculosis H37Rv
gucacaccgaugcguu

SEQ ID NO: 1312576 - RNA, 17 nt, Mycobacterium tuberculosis H37Rv
gucaaguggcaaccgca

SEQ ID NO: 1312577 - RNA, 18 nt, Mycobacterium tuberculosis H37Rv
gucaaguucgccagcaac

SEQ ID NO: 1312578 - RNA, 16 nt, Mycobacterium tuberculosis H37Rv
guauugauacugcccg

SEQ ID NO: 1312579 - RNA, 15 nt, Mycobacterium tuberculosis H37Rv
guauugauccaggua

SEQ ID NO: 1312580 - RNA, 21 nt, Mycobacterium tuberculosis H37Rv
guauuccgggguaucgacccu

SEQ ID NO: 1312581 - RNA, 21 nt, Mycobacterium tuberculosis H37Rv
guauuugccgugcucaccggc

SEQ ID NO: 1312582 - RNA, 12 nt, Mycobacterium tuberculosis H37Rv
guccagcccaga

SEQ ID NO: 1312583 - RNA, 17 nt, Mycobacterium tuberculosis H37Rv
guccagccggcgcgccg

SEQ ID NO: 1312584 - RNA, 19 nt, Mycobacterium tuberculosis H37Rv
guccagcgauccggggcug

SEQ ID NO: 1312585 - RNA, 15 nt, Mycobacterium tuberculosis H37Rv
guccagcgcggccuu

SEQ ID NO: 1312586 - RNA, 18 nt, Mycobacterium tuberculosis H37Rv
guccaggagugcgggcau

SEQ ID NO: 1312587 - RNA, 13 nt, Mycobacterium tuberculosis H37Rv
guccagcgggcau

SEQ ID NO: 1312588 - RNA, 20 nt, Mycobacterium tuberculosis H37Rv
guccagcgggaucugaccca

SEQ ID NO: 1312589 - RNA, 15 nt, Mycobacterium tuberculosis H37Rv
guccauguaauucaa

SEQ ID NO: 1312590 - RNA, 15 nt, Mycobacterium tuberculosis H37Rv
guccagugcauuccc

SEQ ID NO: 1312591 - RNA, 18 nt, Mycobacterium tuberculosis H37Rv
guccaguggcagccagcg

SEQ ID NO: 1312592 - RNA, 21 nt, Mycobacterium tuberculosis H37Rv
guccagguccaaguccuccac

SEQ ID NO: 1312593 - RNA, 15 nt, Mycobacterium tuberculosis H37Rv
guccaggcgcugcag

SEQ ID NO: 1312594 - RNA, 16 nt, Mycobacterium tuberculosis H37Rv
guccaggcccuggcca

SEQ ID NO: 1312595 - RNA, 15 nt, Mycobacterium tuberculosis H37Rv
guccagaacgguggc

SEQ ID NO: 1312596 - RNA, 17 nt, Mycobacterium tuberculosis H37Rv
guccagacccagcucgu

SEQ ID NO: 1312597 - RNA, 13 nt, Mycobacterium tuberculosis H37Rv
guccagcaccggg

SEQ ID NO: 1312598 - RNA, 14 nt, Mycobacterium tuberculosis H37Rv
guccagcaccugcc

SEQ ID NO: 1312599 - RNA, 24 nt, Mycobacterium tuberculosis H37Rv
guccagccaacgggaacaacggcg

SEQ ID NO: 1312600 - RNA, 17 nt, Mycobacterium tuberculosis H37Rv
guccagcagcucggccg

SEQ ID NO: 1312601 - RNA, 14 nt, Mycobacterium tuberculosis H37Rv
guccacgggccggg

SEQ ID NO: 1312602 - RNA, 15 nt, Mycobacterium tuberculosis H37Rv
guccacgggccgggc

SEQ ID NO: 1312603 - RNA, 16 nt, Mycobacterium tuberculosis H37Rv
guccacguucggcugc

SEQ ID NO: 1312604 - RNA, 21 nt, Mycobacterium tuberculosis H37Rv
guccacgcaccacgagcagcc

SEQ ID NO: 1312605 - RNA, 16 nt, Mycobacterium tuberculosis H37Rv
guccacgccgugcuug

SEQ ID NO: 1312606 - RNA, 14 nt, Mycobacterium tuberculosis H37Rv
guccacgacagcag

SEQ ID NO: 1312607 - RNA, 13 nt, Mycobacterium tuberculosis H37Rv
guccaccaccugg

SEQ ID NO: 1312608 - RNA, 20 nt, Mycobacterium tuberculosis H37Rv
guccacauccagggugccgg

SEQ ID NO: 1312609 - RNA, 14 nt, Mycobacterium tuberculosis H37Rv
guccaccccgccga

SEQ ID NO: 1312610 - RNA, 23 nt, Mycobacterium tuberculosis H37Rv
guccaccgacguggccagcccgc

SEQ ID NO: 1312611 - RNA, 20 nt, Mycobacterium tuberculosis H37Rv
guccaccgcggcgucgccgu

SEQ ID NO: 1312612 - RNA, 21 nt, Mycobacterium tuberculosis H37Rv
gucaugggaucaggcugggca

SEQ ID NO: 1312613 - RNA, 22 nt, Mycobacterium tuberculosis H37Rv
gucaugggaucaggcugggcag

SEQ ID NO: 1312614 - RNA, 23 nt, Mycobacterium tuberculosis H37Rv
gucaugggcggcuucgaugucgu

SEQ ID NO: 1312615 - RNA, 17 nt, Mycobacterium tuberculosis H37Rv
guccaaccgggccggcu

SEQ ID NO: 1312616 - RNA, 17 nt, Mycobacterium tuberculosis H37Rv
guccaacucggcccggg

SEQ ID NO: 1312617 - RNA, 21 nt, Mycobacterium tuberculosis H37Rv
guccaagcugucaagcgggcu

SEQ ID NO: 1312618 - RNA, 17 nt, Mycobacterium tuberculosis H37Rv
guccaagugcuuccggc

SEQ ID NO: 1312619 - RNA, 13 nt, Mycobacterium tuberculosis H37Rv
guccaacagcgcc

SEQ ID NO: 1312620 - RNA, 21 nt, Mycobacterium tuberculosis H37Rv
guccaccacaccugcggcugc

SEQ ID NO: 1312621 - RNA, 22 nt, Mycobacterium tuberculosis H37Rv
guccaagccggcugcauccucc

SEQ ID NO: 1312622 - RNA, 15 nt, Mycobacterium tuberculosis H37Rv
gucauccuugagguc

SEQ ID NO: 1312623 - RNA, 22 nt, Mycobacterium tuberculosis H37Rv
gucauccggccgucggcgggca

SEQ ID NO: 1312624 - RNA, 21 nt, Mycobacterium tuberculosis H37Rv
gucaucccuuucgcgccgcga

SEQ ID NO: 1312625 - RNA, 16 nt, Mycobacterium tuberculosis H37Rv
gucauccgacaagcug

SEQ ID NO: 1312626 - RNA, 13 nt, Mycobacterium tuberculosis H37Rv
gucauccgcggca

SEQ ID NO: 1312627 - RNA, 20 nt, Mycobacterium tuberculosis H37Rv
gucaucaugucgagguucca

SEQ ID NO: 1312628 - RNA, 15 nt, Mycobacterium tuberculosis H37Rv
gucaucaacguucaa

SEQ ID NO: 1312629 - RNA, 23 nt, Mycobacterium tuberculosis H37Rv
gucgacaccgaggaccucgucac

SEQ ID NO: 1312630 - RNA, 12 nt, Mycobacterium tuberculosis H37Rv
gucgaaguggua

SEQ ID NO: 1312631 - RNA, 20 nt, Mycobacterium tuberculosis H37Rv
gucgacaggugccagaccag

SEQ ID NO: 1312632 - RNA, 14 nt, Mycobacterium tuberculosis H37Rv
gucgaccaggccac

SEQ ID NO: 1312633 - RNA, 15 nt, Mycobacterium tuberculosis H37Rv
gucgaccaggccacu

SEQ ID NO: 1312634 - RNA, 17 nt, Mycobacterium tuberculosis H37Rv
gucgaccgcggcccgga

SEQ ID NO: 1312635 - RNA, 12 nt, Mycobacterium tuberculosis H37Rv
gucgacccagca

SEQ ID NO: 1312636 - RNA, 19 nt, Mycobacterium tuberculosis H37Rv
gucgacccccugccacagc

SEQ ID NO: 1312637 - RNA, 16 nt, Mycobacterium tuberculosis H37Rv
gucgacgacguggcug

SEQ ID NO: 1312638 - RNA, 13 nt, Mycobacterium tuberculosis H37Rv
gucgacgagaucc

SEQ ID NO: 1312639 - RNA, 15 nt, Mycobacterium tuberculosis H37Rv
gucgacgccgcagcg

SEQ ID NO: 1312640 - RNA, 14 nt, Mycobacterium tuberculosis H37Rv
gucgacgcaugggu

SEQ ID NO: 1312641 - RNA, 15 nt, Mycobacterium tuberculosis H37Rv
gucgacgaucgucuu

SEQ ID NO: 1312642 - RNA, 19 nt, Mycobacterium tuberculosis H37Rv
gucgacuccagcaccagca

SEQ ID NO: 1312643 - RNA, 14 nt, Mycobacterium tuberculosis H37Rv
gucgacuccagcac

SEQ ID NO: 1312644 - RNA, 16 nt, Mycobacterium tuberculosis H37Rv
gucgacggcuccuccg

SEQ ID NO: 1312645 - RNA, 22 nt, Mycobacterium tuberculosis H37Rv
gucgacgugugccguccccggc

SEQ ID NO: 1312646 - RNA, 23 nt, Mycobacterium tuberculosis H37Rv
gucgacgucucuggugcagguga

SEQ ID NO: 1312647 - RNA, 19 nt, Mycobacterium tuberculosis H37Rv
gucgacggaaucgucggcg

SEQ ID NO: 1312648 - RNA, 15 nt, Mycobacterium tuberculosis H37Rv
gucgacggccacccc

SEQ ID NO: 1312649 - RNA, 22 nt, Mycobacterium tuberculosis H37Rv
gucgagcaccacccgggccucg

SEQ ID NO: 1312650 - RNA, 21 nt, Mycobacterium tuberculosis H37Rv
gucgacuccagcaccagcacg

SEQ ID NO: 1312651 - RNA, 22 nt, Mycobacterium tuberculosis H37Rv
gucgagacgcuuuccgccgcac

SEQ ID NO: 1312652 - RNA, 12 nt, Mycobacterium tuberculosis H37Rv
gucgaacgcccc

SEQ ID NO: 1312653 - RNA, 19 nt, Mycobacterium tuberculosis H37Rv
gucgaagaaccggccgacg

SEQ ID NO: 1312654 - RNA, 14 nt, Mycobacterium tuberculosis H37Rv
gucgaacaugaucc

SEQ ID NO: 1312655 - RNA, 13 nt, Mycobacterium tuberculosis H37Rv
gucgaaauacccg

SEQ ID NO: 1312656 - RNA, 18 nt, Mycobacterium tuberculosis H37Rv
gucgaagaugaccugauc

SEQ ID NO: 1312657 - RNA, 20 nt, Mycobacterium tuberculosis H37Rv
gucgaagagguggggcagga

SEQ ID NO: 1312658 - RNA, 22 nt, Mycobacterium tuberculosis H37Rv
gucgaagggaucacgaccgcgc

SEQ ID NO: 1312659 - RNA, 13 nt, Mycobacterium tuberculosis H37Rv
gucgaagagcagg

SEQ ID NO: 1312660 - RNA, 23 nt, Mycobacterium tuberculosis H37Rv
gucgaaacgguacgccgccgcga

SEQ ID NO: 1312661 - RNA, 17 nt, Mycobacterium tuberculosis H37Rv
guccuuguuguggugga

SEQ ID NO: 1312662 - RNA, 19 nt, Mycobacterium tuberculosis H37Rv
guccucggcggacccggug

SEQ ID NO: 1312663 - RNA, 19 nt, Mycobacterium tuberculosis H37Rv
guccucgcggagccgucgc

SEQ ID NO: 1312664 - RNA, 19 nt, Mycobacterium tuberculosis H37Rv
guccucgccgcacgccggc

SEQ ID NO: 1312665 - RNA, 16 nt, Mycobacterium tuberculosis H37Rv
guccucgauccgggcg

SEQ ID NO: 1312666 - RNA, 22 nt, Mycobacterium tuberculosis H37Rv
guccucccauucccaacacagc

SEQ ID NO: 1312667 - RNA, 22 nt, Mycobacterium tuberculosis H37Rv
guccucccaucccaugucgagg

SEQ ID NO: 1312668 - RNA, 18 nt, Mycobacterium tuberculosis H37Rv
guccucgagugccgccgu

SEQ ID NO: 1312669 - RNA, 19 nt, Mycobacterium tuberculosis H37Rv
guccuccuucggugguggg

SEQ ID NO: 1312670 - RNA, 22 nt, Mycobacterium tuberculosis H37Rv
guccucgaaacgcuuacccagc

SEQ ID NO: 1312671 - RNA, 17 nt, Mycobacterium tuberculosis H37Rv
gucccgguguccagcca

SEQ ID NO: 1312672 - RNA, 19 nt, Mycobacterium tuberculosis H37Rv
gucccggcggucagcggcu

SEQ ID NO: 1312673 - RNA, 20 nt, Mycobacterium tuberculosis H37Rv
gucccggcgguuggugcagc

SEQ ID NO: 1312674 - RNA, 12 nt, Mycobacterium tuberculosis H37Rv
gucccggcuggg

SEQ ID NO: 1312675 - RNA, 19 nt, Mycobacterium tuberculosis H37Rv
gucccacaccuccucgagc

SEQ ID NO: 1312676 - RNA, 22 nt, Mycobacterium tuberculosis H37Rv
guccauguuuugcugcaugccg

SEQ ID NO: 1312677 - RNA, 14 nt, Mycobacterium tuberculosis H37Rv
guccgaccagcggc

SEQ ID NO: 1312678 - RNA, 15 nt, Mycobacterium tuberculosis H37Rv
guccgaaccaccugu

SEQ ID NO: 1312679 - RNA, 17 nt, Mycobacterium tuberculosis H37Rv
guccgacaccggcggca

SEQ ID NO: 1312680 - RNA, 21 nt, Mycobacterium tuberculosis H37Rv
guccgaaguacuggccgccgc

SEQ ID NO: 1312681 - RNA, 19 nt, Mycobacterium tuberculosis H37Rv
gucccugugucgccgucgc

SEQ ID NO: 1312682 - RNA, 14 nt, Mycobacterium tuberculosis H37Rv
gucccucggcggcg

SEQ ID NO: 1312683 - RNA, 16 nt, Mycobacterium tuberculosis H37Rv
gucccugaagccagcg

SEQ ID NO: 1312684 - RNA, 19 nt, Mycobacterium tuberculosis H37Rv
gucccgguguccagccacg

SEQ ID NO: 1312685 - RNA, 20 nt, Mycobacterium tuberculosis H37Rv
gucccgugcgcgcgcagcug

SEQ ID NO: 1312686 - RNA, 19 nt, Mycobacterium tuberculosis H37Rv
gucccguucgcccgcccgu

SEQ ID NO: 1312687 - RNA, 19 nt, Mycobacterium tuberculosis H37Rv
guccguggacaagcacagc

SEQ ID NO: 1312688 - RNA, 20 nt, Mycobacterium tuberculosis H37Rv
guccgucagcaccccgccgc

SEQ ID NO: 1312689 - RNA, 16 nt, Mycobacterium tuberculosis H37Rv
guccgucggucgccgg

SEQ ID NO: 1312690 - RNA, 23 nt, Mycobacterium tuberculosis H37Rv
guccggggcaacgaucagguugg

SEQ ID NO: 1312691 - RNA, 14 nt, Mycobacterium tuberculosis H37Rv
guccggggcgcagg

SEQ ID NO: 1312692 - RNA, 16 nt, Mycobacterium tuberculosis H37Rv
guccgggucaccagcg

SEQ ID NO: 1312693 - RNA, 18 nt, Mycobacterium tuberculosis H37Rv
guccgcugguggucagca

SEQ ID NO: 1312694 - RNA, 14 nt, Mycobacterium tuberculosis H37Rv
guccggugcaccag

SEQ ID NO: 1312695 - RNA, 20 nt, Mycobacterium tuberculosis H37Rv
guccggucgccaagugcagg

SEQ ID NO: 1312696 - RNA, 21 nt, Mycobacterium tuberculosis H37Rv
guccgguagcuguggugguga

SEQ ID NO: 1312697 - RNA, 18 nt, Mycobacterium tuberculosis H37Rv
guccgguauugaucgaau

SEQ ID NO: 1312698 - RNA, 22 nt, Mycobacterium tuberculosis H37Rv
guccgagcguaaugcugcugca

SEQ ID NO: 1312699 - RNA, 20 nt, Mycobacterium tuberculosis H37Rv
guccgagcguaaugcugcug

SEQ ID NO: 1312700 - RNA, 20 nt, Mycobacterium tuberculosis H37Rv
guccgccguugccgaucccc

SEQ ID NO: 1312701 - RNA, 14 nt, Mycobacterium tuberculosis H37Rv
guccgccugcaccg

SEQ ID NO: 1312702 - RNA, 20 nt, Mycobacterium tuberculosis H37Rv
guccgccggauagcaccggc

SEQ ID NO: 1312703 - RNA, 18 nt, Mycobacterium tuberculosis H37Rv
guccgcggguagcgguuc

SEQ ID NO: 1312704 - RNA, 13 nt, Mycobacterium tuberculosis H37Rv
guccgcggccacc

SEQ ID NO: 1312705 - RNA, 20 nt, Mycobacterium tuberculosis H37Rv
guccgcggucgcagcagacc

SEQ ID NO: 1312706 - RNA, 15 nt, Mycobacterium tuberculosis H37Rv
guccgcgcccgagcc

SEQ ID NO: 1312707 - RNA, 12 nt, Mycobacterium tuberculosis H37Rv
guccgcucgccg

SEQ ID NO: 1312708 - RNA, 16 nt, Mycobacterium tuberculosis H37Rv
guccgcugagcgggca

SEQ ID NO: 1312709 - RNA, 12 nt, Mycobacterium tuberculosis H37Rv
guccgcggccac

SEQ ID NO: 1312710 - RNA, 15 nt, Mycobacterium tuberculosis H37Rv
guccgcgggccgcgc

SEQ ID NO: 1312711 - RNA, 17 nt, Mycobacterium tuberculosis H37Rv
guccgcgcucagcuccg

SEQ ID NO: 1312712 - RNA, 21 nt, Mycobacterium tuberculosis H37Rv
gucgggcagauucuucaccca

SEQ ID NO: 1312713 - RNA, 14 nt, Mycobacterium tuberculosis H37Rv
gucgggcaugacga

SEQ ID NO: 1312714 - RNA, 21 nt, Mycobacterium tuberculosis H37Rv
gucgggagagugguugcgccc

SEQ ID NO: 1312715 - RNA, 21 nt, Mycobacterium tuberculosis H37Rv
gucgggcacaccgacgccgcc

SEQ ID NO: 1312716 - RNA, 16 nt, Mycobacterium tuberculosis H37Rv
gucggcuggacggcgc

SEQ ID NO: 1312717 - RNA, 13 nt, Mycobacterium tuberculosis H37Rv
gucggcugccgcg

SEQ ID NO: 1312718 - RNA, 18 nt, Mycobacterium tuberculosis H37Rv
gucggcugccgcggcugc

SEQ ID NO: 1312719 - RNA, 18 nt, Mycobacterium tuberculosis H37Rv
gucggcguugaucgacau

SEQ ID NO: 1312720 - RNA, 17 nt, Mycobacterium tuberculosis H37Rv
gucggcuuccuccucgg

SEQ ID NO: 1312721 - RNA, 21 nt, Mycobacterium tuberculosis H37Rv
gucggcugauuggcccaccgc

SEQ ID NO: 1312722 - RNA, 20 nt, Mycobacterium tuberculosis H37Rv
gucggcuaccgccgaccgga

SEQ ID NO: 1312723 - RNA, 22 nt, Mycobacterium tuberculosis H37Rv
gucgggcuugacccuugggcac

SEQ ID NO: 1312724 - RNA, 16 nt, Mycobacterium tuberculosis H37Rv
gucggggaacgcggcg

SEQ ID NO: 1312725 - RNA, 20 nt, Mycobacterium tuberculosis H37Rv
gucggggaagacgaccgugc

SEQ ID NO: 1312726 - RNA, 22 nt, Mycobacterium tuberculosis H37Rv
gucggggaagacgaccgugcug

SEQ ID NO: 1312727 - RNA, 13 nt, Mycobacterium tuberculosis H37Rv
gucgggccaggcg

SEQ ID NO: 1312728 - RNA, 18 nt, Mycobacterium tuberculosis H37Rv
gucgggcccccggcagca

SEQ ID NO: 1312729 - RNA, 16 nt, Mycobacterium tuberculosis H37Rv
gucgggccgcaacugc

SEQ ID NO: 1312730 - RNA, 14 nt, Mycobacterium tuberculosis H37Rv
gucgggcggcgucg

SEQ ID NO: 1312731 - RNA, 17 nt, Mycobacterium tuberculosis H37Rv
gucgggcuccgugguug

SEQ ID NO: 1312732 - RNA, 22 nt, Mycobacterium tuberculosis H37Rv
gucgggguguucgaugggugca

SEQ ID NO: 1312733 - RNA, 24 nt, Mycobacterium tuberculosis H37Rv
gucggggucguugaggccggugaa

SEQ ID NO: 1312734 - RNA, 16 nt, Mycobacterium tuberculosis H37Rv
gucgggguccgcggca

SEQ ID NO: 1312735 - RNA, 18 nt, Mycobacterium tuberculosis H37Rv
gucggguaccacgcuggc

SEQ ID NO: 1312736 - RNA, 22 nt, Mycobacterium tuberculosis H37Rv
gucggguaaauauugcgcccgg

SEQ ID NO: 1312737 - RNA, 20 nt, Mycobacterium tuberculosis H37Rv
gucgggucccuuguggucug

SEQ ID NO: 1312738 - RNA, 22 nt, Mycobacterium tuberculosis H37Rv
gucgggucgcaccccggcggcg

SEQ ID NO: 1312739 - RNA, 15 nt, Mycobacterium tuberculosis H37Rv
gucggguggcugcug

SEQ ID NO: 1312740 - RNA, 14 nt, Mycobacterium tuberculosis H37Rv
gucggccagcagau

SEQ ID NO: 1312741 - RNA, 12 nt, Mycobacterium tuberculosis H37Rv
gucggccaggcc

SEQ ID NO: 1312742 - RNA, 14 nt, Mycobacterium tuberculosis H37Rv
gucggccaggccac

SEQ ID NO: 1312743 - RNA, 12 nt, Mycobacterium tuberculosis H37Rv
gucggccaggcu

SEQ ID NO: 1312744 - RNA, 14 nt, Mycobacterium tuberculosis H37Rv
gucggcgaccaggu

SEQ ID NO: 1312745 - RNA, 15 nt, Mycobacterium tuberculosis H37Rv
gucggcgaccgcgcu

SEQ ID NO: 1312746 - RNA, 17 nt, Mycobacterium tuberculosis H37Rv
gucggcgacguccaguc

SEQ ID NO: 1312747 - RNA, 16 nt, Mycobacterium tuberculosis H37Rv
gucggcgagcgcccgc

SEQ ID NO: 1312748 - RNA, 23 nt, Mycobacterium tuberculosis H37Rv
gucggccgccuucuccggcguca

SEQ ID NO: 1312749 - RNA, 13 nt, Mycobacterium tuberculosis H37Rv
gucggccggcggu

SEQ ID NO: 1312750 - RNA, 22 nt, Mycobacterium tuberculosis H37Rv
gucggcggguagaaccagcccg

SEQ ID NO: 1312751 - RNA, 15 nt, Mycobacterium tuberculosis H37Rv
gucggcgucauccac

SEQ ID NO: 1312752 - RNA, 15 nt, Mycobacterium tuberculosis H37Rv
gucggcggugccgug

SEQ ID NO: 1312753 - RNA, 16 nt, Mycobacterium tuberculosis H37Rv
gucggcggccuccgcg

SEQ ID NO: 1312754 - RNA, 15 nt, Mycobacterium tuberculosis H37Rv
gucggcgcggcuguc

SEQ ID NO: 1312755 - RNA, 18 nt, Mycobacterium tuberculosis H37Rv
gucggcgccggcggccgc

SEQ ID NO: 1312756 - RNA, 16 nt, Mycobacterium tuberculosis H37Rv
gucggcgcgccgcaca

SEQ ID NO: 1312757 - RNA, 14 nt, Mycobacterium tuberculosis H37Rv
gucggcgcggcugc

SEQ ID NO: 1312758 - RNA, 16 nt, Mycobacterium tuberculosis H37Rv
gucggcgcggcugccg

SEQ ID NO: 1312759 - RNA, 14 nt, Mycobacterium tuberculosis H37Rv
gucggcgcggcugu

SEQ ID NO: 1312760 - RNA, 16 nt, Mycobacterium tuberculosis H37Rv
gucggcgauggcggca

SEQ ID NO: 1312761 - RNA, 17 nt, Mycobacterium tuberculosis H37Rv
gucggcgaugcguccgc

SEQ ID NO: 1312762 - RNA, 21 nt, Mycobacterium tuberculosis H37Rv
gucgaugccggcuggcggcgu

SEQ ID NO: 1312763 - RNA, 17 nt, Mycobacterium tuberculosis H37Rv
gucgauggcugcgccga

SEQ ID NO: 1312764 - RNA, 16 nt, Mycobacterium tuberculosis H37Rv
gucgaugcgcgccggc

SEQ ID NO: 1312765 - RNA, 19 nt, Mycobacterium tuberculosis H37Rv
gucgauguccacgccgugc

SEQ ID NO: 1312766 - RNA, 14 nt, Mycobacterium tuberculosis H37Rv
gucgaugucgccgc

SEQ ID NO: 1312767 - RNA, 15 nt, Mycobacterium tuberculosis H37Rv
gucgauguccgugag

SEQ ID NO: 1312768 - RNA, 17 nt, Mycobacterium tuberculosis H37Rv
gucgauguucgccgcgc

SEQ ID NO: 1312769 - RNA, 11 nt, Mycobacterium tuberculosis H37Rv
gucgagcagcc

SEQ ID NO: 1312770 - RNA, 15 nt, Mycobacterium tuberculosis H37Rv
gucgagcgcccacug

SEQ ID NO: 1312771 - RNA, 15 nt, Mycobacterium tuberculosis H37Rv
gucgagcgccgcagu

SEQ ID NO: 1312772 - RNA, 19 nt, Mycobacterium tuberculosis H37Rv
gucgagcgcuucgucgccg

SEQ ID NO: 1312773 - RNA, 21 nt, Mycobacterium tuberculosis H37Rv
gucgaucucggcgcagggacu

SEQ ID NO: 1312774 - RNA, 18 nt, Mycobacterium tuberculosis H37Rv
gucgauuagcccacccau

SEQ ID NO: 1312775 - RNA, 23 nt, Mycobacterium tuberculosis H37Rv
gucgcgagcccgccacagcccca

SEQ ID NO: 1312776 - RNA, 22 nt, Mycobacterium tuberculosis H37Rv
gucgcgcaccggaucgccgucg

SEQ ID NO: 1312777 - RNA, 14 nt, Mycobacterium tuberculosis H37Rv
gucgcgaugacgau

SEQ ID NO: 1312778 - RNA, 17 nt, Mycobacterium tuberculosis H37Rv
gucgcgauagccgccgc

SEQ ID NO: 1312779 - RNA, 13 nt, Mycobacterium tuberculosis H37Rv
gucgcgccaggcu

SEQ ID NO: 1312780 - RNA, 16 nt, Mycobacterium tuberculosis H37Rv
gucgcggguggcuucc

SEQ ID NO: 1312781 - RNA, 15 nt, Mycobacterium tuberculosis H37Rv
gucgcgcgaccuggu

SEQ ID NO: 1312782 - RNA, 22 nt, Mycobacterium tuberculosis H37Rv
gucggcagguaccaccgcggug

SEQ ID NO: 1312783 - RNA, 17 nt, Mycobacterium tuberculosis H37Rv
gucggcagcgacgccgg

SEQ ID NO: 1312784 - RNA, 14 nt, Mycobacterium tuberculosis H37Rv
gucggcagcugggg

SEQ ID NO: 1312785 - RNA, 15 nt, Mycobacterium tuberculosis H37Rv
gucggcagcuggggc

SEQ ID NO: 1312786 - RNA, 23 nt, Mycobacterium tuberculosis H37Rv
gucggcaugacauacagcgggcg

SEQ ID NO: 1312787 - RNA, 17 nt, Mycobacterium tuberculosis H37Rv
gucggcaugggccggcg

SEQ ID NO: 1312788 - RNA, 16 nt, Mycobacterium tuberculosis H37Rv
gucggcaucggagaua

SEQ ID NO: 1312789 - RNA, 22 nt, Mycobacterium tuberculosis H37Rv
gucggacagcgucucggaggcg

SEQ ID NO: 1312790 - RNA, 20 nt, Mycobacterium tuberculosis H37Rv
gucggcaccauagcuggagu

SEQ ID NO: 1312791 - RNA, 14 nt, Mycobacterium tuberculosis H37Rv
gucggcaccgguuu

SEQ ID NO: 1312792 - RNA, 15 nt, Mycobacterium tuberculosis H37Rv
gucgcggucgcccgc

SEQ ID NO: 1312793 - RNA, 15 nt, Mycobacterium tuberculosis H37Rv
gucgcgguggcggcg

SEQ ID NO: 1312794 - RNA, 15 nt, Mycobacterium tuberculosis H37Rv
gucgcuaaagccccc

SEQ ID NO: 1312795 - RNA, 19 nt, Mycobacterium tuberculosis H37Rv
gucggagaacauguagguc

SEQ ID NO: 1312796 - RNA, 14 nt, Mycobacterium tuberculosis H37Rv
gucggaaugggcgc

SEQ ID NO: 1312797 - RNA, 16 nt, Mycobacterium tuberculosis H37Rv
gucggaaugggcgcca

SEQ ID NO: 1312798 - RNA, 18 nt, Mycobacterium tuberculosis H37Rv
gucgcucacggcccgagc

SEQ ID NO: 1312799 - RNA, 17 nt, Mycobacterium tuberculosis H37Rv
gucgucuugguugugga

SEQ ID NO: 1312800 - RNA, 19 nt, Mycobacterium tuberculosis H37Rv
gucgugaucuucugccuug

SEQ ID NO: 1312801 - RNA, 17 nt, Mycobacterium tuberculosis H37Rv
gucgucguacggcucau

SEQ ID NO: 1312802 - RNA, 20 nt, Mycobacterium tuberculosis H37Rv
gucguccuguccgggcugca

SEQ ID NO: 1312803 - RNA, 21 nt, Mycobacterium tuberculosis H37Rv
gucguggacuuuauggcuagu

SEQ ID NO: 1312804 - RNA, 14 nt, Mycobacterium tuberculosis H37Rv
gucguggagcucac

SEQ ID NO: 1312805 - RNA, 14 nt, Mycobacterium tuberculosis H37Rv
gucgucgagcugac

SEQ ID NO: 1312806 - RNA, 16 nt, Mycobacterium tuberculosis H37Rv
gucgucgauuagccca

SEQ ID NO: 1312807 - RNA, 17 nt, Mycobacterium tuberculosis H37Rv
gucgucgcuugcugggu

SEQ ID NO: 1312808 - RNA, 14 nt, Mycobacterium tuberculosis H37Rv
gucgucgcugagca

SEQ ID NO: 1312809 - RNA, 19 nt, Mycobacterium tuberculosis H37Rv
gucgucggacucguccuuc

SEQ ID NO: 1312810 - RNA, 23 nt, Mycobacterium tuberculosis H37Rv
gucgucggcgucgguggaggcgu

SEQ ID NO: 1312811 - RNA, 22 nt, Mycobacterium tuberculosis H37Rv
gucgucggugaucaccgcggcg

SEQ ID NO: 1312812 - RNA, 16 nt, Mycobacterium tuberculosis H37Rv
gucguccagggcgacg

SEQ ID NO: 1312813 - RNA, 23 nt, Mycobacterium tuberculosis H37Rv
gucguccaucgcgucgucuucuu

SEQ ID NO: 1312814 - RNA, 15 nt, Mycobacterium tuberculosis H37Rv
gucguccgccugcac

SEQ ID NO: 1312815 - RNA, 14 nt, Mycobacterium tuberculosis H37Rv
gucgucgaccaggc

SEQ ID NO: 1312816 - RNA, 20 nt, Mycobacterium tuberculosis H37Rv
gucgucgaccaggccacugc

SEQ ID NO: 1312817 - RNA, 14 nt, Mycobacterium tuberculosis H37Rv
gucgucgagcgcgc

SEQ ID NO: 1312818 - RNA, 18 nt, Mycobacterium tuberculosis H37Rv
gucguccgcugacccgcc

SEQ ID NO: 1312819 - RNA, 18 nt, Mycobacterium tuberculosis H37Rv
gucggucaaugcgcgcug

SEQ ID NO: 1312820 - RNA, 18 nt, Mycobacterium tuberculosis H37Rv
gucggguugguuggcucg

SEQ ID NO: 1312821 - RNA, 23 nt, Mycobacterium tuberculosis H37Rv
gucggucggguggaucuucaccu

SEQ ID NO: 1312822 - RNA, 15 nt, Mycobacterium tuberculosis H37Rv
gucggugaccuguuu

SEQ ID NO: 1312823 - RNA, 20 nt, Mycobacterium tuberculosis H37Rv
gucggucaccauggcgccgc

SEQ ID NO: 1312824 - RNA, 21 nt, Mycobacterium tuberculosis H37Rv
gucgguggccgcggcggucug

SEQ ID NO: 1312825 - RNA, 19 nt, Mycobacterium tuberculosis H37Rv
gucggugguaccggcggcg

SEQ ID NO: 1312826 - RNA, 23 nt, Mycobacterium tuberculosis H37Rv
gucggugguuuucccgucgccgc

SEQ ID NO: 1312827 - RNA, 22 nt, Mycobacterium tuberculosis H37Rv
gucggugaugguuucggcggga

SEQ ID NO: 1312828 - RNA, 19 nt, Mycobacterium tuberculosis H37Rv
gucggugaggaagcggccg

SEQ ID NO: 1312829 - RNA, 15 nt, Mycobacterium tuberculosis H37Rv
gucggucuggcuggu

SEQ ID NO: 1312830 - RNA, 14 nt, Mycobacterium tuberculosis H37Rv
gucggugcgcggca

SEQ ID NO: 1312831 - RNA, 19 nt, Mycobacterium tuberculosis H37Rv
gucggugccgccgccggcg

SEQ ID NO: 1312832 - RNA, 12 nt, Mycobacterium tuberculosis H37Rv
gucggugccggg

SEQ ID NO: 1312833 - RNA, 15 nt, Mycobacterium tuberculosis H37Rv
gucggugcgccacga

SEQ ID NO: 1312834 - RNA, 21 nt, Mycobacterium tuberculosis H37Rv
gucguacucccaggccgccgc

SEQ ID NO: 1312835 - RNA, 16 nt, Mycobacterium tuberculosis H37Rv
gucguacucggcggcc

SEQ ID NO: 1312836 - RNA, 19 nt, Mycobacterium tuberculosis H37Rv
gucguaccgcucggcggca

SEQ ID NO: 1312837 - RNA, 20 nt, Mycobacterium tuberculosis H37Rv
gucgguucggccggagccgc

SEQ ID NO: 1312838 - RNA, 20 nt, Mycobacterium tuberculosis H37Rv
gucgguucagccacgcagca

SEQ ID NO: 1312839 - RNA, 21 nt, Mycobacterium tuberculosis H37Rv
gucgguucagccacgcagcac

SEQ ID NO: 1312840 - RNA, 23 nt, Mycobacterium tuberculosis H37Rv
gucguagccacgcaugggccagg

SEQ ID NO: 1312841 - RNA, 21 nt, Mycobacterium tuberculosis H37Rv
gucucacguugugagccacgc

SEQ ID NO: 1312842 - RNA, 16 nt, Mycobacterium tuberculosis H37Rv
gucucagugcucgccc

SEQ ID NO: 1312843 - RNA, 14 nt, Mycobacterium tuberculosis H37Rv
gucuccagcugggu

SEQ ID NO: 1312844 - RNA, 16 nt, Mycobacterium tuberculosis H37Rv
gucuccagcuggguga

SEQ ID NO: 1312845 - RNA, 18 nt, Mycobacterium tuberculosis H37Rv
gucuaggccaaaccccug

SEQ ID NO: 1312846 - RNA, 17 nt, Mycobacterium tuberculosis H37Rv
gucguugccgcggucgg

SEQ ID NO: 1312847 - RNA, 17 nt, Mycobacterium tuberculosis H37Rv
gucguugaggaagcccg

SEQ ID NO: 1312848 - RNA, 18 nt, Mycobacterium tuberculosis H37Rv
gucguugaggaagcccga

SEQ ID NO: 1312849 - RNA, 13 nt, Mycobacterium tuberculosis H37Rv
gucgugucgccgc

SEQ ID NO: 1312850 - RNA, 17 nt, Mycobacterium tuberculosis H37Rv
gucguuguuagugacgu

SEQ ID NO: 1312851 - RNA, 18 nt, Mycobacterium tuberculosis H37Rv
gucguuggcggcggucgg

SEQ ID NO: 1312852 - RNA, 16 nt, Mycobacterium tuberculosis H37Rv
gucugcucgcgcccgc

SEQ ID NO: 1312853 - RNA, 23 nt, Mycobacterium tuberculosis H37Rv
gucugcucgcgccggugaggcga

SEQ ID NO: 1312854 - RNA, 20 nt, Mycobacterium tuberculosis H37Rv
gucugcucggcggagaaaag

SEQ ID NO: 1312855 - RNA, 16 nt, Mycobacterium tuberculosis H37Rv
gucugcucgccaggcc

SEQ ID NO: 1312856 - RNA, 13 nt, Mycobacterium tuberculosis H37Rv
gucugcucgccag

SEQ ID NO: 1312857 - RNA, 16 nt, Mycobacterium tuberculosis H37Rv
gucugcccgcccagcc

SEQ ID NO: 1312858 - RNA, 13 nt, Mycobacterium tuberculosis H37Rv
gucugcgccgccg

SEQ ID NO: 1312859 - RNA, 14 nt, Mycobacterium tuberculosis H37Rv
gucugcgccgccgg

SEQ ID NO: 1312860 - RNA, 12 nt, Mycobacterium tuberculosis H37Rv
gucugccaggcg

SEQ ID NO: 1312861 - RNA, 16 nt, Mycobacterium tuberculosis H37Rv
gucugccaggcgcagc

SEQ ID NO: 1312862 - RNA, 13 nt, Mycobacterium tuberculosis H37Rv
gucugacgaaucg

SEQ ID NO: 1312863 - RNA, 21 nt, Mycobacterium tuberculosis H37Rv
gucugcacguacucggccagc

SEQ ID NO: 1312864 - RNA, 18 nt, Mycobacterium tuberculosis H37Rv
gucucgacaaagcggcug

SEQ ID NO: 1312865 - RNA, 20 nt, Mycobacterium tuberculosis H37Rv
gucucgacaaagcggcugcc

SEQ ID NO: 1312866 - RNA, 16 nt, Mycobacterium tuberculosis H37Rv
gucucgacacugcagu

SEQ ID NO: 1312867 - RNA, 16 nt, Mycobacterium tuberculosis H37Rv
gucucgaacuccaugc

SEQ ID NO: 1312868 - RNA, 22 nt, Mycobacterium tuberculosis H37Rv
gucuccuccggaaagcucucgg

SEQ ID NO: 1312869 - RNA, 22 nt, Mycobacterium tuberculosis H37Rv
gucuccuugagcuucucgucgg

SEQ ID NO: 1312870 - RNA, 15 nt, Mycobacterium tuberculosis H37Rv
gucucgacggcggcc

SEQ ID NO: 1312871 - RNA, 23 nt, Mycobacterium tuberculosis H37Rv
gucucgagcgcgccgcgcucgcc

SEQ ID NO: 1312872 - RNA, 19 nt, Mycobacterium tuberculosis H37Rv
gucucgcagcaacggcggc

SEQ ID NO: 1312873 - RNA, 21 nt, Mycobacterium tuberculosis H37Rv
gucucgcgagcguuucaccag

SEQ ID NO: 1312874 - RNA, 13 nt, Mycobacterium tuberculosis H37Rv
gucucggccacga

SEQ ID NO: 1312875 - RNA, 16 nt, Mycobacterium tuberculosis H37Rv
gucucggugcagcagc

SEQ ID NO: 1312876 - RNA, 15 nt, Mycobacterium tuberculosis H37Rv
gucucggcgguggcg

SEQ ID NO: 1312877 - RNA, 23 nt, Mycobacterium tuberculosis H37Rv
gucugguugucgaucucggccag

SEQ ID NO: 1312878 - RNA, 20 nt, Mycobacterium tuberculosis H37Rv
gucugguugggccagcuccu

SEQ ID NO: 1312879 - RNA, 14 nt, Mycobacterium tuberculosis H37Rv
gucuggguggacag

SEQ ID NO: 1312880 - RNA, 14 nt, Mycobacterium tuberculosis H37Rv
gucugggugcaggu

SEQ ID NO: 1312881 - RNA, 21 nt, Mycobacterium tuberculosis H37Rv
gucugguauuuguccggcgga

SEQ ID NO: 1312882 - RNA, 23 nt, Mycobacterium tuberculosis H37Rv
gucugggcaagaccgcguuccgg

SEQ ID NO: 1312883 - RNA, 17 nt, Mycobacterium tuberculosis H37Rv
gucuggccugccccaga

SEQ ID NO: 1312884 - RNA, 16 nt, Mycobacterium tuberculosis H37Rv
gucuggacugcagccc

SEQ ID NO: 1312885 - RNA, 21 nt, Mycobacterium tuberculosis H37Rv
gucugcugggcacgauggcuc

SEQ ID NO: 1312886 - RNA, 17 nt, Mycobacterium tuberculosis H37Rv
gucuucagguccaccgc

SEQ ID NO: 1312887 - RNA, 14 nt, Mycobacterium tuberculosis H37Rv
gucugugcucacgg

SEQ ID NO: 1312888 - RNA, 16 nt, Mycobacterium tuberculosis H37Rv
gucuugguuguggagg

SEQ ID NO: 1312889 - RNA, 15 nt, Mycobacterium tuberculosis H37Rv
gucuugugcugcaag

SEQ ID NO: 1312890 - RNA, 18 nt, Mycobacterium tuberculosis H37Rv
gucuugcaguaacuucac

SEQ ID NO: 1312891 - RNA, 20 nt, Mycobacterium tuberculosis H37Rv
gucuugcaucgccgaugcgg

SEQ ID NO: 1312892 - RNA, 21 nt, Mycobacterium tuberculosis H37Rv
gucuugcguccauccgcagca

SEQ ID NO: 1312893 - RNA, 14 nt, Mycobacterium tuberculosis H37Rv
gucuugccggccag

SEQ ID NO: 1312894 - RNA, 19 nt, Mycobacterium tuberculosis H37Rv
gucuucgggcucguccagc

SEQ ID NO: 1312895 - RNA, 19 nt, Mycobacterium tuberculosis H37Rv
gucuucgucggagucuucg

SEQ ID NO: 1312896 - RNA, 16 nt, Mycobacterium tuberculosis H37Rv
gucuuccagccaggcc

SEQ ID NO: 1312897 - RNA, 19 nt, Mycobacterium tuberculosis H37Rv
gucuuccucggccacccgc

SEQ ID NO: 1312898 - RNA, 16 nt, Mycobacterium tuberculosis H37Rv
gugaaaccggccuucu

SEQ ID NO: 1312899 - RNA, 20 nt, Mycobacterium tuberculosis H37Rv
gugaaacaggacgugucggu

SEQ ID NO: 1312900 - RNA, 23 nt, Mycobacterium tuberculosis H37Rv
gugaaaaaggcgacucggugcgg

SEQ ID NO: 1312901 - RNA, 22 nt, Mycobacterium tuberculosis H37Rv
gucuuugguuguuggugccagc

SEQ ID NO: 1312902 - RNA, 22 nt, Mycobacterium tuberculosis H37Rv
gucuuugcucucggucugcaug

SEQ ID NO: 1312903 - RNA, 23 nt, Mycobacterium tuberculosis H37Rv
gucuuugcucucggucugcaugc

SEQ ID NO: 1312904 - RNA, 22 nt, Mycobacterium tuberculosis H37Rv
gugaaggcaaacaccagcccgg

SEQ ID NO: 1312905 - RNA, 15 nt, Mycobacterium tuberculosis H37Rv
gugaagucggugccg

SEQ ID NO: 1312906 - RNA, 17 nt, Mycobacterium tuberculosis H37Rv
gugaagucggugccgag

SEQ ID NO: 1312907 - RNA, 20 nt, Mycobacterium tuberculosis H37Rv
gugacaacugcgccggugcc

SEQ ID NO: 1312908 - RNA, 12 nt, Mycobacterium tuberculosis H37Rv
gugaaccgcgcg

SEQ ID NO: 1312909 - RNA, 14 nt, Mycobacterium tuberculosis H37Rv
gugaacggcaaggu

SEQ ID NO: 1312910 - RNA, 15 nt, Mycobacterium tuberculosis H37Rv
gugaacuguccgggu

SEQ ID NO: 1312911 - RNA, 14 nt, Mycobacterium tuberculosis H37Rv
gugaacggcgcggg

SEQ ID NO: 1312912 - RNA, 14 nt, Mycobacterium tuberculosis H37Rv
gugaacggcucggg

SEQ ID NO: 1312913 - RNA, 18 nt, Mycobacterium tuberculosis H37Rv
gugaacguuuccagcuga

SEQ ID NO: 1312914 - RNA, 17 nt, Mycobacterium tuberculosis H37Rv
gugaaauucgcggcggu

SEQ ID NO: 1312915 - RNA, 14 nt, Mycobacterium tuberculosis H37Rv
gugaaaugccgaga

SEQ ID NO: 1312916 - RNA, 19 nt, Mycobacterium tuberculosis H37Rv
gugaacaaaugccggugca

SEQ ID NO: 1312917 - RNA, 12 nt, Mycobacterium tuberculosis H37Rv
gugaacaccccu

SEQ ID NO: 1312918 - RNA, 17 nt, Mycobacterium tuberculosis H37Rv
gugaacaccgccagcag

SEQ ID NO: 1312919 - RNA, 21 nt, Mycobacterium tuberculosis H37Rv
gugaaaguaagccgcgcccau

SEQ ID NO: 1312920 - RNA, 13 nt, Mycobacterium tuberculosis H37Rv
gugaccgcuggug

SEQ ID NO: 1312921 - RNA, 22 nt, Mycobacterium tuberculosis H37Rv
gugaccgcuggugugucccggg

SEQ ID NO: 1312922 - RNA, 23 nt, Mycobacterium tuberculosis H37Rv
gugaccggcgaucgggcggguga

SEQ ID NO: 1312923 - RNA, 15 nt, Mycobacterium tuberculosis H37Rv
gugacccucagcacc

SEQ ID NO: 1312924 - RNA, 23 nt, Mycobacterium tuberculosis H37Rv
gugacccgccggcgacugcagcg

SEQ ID NO: 1312925 - RNA, 14 nt, Mycobacterium tuberculosis H37Rv
gugaccguggcggg

SEQ ID NO: 1312926 - RNA, 14 nt, Mycobacterium tuberculosis H37Rv
gugaccucaccaac

SEQ ID NO: 1312927 - RNA, 15 nt, Mycobacterium tuberculosis H37Rv
gugaccucggcgacc

SEQ ID NO: 1312928 - RNA, 20 nt, Mycobacterium tuberculosis H37Rv
gugacgaaagagcgguacgg

SEQ ID NO: 1312929 - RNA, 20 nt, Mycobacterium tuberculosis H37Rv
gugaccuguuuggggcugug

SEQ ID NO: 1312930 - RNA, 15 nt, Mycobacterium tuberculosis H37Rv
gugaccaggcggcgc

SEQ ID NO: 1312931 - RNA, 13 nt, Mycobacterium tuberculosis H37Rv
gugaccaggugcc

SEQ ID NO: 1312932 - RNA, 16 nt, Mycobacterium tuberculosis H37Rv
gugaccaggugccagg

SEQ ID NO: 1312933 - RNA, 12 nt, Mycobacterium tuberculosis H37Rv
gugaccagcagg

SEQ ID NO: 1312934 - RNA, 19 nt, Mycobacterium tuberculosis H37Rv
gugaccacgcugcugguga

SEQ ID NO: 1312935 - RNA, 15 nt, Mycobacterium tuberculosis H37Rv
gugaccacgcugcug

SEQ ID NO: 1312936 - RNA, 20 nt, Mycobacterium tuberculosis H37Rv
gugacagugcgucgagcauc

SEQ ID NO: 1312937 - RNA, 20 nt, Mycobacterium tuberculosis H37Rv
gugacguaucgccgcgggcg

SEQ ID NO: 1312938 - RNA, 16 nt, Mycobacterium tuberculosis H37Rv
gugacguagggcagcg

SEQ ID NO: 1312939 - RNA, 12 nt, Mycobacterium tuberculosis H37Rv
gugacggcggcc

SEQ ID NO: 1312940 - RNA, 23 nt, Mycobacterium tuberculosis H37Rv
gugacgcgccguaacagccggcc

SEQ ID NO: 1312941 - RNA, 21 nt, Mycobacterium tuberculosis H37Rv
gugacgccacgaccgccgaua

SEQ ID NO: 1312942 - RNA, 17 nt, Mycobacterium tuberculosis H37Rv
gugacgccgccagcacc

SEQ ID NO: 1312943 - RNA, 15 nt, Mycobacterium tuberculosis H37Rv
gugagaagaagccca

SEQ ID NO: 1312944 - RNA, 22 nt, Mycobacterium tuberculosis H37Rv
gugagaccagguucucggucgg

SEQ ID NO: 1312945 - RNA, 23 nt, Mycobacterium tuberculosis H37Rv
gugagaccuagcagggugccggc

SEQ ID NO: 1312946 - RNA, 21 nt, Mycobacterium tuberculosis H37Rv
gugagacugggcgcuggaggc

SEQ ID NO: 1312947 - RNA, 13 nt, Mycobacterium tuberculosis H37Rv
gugacuggugaac

SEQ ID NO: 1312948 - RNA, 18 nt, Mycobacterium tuberculosis H37Rv
gugacguuggcaggcagg

SEQ ID NO: 1312949 - RNA, 17 nt, Mycobacterium tuberculosis H37Rv
gugaucgcgguggcuuc

SEQ ID NO: 1312950 - RNA, 21 nt, Mycobacterium tuberculosis H37Rv
gugaucgauccggcuccaccc

SEQ ID NO: 1312951 - RNA, 22 nt, Mycobacterium tuberculosis H37Rv
gugaucgaucgcggcgcccagg

SEQ ID NO: 1312952 - RNA, 21 nt, Mycobacterium tuberculosis H37Rv
gugaucagcaggaucggcagc

SEQ ID NO: 1312953 - RNA, 14 nt, Mycobacterium tuberculosis H37Rv
gugaucacggucgg

SEQ ID NO: 1312954 - RNA, 16 nt, Mycobacterium tuberculosis H37Rv
gugauccgagaccaug

SEQ ID NO: 1312955 - RNA, 23 nt, Mycobacterium tuberculosis H37Rv
gugauacagcgccaggggugugc

SEQ ID NO: 1312956 - RNA, 20 nt, Mycobacterium tuberculosis H37Rv
gugaggucgaucagcggcga

SEQ ID NO: 1312957 - RNA, 19 nt, Mycobacterium tuberculosis H37Rv
gugaguaccaauccaggcc

SEQ ID NO: 1312958 - RNA, 17 nt, Mycobacterium tuberculosis H37Rv
gugaggccgaccagcac

SEQ ID NO: 1312959 - RNA, 20 nt, Mycobacterium tuberculosis H37Rv
gugagcuuuaucugcaugcc

SEQ ID NO: 1312960 - RNA, 15 nt, Mycobacterium tuberculosis H37Rv
gugaggccaaccaca

SEQ ID NO: 1312961 - RNA, 14 nt, Mycobacterium tuberculosis H37Rv
gugagcgagcgcgc

SEQ ID NO: 1312962 - RNA, 23 nt, Mycobacterium tuberculosis H37Rv
gugagcuuagcgcaugggccuug

SEQ ID NO: 1312963 - RNA, 14 nt, Mycobacterium tuberculosis H37Rv
gugagccauacgcg

SEQ ID NO: 1312964 - RNA, 14 nt, Mycobacterium tuberculosis H37Rv
gugagcugcggggu

SEQ ID NO: 1312965 - RNA, 22 nt, Mycobacterium tuberculosis H37Rv
gugagcuggucggcgagcgccc

SEQ ID NO: 1312966 - RNA, 12 nt, Mycobacterium tuberculosis H37Rv
gugagcaccugg

SEQ ID NO: 1312967 - RNA, 15 nt, Mycobacterium tuberculosis H37Rv
gugagauggcgguga

SEQ ID NO: 1312968 - RNA, 22 nt, Mycobacterium tuberculosis H37Rv
gugagcagcgggacauccagug

SEQ ID NO: 1312969 - RNA, 17 nt, Mycobacterium tuberculosis H37Rv
gugagcauggcuagggc

SEQ ID NO: 1312970 - RNA, 17 nt, Mycobacterium tuberculosis H37Rv
gugagccgguggcccgc

SEQ ID NO: 1312971 - RNA, 22 nt, Mycobacterium tuberculosis H37Rv
gugagcccggcgaucagcagcg

SEQ ID NO: 1312972 - RNA, 19 nt, Mycobacterium tuberculosis H37Rv
gugagcccguugaccugcg

SEQ ID NO: 1312973 - RNA, 17 nt, Mycobacterium tuberculosis H37Rv
gugccucgaggacggcg

SEQ ID NO: 1312974 - RNA, 19 nt, Mycobacterium tuberculosis H37Rv
gugccucgauuguggccag

SEQ ID NO: 1312975 - RNA, 20 nt, Mycobacterium tuberculosis H37Rv
gugccucgauuguggccagc

SEQ ID NO: 1312976 - RNA, 23 nt, Mycobacterium tuberculosis H37Rv
gugccucgauuguggccagcgcu

SEQ ID NO: 1312977 - RNA, 13 nt, Mycobacterium tuberculosis H37Rv
gugccuggccggu

SEQ ID NO: 1312978 - RNA, 15 nt, Mycobacterium tuberculosis H37Rv
gugcgauaccuagcc

SEQ ID NO: 1312979 - RNA, 14 nt, Mycobacterium tuberculosis H37Rv
gugccguuggagcc

SEQ ID NO: 1312980 - RNA, 18 nt, Mycobacterium tuberculosis H37Rv
gugccgugaucgcuggcg

SEQ ID NO: 1312981 - RNA, 19 nt, Mycobacterium tuberculosis H37Rv
gugccggggcugccgccgu

SEQ ID NO: 1312982 - RNA, 14 nt, Mycobacterium tuberculosis H37Rv
gugccgguggcgcc

SEQ ID NO: 1312983 - RNA, 15 nt, Mycobacterium tuberculosis H37Rv
gugccggggcugccg

SEQ ID NO: 1312984 - RNA, 15 nt, Mycobacterium tuberculosis H37Rv
gugccgggcaccacc

SEQ ID NO: 1312985 - RNA, 21 nt, Mycobacterium tuberculosis H37Rv
gugccgcugcauccgcagcac

SEQ ID NO: 1312986 - RNA, 13 nt, Mycobacterium tuberculosis H37Rv
gugccgccagcaa

SEQ ID NO: 1312987 - RNA, 14 nt, Mycobacterium tuberculosis H37Rv
gugccgccaccacc

SEQ ID NO: 1312988 - RNA, 13 nt, Mycobacterium tuberculosis H37Rv
gugccggcagcgg

SEQ ID NO: 1312989 - RNA, 16 nt, Mycobacterium tuberculosis H37Rv
gugccgaguuccugca

SEQ ID NO: 1312990 - RNA, 14 nt, Mycobacterium tuberculosis H37Rv
gugccgaucgaugc

SEQ ID NO: 1312991 - RNA, 22 nt, Mycobacterium tuberculosis H37Rv
gugccgagcgugcgcugguggc

SEQ ID NO: 1312992 - RNA, 14 nt, Mycobacterium tuberculosis H37Rv
gugccaguccgaug

SEQ ID NO: 1312993 - RNA, 21 nt, Mycobacterium tuberculosis H37Rv
gugccaguacucggccagcgc

SEQ ID NO: 1312994 - RNA, 15 nt, Mycobacterium tuberculosis H37Rv
gugccaucgggcgcg

SEQ ID NO: 1312995 - RNA, 22 nt, Mycobacterium tuberculosis H37Rv
gugccgagaauuccccagccgc

SEQ ID NO: 1312996 - RNA, 15 nt, Mycobacterium tuberculosis H37Rv
gugcaggcgacggcu

SEQ ID NO: 1312997 - RNA, 20 nt, Mycobacterium tuberculosis H37Rv
gugcagcugcaaugacugga

SEQ ID NO: 1312998 - RNA, 21 nt, Mycobacterium tuberculosis H37Rv
gugcagcugcaaugacuggac

SEQ ID NO: 1312999 - RNA, 21 nt, Mycobacterium tuberculosis H37Rv
gugcagcuccgggugcagauc

SEQ ID NO: 1313000 - RNA, 17 nt, Mycobacterium tuberculosis H37Rv
gugcagcgugggcagcg

SEQ ID NO: 1313001 - RNA, 13 nt, Mycobacterium tuberculosis H37Rv
gugcaggugcggg

SEQ ID NO: 1313002 - RNA, 16 nt, Mycobacterium tuberculosis H37Rv
gugcaggugaugcaug

SEQ ID NO: 1313003 - RNA, 15 nt, Mycobacterium tuberculosis H37Rv
gugcaggucguccau

SEQ ID NO: 1313004 - RNA, 17 nt, Mycobacterium tuberculosis H37Rv
gugcaggucguccaucg

SEQ ID NO: 1313005 - RNA, 18 nt, Mycobacterium tuberculosis H37Rv
gugcagguugcccucacc

SEQ ID NO: 1313006 - RNA, 19 nt, Mycobacterium tuberculosis H37Rv
gugcagguggccgucgccg

SEQ ID NO: 1313007 - RNA, 19 nt, Mycobacterium tuberculosis H37Rv
gugcagggcauugcggccc

SEQ ID NO: 1313008 - RNA, 20 nt, Mycobacterium tuberculosis H37Rv
gugcagggcauugcggcccg

SEQ ID NO: 1313009 - RNA, 15 nt, Mycobacterium tuberculosis H37Rv
gugcaggcugucaau

SEQ ID NO: 1313010 - RNA, 13 nt, Mycobacterium tuberculosis H37Rv
gugcaggcggccg

SEQ ID NO: 1313011 - RNA, 12 nt, Mycobacterium tuberculosis H37Rv
gugcaggcggga

SEQ ID NO: 1313012 - RNA, 18 nt, Mycobacterium tuberculosis H37Rv
gugcagggugagcacgua

SEQ ID NO: 1313013 - RNA, 21 nt, Mycobacterium tuberculosis H37Rv
gugcauaccgcaauggcggcc

SEQ ID NO: 1313014 - RNA, 23 nt, Mycobacterium tuberculosis H37Rv
gugcauaccgcaauggcggccuu

SEQ ID NO: 1313015 - RNA, 21 nt, Mycobacterium tuberculosis H37Rv
gugcauaucaaccccggugca

SEQ ID NO: 1313016 - RNA, 18 nt, Mycobacterium tuberculosis H37Rv
gugcaucgccugcgccuu

SEQ ID NO: 1313017 - RNA, 13 nt, Mycobacterium tuberculosis H37Rv
gugcacugccggg

SEQ ID NO: 1313018 - RNA, 23 nt, Mycobacterium tuberculosis H37Rv
gugcagcgacuccguaccggguu

SEQ ID NO: 1313019 - RNA, 13 nt, Mycobacterium tuberculosis H37Rv
gugcacgcgggcg

SEQ ID NO: 1313020 - RNA, 20 nt, Mycobacterium tuberculosis H37Rv
gugcacggcgaggccgaacu

SEQ ID NO: 1313021 - RNA, 15 nt, Mycobacterium tuberculosis H37Rv
gugcacgcugagccg

SEQ ID NO: 1313022 - RNA, 20 nt, Mycobacterium tuberculosis H37Rv
gugcacggcgaggugcucgg

SEQ ID NO: 1313023 - RNA, 14 nt, Mycobacterium tuberculosis H37Rv
gugcacggcggcca

SEQ ID NO: 1313024 - RNA, 23 nt, Mycobacterium tuberculosis H37Rv
gugcacuacaggguuggcagcaa

SEQ ID NO: 1313025 - RNA, 18 nt, Mycobacterium tuberculosis H37Rv
gugcaccucguguccggg

SEQ ID NO: 1313026 - RNA, 20 nt, Mycobacterium tuberculosis H37Rv
gugcaccuccagguagucgc

SEQ ID NO: 1313027 - RNA, 17 nt, Mycobacterium tuberculosis H37Rv
gugcacgaucgcgguga

SEQ ID NO: 1313028 - RNA, 17 nt, Mycobacterium tuberculosis H37Rv
guggucgaucagguacu

SEQ ID NO: 1313029 - RNA, 22 nt, Mycobacterium tuberculosis H37Rv
guggucccguucgcccgcccgu

SEQ ID NO: 1313030 - RNA, 22 nt, Mycobacterium tuberculosis H37Rv
guggucgcugcugccgcaccgg

SEQ ID NO: 1313031 - RNA, 19 nt, Mycobacterium tuberculosis H37Rv
guggucucgauaucaguga

SEQ ID NO: 1313032 - RNA, 19 nt, Mycobacterium tuberculosis H37Rv
guggucucgguaggcggug

SEQ ID NO: 1313033 - RNA, 23 nt, Mycobacterium tuberculosis H37Rv
guggucgucccgauggcgguggg

SEQ ID NO: 1313034 - RNA, 21 nt, Mycobacterium tuberculosis H37Rv
guggucgucccgauggcggug

SEQ ID NO: 1313035 - RNA, 14 nt, Mycobacterium tuberculosis H37Rv
gugggcgugacggg

SEQ ID NO: 1313036 - RNA, 18 nt, Mycobacterium tuberculosis H37Rv
gugggcgugacgggcagg

SEQ ID NO: 1313037 - RNA, 15 nt, Mycobacterium tuberculosis H37Rv
gugggcgugagcgcg

SEQ ID NO: 1313038 - RNA, 18 nt, Mycobacterium tuberculosis H37Rv
gugggcgugagcgcgcgc

SEQ ID NO: 1313039 - RNA, 13 nt, Mycobacterium tuberculosis H37Rv
gugggcgugcagg

SEQ ID NO: 1313040 - RNA, 13 nt, Mycobacterium tuberculosis H37Rv
gugggcguucccc

SEQ ID NO: 1313041 - RNA, 21 nt, Mycobacterium tuberculosis H37Rv
guggucgaacucgccccgcgu

SEQ ID NO: 1313042 - RNA, 11 nt, Mycobacterium tuberculosis H37Rv
gugguccagcc

SEQ ID NO: 1313043 - RNA, 23 nt, Mycobacterium tuberculosis H37Rv
gugggcggguucggacgagguca

SEQ ID NO: 1313044 - RNA, 15 nt, Mycobacterium tuberculosis H37Rv
gugggcgccgacacc

SEQ ID NO: 1313045 - RNA, 21 nt, Mycobacterium tuberculosis H37Rv
gugggcgccgacaccggcuga

SEQ ID NO: 1313046 - RNA, 14 nt, Mycobacterium tuberculosis H37Rv
gugggccggcggua

SEQ ID NO: 1313047 - RNA, 16 nt, Mycobacterium tuberculosis H37Rv
gugggccguggguguc

SEQ ID NO: 1313048 - RNA, 19 nt, Mycobacterium tuberculosis H37Rv
gugggccucgaucagcgcc

SEQ ID NO: 1313049 - RNA, 14 nt, Mycobacterium tuberculosis H37Rv
gugggagcagccga

SEQ ID NO: 1313050 - RNA, 18 nt, Mycobacterium tuberculosis H37Rv
gugggacuggcgugaacg

SEQ ID NO: 1313051 - RNA, 17 nt, Mycobacterium tuberculosis H37Rv
gugggagguggcgcggg

SEQ ID NO: 1313052 - RNA, 21 nt, Mycobacterium tuberculosis H37Rv
gugggcauugcggcgcgggug

SEQ ID NO: 1313053 - RNA, 14 nt, Mycobacterium tuberculosis H37Rv
gugggccagcagca

SEQ ID NO: 1313054 - RNA, 18 nt, Mycobacterium tuberculosis H37Rv
guggccgccaccucccag

SEQ ID NO: 1313055 - RNA, 19 nt, Mycobacterium tuberculosis H37Rv
guggccgccggcgcuggcg

SEQ ID NO: 1313056 - RNA, 19 nt, Mycobacterium tuberculosis H37Rv
guggcaguacaccggcgug

SEQ ID NO: 1313057 - RNA, 16 nt, Mycobacterium tuberculosis H37Rv
guggcaucggcggccu

SEQ ID NO: 1313058 - RNA, 16 nt, Mycobacterium tuberculosis H37Rv
guggcccgggccaccg

SEQ ID NO: 1313059 - RNA, 22 nt, Mycobacterium tuberculosis H37Rv
guggcccggcgaaagcuugggc

SEQ ID NO: 1313060 - RNA, 12 nt, Mycobacterium tuberculosis H37Rv
guggcggcgcug

SEQ ID NO: 1313061 - RNA, 14 nt, Mycobacterium tuberculosis H37Rv
guggcggcgcgcgc

SEQ ID NO: 1313062 - RNA, 22 nt, Mycobacterium tuberculosis H37Rv
guggccgucgggugcagcacgg

SEQ ID NO: 1313063 - RNA, 14 nt, Mycobacterium tuberculosis H37Rv
guggccucauccac

SEQ ID NO: 1313064 - RNA, 14 nt, Mycobacterium tuberculosis H37Rv
guggccgugggugu

SEQ ID NO: 1313065 - RNA, 18 nt, Mycobacterium tuberculosis H37Rv
guggccgcugccagccgu

SEQ ID NO: 1313066 - RNA, 16 nt, Mycobacterium tuberculosis H37Rv
guggcgggucagccuu

SEQ ID NO: 1313067 - RNA, 14 nt, Mycobacterium tuberculosis H37Rv
guggcgggccggau

SEQ ID NO: 1313068 - RNA, 16 nt, Mycobacterium tuberculosis H37Rv
guggcuaccgcaggug

SEQ ID NO: 1313069 - RNA, 19 nt, Mycobacterium tuberculosis H37Rv
guggcguuugaugcgggcg

SEQ ID NO: 1313070 - RNA, 14 nt, Mycobacterium tuberculosis H37Rv
gugggacaccaucu

SEQ ID NO: 1313071 - RNA, 18 nt, Mycobacterium tuberculosis H37Rv
gugggacaaagacgccgu

SEQ ID NO: 1313072 - RNA, 16 nt, Mycobacterium tuberculosis H37Rv
gugggacgggcgcguc

SEQ ID NO: 1313073 - RNA, 22 nt, Mycobacterium tuberculosis H37Rv
guggcacccggcugaaacgucc

SEQ ID NO: 1313074 - RNA, 20 nt, Mycobacterium tuberculosis H37Rv
guggaguuggcugccggaga

SEQ ID NO: 1313075 - RNA, 23 nt, Mycobacterium tuberculosis H37Rv
guggaucauguucggccaccaga

SEQ ID NO: 1313076 - RNA, 16 nt, Mycobacterium tuberculosis H37Rv
guggcagccagcggcg

SEQ ID NO: 1313077 - RNA, 16 nt, Mycobacterium tuberculosis H37Rv
guggcagagccgccgu

SEQ ID NO: 1313078 - RNA, 15 nt, Mycobacterium tuberculosis H37Rv
guggcagagccgccg

SEQ ID NO: 1313079 - RNA, 17 nt, Mycobacterium tuberculosis H37Rv
guggcagcgcggccggg

SEQ ID NO: 1313080 - RNA, 14 nt, Mycobacterium tuberculosis H37Rv
guggcagagccgcc

SEQ ID NO: 1313081 - RNA, 12 nt, Mycobacterium tuberculosis H37Rv
guggcagccagc

SEQ ID NO: 1313082 - RNA, 14 nt, Mycobacterium tuberculosis H37Rv
guggcagccugcug

SEQ ID NO: 1313083 - RNA, 14 nt, Mycobacterium tuberculosis H37Rv
guggaccggccugg

SEQ ID NO: 1313084 - RNA, 16 nt, Mycobacterium tuberculosis H37Rv
guggagcucgcggcgc

SEQ ID NO: 1313085 - RNA, 15 nt, Mycobacterium tuberculosis H37Rv
gugcgcaaucgacac

SEQ ID NO: 1313086 - RNA, 23 nt, Mycobacterium tuberculosis H37Rv
gugcgcacugaggcucaggugcu

SEQ ID NO: 1313087 - RNA, 20 nt, Mycobacterium tuberculosis H37Rv
gugcgcacugaggcucaggu

SEQ ID NO: 1313088 - RNA, 17 nt, Mycobacterium tuberculosis H37Rv
gugcgcaacccagccgc

SEQ ID NO: 1313089 - RNA, 15 nt, Mycobacterium tuberculosis H37Rv
gugcgcaacccagcc

SEQ ID NO: 1313090 - RNA, 21 nt, Mycobacterium tuberculosis H37Rv
gugcgauuuugugucugcucg

SEQ ID NO: 1313091 - RNA, 20 nt, Mycobacterium tuberculosis H37Rv
gugcgauucugcgucugcuc

SEQ ID NO: 1313092 - RNA, 14 nt, Mycobacterium tuberculosis H37Rv
guggaacaccgcgg

SEQ ID NO: 1313093 - RNA, 19 nt, Mycobacterium tuberculosis H37Rv
guggaagcccgucgcggcc

SEQ ID NO: 1313094 - RNA, 19 nt, Mycobacterium tuberculosis H37Rv
guggaagguguuggugcgg

SEQ ID NO: 1313095 - RNA, 16 nt, Mycobacterium tuberculosis H37Rv
guggaagguguuggug

SEQ ID NO: 1313096 - RNA, 15 nt, Mycobacterium tuberculosis H37Rv
guguccccgcccggc

SEQ ID NO: 1313097 - RNA, 21 nt, Mycobacterium tuberculosis H37Rv
guguccccgcccggccagcuc

SEQ ID NO: 1313098 - RNA, 20 nt, Mycobacterium tuberculosis H37Rv
guguccccggcugccagcgc

SEQ ID NO: 1313099 - RNA, 21 nt, Mycobacterium tuberculosis H37Rv
gugucccggaccaucgccugc

SEQ ID NO: 1313100 - RNA, 18 nt, Mycobacterium tuberculosis H37Rv
guguccucgucgagguca

SEQ ID NO: 1313101 - RNA, 20 nt, Mycobacterium tuberculosis H37Rv
gugucgacaaccgcugccgc

SEQ ID NO: 1313102 - RNA, 15 nt, Mycobacterium tuberculosis H37Rv
gugucgaagagcagg

SEQ ID NO: 1313103 - RNA, 21 nt, Mycobacterium tuberculosis H37Rv
gugucggcuggucgcugcugc

SEQ ID NO: 1313104 - RNA, 22 nt, Mycobacterium tuberculosis H37Rv
gugucguaggcgaugagcgugc

SEQ ID NO: 1313105 - RNA, 14 nt, Mycobacterium tuberculosis H37Rv
gugucggugcgcgc

SEQ ID NO: 1313106 - RNA, 15 nt, Mycobacterium tuberculosis H37Rv
gugucgaucagcucc

SEQ ID NO: 1313107 - RNA, 22 nt, Mycobacterium tuberculosis H37Rv
gugugcuucgagcaccgacacc

SEQ ID NO: 1313108 - RNA, 20 nt, Mycobacterium tuberculosis H37Rv
guguggaauacgcugcuggu

SEQ ID NO: 1313109 - RNA, 17 nt, Mycobacterium tuberculosis H37Rv
guguggaacauccgcac

SEQ ID NO: 1313110 - RNA, 15 nt, Mycobacterium tuberculosis H37Rv
gugugcuucgagcac

SEQ ID NO: 1313111 - RNA, 14 nt, Mycobacterium tuberculosis H37Rv
guguggcagcccca

SEQ ID NO: 1313112 - RNA, 13 nt, Mycobacterium tuberculosis H37Rv
guguggcagcccc

SEQ ID NO: 1313113 - RNA, 12 nt, Mycobacterium tuberculosis H37Rv
guguggcagccc

SEQ ID NO: 1313114 - RNA, 23 nt, Mycobacterium tuberculosis H37Rv
guguggcuugacgcccgggcacc

SEQ ID NO: 1313115 - RNA, 21 nt, Mycobacterium tuberculosis H37Rv
guguggcuuugacugcugggg

SEQ ID NO: 1313116 - RNA, 22 nt, Mycobacterium tuberculosis H37Rv
guguggcuuugacugcuggggg

SEQ ID NO: 1313117 - RNA, 18 nt, Mycobacterium tuberculosis H37Rv
guguggccuugcgucauc

SEQ ID NO: 1313118 - RNA, 16 nt, Mycobacterium tuberculosis H37Rv
gugugcugccaccggc

SEQ ID NO: 1313119 - RNA, 10 nt, Mycobacterium tuberculosis H37Rv
gugugcugca

SEQ ID NO: 1313120 - RNA, 17 nt, Mycobacterium tuberculosis H37Rv
gugucgucgaggucagu

SEQ ID NO: 1313121 - RNA, 21 nt, Mycobacterium tuberculosis H37Rv
gugucguucggcgaggacggc

SEQ ID NO: 1313122 - RNA, 12 nt, Mycobacterium tuberculosis H37Rv
guguagcccagc

SEQ ID NO: 1313123 - RNA, 22 nt, Mycobacterium tuberculosis H37Rv
guguaggcaaccuuuggccgcu

SEQ ID NO: 1313124 - RNA, 20 nt, Mycobacterium tuberculosis H37Rv
guguagacaggaccgguggg

SEQ ID NO: 1313125 - RNA, 18 nt, Mycobacterium tuberculosis H37Rv
guggucuuggcccggcgg

SEQ ID NO: 1313126 - RNA, 22 nt, Mycobacterium tuberculosis H37Rv
guguagccaaccguguaggcca

SEQ ID NO: 1313127 - RNA, 16 nt, Mycobacterium tuberculosis H37Rv
guguagcagcgccagc

SEQ ID NO: 1313128 - RNA, 20 nt, Mycobacterium tuberculosis H37Rv
guguagcagcgccagcagcu

SEQ ID NO: 1313129 - RNA, 18 nt, Mycobacterium tuberculosis H37Rv
guguaggccucggcagca

SEQ ID NO: 1313130 - RNA, 20 nt, Mycobacterium tuberculosis H37Rv
guguaggccucggcagcaaa

SEQ ID NO: 1313131 - RNA, 23 nt, Mycobacterium tuberculosis H37Rv
guguaggccugcccccggcgcgg

SEQ ID NO: 1313132 - RNA, 15 nt, Mycobacterium tuberculosis H37Rv
guguaguacagcgca

SEQ ID NO: 1313133 - RNA, 22 nt, Mycobacterium tuberculosis H37Rv
guguaugcauccacugcggcgc

SEQ ID NO: 1313134 - RNA, 22 nt, Mycobacterium tuberculosis H37Rv
gugucagcugauuaccgacacc

SEQ ID NO: 1313135 - RNA, 14 nt, Mycobacterium tuberculosis H37Rv
gugucaacggcacc

SEQ ID NO: 1313136 - RNA, 13 nt, Mycobacterium tuberculosis H37Rv
guguauuggggug

SEQ ID NO: 1313137 - RNA, 14 nt, Mycobacterium tuberculosis H37Rv
guguauuggggugg

SEQ ID NO: 1313138 - RNA, 15 nt, Mycobacterium tuberculosis H37Rv
guguuaggcccgcac

SEQ ID NO: 1313139 - RNA, 18 nt, Mycobacterium tuberculosis H37Rv
guguggcaccgugggcgg

SEQ ID NO: 1313140 - RNA, 13 nt, Mycobacterium tuberculosis H37Rv
guguucgccacac

SEQ ID NO: 1313141 - RNA, 22 nt, Mycobacterium tuberculosis H37Rv
guguucgacgagguugccgcac

SEQ ID NO: 1313142 - RNA, 18 nt, Mycobacterium tuberculosis H37Rv
guuaacacccugggcaaa

SEQ ID NO: 1313143 - RNA, 20 nt, Mycobacterium tuberculosis H37Rv
guucaacgcgcgcacgccac

SEQ ID NO: 1313144 - RNA, 21 nt, Mycobacterium tuberculosis H37Rv
guuaucccagacugucgagcg

SEQ ID NO: 1313145 - RNA, 13 nt, Mycobacterium tuberculosis H37Rv
guuacccaucgcc

SEQ ID NO: 1313146 - RNA, 21 nt, Mycobacterium tuberculosis H37Rv
guuaccgccaaacgcugcgcc

SEQ ID NO: 1313147 - RNA, 22 nt, Mycobacterium tuberculosis H37Rv
guuagcauugaguucggccacc

SEQ ID NO: 1313148 - RNA, 14 nt, Mycobacterium tuberculosis H37Rv
guuaggguccaggu

SEQ ID NO: 1313149 - RNA, 21 nt, Mycobacterium tuberculosis H37Rv
guuagguggcuggcugugccg

SEQ ID NO: 1313150 - RNA, 22 nt, Mycobacterium tuberculosis H37Rv
guuagcguagcccgaguuguug

SEQ ID NO: 1313151 - RNA, 23 nt, Mycobacterium tuberculosis H37Rv
guuagcgcggccagcagcagaug

SEQ ID NO: 1313152 - RNA, 19 nt, Mycobacterium tuberculosis H37Rv
guuaggaguggccgggcgg

SEQ ID NO: 1313153 - RNA, 23 nt, Mycobacterium tuberculosis H37Rv
guucaucacgccgccggagguga

SEQ ID NO: 1313154 - RNA, 17 nt, Mycobacterium tuberculosis H37Rv
guucacggggaccagau

SEQ ID NO: 1313155 - RNA, 21 nt, Mycobacterium tuberculosis H37Rv
guucacgcgcggaucggcggc

SEQ ID NO: 1313156 - RNA, 15 nt, Mycobacterium tuberculosis H37Rv
guucaccgaggugcc

SEQ ID NO: 1313157 - RNA, 21 nt, Mycobacterium tuberculosis H37Rv
guucacgccagucccacuggg

SEQ ID NO: 1313158 - RNA, 19 nt, Mycobacterium tuberculosis H37Rv
guuccacggacggucgggc

SEQ ID NO: 1313159 - RNA, 14 nt, Mycobacterium tuberculosis H37Rv
guucauccacuccg

SEQ ID NO: 1313160 - RNA, 21 nt, Mycobacterium tuberculosis H37Rv
guuccaguuggaacugaugaa

SEQ ID NO: 1313161 - RNA, 18 nt, Mycobacterium tuberculosis H37Rv
guuccauacagccgccga

SEQ ID NO: 1313162 - RNA, 16 nt, Mycobacterium tuberculosis H37Rv
guuccaucacggacca

SEQ ID NO: 1313163 - RNA, 22 nt, Mycobacterium tuberculosis H37Rv
guuccagccgacggcagugcug

SEQ ID NO: 1313164 - RNA, 15 nt, Mycobacterium tuberculosis H37Rv
guucccacccacgcc

SEQ ID NO: 1313165 - RNA, 19 nt, Mycobacterium tuberculosis H37Rv
guuccgcugcggugccggc

SEQ ID NO: 1313166 - RNA, 21 nt, Mycobacterium tuberculosis H37Rv
guuccgcugcggugccggccc

SEQ ID NO: 1313167 - RNA, 16 nt, Mycobacterium tuberculosis H37Rv
guuccgccggccccac

SEQ ID NO: 1313168 - RNA, 22 nt, Mycobacterium tuberculosis H37Rv
guuccgccaggccgaccgcgca

SEQ ID NO: 1313169 - RNA, 22 nt, Mycobacterium tuberculosis H37Rv
guucucaccaccagagacgauc

SEQ ID NO: 1313170 - RNA, 23 nt, Mycobacterium tuberculosis H37Rv
guucggccaccaaccucaucgcg

SEQ ID NO: 1313171 - RNA, 17 nt, Mycobacterium tuberculosis H37Rv
guucggcccgcaaacag

SEQ ID NO: 1313172 - RNA, 15 nt, Mycobacterium tuberculosis H37Rv
guucggcgcccgcuc

SEQ ID NO: 1313173 - RNA, 16 nt, Mycobacterium tuberculosis H37Rv
guucggcggcgccccg

SEQ ID NO: 1313174 - RNA, 20 nt, Mycobacterium tuberculosis H37Rv
guucggcgggagcugccggg

SEQ ID NO: 1313175 - RNA, 14 nt, Mycobacterium tuberculosis H37Rv
guucgggcagcacc

SEQ ID NO: 1313176 - RNA, 14 nt, Mycobacterium tuberculosis H37Rv
guucguagcgggca

SEQ ID NO: 1313177 - RNA, 13 nt, Mycobacterium tuberculosis H37Rv
guucgacccccgc

SEQ ID NO: 1313178 - RNA, 21 nt, Mycobacterium tuberculosis H37Rv
guuccuugagacgccggggaa

SEQ ID NO: 1313179 - RNA, 19 nt, Mycobacterium tuberculosis H37Rv
guuccuugccgaucgccga

SEQ ID NO: 1313180 - RNA, 16 nt, Mycobacterium tuberculosis H37Rv
guuccggcggucaaga

SEQ ID NO: 1313181 - RNA, 13 nt, Mycobacterium tuberculosis H37Rv
guuccggccggcu

SEQ ID NO: 1313182 - RNA, 12 nt, Mycobacterium tuberculosis H37Rv
guuccggcuggu

SEQ ID NO: 1313183 - RNA, 20 nt, Mycobacterium tuberculosis H37Rv
guuuccaagucggagcgggg

SEQ ID NO: 1313184 - RNA, 16 nt, Mycobacterium tuberculosis H37Rv
guuucacauuuuuguu

SEQ ID NO: 1313185 - RNA, 17 nt, Mycobacterium tuberculosis H37Rv
guuucacauuuuuguug

SEQ ID NO: 1313186 - RNA, 16 nt, Mycobacterium tuberculosis H37Rv
guuguggcacccggcu

SEQ ID NO: 1313187 - RNA, 23 nt, Mycobacterium tuberculosis H37Rv
guugugccgcaagccucguggug

SEQ ID NO: 1313188 - RNA, 17 nt, Mycobacterium tuberculosis H37Rv
guuuacggcccggcacc

SEQ ID NO: 1313189 - RNA, 15 nt, Mycobacterium tuberculosis H37Rv
guucuggaaccccga

SEQ ID NO: 1313190 - RNA, 17 nt, Mycobacterium tuberculosis H37Rv
guugucguugcuggugu

SEQ ID NO: 1313191 - RNA, 13 nt, Mycobacterium tuberculosis H37Rv
guugucguccaac

SEQ ID NO: 1313192 - RNA, 15 nt, Mycobacterium tuberculosis H37Rv
guugucuagcuggug

SEQ ID NO: 1313193 - RNA, 18 nt, Mycobacterium tuberculosis H37Rv
guugucuagcugguggug

SEQ ID NO: 1313194 - RNA, 18 nt, Mycobacterium tuberculosis H37Rv
guugucggcgcuccccuc

SEQ ID NO: 1313195 - RNA, 20 nt, Mycobacterium tuberculosis H37Rv
guuuggccgacagccaccgc

SEQ ID NO: 1313196 - RNA, 19 nt, Mycobacterium tuberculosis H37Rv
guuugucgugucaugcuca

SEQ ID NO: 1313197 - RNA, 16 nt, Mycobacterium tuberculosis H37Rv
guuugucgcgguggug

SEQ ID NO: 1313198 - RNA, 17 nt, Mycobacterium tuberculosis H37Rv
guuuguuuuugccuccc

SEQ ID NO: 1313199 - RNA, 13 nt, Mycobacterium tuberculosis H37Rv
guuugccggugcg

SEQ ID NO: 1313200 - RNA, 14 nt, Mycobacterium tuberculosis H37Rv
guuugccgguucgg

SEQ ID NO: 1313201 - RNA, 16 nt, Mycobacterium tuberculosis H37Rv
guuugcacgcaccaca

SEQ ID NO: 1313202 - RNA, 20 nt, Mycobacterium tuberculosis H37Rv
guuuucagagccgggcuggc

SEQ ID NO: 1313203 - RNA, 16 nt, Mycobacterium tuberculosis H37Rv
guuuucggccgccagu

SEQ ID NO: 1313204 - RNA, 18 nt, Mycobacterium tuberculosis H37Rv
guuuucggccgccaguac

SEQ ID NO: 1313205 - RNA, 15 nt, Mycobacterium tuberculosis H37Rv
guuuucgaucuggcu

SEQ ID NO: 1313206 - RNA, 20 nt, Mycobacterium tuberculosis H37Rv
guuuucgcgcuugaaacuga

SEQ ID NO: 1313207 - RNA, 14 nt, Mycobacterium tuberculosis H37Rv
guuuugcugcaugc

SEQ ID NO: 1313208 - RNA, 12 nt, Mycobacterium tuberculosis H37Rv
uaaccggcccga

SEQ ID NO: 1313209 - RNA, 15 nt, Mycobacterium tuberculosis H37Rv
uaaccggccaugucu

SEQ ID NO: 1313210 - RNA, 14 nt, Mycobacterium tuberculosis H37Rv
uaacgagccgucca

SEQ ID NO: 1313211 - RNA, 14 nt, Mycobacterium tuberculosis H37Rv
uaacgacugacaac

SEQ ID NO: 1313212 - RNA, 20 nt, Mycobacterium tuberculosis H37Rv
uaacccggcuccagcaccgu

SEQ ID NO: 1313213 - RNA, 21 nt, Mycobacterium tuberculosis H37Rv
uaacccuggcggaacagcuuc

SEQ ID NO: 1313214 - RNA, 19 nt, Mycobacterium tuberculosis H37Rv
uaacccggcuccagcaccg

SEQ ID NO: 1313215 - RNA, 11 nt, Mycobacterium tuberculosis H37Rv
uaaagaagccu

SEQ ID NO: 1313216 - RNA, 21 nt, Mycobacterium tuberculosis H37Rv
uaaaugggugugcugccaccg

SEQ ID NO: 1313217 - RNA, 22 nt, Mycobacterium tuberculosis H37Rv
uaaaugguggcguguucgacgg

SEQ ID NO: 1313218 - RNA, 19 nt, Mycobacterium tuberculosis H37Rv
uaaauaucggggccacuga

SEQ ID NO: 1313219 - RNA, 18 nt, Mycobacterium tuberculosis H37Rv
uauugaacccguguucug

SEQ ID NO: 1313220 - RNA, 12 nt, Mycobacterium tuberculosis H37Rv
uauucggcggca

SEQ ID NO: 1313221 - RNA, 20 nt, Mycobacterium tuberculosis H37Rv
uauugagucggcugguccuc

SEQ ID NO: 1313222 - RNA, 18 nt, Mycobacterium tuberculosis H37Rv
uauugcgcccggccauga

SEQ ID NO: 1313223 - RNA, 13 nt, Mycobacterium tuberculosis H37Rv
uauuggacugcag

SEQ ID NO: 1313224 - RNA, 16 nt, Mycobacterium tuberculosis H37Rv
uauugggguggcagcu

SEQ ID NO: 1313225 - RNA, 17 nt, Mycobacterium tuberculosis H37Rv
ucaagaagaacucggug

SEQ ID NO: 1313226 - RNA, 19 nt, Mycobacterium tuberculosis H37Rv
ucaacuucuuggugcccau

SEQ ID NO: 1313227 - RNA, 19 nt, Mycobacterium tuberculosis H37Rv
ucaagagugcucagcgcgc

SEQ ID NO: 1313228 - RNA, 19 nt, Mycobacterium tuberculosis H37Rv
ucaagauuaccgaagcccg

SEQ ID NO: 1313229 - RNA, 14 nt, Mycobacterium tuberculosis H37Rv
ucaagcacagcccg

SEQ ID NO: 1313230 - RNA, 13 nt, Mycobacterium tuberculosis H37Rv
ucaagcacagccc

SEQ ID NO: 1313231 - RNA, 12 nt, Mycobacterium tuberculosis H37Rv
ucaagcacagcc

SEQ ID NO: 1313232 - RNA, 16 nt, Mycobacterium tuberculosis H37Rv
ucaaccggccggugau

SEQ ID NO: 1313233 - RNA, 21 nt, Mycobacterium tuberculosis H37Rv
ucaacgcgaguccgcugcuuc

SEQ ID NO: 1313234 - RNA, 18 nt, Mycobacterium tuberculosis H37Rv
ucaacgcguugcacagca

SEQ ID NO: 1313235 - RNA, 19 nt, Mycobacterium tuberculosis H37Rv
ucaacgacgacgacaagug

SEQ ID NO: 1313236 - RNA, 22 nt, Mycobacterium tuberculosis H37Rv
ucaacguauccccgaccacuga

SEQ ID NO: 1313237 - RNA, 13 nt, Mycobacterium tuberculosis H37Rv
ucaacuccacgcg

SEQ ID NO: 1313238 - RNA, 23 nt, Mycobacterium tuberculosis H37Rv
ucaacucccgaacacuuugcgca

SEQ ID NO: 1313239 - RNA, 20 nt, Mycobacterium tuberculosis H37Rv
ucaacucgggcagcgcggcc

SEQ ID NO: 1313240 - RNA, 19 nt, Mycobacterium tuberculosis H37Rv
ucaacagcggcaagaaguu

SEQ ID NO: 1313241 - RNA, 13 nt, Mycobacterium tuberculosis H37Rv
ucaacagccaggg

SEQ ID NO: 1313242 - RNA, 12 nt, Mycobacterium tuberculosis H37Rv
ucaacagcaccg

SEQ ID NO: 1313243 - RNA, 22 nt, Mycobacterium tuberculosis H37Rv
ucaacaccagcaagugugagca

SEQ ID NO: 1313244 - RNA, 15 nt, Mycobacterium tuberculosis H37Rv
ucaaccaagcgugcc

SEQ ID NO: 1313245 - RNA, 22 nt, Mycobacterium tuberculosis H37Rv
ucaacaacagccgcagccaggu

SEQ ID NO: 1313246 - RNA, 23 nt, Mycobacterium tuberculosis H37Rv
ucaaaccuauccguucaauuucg

SEQ ID NO: 1313247 - RNA, 20 nt, Mycobacterium tuberculosis H37Rv
ucaaacccgaaaacccaaca

SEQ ID NO: 1313248 - RNA, 19 nt, Mycobacterium tuberculosis H37Rv
ucaaacccgaaaacccaac

SEQ ID NO: 1313249 - RNA, 15 nt, Mycobacterium tuberculosis H37Rv
ucaaaaucagggugc

SEQ ID NO: 1313250 - RNA, 17 nt, Mycobacterium tuberculosis H37Rv
ucaaguucgccagcaac

SEQ ID NO: 1313251 - RNA, 21 nt, Mycobacterium tuberculosis H37Rv
ucaaguggcaaccgcaccgca

SEQ ID NO: 1313252 - RNA, 19 nt, Mycobacterium tuberculosis H37Rv
ucaaggcgugcacccccau

SEQ ID NO: 1313253 - RNA, 15 nt, Mycobacterium tuberculosis H37Rv
ucaaggaagccgcgg

SEQ ID NO: 1313254 - RNA, 15 nt, Mycobacterium tuberculosis H37Rv
ucaaggugcgccgcc

SEQ ID NO: 1313255 - RNA, 20 nt, Mycobacterium tuberculosis H37Rv
ucaagguuucgacaucacuc

SEQ ID NO: 1313256 - RNA, 22 nt, Mycobacterium tuberculosis H37Rv
ucaauaauggcaaccagcuucu

SEQ ID NO: 1313257 - RNA, 16 nt, Mycobacterium tuberculosis H37Rv
ucaauaguguguuugg

SEQ ID NO: 1313258 - RNA, 12 nt, Mycobacterium tuberculosis H37Rv
ucacaaacccag

SEQ ID NO: 1313259 - RNA, 23 nt, Mycobacterium tuberculosis H37Rv
ucaauuccgcgaguagaucaucg

SEQ ID NO: 1313260 - RNA, 19 nt, Mycobacterium tuberculosis H37Rv
ucaaugcgcgcugggaggc

SEQ ID NO: 1313261 - RNA, 15 nt, Mycobacterium tuberculosis H37Rv
ucacagccaccagcc

SEQ ID NO: 1313262 - RNA, 14 nt, Mycobacterium tuberculosis H37Rv
ucacagccaccagc

SEQ ID NO: 1313263 - RNA, 19 nt, Mycobacterium tuberculosis H37Rv
ucacaggccgccugggggu

SEQ ID NO: 1313264 - RNA, 18 nt, Mycobacterium tuberculosis H37Rv
ucacaggccgccuggggg

SEQ ID NO: 1313265 - RNA, 17 nt, Mycobacterium tuberculosis H37Rv
ucacaggccgccugggg

SEQ ID NO: 1313266 - RNA, 17 nt, Mycobacterium tuberculosis H37Rv
ucacagcuugagcacac

SEQ ID NO: 1313267 - RNA, 22 nt, Mycobacterium tuberculosis H37Rv
ucacacccacacccagcgugcc

SEQ ID NO: 1313268 - RNA, 11 nt, Mycobacterium tuberculosis H37Rv
ucacaccagcg

SEQ ID NO: 1313269 - RNA, 15 nt, Mycobacterium tuberculosis H37Rv
ucacaccccaggcac

SEQ ID NO: 1313270 - RNA, 14 nt, Mycobacterium tuberculosis H37Rv
ucacacgccagccg

SEQ ID NO: 1313271 - RNA, 23 nt, Mycobacterium tuberculosis H37Rv
ucacacguuggcagcccucuggu

SEQ ID NO: 1313272 - RNA, 18 nt, Mycobacterium tuberculosis H37Rv
ucacaacgugcccaccaa

SEQ ID NO: 1313273 - RNA, 19 nt, Mycobacterium tuberculosis H37Rv
ucacauccgacagcagccg

SEQ ID NO: 1313274 - RNA, 15 nt, Mycobacterium tuberculosis H37Rv
ucacauccacgcacu

SEQ ID NO: 1313275 - RNA, 21 nt, Mycobacterium tuberculosis H37Rv
ucacaucggccucugaccagc

SEQ ID NO: 1313276 - RNA, 18 nt, Mycobacterium tuberculosis H37Rv
ucacaugcccgcaccguc

SEQ ID NO: 1313277 - RNA, 15 nt, Mycobacterium tuberculosis H37Rv
ucacauacagcaggc

SEQ ID NO: 1313278 - RNA, 15 nt, Mycobacterium tuberculosis H37Rv
ucacaugcgccgaaa

SEQ ID NO: 1313279 - RNA, 21 nt, Mycobacterium tuberculosis H37Rv
ucacaugcgccgaaacucaag

SEQ ID NO: 1313280 - RNA, 15 nt, Mycobacterium tuberculosis H37Rv
ucacauuggccaggu

SEQ ID NO: 1313281 - RNA, 20 nt, Mycobacterium tuberculosis H37Rv
ucaccaacccguguggcacg

SEQ ID NO: 1313282 - RNA, 17 nt, Mycobacterium tuberculosis H37Rv
ucaccaacgcgggaacg

SEQ ID NO: 1313283 - RNA, 22 nt, Mycobacterium tuberculosis H37Rv
ucaccaaucugcgggccgguga

SEQ ID NO: 1313284 - RNA, 20 nt, Mycobacterium tuberculosis H37Rv
ucacccggucaacgugaacu

SEQ ID NO: 1313285 - RNA, 18 nt, Mycobacterium tuberculosis H37Rv
ucaccgaugagccgacgg

SEQ ID NO: 1313286 - RNA, 18 nt, Mycobacterium tuberculosis H37Rv
ucaccgaucccgcggccg

SEQ ID NO: 1313287 - RNA, 22 nt, Mycobacterium tuberculosis H37Rv
ucaccgaucccgcggccgggcc

SEQ ID NO: 1313288 - RNA, 18 nt, Mycobacterium tuberculosis H37Rv
ucaccgaucgaacagugc

SEQ ID NO: 1313289 - RNA, 19 nt, Mycobacterium tuberculosis H37Rv
ucaccgaacgacccuggcc

SEQ ID NO: 1313290 - RNA, 20 nt, Mycobacterium tuberculosis H37Rv
ucaccgaaacgaugcggccu

SEQ ID NO: 1313291 - RNA, 22 nt, Mycobacterium tuberculosis H37Rv
ucaccgcacaccugcgcggcgu

SEQ ID NO: 1313292 - RNA, 17 nt, Mycobacterium tuberculosis H37Rv
ucaccgccaccaccagg

SEQ ID NO: 1313293 - RNA, 21 nt, Mycobacterium tuberculosis H37Rv
ucaccgccagcugggcagcca

SEQ ID NO: 1313294 - RNA, 17 nt, Mycobacterium tuberculosis H37Rv
ucaccgccguugccgcc

SEQ ID NO: 1313295 - RNA, 18 nt, Mycobacterium tuberculosis H37Rv
ucaccgccgcgaccgccu

SEQ ID NO: 1313296 - RNA, 15 nt, Mycobacterium tuberculosis H37Rv
ucaccgccgcggccg

SEQ ID NO: 1313297 - RNA, 16 nt, Mycobacterium tuberculosis H37Rv
ucaccgccgggaagcc

SEQ ID NO: 1313298 - RNA, 14 nt, Mycobacterium tuberculosis H37Rv
ucaccgccagcccc

SEQ ID NO: 1313299 - RNA, 18 nt, Mycobacterium tuberculosis H37Rv
ucaccgcguagaccccaa

SEQ ID NO: 1313300 - RNA, 19 nt, Mycobacterium tuberculosis H37Rv
ucaccgcguagaccccaau

SEQ ID NO: 1313301 - RNA, 14 nt, Mycobacterium tuberculosis H37Rv
ucaccgcgcugaac

SEQ ID NO: 1313302 - RNA, 17 nt, Mycobacterium tuberculosis H37Rv
ucaccguuggccgcgcu

SEQ ID NO: 1313303 - RNA, 16 nt, Mycobacterium tuberculosis H37Rv
ucaccgugguggcgua

SEQ ID NO: 1313304 - RNA, 15 nt, Mycobacterium tuberculosis H37Rv
ucaccguuggccgcg

SEQ ID NO: 1313305 - RNA, 14 nt, Mycobacterium tuberculosis H37Rv
ucaccgguucggug

SEQ ID NO: 1313306 - RNA, 17 nt, Mycobacterium tuberculosis H37Rv
ucaccguaauuucuuca

SEQ ID NO: 1313307 - RNA, 13 nt, Mycobacterium tuberculosis H37Rv
ucaccggcugcug

SEQ ID NO: 1313308 - RNA, 14 nt, Mycobacterium tuberculosis H37Rv
ucaccggcauacag

SEQ ID NO: 1313309 - RNA, 18 nt, Mycobacterium tuberculosis H37Rv
ucaccggcauacagccgg

SEQ ID NO: 1313310 - RNA, 22 nt, Mycobacterium tuberculosis H37Rv
ucacccagcucgcgcacccagc

SEQ ID NO: 1313311 - RNA, 19 nt, Mycobacterium tuberculosis H37Rv
ucacccagcucgcgcaccc

SEQ ID NO: 1313312 - RNA, 22 nt, Mycobacterium tuberculosis H37Rv
ucacccacccgcaccgcgguac

SEQ ID NO: 1313313 - RNA, 15 nt, Mycobacterium tuberculosis H37Rv
ucaccagacgcugcc

SEQ ID NO: 1313314 - RNA, 21 nt, Mycobacterium tuberculosis H37Rv
ucaccacgccggucgagguga

SEQ ID NO: 1313315 - RNA, 16 nt, Mycobacterium tuberculosis H37Rv
ucaccaccgccagcga

SEQ ID NO: 1313316 - RNA, 21 nt, Mycobacterium tuberculosis H37Rv
ucacgcgcggaucggcggccg

SEQ ID NO: 1313317 - RNA, 13 nt, Mycobacterium tuberculosis H37Rv
ucacggcggggau

SEQ ID NO: 1313318 - RNA, 16 nt, Mycobacterium tuberculosis H37Rv
ucacgguugccgcgau

SEQ ID NO: 1313319 - RNA, 22 nt, Mycobacterium tuberculosis H37Rv
ucacgguggugucagccaccgg

SEQ ID NO: 1313320 - RNA, 21 nt, Mycobacterium tuberculosis H37Rv
ucacgggcuaccggcagcugc

SEQ ID NO: 1313321 - RNA, 21 nt, Mycobacterium tuberculosis H37Rv
ucacgggguccgaugcgugcc

SEQ ID NO: 1313322 - RNA, 12 nt, Mycobacterium tuberculosis H37Rv
ucacgcaccaca

SEQ ID NO: 1313323 - RNA, 16 nt, Mycobacterium tuberculosis H37Rv
ucacgcacaagccucg

SEQ ID NO: 1313324 - RNA, 19 nt, Mycobacterium tuberculosis H37Rv
ucacgcacccggcgcaaca

SEQ ID NO: 1313325 - RNA, 12 nt, Mycobacterium tuberculosis H37Rv
ucacgcacugau

SEQ ID NO: 1313326 - RNA, 13 nt, Mycobacterium tuberculosis H37Rv
ucacgccugccac

SEQ ID NO: 1313327 - RNA, 13 nt, Mycobacterium tuberculosis H37Rv
ucacgcccaccac

SEQ ID NO: 1313328 - RNA, 16 nt, Mycobacterium tuberculosis H37Rv
ucaccuugcugcaguc

SEQ ID NO: 1313329 - RNA, 21 nt, Mycobacterium tuberculosis H37Rv
ucacgacgccgagcagauacu

SEQ ID NO: 1313330 - RNA, 14 nt, Mycobacterium tuberculosis H37Rv
ucacgacgccgaau

SEQ ID NO: 1313331 - RNA, 17 nt, Mycobacterium tuberculosis H37Rv
ucacgaccugcucaucc

SEQ ID NO: 1313332 - RNA, 13 nt, Mycobacterium tuberculosis H37Rv
ucacgagccaggg

SEQ ID NO: 1313333 - RNA, 18 nt, Mycobacterium tuberculosis H37Rv
ucaccugggccagcagcc

SEQ ID NO: 1313334 - RNA, 20 nt, Mycobacterium tuberculosis H37Rv
ucaccuggugugcgggagac

SEQ ID NO: 1313335 - RNA, 21 nt, Mycobacterium tuberculosis H37Rv
ucaccuggcgugucgccgcca

SEQ ID NO: 1313336 - RNA, 17 nt, Mycobacterium tuberculosis H37Rv
ucaccuucggccgaccg

SEQ ID NO: 1313337 - RNA, 18 nt, Mycobacterium tuberculosis H37Rv
ucaccuucaccgggugac

SEQ ID NO: 1313338 - RNA, 20 nt, Mycobacterium tuberculosis H37Rv
ucaccucggugccggccgca

SEQ ID NO: 1313339 - RNA, 18 nt, Mycobacterium tuberculosis H37Rv
ucacugugccgcugcauc

SEQ ID NO: 1313340 - RNA, 14 nt, Mycobacterium tuberculosis H37Rv
ucacugcgagcgca

SEQ ID NO: 1313341 - RNA, 14 nt, Mycobacterium tuberculosis H37Rv
ucacugaugggccg

SEQ ID NO: 1313342 - RNA, 11 nt, Mycobacterium tuberculosis H37Rv
ucacugagauc

SEQ ID NO: 1313343 - RNA, 23 nt, Mycobacterium tuberculosis H37Rv
ucacuucgcguuucacgaaaccc

SEQ ID NO: 1313344 - RNA, 22 nt, Mycobacterium tuberculosis H37Rv
ucacguagcgaccgcggucgcu

SEQ ID NO: 1313345 - RNA, 13 nt, Mycobacterium tuberculosis H37Rv
ucacguaauuccc

SEQ ID NO: 1313346 - RNA, 15 nt, Mycobacterium tuberculosis H37Rv
ucacguaauucccca

SEQ ID NO: 1313347 - RNA, 17 nt, Mycobacterium tuberculosis H37Rv
ucacguaauuccccagg

SEQ ID NO: 1313348 - RNA, 17 nt, Mycobacterium tuberculosis H37Rv
ucacguagcgagcccac

SEQ ID NO: 1313349 - RNA, 14 nt, Mycobacterium tuberculosis H37Rv
ucacuacuccgguc

SEQ ID NO: 1313350 - RNA, 16 nt, Mycobacterium tuberculosis H37Rv
ucacuccaugauccag

SEQ ID NO: 1313351 - RNA, 17 nt, Mycobacterium tuberculosis H37Rv
ucagaacaccggccagg

SEQ ID NO: 1313352 - RNA, 15 nt, Mycobacterium tuberculosis H37Rv
ucagaaucaggcucg

SEQ ID NO: 1313353 - RNA, 22 nt, Mycobacterium tuberculosis H37Rv
ucagaaucaggcucgccgaugc

SEQ ID NO: 1313354 - RNA, 18 nt, Mycobacterium tuberculosis H37Rv
ucagacgauucggcggcc

SEQ ID NO: 1313355 - RNA, 19 nt, Mycobacterium tuberculosis H37Rv
ucagacccagcgcggcaac

SEQ ID NO: 1313356 - RNA, 11 nt, Mycobacterium tuberculosis H37Rv
ucagacaacaa

SEQ ID NO: 1313357 - RNA, 17 nt, Mycobacterium tuberculosis H37Rv
ucagaaugccuggcccg

SEQ ID NO: 1313358 - RNA, 23 nt, Mycobacterium tuberculosis H37Rv
ucagaauugugugcagcagcauc

SEQ ID NO: 1313359 - RNA, 13 nt, Mycobacterium tuberculosis H37Rv
ucagauggccacc

SEQ ID NO: 1313360 - RNA, 14 nt, Mycobacterium tuberculosis H37Rv
ucagauggccaccc

SEQ ID NO: 1313361 - RNA, 12 nt, Mycobacterium tuberculosis H37Rv
ucagcagcucca

SEQ ID NO: 1313362 - RNA, 22 nt, Mycobacterium tuberculosis H37Rv
ucagcaggagaucaacauccug

SEQ ID NO: 1313363 - RNA, 14 nt, Mycobacterium tuberculosis H37Rv
ucagcaggcccagc

SEQ ID NO: 1313364 - RNA, 18 nt, Mycobacterium tuberculosis H37Rv
ucagcaggaucggcagca

SEQ ID NO: 1313365 - RNA, 16 nt, Mycobacterium tuberculosis H37Rv
ucagcacccaccgaag

SEQ ID NO: 1313366 - RNA, 15 nt, Mycobacterium tuberculosis H37Rv
ucagcacaaacccag

SEQ ID NO: 1313367 - RNA, 23 nt, Mycobacterium tuberculosis H37Rv
ucagcacguaacgccgcucaucc

SEQ ID NO: 1313368 - RNA, 21 nt, Mycobacterium tuberculosis H37Rv
ucagcacggugaucagcagca

SEQ ID NO: 1313369 - RNA, 20 nt, Mycobacterium tuberculosis H37Rv
ucagcaagaucggcagcgug

SEQ ID NO: 1313370 - RNA, 22 nt, Mycobacterium tuberculosis H37Rv
ucagcgaccacgucaagaagaa

SEQ ID NO: 1313371 - RNA, 21 nt, Mycobacterium tuberculosis H37Rv
ucagccugauauccgcggauc

SEQ ID NO: 1313372 - RNA, 21 nt, Mycobacterium tuberculosis H37Rv
ucagccgggugcgcacccggg

SEQ ID NO: 1313373 - RNA, 15 nt, Mycobacterium tuberculosis H37Rv
ucagccguggcaguc

SEQ ID NO: 1313374 - RNA, 22 nt, Mycobacterium tuberculosis H37Rv
ucagccggugacaaguggugcc

SEQ ID NO: 1313375 - RNA, 17 nt, Mycobacterium tuberculosis H37Rv
ucagccgguggucugcg

SEQ ID NO: 1313376 - RNA, 22 nt, Mycobacterium tuberculosis H37Rv
ucagccgcgcgggucacgaccu

SEQ ID NO: 1313377 - RNA, 18 nt, Mycobacterium tuberculosis H37Rv
ucagccgcgccggguccg

SEQ ID NO: 1313378 - RNA, 21 nt, Mycobacterium tuberculosis H37Rv
ucagccgcggcggcagcaccc

SEQ ID NO: 1313379 - RNA, 15 nt, Mycobacterium tuberculosis H37Rv
ucagccggaccacca

SEQ ID NO: 1313380 - RNA, 18 nt, Mycobacterium tuberculosis H37Rv
ucagcccggcgcgccgag

SEQ ID NO: 1313381 - RNA, 17 nt, Mycobacterium tuberculosis H37Rv
ucagcccggcgcgaucc

SEQ ID NO: 1313382 - RNA, 15 nt, Mycobacterium tuberculosis H37Rv
ucagcccggcgcgcc

SEQ ID NO: 1313383 - RNA, 13 nt, Mycobacterium tuberculosis H37Rv
ucagcccgcgcag

SEQ ID NO: 1313384 - RNA, 21 nt, Mycobacterium tuberculosis H37Rv
ucagccaggccagugccaccu

SEQ ID NO: 1313385 - RNA, 14 nt, Mycobacterium tuberculosis H37Rv
ucagccacgcagca

SEQ ID NO: 1313386 - RNA, 19 nt, Mycobacterium tuberculosis H37Rv
ucagccacgcagcacggca

SEQ ID NO: 1313387 - RNA, 21 nt, Mycobacterium tuberculosis H37Rv
ucagcccagccaacucaggcc

SEQ ID NO: 1313388 - RNA, 19 nt, Mycobacterium tuberculosis H37Rv
ucagccaguccagcgcgcc

SEQ ID NO: 1313389 - RNA, 17 nt, Mycobacterium tuberculosis H37Rv
ucagcaugguccacagc

SEQ ID NO: 1313390 - RNA, 12 nt, Mycobacterium tuberculosis H37Rv
ucagccaccauc

SEQ ID NO: 1313391 - RNA, 19 nt, Mycobacterium tuberculosis H37Rv
ucagccaccaucuggaugg

SEQ ID NO: 1313392 - RNA, 16 nt, Mycobacterium tuberculosis H37Rv
uaugugcccggcgcga

SEQ ID NO: 1313393 - RNA, 19 nt, Mycobacterium tuberculosis H37Rv
uauguucggcgguguccua

SEQ ID NO: 1313394 - RNA, 22 nt, Mycobacterium tuberculosis H37Rv
uauggcccgggccgaagcgcgc

SEQ ID NO: 1313395 - RNA, 18 nt, Mycobacterium tuberculosis H37Rv
uaugccaggacuggcacc

SEQ ID NO: 1313396 - RNA, 12 nt, Mycobacterium tuberculosis H37Rv
uaugccacaggc

SEQ ID NO: 1313397 - RNA, 20 nt, Mycobacterium tuberculosis H37Rv
uauccgugaauggcagcacg

SEQ ID NO: 1313398 - RNA, 17 nt, Mycobacterium tuberculosis H37Rv
uauccggacuugaccag

SEQ ID NO: 1313399 - RNA, 20 nt, Mycobacterium tuberculosis H37Rv
uauccggaucggccugucca

SEQ ID NO: 1313400 - RNA, 13 nt, Mycobacterium tuberculosis H37Rv
uaucgccgggaac

SEQ ID NO: 1313401 - RNA, 17 nt, Mycobacterium tuberculosis H37Rv
uaucguuggcgaccacc

SEQ ID NO: 1313402 - RNA, 21 nt, Mycobacterium tuberculosis H37Rv
uaucggugcuggucgccgcgg

SEQ ID NO: 1313403 - RNA, 15 nt, Mycobacterium tuberculosis H37Rv
uaucggcgugucucg

SEQ ID NO: 1313404 - RNA, 19 nt, Mycobacterium tuberculosis H37Rv
uagauggugguggcccggc

SEQ ID NO: 1313405 - RNA, 20 nt, Mycobacterium tuberculosis H37Rv
uagauggugguggcccggcu

SEQ ID NO: 1313406 - RNA, 19 nt, Mycobacterium tuberculosis H37Rv
uagaugcggaacgccgagc

SEQ ID NO: 1313407 - RNA, 12 nt, Mycobacterium tuberculosis H37Rv
uagcagcgcggc

SEQ ID NO: 1313408 - RNA, 18 nt, Mycobacterium tuberculosis H37Rv
uagcccgaccgguccagc

SEQ ID NO: 1313409 - RNA, 15 nt, Mycobacterium tuberculosis H37Rv
uagcccgauggugcc

SEQ ID NO: 1313410 - RNA, 21 nt, Mycobacterium tuberculosis H37Rv
uagcccgccacccuuggcccg

SEQ ID NO: 1313411 - RNA, 22 nt, Mycobacterium tuberculosis H37Rv
uagccccgcagagucgccgaac

SEQ ID NO: 1313412 - RNA, 15 nt, Mycobacterium tuberculosis H37Rv
uagcccggcagcacg

SEQ ID NO: 1313413 - RNA, 16 nt, Mycobacterium tuberculosis H37Rv
uagcccggcagcacgu

SEQ ID NO: 1313414 - RNA, 19 nt, Mycobacterium tuberculosis H37Rv
uagcccacccauggccucc

SEQ ID NO: 1313415 - RNA, 16 nt, Mycobacterium tuberculosis H37Rv
uagcggucccgcggac

SEQ ID NO: 1313416 - RNA, 19 nt, Mycobacterium tuberculosis H37Rv
uagcggcgcccgccaccgg

SEQ ID NO: 1313417 - RNA, 23 nt, Mycobacterium tuberculosis H37Rv
uagcggcgcagcgugagugcagc

SEQ ID NO: 1313418 - RNA, 13 nt, Mycobacterium tuberculosis H37Rv
uagcggcugaggg

SEQ ID NO: 1313419 - RNA, 22 nt, Mycobacterium tuberculosis H37Rv
uagcggcuugaacagcugaucc

SEQ ID NO: 1313420 - RNA, 18 nt, Mycobacterium tuberculosis H37Rv
uagcggaucaggucuggc

SEQ ID NO: 1313421 - RNA, 21 nt, Mycobacterium tuberculosis H37Rv
uagcgcuugccgcugagcccu

SEQ ID NO: 1313422 - RNA, 19 nt, Mycobacterium tuberculosis H37Rv
uagcgccgcgcccaccaug

SEQ ID NO: 1313423 - RNA, 23 nt, Mycobacterium tuberculosis H37Rv
uagcgcccaccguagacgacauc

SEQ ID NO: 1313424 - RNA, 14 nt, Mycobacterium tuberculosis H37Rv
uagcgcgugcugca

SEQ ID NO: 1313425 - RNA, 17 nt, Mycobacterium tuberculosis H37Rv
uagcgcgggcucacaug

SEQ ID NO: 1313426 - RNA, 15 nt, Mycobacterium tuberculosis H37Rv
uagccgaaaaagacc

SEQ ID NO: 1313427 - RNA, 15 nt, Mycobacterium tuberculosis H37Rv
uagccgaacagcgga

SEQ ID NO: 1313428 - RNA, 23 nt, Mycobacterium tuberculosis H37Rv
uagcccuugccguguucgggggc

SEQ ID NO: 1313429 - RNA, 21 nt, Mycobacterium tuberculosis H37Rv
uagcgcaccacacuggcagug

SEQ ID NO: 1313430 - RNA, 18 nt, Mycobacterium tuberculosis H37Rv
uagcgcacugccgggugg

SEQ ID NO: 1313431 - RNA, 19 nt, Mycobacterium tuberculosis H37Rv
uagccgaagcgcccggaga

SEQ ID NO: 1313432 - RNA, 15 nt, Mycobacterium tuberculosis H37Rv
uagccgaccagcgcu

SEQ ID NO: 1313433 - RNA, 21 nt, Mycobacterium tuberculosis H37Rv
uagccgagaagagauccugga

SEQ ID NO: 1313434 - RNA, 13 nt, Mycobacterium tuberculosis H37Rv
uagccgagccagu

SEQ ID NO: 1313435 - RNA, 18 nt, Mycobacterium tuberculosis H37Rv
uagccgagcuugaaauag

SEQ ID NO: 1313436 - RNA, 11 nt, Mycobacterium tuberculosis H37Rv
uaggcccagca

SEQ ID NO: 1313437 - RNA, 15 nt, Mycobacterium tuberculosis H37Rv
uaggccaccacugcg

SEQ ID NO: 1313438 - RNA, 19 nt, Mycobacterium tuberculosis H37Rv
uaggacaccgucaugccgu

SEQ ID NO: 1313439 - RNA, 13 nt, Mycobacterium tuberculosis H37Rv
uaggaccaccagc

SEQ ID NO: 1313440 - RNA, 16 nt, Mycobacterium tuberculosis H37Rv
uaggacccagccagcu

SEQ ID NO: 1313441 - RNA, 13 nt, Mycobacterium tuberculosis H37Rv
uaggacaggaucg

SEQ ID NO: 1313442 - RNA, 19 nt, Mycobacterium tuberculosis H37Rv
uaggacuugauaucggcgg

SEQ ID NO: 1313443 - RNA, 22 nt, Mycobacterium tuberculosis H37Rv
uagcuguuggccagccgacaac

SEQ ID NO: 1313444 - RNA, 20 nt, Mycobacterium tuberculosis H37Rv
uaguuuaucggccgugaauu

SEQ ID NO: 1313445 - RNA, 15 nt, Mycobacterium tuberculosis H37Rv
uagugcucgcagcca

SEQ ID NO: 1313446 - RNA, 21 nt, Mycobacterium tuberculosis H37Rv
uaguagugagaaaucaaaucc

SEQ ID NO: 1313447 - RNA, 12 nt, Mycobacterium tuberculosis H37Rv
uagucagaaccg

SEQ ID NO: 1313448 - RNA, 18 nt, Mycobacterium tuberculosis H37Rv
uagucgaauggcaacaca

SEQ ID NO: 1313449 - RNA, 16 nt, Mycobacterium tuberculosis H37Rv
uagucgccggucaggc

SEQ ID NO: 1313450 - RNA, 21 nt, Mycobacterium tuberculosis H37Rv
uaguccgcgccgacggccagc

SEQ ID NO: 1313451 - RNA, 20 nt, Mycobacterium tuberculosis H37Rv
uagucccucaucaccucucc

SEQ ID NO: 1313452 - RNA, 13 nt, Mycobacterium tuberculosis H37Rv
uaggcuccaagca

SEQ ID NO: 1313453 - RNA, 19 nt, Mycobacterium tuberculosis H37Rv
uaggcuccaagcaauucca

SEQ ID NO: 1313454 - RNA, 13 nt, Mycobacterium tuberculosis H37Rv
uaggugggcucgu

SEQ ID NO: 1313455 - RNA, 19 nt, Mycobacterium tuberculosis H37Rv
uaggugucgggcucgcauu

SEQ ID NO: 1313456 - RNA, 20 nt, Mycobacterium tuberculosis H37Rv
uaggugacgccgccagcacc

SEQ ID NO: 1313457 - RNA, 23 nt, Mycobacterium tuberculosis H37Rv
uaggugcucgcgaucugcucgua

SEQ ID NO: 1313458 - RNA, 20 nt, Mycobacterium tuberculosis H37Rv
uagguuuucggcggcucuag

SEQ ID NO: 1313459 - RNA, 18 nt, Mycobacterium tuberculosis H37Rv
uacggaccguggcagcug

SEQ ID NO: 1313460 - RNA, 16 nt, Mycobacterium tuberculosis H37Rv
uacgcgcugacccgcc

SEQ ID NO: 1313461 - RNA, 17 nt, Mycobacterium tuberculosis H37Rv
uacggcccggcacccgg

SEQ ID NO: 1313462 - RNA, 13 nt, Mycobacterium tuberculosis H37Rv
uacggccacaccg

SEQ ID NO: 1313463 - RNA, 19 nt, Mycobacterium tuberculosis H37Rv
uacgaagccgccgcgacca

SEQ ID NO: 1313464 - RNA, 11 nt, Mycobacterium tuberculosis H37Rv
uaccagcaccg

SEQ ID NO: 1313465 - RNA, 21 nt, Mycobacterium tuberculosis H37Rv
uaccaggucggaacuagccag

SEQ ID NO: 1313466 - RNA, 22 nt, Mycobacterium tuberculosis H37Rv
uaccagcuggccacuuucagau

SEQ ID NO: 1313467 - RNA, 22 nt, Mycobacterium tuberculosis H37Rv
uaccacuguuacggccacaccg

SEQ ID NO: 1313468 - RNA, 15 nt, Mycobacterium tuberculosis H37Rv
uaccggcuggccagg

SEQ ID NO: 1313469 - RNA, 15 nt, Mycobacterium tuberculosis H37Rv
uaccggucagcaccu

SEQ ID NO: 1313470 - RNA, 14 nt, Mycobacterium tuberculosis H37Rv
uaccgcgaagcugc

SEQ ID NO: 1313471 - RNA, 21 nt, Mycobacterium tuberculosis H37Rv
uaccgccggcgccggugccgc

SEQ ID NO: 1313472 - RNA, 20 nt, Mycobacterium tuberculosis H37Rv
uaccgccggcggcggccgca

SEQ ID NO: 1313473 - RNA, 14 nt, Mycobacterium tuberculosis H37Rv
uaccgccgcgaccg

SEQ ID NO: 1313474 - RNA, 21 nt, Mycobacterium tuberculosis H37Rv
uaccgccgcgcagccgcucga

SEQ ID NO: 1313475 - RNA, 16 nt, Mycobacterium tuberculosis H37Rv
uaccgccagcgccacc

SEQ ID NO: 1313476 - RNA, 14 nt, Mycobacterium tuberculosis H37Rv
uaccgauuggcccg

SEQ ID NO: 1313477 - RNA, 14 nt, Mycobacterium tuberculosis H37Rv
uaccgaucagcagg

SEQ ID NO: 1313478 - RNA, 18 nt, Mycobacterium tuberculosis H37Rv
uaccgcaauggcggccuu

SEQ ID NO: 1313479 - RNA, 15 nt, Mycobacterium tuberculosis H37Rv
uaccccagcgcuguc

SEQ ID NO: 1313480 - RNA, 19 nt, Mycobacterium tuberculosis H37Rv
uacccaccucccgcagccg

SEQ ID NO: 1313481 - RNA, 16 nt, Mycobacterium tuberculosis H37Rv
uacccacgacgggccg

SEQ ID NO: 1313482 - RNA, 13 nt, Mycobacterium tuberculosis H37Rv
uacccaccagggu

SEQ ID NO: 1313483 - RNA, 23 nt, Mycobacterium tuberculosis H37Rv
uaccccagcaucuuuggcggccg

SEQ ID NO: 1313484 - RNA, 17 nt, Mycobacterium tuberculosis H37Rv
uacucgcggcgcggccg

SEQ ID NO: 1313485 - RNA, 22 nt, Mycobacterium tuberculosis H37Rv
uacucgcggcgcggccgcagcc

SEQ ID NO: 1313486 - RNA, 18 nt, Mycobacterium tuberculosis H37Rv
uacucggcgacugcgucg

SEQ ID NO: 1313487 - RNA, 16 nt, Mycobacterium tuberculosis H37Rv
uacuccgacggcccgg

SEQ ID NO: 1313488 - RNA, 16 nt, Mycobacterium tuberculosis H37Rv
uacucgaaacccaugu

SEQ ID NO: 1313489 - RNA, 15 nt, Mycobacterium tuberculosis H37Rv
uacucagguggaagu

SEQ ID NO: 1313490 - RNA, 15 nt, Mycobacterium tuberculosis H37Rv
uacuccacccaggcc

SEQ ID NO: 1313491 - RNA, 11 nt, Mycobacterium tuberculosis H37Rv
uacugcugcuu

SEQ ID NO: 1313492 - RNA, 21 nt, Mycobacterium tuberculosis H37Rv
uacugaggaaagucaccgucc

SEQ ID NO: 1313493 - RNA, 21 nt, Mycobacterium tuberculosis H37Rv
uacugagccgcgaaaucaccg

SEQ ID NO: 1313494 - RNA, 16 nt, Mycobacterium tuberculosis H37Rv
uacugguuagagacuu

SEQ ID NO: 1313495 - RNA, 21 nt, Mycobacterium tuberculosis H37Rv
uacuguucugcuggcuguggc

SEQ ID NO: 1313496 - RNA, 18 nt, Mycobacterium tuberculosis H37Rv
uacuggcguugccaccgg

SEQ ID NO: 1313497 - RNA, 19 nt, Mycobacterium tuberculosis H37Rv
uacuucaucggcacaggcg

SEQ ID NO: 1313498 - RNA, 12 nt, Mycobacterium tuberculosis H37Rv
uacuuuuccagu

SEQ ID NO: 1313499 - RNA, 13 nt, Mycobacterium tuberculosis H37Rv
uacuuggcuuccg

SEQ ID NO: 1313500 - RNA, 14 nt, Mycobacterium tuberculosis H37Rv
uacuugagggucuu

SEQ ID NO: 1313501 - RNA, 15 nt, Mycobacterium tuberculosis H37Rv
uaacggagcggccua

SEQ ID NO: 1313502 - RNA, 17 nt, Mycobacterium tuberculosis H37Rv
uaauccgggcaaucaca

SEQ ID NO: 1313503 - RNA, 22 nt, Mycobacterium tuberculosis H37Rv
uaauccgggcaaucacaucaaa

SEQ ID NO: 1313504 - RNA, 17 nt, Mycobacterium tuberculosis H37Rv
uaauggcgugcagaccc

SEQ ID NO: 1313505 - RNA, 19 nt, Mycobacterium tuberculosis H37Rv
uacacauaggugcggggcc

SEQ ID NO: 1313506 - RNA, 20 nt, Mycobacterium tuberculosis H37Rv
uacagcaucaaccguccccg

SEQ ID NO: 1313507 - RNA, 22 nt, Mycobacterium tuberculosis H37Rv
uacaccuuguggacccgccagg

SEQ ID NO: 1313508 - RNA, 20 nt, Mycobacterium tuberculosis H37Rv
uacagcuugaucgccgaggc

SEQ ID NO: 1313509 - RNA, 21 nt, Mycobacterium tuberculosis H37Rv
uacagcuugaucgccgaggcc

SEQ ID NO: 1313510 - RNA, 12 nt, Mycobacterium tuberculosis H37Rv
uacaggugcagg

SEQ ID NO: 1313511 - RNA, 23 nt, Mycobacterium tuberculosis H37Rv
uacagugcgcggaucaacaggcc

SEQ ID NO: 1313512 - RNA, 21 nt, Mycobacterium tuberculosis H37Rv
uacagucgaccggacacuccu

SEQ ID NO: 1313513 - RNA, 22 nt, Mycobacterium tuberculosis H37Rv
gcugccauugccugggcgaccg

SEQ ID NO: 1313514 - RNA, 18 nt, Mycobacterium tuberculosis H37Rv
gcugcccaaaagcgcggc

SEQ ID NO: 1313515 - RNA, 15 nt, Mycobacterium tuberculosis H37Rv
gcugccauuccagau

SEQ ID NO: 1313516 - RNA, 13 nt, Mycobacterium tuberculosis H37Rv
gcugccauugccg

SEQ ID NO: 1313517 - RNA, 12 nt, Mycobacterium tuberculosis H37Rv
gcugccaugcgg

SEQ ID NO: 1313518 - RNA, 16 nt, Mycobacterium tuberculosis H37Rv
gcugcccaugcggcag

SEQ ID NO: 1313519 - RNA, 13 nt, Mycobacterium tuberculosis H37Rv
gcugcccgccagc

SEQ ID NO: 1313520 - RNA, 16 nt, Mycobacterium tuberculosis H37Rv
gcugcccgccagcgcc

SEQ ID NO: 1313521 - RNA, 12 nt, Mycobacterium tuberculosis H37Rv
gcugcccgccgc

SEQ ID NO: 1313522 - RNA, 16 nt, Mycobacterium tuberculosis H37Rv
gcugcccgggcugccg

SEQ ID NO: 1313523 - RNA, 23 nt, Mycobacterium tuberculosis H37Rv
gcugccgaacaguucggcgagca

SEQ ID NO: 1313524 - RNA, 19 nt, Mycobacterium tuberculosis H37Rv
gcugccgaagcggccaccg

SEQ ID NO: 1313525 - RNA, 16 nt, Mycobacterium tuberculosis H37Rv
gcugccgcacccccuc

SEQ ID NO: 1313526 - RNA, 23 nt, Mycobacterium tuberculosis H37Rv
gcugccgauacagcacauccagc

SEQ ID NO: 1313527 - RNA, 17 nt, Mycobacterium tuberculosis H37Rv
gcugccgauagcgcggc

SEQ ID NO: 1313528 - RNA, 18 nt, Mycobacterium tuberculosis H37Rv
gcugccgauagcgcggca

SEQ ID NO: 1313529 - RNA, 14 nt, Mycobacterium tuberculosis H37Rv
gcugccgucagccg

SEQ ID NO: 1313530 - RNA, 20 nt, Mycobacterium tuberculosis H37Rv
gcugccggcacgcaugccgg

SEQ ID NO: 1313531 - RNA, 15 nt, Mycobacterium tuberculosis H37Rv
gcugccgcggugcca

SEQ ID NO: 1313532 - RNA, 20 nt, Mycobacterium tuberculosis H37Rv
gcugccgcgcggcgagagcc

SEQ ID NO: 1313533 - RNA, 17 nt, Mycobacterium tuberculosis H37Rv
gcugccgccgagcuggc

SEQ ID NO: 1313534 - RNA, 17 nt, Mycobacterium tuberculosis H37Rv
gcugccguugggcaccg

SEQ ID NO: 1313535 - RNA, 21 nt, Mycobacterium tuberculosis H37Rv
gcugcgagaucgcggcgaccc

SEQ ID NO: 1313536 - RNA, 19 nt, Mycobacterium tuberculosis H37Rv
gcugccuugauugccgcgu

SEQ ID NO: 1313537 - RNA, 19 nt, Mycobacterium tuberculosis H37Rv
gcugccuuggcgcggcacc

SEQ ID NO: 1313538 - RNA, 18 nt, Mycobacterium tuberculosis H37Rv
gcugcgaaagccacucgc

SEQ ID NO: 1313539 - RNA, 22 nt, Mycobacterium tuberculosis H37Rv
gcugcaccguuuccggcgcucc

SEQ ID NO: 1313540 - RNA, 22 nt, Mycobacterium tuberculosis H37Rv
gcugcacccggagaaucggucc

SEQ ID NO: 1313541 - RNA, 23 nt, Mycobacterium tuberculosis H37Rv
gcugcaauagccuuacgcgggug

SEQ ID NO: 1313542 - RNA, 17 nt, Mycobacterium tuberculosis H37Rv
gcugauugcgaccgcgc

SEQ ID NO: 1313543 - RNA, 23 nt, Mycobacterium tuberculosis H37Rv
gcugcaacgauugaacucuggug

SEQ ID NO: 1313544 - RNA, 22 nt, Mycobacterium tuberculosis H37Rv
gcugcaaccgacuucgauggug

SEQ ID NO: 1313545 - RNA, 16 nt, Mycobacterium tuberculosis H37Rv
gcugcagguccagggu

SEQ ID NO: 1313546 - RNA, 14 nt, Mycobacterium tuberculosis H37Rv
gcugcaggcggccg

SEQ ID NO: 1313547 - RNA, 15 nt, Mycobacterium tuberculosis H37Rv
gcugcagccugugga

SEQ ID NO: 1313548 - RNA, 14 nt, Mycobacterium tuberculosis H37Rv
gcugcagcagaccc

SEQ ID NO: 1313549 - RNA, 19 nt, Mycobacterium tuberculosis H37Rv
gcugcagacccguucgccg

SEQ ID NO: 1313550 - RNA, 15 nt, Mycobacterium tuberculosis H37Rv
gcugccagccguucc

SEQ ID NO: 1313551 - RNA, 12 nt, Mycobacterium tuberculosis H37Rv
gcugccagcggc

SEQ ID NO: 1313552 - RNA, 18 nt, Mycobacterium tuberculosis H37Rv
gcugccagccauggccgc

SEQ ID NO: 1313553 - RNA, 14 nt, Mycobacterium tuberculosis H37Rv
gcugccacccaucg

SEQ ID NO: 1313554 - RNA, 10 nt, Mycobacterium tuberculosis H37Rv
gcugccaccg

SEQ ID NO: 1313555 - RNA, 11 nt, Mycobacterium tuberculosis H37Rv
gcugccaccgg

SEQ ID NO: 1313556 - RNA, 13 nt, Mycobacterium tuberculosis H37Rv
gcugccaccggcc

SEQ ID NO: 1313557 - RNA, 15 nt, Mycobacterium tuberculosis H37Rv
gcugccaccggccgg

SEQ ID NO: 1313558 - RNA, 18 nt, Mycobacterium tuberculosis H37Rv
gcugccagaaugggcggc

SEQ ID NO: 1313559 - RNA, 23 nt, Mycobacterium tuberculosis H37Rv
gcugccacggccuucagcggucg

SEQ ID NO: 1313560 - RNA, 18 nt, Mycobacterium tuberculosis H37Rv
gcuggauguaguuggcga

SEQ ID NO: 1313561 - RNA, 22 nt, Mycobacterium tuberculosis H37Rv
gcuggauguaguuggcgaccug

SEQ ID NO: 1313562 - RNA, 19 nt, Mycobacterium tuberculosis H37Rv
gcuggcaacgccgcgccgu

SEQ ID NO: 1313563 - RNA, 13 nt, Mycobacterium tuberculosis H37Rv
gcuggcaaccgcg

SEQ ID NO: 1313564 - RNA, 18 nt, Mycobacterium tuberculosis H37Rv
gcuggcaaguucggccga

SEQ ID NO: 1313565 - RNA, 12 nt, Mycobacterium tuberculosis H37Rv
gcuggcagacuc

SEQ ID NO: 1313566 - RNA, 14 nt, Mycobacterium tuberculosis H37Rv
gcuggacccgcaug

SEQ ID NO: 1313567 - RNA, 14 nt, Mycobacterium tuberculosis H37Rv
gcuggacggcgggc

SEQ ID NO: 1313568 - RNA, 23 nt, Mycobacterium tuberculosis H37Rv
gcuggacuccggucagcgcggcg

SEQ ID NO: 1313569 - RNA, 21 nt, Mycobacterium tuberculosis H37Rv
gcuggacuaucgccgcgcguc

SEQ ID NO: 1313570 - RNA, 12 nt, Mycobacterium tuberculosis H37Rv
gcuggaggccac

SEQ ID NO: 1313571 - RNA, 16 nt, Mycobacterium tuberculosis H37Rv
gcuggaguaggugugc

SEQ ID NO: 1313572 - RNA, 20 nt, Mycobacterium tuberculosis H37Rv
gcuggaggugaacucguuca

SEQ ID NO: 1313573 - RNA, 16 nt, Mycobacterium tuberculosis H37Rv
gcugcuggcgcgccug

SEQ ID NO: 1313574 - RNA, 15 nt, Mycobacterium tuberculosis H37Rv
gcugcuggcgcgccu

SEQ ID NO: 1313575 - RNA, 16 nt, Mycobacterium tuberculosis H37Rv
gcugcugcucggccug

SEQ ID NO: 1313576 - RNA, 14 nt, Mycobacterium tuberculosis H37Rv
gcugcugcgcggug

SEQ ID NO: 1313577 - RNA, 20 nt, Mycobacterium tuberculosis H37Rv
gcugcuuggcggucugcgcc

SEQ ID NO: 1313578 - RNA, 21 nt, Mycobacterium tuberculosis H37Rv
gcugcuucuucggacagcagc

SEQ ID NO: 1313579 - RNA, 18 nt, Mycobacterium tuberculosis H37Rv
gcugcuucuccgagauca

SEQ ID NO: 1313580 - RNA, 20 nt, Mycobacterium tuberculosis H37Rv
gcugcgccgucgcagccagc

SEQ ID NO: 1313581 - RNA, 19 nt, Mycobacterium tuberculosis H37Rv
gcugcgcaccgccgcgcga

SEQ ID NO: 1313582 - RNA, 13 nt, Mycobacterium tuberculosis H37Rv
gcugcgcagcggc

SEQ ID NO: 1313583 - RNA, 21 nt, Mycobacterium tuberculosis H37Rv
gcugcggccagcgcggcgcgc

SEQ ID NO: 1313584 - RNA, 13 nt, Mycobacterium tuberculosis H37Rv
gcugcggccaggg

SEQ ID NO: 1313585 - RNA, 14 nt, Mycobacterium tuberculosis H37Rv
gcugcggccaggga

SEQ ID NO: 1313586 - RNA, 15 nt, Mycobacterium tuberculosis H37Rv
gcugcggccagggag

SEQ ID NO: 1313587 - RNA, 16 nt, Mycobacterium tuberculosis H37Rv
gcugcggcgacgguga

SEQ ID NO: 1313588 - RNA, 17 nt, Mycobacterium tuberculosis H37Rv
gcugcggcgaucugguc

SEQ ID NO: 1313589 - RNA, 14 nt, Mycobacterium tuberculosis H37Rv
gcugcggcaccacc

SEQ ID NO: 1313590 - RNA, 14 nt, Mycobacterium tuberculosis H37Rv
gcugcggcaacgag

SEQ ID NO: 1313591 - RNA, 22 nt, Mycobacterium tuberculosis H37Rv
gcugcggauuaagucggcggcc

SEQ ID NO: 1313592 - RNA, 19 nt, Mycobacterium tuberculosis H37Rv
gcugcggauacagccgccg

SEQ ID NO: 1313593 - RNA, 20 nt, Mycobacterium tuberculosis H37Rv
gcugcggauacagccgccgc

SEQ ID NO: 1313594 - RNA, 11 nt, Mycobacterium tuberculosis H37Rv
gcugcgcuggu

SEQ ID NO: 1313595 - RNA, 22 nt, Mycobacterium tuberculosis H37Rv
gcugcucgaucaucgggagccg

SEQ ID NO: 1313596 - RNA, 14 nt, Mycobacterium tuberculosis H37Rv
gcugcuccuggaag

SEQ ID NO: 1313597 - RNA, 22 nt, Mycobacterium tuberculosis H37Rv
gcugcucaucgcgcccgccauc

SEQ ID NO: 1313598 - RNA, 20 nt, Mycobacterium tuberculosis H37Rv
gcugcucgagcagaucagca

SEQ ID NO: 1313599 - RNA, 17 nt, Mycobacterium tuberculosis H37Rv
gcugcucgugagcccca

SEQ ID NO: 1313600 - RNA, 14 nt, Mycobacterium tuberculosis H37Rv
gcugcucgccggcc

SEQ ID NO: 1313601 - RNA, 20 nt, Mycobacterium tuberculosis H37Rv
gcugcucggucaggcggcug

SEQ ID NO: 1313602 - RNA, 20 nt, Mycobacterium tuberculosis H37Rv
gcugcgucgucugcagaccu

SEQ ID NO: 1313603 - RNA, 23 nt, Mycobacterium tuberculosis H37Rv
gcugcguggcgaaccaggggucg

SEQ ID NO: 1313604 - RNA, 14 nt, Mycobacterium tuberculosis H37Rv
gcugcggugggcca

SEQ ID NO: 1313605 - RNA, 17 nt, Mycobacterium tuberculosis H37Rv
gcugcggugggccaggu

SEQ ID NO: 1313606 - RNA, 16 nt, Mycobacterium tuberculosis H37Rv
gcugcggucgcggcug

SEQ ID NO: 1313607 - RNA, 17 nt, Mycobacterium tuberculosis H37Rv
gcugcggugccggcccu

SEQ ID NO: 1313608 - RNA, 21 nt, Mycobacterium tuberculosis H37Rv
gcugcgggucucgccgaccuu

SEQ ID NO: 1313609 - RNA, 21 nt, Mycobacterium tuberculosis H37Rv
gcugcgggugauugagcucag

SEQ ID NO: 1313610 - RNA, 18 nt, Mycobacterium tuberculosis H37Rv
gcuguccgcgggccgcgc

SEQ ID NO: 1313611 - RNA, 17 nt, Mycobacterium tuberculosis H37Rv
gcuguccgcgggccgcg

SEQ ID NO: 1313612 - RNA, 17 nt, Mycobacterium tuberculosis H37Rv
gcuguccaggucugggc

SEQ ID NO: 1313613 - RNA, 20 nt, Mycobacterium tuberculosis H37Rv
gcuguccaccgaggccugac

SEQ ID NO: 1313614 - RNA, 18 nt, Mycobacterium tuberculosis H37Rv
gcugucacaagccugccg

SEQ ID NO: 1313615 - RNA, 22 nt, Mycobacterium tuberculosis H37Rv
gcugucacguagcgagcccacg

SEQ ID NO: 1313616 - RNA, 20 nt, Mycobacterium tuberculosis H37Rv
gcugucaauccgcccuaaug

SEQ ID NO: 1313617 - RNA, 23 nt, Mycobacterium tuberculosis H37Rv
gcuguauuucaauucucgagcaa

SEQ ID NO: 1313618 - RNA, 16 nt, Mycobacterium tuberculosis H37Rv
gcuguagucgcgccuc

SEQ ID NO: 1313619 - RNA, 16 nt, Mycobacterium tuberculosis H37Rv
gcuguaggccagcccg

SEQ ID NO: 1313620 - RNA, 21 nt, Mycobacterium tuberculosis H37Rv
gcuguaacacccggccgccga

SEQ ID NO: 1313621 - RNA, 18 nt, Mycobacterium tuberculosis H37Rv
gcuguaacacccggccgc

SEQ ID NO: 1313622 - RNA, 15 nt, Mycobacterium tuberculosis H37Rv
gcugguugcgccacu

SEQ ID NO: 1313623 - RNA, 22 nt, Mycobacterium tuberculosis H37Rv
gcuguacccgaccagcaccaga

SEQ ID NO: 1313624 - RNA, 19 nt, Mycobacterium tuberculosis H37Rv
gcuguacugccccagcaca

SEQ ID NO: 1313625 - RNA, 18 nt, Mycobacterium tuberculosis H37Rv
gcuggugcgcccaucaug

SEQ ID NO: 1313626 - RNA, 16 nt, Mycobacterium tuberculosis H37Rv
gcuggugcgcggucug

SEQ ID NO: 1313627 - RNA, 19 nt, Mycobacterium tuberculosis H37Rv
gcuggugggggagcggccg

SEQ ID NO: 1313628 - RNA, 18 nt, Mycobacterium tuberculosis H37Rv
gcuggugggacgcggccg

SEQ ID NO: 1313629 - RNA, 17 nt, Mycobacterium tuberculosis H37Rv
gcuggugggaggggacc

SEQ ID NO: 1313630 - RNA, 14 nt, Mycobacterium tuberculosis H37Rv
gcugguggucagca

SEQ ID NO: 1313631 - RNA, 16 nt, Mycobacterium tuberculosis H37Rv
gcuggugugucccggg

SEQ ID NO: 1313632 - RNA, 18 nt, Mycobacterium tuberculosis H37Rv
gcugguugggggucgggc

SEQ ID NO: 1313633 - RNA, 18 nt, Mycobacterium tuberculosis H37Rv
gcugguguccagccaggc

SEQ ID NO: 1313634 - RNA, 18 nt, Mycobacterium tuberculosis H37Rv
gcuguugcaucgccgcga

SEQ ID NO: 1313635 - RNA, 15 nt, Mycobacterium tuberculosis H37Rv
gcuguugcggggugc

SEQ ID NO: 1313636 - RNA, 13 nt, Mycobacterium tuberculosis H37Rv
gcugugugggagc

SEQ ID NO: 1313637 - RNA, 21 nt, Mycobacterium tuberculosis H37Rv
gcugugguggugaugggcaug

SEQ ID NO: 1313638 - RNA, 21 nt, Mycobacterium tuberculosis H37Rv
gcuguggucggugccagcacc

SEQ ID NO: 1313639 - RNA, 17 nt, Mycobacterium tuberculosis H37Rv
gcugugggcugagaugg

SEQ ID NO: 1313640 - RNA, 13 nt, Mycobacterium tuberculosis H37Rv
gcugugccggcca

SEQ ID NO: 1313641 - RNA, 14 nt, Mycobacterium tuberculosis H37Rv
gcugugcgcugguc

SEQ ID NO: 1313642 - RNA, 13 nt, Mycobacterium tuberculosis H37Rv
gcugugcgcuggu

SEQ ID NO: 1313643 - RNA, 17 nt, Mycobacterium tuberculosis H37Rv
gcuguggcgggagaucg

SEQ ID NO: 1313644 - RNA, 14 nt, Mycobacterium tuberculosis H37Rv
gcugucgggcagcu

SEQ ID NO: 1313645 - RNA, 23 nt, Mycobacterium tuberculosis H37Rv
gcugucgugauacagcucggugc

SEQ ID NO: 1313646 - RNA, 23 nt, Mycobacterium tuberculosis H37Rv
gcugucguuugacgagccgacca

SEQ ID NO: 1313647 - RNA, 13 nt, Mycobacterium tuberculosis H37Rv
gcugugauagcgc

SEQ ID NO: 1313648 - RNA, 23 nt, Mycobacterium tuberculosis H37Rv
gcugugcccgaucagccguggca

SEQ ID NO: 1313649 - RNA, 13 nt, Mycobacterium tuberculosis H37Rv
gcugugccccagg

SEQ ID NO: 1313650 - RNA, 21 nt, Mycobacterium tuberculosis H37Rv
gcuggcagcgacuuaggcaga

SEQ ID NO: 1313651 - RNA, 12 nt, Mycobacterium tuberculosis H37Rv
gcuggcccagcg

SEQ ID NO: 1313652 - RNA, 22 nt, Mycobacterium tuberculosis H37Rv
gcuggccaccuuagcgcuugcc

SEQ ID NO: 1313653 - RNA, 14 nt, Mycobacterium tuberculosis H37Rv
gcuggccacgaucc

SEQ ID NO: 1313654 - RNA, 20 nt, Mycobacterium tuberculosis H37Rv
gcuggccuccagcuuggcga

SEQ ID NO: 1313655 - RNA, 23 nt, Mycobacterium tuberculosis H37Rv
gcuggccguaacgcggaucgggc

SEQ ID NO: 1313656 - RNA, 23 nt, Mycobacterium tuberculosis H37Rv
gcuggccgcggcuggugucgggc

SEQ ID NO: 1313657 - RNA, 17 nt, Mycobacterium tuberculosis H37Rv
gcuggcccgcaugccgg

SEQ ID NO: 1313658 - RNA, 17 nt, Mycobacterium tuberculosis H37Rv
gcuggcggguugguccc

SEQ ID NO: 1313659 - RNA, 14 nt, Mycobacterium tuberculosis H37Rv
gcuggcggcgcagc

SEQ ID NO: 1313660 - RNA, 21 nt, Mycobacterium tuberculosis H37Rv
gcuggcgcucauaggccggcg

SEQ ID NO: 1313661 - RNA, 15 nt, Mycobacterium tuberculosis H37Rv
gcuggcgccccaggu

SEQ ID NO: 1313662 - RNA, 21 nt, Mycobacterium tuberculosis H37Rv
gcuggcgccccaggugguuca

SEQ ID NO: 1313663 - RNA, 14 nt, Mycobacterium tuberculosis H37Rv
gcuggcgccgcagg

SEQ ID NO: 1313664 - RNA, 21 nt, Mycobacterium tuberculosis H37Rv
gcuggcgaaggacaacagccg

SEQ ID NO: 1313665 - RNA, 16 nt, Mycobacterium tuberculosis H37Rv
gcuggcgaugccgaga

SEQ ID NO: 1313666 - RNA, 14 nt, Mycobacterium tuberculosis H37Rv
gcuggcgcaaccaa

SEQ ID NO: 1313667 - RNA, 23 nt, Mycobacterium tuberculosis H37Rv
gcugguaucgagcaccccgacgu

SEQ ID NO: 1313668 - RNA, 20 nt, Mycobacterium tuberculosis H37Rv
gcugguauagcucacggugg

SEQ ID NO: 1313669 - RNA, 19 nt, Mycobacterium tuberculosis H37Rv
gcuggucagccgugccgug

SEQ ID NO: 1313670 - RNA, 23 nt, Mycobacterium tuberculosis H37Rv
gcugguccuccuucggugguggg

SEQ ID NO: 1313671 - RNA, 17 nt, Mycobacterium tuberculosis H37Rv
gcuggucgugccgccgu

SEQ ID NO: 1313672 - RNA, 19 nt, Mycobacterium tuberculosis H37Rv
gcuggucgugggccaccac

SEQ ID NO: 1313673 - RNA, 14 nt, Mycobacterium tuberculosis H37Rv
gcuggucgccgcgg

SEQ ID NO: 1313674 - RNA, 14 nt, Mycobacterium tuberculosis H37Rv
gcuggucggugggc

SEQ ID NO: 1313675 - RNA, 13 nt, Mycobacterium tuberculosis H37Rv
gcuggugccaacu

SEQ ID NO: 1313676 - RNA, 23 nt, Mycobacterium tuberculosis H37Rv
gcuggugaucugcugggcaagau

SEQ ID NO: 1313677 - RNA, 16 nt, Mycobacterium tuberculosis H37Rv
gcuggggguaccuccc

SEQ ID NO: 1313678 - RNA, 16 nt, Mycobacterium tuberculosis H37Rv
gcuggguaugcaccca

SEQ ID NO: 1313679 - RNA, 18 nt, Mycobacterium tuberculosis H37Rv
gcuggguaugcacccagg

SEQ ID NO: 1313680 - RNA, 13 nt, Mycobacterium tuberculosis H37Rv
gcuggggccccgc

SEQ ID NO: 1313681 - RNA, 15 nt, Mycobacterium tuberculosis H37Rv
gcuggggccccgcgc

SEQ ID NO: 1313682 - RNA, 19 nt, Mycobacterium tuberculosis H37Rv
gcugggggauaccgcuggg

SEQ ID NO: 1313683 - RNA, 13 nt, Mycobacterium tuberculosis H37Rv
gcugggggccggc

SEQ ID NO: 1313684 - RNA, 20 nt, Mycobacterium tuberculosis H37Rv
gcuggguggccaaccaaccg

SEQ ID NO: 1313685 - RNA, 17 nt, Mycobacterium tuberculosis H37Rv
gcugggacgggcgcguc

SEQ ID NO: 1313686 - RNA, 20 nt, Mycobacterium tuberculosis H37Rv
gcugggcaucaccgccgcgg

SEQ ID NO: 1313687 - RNA, 19 nt, Mycobacterium tuberculosis H37Rv
gcugggcaagaucguuucc

SEQ ID NO: 1313688 - RNA, 23 nt, Mycobacterium tuberculosis H37Rv
gcugggcccgccagcccagcacg

SEQ ID NO: 1313689 - RNA, 14 nt, Mycobacterium tuberculosis H37Rv
gcugggcccgccgu

SEQ ID NO: 1313690 - RNA, 16 nt, Mycobacterium tuberculosis H37Rv
gcugggcgccgcgcuc

SEQ ID NO: 1313691 - RNA, 21 nt, Mycobacterium tuberculosis H37Rv
gcugggccggggaggcuaggc

SEQ ID NO: 1313692 - RNA, 23 nt, Mycobacterium tuberculosis H37Rv
gcugggcgcgcucaucgaccggg

SEQ ID NO: 1313693 - RNA, 22 nt, Mycobacterium tuberculosis H37Rv
gcugggcgccgucgggccugcc

SEQ ID NO: 1313694 - RNA, 21 nt, Mycobacterium tuberculosis H37Rv
gcuggcugaccgaauggccgc

SEQ ID NO: 1313695 - RNA, 24 nt, Mycobacterium tuberculosis H37Rv
gcuggcuagcagguacucgcccca

SEQ ID NO: 1313696 - RNA, 13 nt, Mycobacterium tuberculosis H37Rv
gcuggcuguggcu

SEQ ID NO: 1313697 - RNA, 14 nt, Mycobacterium tuberculosis H37Rv
gcuggcuguggcug

SEQ ID NO: 1313698 - RNA, 23 nt, Mycobacterium tuberculosis H37Rv
gcuggcugccacgaacgcuucca

SEQ ID NO: 1313699 - RNA, 16 nt, Mycobacterium tuberculosis H37Rv
gcuggcuugggccagc

SEQ ID NO: 1313700 - RNA, 13 nt, Mycobacterium tuberculosis H37Rv
gcugggaaagcau

SEQ ID NO: 1313701 - RNA, 15 nt, Mycobacterium tuberculosis H37Rv
gcuggcuucucgcag

SEQ ID NO: 1313702 - RNA, 22 nt, Mycobacterium tuberculosis H37Rv
gcugggacgggcgcgucggcgu

SEQ ID NO: 1313703 - RNA, 23 nt, Mycobacterium tuberculosis H37Rv
gcugggacgucuccaccgcgaug

SEQ ID NO: 1313704 - RNA, 15 nt, Mycobacterium tuberculosis H37Rv
gcugggagcggaugu

SEQ ID NO: 1313705 - RNA, 13 nt, Mycobacterium tuberculosis H37Rv
gcugggaggcgcg

SEQ ID NO: 1313706 - RNA, 22 nt, Mycobacterium tuberculosis H37Rv
gcuuaacagcggguccuucugc

SEQ ID NO: 1313707 - RNA, 14 nt, Mycobacterium tuberculosis H37Rv
gcuuaccggcgggc

SEQ ID NO: 1313708 - RNA, 18 nt, Mycobacterium tuberculosis H37Rv
gcuuagcgcgaaagcgcc

SEQ ID NO: 1313709 - RNA, 15 nt, Mycobacterium tuberculosis H37Rv
gcuuagcggcuuggc

SEQ ID NO: 1313710 - RNA, 23 nt, Mycobacterium tuberculosis H37Rv
gcuuagcugccgucggugccggg

SEQ ID NO: 1313711 - RNA, 17 nt, Mycobacterium tuberculosis H37Rv
gcuuagcuuccggguuc

SEQ ID NO: 1313712 - RNA, 19 nt, Mycobacterium tuberculosis H37Rv
gcuuacuuaaccaggcgag

SEQ ID NO: 1313713 - RNA, 17 nt, Mycobacterium tuberculosis H37Rv
gcuuccaacucggcggc

SEQ ID NO: 1313714 - RNA, 21 nt, Mycobacterium tuberculosis H37Rv
gcuuccaacucggcggccagc

SEQ ID NO: 1313715 - RNA, 18 nt, Mycobacterium tuberculosis H37Rv
gcuucaucccggagccgc

SEQ ID NO: 1313716 - RNA, 20 nt, Mycobacterium tuberculosis H37Rv
gcuucaagauuaccgaagcc

SEQ ID NO: 1313717 - RNA, 21 nt, Mycobacterium tuberculosis H37Rv
gcuugacccuugggcaccacc

SEQ ID NO: 1313718 - RNA, 18 nt, Mycobacterium tuberculosis H37Rv
gcuugaccgccuggaagg

SEQ ID NO: 1313719 - RNA, 15 nt, Mycobacterium tuberculosis H37Rv
gcuugaccccgccga

SEQ ID NO: 1313720 - RNA, 16 nt, Mycobacterium tuberculosis H37Rv
gcuugacaacccuguu

SEQ ID NO: 1313721 - RNA, 19 nt, Mycobacterium tuberculosis H37Rv
gcuugacccacgagagcgc

SEQ ID NO: 1313722 - RNA, 16 nt, Mycobacterium tuberculosis H37Rv
gcuugaaauagucuuc

SEQ ID NO: 1313723 - RNA, 17 nt, Mycobacterium tuberculosis H37Rv
gcuugaaauagucuucu

SEQ ID NO: 1313724 - RNA, 23 nt, Mycobacterium tuberculosis H37Rv
gcuugaacgcauacagcgcccgg

SEQ ID NO: 1313725 - RNA, 20 nt, Mycobacterium tuberculosis H37Rv
gcuucuuguggauuguccga

SEQ ID NO: 1313726 - RNA, 22 nt, Mycobacterium tuberculosis H37Rv
gcuucuucggacagcagccggc

SEQ ID NO: 1313727 - RNA, 12 nt, Mycobacterium tuberculosis H37Rv
gcuucuccucca

SEQ ID NO: 1313728 - RNA, 20 nt, Mycobacterium tuberculosis H37Rv
gcuucucccgccacugcugg

SEQ ID NO: 1313729 - RNA, 17 nt, Mycobacterium tuberculosis H37Rv
gcuucuccuccagagac

SEQ ID NO: 1313730 - RNA, 19 nt, Mycobacterium tuberculosis H37Rv
gcuucucccgccacugcug

SEQ ID NO: 1313731 - RNA, 15 nt, Mycobacterium tuberculosis H37Rv
gcuucugccugcgca

SEQ ID NO: 1313732 - RNA, 22 nt, Mycobacterium tuberculosis H37Rv
gcuucgucggccggcaccccac

SEQ ID NO: 1313733 - RNA, 15 nt, Mycobacterium tuberculosis H37Rv
gcuucgugcaccaca

SEQ ID NO: 1313734 - RNA, 17 nt, Mycobacterium tuberculosis H37Rv
gcuucguggcggcgcgc

SEQ ID NO: 1313735 - RNA, 15 nt, Mycobacterium tuberculosis H37Rv
gcuucgucggccggc

SEQ ID NO: 1313736 - RNA, 16 nt, Mycobacterium tuberculosis H37Rv
gcuucgucggccggca

SEQ ID NO: 1313737 - RNA, 17 nt, Mycobacterium tuberculosis H37Rv
gcuucgucggccagcag

SEQ ID NO: 1313738 - RNA, 16 nt, Mycobacterium tuberculosis H37Rv
gcuucggugagcgggc

SEQ ID NO: 1313739 - RNA, 18 nt, Mycobacterium tuberculosis H37Rv
gcuucggcaccgacugcu

SEQ ID NO: 1313740 - RNA, 23 nt, Mycobacterium tuberculosis H37Rv
gcuucggcaccgacugcugucac

SEQ ID NO: 1313741 - RNA, 18 nt, Mycobacterium tuberculosis H37Rv
gcuucggcggccgagcgc

SEQ ID NO: 1313742 - RNA, 17 nt, Mycobacterium tuberculosis H37Rv
gcuucgcccagagccgc

SEQ ID NO: 1313743 - RNA, 20 nt, Mycobacterium tuberculosis H37Rv
gcuucgccagguggccgcuc

SEQ ID NO: 1313744 - RNA, 13 nt, Mycobacterium tuberculosis H37Rv
gcuucgcccggcu

SEQ ID NO: 1313745 - RNA, 15 nt, Mycobacterium tuberculosis H37Rv
gcuucgcccggcugc

SEQ ID NO: 1313746 - RNA, 15 nt, Mycobacterium tuberculosis H37Rv
gcuucgaccguggug

SEQ ID NO: 1313747 - RNA, 13 nt, Mycobacterium tuberculosis H37Rv
gcuucgagcaccg

SEQ ID NO: 1313748 - RNA, 19 nt, Mycobacterium tuberculosis H37Rv
gcuucgcaagucauccagg

SEQ ID NO: 1313749 - RNA, 22 nt, Mycobacterium tuberculosis H37Rv
gcuuccgcgcgcagaugagcgc

SEQ ID NO: 1313750 - RNA, 21 nt, Mycobacterium tuberculosis H37Rv
gcuugaucugggcugcggccg

SEQ ID NO: 1313751 - RNA, 15 nt, Mycobacterium tuberculosis H37Rv
gcuugaucgccgagg

SEQ ID NO: 1313752 - RNA, 16 nt, Mycobacterium tuberculosis H37Rv
gcuugacugcacacca

SEQ ID NO: 1313753 - RNA, 18 nt, Mycobacterium tuberculosis H37Rv
gcuugccccgccuuggcc

SEQ ID NO: 1313754 - RNA, 19 nt, Mycobacterium tuberculosis H37Rv
gcuugccccgccuuggcca

SEQ ID NO: 1313755 - RNA, 17 nt, Mycobacterium tuberculosis H37Rv
gcuugcaggcgaucugg

SEQ ID NO: 1313756 - RNA, 14 nt, Mycobacterium tuberculosis H37Rv
gcuugcagggccac

SEQ ID NO: 1313757 - RNA, 17 nt, Mycobacterium tuberculosis H37Rv
gcuugcauugaggggcg

SEQ ID NO: 1313758 - RNA, 16 nt, Mycobacterium tuberculosis H37Rv
gcuugccggggugugc

SEQ ID NO: 1313759 - RNA, 19 nt, Mycobacterium tuberculosis H37Rv
gcuuggagaucgccgccgg

SEQ ID NO: 1313760 - RNA, 14 nt, Mycobacterium tuberculosis H37Rv
gcuugcggcaccca

SEQ ID NO: 1313761 - RNA, 14 nt, Mycobacterium tuberculosis H37Rv
gcuugcgcggcuug

SEQ ID NO: 1313762 - RNA, 15 nt, Mycobacterium tuberculosis H37Rv
gcuugcgcguggcag

SEQ ID NO: 1313763 - RNA, 22 nt, Mycobacterium tuberculosis H37Rv
gcuugcgccgcccaugccucca

SEQ ID NO: 1313764 - RNA, 14 nt, Mycobacterium tuberculosis H37Rv
gcuugcgccgcagc

SEQ ID NO: 1313765 - RNA, 15 nt, Mycobacterium tuberculosis H37Rv
gcuugcgcagcagcg

SEQ ID NO: 1313766 - RNA, 18 nt, Mycobacterium tuberculosis H37Rv
gcuugcgcagccgcagcc

SEQ ID NO: 1313767 - RNA, 17 nt, Mycobacterium tuberculosis H37Rv
gcuugcgaucggcacuu

SEQ ID NO: 1313768 - RNA, 21 nt, Mycobacterium tuberculosis H37Rv
gcuugcgaucggcacuuagcc

SEQ ID NO: 1313769 - RNA, 14 nt, Mycobacterium tuberculosis H37Rv
gcuugucgcggugc

SEQ ID NO: 1313770 - RNA, 13 nt, Mycobacterium tuberculosis H37Rv
gcuugugcccaau

SEQ ID NO: 1313771 - RNA, 14 nt, Mycobacterium tuberculosis H37Rv
gcuugugcccaaua

SEQ ID NO: 1313772 - RNA, 15 nt, Mycobacterium tuberculosis H37Rv
gcuugucgccccaug

SEQ ID NO: 1313773 - RNA, 18 nt, Mycobacterium tuberculosis H37Rv
gcuugucgguagguguca

SEQ ID NO: 1313774 - RNA, 21 nt, Mycobacterium tuberculosis H37Rv
gcuuggcgaucucaccuggag

SEQ ID NO: 1313775 - RNA, 23 nt, Mycobacterium tuberculosis H37Rv
gcuuggcgacgaugcaggugaca

SEQ ID NO: 1313776 - RNA, 23 nt, Mycobacterium tuberculosis H37Rv
gcuuggccgcgcaggcuuccagc

SEQ ID NO: 1313777 - RNA, 14 nt, Mycobacterium tuberculosis H37Rv
gcuuggccgcgcag

SEQ ID NO: 1313778 - RNA, 18 nt, Mycobacterium tuberculosis H37Rv
gcuuggcuccacaauccu

SEQ ID NO: 1313779 - RNA, 13 nt, Mycobacterium tuberculosis H37Rv
gcuuggcggccag

SEQ ID NO: 1313780 - RNA, 17 nt, Mycobacterium tuberculosis H37Rv
gcuuggcgggaccguga

SEQ ID NO: 1313781 - RNA, 23 nt, Mycobacterium tuberculosis H37Rv
gcuuggcggccagcgugucccaa

SEQ ID NO: 1313782 - RNA, 19 nt, Mycobacterium tuberculosis H37Rv
gcuugguggcguggcccuc

SEQ ID NO: 1313783 - RNA, 22 nt, Mycobacterium tuberculosis H37Rv
gcuugguggucuuggccggugc

SEQ ID NO: 1313784 - RNA, 22 nt, Mycobacterium tuberculosis H37Rv
gcuuggugaacguuuccagcug

SEQ ID NO: 1313785 - RNA, 15 nt, Mycobacterium tuberculosis H37Rv
gcuuggcgugaccua

SEQ ID NO: 1313786 - RNA, 18 nt, Mycobacterium tuberculosis H37Rv
gcuuggucgcccagccac

SEQ ID NO: 1313787 - RNA, 14 nt, Mycobacterium tuberculosis H37Rv
gcuuguucaucauc

SEQ ID NO: 1313788 - RNA, 16 nt, Mycobacterium tuberculosis H37Rv
gcuuuaaucguggcac

SEQ ID NO: 1313789 - RNA, 14 nt, Mycobacterium tuberculosis H37Rv
gcuuugggcugccg

SEQ ID NO: 1313790 - RNA, 16 nt, Mycobacterium tuberculosis H37Rv
gcuuugguuagaggau

SEQ ID NO: 1313791 - RNA, 17 nt, Mycobacterium tuberculosis H37Rv
gcuuuuacgucugcucg

SEQ ID NO: 1313792 - RNA, 18 nt, Mycobacterium tuberculosis H37Rv
gcuuuccucaccagccgu

SEQ ID NO: 1313793 - RNA, 12 nt, Mycobacterium tuberculosis H37Rv
gcuuucagcacc

SEQ ID NO: 1313794 - RNA, 15 nt, Mycobacterium tuberculosis H37Rv
gcuuugcacagcggc

SEQ ID NO: 1313795 - RNA, 14 nt, Mycobacterium tuberculosis H37Rv
gcuuugccaacaaa

SEQ ID NO: 1313796 - RNA, 14 nt, Mycobacterium tuberculosis H37Rv
gcuuugcacugugg

SEQ ID NO: 1313797 - RNA, 20 nt, Mycobacterium tuberculosis H37Rv
gcuuucuuggcgggcgccuu

SEQ ID NO: 1313798 - RNA, 14 nt, Mycobacterium tuberculosis H37Rv
gcuuugagccgcuc

SEQ ID NO: 1313799 - RNA, 13 nt, Mycobacterium tuberculosis H37Rv
ggaaaagcccgga

SEQ ID NO: 1313800 - RNA, 15 nt, Mycobacterium tuberculosis H37Rv
ggaaaaagcccgaca

SEQ ID NO: 1313801 - RNA, 17 nt, Mycobacterium tuberculosis H37Rv
ggaaaccacagcgccau

SEQ ID NO: 1313802 - RNA, 22 nt, Mycobacterium tuberculosis H37Rv
ggaaaccgccccgugggccucg

SEQ ID NO: 1313803 - RNA, 15 nt, Mycobacterium tuberculosis H37Rv
ggaaaccggccagcc

SEQ ID NO: 1313804 - RNA, 19 nt, Mycobacterium tuberculosis H37Rv
ggaaacccggccagcugcg

SEQ ID NO: 1313805 - RNA, 17 nt, Mycobacterium tuberculosis H37Rv
ggaaacggagccgagcc

SEQ ID NO: 1313806 - RNA, 16 nt, Mycobacterium tuberculosis H37Rv
ggaaacggagccgagc

SEQ ID NO: 1313807 - RNA, 20 nt, Mycobacterium tuberculosis H37Rv
ggaaaggcuuccgcgugcga

SEQ ID NO: 1313808 - RNA, 16 nt, Mycobacterium tuberculosis H37Rv
ggaacaccgcccggcc

SEQ ID NO: 1313809 - RNA, 19 nt, Mycobacterium tuberculosis H37Rv
ggaacaccgcccggcccgg

SEQ ID NO: 1313810 - RNA, 15 nt, Mycobacterium tuberculosis H37Rv
ggaacagccuauucc

SEQ ID NO: 1313811 - RNA, 17 nt, Mycobacterium tuberculosis H37Rv
ggaaccggucagccgga

SEQ ID NO: 1313812 - RNA, 16 nt, Mycobacterium tuberculosis H37Rv
ggaaccgggcaaauca

SEQ ID NO: 1313813 - RNA, 18 nt, Mycobacterium tuberculosis H37Rv
ggaaccgggcaaaucaag

SEQ ID NO: 1313814 - RNA, 20 nt, Mycobacterium tuberculosis H37Rv
ggaaccuugaccgaccagcu

SEQ ID NO: 1313815 - RNA, 21 nt, Mycobacterium tuberculosis H37Rv
ggaaccuugaccgaccagcug

SEQ ID NO: 1313816 - RNA, 17 nt, Mycobacterium tuberculosis H37Rv
ggaacgagccacgccag

SEQ ID NO: 1313817 - RNA, 23 nt, Mycobacterium tuberculosis H37Rv
ggaaccccccauagcaagaaccg

SEQ ID NO: 1313818 - RNA, 23 nt, Mycobacterium tuberculosis H37Rv
ggaacccgaaucccacagcagga

SEQ ID NO: 1313819 - RNA, 18 nt, Mycobacterium tuberculosis H37Rv
ggaaccacucgcucagga

SEQ ID NO: 1313820 - RNA, 19 nt, Mycobacterium tuberculosis H37Rv
ggaaccaccaguaccaccg

SEQ ID NO: 1313821 - RNA, 16 nt, Mycobacterium tuberculosis H37Rv
ggaaaucggacgacuc

SEQ ID NO: 1313822 - RNA, 20 nt, Mycobacterium tuberculosis H37Rv
ggaacaacgcgcaaccagcc

SEQ ID NO: 1313823 - RNA, 14 nt, Mycobacterium tuberculosis H37Rv
ggaaaugaaguggc

SEQ ID NO: 1313824 - RNA, 13 nt, Mycobacterium tuberculosis H37Rv
ggaaaugucuccu

SEQ ID NO: 1313825 - RNA, 22 nt, Mycobacterium tuberculosis H37Rv
ggaaauacuuuggaugcccgua

SEQ ID NO: 1313826 - RNA, 21 nt, Mycobacterium tuberculosis H37Rv
ggaacuggaccggugccagca

SEQ ID NO: 1313827 - RNA, 19 nt, Mycobacterium tuberculosis H37Rv
ggaacucgucgcugcccau

SEQ ID NO: 1313828 - RNA, 16 nt, Mycobacterium tuberculosis H37Rv
ggaacuccggguggcg

SEQ ID NO: 1313829 - RNA, 21 nt, Mycobacterium tuberculosis H37Rv
ggaacgugacccccagcaggg

SEQ ID NO: 1313830 - RNA, 21 nt, Mycobacterium tuberculosis H37Rv
ggaacguuccugcacagacag

SEQ ID NO: 1313831 - RNA, 14 nt, Mycobacterium tuberculosis H37Rv
ggaacguccagccg

SEQ ID NO: 1313832 - RNA, 15 nt, Mycobacterium tuberculosis H37Rv
ggaacgcuaggcgau

SEQ ID NO: 1313833 - RNA, 12 nt, Mycobacterium tuberculosis H37Rv
ggaacgccggca

SEQ ID NO: 1313834 - RNA, 18 nt, Mycobacterium tuberculosis H37Rv
ggaagaucucggccagga

SEQ ID NO: 1313835 - RNA, 19 nt, Mycobacterium tuberculosis H37Rv
ggaagacuuagcgggugcc

SEQ ID NO: 1313836 - RNA, 23 nt, Mycobacterium tuberculosis H37Rv
ggaagcgcaaugcgcgacgguca

SEQ ID NO: 1313837 - RNA, 21 nt, Mycobacterium tuberculosis H37Rv
ggaagcgguugacccacagca

SEQ ID NO: 1313838 - RNA, 17 nt, Mycobacterium tuberculosis H37Rv
ggaagccgacgaccagc

SEQ ID NO: 1313839 - RNA, 11 nt, Mycobacterium tuberculosis H37Rv
ggaagccgacc

SEQ ID NO: 1313840 - RNA, 19 nt, Mycobacterium tuberculosis H37Rv
ggaagcccggcagaugcag

SEQ ID NO: 1313841 - RNA, 21 nt, Mycobacterium tuberculosis H37Rv
ggaagcgcaaugcgcgacggu

SEQ ID NO: 1313842 - RNA, 22 nt, Mycobacterium tuberculosis H37Rv
ggaauggacaggucgggcagca

SEQ ID NO: 1313843 - RNA, 17 nt, Mycobacterium tuberculosis H37Rv
ggaauggaccagcgccc

SEQ ID NO: 1313844 - RNA, 16 nt, Mycobacterium tuberculosis H37Rv
ggaaugccgucgccgg

SEQ ID NO: 1313845 - RNA, 16 nt, Mycobacterium tuberculosis H37Rv
ggaaucccgagucugc

SEQ ID NO: 1313846 - RNA, 21 nt, Mycobacterium tuberculosis H37Rv
ggaaucagugaagacaccagg

SEQ ID NO: 1313847 - RNA, 20 nt, Mycobacterium tuberculosis H37Rv
ggaaggggcucagcgguggc

SEQ ID NO: 1313848 - RNA, 17 nt, Mycobacterium tuberculosis H37Rv
ggaaggcucaccacggu

SEQ ID NO: 1313849 - RNA, 19 nt, Mycobacterium tuberculosis H37Rv
ggaaggcccaccauggcug

SEQ ID NO: 1313850 - RNA, 14 nt, Mycobacterium tuberculosis H37Rv
ggaaggcggccagg

SEQ ID NO: 1313851 - RNA, 15 nt, Mycobacterium tuberculosis H37Rv
ggaauuagucgccgc

SEQ ID NO: 1313852 - RNA, 19 nt, Mycobacterium tuberculosis H37Rv
ggaauuccgcuaccgcaca

SEQ ID NO: 1313853 - RNA, 21 nt, Mycobacterium tuberculosis H37Rv
ggacacuccugcacacaggac

SEQ ID NO: 1313854 - RNA, 22 nt, Mycobacterium tuberculosis H37Rv
ggacacuccugcacacaggacu

SEQ ID NO: 1313855 - RNA, 19 nt, Mycobacterium tuberculosis H37Rv
ggacaccaucuccgccguc

SEQ ID NO: 1313856 - RNA, 19 nt, Mycobacterium tuberculosis H37Rv
ggacaccguggaucggcag

SEQ ID NO: 1313857 - RNA, 23 nt, Mycobacterium tuberculosis H37Rv
ggacaccguggaucggcagcccg

SEQ ID NO: 1313858 - RNA, 19 nt, Mycobacterium tuberculosis H37Rv
ggacacagcguccgucguc

SEQ ID NO: 1313859 - RNA, 18 nt, Mycobacterium tuberculosis H37Rv
ggacacauugaccaggug

SEQ ID NO: 1313860 - RNA, 19 nt, Mycobacterium tuberculosis H37Rv
ggacaccaacccacccccc

SEQ ID NO: 1313861 - RNA, 14 nt, Mycobacterium tuberculosis H37Rv
ggacacacaggcgg

SEQ ID NO: 1313862 - RNA, 11 nt, Mycobacterium tuberculosis H37Rv
ggagagccggu

SEQ ID NO: 1313863 - RNA, 15 nt, Mycobacterium tuberculosis H37Rv
ggagacucucugauc

SEQ ID NO: 1313864 - RNA, 19 nt, Mycobacterium tuberculosis H37Rv
ggagacacccgccaggccg

SEQ ID NO: 1313865 - RNA, 24 nt, Mycobacterium tuberculosis H37Rv
ggagaaguucgugagcgaacgggc

SEQ ID NO: 1313866 - RNA, 21 nt, Mycobacterium tuberculosis H37Rv
ggagaccggccgggugaacca

SEQ ID NO: 1313867 - RNA, 17 nt, Mycobacterium tuberculosis H37Rv
ggacggccgccgccgca

SEQ ID NO: 1313868 - RNA, 23 nt, Mycobacterium tuberculosis H37Rv
ggacggcauagcagccagcgucc

SEQ ID NO: 1313869 - RNA, 18 nt, Mycobacterium tuberculosis H37Rv
ggacuaccgccggcggcg

SEQ ID NO: 1313870 - RNA, 15 nt, Mycobacterium tuberculosis H37Rv
ggacguuucagccgg

SEQ ID NO: 1313871 - RNA, 17 nt, Mycobacterium tuberculosis H37Rv
ggacaggucgggcagca

SEQ ID NO: 1313872 - RNA, 22 nt, Mycobacterium tuberculosis H37Rv
ggacagggugggggcaucaggg

SEQ ID NO: 1313873 - RNA, 15 nt, Mycobacterium tuberculosis H37Rv
ggacaggucgcccaa

SEQ ID NO: 1313874 - RNA, 18 nt, Mycobacterium tuberculosis H37Rv
ggacaggucgcccaacac

SEQ ID NO: 1313875 - RNA, 13 nt, Mycobacterium tuberculosis H37Rv
ggacagggcggcg

SEQ ID NO: 1313876 - RNA, 12 nt, Mycobacterium tuberculosis H37Rv
ggacgcgagugc

SEQ ID NO: 1313877 - RNA, 16 nt, Mycobacterium tuberculosis H37Rv
ggacgcgagugcguga

SEQ ID NO: 1313878 - RNA, 14 nt, Mycobacterium tuberculosis H37Rv
ggacgcgguuuugu

SEQ ID NO: 1313879 - RNA, 12 nt, Mycobacterium tuberculosis H37Rv
ggacgcuccggg

SEQ ID NO: 1313880 - RNA, 21 nt, Mycobacterium tuberculosis H37Rv
ggacgccuugcacaagcugaa

SEQ ID NO: 1313881 - RNA, 17 nt, Mycobacterium tuberculosis H37Rv
ggacgccgcgccgcaga

SEQ ID NO: 1313882 - RNA, 18 nt, Mycobacterium tuberculosis H37Rv
ggacauccgggccgagcg

SEQ ID NO: 1313883 - RNA, 23 nt, Mycobacterium tuberculosis H37Rv
ggacauccgaugcgucacaccac

SEQ ID NO: 1313884 - RNA, 20 nt, Mycobacterium tuberculosis H37Rv
ggacauccgcuuacgggugu

SEQ ID NO: 1313885 - RNA, 22 nt, Mycobacterium tuberculosis H37Rv
ggagcccggcauuaggccgggg

SEQ ID NO: 1313886 - RNA, 15 nt, Mycobacterium tuberculosis H37Rv
ggagcccgagcucac

SEQ ID NO: 1313887 - RNA, 21 nt, Mycobacterium tuberculosis H37Rv
ggagcccgagcucaccgcaca

SEQ ID NO: 1313888 - RNA, 19 nt, Mycobacterium tuberculosis H37Rv
ggagccgccggccccgcca

SEQ ID NO: 1313889 - RNA, 22 nt, Mycobacterium tuberculosis H37Rv
ggagccgcccaagccgccggcg

SEQ ID NO: 1313890 - RNA, 21 nt, Mycobacterium tuberculosis H37Rv
ggagccgccggacgaacugug

SEQ ID NO: 1313891 - RNA, 12 nt, Mycobacterium tuberculosis H37Rv
ggagccgcccaa

SEQ ID NO: 1313892 - RNA, 15 nt, Mycobacterium tuberculosis H37Rv
ggagccgcccaagcc

SEQ ID NO: 1313893 - RNA, 16 nt, Mycobacterium tuberculosis H37Rv
ggagcaccgaccaggg

SEQ ID NO: 1313894 - RNA, 23 nt, Mycobacterium tuberculosis H37Rv
ggagccacucggcccggcaggac

SEQ ID NO: 1313895 - RNA, 16 nt, Mycobacterium tuberculosis H37Rv
ggagcuauucgguguc

SEQ ID NO: 1313896 - RNA, 20 nt, Mycobacterium tuberculosis H37Rv
ggagcucacgccgggugugg

SEQ ID NO: 1313897 - RNA, 16 nt, Mycobacterium tuberculosis H37Rv
ggagcucuugcgggca

SEQ ID NO: 1313898 - RNA, 14 nt, Mycobacterium tuberculosis H37Rv
ggagcugcggcggc

SEQ ID NO: 1313899 - RNA, 22 nt, Mycobacterium tuberculosis H37Rv
ggagccgggccguccggguaga

SEQ ID NO: 1313900 - RNA, 19 nt, Mycobacterium tuberculosis H37Rv
ggagccuccagcgcaccgg

SEQ ID NO: 1313901 - RNA, 22 nt, Mycobacterium tuberculosis H37Rv
ggagccgucgcaucaggucggu

SEQ ID NO: 1313902 - RNA, 12 nt, Mycobacterium tuberculosis H37Rv
ggaggcugggcu

SEQ ID NO: 1313903 - RNA, 17 nt, Mycobacterium tuberculosis H37Rv
ggaggggacccagcggc

SEQ ID NO: 1313904 - RNA, 15 nt, Mycobacterium tuberculosis H37Rv
ggaguugaagaagcc

SEQ ID NO: 1313905 - RNA, 20 nt, Mycobacterium tuberculosis H37Rv
ggaggugaaccccgccggca

SEQ ID NO: 1313906 - RNA, 19 nt, Mycobacterium tuberculosis H37Rv
ggauaacccagcaccacaa

SEQ ID NO: 1313907 - RNA, 23 nt, Mycobacterium tuberculosis H37Rv
ggauaacccagcggcgccacgug

SEQ ID NO: 1313908 - RNA, 13 nt, Mycobacterium tuberculosis H37Rv
ggaguuuccccua

SEQ ID NO: 1313909 - RNA, 16 nt, Mycobacterium tuberculosis H37Rv
ggaguugucgacggcc

SEQ ID NO: 1313910 - RNA, 19 nt, Mycobacterium tuberculosis H37Rv
ggaucccagugccagugcc

SEQ ID NO: 1313911 - RNA, 12 nt, Mycobacterium tuberculosis H37Rv
ggauccagcagg

SEQ ID NO: 1313912 - RNA, 15 nt, Mycobacterium tuberculosis H37Rv
ggauccagcaggccg

SEQ ID NO: 1313913 - RNA, 19 nt, Mycobacterium tuberculosis H37Rv
ggauccaccacgcuggccu

SEQ ID NO: 1313914 - RNA, 13 nt, Mycobacterium tuberculosis H37Rv
ggauccggcggca

SEQ ID NO: 1313915 - RNA, 15 nt, Mycobacterium tuberculosis H37Rv
ggauccgggagucga

SEQ ID NO: 1313916 - RNA, 17 nt, Mycobacterium tuberculosis H37Rv
ggauccggcagcagccg

SEQ ID NO: 1313917 - RNA, 17 nt, Mycobacterium tuberculosis H37Rv
ggauccgaagagccagc

SEQ ID NO: 1313918 - RNA, 19 nt, Mycobacterium tuberculosis H37Rv
ggaucgacgucgcggcgcc

SEQ ID NO: 1313919 - RNA, 14 nt, Mycobacterium tuberculosis H37Rv
ggaucgaccgccag

SEQ ID NO: 1313920 - RNA, 15 nt, Mycobacterium tuberculosis H37Rv
ggaucgaccaugguc

SEQ ID NO: 1313921 - RNA, 20 nt, Mycobacterium tuberculosis H37Rv
ggaucgacaguugcgccagc

SEQ ID NO: 1313922 - RNA, 18 nt, Mycobacterium tuberculosis H37Rv
ggauccuccggguuggcg

SEQ ID NO: 1313923 - RNA, 19 nt, Mycobacterium tuberculosis H37Rv
ggauccgggcgugguggau

SEQ ID NO: 1313924 - RNA, 18 nt, Mycobacterium tuberculosis H37Rv
ggauccgguggugggccg

SEQ ID NO: 1313925 - RNA, 15 nt, Mycobacterium tuberculosis H37Rv
ggaucgcccaggcgc

SEQ ID NO: 1313926 - RNA, 20 nt, Mycobacterium tuberculosis H37Rv
ggaucgccggugaacaggga

SEQ ID NO: 1313927 - RNA, 17 nt, Mycobacterium tuberculosis H37Rv
ggaucgccaccggcgcc

SEQ ID NO: 1313928 - RNA, 17 nt, Mycobacterium tuberculosis H37Rv
ggaucgccugagcgccg

SEQ ID NO: 1313929 - RNA, 21 nt, Mycobacterium tuberculosis H37Rv
ggaucgccuuggcgcccgcga

SEQ ID NO: 1313930 - RNA, 17 nt, Mycobacterium tuberculosis H37Rv
ggaucagcgugucgccg

SEQ ID NO: 1313931 - RNA, 17 nt, Mycobacterium tuberculosis H37Rv
ggauaguucaccacaug

SEQ ID NO: 1313932 - RNA, 14 nt, Mycobacterium tuberculosis H37Rv
ggauacccagcgcc

SEQ ID NO: 1313933 - RNA, 23 nt, Mycobacterium tuberculosis H37Rv
ggauacccuuugcacgguggcaa

SEQ ID NO: 1313934 - RNA, 14 nt, Mycobacterium tuberculosis H37Rv
ggaucggcucgcca

SEQ ID NO: 1313935 - RNA, 16 nt, Mycobacterium tuberculosis H37Rv
ggaucggccggcgguc

SEQ ID NO: 1313936 - RNA, 14 nt, Mycobacterium tuberculosis H37Rv
ggaucgucgcugug

SEQ ID NO: 1313937 - RNA, 22 nt, Mycobacterium tuberculosis H37Rv
ggaucgguuucugcggccccga

SEQ ID NO: 1313938 - RNA, 14 nt, Mycobacterium tuberculosis H37Rv
ggaucuuggccagc

SEQ ID NO: 1313939 - RNA, 15 nt, Mycobacterium tuberculosis H37Rv
ggaucuuggccagca

SEQ ID NO: 1313940 - RNA, 15 nt, Mycobacterium tuberculosis H37Rv
ggaugccggucggcg

SEQ ID NO: 1313941 - RNA, 15 nt, Mycobacterium tuberculosis H37Rv
ggaugacgcccaggg

SEQ ID NO: 1313942 - RNA, 16 nt, Mycobacterium tuberculosis H37Rv
ggaugaccaccgguuc

SEQ ID NO: 1313943 - RNA, 21 nt, Mycobacterium tuberculosis H37Rv
ggaugcguuggccccaggauc

SEQ ID NO: 1313944 - RNA, 15 nt, Mycobacterium tuberculosis H37Rv
ggaugcucaggucac

SEQ ID NO: 1313945 - RNA, 14 nt, Mycobacterium tuberculosis H37Rv
ggaugcgaggcgua

SEQ ID NO: 1313946 - RNA, 18 nt, Mycobacterium tuberculosis H37Rv
ggaugcgcuuccaucgcc

SEQ ID NO: 1313947 - RNA, 21 nt, Mycobacterium tuberculosis H37Rv
ggauucagcgcagcaacuggg

SEQ ID NO: 1313948 - RNA, 17 nt, Mycobacterium tuberculosis H37Rv
ggaugucucggcaccac

SEQ ID NO: 1313949 - RNA, 19 nt, Mycobacterium tuberculosis H37Rv
ggaugucgagcguggcgac

SEQ ID NO: 1313950 - RNA, 19 nt, Mycobacterium tuberculosis H37Rv
ggaugucgucgaccaggcc

SEQ ID NO: 1313951 - RNA, 13 nt, Mycobacterium tuberculosis H37Rv
ggaugucgugcgg

SEQ ID NO: 1313952 - RNA, 15 nt, Mycobacterium tuberculosis H37Rv
ggaugucgugcgggc

SEQ ID NO: 1313953 - RNA, 15 nt, Mycobacterium tuberculosis H37Rv
ggaugcucgauccac

SEQ ID NO: 1313954 - RNA, 21 nt, Mycobacterium tuberculosis H37Rv
ggauucgaagccgagcuccuc

SEQ ID NO: 1313955 - RNA, 18 nt, Mycobacterium tuberculosis H37Rv
ggauuccgcacccccguc

SEQ ID NO: 1313956 - RNA, 15 nt, Mycobacterium tuberculosis H37Rv
ggauucggcugccac

SEQ ID NO: 1313957 - RNA, 16 nt, Mycobacterium tuberculosis H37Rv
ggauucgggcgccgca

SEQ ID NO: 1313958 - RNA, 12 nt, Mycobacterium tuberculosis H37Rv
ggauucuucagc

SEQ ID NO: 1313959 - RNA, 20 nt, Mycobacterium tuberculosis H37Rv
ggcccucgggacugcgcggc

SEQ ID NO: 1313960 - RNA, 19 nt, Mycobacterium tuberculosis H37Rv
ggcccuccacugcgagcgc

SEQ ID NO: 1313961 - RNA, 20 nt, Mycobacterium tuberculosis H37Rv
ggcccggacaugcgggcagc

SEQ ID NO: 1313962 - RNA, 13 nt, Mycobacterium tuberculosis H37Rv
ggcccggccgcca

SEQ ID NO: 1313963 - RNA, 13 nt, Mycobacterium tuberculosis H37Rv
ggcccgcucaccu

SEQ ID NO: 1313964 - RNA, 14 nt, Mycobacterium tuberculosis H37Rv
ggcccgcucccugc

SEQ ID NO: 1313965 - RNA, 17 nt, Mycobacterium tuberculosis H37Rv
ggcccgcucccugcacc

SEQ ID NO: 1313966 - RNA, 22 nt, Mycobacterium tuberculosis H37Rv
ggcccgcuccacggucaggcgu

SEQ ID NO: 1313967 - RNA, 15 nt, Mycobacterium tuberculosis H37Rv
ggcccgcucagccgu

SEQ ID NO: 1313968 - RNA, 14 nt, Mycobacterium tuberculosis H37Rv
ggcccggcaggacu

SEQ ID NO: 1313969 - RNA, 16 nt, Mycobacterium tuberculosis H37Rv
ggcccgcuguggucuu

SEQ ID NO: 1313970 - RNA, 15 nt, Mycobacterium tuberculosis H37Rv
ggcccugagcugccg

SEQ ID NO: 1313971 - RNA, 19 nt, Mycobacterium tuberculosis H37Rv
ggcccugagcugccgagcg

SEQ ID NO: 1313972 - RNA, 16 nt, Mycobacterium tuberculosis H37Rv
ggcccugccgccggcc

SEQ ID NO: 1313973 - RNA, 19 nt, Mycobacterium tuberculosis H37Rv
ggcccugccgacgcuccag

SEQ ID NO: 1313974 - RNA, 20 nt, Mycobacterium tuberculosis H37Rv
ggccgaacgggucggcgacc

SEQ ID NO: 1313975 - RNA, 20 nt, Mycobacterium tuberculosis H37Rv
ggcccugcuccucgcgggcg

SEQ ID NO: 1313976 - RNA, 23 nt, Mycobacterium tuberculosis H37Rv
ggcccugcuccucgcgggcggcg

SEQ ID NO: 1313977 - RNA, 21 nt, Mycobacterium tuberculosis H37Rv
ggccgaagcccgaucggcggg

SEQ ID NO: 1313978 - RNA, 21 nt, Mycobacterium tuberculosis H37Rv
ggccgaacugccgcgccgacg

SEQ ID NO: 1313979 - RNA, 20 nt, Mycobacterium tuberculosis H37Rv
ggccgaagcucacacuggcu

SEQ ID NO: 1313980 - RNA, 17 nt, Mycobacterium tuberculosis H37Rv
ggccgacaacccggccg

SEQ ID NO: 1313981 - RNA, 17 nt, Mycobacterium tuberculosis H37Rv
ggccgacacgccgaugc

SEQ ID NO: 1313982 - RNA, 20 nt, Mycobacterium tuberculosis H37Rv
ggccgcaacugcagguucuu

SEQ ID NO: 1313983 - RNA, 19 nt, Mycobacterium tuberculosis H37Rv
ggccgauggugugcacggc

SEQ ID NO: 1313984 - RNA, 19 nt, Mycobacterium tuberculosis H37Rv
ggccgaucaccccggugga

SEQ ID NO: 1313985 - RNA, 16 nt, Mycobacterium tuberculosis H37Rv
ggccgaugccgaccuu

SEQ ID NO: 1313986 - RNA, 19 nt, Mycobacterium tuberculosis H37Rv
ggccgauacgaagccgccg

SEQ ID NO: 1313987 - RNA, 21 nt, Mycobacterium tuberculosis H37Rv
ggccgaguuguaggccgccug

SEQ ID NO: 1313988 - RNA, 22 nt, Mycobacterium tuberculosis H37Rv
ggccgagcucguugcuggcggc

SEQ ID NO: 1313989 - RNA, 21 nt, Mycobacterium tuberculosis H37Rv
ggccgagcggagacuccagca

SEQ ID NO: 1313990 - RNA, 12 nt, Mycobacterium tuberculosis H37Rv
ggccgagcgcga

SEQ ID NO: 1313991 - RNA, 15 nt, Mycobacterium tuberculosis H37Rv
ggccgagcgcaccgc

SEQ ID NO: 1313992 - RNA, 18 nt, Mycobacterium tuberculosis H37Rv
ggccgagcgcaccacggc

SEQ ID NO: 1313993 - RNA, 13 nt, Mycobacterium tuberculosis H37Rv
ggccgaccagagc

SEQ ID NO: 1313994 - RNA, 22 nt, Mycobacterium tuberculosis H37Rv
ggccgacagcacgccaggcaug

SEQ ID NO: 1313995 - RNA, 19 nt, Mycobacterium tuberculosis H37Rv
ggccccgccgaugccgccg

SEQ ID NO: 1313996 - RNA, 15 nt, Mycobacterium tuberculosis H37Rv
ggccccgccggcccc

SEQ ID NO: 1313997 - RNA, 14 nt, Mycobacterium tuberculosis H37Rv
ggccccgaucccga

SEQ ID NO: 1313998 - RNA, 15 nt, Mycobacterium tuberculosis H37Rv
ggccccgccagcgcc

SEQ ID NO: 1313999 - RNA, 15 nt, Mycobacterium tuberculosis H37Rv
ggccccgccagcggc

SEQ ID NO: 1314000 - RNA, 21 nt, Mycobacterium tuberculosis H37Rv
ggccccgccggccccgccguc

SEQ ID NO: 1314001 - RNA, 16 nt, Mycobacterium tuberculosis H37Rv
ggccccgccgguggcc

SEQ ID NO: 1314002 - RNA, 19 nt, Mycobacterium tuberculosis H37Rv
ggccccgccguugccgccg

SEQ ID NO: 1314003 - RNA, 14 nt, Mycobacterium tuberculosis H37Rv
ggccccgcgccggc

SEQ ID NO: 1314004 - RNA, 15 nt, Mycobacterium tuberculosis H37Rv
ggccccgcgccggcc

SEQ ID NO: 1314005 - RNA, 20 nt, Mycobacterium tuberculosis H37Rv
ggccccgcggcgccgccacg

SEQ ID NO: 1314006 - RNA, 19 nt, Mycobacterium tuberculosis H37Rv
ggccccccgcgccugccuc

SEQ ID NO: 1314007 - RNA, 17 nt, Mycobacterium tuberculosis H37Rv
ggccccccgcgccugcc

SEQ ID NO: 1314008 - RNA, 17 nt, Mycobacterium tuberculosis H37Rv
ggcccccaagaccaagu

SEQ ID NO: 1314009 - RNA, 15 nt, Mycobacterium tuberculosis H37Rv
ggccccaccggugcc

SEQ ID NO: 1314010 - RNA, 20 nt, Mycobacterium tuberculosis H37Rv
ggccccacuggugcagcgcc

SEQ ID NO: 1314011 - RNA, 16 nt, Mycobacterium tuberculosis H37Rv
ggcccgccagcccagc

SEQ ID NO: 1314012 - RNA, 15 nt, Mycobacterium tuberculosis H37Rv
ggcccgcggucgcga

SEQ ID NO: 1314013 - RNA, 13 nt, Mycobacterium tuberculosis H37Rv
ggcccgccagccc

SEQ ID NO: 1314014 - RNA, 22 nt, Mycobacterium tuberculosis H37Rv
ggcccgccaaaaacgccccggc

SEQ ID NO: 1314015 - RNA, 20 nt, Mycobacterium tuberculosis H37Rv
ggcccgccagaacggcgucg

SEQ ID NO: 1314016 - RNA, 14 nt, Mycobacterium tuberculosis H37Rv
ggcccgcagcgugu

SEQ ID NO: 1314017 - RNA, 23 nt, Mycobacterium tuberculosis H37Rv
ggcccgcagcccgccgggcucca

SEQ ID NO: 1314018 - RNA, 19 nt, Mycobacterium tuberculosis H37Rv
ggcccgcacguuggcggcc

SEQ ID NO: 1314019 - RNA, 19 nt, Mycobacterium tuberculosis H37Rv
ggcccgcagccaaguccgc

SEQ ID NO: 1314020 - RNA, 12 nt, Mycobacterium tuberculosis H37Rv
ggcccgcacggc

SEQ ID NO: 1314021 - RNA, 16 nt, Mycobacterium tuberculosis H37Rv
ggcccgcacggccgca

SEQ ID NO: 1314022 - RNA, 21 nt, Mycobacterium tuberculosis H37Rv
ggcccgcacggccgcagccga

SEQ ID NO: 1314023 - RNA, 21 nt, Mycobacterium tuberculosis H37Rv
ggcccgauugaguucggcggc

SEQ ID NO: 1314024 - RNA, 13 nt, Mycobacterium tuberculosis H37Rv
ggcccgauccagu

SEQ ID NO: 1314025 - RNA, 15 nt, Mycobacterium tuberculosis H37Rv
ggccccggccgcguc

SEQ ID NO: 1314026 - RNA, 19 nt, Mycobacterium tuberculosis H37Rv
ggcccgaucgaccgcugga

SEQ ID NO: 1314027 - RNA, 18 nt, Mycobacterium tuberculosis H37Rv
ggcccgaucugagcugcc

SEQ ID NO: 1314028 - RNA, 11 nt, Mycobacterium tuberculosis H37Rv
ggcccagcgcg

SEQ ID NO: 1314029 - RNA, 12 nt, Mycobacterium tuberculosis H37Rv
ggcccagcgcgc

SEQ ID NO: 1314030 - RNA, 22 nt, Mycobacterium tuberculosis H37Rv
ggcccagccggaccgcgacggc

SEQ ID NO: 1314031 - RNA, 17 nt, Mycobacterium tuberculosis H37Rv
ggcccagccgagcggcg

SEQ ID NO: 1314032 - RNA, 19 nt, Mycobacterium tuberculosis H37Rv
ggcccagccgagcggcggc

SEQ ID NO: 1314033 - RNA, 20 nt, Mycobacterium tuberculosis H37Rv
ggcccagcaaccgcucggcg

SEQ ID NO: 1314034 - RNA, 16 nt, Mycobacterium tuberculosis H37Rv
ggcccacggcagcgcc

SEQ ID NO: 1314035 - RNA, 22 nt, Mycobacterium tuberculosis H37Rv
ggccccaagcgugcugccgccu

SEQ ID NO: 1314036 - RNA, 23 nt, Mycobacterium tuberculosis H37Rv
ggccccaagcgugcugccgccuu

SEQ ID NO: 1314037 - RNA, 22 nt, Mycobacterium tuberculosis H37Rv
ggcccaucuucggacgccagcu

SEQ ID NO: 1314038 - RNA, 21 nt, Mycobacterium tuberculosis H37Rv
ggcccagugggacuggcguga

SEQ ID NO: 1314039 - RNA, 23 nt, Mycobacterium tuberculosis H37Rv
ggccagggucagcucggugaugu

SEQ ID NO: 1314040 - RNA, 14 nt, Mycobacterium tuberculosis H37Rv
ggccaggcccagcu

SEQ ID NO: 1314041 - RNA, 20 nt, Mycobacterium tuberculosis H37Rv
ggccaggauaaguccggaca

SEQ ID NO: 1314042 - RNA, 17 nt, Mycobacterium tuberculosis H37Rv
ggccaggaagucccggg

SEQ ID NO: 1314043 - RNA, 19 nt, Mycobacterium tuberculosis H37Rv
ggccaggaagucccgggca

SEQ ID NO: 1314044 - RNA, 20 nt, Mycobacterium tuberculosis H37Rv
ggccaggaugaagacgcggg

SEQ ID NO: 1314045 - RNA, 24 nt, Mycobacterium tuberculosis H37Rv
ggccaggaucgcuacgucgaccga

SEQ ID NO: 1314046 - RNA, 20 nt, Mycobacterium tuberculosis H37Rv
ggccagcuugcggagccgcc

SEQ ID NO: 1314047 - RNA, 19 nt, Mycobacterium tuberculosis H37Rv
ggccagcgcggcgcgcggg

SEQ ID NO: 1314048 - RNA, 21 nt, Mycobacterium tuberculosis H37Rv
ggccagcgcggcgcgcggggc

SEQ ID NO: 1314049 - RNA, 12 nt, Mycobacterium tuberculosis H37Rv
ggccagcugcgu

SEQ ID NO: 1314050 - RNA, 19 nt, Mycobacterium tuberculosis H37Rv
ggccagcugcggcuccggc

SEQ ID NO: 1314051 - RNA, 12 nt, Mycobacterium tuberculosis H37Rv
ggccagcccagc

SEQ ID NO: 1314052 - RNA, 14 nt, Mycobacterium tuberculosis H37Rv
ggccagcccgagcu

SEQ ID NO: 1314053 - RNA, 15 nt, Mycobacterium tuberculosis H37Rv
ggccagcgcgcgcgg

SEQ ID NO: 1314054 - RNA, 18 nt, Mycobacterium tuberculosis H37Rv
ggccagcgcgccacgagc

SEQ ID NO: 1314055 - RNA, 16 nt, Mycobacterium tuberculosis H37Rv
ggccaguucggugagc

SEQ ID NO: 1314056 - RNA, 18 nt, Mycobacterium tuberculosis H37Rv
ggccaggucagccgcgcg

SEQ ID NO: 1314057 - RNA, 15 nt, Mycobacterium tuberculosis H37Rv
ggccaggucgagcac

SEQ ID NO: 1314058 - RNA, 17 nt, Mycobacterium tuberculosis H37Rv
ggccauaccgcucgccg

SEQ ID NO: 1314059 - RNA, 19 nt, Mycobacterium tuberculosis H37Rv
ggccaucagaaccuccucg

SEQ ID NO: 1314060 - RNA, 15 nt, Mycobacterium tuberculosis H37Rv
ggccaucaccgcgcu

SEQ ID NO: 1314061 - RNA, 16 nt, Mycobacterium tuberculosis H37Rv
ggccaucagcucgcca

SEQ ID NO: 1314062 - RNA, 20 nt, Mycobacterium tuberculosis H37Rv
ggccaucagcucgccagggu

SEQ ID NO: 1314063 - RNA, 14 nt, Mycobacterium tuberculosis H37Rv
ggccaugcucgcca

SEQ ID NO: 1314064 - RNA, 21 nt, Mycobacterium tuberculosis H37Rv
ggccaugcuaggaccaccagc

SEQ ID NO: 1314065 - RNA, 21 nt, Mycobacterium tuberculosis H37Rv
ggccaugcuggucagcggcgc

SEQ ID NO: 1314066 - RNA, 16 nt, Mycobacterium tuberculosis H37Rv
ggccauguugcccugc

SEQ ID NO: 1314067 - RNA, 22 nt, Mycobacterium tuberculosis H37Rv
ggccauguagccguugccgccg

SEQ ID NO: 1314068 - RNA, 16 nt, Mycobacterium tuberculosis H37Rv
ggccaugucagcggcc

SEQ ID NO: 1314069 - RNA, 20 nt, Mycobacterium tuberculosis H37Rv
ggccagagucgcccgcacac

SEQ ID NO: 1314070 - RNA, 16 nt, Mycobacterium tuberculosis H37Rv
ggccagagucgcccgc

SEQ ID NO: 1314071 - RNA, 16 nt, Mycobacterium tuberculosis H37Rv
ggccagagccgcgcgc

SEQ ID NO: 1314072 - RNA, 16 nt, Mycobacterium tuberculosis H37Rv
ggccagaucgaagcgc

SEQ ID NO: 1314073 - RNA, 23 nt, Mycobacterium tuberculosis H37Rv
ggccagaucgaagcgcagcaccu

SEQ ID NO: 1314074 - RNA, 16 nt, Mycobacterium tuberculosis H37Rv
ggccacggggcugccg

SEQ ID NO: 1314075 - RNA, 15 nt, Mycobacterium tuberculosis H37Rv
ggccagagccgcccu

SEQ ID NO: 1314076 - RNA, 13 nt, Mycobacterium tuberculosis H37Rv
ggccagagccgcg

SEQ ID NO: 1314077 - RNA, 19 nt, Mycobacterium tuberculosis H37Rv
ggccacggcuuugcggcgc

SEQ ID NO: 1314078 - RNA, 15 nt, Mycobacterium tuberculosis H37Rv
ggccacggcgucggc

SEQ ID NO: 1314079 - RNA, 16 nt, Mycobacterium tuberculosis H37Rv
ggccacggcgucggcc

SEQ ID NO: 1314080 - RNA, 20 nt, Mycobacterium tuberculosis H37Rv
ggccacggcgucggccaccc

SEQ ID NO: 1314081 - RNA, 22 nt, Mycobacterium tuberculosis H37Rv
ggccacggaaguaucgccggcc

SEQ ID NO: 1314082 - RNA, 20 nt, Mycobacterium tuberculosis H37Rv
ggccacggaaguaucgccgg

SEQ ID NO: 1314083 - RNA, 22 nt, Mycobacterium tuberculosis H37Rv
ggccagcaacugccgcacccgg

SEQ ID NO: 1314084 - RNA, 13 nt, Mycobacterium tuberculosis H37Rv
ggccagccacagc

SEQ ID NO: 1314085 - RNA, 12 nt, Mycobacterium tuberculosis H37Rv
ggccagcaggua

SEQ ID NO: 1314086 - RNA, 20 nt, Mycobacterium tuberculosis H37Rv
ggccagcagggccaccacca

SEQ ID NO: 1314087 - RNA, 14 nt, Mycobacterium tuberculosis H37Rv
ggccagcaggcggc

SEQ ID NO: 1314088 - RNA, 15 nt, Mycobacterium tuberculosis H37Rv
ggccagcagugcggu

SEQ ID NO: 1314089 - RNA, 19 nt, Mycobacterium tuberculosis H37Rv
ggcauguuccuugcggccg

SEQ ID NO: 1314090 - RNA, 20 nt, Mycobacterium tuberculosis H37Rv
ggcaugucgguuuccucgag

SEQ ID NO: 1314091 - RNA, 13 nt, Mycobacterium tuberculosis H37Rv
ggcaugucgccga

SEQ ID NO: 1314092 - RNA, 17 nt, Mycobacterium tuberculosis H37Rv
ggccaccagaaccacuu

SEQ ID NO: 1314093 - RNA, 19 nt, Mycobacterium tuberculosis H37Rv
ggccaccaggggaccgcgg

SEQ ID NO: 1314094 - RNA, 14 nt, Mycobacterium tuberculosis H37Rv
ggccaccagcuggc

SEQ ID NO: 1314095 - RNA, 19 nt, Mycobacterium tuberculosis H37Rv
ggccaccaguuguccggcu

SEQ ID NO: 1314096 - RNA, 21 nt, Mycobacterium tuberculosis H37Rv
ggccaccccgagcucaccaag

SEQ ID NO: 1314097 - RNA, 24 nt, Mycobacterium tuberculosis H37Rv
ggccacccgcaggucgcaccacag

SEQ ID NO: 1314098 - RNA, 14 nt, Mycobacterium tuberculosis H37Rv
ggccaccccgaccu

SEQ ID NO: 1314099 - RNA, 13 nt, Mycobacterium tuberculosis H37Rv
ggccaccgcagac

SEQ ID NO: 1314100 - RNA, 19 nt, Mycobacterium tuberculosis H37Rv
ggccaccgccgccugcccg

SEQ ID NO: 1314101 - RNA, 17 nt, Mycobacterium tuberculosis H37Rv
ggccaccgcaucgccga

SEQ ID NO: 1314102 - RNA, 22 nt, Mycobacterium tuberculosis H37Rv
ggccacgcauuccagcaggcca

SEQ ID NO: 1314103 - RNA, 13 nt, Mycobacterium tuberculosis H37Rv
ggccaccggcguc

SEQ ID NO: 1314104 - RNA, 14 nt, Mycobacterium tuberculosis H37Rv
ggccaccggcgguc

SEQ ID NO: 1314105 - RNA, 13 nt, Mycobacterium tuberculosis H37Rv
ggccaccggcgcc

SEQ ID NO: 1314106 - RNA, 16 nt, Mycobacterium tuberculosis H37Rv
ggccaccgcccagugc

SEQ ID NO: 1314107 - RNA, 16 nt, Mycobacterium tuberculosis H37Rv
ggcacguucagccagg

SEQ ID NO: 1314108 - RNA, 17 nt, Mycobacterium tuberculosis H37Rv
ggcacguucagccaggc

SEQ ID NO: 1314109 - RNA, 21 nt, Mycobacterium tuberculosis H37Rv
ggcacguggcgaccggcgacc

SEQ ID NO: 1314110 - RNA, 22 nt, Mycobacterium tuberculosis H37Rv
ggcacguccgaucggcgcgccg

SEQ ID NO: 1314111 - RNA, 19 nt, Mycobacterium tuberculosis H37Rv
ggcacguccgaucggcgcg

SEQ ID NO: 1314112 - RNA, 16 nt, Mycobacterium tuberculosis H37Rv
ggcacgucggcgccga

SEQ ID NO: 1314113 - RNA, 14 nt, Mycobacterium tuberculosis H37Rv
ggcacgcccucguc

SEQ ID NO: 1314114 - RNA, 19 nt, Mycobacterium tuberculosis H37Rv
ggcacgccggccgcgcuga

SEQ ID NO: 1314115 - RNA, 16 nt, Mycobacterium tuberculosis H37Rv
ggcacgccggcggcgg

SEQ ID NO: 1314116 - RNA, 15 nt, Mycobacterium tuberculosis H37Rv
ggcacgccggcggcg

SEQ ID NO: 1314117 - RNA, 14 nt, Mycobacterium tuberculosis H37Rv
ggcacgaucgccaa

SEQ ID NO: 1314118 - RNA, 18 nt, Mycobacterium tuberculosis H37Rv
ggcacgaucgucgcggcc

SEQ ID NO: 1314119 - RNA, 17 nt, Mycobacterium tuberculosis H37Rv
ggcacgcacaaguucuu

SEQ ID NO: 1314120 - RNA, 15 nt, Mycobacterium tuberculosis H37Rv
ggcaccgcggccagc

SEQ ID NO: 1314121 - RNA, 18 nt, Mycobacterium tuberculosis H37Rv
ggcacgacccgggaagga

SEQ ID NO: 1314122 - RNA, 19 nt, Mycobacterium tuberculosis H37Rv
ggcacgacccgggaaggaa

SEQ ID NO: 1314123 - RNA, 16 nt, Mycobacterium tuberculosis H37Rv
ggcacgaccgcucccg

SEQ ID NO: 1314124 - RNA, 15 nt, Mycobacterium tuberculosis H37Rv
ggcaccgcgccggcg

SEQ ID NO: 1314125 - RNA, 21 nt, Mycobacterium tuberculosis H37Rv
ggcaccgccgguggcgccggg

SEQ ID NO: 1314126 - RNA, 20 nt, Mycobacterium tuberculosis H37Rv
ggcaccgccgguggcgccgg

SEQ ID NO: 1314127 - RNA, 16 nt, Mycobacterium tuberculosis H37Rv
ggcaccgccgguggcg

SEQ ID NO: 1314128 - RNA, 15 nt, Mycobacterium tuberculosis H37Rv
ggcaccgccggcgcc

SEQ ID NO: 1314129 - RNA, 21 nt, Mycobacterium tuberculosis H37Rv
ggcaccgccggcgccgccguc

SEQ ID NO: 1314130 - RNA, 19 nt, Mycobacterium tuberculosis H37Rv
ggcaccgccggcuccgccg

SEQ ID NO: 1314131 - RNA, 14 nt, Mycobacterium tuberculosis H37Rv
ggcaccgccgcccc

SEQ ID NO: 1314132 - RNA, 14 nt, Mycobacterium tuberculosis H37Rv
ggcaccgccgagca

SEQ ID NO: 1314133 - RNA, 14 nt, Mycobacterium tuberculosis H37Rv
ggcaccauaucgug

SEQ ID NO: 1314134 - RNA, 15 nt, Mycobacterium tuberculosis H37Rv
ggcaccgauccugga

SEQ ID NO: 1314135 - RNA, 16 nt, Mycobacterium tuberculosis H37Rv
ggcaccgagcugagcg

SEQ ID NO: 1314136 - RNA, 23 nt, Mycobacterium tuberculosis H37Rv
ggcacacgaguacagaucgaggg

SEQ ID NO: 1314137 - RNA, 22 nt, Mycobacterium tuberculosis H37Rv
ggcacacggccuugccgaucag

SEQ ID NO: 1314138 - RNA, 23 nt, Mycobacterium tuberculosis H37Rv
ggcacacuguuacuccgacggcc

SEQ ID NO: 1314139 - RNA, 15 nt, Mycobacterium tuberculosis H37Rv
ggcaaacuccugcag

SEQ ID NO: 1314140 - RNA, 15 nt, Mycobacterium tuberculosis H37Rv
ggcaaacgugaucag

SEQ ID NO: 1314141 - RNA, 20 nt, Mycobacterium tuberculosis H37Rv
ggcaccacuacaucgaucag

SEQ ID NO: 1314142 - RNA, 21 nt, Mycobacterium tuberculosis H37Rv
ggcaccacccgauuggccaac

SEQ ID NO: 1314143 - RNA, 21 nt, Mycobacterium tuberculosis H37Rv
ggcaccagccggugagcgagc

SEQ ID NO: 1314144 - RNA, 19 nt, Mycobacterium tuberculosis H37Rv
ggcaccagguugccgaggu

SEQ ID NO: 1314145 - RNA, 21 nt, Mycobacterium tuberculosis H37Rv
ggcaccagcggcaccgcggcc

SEQ ID NO: 1314146 - RNA, 18 nt, Mycobacterium tuberculosis H37Rv
ggcaccagcggcaccgcg

SEQ ID NO: 1314147 - RNA, 23 nt, Mycobacterium tuberculosis H37Rv
ggcacauugaucgacggccagcc

SEQ ID NO: 1314148 - RNA, 19 nt, Mycobacterium tuberculosis H37Rv
ggcacauugaucgacggcc

SEQ ID NO: 1314149 - RNA, 23 nt, Mycobacterium tuberculosis H37Rv
ggcagagccgccguugccgccgg

SEQ ID NO: 1314150 - RNA, 22 nt, Mycobacterium tuberculosis H37Rv
ggcagauacucggcgacugcgu

SEQ ID NO: 1314151 - RNA, 21 nt, Mycobacterium tuberculosis H37Rv
ggcagaucccacgccaggauc

SEQ ID NO: 1314152 - RNA, 16 nt, Mycobacterium tuberculosis H37Rv
ggcagaucgauaccgu

SEQ ID NO: 1314153 - RNA, 19 nt, Mycobacterium tuberculosis H37Rv
ggcagcaaaaaccagcguc

SEQ ID NO: 1314154 - RNA, 12 nt, Mycobacterium tuberculosis H37Rv
ggcagcaacagg

SEQ ID NO: 1314155 - RNA, 22 nt, Mycobacterium tuberculosis H37Rv
ggcagauuggaagacgccggcg

SEQ ID NO: 1314156 - RNA, 14 nt, Mycobacterium tuberculosis H37Rv
ggcagauggucucg

SEQ ID NO: 1314157 - RNA, 18 nt, Mycobacterium tuberculosis H37Rv
ggcagaugaauugccggg

SEQ ID NO: 1314158 - RNA, 12 nt, Mycobacterium tuberculosis H37Rv
ggcacucccgga

SEQ ID NO: 1314159 - RNA, 13 nt, Mycobacterium tuberculosis H37Rv
ggcacugcccagc

SEQ ID NO: 1314160 - RNA, 17 nt, Mycobacterium tuberculosis H37Rv
ggcacugcccagcagac

SEQ ID NO: 1314161 - RNA, 17 nt, Mycobacterium tuberculosis H37Rv
ggcacuaacggcguguc

SEQ ID NO: 1314162 - RNA, 16 nt, Mycobacterium tuberculosis H37Rv
ggcacuccagcggcgg

SEQ ID NO: 1314163 - RNA, 20 nt, Mycobacterium tuberculosis H37Rv
ggcacuacgcagccguagcu

SEQ ID NO: 1314164 - RNA, 13 nt, Mycobacterium tuberculosis H37Rv
ggcagagccgccg

SEQ ID NO: 1314165 - RNA, 22 nt, Mycobacterium tuberculosis H37Rv
ggcagacacgcugcaggcggcc

SEQ ID NO: 1314166 - RNA, 18 nt, Mycobacterium tuberculosis H37Rv
ggcagacacgcugcaggc

SEQ ID NO: 1314167 - RNA, 12 nt, Mycobacterium tuberculosis H37Rv
ggcagacacgcu

SEQ ID NO: 1314168 - RNA, 14 nt, Mycobacterium tuberculosis H37Rv
ggcagacccgagcg

SEQ ID NO: 1314169 - RNA, 23 nt, Mycobacterium tuberculosis H37Rv
ggcagcaucuccgucggccaggc

SEQ ID NO: 1314170 - RNA, 13 nt, Mycobacterium tuberculosis H37Rv
ggcagcauauccg

SEQ ID NO: 1314171 - RNA, 18 nt, Mycobacterium tuberculosis H37Rv
ggcagcaggacaccuacc

SEQ ID NO: 1314172 - RNA, 21 nt, Mycobacterium tuberculosis H37Rv
ggcagcagcggugcagcccgc

SEQ ID NO: 1314173 - RNA, 23 nt, Mycobacterium tuberculosis H37Rv
ggcagcagcggugcagcccgccg

SEQ ID NO: 1314174 - RNA, 19 nt, Mycobacterium tuberculosis H37Rv
ggcagcagcggugcagccc

SEQ ID NO: 1314175 - RNA, 16 nt, Mycobacterium tuberculosis H37Rv
ggcagcagcgggcgcg

SEQ ID NO: 1314176 - RNA, 12 nt, Mycobacterium tuberculosis H37Rv
ggcagcagcggu

SEQ ID NO: 1314177 - RNA, 15 nt, Mycobacterium tuberculosis H37Rv
ggcagcacaggcugg

SEQ ID NO: 1314178 - RNA, 21 nt, Mycobacterium tuberculosis H37Rv
ggcagcagcgcaacggccagc

SEQ ID NO: 1314179 - RNA, 17 nt, Mycobacterium tuberculosis H37Rv
ggcagcagccggcgggc

SEQ ID NO: 1314180 - RNA, 18 nt, Mycobacterium tuberculosis H37Rv
ggcagcagcagagccaac

SEQ ID NO: 1314181 - RNA, 13 nt, Mycobacterium tuberculosis H37Rv
ggcagccaccagc

SEQ ID NO: 1314182 - RNA, 16 nt, Mycobacterium tuberculosis H37Rv
ggcagccaagcgagcg

SEQ ID NO: 1314183 - RNA, 15 nt, Mycobacterium tuberculosis H37Rv
ggcagccagcggcga

SEQ ID NO: 1314184 - RNA, 13 nt, Mycobacterium tuberculosis H37Rv
ggcagcccgcugg

SEQ ID NO: 1314185 - RNA, 16 nt, Mycobacterium tuberculosis H37Rv
ggcagcccgcuggccu

SEQ ID NO: 1314186 - RNA, 21 nt, Mycobacterium tuberculosis H37Rv
ggcagcccgcuggccuccugg

SEQ ID NO: 1314187 - RNA, 14 nt, Mycobacterium tuberculosis H37Rv
ggcagccccuccgc

SEQ ID NO: 1314188 - RNA, 16 nt, Mycobacterium tuberculosis H37Rv
ggcagccgcccgccag

SEQ ID NO: 1314189 - RNA, 19 nt, Mycobacterium tuberculosis H37Rv
ggcagccgcccgcccaccu

SEQ ID NO: 1314190 - RNA, 14 nt, Mycobacterium tuberculosis H37Rv
ggcagccgcgccgc

SEQ ID NO: 1314191 - RNA, 19 nt, Mycobacterium tuberculosis H37Rv
ggcagccgcgccgcggccc

SEQ ID NO: 1314192 - RNA, 13 nt, Mycobacterium tuberculosis H37Rv
ggcaggaucgccu

SEQ ID NO: 1314193 - RNA, 12 nt, Mycobacterium tuberculosis H37Rv
ggcaggagcagc

SEQ ID NO: 1314194 - RNA, 18 nt, Mycobacterium tuberculosis H37Rv
ggcaggccccacuggugc

SEQ ID NO: 1314195 - RNA, 19 nt, Mycobacterium tuberculosis H37Rv
ggcaggccggcgucgauca

SEQ ID NO: 1314196 - RNA, 12 nt, Mycobacterium tuberculosis H37Rv
ggcaggccggcg

SEQ ID NO: 1314197 - RNA, 17 nt, Mycobacterium tuberculosis H37Rv
ggcaggccucggcgccg

SEQ ID NO: 1314198 - RNA, 12 nt, Mycobacterium tuberculosis H37Rv
ggcaggccgggc

SEQ ID NO: 1314199 - RNA, 19 nt, Mycobacterium tuberculosis H37Rv
ggcaggcccgacggcgccc

SEQ ID NO: 1314200 - RNA, 15 nt, Mycobacterium tuberculosis H37Rv
ggcaggccggcgucg

SEQ ID NO: 1314201 - RNA, 14 nt, Mycobacterium tuberculosis H37Rv
ggcaggccgcuggg

SEQ ID NO: 1314202 - RNA, 21 nt, Mycobacterium tuberculosis H37Rv
ggcagcuggggcccggccgcc

SEQ ID NO: 1314203 - RNA, 20 nt, Mycobacterium tuberculosis H37Rv
ggcagcugguaaccggcggc

SEQ ID NO: 1314204 - RNA, 15 nt, Mycobacterium tuberculosis H37Rv
ggcagcuucucgccg

SEQ ID NO: 1314205 - RNA, 23 nt, Mycobacterium tuberculosis H37Rv
ggcagcuugcagugccgccggcc

SEQ ID NO: 1314206 - RNA, 19 nt, Mycobacterium tuberculosis H37Rv
ggcaggaaucgggucagca

SEQ ID NO: 1314207 - RNA, 19 nt, Mycobacterium tuberculosis H37Rv
ggcagccggguugguaccc

SEQ ID NO: 1314208 - RNA, 16 nt, Mycobacterium tuberculosis H37Rv
ggcagccugcugcaca

SEQ ID NO: 1314209 - RNA, 18 nt, Mycobacterium tuberculosis H37Rv
ggcagcgaccgucgucca

SEQ ID NO: 1314210 - RNA, 16 nt, Mycobacterium tuberculosis H37Rv
ggcagcgaccgucguc

SEQ ID NO: 1314211 - RNA, 12 nt, Mycobacterium tuberculosis H37Rv
ggcagcgcggca

SEQ ID NO: 1314212 - RNA, 12 nt, Mycobacterium tuberculosis H37Rv
ggcagcgcggcc

SEQ ID NO: 1314213 - RNA, 16 nt, Mycobacterium tuberculosis H37Rv
ggcagcgcgcccgaca

SEQ ID NO: 1314214 - RNA, 14 nt, Mycobacterium tuberculosis H37Rv
ggcagcgcgaucga

SEQ ID NO: 1314215 - RNA, 22 nt, Mycobacterium tuberculosis H37Rv
ggcagcgcacccggucggcggc

SEQ ID NO: 1314216 - RNA, 14 nt, Mycobacterium tuberculosis H37Rv
ggcagcguguaacc

SEQ ID NO: 1314217 - RNA, 22 nt, Mycobacterium tuberculosis H37Rv
ggcagcgguuuuaggcagccca

SEQ ID NO: 1314218 - RNA, 14 nt, Mycobacterium tuberculosis H37Rv
ggcagcgguggcaa

SEQ ID NO: 1314219 - RNA, 13 nt, Mycobacterium tuberculosis H37Rv
ggcagcgguggcc

SEQ ID NO: 1314220 - RNA, 20 nt, Mycobacterium tuberculosis H37Rv
ggcagcgguggcccgccggc

SEQ ID NO: 1314221 - RNA, 14 nt, Mycobacterium tuberculosis H37Rv
ggcagcgguggcuu

SEQ ID NO: 1314222 - RNA, 20 nt, Mycobacterium tuberculosis H37Rv
ggcagcggcgcgcugcacgg

SEQ ID NO: 1314223 - RNA, 15 nt, Mycobacterium tuberculosis H37Rv
ggcagcgcggauguc

SEQ ID NO: 1314224 - RNA, 15 nt, Mycobacterium tuberculosis H37Rv
ggcagcgcggccacc

SEQ ID NO: 1314225 - RNA, 15 nt, Mycobacterium tuberculosis H37Rv
ggcagcgcggccagu

SEQ ID NO: 1314226 - RNA, 20 nt, Mycobacterium tuberculosis H37Rv
ggcagcggaccgcugccugc

SEQ ID NO: 1314227 - RNA, 15 nt, Mycobacterium tuberculosis H37Rv
ggcauggucaggcgg

SEQ ID NO: 1314228 - RNA, 14 nt, Mycobacterium tuberculosis H37Rv
ggcauggucgccgg

SEQ ID NO: 1314229 - RNA, 13 nt, Mycobacterium tuberculosis H37Rv
ggcaugguggugg

SEQ ID NO: 1314230 - RNA, 14 nt, Mycobacterium tuberculosis H37Rv
ggcauggugguggc

SEQ ID NO: 1314231 - RNA, 22 nt, Mycobacterium tuberculosis H37Rv
ggcaugggcccugcacagcagc

SEQ ID NO: 1314232 - RNA, 16 nt, Mycobacterium tuberculosis H37Rv
ggcauggccuggguug

SEQ ID NO: 1314233 - RNA, 16 nt, Mycobacterium tuberculosis H37Rv
ggcaugcucuggcaau

SEQ ID NO: 1314234 - RNA, 21 nt, Mycobacterium tuberculosis H37Rv
ggcaucgucgccauaccugcc

SEQ ID NO: 1314235 - RNA, 14 nt, Mycobacterium tuberculosis H37Rv
ggcaugccgcccgc

SEQ ID NO: 1314236 - RNA, 15 nt, Mycobacterium tuberculosis H37Rv
ggcaugcgugccggc

SEQ ID NO: 1314237 - RNA, 23 nt, Mycobacterium tuberculosis H37Rv
ggcaugcggaucggaucaucggg

SEQ ID NO: 1314238 - RNA, 15 nt, Mycobacterium tuberculosis H37Rv
ggcaucgaggccagc

SEQ ID NO: 1314239 - RNA, 16 nt, Mycobacterium tuberculosis H37Rv
ggcaucgaggccagca

SEQ ID NO: 1314240 - RNA, 17 nt, Mycobacterium tuberculosis H37Rv
ggcaucgcgcgcggcuc

SEQ ID NO: 1314241 - RNA, 17 nt, Mycobacterium tuberculosis H37Rv
ggcaucgcgggcggcgc

SEQ ID NO: 1314242 - RNA, 14 nt, Mycobacterium tuberculosis H37Rv
ggcaucggccagcc

SEQ ID NO: 1314243 - RNA, 17 nt, Mycobacterium tuberculosis H37Rv
ggcaugcagccccacuu

SEQ ID NO: 1314244 - RNA, 19 nt, Mycobacterium tuberculosis H37Rv
ggcaucgccgcgggugauc

SEQ ID NO: 1314245 - RNA, 14 nt, Mycobacterium tuberculosis H37Rv
ggcaucggccaucu

SEQ ID NO: 1314246 - RNA, 22 nt, Mycobacterium tuberculosis H37Rv
ggcaucggagauacgggccacc

SEQ ID NO: 1314247 - RNA, 11 nt, Mycobacterium tuberculosis H37Rv
ggcaucggcca

SEQ ID NO: 1314248 - RNA, 14 nt, Mycobacterium tuberculosis H37Rv
ggcaucggcggccu

SEQ ID NO: 1314249 - RNA, 18 nt, Mycobacterium tuberculosis H37Rv
ggcauagccgaacagcgg

SEQ ID NO: 1314250 - RNA, 19 nt, Mycobacterium tuberculosis H37Rv
ggcagugaaauugccgccg

SEQ ID NO: 1314251 - RNA, 13 nt, Mycobacterium tuberculosis H37Rv
ggcauacauccag

SEQ ID NO: 1314252 - RNA, 14 nt, Mycobacterium tuberculosis H37Rv
ggcaguccagccgg

SEQ ID NO: 1314253 - RNA, 18 nt, Mycobacterium tuberculosis H37Rv
ggcaguccagccgggugc

SEQ ID NO: 1314254 - RNA, 14 nt, Mycobacterium tuberculosis H37Rv
ggcagucccagcgc

SEQ ID NO: 1314255 - RNA, 21 nt, Mycobacterium tuberculosis H37Rv
ggcaguagcuguggcccgcgg

SEQ ID NO: 1314256 - RNA, 14 nt, Mycobacterium tuberculosis H37Rv
ggcaggcggccgcc

SEQ ID NO: 1314257 - RNA, 16 nt, Mycobacterium tuberculosis H37Rv
ggcaggcggccgccgg

SEQ ID NO: 1314258 - RNA, 18 nt, Mycobacterium tuberculosis H37Rv
gcgccggggacacagcgu

SEQ ID NO: 1314259 - RNA, 20 nt, Mycobacterium tuberculosis H37Rv
gcgccggggacacagcgucc

SEQ ID NO: 1314260 - RNA, 15 nt, Mycobacterium tuberculosis H37Rv
gcgccgggcucggcg

SEQ ID NO: 1314261 - RNA, 23 nt, Mycobacterium tuberculosis H37Rv
gcgccggagccgcccaagccgcc

SEQ ID NO: 1314262 - RNA, 19 nt, Mycobacterium tuberculosis H37Rv
gcgccggagccgcccaagc

SEQ ID NO: 1314263 - RNA, 13 nt, Mycobacterium tuberculosis H37Rv
gcgccggcggcca

SEQ ID NO: 1314264 - RNA, 12 nt, Mycobacterium tuberculosis H37Rv
gcgccggcggca

SEQ ID NO: 1314265 - RNA, 22 nt, Mycobacterium tuberculosis H37Rv
gcgccggcgguagucggccagc

SEQ ID NO: 1314266 - RNA, 16 nt, Mycobacterium tuberculosis H37Rv
gcgccggcuucgggug

SEQ ID NO: 1314267 - RNA, 16 nt, Mycobacterium tuberculosis H37Rv
gcgccggcuagggccc

SEQ ID NO: 1314268 - RNA, 21 nt, Mycobacterium tuberculosis H37Rv
gcgccggcgucggcgcccagc

SEQ ID NO: 1314269 - RNA, 18 nt, Mycobacterium tuberculosis H37Rv
gcgccggcgugcaugagc

SEQ ID NO: 1314270 - RNA, 21 nt, Mycobacterium tuberculosis H37Rv
gcgccgcugacuccugcggca

SEQ ID NO: 1314271 - RNA, 13 nt, Mycobacterium tuberculosis H37Rv
gcgccgcgcggcu

SEQ ID NO: 1314272 - RNA, 15 nt, Mycobacterium tuberculosis H37Rv
gcgccgcgccguccc

SEQ ID NO: 1314273 - RNA, 13 nt, Mycobacterium tuberculosis H37Rv
gcgccgcgcgcgc

SEQ ID NO: 1314274 - RNA, 16 nt, Mycobacterium tuberculosis H37Rv
gcgccgcgccgcgccg

SEQ ID NO: 1314275 - RNA, 17 nt, Mycobacterium tuberculosis H37Rv
gcgccgcgccgcgccgc

SEQ ID NO: 1314276 - RNA, 17 nt, Mycobacterium tuberculosis H37Rv
gcgccggaccagcuccu

SEQ ID NO: 1314277 - RNA, 16 nt, Mycobacterium tuberculosis H37Rv
gcgccggaccagcucc

SEQ ID NO: 1314278 - RNA, 17 nt, Mycobacterium tuberculosis H37Rv
gcgccggaccgucuuug

SEQ ID NO: 1314279 - RNA, 19 nt, Mycobacterium tuberculosis H37Rv
gcgccggacaaaccgggcg

SEQ ID NO: 1314280 - RNA, 17 nt, Mycobacterium tuberculosis H37Rv
gcgccggaacgagcggc

SEQ ID NO: 1314281 - RNA, 20 nt, Mycobacterium tuberculosis H37Rv
gcgccggaacgagcggccgc

SEQ ID NO: 1314282 - RNA, 21 nt, Mycobacterium tuberculosis H37Rv
gcgccgcugggugaccaggaa

SEQ ID NO: 1314283 - RNA, 18 nt, Mycobacterium tuberculosis H37Rv
gcgccgcugacuccugcg

SEQ ID NO: 1314284 - RNA, 15 nt, Mycobacterium tuberculosis H37Rv
gcgcccagaucgccg

SEQ ID NO: 1314285 - RNA, 13 nt, Mycobacterium tuberculosis H37Rv
gcgcccagccgga

SEQ ID NO: 1314286 - RNA, 14 nt, Mycobacterium tuberculosis H37Rv
gcgcccaccccggc

SEQ ID NO: 1314287 - RNA, 24 nt, Mycobacterium tuberculosis H37Rv
gcgcccacaucgucggcgggcggc

SEQ ID NO: 1314288 - RNA, 16 nt, Mycobacterium tuberculosis H37Rv
gcgcccaccgggcggc

SEQ ID NO: 1314289 - RNA, 23 nt, Mycobacterium tuberculosis H37Rv
gcgccgcccuugccgccggcccc

SEQ ID NO: 1314290 - RNA, 13 nt, Mycobacterium tuberculosis H37Rv
gcgccgccgaucc

SEQ ID NO: 1314291 - RNA, 12 nt, Mycobacterium tuberculosis H37Rv
gcgccgccgacc

SEQ ID NO: 1314292 - RNA, 14 nt, Mycobacterium tuberculosis H37Rv
gcgcccagcgccuc

SEQ ID NO: 1314293 - RNA, 13 nt, Mycobacterium tuberculosis H37Rv
gcgcccaggaacu

SEQ ID NO: 1314294 - RNA, 16 nt, Mycobacterium tuberculosis H37Rv
gcgccgcgcagcgagg

SEQ ID NO: 1314295 - RNA, 13 nt, Mycobacterium tuberculosis H37Rv
gcgccgcgcccac

SEQ ID NO: 1314296 - RNA, 18 nt, Mycobacterium tuberculosis H37Rv
gcgccgccucgggcaccu

SEQ ID NO: 1314297 - RNA, 16 nt, Mycobacterium tuberculosis H37Rv
gcgccgcgaggcaccg

SEQ ID NO: 1314298 - RNA, 17 nt, Mycobacterium tuberculosis H37Rv
gcgccgccguccagcgc

SEQ ID NO: 1314299 - RNA, 19 nt, Mycobacterium tuberculosis H37Rv
gcgccgccguuaccgccgg

SEQ ID NO: 1314300 - RNA, 21 nt, Mycobacterium tuberculosis H37Rv
gcgccgccguuaccgccggcg

SEQ ID NO: 1314301 - RNA, 19 nt, Mycobacterium tuberculosis H37Rv
gcgccgccggcaccgccgg

SEQ ID NO: 1314302 - RNA, 16 nt, Mycobacterium tuberculosis H37Rv
gcgccgccggcaccuc

SEQ ID NO: 1314303 - RNA, 17 nt, Mycobacterium tuberculosis H37Rv
gcgccgccggcaccucc

SEQ ID NO: 1314304 - RNA, 22 nt, Mycobacterium tuberculosis H37Rv
gcgccgccggcaccucccuggc

SEQ ID NO: 1314305 - RNA, 20 nt, Mycobacterium tuberculosis H37Rv
gcgccgccggcgccgcccgc

SEQ ID NO: 1314306 - RNA, 15 nt, Mycobacterium tuberculosis H37Rv
gcgccgccggcggcg

SEQ ID NO: 1314307 - RNA, 19 nt, Mycobacterium tuberculosis H37Rv
gcgccgccgaucccgucgg

SEQ ID NO: 1314308 - RNA, 10 nt, Mycobacterium tuberculosis H37Rv
gcgccgccgc

SEQ ID NO: 1314309 - RNA, 20 nt, Mycobacterium tuberculosis H37Rv
gcgccgccgcgagcgccggc

SEQ ID NO: 1314310 - RNA, 20 nt, Mycobacterium tuberculosis H37Rv
gcgccgccggaagcgccggc

SEQ ID NO: 1314311 - RNA, 22 nt, Mycobacterium tuberculosis H37Rv
gcgccgccggaagcgccggccg

SEQ ID NO: 1314312 - RNA, 15 nt, Mycobacterium tuberculosis H37Rv
gcgccgccggcaccg

SEQ ID NO: 1314313 - RNA, 19 nt, Mycobacterium tuberculosis H37Rv
gcgccugaauaggucgguc

SEQ ID NO: 1314314 - RNA, 17 nt, Mycobacterium tuberculosis H37Rv
gcgccucggcggccagc

SEQ ID NO: 1314315 - RNA, 20 nt, Mycobacterium tuberculosis H37Rv
gcgccucggugagcugcacg

SEQ ID NO: 1314316 - RNA, 11 nt, Mycobacterium tuberculosis H37Rv
gcgccugagcg

SEQ ID NO: 1314317 - RNA, 15 nt, Mycobacterium tuberculosis H37Rv
gcgccugagcggccu

SEQ ID NO: 1314318 - RNA, 14 nt, Mycobacterium tuberculosis H37Rv
gcgccugacucauc

SEQ ID NO: 1314319 - RNA, 19 nt, Mycobacterium tuberculosis H37Rv
gcgccugauaggccugagc

SEQ ID NO: 1314320 - RNA, 18 nt, Mycobacterium tuberculosis H37Rv
gcgccugaugcggccggc

SEQ ID NO: 1314321 - RNA, 20 nt, Mycobacterium tuberculosis H37Rv
gcgccugaugcggccggcgc

SEQ ID NO: 1314322 - RNA, 15 nt, Mycobacterium tuberculosis H37Rv
gcgccucgcccagca

SEQ ID NO: 1314323 - RNA, 19 nt, Mycobacterium tuberculosis H37Rv
gcgccuccguugcccccau

SEQ ID NO: 1314324 - RNA, 20 nt, Mycobacterium tuberculosis H37Rv
gcgccuccagcaccacggcg

SEQ ID NO: 1314325 - RNA, 14 nt, Mycobacterium tuberculosis H37Rv
gcgccggucagggc

SEQ ID NO: 1314326 - RNA, 17 nt, Mycobacterium tuberculosis H37Rv
gcgccucauccuccagu

SEQ ID NO: 1314327 - RNA, 19 nt, Mycobacterium tuberculosis H37Rv
gcgccggggggcugcugcu

SEQ ID NO: 1314328 - RNA, 20 nt, Mycobacterium tuberculosis H37Rv
gcgccggggggcugcugcuc

SEQ ID NO: 1314329 - RNA, 17 nt, Mycobacterium tuberculosis H37Rv
gcgccggggggcugcug

SEQ ID NO: 1314330 - RNA, 16 nt, Mycobacterium tuberculosis H37Rv
gcgccgggggcgccgc

SEQ ID NO: 1314331 - RNA, 23 nt, Mycobacterium tuberculosis H37Rv
gcgccggucagcaauacggcggc

SEQ ID NO: 1314332 - RNA, 16 nt, Mycobacterium tuberculosis H37Rv
gcgccuuggucgccgg

SEQ ID NO: 1314333 - RNA, 17 nt, Mycobacterium tuberculosis H37Rv
gcgccuuggucgccggc

SEQ ID NO: 1314334 - RNA, 15 nt, Mycobacterium tuberculosis H37Rv
gcgccuuggucgccg

SEQ ID NO: 1314335 - RNA, 18 nt, Mycobacterium tuberculosis H37Rv
gcgccuuggucgccgccu

SEQ ID NO: 1314336 - RNA, 18 nt, Mycobacterium tuberculosis H37Rv
gcgccuuggucgccgcuu

SEQ ID NO: 1314337 - RNA, 14 nt, Mycobacterium tuberculosis H37Rv
gcgccuucgccagc

SEQ ID NO: 1314338 - RNA, 17 nt, Mycobacterium tuberculosis H37Rv
gcgccugugcgcaaggc

SEQ ID NO: 1314339 - RNA, 14 nt, Mycobacterium tuberculosis H37Rv
gcgccugcugcggc

SEQ ID NO: 1314340 - RNA, 22 nt, Mycobacterium tuberculosis H37Rv
gcgccuuccaggcgggcggcac

SEQ ID NO: 1314341 - RNA, 18 nt, Mycobacterium tuberculosis H37Rv
gcgccuucaccuggugug

SEQ ID NO: 1314342 - RNA, 20 nt, Mycobacterium tuberculosis H37Rv
gcgccuggcuggccagcugc

SEQ ID NO: 1314343 - RNA, 16 nt, Mycobacterium tuberculosis H37Rv
gcgccuggcggcgccg

SEQ ID NO: 1314344 - RNA, 21 nt, Mycobacterium tuberculosis H37Rv
gcgccugguccucacgggucg

SEQ ID NO: 1314345 - RNA, 13 nt, Mycobacterium tuberculosis H37Rv
gcgccugcccggg

SEQ ID NO: 1314346 - RNA, 15 nt, Mycobacterium tuberculosis H37Rv
gcgcggcggcggagg

SEQ ID NO: 1314347 - RNA, 17 nt, Mycobacterium tuberculosis H37Rv
gcgcggccuuggugggc

SEQ ID NO: 1314348 - RNA, 17 nt, Mycobacterium tuberculosis H37Rv
gcgcggcggagugcaug

SEQ ID NO: 1314349 - RNA, 12 nt, Mycobacterium tuberculosis H37Rv
gcgcggcugccg

SEQ ID NO: 1314350 - RNA, 15 nt, Mycobacterium tuberculosis H37Rv
gcgcggcuggggccc

SEQ ID NO: 1314351 - RNA, 22 nt, Mycobacterium tuberculosis H37Rv
gcgcggcuggggccccgcgccg

SEQ ID NO: 1314352 - RNA, 14 nt, Mycobacterium tuberculosis H37Rv
gcgcgggggugggc

SEQ ID NO: 1314353 - RNA, 15 nt, Mycobacterium tuberculosis H37Rv
gcgcggggugcgcgc

SEQ ID NO: 1314354 - RNA, 19 nt, Mycobacterium tuberculosis H37Rv
gcgcggggugcgcgcgacc

SEQ ID NO: 1314355 - RNA, 13 nt, Mycobacterium tuberculosis H37Rv
gcgcggggcggcu

SEQ ID NO: 1314356 - RNA, 16 nt, Mycobacterium tuberculosis H37Rv
gcgcggggcggcugcg

SEQ ID NO: 1314357 - RNA, 23 nt, Mycobacterium tuberculosis H37Rv
gcgcggggcggcugcgggcccgg

SEQ ID NO: 1314358 - RNA, 16 nt, Mycobacterium tuberculosis H37Rv
gcgcgggguggcggcg

SEQ ID NO: 1314359 - RNA, 18 nt, Mycobacterium tuberculosis H37Rv
gcgcgggguggcggcgcu

SEQ ID NO: 1314360 - RNA, 17 nt, Mycobacterium tuberculosis H37Rv
gcgcgguaccgguguca

SEQ ID NO: 1314361 - RNA, 18 nt, Mycobacterium tuberculosis H37Rv
gcgcgguacugcgcagcg

SEQ ID NO: 1314362 - RNA, 16 nt, Mycobacterium tuberculosis H37Rv
gcgcggguccagccac

SEQ ID NO: 1314363 - RNA, 18 nt, Mycobacterium tuberculosis H37Rv
gcgcggguggcagcggcg

SEQ ID NO: 1314364 - RNA, 14 nt, Mycobacterium tuberculosis H37Rv
gcgcggugccggcg

SEQ ID NO: 1314365 - RNA, 18 nt, Mycobacterium tuberculosis H37Rv
gcgcggugcccugccggc

SEQ ID NO: 1314366 - RNA, 15 nt, Mycobacterium tuberculosis H37Rv
gcgcggugccggccg

SEQ ID NO: 1314367 - RNA, 20 nt, Mycobacterium tuberculosis H37Rv
gcgcggucggagucgagcac

SEQ ID NO: 1314368 - RNA, 15 nt, Mycobacterium tuberculosis H37Rv
gcgcggucgaccuga

SEQ ID NO: 1314369 - RNA, 20 nt, Mycobacterium tuberculosis H37Rv
gcgcgcggcgacgacggccu

SEQ ID NO: 1314370 - RNA, 13 nt, Mycobacterium tuberculosis H37Rv
gcgcgcggccgcg

SEQ ID NO: 1314371 - RNA, 21 nt, Mycobacterium tuberculosis H37Rv
gcgcgcggccgcgcugcagca

SEQ ID NO: 1314372 - RNA, 19 nt, Mycobacterium tuberculosis H37Rv
gcgcgcggcgaccauaagc

SEQ ID NO: 1314373 - RNA, 22 nt, Mycobacterium tuberculosis H37Rv
gcgcgcucgcucaccggcuggu

SEQ ID NO: 1314374 - RNA, 13 nt, Mycobacterium tuberculosis H37Rv
gcgcgcucgcggc

SEQ ID NO: 1314375 - RNA, 22 nt, Mycobacterium tuberculosis H37Rv
gcgcgcucaucgaccgcggccg

SEQ ID NO: 1314376 - RNA, 16 nt, Mycobacterium tuberculosis H37Rv
gcgcgcguagcggggg

SEQ ID NO: 1314377 - RNA, 17 nt, Mycobacterium tuberculosis H37Rv
gcgcgcgggguggcggc

SEQ ID NO: 1314378 - RNA, 14 nt, Mycobacterium tuberculosis H37Rv
gcgcggccgcgcug

SEQ ID NO: 1314379 - RNA, 14 nt, Mycobacterium tuberculosis H37Rv
gcgcggccgcagcc

SEQ ID NO: 1314380 - RNA, 11 nt, Mycobacterium tuberculosis H37Rv
gcgcggccgcc

SEQ ID NO: 1314381 - RNA, 12 nt, Mycobacterium tuberculosis H37Rv
gcgcggcccgcc

SEQ ID NO: 1314382 - RNA, 15 nt, Mycobacterium tuberculosis H37Rv
gcgcgcucggccggg

SEQ ID NO: 1314383 - RNA, 16 nt, Mycobacterium tuberculosis H37Rv
gcgcgcucggccgggg

SEQ ID NO: 1314384 - RNA, 19 nt, Mycobacterium tuberculosis H37Rv
gcgcgcucgaggguggcgc

SEQ ID NO: 1314385 - RNA, 15 nt, Mycobacterium tuberculosis H37Rv
gcgcgcucgggccca

SEQ ID NO: 1314386 - RNA, 17 nt, Mycobacterium tuberculosis H37Rv
gcgcgcucgggcccagc

SEQ ID NO: 1314387 - RNA, 18 nt, Mycobacterium tuberculosis H37Rv
gcgcgccuaugggccugc

SEQ ID NO: 1314388 - RNA, 20 nt, Mycobacterium tuberculosis H37Rv
gcgcgcgaccucgcuggccg

SEQ ID NO: 1314389 - RNA, 15 nt, Mycobacterium tuberculosis H37Rv
gcgcgcgccgcagcg

SEQ ID NO: 1314390 - RNA, 13 nt, Mycobacterium tuberculosis H37Rv
gcgcgcgcgccgg

SEQ ID NO: 1314391 - RNA, 14 nt, Mycobacterium tuberculosis H37Rv
gcgcgcgcgccggc

SEQ ID NO: 1314392 - RNA, 23 nt, Mycobacterium tuberculosis H37Rv
gcgcgcggagucaagcagcagca

SEQ ID NO: 1314393 - RNA, 21 nt, Mycobacterium tuberculosis H37Rv
gcgcgccguagaccagcaggc

SEQ ID NO: 1314394 - RNA, 12 nt, Mycobacterium tuberculosis H37Rv
gcgcgccgaccg

SEQ ID NO: 1314395 - RNA, 13 nt, Mycobacterium tuberculosis H37Rv
gcgcgcccgggcg

SEQ ID NO: 1314396 - RNA, 12 nt, Mycobacterium tuberculosis H37Rv
gcgcgccguuca

SEQ ID NO: 1314397 - RNA, 14 nt, Mycobacterium tuberculosis H37Rv
gcgcgccccaccgc

SEQ ID NO: 1314398 - RNA, 21 nt, Mycobacterium tuberculosis H37Rv
gcgcgcccaccgggcggcggc

SEQ ID NO: 1314399 - RNA, 14 nt, Mycobacterium tuberculosis H37Rv
gcgccuuugagccc

SEQ ID NO: 1314400 - RNA, 21 nt, Mycobacterium tuberculosis H37Rv
gcgcgaugggagcccggcggc

SEQ ID NO: 1314401 - RNA, 16 nt, Mycobacterium tuberculosis H37Rv
gcgcgauggcgcgugg

SEQ ID NO: 1314402 - RNA, 17 nt, Mycobacterium tuberculosis H37Rv
gcgcgaucuccuccacc

SEQ ID NO: 1314403 - RNA, 21 nt, Mycobacterium tuberculosis H37Rv
gcgcgaucugcucgccccaug

SEQ ID NO: 1314404 - RNA, 22 nt, Mycobacterium tuberculosis H37Rv
gcgcgcaccggguugagccgcc

SEQ ID NO: 1314405 - RNA, 15 nt, Mycobacterium tuberculosis H37Rv
gcgcgcagccgggca

SEQ ID NO: 1314406 - RNA, 18 nt, Mycobacterium tuberculosis H37Rv
gcgcgcagccgggcaccg

SEQ ID NO: 1314407 - RNA, 20 nt, Mycobacterium tuberculosis H37Rv
gcgcgcagaugagcgcggcg

SEQ ID NO: 1314408 - RNA, 15 nt, Mycobacterium tuberculosis H37Rv
gcgcgcacggcgucg

SEQ ID NO: 1314409 - RNA, 19 nt, Mycobacterium tuberculosis H37Rv
gcgcgccauuggcgguggu

SEQ ID NO: 1314410 - RNA, 20 nt, Mycobacterium tuberculosis H37Rv
gcgcgccauuggcgccgccg

SEQ ID NO: 1314411 - RNA, 16 nt, Mycobacterium tuberculosis H37Rv
gcgcgcccaccgggcg

SEQ ID NO: 1314412 - RNA, 20 nt, Mycobacterium tuberculosis H37Rv
gcgcgcccaccgggcggcgg

SEQ ID NO: 1314413 - RNA, 17 nt, Mycobacterium tuberculosis H37Rv
gcgcgcauagggcuggu

SEQ ID NO: 1314414 - RNA, 19 nt, Mycobacterium tuberculosis H37Rv
gcgcgcagccgggcaccga

SEQ ID NO: 1314415 - RNA, 19 nt, Mycobacterium tuberculosis H37Rv
gcgcugagcgacugcagcg

SEQ ID NO: 1314416 - RNA, 21 nt, Mycobacterium tuberculosis H37Rv
gcgcugagcgacugcagcggc

SEQ ID NO: 1314417 - RNA, 22 nt, Mycobacterium tuberculosis H37Rv
gcgcugagcgacugcagcggcg

SEQ ID NO: 1314418 - RNA, 13 nt, Mycobacterium tuberculosis H37Rv
gcgcugacccgcc

SEQ ID NO: 1314419 - RNA, 23 nt, Mycobacterium tuberculosis H37Rv
gcgcugcugaccugcaugggcag

SEQ ID NO: 1314420 - RNA, 22 nt, Mycobacterium tuberculosis H37Rv
gcgcugcucccgaaaagcgccu

SEQ ID NO: 1314421 - RNA, 15 nt, Mycobacterium tuberculosis H37Rv
gcgcuggcgccgccg

SEQ ID NO: 1314422 - RNA, 18 nt, Mycobacterium tuberculosis H37Rv
gcgcuggcgggcggcgug

SEQ ID NO: 1314423 - RNA, 15 nt, Mycobacterium tuberculosis H37Rv
gcgcuggcgggcagc

SEQ ID NO: 1314424 - RNA, 14 nt, Mycobacterium tuberculosis H37Rv
gcgcuggcgggcgg

SEQ ID NO: 1314425 - RNA, 16 nt, Mycobacterium tuberculosis H37Rv
gcgcuggcgccgccgg

SEQ ID NO: 1314426 - RNA, 18 nt, Mycobacterium tuberculosis H37Rv
gcgcuggaggccaccacc

SEQ ID NO: 1314427 - RNA, 17 nt, Mycobacterium tuberculosis H37Rv
gcgcuggaggccaccac

SEQ ID NO: 1314428 - RNA, 22 nt, Mycobacterium tuberculosis H37Rv
gcgcuggaucgagcuaguucgg

SEQ ID NO: 1314429 - RNA, 16 nt, Mycobacterium tuberculosis H37Rv
gcgcgguugggcagau

SEQ ID NO: 1314430 - RNA, 23 nt, Mycobacterium tuberculosis H37Rv
gcgcgguucgucggcgagcgcgg

SEQ ID NO: 1314431 - RNA, 18 nt, Mycobacterium tuberculosis H37Rv
gcgcgguuucggcgauga

SEQ ID NO: 1314432 - RNA, 16 nt, Mycobacterium tuberculosis H37Rv
gcgcgguggucagcac

SEQ ID NO: 1314433 - RNA, 18 nt, Mycobacterium tuberculosis H37Rv
gcgcgguguagagcgcac

SEQ ID NO: 1314434 - RNA, 14 nt, Mycobacterium tuberculosis H37Rv
gcgcgguugcuggu

SEQ ID NO: 1314435 - RNA, 16 nt, Mycobacterium tuberculosis H37Rv
gcgcguagcgggggag

SEQ ID NO: 1314436 - RNA, 20 nt, Mycobacterium tuberculosis H37Rv
gcgcguaucgcgucugggug

SEQ ID NO: 1314437 - RNA, 21 nt, Mycobacterium tuberculosis H37Rv
gcgcgucacauccgacagcag

SEQ ID NO: 1314438 - RNA, 19 nt, Mycobacterium tuberculosis H37Rv
gcgcgucagccgcaccccg

SEQ ID NO: 1314439 - RNA, 21 nt, Mycobacterium tuberculosis H37Rv
gcgcucgccgauaucugccac

SEQ ID NO: 1314440 - RNA, 18 nt, Mycobacterium tuberculosis H37Rv
gcgcucgcacccgcucgg

SEQ ID NO: 1314441 - RNA, 19 nt, Mycobacterium tuberculosis H37Rv
gcgcucgcacccgcucggc

SEQ ID NO: 1314442 - RNA, 13 nt, Mycobacterium tuberculosis H37Rv
gcgcucgcgcgcu

SEQ ID NO: 1314443 - RNA, 14 nt, Mycobacterium tuberculosis H37Rv
gcgcguccccagcg

SEQ ID NO: 1314444 - RNA, 21 nt, Mycobacterium tuberculosis H37Rv
gcgcucgauggcggccaccag

SEQ ID NO: 1314445 - RNA, 15 nt, Mycobacterium tuberculosis H37Rv
gcgcucggcagccgg

SEQ ID NO: 1314446 - RNA, 16 nt, Mycobacterium tuberculosis H37Rv
gcgcucggcagccggc

SEQ ID NO: 1314447 - RNA, 23 nt, Mycobacterium tuberculosis H37Rv
gcgcucgcucacgccguccggug

SEQ ID NO: 1314448 - RNA, 22 nt, Mycobacterium tuberculosis H37Rv
gcgcucgcggcuucaguccggc

SEQ ID NO: 1314449 - RNA, 16 nt, Mycobacterium tuberculosis H37Rv
gcgcucgcucaccggc

SEQ ID NO: 1314450 - RNA, 21 nt, Mycobacterium tuberculosis H37Rv
gcgcugggaggcggcgccagu

SEQ ID NO: 1314451 - RNA, 21 nt, Mycobacterium tuberculosis H37Rv
gcgcugggcccaggagaucca

SEQ ID NO: 1314452 - RNA, 20 nt, Mycobacterium tuberculosis H37Rv
gcgcuucacagccaccagcc

SEQ ID NO: 1314453 - RNA, 14 nt, Mycobacterium tuberculosis H37Rv
gcgcuucgccacac

SEQ ID NO: 1314454 - RNA, 21 nt, Mycobacterium tuberculosis H37Rv
gcgcuugcgaccccggcugcg

SEQ ID NO: 1314455 - RNA, 20 nt, Mycobacterium tuberculosis H37Rv
gcgcuugcgccgcccaugcc

SEQ ID NO: 1314456 - RNA, 17 nt, Mycobacterium tuberculosis H37Rv
gcgcuucgucggccggc

SEQ ID NO: 1314457 - RNA, 24 nt, Mycobacterium tuberculosis H37Rv
gcggaacaagguauagccggagcg

SEQ ID NO: 1314458 - RNA, 14 nt, Mycobacterium tuberculosis H37Rv
gcggaagaagugcu

SEQ ID NO: 1314459 - RNA, 18 nt, Mycobacterium tuberculosis H37Rv
gcggaacugggcccccaa

SEQ ID NO: 1314460 - RNA, 21 nt, Mycobacterium tuberculosis H37Rv
gcggaagcgguugacccacag

SEQ ID NO: 1314461 - RNA, 15 nt, Mycobacterium tuberculosis H37Rv
gcggaagcggcggcc

SEQ ID NO: 1314462 - RNA, 16 nt, Mycobacterium tuberculosis H37Rv
gcggaacaccagcagg

SEQ ID NO: 1314463 - RNA, 19 nt, Mycobacterium tuberculosis H37Rv
gcggaacgcgucgccgacg

SEQ ID NO: 1314464 - RNA, 16 nt, Mycobacterium tuberculosis H37Rv
gcggcaaagagcagcc

SEQ ID NO: 1314465 - RNA, 11 nt, Mycobacterium tuberculosis H37Rv
gcggauucggc

SEQ ID NO: 1314466 - RNA, 20 nt, Mycobacterium tuberculosis H37Rv
gcggauucggcgucgaagca

SEQ ID NO: 1314467 - RNA, 19 nt, Mycobacterium tuberculosis H37Rv
gcggcaagcucguccggug

SEQ ID NO: 1314468 - RNA, 11 nt, Mycobacterium tuberculosis H37Rv
gcggcaccaga

SEQ ID NO: 1314469 - RNA, 21 nt, Mycobacterium tuberculosis H37Rv
gcggcaauucgggcauggucg

SEQ ID NO: 1314470 - RNA, 22 nt, Mycobacterium tuberculosis H37Rv
gcggcacccaaccaggccgcga

SEQ ID NO: 1314471 - RNA, 14 nt, Mycobacterium tuberculosis H37Rv
gcggcaagggcuuc

SEQ ID NO: 1314472 - RNA, 19 nt, Mycobacterium tuberculosis H37Rv
gcggauuaagucggcggcc

SEQ ID NO: 1314473 - RNA, 22 nt, Mycobacterium tuberculosis H37Rv
gcggauguacacuuugcccgcc

SEQ ID NO: 1314474 - RNA, 20 nt, Mycobacterium tuberculosis H37Rv
gcggaugcaugucaaguucg

SEQ ID NO: 1314475 - RNA, 18 nt, Mycobacterium tuberculosis H37Rv
gcggaugcguuggcccca

SEQ ID NO: 1314476 - RNA, 22 nt, Mycobacterium tuberculosis H37Rv
gcggaucuggcuccggccaggg

SEQ ID NO: 1314477 - RNA, 12 nt, Mycobacterium tuberculosis H37Rv
gcggaucugggc

SEQ ID NO: 1314478 - RNA, 21 nt, Mycobacterium tuberculosis H37Rv
gcggaucucaccacccgucgg

SEQ ID NO: 1314479 - RNA, 23 nt, Mycobacterium tuberculosis H37Rv
gcggaucucaucgggccacagca

SEQ ID NO: 1314480 - RNA, 15 nt, Mycobacterium tuberculosis H37Rv
gcggaucguggcgcc

SEQ ID NO: 1314481 - RNA, 13 nt, Mycobacterium tuberculosis H37Rv
gcggaucuguucc

SEQ ID NO: 1314482 - RNA, 17 nt, Mycobacterium tuberculosis H37Rv
gcggaucugggcggccu

SEQ ID NO: 1314483 - RNA, 12 nt, Mycobacterium tuberculosis H37Rv
gcggaucugguc

SEQ ID NO: 1314484 - RNA, 17 nt, Mycobacterium tuberculosis H37Rv
gcggaugaaaucggcaa

SEQ ID NO: 1314485 - RNA, 15 nt, Mycobacterium tuberculosis H37Rv
gcggaucgcgcugcg

SEQ ID NO: 1314486 - RNA, 16 nt, Mycobacterium tuberculosis H37Rv
gcggaucgcgagcgcc

SEQ ID NO: 1314487 - RNA, 19 nt, Mycobacterium tuberculosis H37Rv
gcggaucgcgcugaucagc

SEQ ID NO: 1314488 - RNA, 21 nt, Mycobacterium tuberculosis H37Rv
gcggaucggcggaccgcagcg

SEQ ID NO: 1314489 - RNA, 17 nt, Mycobacterium tuberculosis H37Rv
gcggaucccgaggcgcc

SEQ ID NO: 1314490 - RNA, 18 nt, Mycobacterium tuberculosis H37Rv
gcggauccgggcguggug

SEQ ID NO: 1314491 - RNA, 19 nt, Mycobacterium tuberculosis H37Rv
gcggaccggcgucggcuga

SEQ ID NO: 1314492 - RNA, 16 nt, Mycobacterium tuberculosis H37Rv
gcggaccuggcggcgg

SEQ ID NO: 1314493 - RNA, 17 nt, Mycobacterium tuberculosis H37Rv
gcggaccuggcggcggu

SEQ ID NO: 1314494 - RNA, 18 nt, Mycobacterium tuberculosis H37Rv
gcggacccgcagcugcgg

SEQ ID NO: 1314495 - RNA, 19 nt, Mycobacterium tuberculosis H37Rv
gcggacccgcgcgucgccc

SEQ ID NO: 1314496 - RNA, 20 nt, Mycobacterium tuberculosis H37Rv
gcggacccgccgugaguagg

SEQ ID NO: 1314497 - RNA, 19 nt, Mycobacterium tuberculosis H37Rv
gcggacccuaacucccccg

SEQ ID NO: 1314498 - RNA, 20 nt, Mycobacterium tuberculosis H37Rv
gcggacccuaacucccccgc

SEQ ID NO: 1314499 - RNA, 24 nt, Mycobacterium tuberculosis H37Rv
gcggacccggugacccgcugggcc

SEQ ID NO: 1314500 - RNA, 21 nt, Mycobacterium tuberculosis H37Rv
gcggaccgaugacgaucggcg

SEQ ID NO: 1314501 - RNA, 14 nt, Mycobacterium tuberculosis H37Rv
gcggacccgcagcu

SEQ ID NO: 1314502 - RNA, 16 nt, Mycobacterium tuberculosis H37Rv
gcggaauggaggccgc

SEQ ID NO: 1314503 - RNA, 20 nt, Mycobacterium tuberculosis H37Rv
gcggaaucgucggcuagcuc

SEQ ID NO: 1314504 - RNA, 17 nt, Mycobacterium tuberculosis H37Rv
gcggaauuagucgccgc

SEQ ID NO: 1314505 - RNA, 14 nt, Mycobacterium tuberculosis H37Rv
gcggacaccgcggc

SEQ ID NO: 1314506 - RNA, 20 nt, Mycobacterium tuberculosis H37Rv
gcggacauccgggccgagcg

SEQ ID NO: 1314507 - RNA, 20 nt, Mycobacterium tuberculosis H37Rv
gcggacagcaucacgaucac

SEQ ID NO: 1314508 - RNA, 18 nt, Mycobacterium tuberculosis H37Rv
gcggacaccucgggcgcc

SEQ ID NO: 1314509 - RNA, 20 nt, Mycobacterium tuberculosis H37Rv
gcggacacgaucgcgucggc

SEQ ID NO: 1314510 - RNA, 16 nt, Mycobacterium tuberculosis H37Rv
gcggacguggucggag

SEQ ID NO: 1314511 - RNA, 19 nt, Mycobacterium tuberculosis H37Rv
gcggacgguguacaggucg

SEQ ID NO: 1314512 - RNA, 20 nt, Mycobacterium tuberculosis H37Rv
gcggacuugcgagccguaga

SEQ ID NO: 1314513 - RNA, 17 nt, Mycobacterium tuberculosis H37Rv
gcggacuggcauccgcc

SEQ ID NO: 1314514 - RNA, 22 nt, Mycobacterium tuberculosis H37Rv
gcggacuggcauccgccccgcc

SEQ ID NO: 1314515 - RNA, 21 nt, Mycobacterium tuberculosis H37Rv
gcggagccaggacgacgccga

SEQ ID NO: 1314516 - RNA, 23 nt, Mycobacterium tuberculosis H37Rv
gcggagccgccgacucggcaccg

SEQ ID NO: 1314517 - RNA, 17 nt, Mycobacterium tuberculosis H37Rv
gcggagccacucggccc

SEQ ID NO: 1314518 - RNA, 18 nt, Mycobacterium tuberculosis H37Rv
gcggagaaggcgcgggcg

SEQ ID NO: 1314519 - RNA, 18 nt, Mycobacterium tuberculosis H37Rv
gcggagaacgcgucgcgc

SEQ ID NO: 1314520 - RNA, 17 nt, Mycobacterium tuberculosis H37Rv
gcggagaacaucccccg

SEQ ID NO: 1314521 - RNA, 16 nt, Mycobacterium tuberculosis H37Rv
gcggaguaggccgcgc

SEQ ID NO: 1314522 - RNA, 18 nt, Mycobacterium tuberculosis H37Rv
gcggaguaggccgcgccc

SEQ ID NO: 1314523 - RNA, 17 nt, Mycobacterium tuberculosis H37Rv
gcggagucaagcagcag

SEQ ID NO: 1314524 - RNA, 17 nt, Mycobacterium tuberculosis H37Rv
gcggaguucgcugacgg

SEQ ID NO: 1314525 - RNA, 17 nt, Mycobacterium tuberculosis H37Rv
gcggauacuguucugcu

SEQ ID NO: 1314526 - RNA, 15 nt, Mycobacterium tuberculosis H37Rv
gcggauacagccgcc

SEQ ID NO: 1314527 - RNA, 16 nt, Mycobacterium tuberculosis H37Rv
gcggauaaccggcaug

SEQ ID NO: 1314528 - RNA, 13 nt, Mycobacterium tuberculosis H37Rv
gcgaagcaaguga

SEQ ID NO: 1314529 - RNA, 14 nt, Mycobacterium tuberculosis H37Rv
gcgaagagcccguu

SEQ ID NO: 1314530 - RNA, 15 nt, Mycobacterium tuberculosis H37Rv
gcgaacccccgccgc

SEQ ID NO: 1314531 - RNA, 13 nt, Mycobacterium tuberculosis H37Rv
gcgaacccgccga

SEQ ID NO: 1314532 - RNA, 12 nt, Mycobacterium tuberculosis H37Rv
gcgaaucacccg

SEQ ID NO: 1314533 - RNA, 12 nt, Mycobacterium tuberculosis H37Rv
gcgaagcgggcg

SEQ ID NO: 1314534 - RNA, 17 nt, Mycobacterium tuberculosis H37Rv
gcgaagcugaccagaca

SEQ ID NO: 1314535 - RNA, 18 nt, Mycobacterium tuberculosis H37Rv
gcgaagcugugcccggcg

SEQ ID NO: 1314536 - RNA, 21 nt, Mycobacterium tuberculosis H37Rv
gcgaagcugugcccggcgccc

SEQ ID NO: 1314537 - RNA, 20 nt, Mycobacterium tuberculosis H37Rv
gcgaagcccgacaugaggcu

SEQ ID NO: 1314538 - RNA, 15 nt, Mycobacterium tuberculosis H37Rv
gcgaagccggccggg

SEQ ID NO: 1314539 - RNA, 21 nt, Mycobacterium tuberculosis H37Rv
gcgaagcauucaggccgagga

SEQ ID NO: 1314540 - RNA, 15 nt, Mycobacterium tuberculosis H37Rv
gcgaaacaggccacu

SEQ ID NO: 1314541 - RNA, 15 nt, Mycobacterium tuberculosis H37Rv
gcgaaacgcccgggc

SEQ ID NO: 1314542 - RNA, 18 nt, Mycobacterium tuberculosis H37Rv
gcgaaacgcccgggcggc

SEQ ID NO: 1314543 - RNA, 13 nt, Mycobacterium tuberculosis H37Rv
gcgaaagagagcu

SEQ ID NO: 1314544 - RNA, 16 nt, Mycobacterium tuberculosis H37Rv
gcgaaaagccuugacc

SEQ ID NO: 1314545 - RNA, 20 nt, Mycobacterium tuberculosis H37Rv
gccguuguugaggaugacga

SEQ ID NO: 1314546 - RNA, 15 nt, Mycobacterium tuberculosis H37Rv
gccguugggccgcgc

SEQ ID NO: 1314547 - RNA, 17 nt, Mycobacterium tuberculosis H37Rv
gccguucgcucccccgc

SEQ ID NO: 1314548 - RNA, 17 nt, Mycobacterium tuberculosis H37Rv
gccguucggcaucuggu

SEQ ID NO: 1314549 - RNA, 19 nt, Mycobacterium tuberculosis H37Rv
gccguugucgucggcggcg

SEQ ID NO: 1314550 - RNA, 15 nt, Mycobacterium tuberculosis H37Rv
gccguucgggaugca

SEQ ID NO: 1314551 - RNA, 15 nt, Mycobacterium tuberculosis H37Rv
gccguucggggcgcg

SEQ ID NO: 1314552 - RNA, 22 nt, Mycobacterium tuberculosis H37Rv
gcgacagcgugccgaacaggga

SEQ ID NO: 1314553 - RNA, 22 nt, Mycobacterium tuberculosis H37Rv
gcgaauucguagggaugcggcc

SEQ ID NO: 1314554 - RNA, 18 nt, Mycobacterium tuberculosis H37Rv
gcgaaugcgggccuccug

SEQ ID NO: 1314555 - RNA, 17 nt, Mycobacterium tuberculosis H37Rv
gcgaaugcgggccuccu

SEQ ID NO: 1314556 - RNA, 13 nt, Mycobacterium tuberculosis H37Rv
gcgacauccgcgg

SEQ ID NO: 1314557 - RNA, 19 nt, Mycobacterium tuberculosis H37Rv
gcgaccaauagguccccac

SEQ ID NO: 1314558 - RNA, 22 nt, Mycobacterium tuberculosis H37Rv
gcgaccaacacgucgagcagcc

SEQ ID NO: 1314559 - RNA, 22 nt, Mycobacterium tuberculosis H37Rv
gcgacaggagacgguacgccag

SEQ ID NO: 1314560 - RNA, 13 nt, Mycobacterium tuberculosis H37Rv
gcgaccggccggc

SEQ ID NO: 1314561 - RNA, 15 nt, Mycobacterium tuberculosis H37Rv
gcgaccggcgagccc

SEQ ID NO: 1314562 - RNA, 18 nt, Mycobacterium tuberculosis H37Rv
gcgaccggcaacgcggcc

SEQ ID NO: 1314563 - RNA, 22 nt, Mycobacterium tuberculosis H37Rv
gcgaccggcaacgcggccuugc

SEQ ID NO: 1314564 - RNA, 20 nt, Mycobacterium tuberculosis H37Rv
gcgaccggcguaaccggcag

SEQ ID NO: 1314565 - RNA, 19 nt, Mycobacterium tuberculosis H37Rv
gcgacgccauggucagaua

SEQ ID NO: 1314566 - RNA, 15 nt, Mycobacterium tuberculosis H37Rv
gcgacgccaugguca

SEQ ID NO: 1314567 - RNA, 22 nt, Mycobacterium tuberculosis H37Rv
gcgacgcauaaccggcgcgccc

SEQ ID NO: 1314568 - RNA, 14 nt, Mycobacterium tuberculosis H37Rv
gcgacgccggcccg

SEQ ID NO: 1314569 - RNA, 18 nt, Mycobacterium tuberculosis H37Rv
gcgacgccggcccgacgg

SEQ ID NO: 1314570 - RNA, 22 nt, Mycobacterium tuberculosis H37Rv
gcgacgcgacacacgccgccgg

SEQ ID NO: 1314571 - RNA, 22 nt, Mycobacterium tuberculosis H37Rv
gcgaccgcgcucaccggggccg

SEQ ID NO: 1314572 - RNA, 17 nt, Mycobacterium tuberculosis H37Rv
gcgaccgccugcgcggc

SEQ ID NO: 1314573 - RNA, 13 nt, Mycobacterium tuberculosis H37Rv
gcgaccaccaccg

SEQ ID NO: 1314574 - RNA, 15 nt, Mycobacterium tuberculosis H37Rv
gcgaccacccccggc

SEQ ID NO: 1314575 - RNA, 18 nt, Mycobacterium tuberculosis H37Rv
gcgaccaccgcgucgggc

SEQ ID NO: 1314576 - RNA, 15 nt, Mycobacterium tuberculosis H37Rv
gcgaccaccagcgcc

SEQ ID NO: 1314577 - RNA, 12 nt, Mycobacterium tuberculosis H37Rv
gcgaccaccagc

SEQ ID NO: 1314578 - RNA, 20 nt, Mycobacterium tuberculosis H37Rv
gcgagguuggcguugguggu

SEQ ID NO: 1314579 - RNA, 18 nt, Mycobacterium tuberculosis H37Rv
gcgaggugccgggguggc

SEQ ID NO: 1314580 - RNA, 13 nt, Mycobacterium tuberculosis H37Rv
gcgaggugccggg

SEQ ID NO: 1314581 - RNA, 16 nt, Mycobacterium tuberculosis H37Rv
gcgagcuggcguuccc

SEQ ID NO: 1314582 - RNA, 14 nt, Mycobacterium tuberculosis H37Rv
gcgagcucccgggc

SEQ ID NO: 1314583 - RNA, 23 nt, Mycobacterium tuberculosis H37Rv
gcgagcggaauggaggccgccga

SEQ ID NO: 1314584 - RNA, 16 nt, Mycobacterium tuberculosis H37Rv
gcgagcggccuccagc

SEQ ID NO: 1314585 - RNA, 18 nt, Mycobacterium tuberculosis H37Rv
gcgagcggccuccagcac

SEQ ID NO: 1314586 - RNA, 21 nt, Mycobacterium tuberculosis H37Rv
gcgagugucuuagccagcagc

SEQ ID NO: 1314587 - RNA, 22 nt, Mycobacterium tuberculosis H37Rv
gcgagugucuuagccagcagca

SEQ ID NO: 1314588 - RNA, 23 nt, Mycobacterium tuberculosis H37Rv
gcgagugcgugaucuggccgaag

SEQ ID NO: 1314589 - RNA, 13 nt, Mycobacterium tuberculosis H37Rv
gcgagucgggggc

SEQ ID NO: 1314590 - RNA, 19 nt, Mycobacterium tuberculosis H37Rv
gcgaguuucugcucgaccg

SEQ ID NO: 1314591 - RNA, 22 nt, Mycobacterium tuberculosis H37Rv
gcgaguuggccguggcgaauga

SEQ ID NO: 1314592 - RNA, 16 nt, Mycobacterium tuberculosis H37Rv
gcgagugaacucgucc

SEQ ID NO: 1314593 - RNA, 18 nt, Mycobacterium tuberculosis H37Rv
gcgaguuaggccgccagc

SEQ ID NO: 1314594 - RNA, 19 nt, Mycobacterium tuberculosis H37Rv
gcgaucaauugcccggcac

SEQ ID NO: 1314595 - RNA, 18 nt, Mycobacterium tuberculosis H37Rv
gcgaucaccguuuggucc

SEQ ID NO: 1314596 - RNA, 13 nt, Mycobacterium tuberculosis H37Rv
gcgaucaccaccg

SEQ ID NO: 1314597 - RNA, 16 nt, Mycobacterium tuberculosis H37Rv
gcgaucgucagccagc

SEQ ID NO: 1314598 - RNA, 20 nt, Mycobacterium tuberculosis H37Rv
gcgaucgucucggugaucuc

SEQ ID NO: 1314599 - RNA, 16 nt, Mycobacterium tuberculosis H37Rv
gcgaucgugccgggcc

SEQ ID NO: 1314600 - RNA, 20 nt, Mycobacterium tuberculosis H37Rv
gcgaucgugcggaaaccgcu

SEQ ID NO: 1314601 - RNA, 16 nt, Mycobacterium tuberculosis H37Rv
gcgaucgcuccgcggc

SEQ ID NO: 1314602 - RNA, 16 nt, Mycobacterium tuberculosis H37Rv
gcgaucggcacuuagc

SEQ ID NO: 1314603 - RNA, 19 nt, Mycobacterium tuberculosis H37Rv
gcgaucggcacuuagcccg

SEQ ID NO: 1314604 - RNA, 21 nt, Mycobacterium tuberculosis H37Rv
gcgaucagcagccgccgauga

SEQ ID NO: 1314605 - RNA, 20 nt, Mycobacterium tuberculosis H37Rv
gcgaucagcagcgccagcac

SEQ ID NO: 1314606 - RNA, 17 nt, Mycobacterium tuberculosis H37Rv
gcgaucuugcgacgccc

SEQ ID NO: 1314607 - RNA, 15 nt, Mycobacterium tuberculosis H37Rv
gcgaucugcucgccc

SEQ ID NO: 1314608 - RNA, 22 nt, Mycobacterium tuberculosis H37Rv
gcgaucugggcuuucagcaccg

SEQ ID NO: 1314609 - RNA, 20 nt, Mycobacterium tuberculosis H37Rv
gcgaucugcgcgaugcccac

SEQ ID NO: 1314610 - RNA, 18 nt, Mycobacterium tuberculosis H37Rv
gcgaucucaccuggagcu

SEQ ID NO: 1314611 - RNA, 15 nt, Mycobacterium tuberculosis H37Rv
gcgaucgggccggcg

SEQ ID NO: 1314612 - RNA, 16 nt, Mycobacterium tuberculosis H37Rv
gcgaucggggcgguga

SEQ ID NO: 1314613 - RNA, 18 nt, Mycobacterium tuberculosis H37Rv
gcgaugccccacggugcg

SEQ ID NO: 1314614 - RNA, 20 nt, Mycobacterium tuberculosis H37Rv
gcgaugccguccaagauguc

SEQ ID NO: 1314615 - RNA, 17 nt, Mycobacterium tuberculosis H37Rv
gcgaugcgccaggcuga

SEQ ID NO: 1314616 - RNA, 19 nt, Mycobacterium tuberculosis H37Rv
gcgaugcgcgggugguuca

SEQ ID NO: 1314617 - RNA, 12 nt, Mycobacterium tuberculosis H37Rv
gcgagccaacuc

SEQ ID NO: 1314618 - RNA, 13 nt, Mycobacterium tuberculosis H37Rv
gcgagccagcugc

SEQ ID NO: 1314619 - RNA, 21 nt, Mycobacterium tuberculosis H37Rv
gcgagcccacguggggccggg

SEQ ID NO: 1314620 - RNA, 15 nt, Mycobacterium tuberculosis H37Rv
gcgagcgcgccggcc

SEQ ID NO: 1314621 - RNA, 14 nt, Mycobacterium tuberculosis H37Rv
gcgagcgcgcgacu

SEQ ID NO: 1314622 - RNA, 12 nt, Mycobacterium tuberculosis H37Rv
gcgagcgcgccg

SEQ ID NO: 1314623 - RNA, 14 nt, Mycobacterium tuberculosis H37Rv
gcgagcgcgccggc

SEQ ID NO: 1314624 - RNA, 12 nt, Mycobacterium tuberculosis H37Rv
gcgagcgcgcca

SEQ ID NO: 1314625 - RNA, 22 nt, Mycobacterium tuberculosis H37Rv
gcgagcgcggcggagccgggug

SEQ ID NO: 1314626 - RNA, 22 nt, Mycobacterium tuberculosis H37Rv
gcgagcggaauggaggccgccg

SEQ ID NO: 1314627 - RNA, 19 nt, Mycobacterium tuberculosis H37Rv
gcgagcauaccgccgcugc

SEQ ID NO: 1314628 - RNA, 23 nt, Mycobacterium tuberculosis H37Rv
gcgagcagggcgucgaccgcggc

SEQ ID NO: 1314629 - RNA, 15 nt, Mycobacterium tuberculosis H37Rv
gcgagcagacgcgga

SEQ ID NO: 1314630 - RNA, 22 nt, Mycobacterium tuberculosis H37Rv
gcgagcagacgcaaaagccacc

SEQ ID NO: 1314631 - RNA, 17 nt, Mycobacterium tuberculosis H37Rv
gcgagcagacgccgcgu

SEQ ID NO: 1314632 - RNA, 21 nt, Mycobacterium tuberculosis H37Rv
gcgagcaccaccccagcggcc

SEQ ID NO: 1314633 - RNA, 21 nt, Mycobacterium tuberculosis H37Rv
gcgagcacccgcuggucgagc

SEQ ID NO: 1314634 - RNA, 15 nt, Mycobacterium tuberculosis H37Rv
gcgacuuucugcgcg

SEQ ID NO: 1314635 - RNA, 13 nt, Mycobacterium tuberculosis H37Rv
gcgacucgccggc

SEQ ID NO: 1314636 - RNA, 19 nt, Mycobacterium tuberculosis H37Rv
gcgacuuggcaucgcgagc

SEQ ID NO: 1314637 - RNA, 16 nt, Mycobacterium tuberculosis H37Rv
gcgagaaggugcugcg

SEQ ID NO: 1314638 - RNA, 19 nt, Mycobacterium tuberculosis H37Rv
gcgagaagcagggauucug

SEQ ID NO: 1314639 - RNA, 22 nt, Mycobacterium tuberculosis H37Rv
gcgagacgcuccaguggcgcca

SEQ ID NO: 1314640 - RNA, 13 nt, Mycobacterium tuberculosis H37Rv
gcgagcaccaccc

SEQ ID NO: 1314641 - RNA, 18 nt, Mycobacterium tuberculosis H37Rv
gcgagacgcaugucgggc

SEQ ID NO: 1314642 - RNA, 19 nt, Mycobacterium tuberculosis H37Rv
gcgacuaagggcacuccac

SEQ ID NO: 1314643 - RNA, 21 nt, Mycobacterium tuberculosis H37Rv
gcgacuacggccucgcugggc

SEQ ID NO: 1314644 - RNA, 16 nt, Mycobacterium tuberculosis H37Rv
gcgacuccaccccacc

SEQ ID NO: 1314645 - RNA, 17 nt, Mycobacterium tuberculosis H37Rv
gcgacgucaggguaucc

SEQ ID NO: 1314646 - RNA, 22 nt, Mycobacterium tuberculosis H37Rv
gcgacguaguggaagccgacca

SEQ ID NO: 1314647 - RNA, 19 nt, Mycobacterium tuberculosis H37Rv
gcgacggucgugaucggcg

SEQ ID NO: 1314648 - RNA, 18 nt, Mycobacterium tuberculosis H37Rv
gcgacgguguagcccauc

SEQ ID NO: 1314649 - RNA, 19 nt, Mycobacterium tuberculosis H37Rv
gcgacgucugccaggcgca

SEQ ID NO: 1314650 - RNA, 21 nt, Mycobacterium tuberculosis H37Rv
gcgacgucugccaggcgcagc

SEQ ID NO: 1314651 - RNA, 18 nt, Mycobacterium tuberculosis H37Rv
gcgacguccaccagccgg

SEQ ID NO: 1314652 - RNA, 20 nt, Mycobacterium tuberculosis H37Rv
gcgacgucgcuagaucccag

SEQ ID NO: 1314653 - RNA, 16 nt, Mycobacterium tuberculosis H37Rv
gcgacgcuaccgccgg

SEQ ID NO: 1314654 - RNA, 17 nt, Mycobacterium tuberculosis H37Rv
gcgacgcguagcacggc

SEQ ID NO: 1314655 - RNA, 20 nt, Mycobacterium tuberculosis H37Rv
gcgacgcuaggacggcugcc

SEQ ID NO: 1314656 - RNA, 15 nt, Mycobacterium tuberculosis H37Rv
gcgacgcucgcugca

SEQ ID NO: 1314657 - RNA, 23 nt, Mycobacterium tuberculosis H37Rv
gcgacggucaaggugcgccgcca

SEQ ID NO: 1314658 - RNA, 20 nt, Mycobacterium tuberculosis H37Rv
gcgacgggucgggcaaccug

SEQ ID NO: 1314659 - RNA, 19 nt, Mycobacterium tuberculosis H37Rv
gcgacgggcacccgagccg

SEQ ID NO: 1314660 - RNA, 14 nt, Mycobacterium tuberculosis H37Rv
gcgacggccagcgc

SEQ ID NO: 1314661 - RNA, 15 nt, Mycobacterium tuberculosis H37Rv
gcgacggcgacguga

SEQ ID NO: 1314662 - RNA, 20 nt, Mycobacterium tuberculosis H37Rv
gcgcaguuggcaccagccgg

SEQ ID NO: 1314663 - RNA, 16 nt, Mycobacterium tuberculosis H37Rv
gcgcaguuggccaugc

SEQ ID NO: 1314664 - RNA, 16 nt, Mycobacterium tuberculosis H37Rv
gcgcauauccgcaggc

SEQ ID NO: 1314665 - RNA, 21 nt, Mycobacterium tuberculosis H37Rv
gcgcagguuggcaagcacggc

SEQ ID NO: 1314666 - RNA, 17 nt, Mycobacterium tuberculosis H37Rv
gcgcaggugcugggcga

SEQ ID NO: 1314667 - RNA, 14 nt, Mycobacterium tuberculosis H37Rv
gcgcaggggcggcg

SEQ ID NO: 1314668 - RNA, 16 nt, Mycobacterium tuberculosis H37Rv
gcgcaggggcggcgug

SEQ ID NO: 1314669 - RNA, 15 nt, Mycobacterium tuberculosis H37Rv
gcgcagggaucgcag

SEQ ID NO: 1314670 - RNA, 14 nt, Mycobacterium tuberculosis H37Rv
gcgcagccggcccg

SEQ ID NO: 1314671 - RNA, 16 nt, Mycobacterium tuberculosis H37Rv
gcgcagccgcucgacg

SEQ ID NO: 1314672 - RNA, 13 nt, Mycobacterium tuberculosis H37Rv
gcgcagcgccucc

SEQ ID NO: 1314673 - RNA, 13 nt, Mycobacterium tuberculosis H37Rv
gcgcagcgccggc

SEQ ID NO: 1314674 - RNA, 16 nt, Mycobacterium tuberculosis H37Rv
gcgcagcgccggcagc

SEQ ID NO: 1314675 - RNA, 15 nt, Mycobacterium tuberculosis H37Rv
gcgcagccugcagcg

SEQ ID NO: 1314676 - RNA, 14 nt, Mycobacterium tuberculosis H37Rv
gcgcagccugcagc

SEQ ID NO: 1314677 - RNA, 21 nt, Mycobacterium tuberculosis H37Rv
gcgcagcgaaucuccaaguag

SEQ ID NO: 1314678 - RNA, 20 nt, Mycobacterium tuberculosis H37Rv
gcgcagcgauucgccuagcg

SEQ ID NO: 1314679 - RNA, 14 nt, Mycobacterium tuberculosis H37Rv
gcgcaccaccgagc

SEQ ID NO: 1314680 - RNA, 18 nt, Mycobacterium tuberculosis H37Rv
gcgcaccaccgcggcggc

SEQ ID NO: 1314681 - RNA, 15 nt, Mycobacterium tuberculosis H37Rv
gcgcacaguucgccg

SEQ ID NO: 1314682 - RNA, 22 nt, Mycobacterium tuberculosis H37Rv
gcgcaacguagccagcagcggc

SEQ ID NO: 1314683 - RNA, 22 nt, Mycobacterium tuberculosis H37Rv
gcgaugcucaaugugccgccgg

SEQ ID NO: 1314684 - RNA, 14 nt, Mycobacterium tuberculosis H37Rv
gcgaugcguccgcc

SEQ ID NO: 1314685 - RNA, 20 nt, Mycobacterium tuberculosis H37Rv
gcgaugcgggccgccaggcg

SEQ ID NO: 1314686 - RNA, 17 nt, Mycobacterium tuberculosis H37Rv
gcgcaagcgccgcgcuu

SEQ ID NO: 1314687 - RNA, 19 nt, Mycobacterium tuberculosis H37Rv
gcgcaacuucuucagcagc

SEQ ID NO: 1314688 - RNA, 23 nt, Mycobacterium tuberculosis H37Rv
gcgcaacuucgacuugagaaacc

SEQ ID NO: 1314689 - RNA, 22 nt, Mycobacterium tuberculosis H37Rv
gcgcagacucgccaccgcggcg

SEQ ID NO: 1314690 - RNA, 19 nt, Mycobacterium tuberculosis H37Rv
gcgcacuugcguggcguug

SEQ ID NO: 1314691 - RNA, 16 nt, Mycobacterium tuberculosis H37Rv
gcgcagaacaccaccg

SEQ ID NO: 1314692 - RNA, 15 nt, Mycobacterium tuberculosis H37Rv
gcgcacgauagccac

SEQ ID NO: 1314693 - RNA, 17 nt, Mycobacterium tuberculosis H37Rv
gcgcacgaaaccgcagc

SEQ ID NO: 1314694 - RNA, 23 nt, Mycobacterium tuberculosis H37Rv
gcgcacugaaauggcgugcucga

SEQ ID NO: 1314695 - RNA, 14 nt, Mycobacterium tuberculosis H37Rv
gcgcaccugaaggc

SEQ ID NO: 1314696 - RNA, 19 nt, Mycobacterium tuberculosis H37Rv
gcgcaccuccugcgagugc

SEQ ID NO: 1314697 - RNA, 14 nt, Mycobacterium tuberculosis H37Rv
gcgcaccgcggacc

SEQ ID NO: 1314698 - RNA, 21 nt, Mycobacterium tuberculosis H37Rv
gcgcaccggguugagccgccg

SEQ ID NO: 1314699 - RNA, 15 nt, Mycobacterium tuberculosis H37Rv
gcgcacccgcggguc

SEQ ID NO: 1314700 - RNA, 15 nt, Mycobacterium tuberculosis H37Rv
gcgcaccaguccagc

SEQ ID NO: 1314701 - RNA, 19 nt, Mycobacterium tuberculosis H37Rv
gcgcaccaguccagcgggc

SEQ ID NO: 1314702 - RNA, 21 nt, Mycobacterium tuberculosis H37Rv
gcgcaccccgcuugcgcggcu

SEQ ID NO: 1314703 - RNA, 22 nt, Mycobacterium tuberculosis H37Rv
gcgcacccagcccagccguucg

SEQ ID NO: 1314704 - RNA, 18 nt, Mycobacterium tuberculosis H37Rv
gcgcaccaucgcggccgc

SEQ ID NO: 1314705 - RNA, 19 nt, Mycobacterium tuberculosis H37Rv
gcgcaccaucgcggccgcu

SEQ ID NO: 1314706 - RNA, 14 nt, Mycobacterium tuberculosis H37Rv
gcgcaucgcgccuu

SEQ ID NO: 1314707 - RNA, 17 nt, Mycobacterium tuberculosis H37Rv
gcgcaucgccuccucga

SEQ ID NO: 1314708 - RNA, 12 nt, Mycobacterium tuberculosis H37Rv
gcgcaucgccaa

SEQ ID NO: 1314709 - RNA, 15 nt, Mycobacterium tuberculosis H37Rv
gcgcaucugcucggc

SEQ ID NO: 1314710 - RNA, 18 nt, Mycobacterium tuberculosis H37Rv
gcgcaucguugccgcaga

SEQ ID NO: 1314711 - RNA, 21 nt, Mycobacterium tuberculosis H37Rv
gcgcaucgccgcuggccagca

SEQ ID NO: 1314712 - RNA, 20 nt, Mycobacterium tuberculosis H37Rv
gcgcauugccgacgcgcggc

SEQ ID NO: 1314713 - RNA, 21 nt, Mycobacterium tuberculosis H37Rv
gcgcaugugaaagacaacccg

SEQ ID NO: 1314714 - RNA, 18 nt, Mycobacterium tuberculosis H37Rv
gcgcauucgccgggcggc

SEQ ID NO: 1314715 - RNA, 20 nt, Mycobacterium tuberculosis H37Rv
gcgccacauacaccggccgg

SEQ ID NO: 1314716 - RNA, 21 nt, Mycobacterium tuberculosis H37Rv
gcgccaccagucacgcccacc

SEQ ID NO: 1314717 - RNA, 15 nt, Mycobacterium tuberculosis H37Rv
gcgccacccgcgccg

SEQ ID NO: 1314718 - RNA, 23 nt, Mycobacterium tuberculosis H37Rv
gcgccacccgcgccgccagcgcc

SEQ ID NO: 1314719 - RNA, 17 nt, Mycobacterium tuberculosis H37Rv
gcgccaccggcaccgcc

SEQ ID NO: 1314720 - RNA, 15 nt, Mycobacterium tuberculosis H37Rv
gcgccaccggcaccg

SEQ ID NO: 1314721 - RNA, 18 nt, Mycobacterium tuberculosis H37Rv
gcgcauuucguggcgcgc

SEQ ID NO: 1314722 - RNA, 15 nt, Mycobacterium tuberculosis H37Rv
gcgccaaacaccccg

SEQ ID NO: 1314723 - RNA, 14 nt, Mycobacterium tuberculosis H37Rv
gcgccaaaaaggau

SEQ ID NO: 1314724 - RNA, 18 nt, Mycobacterium tuberculosis H37Rv
gcgccaaaauccgcccac

SEQ ID NO: 1314725 - RNA, 17 nt, Mycobacterium tuberculosis H37Rv
gcgccaacagaugccac

SEQ ID NO: 1314726 - RNA, 23 nt, Mycobacterium tuberculosis H37Rv
gcgccaacucgagaguggccucg

SEQ ID NO: 1314727 - RNA, 20 nt, Mycobacterium tuberculosis H37Rv
gcgccaagacgaacagcacg

SEQ ID NO: 1314728 - RNA, 21 nt, Mycobacterium tuberculosis H37Rv
gcgccaagacgaacagcacga

SEQ ID NO: 1314729 - RNA, 12 nt, Mycobacterium tuberculosis H37Rv
gcgccaacaccu

SEQ ID NO: 1314730 - RNA, 22 nt, Mycobacterium tuberculosis H37Rv
gcgccaagccgugccgcacagc

SEQ ID NO: 1314731 - RNA, 22 nt, Mycobacterium tuberculosis H37Rv
gcgccaaggucugccgggcgcg

SEQ ID NO: 1314732 - RNA, 15 nt, Mycobacterium tuberculosis H37Rv
gcgccaguggccacc

SEQ ID NO: 1314733 - RNA, 21 nt, Mycobacterium tuberculosis H37Rv
gcgccaggccgcacagcacca

SEQ ID NO: 1314734 - RNA, 17 nt, Mycobacterium tuberculosis H37Rv
gcgccaggccgcacagc

SEQ ID NO: 1314735 - RNA, 13 nt, Mycobacterium tuberculosis H37Rv
gcgccaggccacg

SEQ ID NO: 1314736 - RNA, 12 nt, Mycobacterium tuberculosis H37Rv
gcgccaggaacc

SEQ ID NO: 1314737 - RNA, 21 nt, Mycobacterium tuberculosis H37Rv
gcgccauaauauugccgccuc

SEQ ID NO: 1314738 - RNA, 12 nt, Mycobacterium tuberculosis H37Rv
gcgccagugcgg

SEQ ID NO: 1314739 - RNA, 19 nt, Mycobacterium tuberculosis H37Rv
gcgccaguucgcggcugcg

SEQ ID NO: 1314740 - RNA, 19 nt, Mycobacterium tuberculosis H37Rv
gcgccaguucggcgggagc

SEQ ID NO: 1314741 - RNA, 21 nt, Mycobacterium tuberculosis H37Rv
gcgccaguucggcgggagcug

SEQ ID NO: 1314742 - RNA, 20 nt, Mycobacterium tuberculosis H37Rv
gcgccaguucggcgggcgcg

SEQ ID NO: 1314743 - RNA, 21 nt, Mycobacterium tuberculosis H37Rv
gcgccaguucggcgggcgcgg

SEQ ID NO: 1314744 - RNA, 21 nt, Mycobacterium tuberculosis H37Rv
gcgccauauugauuccgaccc

SEQ ID NO: 1314745 - RNA, 22 nt, Mycobacterium tuberculosis H37Rv
gcgccaucacaucggccucuga

SEQ ID NO: 1314746 - RNA, 13 nt, Mycobacterium tuberculosis H37Rv
gcgccagcuccgu

SEQ ID NO: 1314747 - RNA, 17 nt, Mycobacterium tuberculosis H37Rv
gcgccacggcagcgccc

SEQ ID NO: 1314748 - RNA, 13 nt, Mycobacterium tuberculosis H37Rv
gcgccacggcagc

SEQ ID NO: 1314749 - RNA, 16 nt, Mycobacterium tuberculosis H37Rv
gcgccaccguggugga

SEQ ID NO: 1314750 - RNA, 19 nt, Mycobacterium tuberculosis H37Rv
gcgccaccguuaccgccgu

SEQ ID NO: 1314751 - RNA, 22 nt, Mycobacterium tuberculosis H37Rv
gcgccaccucccacgccgccgu

SEQ ID NO: 1314752 - RNA, 17 nt, Mycobacterium tuberculosis H37Rv
gcuaucgcuagccggcu

SEQ ID NO: 1314753 - RNA, 17 nt, Mycobacterium tuberculosis H37Rv
gcuaucgguucagcugc

SEQ ID NO: 1314754 - RNA, 22 nt, Mycobacterium tuberculosis H37Rv
gcuauccaggccgucaggcgug

SEQ ID NO: 1314755 - RNA, 15 nt, Mycobacterium tuberculosis H37Rv
gcuaguucggcgucc

SEQ ID NO: 1314756 - RNA, 15 nt, Mycobacterium tuberculosis H37Rv
gcuagcucucgcggc

SEQ ID NO: 1314757 - RNA, 18 nt, Mycobacterium tuberculosis H37Rv
gcuagccguucggcugcc

SEQ ID NO: 1314758 - RNA, 21 nt, Mycobacterium tuberculosis H37Rv
gcuagcgcuugcgaccccggc

SEQ ID NO: 1314759 - RNA, 20 nt, Mycobacterium tuberculosis H37Rv
gcuagccgggcgcgccggcc

SEQ ID NO: 1314760 - RNA, 13 nt, Mycobacterium tuberculosis H37Rv
gcuagcccggcag

SEQ ID NO: 1314761 - RNA, 14 nt, Mycobacterium tuberculosis H37Rv
gcuagcccggcggc

SEQ ID NO: 1314762 - RNA, 13 nt, Mycobacterium tuberculosis H37Rv
gcguuguggcuga

SEQ ID NO: 1314763 - RNA, 22 nt, Mycobacterium tuberculosis H37Rv
gcguuuauaccucgccgcccug

SEQ ID NO: 1314764 - RNA, 16 nt, Mycobacterium tuberculosis H37Rv
gcuauucgccagcgcc

SEQ ID NO: 1314765 - RNA, 16 nt, Mycobacterium tuberculosis H37Rv
gcuauugggugcagug

SEQ ID NO: 1314766 - RNA, 16 nt, Mycobacterium tuberculosis H37Rv
gcuaugaugccgccgg

SEQ ID NO: 1314767 - RNA, 23 nt, Mycobacterium tuberculosis H37Rv
gcuaugcgccgcaugccaccgag

SEQ ID NO: 1314768 - RNA, 20 nt, Mycobacterium tuberculosis H37Rv
gcucaaccucuggcggcggg

SEQ ID NO: 1314769 - RNA, 21 nt, Mycobacterium tuberculosis H37Rv
gcucaacggcgaaaguccugc

SEQ ID NO: 1314770 - RNA, 21 nt, Mycobacterium tuberculosis H37Rv
gcucaaaucaugcgauucugc

SEQ ID NO: 1314771 - RNA, 15 nt, Mycobacterium tuberculosis H37Rv
gcucacggacgcugg

SEQ ID NO: 1314772 - RNA, 15 nt, Mycobacterium tuberculosis H37Rv
gcucacgaucacccg

SEQ ID NO: 1314773 - RNA, 17 nt, Mycobacterium tuberculosis H37Rv
gcucacgacuggcgccc

SEQ ID NO: 1314774 - RNA, 21 nt, Mycobacterium tuberculosis H37Rv
gcucacgacuggcgcccagcc

SEQ ID NO: 1314775 - RNA, 23 nt, Mycobacterium tuberculosis H37Rv
gcucacgacuggcgcccagccgg

SEQ ID NO: 1314776 - RNA, 13 nt, Mycobacterium tuberculosis H37Rv
gcucaccggggcc

SEQ ID NO: 1314777 - RNA, 18 nt, Mycobacterium tuberculosis H37Rv
gcucaagguccagcgauc

SEQ ID NO: 1314778 - RNA, 14 nt, Mycobacterium tuberculosis H37Rv
gcucccgggggcac

SEQ ID NO: 1314779 - RNA, 23 nt, Mycobacterium tuberculosis H37Rv
gcucccgguugggguggcggugc

SEQ ID NO: 1314780 - RNA, 18 nt, Mycobacterium tuberculosis H37Rv
gcucccgggcggcggccu

SEQ ID NO: 1314781 - RNA, 16 nt, Mycobacterium tuberculosis H37Rv
gcucccgggcggcggc

SEQ ID NO: 1314782 - RNA, 20 nt, Mycobacterium tuberculosis H37Rv
gcucccgccacgucgccggc

SEQ ID NO: 1314783 - RNA, 21 nt, Mycobacterium tuberculosis H37Rv
gcucccgccggcagcgucggc

SEQ ID NO: 1314784 - RNA, 16 nt, Mycobacterium tuberculosis H37Rv
gcuccccgucggggaa

SEQ ID NO: 1314785 - RNA, 21 nt, Mycobacterium tuberculosis H37Rv
gcucccccgccaaccccaaca

SEQ ID NO: 1314786 - RNA, 22 nt, Mycobacterium tuberculosis H37Rv
gcucccgugcuggcgccgaagu

SEQ ID NO: 1314787 - RNA, 22 nt, Mycobacterium tuberculosis H37Rv
gcucccguacgccggcgguggc

SEQ ID NO: 1314788 - RNA, 18 nt, Mycobacterium tuberculosis H37Rv
gcucccuacgagcccacg

SEQ ID NO: 1314789 - RNA, 13 nt, Mycobacterium tuberculosis H37Rv
gcuccgccagcgc

SEQ ID NO: 1314790 - RNA, 14 nt, Mycobacterium tuberculosis H37Rv
gcuccgccagcgcc

SEQ ID NO: 1314791 - RNA, 22 nt, Mycobacterium tuberculosis H37Rv
gcuccgccggguuggcgccggc

SEQ ID NO: 1314792 - RNA, 14 nt, Mycobacterium tuberculosis H37Rv
gcuccgccgucgcc

SEQ ID NO: 1314793 - RNA, 23 nt, Mycobacterium tuberculosis H37Rv
gcuccgccggguuggcgccggcc

SEQ ID NO: 1314794 - RNA, 19 nt, Mycobacterium tuberculosis H37Rv
gcuccgccugccgcugguc

SEQ ID NO: 1314795 - RNA, 18 nt, Mycobacterium tuberculosis H37Rv
gcucccgcggcgccaccc

SEQ ID NO: 1314796 - RNA, 15 nt, Mycobacterium tuberculosis H37Rv
gcuccgcggcgcagc

SEQ ID NO: 1314797 - RNA, 16 nt, Mycobacterium tuberculosis H37Rv
gcuccgcgccgcucau

SEQ ID NO: 1314798 - RNA, 17 nt, Mycobacterium tuberculosis H37Rv
gcuccggcggcagcggc

SEQ ID NO: 1314799 - RNA, 22 nt, Mycobacterium tuberculosis H37Rv
gcuccggcccugccgccggccc

SEQ ID NO: 1314800 - RNA, 18 nt, Mycobacterium tuberculosis H37Rv
gcuccuugaggucaccca

SEQ ID NO: 1314801 - RNA, 15 nt, Mycobacterium tuberculosis H37Rv
gcucgacgaggccac

SEQ ID NO: 1314802 - RNA, 17 nt, Mycobacterium tuberculosis H37Rv
gcuccuguaacugcucc

SEQ ID NO: 1314803 - RNA, 20 nt, Mycobacterium tuberculosis H37Rv
gcuccuguaacugcuccugg

SEQ ID NO: 1314804 - RNA, 15 nt, Mycobacterium tuberculosis H37Rv
gcucgccgaccagcu

SEQ ID NO: 1314805 - RNA, 22 nt, Mycobacterium tuberculosis H37Rv
gcucgcccuaaccuaggcgcuc

SEQ ID NO: 1314806 - RNA, 18 nt, Mycobacterium tuberculosis H37Rv
gcucgcccuauacgcaac

SEQ ID NO: 1314807 - RNA, 14 nt, Mycobacterium tuberculosis H37Rv
gcucgcccucagag

SEQ ID NO: 1314808 - RNA, 23 nt, Mycobacterium tuberculosis H37Rv
gcucgccgagcagacacagaauc

SEQ ID NO: 1314809 - RNA, 13 nt, Mycobacterium tuberculosis H37Rv
gcucgcccgccgc

SEQ ID NO: 1314810 - RNA, 20 nt, Mycobacterium tuberculosis H37Rv
gcucgccagggucgcgagcc

SEQ ID NO: 1314811 - RNA, 14 nt, Mycobacterium tuberculosis H37Rv
gcucgcccagugaa

SEQ ID NO: 1314812 - RNA, 15 nt, Mycobacterium tuberculosis H37Rv
gcucgagguggucuc

SEQ ID NO: 1314813 - RNA, 23 nt, Mycobacterium tuberculosis H37Rv
gcucgccaggcaagccagcacug

SEQ ID NO: 1314814 - RNA, 20 nt, Mycobacterium tuberculosis H37Rv
gcucgaucaucgggagccgc

SEQ ID NO: 1314815 - RNA, 13 nt, Mycobacterium tuberculosis H37Rv
gcucgccaggcaa

SEQ ID NO: 1314816 - RNA, 19 nt, Mycobacterium tuberculosis H37Rv
gcucccaugaucgccgacc

SEQ ID NO: 1314817 - RNA, 22 nt, Mycobacterium tuberculosis H37Rv
gcuccagcugagcggccggcau

SEQ ID NO: 1314818 - RNA, 22 nt, Mycobacterium tuberculosis H37Rv
gcuccaccgggcccgccguccc

SEQ ID NO: 1314819 - RNA, 19 nt, Mycobacterium tuberculosis H37Rv
gcuccaccucgguacuugc

SEQ ID NO: 1314820 - RNA, 18 nt, Mycobacterium tuberculosis H37Rv
gcuccaauugcggccgcg

SEQ ID NO: 1314821 - RNA, 14 nt, Mycobacterium tuberculosis H37Rv
gcuccaccaggacg

SEQ ID NO: 1314822 - RNA, 21 nt, Mycobacterium tuberculosis H37Rv
gcuccagcugagcggccggca

SEQ ID NO: 1314823 - RNA, 21 nt, Mycobacterium tuberculosis H37Rv
gcuccagcgcgcgccgcagcg

SEQ ID NO: 1314824 - RNA, 19 nt, Mycobacterium tuberculosis H37Rv
gcucaucuguaaccuccuc

SEQ ID NO: 1314825 - RNA, 17 nt, Mycobacterium tuberculosis H37Rv
gcucauggcauuuccug

SEQ ID NO: 1314826 - RNA, 17 nt, Mycobacterium tuberculosis H37Rv
gcucagcgugcgcuggc

SEQ ID NO: 1314827 - RNA, 20 nt, Mycobacterium tuberculosis H37Rv
gcucagcgugcgcuggcuga

SEQ ID NO: 1314828 - RNA, 22 nt, Mycobacterium tuberculosis H37Rv
gcucagcuaaaaaccgcugccg

SEQ ID NO: 1314829 - RNA, 23 nt, Mycobacterium tuberculosis H37Rv
gcucagcgcgcgccgcuggguga

SEQ ID NO: 1314830 - RNA, 17 nt, Mycobacterium tuberculosis H37Rv
gcucagcgcggccccga

SEQ ID NO: 1314831 - RNA, 14 nt, Mycobacterium tuberculosis H37Rv
gcucagcgcggccc

SEQ ID NO: 1314832 - RNA, 22 nt, Mycobacterium tuberculosis H37Rv
gcucagccguccgggcggccuc

SEQ ID NO: 1314833 - RNA, 20 nt, Mycobacterium tuberculosis H37Rv
gcucagccggcccugcggcc

SEQ ID NO: 1314834 - RNA, 13 nt, Mycobacterium tuberculosis H37Rv
gcucacggcggcg

SEQ ID NO: 1314835 - RNA, 13 nt, Mycobacterium tuberculosis H37Rv
gcucacgguggcc

SEQ ID NO: 1314836 - RNA, 16 nt, Mycobacterium tuberculosis H37Rv
gcucacgcuccgccgg

SEQ ID NO: 1314837 - RNA, 18 nt, Mycobacterium tuberculosis H37Rv
gcucacggcccgagccgc

SEQ ID NO: 1314838 - RNA, 19 nt, Mycobacterium tuberculosis H37Rv
gcucacuacccgcaacgag

SEQ ID NO: 1314839 - RNA, 12 nt, Mycobacterium tuberculosis H37Rv
gcucacggcggc

SEQ ID NO: 1314840 - RNA, 17 nt, Mycobacterium tuberculosis H37Rv
gcugagcagcgccgcgu

SEQ ID NO: 1314841 - RNA, 11 nt, Mycobacterium tuberculosis H37Rv
gcugagcagcg

SEQ ID NO: 1314842 - RNA, 14 nt, Mycobacterium tuberculosis H37Rv
gcugagcacgcgga

SEQ ID NO: 1314843 - RNA, 18 nt, Mycobacterium tuberculosis H37Rv
gcugacgugucggcugcu

SEQ ID NO: 1314844 - RNA, 16 nt, Mycobacterium tuberculosis H37Rv
gcugacgugucggcug

SEQ ID NO: 1314845 - RNA, 14 nt, Mycobacterium tuberculosis H37Rv
gcugagccccccga

SEQ ID NO: 1314846 - RNA, 20 nt, Mycobacterium tuberculosis H37Rv
gcugagcccguuuccucagc

SEQ ID NO: 1314847 - RNA, 18 nt, Mycobacterium tuberculosis H37Rv
gcugagcugcucgccggc

SEQ ID NO: 1314848 - RNA, 19 nt, Mycobacterium tuberculosis H37Rv
gcugagcugcucgccggcc

SEQ ID NO: 1314849 - RNA, 14 nt, Mycobacterium tuberculosis H37Rv
gcugagcugcucgc

SEQ ID NO: 1314850 - RNA, 13 nt, Mycobacterium tuberculosis H37Rv
gcugagcggacuc

SEQ ID NO: 1314851 - RNA, 16 nt, Mycobacterium tuberculosis H37Rv
gcugagccggucgcgc

SEQ ID NO: 1314852 - RNA, 19 nt, Mycobacterium tuberculosis H37Rv
gcugaguccccaggugggc

SEQ ID NO: 1314853 - RNA, 17 nt, Mycobacterium tuberculosis H37Rv
gcugaguccccaggugg

SEQ ID NO: 1314854 - RNA, 12 nt, Mycobacterium tuberculosis H37Rv
gcugagggugga

SEQ ID NO: 1314855 - RNA, 19 nt, Mycobacterium tuberculosis H37Rv
gcugagguaauucgcggcc

SEQ ID NO: 1314856 - RNA, 17 nt, Mycobacterium tuberculosis H37Rv
gcugaggaagcggcggc

SEQ ID NO: 1314857 - RNA, 18 nt, Mycobacterium tuberculosis H37Rv
gcugaggaagcggcggca

SEQ ID NO: 1314858 - RNA, 21 nt, Mycobacterium tuberculosis H37Rv
gcugagcucgaugucagcggc

SEQ ID NO: 1314859 - RNA, 24 nt, Mycobacterium tuberculosis H37Rv
gcugagucgguucagccacgcagc

SEQ ID NO: 1314860 - RNA, 20 nt, Mycobacterium tuberculosis H37Rv
gcugaguccccaggugggca

SEQ ID NO: 1314861 - RNA, 22 nt, Mycobacterium tuberculosis H37Rv
gcugaguccccaggugggcagc

SEQ ID NO: 1314862 - RNA, 12 nt, Mycobacterium tuberculosis H37Rv
gcugaucaacag

SEQ ID NO: 1314863 - RNA, 12 nt, Mycobacterium tuberculosis H37Rv
gcugauccaagu

SEQ ID NO: 1314864 - RNA, 22 nt, Mycobacterium tuberculosis H37Rv
gcugaucaggucuucgauggcc

SEQ ID NO: 1314865 - RNA, 22 nt, Mycobacterium tuberculosis H37Rv
gcugaucuuggcaagccaagcg

SEQ ID NO: 1314866 - RNA, 23 nt, Mycobacterium tuberculosis H37Rv
gcugaucucggucuccacgccgu

SEQ ID NO: 1314867 - RNA, 19 nt, Mycobacterium tuberculosis H37Rv
gcugaccggggcgcccggc

SEQ ID NO: 1314868 - RNA, 15 nt, Mycobacterium tuberculosis H37Rv
gcugaccgaagagcu

SEQ ID NO: 1314869 - RNA, 22 nt, Mycobacterium tuberculosis H37Rv
gcugaccgcuaccagcugggcg

SEQ ID NO: 1314870 - RNA, 20 nt, Mycobacterium tuberculosis H37Rv
gcugaccguggcgccggucg

SEQ ID NO: 1314871 - RNA, 20 nt, Mycobacterium tuberculosis H37Rv
gcugaccugcaugggcagcu

SEQ ID NO: 1314872 - RNA, 19 nt, Mycobacterium tuberculosis H37Rv
gcugacgguuugcggagca

SEQ ID NO: 1314873 - RNA, 15 nt, Mycobacterium tuberculosis H37Rv
gcugacgcccuccug

SEQ ID NO: 1314874 - RNA, 14 nt, Mycobacterium tuberculosis H37Rv
gcugacgcccuccu

SEQ ID NO: 1314875 - RNA, 15 nt, Mycobacterium tuberculosis H37Rv
gcugacgaguugaug

SEQ ID NO: 1314876 - RNA, 22 nt, Mycobacterium tuberculosis H37Rv
gcugaccaugaccgggcuggcc

SEQ ID NO: 1314877 - RNA, 22 nt, Mycobacterium tuberculosis H37Rv
gcugaccagcguccagccgccc

SEQ ID NO: 1314878 - RNA, 21 nt, Mycobacterium tuberculosis H37Rv
gcugaccgacccggaccuggg

SEQ ID NO: 1314879 - RNA, 14 nt, Mycobacterium tuberculosis H37Rv
gcugaccgaagagc

SEQ ID NO: 1314880 - RNA, 14 nt, Mycobacterium tuberculosis H37Rv
gcugaccccgccgg

SEQ ID NO: 1314881 - RNA, 21 nt, Mycobacterium tuberculosis H37Rv
gcugaccccgccggcugcgga

SEQ ID NO: 1314882 - RNA, 23 nt, Mycobacterium tuberculosis H37Rv
gcugaauguugguuugccggcgg

SEQ ID NO: 1314883 - RNA, 14 nt, Mycobacterium tuberculosis H37Rv
gcugaauuggcgcc

SEQ ID NO: 1314884 - RNA, 16 nt, Mycobacterium tuberculosis H37Rv
gcugaauucggcgagc

SEQ ID NO: 1314885 - RNA, 14 nt, Mycobacterium tuberculosis H37Rv
gcugaaggacggca

SEQ ID NO: 1314886 - RNA, 20 nt, Mycobacterium tuberculosis H37Rv
gcugaaauaagggccggcgg

SEQ ID NO: 1314887 - RNA, 20 nt, Mycobacterium tuberculosis H37Rv
gcugaacauuccggcaccuc

SEQ ID NO: 1314888 - RNA, 23 nt, Mycobacterium tuberculosis H37Rv
gcugaacauuccggcaccuccgc

SEQ ID NO: 1314889 - RNA, 20 nt, Mycobacterium tuberculosis H37Rv
gcugaagaucaacaggcguc

SEQ ID NO: 1314890 - RNA, 23 nt, Mycobacterium tuberculosis H37Rv
gcugaagccaggauugccgccgu

SEQ ID NO: 1314891 - RNA, 19 nt, Mycobacterium tuberculosis H37Rv
gcugaagccgcuggaaguc

SEQ ID NO: 1314892 - RNA, 13 nt, Mycobacterium tuberculosis H37Rv
gcugaacgcgagc

SEQ ID NO: 1314893 - RNA, 21 nt, Mycobacterium tuberculosis H37Rv
gcucguguuguugaagcccga

SEQ ID NO: 1314894 - RNA, 20 nt, Mycobacterium tuberculosis H37Rv
gcucgucgucgauccagccc

SEQ ID NO: 1314895 - RNA, 21 nt, Mycobacterium tuberculosis H37Rv
gcucgucgucgauccagccca

SEQ ID NO: 1314896 - RNA, 19 nt, Mycobacterium tuberculosis H37Rv
gcucgugcacgcugagccg

SEQ ID NO: 1314897 - RNA, 16 nt, Mycobacterium tuberculosis H37Rv
gcucgugagccccagc

SEQ ID NO: 1314898 - RNA, 17 nt, Mycobacterium tuberculosis H37Rv
gcucgucgucgauccag

SEQ ID NO: 1314899 - RNA, 20 nt, Mycobacterium tuberculosis H37Rv
gcucgucguacaugggcaga

SEQ ID NO: 1314900 - RNA, 12 nt, Mycobacterium tuberculosis H37Rv
gcucguucaccg

SEQ ID NO: 1314901 - RNA, 18 nt, Mycobacterium tuberculosis H37Rv
gcucgguuugcguccugg

SEQ ID NO: 1314902 - RNA, 20 nt, Mycobacterium tuberculosis H37Rv
gcucgguuugcguccuggug

SEQ ID NO: 1314903 - RNA, 17 nt, Mycobacterium tuberculosis H37Rv
gcucguagacuugcugc

SEQ ID NO: 1314904 - RNA, 14 nt, Mycobacterium tuberculosis H37Rv
gcucguagcccagg

SEQ ID NO: 1314905 - RNA, 17 nt, Mycobacterium tuberculosis H37Rv
gcucguagcggcggcgc

SEQ ID NO: 1314906 - RNA, 14 nt, Mycobacterium tuberculosis H37Rv
gcucguagcuggug

SEQ ID NO: 1314907 - RNA, 21 nt, Mycobacterium tuberculosis H37Rv
gcucgucacgugucccgcaug

SEQ ID NO: 1314908 - RNA, 21 nt, Mycobacterium tuberculosis H37Rv
gcucguccagcgagcgcagca

SEQ ID NO: 1314909 - RNA, 17 nt, Mycobacterium tuberculosis H37Rv
gcucgucauccauccgg

SEQ ID NO: 1314910 - RNA, 13 nt, Mycobacterium tuberculosis H37Rv
gcucgucgagcug

SEQ ID NO: 1314911 - RNA, 14 nt, Mycobacterium tuberculosis H37Rv
gcucgucgccggug

SEQ ID NO: 1314912 - RNA, 22 nt, Mycobacterium tuberculosis H37Rv
gcucgucgcggcccgcgaauac

SEQ ID NO: 1314913 - RNA, 23 nt, Mycobacterium tuberculosis H37Rv
gcucgucgcugaacagacggcuc

SEQ ID NO: 1314914 - RNA, 23 nt, Mycobacterium tuberculosis H37Rv
gcucgucggcgauggccagcacg

SEQ ID NO: 1314915 - RNA, 21 nt, Mycobacterium tuberculosis H37Rv
gcucgucggcgauggccagca

SEQ ID NO: 1314916 - RNA, 20 nt, Mycobacterium tuberculosis H37Rv
gcucgucggcgccggcggcc

SEQ ID NO: 1314917 - RNA, 19 nt, Mycobacterium tuberculosis H37Rv
gcucucuucgcgcgcuggg

SEQ ID NO: 1314918 - RNA, 18 nt, Mycobacterium tuberculosis H37Rv
gcucucguggauggccgc

SEQ ID NO: 1314919 - RNA, 16 nt, Mycobacterium tuberculosis H37Rv
gcucucggcacccggc

SEQ ID NO: 1314920 - RNA, 16 nt, Mycobacterium tuberculosis H37Rv
gcucucggucaguucc

SEQ ID NO: 1314921 - RNA, 22 nt, Mycobacterium tuberculosis H37Rv
gcucucgcucgugcacgcugag

SEQ ID NO: 1314922 - RNA, 20 nt, Mycobacterium tuberculosis H37Rv
gcucucgaguccaggcagcu

SEQ ID NO: 1314923 - RNA, 17 nt, Mycobacterium tuberculosis H37Rv
gcucucauagcgacggc

SEQ ID NO: 1314924 - RNA, 13 nt, Mycobacterium tuberculosis H37Rv
gcucucagcgaca

SEQ ID NO: 1314925 - RNA, 20 nt, Mycobacterium tuberculosis H37Rv
gcucugagcuuggucgccgg

SEQ ID NO: 1314926 - RNA, 18 nt, Mycobacterium tuberculosis H37Rv
gcucugcgccacagcagc

SEQ ID NO: 1314927 - RNA, 17 nt, Mycobacterium tuberculosis H37Rv
gcugaaaauaggccggg

SEQ ID NO: 1314928 - RNA, 14 nt, Mycobacterium tuberculosis H37Rv
gcucuugcgggcag

SEQ ID NO: 1314929 - RNA, 21 nt, Mycobacterium tuberculosis H37Rv
gcgucgcgccugcccggguga

SEQ ID NO: 1314930 - RNA, 14 nt, Mycobacterium tuberculosis H37Rv
gcgucgcgcgccuu

SEQ ID NO: 1314931 - RNA, 14 nt, Mycobacterium tuberculosis H37Rv
gcgucgccgccauu

SEQ ID NO: 1314932 - RNA, 20 nt, Mycobacterium tuberculosis H37Rv
gcgucgccggccuugagcac

SEQ ID NO: 1314933 - RNA, 13 nt, Mycobacterium tuberculosis H37Rv
gcgucggccaccc

SEQ ID NO: 1314934 - RNA, 13 nt, Mycobacterium tuberculosis H37Rv
gcgucggccgcgc

SEQ ID NO: 1314935 - RNA, 17 nt, Mycobacterium tuberculosis H37Rv
gcgucggccgcgcugcu

SEQ ID NO: 1314936 - RNA, 16 nt, Mycobacterium tuberculosis H37Rv
gcgucggagccgggca

SEQ ID NO: 1314937 - RNA, 19 nt, Mycobacterium tuberculosis H37Rv
gcgucggaauacaacagcu

SEQ ID NO: 1314938 - RNA, 18 nt, Mycobacterium tuberculosis H37Rv
gcgucgcggacggugcgg

SEQ ID NO: 1314939 - RNA, 17 nt, Mycobacterium tuberculosis H37Rv
gcgucgucgccggcgcu

SEQ ID NO: 1314940 - RNA, 16 nt, Mycobacterium tuberculosis H37Rv
gcgucgucggccccac

SEQ ID NO: 1314941 - RNA, 21 nt, Mycobacterium tuberculosis H37Rv
gcgucgugccacuuccacggc

SEQ ID NO: 1314942 - RNA, 16 nt, Mycobacterium tuberculosis H37Rv
gcgucgugccacuucc

SEQ ID NO: 1314943 - RNA, 21 nt, Mycobacterium tuberculosis H37Rv
gcgucguagcgcucgugaccg

SEQ ID NO: 1314944 - RNA, 13 nt, Mycobacterium tuberculosis H37Rv
gcgucggcgauga

SEQ ID NO: 1314945 - RNA, 15 nt, Mycobacterium tuberculosis H37Rv
gcgucggcggcuucc

SEQ ID NO: 1314946 - RNA, 19 nt, Mycobacterium tuberculosis H37Rv
gcgugacgaccagccccgc

SEQ ID NO: 1314947 - RNA, 16 nt, Mycobacterium tuberculosis H37Rv
gcgugacgaccagccc

SEQ ID NO: 1314948 - RNA, 15 nt, Mycobacterium tuberculosis H37Rv
gcgugccgacccgcu

SEQ ID NO: 1314949 - RNA, 15 nt, Mycobacterium tuberculosis H37Rv
gcgugccgccgcaga

SEQ ID NO: 1314950 - RNA, 19 nt, Mycobacterium tuberculosis H37Rv
gcgugccggcagcgguggc

SEQ ID NO: 1314951 - RNA, 16 nt, Mycobacterium tuberculosis H37Rv
gcgucguucgcgggug

SEQ ID NO: 1314952 - RNA, 15 nt, Mycobacterium tuberculosis H37Rv
gcgugacccgacaug

SEQ ID NO: 1314953 - RNA, 15 nt, Mycobacterium tuberculosis H37Rv
gcgugacccgccggc

SEQ ID NO: 1314954 - RNA, 18 nt, Mycobacterium tuberculosis H37Rv
gcgugaccgacugcgggu

SEQ ID NO: 1314955 - RNA, 18 nt, Mycobacterium tuberculosis H37Rv
gcgucuccagcuggguga

SEQ ID NO: 1314956 - RNA, 13 nt, Mycobacterium tuberculosis H37Rv
gcgugcggcugcc

SEQ ID NO: 1314957 - RNA, 23 nt, Mycobacterium tuberculosis H37Rv
gcguggcaguacaccggcgugcu

SEQ ID NO: 1314958 - RNA, 14 nt, Mycobacterium tuberculosis H37Rv
gcguggccgccggc

SEQ ID NO: 1314959 - RNA, 20 nt, Mycobacterium tuberculosis H37Rv
gcguggccaauccggcggcg

SEQ ID NO: 1314960 - RNA, 17 nt, Mycobacterium tuberculosis H37Rv
gcguggccgccggcgcu

SEQ ID NO: 1314961 - RNA, 23 nt, Mycobacterium tuberculosis H37Rv
gcguggcuggcaccucccgggcg

SEQ ID NO: 1314962 - RNA, 20 nt, Mycobacterium tuberculosis H37Rv
gcguggcuucacccaacccc

SEQ ID NO: 1314963 - RNA, 23 nt, Mycobacterium tuberculosis H37Rv
gcgugggacgcagucgcaacagu

SEQ ID NO: 1314964 - RNA, 22 nt, Mycobacterium tuberculosis H37Rv
gcgugucguugccagggcgggc

SEQ ID NO: 1314965 - RNA, 16 nt, Mycobacterium tuberculosis H37Rv
gcgugucugcccgagg

SEQ ID NO: 1314966 - RNA, 19 nt, Mycobacterium tuberculosis H37Rv
gcguguccuuugccaccuc

SEQ ID NO: 1314967 - RNA, 21 nt, Mycobacterium tuberculosis H37Rv
gcgugucgagcgccgcaguga

SEQ ID NO: 1314968 - RNA, 12 nt, Mycobacterium tuberculosis H37Rv
gcgugugcucgu

SEQ ID NO: 1314969 - RNA, 15 nt, Mycobacterium tuberculosis H37Rv
gcgugugcgcgugcu

SEQ ID NO: 1314970 - RNA, 15 nt, Mycobacterium tuberculosis H37Rv
gcguguggagcucgc

SEQ ID NO: 1314971 - RNA, 22 nt, Mycobacterium tuberculosis H37Rv
gcguguggcuuugacugcuggg

SEQ ID NO: 1314972 - RNA, 19 nt, Mycobacterium tuberculosis H37Rv
gcguugggcagcuccacca

SEQ ID NO: 1314973 - RNA, 12 nt, Mycobacterium tuberculosis H37Rv
gcguuggcuggu

SEQ ID NO: 1314974 - RNA, 20 nt, Mycobacterium tuberculosis H37Rv
gcguugguggucggcccucc

SEQ ID NO: 1314975 - RNA, 19 nt, Mycobacterium tuberculosis H37Rv
gcguugucggguggcugcu

SEQ ID NO: 1314976 - RNA, 22 nt, Mycobacterium tuberculosis H37Rv
gcguugucuagcugguggugcg

SEQ ID NO: 1314977 - RNA, 16 nt, Mycobacterium tuberculosis H37Rv
gcguugccgaaacccg

SEQ ID NO: 1314978 - RNA, 12 nt, Mycobacterium tuberculosis H37Rv
gcguuggcggcg

SEQ ID NO: 1314979 - RNA, 20 nt, Mycobacterium tuberculosis H37Rv
gcguuggcgaucucgacggc

SEQ ID NO: 1314980 - RNA, 15 nt, Mycobacterium tuberculosis H37Rv
gcguuggccagcagg

SEQ ID NO: 1314981 - RNA, 19 nt, Mycobacterium tuberculosis H37Rv
gcguucagcggccagcagu

SEQ ID NO: 1314982 - RNA, 22 nt, Mycobacterium tuberculosis H37Rv
gcguucagguguugacgccaac

SEQ ID NO: 1314983 - RNA, 19 nt, Mycobacterium tuberculosis H37Rv
gcguucaggaugccaggac

SEQ ID NO: 1314984 - RNA, 23 nt, Mycobacterium tuberculosis H37Rv
gcguucagugauucggccugagc

SEQ ID NO: 1314985 - RNA, 14 nt, Mycobacterium tuberculosis H37Rv
gcguucccccacuc

SEQ ID NO: 1314986 - RNA, 21 nt, Mycobacterium tuberculosis H37Rv
gcguugcacagcagcgguuga

SEQ ID NO: 1314987 - RNA, 19 nt, Mycobacterium tuberculosis H37Rv
gcguugccaggugcuguuu

SEQ ID NO: 1314988 - RNA, 17 nt, Mycobacterium tuberculosis H37Rv
gcguucccacuggaggu

SEQ ID NO: 1314989 - RNA, 17 nt, Mycobacterium tuberculosis H37Rv
gcguuccagcacaccca

SEQ ID NO: 1314990 - RNA, 18 nt, Mycobacterium tuberculosis H37Rv
gcguccgcgaucugcagc

SEQ ID NO: 1314991 - RNA, 19 nt, Mycobacterium tuberculosis H37Rv
gcguccgcccagccgcagc

SEQ ID NO: 1314992 - RNA, 16 nt, Mycobacterium tuberculosis H37Rv
gcgucccggcggucag

SEQ ID NO: 1314993 - RNA, 14 nt, Mycobacterium tuberculosis H37Rv
gcguccauccgcag

SEQ ID NO: 1314994 - RNA, 16 nt, Mycobacterium tuberculosis H37Rv
gcguccauccgcagca

SEQ ID NO: 1314995 - RNA, 16 nt, Mycobacterium tuberculosis H37Rv
gcguccaucgcgcgcc

SEQ ID NO: 1314996 - RNA, 17 nt, Mycobacterium tuberculosis H37Rv
gcguccccagcgccacc

SEQ ID NO: 1314997 - RNA, 17 nt, Mycobacterium tuberculosis H37Rv
gcgucccgccgcaccgc

SEQ ID NO: 1314998 - RNA, 19 nt, Mycobacterium tuberculosis H37Rv
gcguccaccugcuccgcug

SEQ ID NO: 1314999 - RNA, 21 nt, Mycobacterium tuberculosis H37Rv
gcguccacccacgaucagcag

SEQ ID NO: 1315000 - RNA, 22 nt, Mycobacterium tuberculosis H37Rv
gcguccacccacgaucagcagc

SEQ ID NO: 1315001 - RNA, 13 nt, Mycobacterium tuberculosis H37Rv
gcguccagcagcg

SEQ ID NO: 1315002 - RNA, 17 nt, Mycobacterium tuberculosis H37Rv
gcguccaggcgagugaa

SEQ ID NO: 1315003 - RNA, 15 nt, Mycobacterium tuberculosis H37Rv
gcguccaaggcgcug

SEQ ID NO: 1315004 - RNA, 16 nt, Mycobacterium tuberculosis H37Rv
gcguccuccucggugu

SEQ ID NO: 1315005 - RNA, 16 nt, Mycobacterium tuberculosis H37Rv
gcguccucgcccuggc

SEQ ID NO: 1315006 - RNA, 19 nt, Mycobacterium tuberculosis H37Rv
gcguccguagcgauucugg

SEQ ID NO: 1315007 - RNA, 17 nt, Mycobacterium tuberculosis H37Rv
gcguccgucucgcaggc

SEQ ID NO: 1315008 - RNA, 16 nt, Mycobacterium tuberculosis H37Rv
gcguccuugggcgucg

SEQ ID NO: 1315009 - RNA, 21 nt, Mycobacterium tuberculosis H37Rv
gcgucgcaaggcccgcaccgc

SEQ ID NO: 1315010 - RNA, 18 nt, Mycobacterium tuberculosis H37Rv
gcgucgaugucgccgccc

SEQ ID NO: 1315011 - RNA, 18 nt, Mycobacterium tuberculosis H37Rv
gcgucgaugcgcugcuca

SEQ ID NO: 1315012 - RNA, 15 nt, Mycobacterium tuberculosis H37Rv
gcgucgagcagcacc

SEQ ID NO: 1315013 - RNA, 16 nt, Mycobacterium tuberculosis H37Rv
gcgucgagggagcgcc

SEQ ID NO: 1315014 - RNA, 19 nt, Mycobacterium tuberculosis H37Rv
gcgucgacgucgacggcga

SEQ ID NO: 1315015 - RNA, 16 nt, Mycobacterium tuberculosis H37Rv
gcgucgacccagaaca

SEQ ID NO: 1315016 - RNA, 20 nt, Mycobacterium tuberculosis H37Rv
gcgucgacccugcccagcac

SEQ ID NO: 1315017 - RNA, 21 nt, Mycobacterium tuberculosis H37Rv
gcgucgacccugcccagcacc

SEQ ID NO: 1315018 - RNA, 15 nt, Mycobacterium tuberculosis H37Rv
gcgucgaccgcggcc

SEQ ID NO: 1315019 - RNA, 18 nt, Mycobacterium tuberculosis H37Rv
gcgucaaauccagcgagg

SEQ ID NO: 1315020 - RNA, 19 nt, Mycobacterium tuberculosis H37Rv
gcgucaaacaccuccagga

SEQ ID NO: 1315021 - RNA, 18 nt, Mycobacterium tuberculosis H37Rv
gcgucaagggcuggguca

SEQ ID NO: 1315022 - RNA, 16 nt, Mycobacterium tuberculosis H37Rv
gcgucaagggcugggu

SEQ ID NO: 1315023 - RNA, 20 nt, Mycobacterium tuberculosis H37Rv
gcgucacauccgacagcagc

SEQ ID NO: 1315024 - RNA, 15 nt, Mycobacterium tuberculosis H37Rv
gcgucaccgccggug

SEQ ID NO: 1315025 - RNA, 21 nt, Mycobacterium tuberculosis H37Rv
gcgucaccccggucccgccga

SEQ ID NO: 1315026 - RNA, 13 nt, Mycobacterium tuberculosis H37Rv
gcgucaggccagc

SEQ ID NO: 1315027 - RNA, 20 nt, Mycobacterium tuberculosis H37Rv
gcgucagcgccuuguggcac

SEQ ID NO: 1315028 - RNA, 21 nt, Mycobacterium tuberculosis H37Rv
gcgucagccgcaccccgcccg

SEQ ID NO: 1315029 - RNA, 15 nt, Mycobacterium tuberculosis H37Rv
gcgucagcggcgagc

SEQ ID NO: 1315030 - RNA, 17 nt, Mycobacterium tuberculosis H37Rv
gcgucaggugcgcgacc

SEQ ID NO: 1315031 - RNA, 19 nt, Mycobacterium tuberculosis H37Rv
gcgucaguccucaucgagc

SEQ ID NO: 1315032 - RNA, 23 nt, Mycobacterium tuberculosis H37Rv
gcgucaguccucaucgagcgcgc

SEQ ID NO: 1315033 - RNA, 17 nt, Mycobacterium tuberculosis H37Rv
gcgucauccgcggcagg

SEQ ID NO: 1315034 - RNA, 16 nt, Mycobacterium tuberculosis H37Rv
gcggugccggcccugc

SEQ ID NO: 1315035 - RNA, 18 nt, Mycobacterium tuberculosis H37Rv
gcggugccggcggaucug

SEQ ID NO: 1315036 - RNA, 16 nt, Mycobacterium tuberculosis H37Rv
gcggugcccagcagcg

SEQ ID NO: 1315037 - RNA, 13 nt, Mycobacterium tuberculosis H37Rv
gcggugcccagca

SEQ ID NO: 1315038 - RNA, 15 nt, Mycobacterium tuberculosis H37Rv
gcggugcccagcagc

SEQ ID NO: 1315039 - RNA, 18 nt, Mycobacterium tuberculosis H37Rv
gcggugccgacggugggc

SEQ ID NO: 1315040 - RNA, 18 nt, Mycobacterium tuberculosis H37Rv
gcggugcccgcaccagaa

SEQ ID NO: 1315041 - RNA, 18 nt, Mycobacterium tuberculosis H37Rv
gcggugaugggccaggcg

SEQ ID NO: 1315042 - RNA, 16 nt, Mycobacterium tuberculosis H37Rv
gcggugcacacugacc

SEQ ID NO: 1315043 - RNA, 17 nt, Mycobacterium tuberculosis H37Rv
gcguagguggccagcgc

SEQ ID NO: 1315044 - RNA, 18 nt, Mycobacterium tuberculosis H37Rv
gcguauucggcaucgccg

SEQ ID NO: 1315045 - RNA, 17 nt, Mycobacterium tuberculosis H37Rv
gcguauugcaccgccag

SEQ ID NO: 1315046 - RNA, 22 nt, Mycobacterium tuberculosis H37Rv
gcguagcgaccucgccgcggcg

SEQ ID NO: 1315047 - RNA, 17 nt, Mycobacterium tuberculosis H37Rv
gcguagcgaccucgccg

SEQ ID NO: 1315048 - RNA, 13 nt, Mycobacterium tuberculosis H37Rv
gcguagcggggga

SEQ ID NO: 1315049 - RNA, 20 nt, Mycobacterium tuberculosis H37Rv
gcguaggccuugcucagccg

SEQ ID NO: 1315050 - RNA, 17 nt, Mycobacterium tuberculosis H37Rv
gcguagcucgcggggcg

SEQ ID NO: 1315051 - RNA, 16 nt, Mycobacterium tuberculosis H37Rv
gcguagcuggccaggu

SEQ ID NO: 1315052 - RNA, 10 nt, Mycobacterium tuberculosis H37Rv
gcggcaccuu

SEQ ID NO: 1315053 - RNA, 19 nt, Mycobacterium tuberculosis H37Rv
gcggcaccuuguagcgggc

SEQ ID NO: 1315054 - RNA, 16 nt, Mycobacterium tuberculosis H37Rv
gcggcaccgcgccggc

SEQ ID NO: 1315055 - RNA, 21 nt, Mycobacterium tuberculosis H37Rv
gcggcaccucauugccguucu

SEQ ID NO: 1315056 - RNA, 15 nt, Mycobacterium tuberculosis H37Rv
gcggcacgcccacag

SEQ ID NO: 1315057 - RNA, 14 nt, Mycobacterium tuberculosis H37Rv
gcggcacgccggcc

SEQ ID NO: 1315058 - RNA, 15 nt, Mycobacterium tuberculosis H37Rv
gcggcacgccggccg

SEQ ID NO: 1315059 - RNA, 23 nt, Mycobacterium tuberculosis H37Rv
gcggcacggaugcgauggccgac

SEQ ID NO: 1315060 - RNA, 15 nt, Mycobacterium tuberculosis H37Rv
gcggcacgcuccagc

SEQ ID NO: 1315061 - RNA, 15 nt, Mycobacterium tuberculosis H37Rv
gcggcgcccuggccg

SEQ ID NO: 1315062 - RNA, 13 nt, Mycobacterium tuberculosis H37Rv
gcggcgcccaucg

SEQ ID NO: 1315063 - RNA, 19 nt, Mycobacterium tuberculosis H37Rv
gcggcgcccaucgcgacgg

SEQ ID NO: 1315064 - RNA, 12 nt, Mycobacterium tuberculosis H37Rv
gcggcgccgggg

SEQ ID NO: 1315065 - RNA, 12 nt, Mycobacterium tuberculosis H37Rv
gcggcgccgcaa

SEQ ID NO: 1315066 - RNA, 14 nt, Mycobacterium tuberculosis H37Rv
gcggcgccgccauc

SEQ ID NO: 1315067 - RNA, 19 nt, Mycobacterium tuberculosis H37Rv
gcggcgccaguauggccgc

SEQ ID NO: 1315068 - RNA, 23 nt, Mycobacterium tuberculosis H37Rv
gcggcgccauagccgcgacccgc

SEQ ID NO: 1315069 - RNA, 19 nt, Mycobacterium tuberculosis H37Rv
gcggcgccacccgcgccgc

SEQ ID NO: 1315070 - RNA, 19 nt, Mycobacterium tuberculosis H37Rv
gcggcgccugaggugcugc

SEQ ID NO: 1315071 - RNA, 12 nt, Mycobacterium tuberculosis H37Rv
gcggcgccgucg

SEQ ID NO: 1315072 - RNA, 20 nt, Mycobacterium tuberculosis H37Rv
gcggcggaccguccgacggc

SEQ ID NO: 1315073 - RNA, 15 nt, Mycobacterium tuberculosis H37Rv
gcggcggagccgggu

SEQ ID NO: 1315074 - RNA, 21 nt, Mycobacterium tuberculosis H37Rv
gcggcggauggcgucgaccac

SEQ ID NO: 1315075 - RNA, 20 nt, Mycobacterium tuberculosis H37Rv
gcggcggcacuggugcccga

SEQ ID NO: 1315076 - RNA, 17 nt, Mycobacterium tuberculosis H37Rv
gcggcggccgcagcggc

SEQ ID NO: 1315077 - RNA, 14 nt, Mycobacterium tuberculosis H37Rv
gcggcggccgcagc

SEQ ID NO: 1315078 - RNA, 15 nt, Mycobacterium tuberculosis H37Rv
gcggcggccgcagcg

SEQ ID NO: 1315079 - RNA, 13 nt, Mycobacterium tuberculosis H37Rv
gcggcggccagcg

SEQ ID NO: 1315080 - RNA, 12 nt, Mycobacterium tuberculosis H37Rv
gcggcgggcccg

SEQ ID NO: 1315081 - RNA, 20 nt, Mycobacterium tuberculosis H37Rv
gcggcggcaucgaggccagc

SEQ ID NO: 1315082 - RNA, 13 nt, Mycobacterium tuberculosis H37Rv
gcggcggccagga

SEQ ID NO: 1315083 - RNA, 22 nt, Mycobacterium tuberculosis H37Rv
gcggcggugcagcagggcgcgc

SEQ ID NO: 1315084 - RNA, 15 nt, Mycobacterium tuberculosis H37Rv
gcggcggucugggug

SEQ ID NO: 1315085 - RNA, 14 nt, Mycobacterium tuberculosis H37Rv
gcggcggucucguc

SEQ ID NO: 1315086 - RNA, 22 nt, Mycobacterium tuberculosis H37Rv
gcggcgguggcguuacgggcga

SEQ ID NO: 1315087 - RNA, 18 nt, Mycobacterium tuberculosis H37Rv
gcggcgguccgcgcgacc

SEQ ID NO: 1315088 - RNA, 14 nt, Mycobacterium tuberculosis H37Rv
gcggcggucggcug

SEQ ID NO: 1315089 - RNA, 16 nt, Mycobacterium tuberculosis H37Rv
gcggcggucggcuggg

SEQ ID NO: 1315090 - RNA, 22 nt, Mycobacterium tuberculosis H37Rv
gcggcggucggcugggcgaagc

SEQ ID NO: 1315091 - RNA, 18 nt, Mycobacterium tuberculosis H37Rv
gcggcgggggcggcggcu

SEQ ID NO: 1315092 - RNA, 14 nt, Mycobacterium tuberculosis H37Rv
gcggcgggcgauga

SEQ ID NO: 1315093 - RNA, 22 nt, Mycobacterium tuberculosis H37Rv
gcggcgggggcgucgccgccgg

SEQ ID NO: 1315094 - RNA, 16 nt, Mycobacterium tuberculosis H37Rv
gcggcgugcccgucgu

SEQ ID NO: 1315095 - RNA, 15 nt, Mycobacterium tuberculosis H37Rv
gcggcgugccgggug

SEQ ID NO: 1315096 - RNA, 16 nt, Mycobacterium tuberculosis H37Rv
gcggcgugcuccugcc

SEQ ID NO: 1315097 - RNA, 19 nt, Mycobacterium tuberculosis H37Rv
gcggcguuggugcagucgg

SEQ ID NO: 1315098 - RNA, 14 nt, Mycobacterium tuberculosis H37Rv
gcggcgucgacggc

SEQ ID NO: 1315099 - RNA, 17 nt, Mycobacterium tuberculosis H37Rv
gcggcgucggucgggug

SEQ ID NO: 1315100 - RNA, 18 nt, Mycobacterium tuberculosis H37Rv
gcggcgucguggaucuuc

SEQ ID NO: 1315101 - RNA, 19 nt, Mycobacterium tuberculosis H37Rv
gcggcgucuagcccgccau

SEQ ID NO: 1315102 - RNA, 18 nt, Mycobacterium tuberculosis H37Rv
gcggcgucggugagcgcg

SEQ ID NO: 1315103 - RNA, 17 nt, Mycobacterium tuberculosis H37Rv
gcggcgucaaauccagc

SEQ ID NO: 1315104 - RNA, 16 nt, Mycobacterium tuberculosis H37Rv
gcggcguccagcagcg

SEQ ID NO: 1315105 - RNA, 22 nt, Mycobacterium tuberculosis H37Rv
gcggcuggggccccgcgccggc

SEQ ID NO: 1315106 - RNA, 16 nt, Mycobacterium tuberculosis H37Rv
gcggcugggcggucgg

SEQ ID NO: 1315107 - RNA, 18 nt, Mycobacterium tuberculosis H37Rv
gcggcugucacgccugcc

SEQ ID NO: 1315108 - RNA, 23 nt, Mycobacterium tuberculosis H37Rv
gcggcuggcccgcaugccggcgc

SEQ ID NO: 1315109 - RNA, 17 nt, Mycobacterium tuberculosis H37Rv
gcgggaaccccccauag

SEQ ID NO: 1315110 - RNA, 23 nt, Mycobacterium tuberculosis H37Rv
gcgggaaccccccauagcaagaa

SEQ ID NO: 1315111 - RNA, 19 nt, Mycobacterium tuberculosis H37Rv
gcgggaaaacgggguggca

SEQ ID NO: 1315112 - RNA, 18 nt, Mycobacterium tuberculosis H37Rv
gcgggaaacccaugcaug

SEQ ID NO: 1315113 - RNA, 18 nt, Mycobacterium tuberculosis H37Rv
gcggcuugucgccccaug

SEQ ID NO: 1315114 - RNA, 17 nt, Mycobacterium tuberculosis H37Rv
gcggcugucggccgggu

SEQ ID NO: 1315115 - RNA, 17 nt, Mycobacterium tuberculosis H37Rv
gcggcuaggccagcacg

SEQ ID NO: 1315116 - RNA, 21 nt, Mycobacterium tuberculosis H37Rv
gcggcuaggccagcacggcga

SEQ ID NO: 1315117 - RNA, 21 nt, Mycobacterium tuberculosis H37Rv
gcggcucaaccucuggcggcg

SEQ ID NO: 1315118 - RNA, 15 nt, Mycobacterium tuberculosis H37Rv
gcggcucacgggcga

SEQ ID NO: 1315119 - RNA, 19 nt, Mycobacterium tuberculosis H37Rv
gcggcucagaacccuccgu

SEQ ID NO: 1315120 - RNA, 16 nt, Mycobacterium tuberculosis H37Rv
gcggcugcugcgcggu

SEQ ID NO: 1315121 - RNA, 22 nt, Mycobacterium tuberculosis H37Rv
gcggcugcuuggucgcccagcc

SEQ ID NO: 1315122 - RNA, 21 nt, Mycobacterium tuberculosis H37Rv
gcggcugcgggcccggcggcc

SEQ ID NO: 1315123 - RNA, 22 nt, Mycobacterium tuberculosis H37Rv
gcggcugcgggcccggcggcca

SEQ ID NO: 1315124 - RNA, 15 nt, Mycobacterium tuberculosis H37Rv
gcggcuccgcccggc

SEQ ID NO: 1315125 - RNA, 18 nt, Mycobacterium tuberculosis H37Rv
gcggcuccgagggcugcg

SEQ ID NO: 1315126 - RNA, 14 nt, Mycobacterium tuberculosis H37Rv
gcgggcgcgggugg

SEQ ID NO: 1315127 - RNA, 15 nt, Mycobacterium tuberculosis H37Rv
gcgggcgcggguggc

SEQ ID NO: 1315128 - RNA, 21 nt, Mycobacterium tuberculosis H37Rv
gcgggcgccuuggucgccgcc

SEQ ID NO: 1315129 - RNA, 14 nt, Mycobacterium tuberculosis H37Rv
gcgggcgccgggaa

SEQ ID NO: 1315130 - RNA, 22 nt, Mycobacterium tuberculosis H37Rv
gcgggcgccuuccaggcgggcg

SEQ ID NO: 1315131 - RNA, 18 nt, Mycobacterium tuberculosis H37Rv
gcgggcgccuuccaggcg

SEQ ID NO: 1315132 - RNA, 13 nt, Mycobacterium tuberculosis H37Rv
gcgggcggugggc

SEQ ID NO: 1315133 - RNA, 12 nt, Mycobacterium tuberculosis H37Rv
gcgggcggcgcu

SEQ ID NO: 1315134 - RNA, 16 nt, Mycobacterium tuberculosis H37Rv
gcgggcgugccgacca

SEQ ID NO: 1315135 - RNA, 13 nt, Mycobacterium tuberculosis H37Rv
gcgggcgugagug

SEQ ID NO: 1315136 - RNA, 21 nt, Mycobacterium tuberculosis H37Rv
gcgggggcuuaugcgucugcu

SEQ ID NO: 1315137 - RNA, 17 nt, Mycobacterium tuberculosis H37Rv
gcgggggcgucgccgcc

SEQ ID NO: 1315138 - RNA, 22 nt, Mycobacterium tuberculosis H37Rv
gcggggguggaaucagggucug

SEQ ID NO: 1315139 - RNA, 14 nt, Mycobacterium tuberculosis H37Rv
gcgggguaggccca

SEQ ID NO: 1315140 - RNA, 20 nt, Mycobacterium tuberculosis H37Rv
gcgggguggcggcgcugcgc

SEQ ID NO: 1315141 - RNA, 24 nt, Mycobacterium tuberculosis H37Rv
gcgggguuggccguggucgaggug

SEQ ID NO: 1315142 - RNA, 19 nt, Mycobacterium tuberculosis H37Rv
gcggggugagggggugguc

SEQ ID NO: 1315143 - RNA, 13 nt, Mycobacterium tuberculosis H37Rv
gcgggcucggucc

SEQ ID NO: 1315144 - RNA, 20 nt, Mycobacterium tuberculosis H37Rv
gcgggcucuacucgcggccg

SEQ ID NO: 1315145 - RNA, 19 nt, Mycobacterium tuberculosis H37Rv
gcgggcugaucgcccggcg

SEQ ID NO: 1315146 - RNA, 23 nt, Mycobacterium tuberculosis H37Rv
gcgggcucgcuucaggcaccgga

SEQ ID NO: 1315147 - RNA, 20 nt, Mycobacterium tuberculosis H37Rv
gcgggcguuggccagcaggu

SEQ ID NO: 1315148 - RNA, 19 nt, Mycobacterium tuberculosis H37Rv
gcgggacagauggcggccg

SEQ ID NO: 1315149 - RNA, 14 nt, Mycobacterium tuberculosis H37Rv
gcgggacaccaccg

SEQ ID NO: 1315150 - RNA, 21 nt, Mycobacterium tuberculosis H37Rv
gcgggaccuucgagccgcaca

SEQ ID NO: 1315151 - RNA, 23 nt, Mycobacterium tuberculosis H37Rv
gcgggacgccgaauacggcugcc

SEQ ID NO: 1315152 - RNA, 19 nt, Mycobacterium tuberculosis H37Rv
gcgggaaguucgucgguug

SEQ ID NO: 1315153 - RNA, 23 nt, Mycobacterium tuberculosis H37Rv
gcgggaagucccgaguggccggu

SEQ ID NO: 1315154 - RNA, 17 nt, Mycobacterium tuberculosis H37Rv
gcgggaagugauguggc

SEQ ID NO: 1315155 - RNA, 16 nt, Mycobacterium tuberculosis H37Rv
gcgggaacgcggcggc

SEQ ID NO: 1315156 - RNA, 22 nt, Mycobacterium tuberculosis H37Rv
gcgggaacgaucgaugaccuuu

SEQ ID NO: 1315157 - RNA, 19 nt, Mycobacterium tuberculosis H37Rv
gcgggacaaaaucagcagc

SEQ ID NO: 1315158 - RNA, 18 nt, Mycobacterium tuberculosis H37Rv
gcgggacaaaaucagcag

SEQ ID NO: 1315159 - RNA, 15 nt, Mycobacterium tuberculosis H37Rv
gcgggcccggcggcc

SEQ ID NO: 1315160 - RNA, 23 nt, Mycobacterium tuberculosis H37Rv
gcgggcccucuaugcgggcagcg

SEQ ID NO: 1315161 - RNA, 17 nt, Mycobacterium tuberculosis H37Rv
gcgggccgacgcaggug

SEQ ID NO: 1315162 - RNA, 16 nt, Mycobacterium tuberculosis H37Rv
gcgggcccgcgcggcg

SEQ ID NO: 1315163 - RNA, 12 nt, Mycobacterium tuberculosis H37Rv
gcgggcccgcgc

SEQ ID NO: 1315164 - RNA, 15 nt, Mycobacterium tuberculosis H37Rv
gcgggcccgccggcc

SEQ ID NO: 1315165 - RNA, 13 nt, Mycobacterium tuberculosis H37Rv
gcgggcccgccgg

SEQ ID NO: 1315166 - RNA, 14 nt, Mycobacterium tuberculosis H37Rv
gcgggcccgccggc

SEQ ID NO: 1315167 - RNA, 15 nt, Mycobacterium tuberculosis H37Rv
gcgggccggucgugc

SEQ ID NO: 1315168 - RNA, 15 nt, Mycobacterium tuberculosis H37Rv
gcgggccgcgcggcg

SEQ ID NO: 1315169 - RNA, 22 nt, Mycobacterium tuberculosis H37Rv
gcgggccguagaucccgaagcg

SEQ ID NO: 1315170 - RNA, 14 nt, Mycobacterium tuberculosis H37Rv
gcggguaggugacg

SEQ ID NO: 1315171 - RNA, 17 nt, Mycobacterium tuberculosis H37Rv
gcgggucuuggcacaca

SEQ ID NO: 1315172 - RNA, 18 nt, Mycobacterium tuberculosis H37Rv
gcgggugaucugggcggu

SEQ ID NO: 1315173 - RNA, 14 nt, Mycobacterium tuberculosis H37Rv
gcgggugcggauca

SEQ ID NO: 1315174 - RNA, 23 nt, Mycobacterium tuberculosis H37Rv
gcgggugcuggucaacagcggca

SEQ ID NO: 1315175 - RNA, 18 nt, Mycobacterium tuberculosis H37Rv
gcggguggcgccaggucg

SEQ ID NO: 1315176 - RNA, 23 nt, Mycobacterium tuberculosis H37Rv
gcgguaaaugccugcccaccuuc

SEQ ID NO: 1315177 - RNA, 21 nt, Mycobacterium tuberculosis H37Rv
gcggguuugaucuccaccuuc

SEQ ID NO: 1315178 - RNA, 16 nt, Mycobacterium tuberculosis H37Rv
gcggguuugccgggcg

SEQ ID NO: 1315179 - RNA, 18 nt, Mycobacterium tuberculosis H37Rv
gcgguaccggaaucggcg

SEQ ID NO: 1315180 - RNA, 18 nt, Mycobacterium tuberculosis H37Rv
gcgguaccuagccgcaga

SEQ ID NO: 1315181 - RNA, 21 nt, Mycobacterium tuberculosis H37Rv
gcgguaccgccgcggucggac

SEQ ID NO: 1315182 - RNA, 23 nt, Mycobacterium tuberculosis H37Rv
gcggucuuuuugggcuugcccca

SEQ ID NO: 1315183 - RNA, 17 nt, Mycobacterium tuberculosis H37Rv
gcggucuuggcgcgccc

SEQ ID NO: 1315184 - RNA, 17 nt, Mycobacterium tuberculosis H37Rv
gcggugaacaccgccag

SEQ ID NO: 1315185 - RNA, 20 nt, Mycobacterium tuberculosis H37Rv
gcggugacucggccuccgcc

SEQ ID NO: 1315186 - RNA, 13 nt, Mycobacterium tuberculosis H37Rv
gcgguccgagcgg

SEQ ID NO: 1315187 - RNA, 16 nt, Mycobacterium tuberculosis H37Rv
gcggucgagccaccca

SEQ ID NO: 1315188 - RNA, 18 nt, Mycobacterium tuberculosis H37Rv
gcggucgagguggcgggc

SEQ ID NO: 1315189 - RNA, 19 nt, Mycobacterium tuberculosis H37Rv
gcggucgugaucagcagga

SEQ ID NO: 1315190 - RNA, 19 nt, Mycobacterium tuberculosis H37Rv
gcggucugcgcgucgcgug

SEQ ID NO: 1315191 - RNA, 17 nt, Mycobacterium tuberculosis H37Rv
gcggucugcuccaggcg

SEQ ID NO: 1315192 - RNA, 22 nt, Mycobacterium tuberculosis H37Rv
gcgguccaccggcccucgccag

SEQ ID NO: 1315193 - RNA, 20 nt, Mycobacterium tuberculosis H37Rv
gcgguccaccggcccucgcc

SEQ ID NO: 1315194 - RNA, 15 nt, Mycobacterium tuberculosis H37Rv
gcgguccaggccggc

SEQ ID NO: 1315195 - RNA, 23 nt, Mycobacterium tuberculosis H37Rv
gcgguccagacaucagugcgccg

SEQ ID NO: 1315196 - RNA, 17 nt, Mycobacterium tuberculosis H37Rv
gcggucccacggccggc

SEQ ID NO: 1315197 - RNA, 20 nt, Mycobacterium tuberculosis H37Rv
gcgguagcagccgcugagcg

SEQ ID NO: 1315198 - RNA, 16 nt, Mycobacterium tuberculosis H37Rv
gcgguagagcucuggu

SEQ ID NO: 1315199 - RNA, 16 nt, Mycobacterium tuberculosis H37Rv
gcgguagcugcccagc

SEQ ID NO: 1315200 - RNA, 20 nt, Mycobacterium tuberculosis H37Rv
gcgguaggcuugcaaggucg

SEQ ID NO: 1315201 - RNA, 23 nt, Mycobacterium tuberculosis H37Rv
gcgguaggcguugaucgccgggc

SEQ ID NO: 1315202 - RNA, 21 nt, Mycobacterium tuberculosis H37Rv
gcgguagucggccagcucgcg

SEQ ID NO: 1315203 - RNA, 16 nt, Mycobacterium tuberculosis H37Rv
gcgguagucgccgagg

SEQ ID NO: 1315204 - RNA, 22 nt, Mycobacterium tuberculosis H37Rv
gcgguaguugucccgccgcgcg

SEQ ID NO: 1315205 - RNA, 22 nt, Mycobacterium tuberculosis H37Rv
gcaugaccccgucagcgggcag

SEQ ID NO: 1315206 - RNA, 23 nt, Mycobacterium tuberculosis H37Rv
gcaugaccccgucagcgggcagc

SEQ ID NO: 1315207 - RNA, 23 nt, Mycobacterium tuberculosis H37Rv
gcaugaagugaaaguucaugcca

SEQ ID NO: 1315208 - RNA, 20 nt, Mycobacterium tuberculosis H37Rv
gcaugaacugcucgccgagg

SEQ ID NO: 1315209 - RNA, 19 nt, Mycobacterium tuberculosis H37Rv
gcaugccacacacugccgg

SEQ ID NO: 1315210 - RNA, 14 nt, Mycobacterium tuberculosis H37Rv
gcaugccacacacu

SEQ ID NO: 1315211 - RNA, 22 nt, Mycobacterium tuberculosis H37Rv
gcaugccagccacgaacugauc

SEQ ID NO: 1315212 - RNA, 21 nt, Mycobacterium tuberculosis H37Rv
gcaugcacgucaucggcuggc

SEQ ID NO: 1315213 - RNA, 18 nt, Mycobacterium tuberculosis H37Rv
gcaugcaaugcuggcggc

SEQ ID NO: 1315214 - RNA, 20 nt, Mycobacterium tuberculosis H37Rv
gcaugcaaugcuggcggcgc

SEQ ID NO: 1315215 - RNA, 20 nt, Mycobacterium tuberculosis H37Rv
gcaugcaaacggaugguucu

SEQ ID NO: 1315216 - RNA, 14 nt, Mycobacterium tuberculosis H37Rv
gcaugccgggaagg

SEQ ID NO: 1315217 - RNA, 12 nt, Mycobacterium tuberculosis H37Rv
gcaugcccugga

SEQ ID NO: 1315218 - RNA, 23 nt, Mycobacterium tuberculosis H37Rv
gcaugccgcccgcuccugcucgu

SEQ ID NO: 1315219 - RNA, 14 nt, Mycobacterium tuberculosis H37Rv
gcaugcccgccauc

SEQ ID NO: 1315220 - RNA, 14 nt, Mycobacterium tuberculosis H37Rv
gcaucggcagcagc

SEQ ID NO: 1315221 - RNA, 14 nt, Mycobacterium tuberculosis H37Rv
gcaucggcagcccc

SEQ ID NO: 1315222 - RNA, 21 nt, Mycobacterium tuberculosis H37Rv
gcaucgcgccuuugagcccgc

SEQ ID NO: 1315223 - RNA, 13 nt, Mycobacterium tuberculosis H37Rv
gcaucggccccca

SEQ ID NO: 1315224 - RNA, 19 nt, Mycobacterium tuberculosis H37Rv
gcaucggcggggcccacac

SEQ ID NO: 1315225 - RNA, 18 nt, Mycobacterium tuberculosis H37Rv
gcaucggugcagcccgcc

SEQ ID NO: 1315226 - RNA, 15 nt, Mycobacterium tuberculosis H37Rv
gcaucggugguaaca

SEQ ID NO: 1315227 - RNA, 16 nt, Mycobacterium tuberculosis H37Rv
gcaucggugcagcccg

SEQ ID NO: 1315228 - RNA, 18 nt, Mycobacterium tuberculosis H37Rv
gcaucggucagcgcggca

SEQ ID NO: 1315229 - RNA, 13 nt, Mycobacterium tuberculosis H37Rv
gcaucggcgguuc

SEQ ID NO: 1315230 - RNA, 22 nt, Mycobacterium tuberculosis H37Rv
gcaucgccaccaucaccgccuu

SEQ ID NO: 1315231 - RNA, 14 nt, Mycobacterium tuberculosis H37Rv
gcaucgcaccaggu

SEQ ID NO: 1315232 - RNA, 20 nt, Mycobacterium tuberculosis H37Rv
gcaucgcgauuccggcggcc

SEQ ID NO: 1315233 - RNA, 14 nt, Mycobacterium tuberculosis H37Rv
gcaucgcggcggcg

SEQ ID NO: 1315234 - RNA, 15 nt, Mycobacterium tuberculosis H37Rv
gcaucgcgggcggcg

SEQ ID NO: 1315235 - RNA, 16 nt, Mycobacterium tuberculosis H37Rv
gcaucgcgagccagcu

SEQ ID NO: 1315236 - RNA, 18 nt, Mycobacterium tuberculosis H37Rv
gcaucgccuccaggcgcc

SEQ ID NO: 1315237 - RNA, 14 nt, Mycobacterium tuberculosis H37Rv
gcaucgccuccucg

SEQ ID NO: 1315238 - RNA, 21 nt, Mycobacterium tuberculosis H37Rv
gcaucgccgucaacgccucug

SEQ ID NO: 1315239 - RNA, 21 nt, Mycobacterium tuberculosis H37Rv
gcaucgccaccaucaccgccu

SEQ ID NO: 1315240 - RNA, 19 nt, Mycobacterium tuberculosis H37Rv
gcaucuccucgccugcccg

SEQ ID NO: 1315241 - RNA, 20 nt, Mycobacterium tuberculosis H37Rv
gcaucucgggcgaagccgcu

SEQ ID NO: 1315242 - RNA, 17 nt, Mycobacterium tuberculosis H37Rv
gcaucgucgccauaccu

SEQ ID NO: 1315243 - RNA, 14 nt, Mycobacterium tuberculosis H37Rv
gcaucguggccgca

SEQ ID NO: 1315244 - RNA, 22 nt, Mycobacterium tuberculosis H37Rv
gcaucuccgucggccaggccac

SEQ ID NO: 1315245 - RNA, 20 nt, Mycobacterium tuberculosis H37Rv
gcaucuccgucggccaggcc

SEQ ID NO: 1315246 - RNA, 16 nt, Mycobacterium tuberculosis H37Rv
gcaucguugccgaccg

SEQ ID NO: 1315247 - RNA, 15 nt, Mycobacterium tuberculosis H37Rv
gcauggacaacagcu

SEQ ID NO: 1315248 - RNA, 15 nt, Mycobacterium tuberculosis H37Rv
gcaugcguuggggca

SEQ ID NO: 1315249 - RNA, 22 nt, Mycobacterium tuberculosis H37Rv
gcaugcgugacccgacaugguc

SEQ ID NO: 1315250 - RNA, 15 nt, Mycobacterium tuberculosis H37Rv
gcauggcccuggcga

SEQ ID NO: 1315251 - RNA, 15 nt, Mycobacterium tuberculosis H37Rv
gcaugguccacagcc

SEQ ID NO: 1315252 - RNA, 19 nt, Mycobacterium tuberculosis H37Rv
gcaugguccacagccggcg

SEQ ID NO: 1315253 - RNA, 20 nt, Mycobacterium tuberculosis H37Rv
gcaugggcggauaguucacc

SEQ ID NO: 1315254 - RNA, 13 nt, Mycobacterium tuberculosis H37Rv
gcaugggccaggu

SEQ ID NO: 1315255 - RNA, 18 nt, Mycobacterium tuberculosis H37Rv
gcauggcggcuggugcgg

SEQ ID NO: 1315256 - RNA, 20 nt, Mycobacterium tuberculosis H37Rv
gcaugguuagcggugauggg

SEQ ID NO: 1315257 - RNA, 20 nt, Mycobacterium tuberculosis H37Rv
gcaugucgccgaacgccacc

SEQ ID NO: 1315258 - RNA, 24 nt, Mycobacterium tuberculosis H37Rv
gcaugugaaagacaacccgcucgg

SEQ ID NO: 1315259 - RNA, 22 nt, Mycobacterium tuberculosis H37Rv
gcaugugacaucgggccgccga

SEQ ID NO: 1315260 - RNA, 20 nt, Mycobacterium tuberculosis H37Rv
gcaugucucgggcgcgggug

SEQ ID NO: 1315261 - RNA, 21 nt, Mycobacterium tuberculosis H37Rv
gcaugugaaagacaacccgcu

SEQ ID NO: 1315262 - RNA, 17 nt, Mycobacterium tuberculosis H37Rv
gcaugucgggccaggcg

SEQ ID NO: 1315263 - RNA, 20 nt, Mycobacterium tuberculosis H37Rv
gcauguugcaggcgcagcug

SEQ ID NO: 1315264 - RNA, 19 nt, Mycobacterium tuberculosis H37Rv
gcauucccgcucgcaggcc

SEQ ID NO: 1315265 - RNA, 23 nt, Mycobacterium tuberculosis H37Rv
gcauucccgcggcaacgcggucu

SEQ ID NO: 1315266 - RNA, 16 nt, Mycobacterium tuberculosis H37Rv
gcauugaagaauggac

SEQ ID NO: 1315267 - RNA, 16 nt, Mycobacterium tuberculosis H37Rv
gcauugaagaagcccg

SEQ ID NO: 1315268 - RNA, 17 nt, Mycobacterium tuberculosis H37Rv
gcauugaagaagcccga

SEQ ID NO: 1315269 - RNA, 15 nt, Mycobacterium tuberculosis H37Rv
gcauugaagaagccc

SEQ ID NO: 1315270 - RNA, 18 nt, Mycobacterium tuberculosis H37Rv
gcauugcuccgguuggcg

SEQ ID NO: 1315271 - RNA, 15 nt, Mycobacterium tuberculosis H37Rv
gcauuggcggcgguc

SEQ ID NO: 1315272 - RNA, 16 nt, Mycobacterium tuberculosis H37Rv
gcauugcggcccgcga

SEQ ID NO: 1315273 - RNA, 19 nt, Mycobacterium tuberculosis H37Rv
gcauugcccauagccaggu

SEQ ID NO: 1315274 - RNA, 21 nt, Mycobacterium tuberculosis H37Rv
gccaacugggccgagcgcgcc

SEQ ID NO: 1315275 - RNA, 18 nt, Mycobacterium tuberculosis H37Rv
gccaacucuucagcaagc

SEQ ID NO: 1315276 - RNA, 19 nt, Mycobacterium tuberculosis H37Rv
gccaacgugacgccggcca

SEQ ID NO: 1315277 - RNA, 21 nt, Mycobacterium tuberculosis H37Rv
gccaacgugacgccggccagu

SEQ ID NO: 1315278 - RNA, 17 nt, Mycobacterium tuberculosis H37Rv
gccaacgugacgccggc

SEQ ID NO: 1315279 - RNA, 18 nt, Mycobacterium tuberculosis H37Rv
gccaacgcgucccgccgc

SEQ ID NO: 1315280 - RNA, 20 nt, Mycobacterium tuberculosis H37Rv
gccaacgcgucccgccgcac

SEQ ID NO: 1315281 - RNA, 14 nt, Mycobacterium tuberculosis H37Rv
gccaacgagcgcgc

SEQ ID NO: 1315282 - RNA, 18 nt, Mycobacterium tuberculosis H37Rv
gccaacgaugaugaugac

SEQ ID NO: 1315283 - RNA, 14 nt, Mycobacterium tuberculosis H37Rv
gccaacgcgcgacc

SEQ ID NO: 1315284 - RNA, 16 nt, Mycobacterium tuberculosis H37Rv
gccaagaccagaagcc

SEQ ID NO: 1315285 - RNA, 14 nt, Mycobacterium tuberculosis H37Rv
gccaagaccgcggc

SEQ ID NO: 1315286 - RNA, 20 nt, Mycobacterium tuberculosis H37Rv
gccaagacggcgggcccggg

SEQ ID NO: 1315287 - RNA, 18 nt, Mycobacterium tuberculosis H37Rv
gccaagcgacucgccggc

SEQ ID NO: 1315288 - RNA, 14 nt, Mycobacterium tuberculosis H37Rv
gccaagcgagcggc

SEQ ID NO: 1315289 - RNA, 17 nt, Mycobacterium tuberculosis H37Rv
gccaagcgacucgccgg

SEQ ID NO: 1315290 - RNA, 16 nt, Mycobacterium tuberculosis H37Rv
gccaagcccaggcgau

SEQ ID NO: 1315291 - RNA, 18 nt, Mycobacterium tuberculosis H37Rv
gccaagccgugccgcaca

SEQ ID NO: 1315292 - RNA, 19 nt, Mycobacterium tuberculosis H37Rv
gccaagccgcggcuaggcc

SEQ ID NO: 1315293 - RNA, 14 nt, Mycobacterium tuberculosis H37Rv
gccaaccugggcca

SEQ ID NO: 1315294 - RNA, 17 nt, Mycobacterium tuberculosis H37Rv
gccaaccugaagccagc

SEQ ID NO: 1315295 - RNA, 12 nt, Mycobacterium tuberculosis H37Rv
gccaacccgggc

SEQ ID NO: 1315296 - RNA, 24 nt, Mycobacterium tuberculosis H37Rv
gccaaccggcgcaguagccgacca

SEQ ID NO: 1315297 - RNA, 14 nt, Mycobacterium tuberculosis H37Rv
gccaacccugcggc

SEQ ID NO: 1315298 - RNA, 17 nt, Mycobacterium tuberculosis H37Rv
gccaacccugcggcguc

SEQ ID NO: 1315299 - RNA, 17 nt, Mycobacterium tuberculosis H37Rv
gccaacccggcgggccc

SEQ ID NO: 1315300 - RNA, 19 nt, Mycobacterium tuberculosis H37Rv
gccaacagaugccacccag

SEQ ID NO: 1315301 - RNA, 12 nt, Mycobacterium tuberculosis H37Rv
gccaacagaugc

SEQ ID NO: 1315302 - RNA, 11 nt, Mycobacterium tuberculosis H37Rv
gccaacaccuc

SEQ ID NO: 1315303 - RNA, 19 nt, Mycobacterium tuberculosis H37Rv
gccaacaccgccagcauga

SEQ ID NO: 1315304 - RNA, 16 nt, Mycobacterium tuberculosis H37Rv
gccaacaccaaccagu

SEQ ID NO: 1315305 - RNA, 18 nt, Mycobacterium tuberculosis H37Rv
gccaacaacaucagcgac

SEQ ID NO: 1315306 - RNA, 19 nt, Mycobacterium tuberculosis H37Rv
gccaaaucggccaaaugcc

SEQ ID NO: 1315307 - RNA, 12 nt, Mycobacterium tuberculosis H37Rv
gccaaagcccac

SEQ ID NO: 1315308 - RNA, 21 nt, Mycobacterium tuberculosis H37Rv
gccaaagccgggauugccgcc

SEQ ID NO: 1315309 - RNA, 21 nt, Mycobacterium tuberculosis H37Rv
gccaaacuacccgcccacggc

SEQ ID NO: 1315310 - RNA, 16 nt, Mycobacterium tuberculosis H37Rv
gccaaaacgagcagau

SEQ ID NO: 1315311 - RNA, 22 nt, Mycobacterium tuberculosis H37Rv
gccaaaacgagcagauggugaa

SEQ ID NO: 1315312 - RNA, 11 nt, Mycobacterium tuberculosis H37Rv
gccaaaagggc

SEQ ID NO: 1315313 - RNA, 20 nt, Mycobacterium tuberculosis H37Rv
gccaaaaaggaucccgccgc

SEQ ID NO: 1315314 - RNA, 21 nt, Mycobacterium tuberculosis H37Rv
gccaaaagggcggcagcgagg

SEQ ID NO: 1315315 - RNA, 13 nt, Mycobacterium tuberculosis H37Rv
gcauuucggaucu

SEQ ID NO: 1315316 - RNA, 21 nt, Mycobacterium tuberculosis H37Rv
gcauuuguugcugcugccgug

SEQ ID NO: 1315317 - RNA, 19 nt, Mycobacterium tuberculosis H37Rv
gccaccgaacgcggccacc

SEQ ID NO: 1315318 - RNA, 15 nt, Mycobacterium tuberculosis H37Rv
gccaccgaagccgcc

SEQ ID NO: 1315319 - RNA, 17 nt, Mycobacterium tuberculosis H37Rv
gccaccgaagccgccgg

SEQ ID NO: 1315320 - RNA, 18 nt, Mycobacterium tuberculosis H37Rv
gccaccgcgagcagagga

SEQ ID NO: 1315321 - RNA, 21 nt, Mycobacterium tuberculosis H37Rv
gccaccgcggccugacgcugc

SEQ ID NO: 1315322 - RNA, 20 nt, Mycobacterium tuberculosis H37Rv
gccaccgcggucagcucggc

SEQ ID NO: 1315323 - RNA, 16 nt, Mycobacterium tuberculosis H37Rv
gccaccgcggccgcgg

SEQ ID NO: 1315324 - RNA, 22 nt, Mycobacterium tuberculosis H37Rv
gccacccggacauagccgcgcu

SEQ ID NO: 1315325 - RNA, 15 nt, Mycobacterium tuberculosis H37Rv
gccacccgguccacc

SEQ ID NO: 1315326 - RNA, 12 nt, Mycobacterium tuberculosis H37Rv
gccacccgcaac

SEQ ID NO: 1315327 - RNA, 19 nt, Mycobacterium tuberculosis H37Rv
gccacccgcgaagccgcca

SEQ ID NO: 1315328 - RNA, 18 nt, Mycobacterium tuberculosis H37Rv
gccacccgcgccgccagc

SEQ ID NO: 1315329 - RNA, 18 nt, Mycobacterium tuberculosis H37Rv
gccacccgcgcuccaaca

SEQ ID NO: 1315330 - RNA, 16 nt, Mycobacterium tuberculosis H37Rv
gccacccgacaacgcu

SEQ ID NO: 1315331 - RNA, 22 nt, Mycobacterium tuberculosis H37Rv
gccaccccgcguaugccaggac

SEQ ID NO: 1315332 - RNA, 17 nt, Mycobacterium tuberculosis H37Rv
gccaccaucaccucgca

SEQ ID NO: 1315333 - RNA, 15 nt, Mycobacterium tuberculosis H37Rv
gccaccacccaggcc

SEQ ID NO: 1315334 - RNA, 17 nt, Mycobacterium tuberculosis H37Rv
gccaccacccaggccau

SEQ ID NO: 1315335 - RNA, 19 nt, Mycobacterium tuberculosis H37Rv
gccaccacccggcgcagcu

SEQ ID NO: 1315336 - RNA, 14 nt, Mycobacterium tuberculosis H37Rv
gccaccaucuggau

SEQ ID NO: 1315337 - RNA, 13 nt, Mycobacterium tuberculosis H37Rv
gccaccaucgccg

SEQ ID NO: 1315338 - RNA, 13 nt, Mycobacterium tuberculosis H37Rv
gccacccagaaug

SEQ ID NO: 1315339 - RNA, 21 nt, Mycobacterium tuberculosis H37Rv
gccacccagcaccagggcgcg

SEQ ID NO: 1315340 - RNA, 18 nt, Mycobacterium tuberculosis H37Rv
gccacccagggccuuccc

SEQ ID NO: 1315341 - RNA, 23 nt, Mycobacterium tuberculosis H37Rv
gccacccccaaccgccggccagc

SEQ ID NO: 1315342 - RNA, 10 nt, Mycobacterium tuberculosis H37Rv
gccaccaacu

SEQ ID NO: 1315343 - RNA, 13 nt, Mycobacterium tuberculosis H37Rv
gccaccaacaccg

SEQ ID NO: 1315344 - RNA, 12 nt, Mycobacterium tuberculosis H37Rv
gccaccaaaccc

SEQ ID NO: 1315345 - RNA, 13 nt, Mycobacterium tuberculosis H37Rv
gccaccaaaccgc

SEQ ID NO: 1315346 - RNA, 13 nt, Mycobacterium tuberculosis H37Rv
gccacauuucacc

SEQ ID NO: 1315347 - RNA, 17 nt, Mycobacterium tuberculosis H37Rv
gccacagcccggcggcg

SEQ ID NO: 1315348 - RNA, 12 nt, Mycobacterium tuberculosis H37Rv
gccacagcccca

SEQ ID NO: 1315349 - RNA, 14 nt, Mycobacterium tuberculosis H37Rv
gccacagccccagg

SEQ ID NO: 1315350 - RNA, 15 nt, Mycobacterium tuberculosis H37Rv
gccacagccccaggg

SEQ ID NO: 1315351 - RNA, 18 nt, Mycobacterium tuberculosis H37Rv
gccacagccccagggugc

SEQ ID NO: 1315352 - RNA, 16 nt, Mycobacterium tuberculosis H37Rv
gccacagcccggcggc

SEQ ID NO: 1315353 - RNA, 22 nt, Mycobacterium tuberculosis H37Rv
gccacacccggcgugagcuccg

SEQ ID NO: 1315354 - RNA, 13 nt, Mycobacterium tuberculosis H37Rv
gccacaccaacgu

SEQ ID NO: 1315355 - RNA, 19 nt, Mycobacterium tuberculosis H37Rv
gccacaccaugauugccag

SEQ ID NO: 1315356 - RNA, 15 nt, Mycobacterium tuberculosis H37Rv
gccacaccgccgcca

SEQ ID NO: 1315357 - RNA, 19 nt, Mycobacterium tuberculosis H37Rv
gccacaccgucacgccacc

SEQ ID NO: 1315358 - RNA, 18 nt, Mycobacterium tuberculosis H37Rv
gccacaccuuggccgccg

SEQ ID NO: 1315359 - RNA, 19 nt, Mycobacterium tuberculosis H37Rv
gccacaccuuggccgccgg

SEQ ID NO: 1315360 - RNA, 20 nt, Mycobacterium tuberculosis H37Rv
gccacaccuuggccgccggc

SEQ ID NO: 1315361 - RNA, 20 nt, Mycobacterium tuberculosis H37Rv
gccacacggggccgccagcu

SEQ ID NO: 1315362 - RNA, 19 nt, Mycobacterium tuberculosis H37Rv
gccacacggggccgccagc

SEQ ID NO: 1315363 - RNA, 14 nt, Mycobacterium tuberculosis H37Rv
gccacacggggccg

SEQ ID NO: 1315364 - RNA, 13 nt, Mycobacterium tuberculosis H37Rv
gccacagcaacgu

SEQ ID NO: 1315365 - RNA, 21 nt, Mycobacterium tuberculosis H37Rv
gccacacucgccagggccauc

SEQ ID NO: 1315366 - RNA, 18 nt, Mycobacterium tuberculosis H37Rv
gccaaguugcagcgggcc

SEQ ID NO: 1315367 - RNA, 15 nt, Mycobacterium tuberculosis H37Rv
gccaagguugucgcu

SEQ ID NO: 1315368 - RNA, 16 nt, Mycobacterium tuberculosis H37Rv
gccaaguacugggcca

SEQ ID NO: 1315369 - RNA, 17 nt, Mycobacterium tuberculosis H37Rv
gccaagggccccuccgg

SEQ ID NO: 1315370 - RNA, 20 nt, Mycobacterium tuberculosis H37Rv
gccaaggccgucgacccagc

SEQ ID NO: 1315371 - RNA, 14 nt, Mycobacterium tuberculosis H37Rv
gccaauagaagcac

SEQ ID NO: 1315372 - RNA, 21 nt, Mycobacterium tuberculosis H37Rv
gccaauagcacguugucgggc

SEQ ID NO: 1315373 - RNA, 14 nt, Mycobacterium tuberculosis H37Rv
gccacaacggcggc

SEQ ID NO: 1315374 - RNA, 23 nt, Mycobacterium tuberculosis H37Rv
gccacaaccucgucgucaucgag

SEQ ID NO: 1315375 - RNA, 16 nt, Mycobacterium tuberculosis H37Rv
gccacaacggcggcgc

SEQ ID NO: 1315376 - RNA, 15 nt, Mycobacterium tuberculosis H37Rv
gccaauggccugcag

SEQ ID NO: 1315377 - RNA, 23 nt, Mycobacterium tuberculosis H37Rv
gccaaugacgucggaccagcugc

SEQ ID NO: 1315378 - RNA, 23 nt, Mycobacterium tuberculosis H37Rv
gccaaugauucggcacgccgggc

SEQ ID NO: 1315379 - RNA, 16 nt, Mycobacterium tuberculosis H37Rv
gccaaugcccaggugu

SEQ ID NO: 1315380 - RNA, 22 nt, Mycobacterium tuberculosis H37Rv
gccagaaaccccaaacaacccc

SEQ ID NO: 1315381 - RNA, 22 nt, Mycobacterium tuberculosis H37Rv
gccagaaacccggcgaccacgg

SEQ ID NO: 1315382 - RNA, 18 nt, Mycobacterium tuberculosis H37Rv
gccacuguugaagaagcc

SEQ ID NO: 1315383 - RNA, 20 nt, Mycobacterium tuberculosis H37Rv
gccacuguugaagaagcccg

SEQ ID NO: 1315384 - RNA, 21 nt, Mycobacterium tuberculosis H37Rv
gccacuguugaagaagcccga

SEQ ID NO: 1315385 - RNA, 22 nt, Mycobacterium tuberculosis H37Rv
gccacuggccgguucgcccgag

SEQ ID NO: 1315386 - RNA, 21 nt, Mycobacterium tuberculosis H37Rv
gccaccggcaaucggcggcac

SEQ ID NO: 1315387 - RNA, 23 nt, Mycobacterium tuberculosis H37Rv
gccaccggaauccgggccgccgc

SEQ ID NO: 1315388 - RNA, 20 nt, Mycobacterium tuberculosis H37Rv
gccacugccguugccgccgg

SEQ ID NO: 1315389 - RNA, 23 nt, Mycobacterium tuberculosis H37Rv
gccaccggcgccaccggcgccgc

SEQ ID NO: 1315390 - RNA, 16 nt, Mycobacterium tuberculosis H37Rv
gccaccggcgccgccc

SEQ ID NO: 1315391 - RNA, 18 nt, Mycobacterium tuberculosis H37Rv
gccaccggccggcgcagu

SEQ ID NO: 1315392 - RNA, 15 nt, Mycobacterium tuberculosis H37Rv
gccagcaagugcggg

SEQ ID NO: 1315393 - RNA, 14 nt, Mycobacterium tuberculosis H37Rv
gccagcaacccugc

SEQ ID NO: 1315394 - RNA, 13 nt, Mycobacterium tuberculosis H37Rv
gccagcaccaccg

SEQ ID NO: 1315395 - RNA, 18 nt, Mycobacterium tuberculosis H37Rv
gccagcaaugcccgcacc

SEQ ID NO: 1315396 - RNA, 21 nt, Mycobacterium tuberculosis H37Rv
gccagagccgcccuugccucc

SEQ ID NO: 1315397 - RNA, 22 nt, Mycobacterium tuberculosis H37Rv
gccagagccgcccuugccuccg

SEQ ID NO: 1315398 - RNA, 13 nt, Mycobacterium tuberculosis H37Rv
gccagagccgcgc

SEQ ID NO: 1315399 - RNA, 14 nt, Mycobacterium tuberculosis H37Rv
gccagcaaaccuuc

SEQ ID NO: 1315400 - RNA, 22 nt, Mycobacterium tuberculosis H37Rv
gccagcaucagcgccagcgagc

SEQ ID NO: 1315401 - RNA, 14 nt, Mycobacterium tuberculosis H37Rv
gccagcagcggcuc

SEQ ID NO: 1315402 - RNA, 17 nt, Mycobacterium tuberculosis H37Rv
gccagcagcugcuccag

SEQ ID NO: 1315403 - RNA, 13 nt, Mycobacterium tuberculosis H37Rv
gccagcaucauca

SEQ ID NO: 1315404 - RNA, 16 nt, Mycobacterium tuberculosis H37Rv
gccagcaucaucaagc

SEQ ID NO: 1315405 - RNA, 19 nt, Mycobacterium tuberculosis H37Rv
gccagcaucgcggugguug

SEQ ID NO: 1315406 - RNA, 16 nt, Mycobacterium tuberculosis H37Rv
gccagcaugacaccgg

SEQ ID NO: 1315407 - RNA, 18 nt, Mycobacterium tuberculosis H37Rv
gccagcaugacaccggcc

SEQ ID NO: 1315408 - RNA, 21 nt, Mycobacterium tuberculosis H37Rv
gccagcaugacaccggccacc

SEQ ID NO: 1315409 - RNA, 16 nt, Mycobacterium tuberculosis H37Rv
gccagcaccggcccga

SEQ ID NO: 1315410 - RNA, 17 nt, Mycobacterium tuberculosis H37Rv
gccagcacccgcagccg

SEQ ID NO: 1315411 - RNA, 16 nt, Mycobacterium tuberculosis H37Rv
gccagcaccucggcca

SEQ ID NO: 1315412 - RNA, 22 nt, Mycobacterium tuberculosis H37Rv
gccagcaccuagucgcggccgu

SEQ ID NO: 1315413 - RNA, 18 nt, Mycobacterium tuberculosis H37Rv
gccagcaccucggccagc

SEQ ID NO: 1315414 - RNA, 18 nt, Mycobacterium tuberculosis H37Rv
gccagcagcgacuccagc

SEQ ID NO: 1315415 - RNA, 13 nt, Mycobacterium tuberculosis H37Rv
gccagcagcgacu

SEQ ID NO: 1315416 - RNA, 16 nt, Mycobacterium tuberculosis H37Rv
gccagcagcggcgagc

SEQ ID NO: 1315417 - RNA, 13 nt, Mycobacterium tuberculosis H37Rv
gccagcagcgcga

SEQ ID NO: 1315418 - RNA, 22 nt, Mycobacterium tuberculosis H37Rv
gccagccaccacaucgcgggcg

SEQ ID NO: 1315419 - RNA, 21 nt, Mycobacterium tuberculosis H37Rv
gccagccaacgcgucccgccg

SEQ ID NO: 1315420 - RNA, 16 nt, Mycobacterium tuberculosis H37Rv
gccagcauugaagaag

SEQ ID NO: 1315421 - RNA, 14 nt, Mycobacterium tuberculosis H37Rv
gccagccagcgggc

SEQ ID NO: 1315422 - RNA, 17 nt, Mycobacterium tuberculosis H37Rv
gccagcccagggugucc

SEQ ID NO: 1315423 - RNA, 16 nt, Mycobacterium tuberculosis H37Rv
gccagccgacgcggcg

SEQ ID NO: 1315424 - RNA, 20 nt, Mycobacterium tuberculosis H37Rv
gccagccgacaacuguccug

SEQ ID NO: 1315425 - RNA, 18 nt, Mycobacterium tuberculosis H37Rv
gccagccccgccggggcc

SEQ ID NO: 1315426 - RNA, 22 nt, Mycobacterium tuberculosis H37Rv
gccagccccgccggggccgccg

SEQ ID NO: 1315427 - RNA, 15 nt, Mycobacterium tuberculosis H37Rv
gccaggauugccgcc

SEQ ID NO: 1315428 - RNA, 22 nt, Mycobacterium tuberculosis H37Rv
gccaggcaaccggucagccugc

SEQ ID NO: 1315429 - RNA, 23 nt, Mycobacterium tuberculosis H37Rv
gccaggaucgaucguagcuccuu

SEQ ID NO: 1315430 - RNA, 22 nt, Mycobacterium tuberculosis H37Rv
gccaggaucuccccguccugcc

SEQ ID NO: 1315431 - RNA, 23 nt, Mycobacterium tuberculosis H37Rv
gccaggaugaauuuggugaagug

SEQ ID NO: 1315432 - RNA, 18 nt, Mycobacterium tuberculosis H37Rv
gccaggaucuguuugggc

SEQ ID NO: 1315433 - RNA, 20 nt, Mycobacterium tuberculosis H37Rv
gccaggauccgaccccgcgc

SEQ ID NO: 1315434 - RNA, 22 nt, Mycobacterium tuberculosis H37Rv
gccagcuucguauggacgagga

SEQ ID NO: 1315435 - RNA, 18 nt, Mycobacterium tuberculosis H37Rv
gccagcuguucgagccgc

SEQ ID NO: 1315436 - RNA, 19 nt, Mycobacterium tuberculosis H37Rv
gccagcuguugcggggugc

SEQ ID NO: 1315437 - RNA, 21 nt, Mycobacterium tuberculosis H37Rv
gccagcuuagccgcagcuugg

SEQ ID NO: 1315438 - RNA, 13 nt, Mycobacterium tuberculosis H37Rv
gccagcugcgcag

SEQ ID NO: 1315439 - RNA, 16 nt, Mycobacterium tuberculosis H37Rv
gccaggccgcacagca

SEQ ID NO: 1315440 - RNA, 14 nt, Mycobacterium tuberculosis H37Rv
gccaggccggcggc

SEQ ID NO: 1315441 - RNA, 14 nt, Mycobacterium tuberculosis H37Rv
gccaggcgcagcug

SEQ ID NO: 1315442 - RNA, 22 nt, Mycobacterium tuberculosis H37Rv
gccaggcgaagucgacucgcca

SEQ ID NO: 1315443 - RNA, 13 nt, Mycobacterium tuberculosis H37Rv
gccaggcgcagcu

SEQ ID NO: 1315444 - RNA, 17 nt, Mycobacterium tuberculosis H37Rv
gccaggggacccggggc

SEQ ID NO: 1315445 - RNA, 14 nt, Mycobacterium tuberculosis H37Rv
gccaggggaucacc

SEQ ID NO: 1315446 - RNA, 19 nt, Mycobacterium tuberculosis H37Rv
gccaggggaucaccggcug

SEQ ID NO: 1315447 - RNA, 23 nt, Mycobacterium tuberculosis H37Rv
gccaggcuugcggcacccagucg

SEQ ID NO: 1315448 - RNA, 13 nt, Mycobacterium tuberculosis H37Rv
gccaggcugcgca

SEQ ID NO: 1315449 - RNA, 22 nt, Mycobacterium tuberculosis H37Rv
gccaggcgugcacaggucagcg

SEQ ID NO: 1315450 - RNA, 12 nt, Mycobacterium tuberculosis H37Rv
gccaggcggccg

SEQ ID NO: 1315451 - RNA, 20 nt, Mycobacterium tuberculosis H37Rv
gccagguguucgccggagac

SEQ ID NO: 1315452 - RNA, 20 nt, Mycobacterium tuberculosis H37Rv
gccaggugcccaagcagucc

SEQ ID NO: 1315453 - RNA, 16 nt, Mycobacterium tuberculosis H37Rv
gccaggucuccuuggg

SEQ ID NO: 1315454 - RNA, 13 nt, Mycobacterium tuberculosis H37Rv
gccaggugcagca

SEQ ID NO: 1315455 - RNA, 17 nt, Mycobacterium tuberculosis H37Rv
gccaggugaugccgccg

SEQ ID NO: 1315456 - RNA, 22 nt, Mycobacterium tuberculosis H37Rv
gccaggugaugccgccgugguu

SEQ ID NO: 1315457 - RNA, 14 nt, Mycobacterium tuberculosis H37Rv
gccaggggcgcagc

SEQ ID NO: 1315458 - RNA, 23 nt, Mycobacterium tuberculosis H37Rv
gccagggucacaaacccagcauc

SEQ ID NO: 1315459 - RNA, 17 nt, Mycobacterium tuberculosis H37Rv
gccagggucccgccgcc

SEQ ID NO: 1315460 - RNA, 21 nt, Mycobacterium tuberculosis H37Rv
gccagggucacaaacccagca

SEQ ID NO: 1315461 - RNA, 18 nt, Mycobacterium tuberculosis H37Rv
gccagcgaauggggcagc

SEQ ID NO: 1315462 - RNA, 20 nt, Mycobacterium tuberculosis H37Rv
gccagccugcuggccgcggc

SEQ ID NO: 1315463 - RNA, 16 nt, Mycobacterium tuberculosis H37Rv
gccagccugcuggccg

SEQ ID NO: 1315464 - RNA, 14 nt, Mycobacterium tuberculosis H37Rv
gccagccugugcug

SEQ ID NO: 1315465 - RNA, 23 nt, Mycobacterium tuberculosis H37Rv
gccagccgcucacccggucgcac

SEQ ID NO: 1315466 - RNA, 14 nt, Mycobacterium tuberculosis H37Rv
gccagccgcggccc

SEQ ID NO: 1315467 - RNA, 14 nt, Mycobacterium tuberculosis H37Rv
gccagccugaaccg

SEQ ID NO: 1315468 - RNA, 21 nt, Mycobacterium tuberculosis H37Rv
gccagccugaaccgccccggu

SEQ ID NO: 1315469 - RNA, 15 nt, Mycobacterium tuberculosis H37Rv
gccagccgcgagccg

SEQ ID NO: 1315470 - RNA, 12 nt, Mycobacterium tuberculosis H37Rv
gccagcgagcgc

SEQ ID NO: 1315471 - RNA, 15 nt, Mycobacterium tuberculosis H37Rv
gccagcgccccgcgg

SEQ ID NO: 1315472 - RNA, 20 nt, Mycobacterium tuberculosis H37Rv
gccagcgagcauaccgccgc

SEQ ID NO: 1315473 - RNA, 13 nt, Mycobacterium tuberculosis H37Rv
gccagcgccggcc

SEQ ID NO: 1315474 - RNA, 19 nt, Mycobacterium tuberculosis H37Rv
gccagcgccgcugaagcca

SEQ ID NO: 1315475 - RNA, 13 nt, Mycobacterium tuberculosis H37Rv
gccagcgccgccg

SEQ ID NO: 1315476 - RNA, 18 nt, Mycobacterium tuberculosis H37Rv
gccagcgccgccgagguc

SEQ ID NO: 1315477 - RNA, 21 nt, Mycobacterium tuberculosis H37Rv
gccagcgccgccgaggucggu

SEQ ID NO: 1315478 - RNA, 21 nt, Mycobacterium tuberculosis H37Rv
gccagcgccggucagggcuug

SEQ ID NO: 1315479 - RNA, 19 nt, Mycobacterium tuberculosis H37Rv
gccagcgcuucgucggccg

SEQ ID NO: 1315480 - RNA, 12 nt, Mycobacterium tuberculosis H37Rv
gccagcggagca

SEQ ID NO: 1315481 - RNA, 20 nt, Mycobacterium tuberculosis H37Rv
gccagcgcuccuugugccug

SEQ ID NO: 1315482 - RNA, 20 nt, Mycobacterium tuberculosis H37Rv
gccagcggcaauggccagca

SEQ ID NO: 1315483 - RNA, 21 nt, Mycobacterium tuberculosis H37Rv
gccagcggcaauggccagcac

SEQ ID NO: 1315484 - RNA, 22 nt, Mycobacterium tuberculosis H37Rv
gccagcggcaauggccagcacc

SEQ ID NO: 1315485 - RNA, 18 nt, Mycobacterium tuberculosis H37Rv
gccagcggccgggcggcc

SEQ ID NO: 1315486 - RNA, 23 nt, Mycobacterium tuberculosis H37Rv
gccagcggccgggcggccaggcg

SEQ ID NO: 1315487 - RNA, 19 nt, Mycobacterium tuberculosis H37Rv
gccagcggccgcuccaccu

SEQ ID NO: 1315488 - RNA, 20 nt, Mycobacterium tuberculosis H37Rv
gccagcguuaggucgccggc

SEQ ID NO: 1315489 - RNA, 18 nt, Mycobacterium tuberculosis H37Rv
gccagcgugucccaacgc

SEQ ID NO: 1315490 - RNA, 23 nt, Mycobacterium tuberculosis H37Rv
gccagcuauugcuauuccgcggc

SEQ ID NO: 1315491 - RNA, 15 nt, Mycobacterium tuberculosis H37Rv
gccagcugacacccg

SEQ ID NO: 1315492 - RNA, 19 nt, Mycobacterium tuberculosis H37Rv
gccagcugacacccgcagc

SEQ ID NO: 1315493 - RNA, 22 nt, Mycobacterium tuberculosis H37Rv
gccagcucacggacgcugggcg

SEQ ID NO: 1315494 - RNA, 17 nt, Mycobacterium tuberculosis H37Rv
gccagcucaaccacaug

SEQ ID NO: 1315495 - RNA, 21 nt, Mycobacterium tuberculosis H37Rv
gccagcucacggacgcugggc

SEQ ID NO: 1315496 - RNA, 12 nt, Mycobacterium tuberculosis H37Rv
gccagcugcccg

SEQ ID NO: 1315497 - RNA, 21 nt, Mycobacterium tuberculosis H37Rv
gcccacggcgaccacgccgcc

SEQ ID NO: 1315498 - RNA, 17 nt, Mycobacterium tuberculosis H37Rv
gcccagauccagcaacg

SEQ ID NO: 1315499 - RNA, 14 nt, Mycobacterium tuberculosis H37Rv
gcccagauagagcu

SEQ ID NO: 1315500 - RNA, 18 nt, Mycobacterium tuberculosis H37Rv
gcccagauaucguacugg

SEQ ID NO: 1315501 - RNA, 20 nt, Mycobacterium tuberculosis H37Rv
gcccagauaucguacuggcu

SEQ ID NO: 1315502 - RNA, 15 nt, Mycobacterium tuberculosis H37Rv
gcccagagccgcugc

SEQ ID NO: 1315503 - RNA, 22 nt, Mycobacterium tuberculosis H37Rv
gcccagagccgcugcggcaccg

SEQ ID NO: 1315504 - RNA, 20 nt, Mycobacterium tuberculosis H37Rv
gcccagauguuuagcguccg

SEQ ID NO: 1315505 - RNA, 21 nt, Mycobacterium tuberculosis H37Rv
gcccagcagguuccacggcca

SEQ ID NO: 1315506 - RNA, 14 nt, Mycobacterium tuberculosis H37Rv
gcccagcagguucc

SEQ ID NO: 1315507 - RNA, 20 nt, Mycobacterium tuberculosis H37Rv
gcccagcaggcccuuggcga

SEQ ID NO: 1315508 - RNA, 13 nt, Mycobacterium tuberculosis H37Rv
gcccagccaacuc

SEQ ID NO: 1315509 - RNA, 19 nt, Mycobacterium tuberculosis H37Rv
gcccagcgcccccagcagc

SEQ ID NO: 1315510 - RNA, 19 nt, Mycobacterium tuberculosis H37Rv
gcccagcgcccgcgcggcc

SEQ ID NO: 1315511 - RNA, 20 nt, Mycobacterium tuberculosis H37Rv
gcccagcgccuccagcacca

SEQ ID NO: 1315512 - RNA, 20 nt, Mycobacterium tuberculosis H37Rv
gcccacgcacagcaacgccc

SEQ ID NO: 1315513 - RNA, 13 nt, Mycobacterium tuberculosis H37Rv
gcccaccuccugg

SEQ ID NO: 1315514 - RNA, 18 nt, Mycobacterium tuberculosis H37Rv
gcccaccuccucgccgga

SEQ ID NO: 1315515 - RNA, 21 nt, Mycobacterium tuberculosis H37Rv
gcccaccucgaucgcgccguc

SEQ ID NO: 1315516 - RNA, 22 nt, Mycobacterium tuberculosis H37Rv
gcccaccgccguugggccgcgc

SEQ ID NO: 1315517 - RNA, 14 nt, Mycobacterium tuberculosis H37Rv
gcccaccggccacu

SEQ ID NO: 1315518 - RNA, 16 nt, Mycobacterium tuberculosis H37Rv
gcccaccggucgccgc

SEQ ID NO: 1315519 - RNA, 15 nt, Mycobacterium tuberculosis H37Rv
gcccaccggcuagcu

SEQ ID NO: 1315520 - RNA, 19 nt, Mycobacterium tuberculosis H37Rv
gcccaccggugccgcccgc

SEQ ID NO: 1315521 - RNA, 21 nt, Mycobacterium tuberculosis H37Rv
gcccaccggugccgcccgcgc

SEQ ID NO: 1315522 - RNA, 22 nt, Mycobacterium tuberculosis H37Rv
gcccaccgcaacgcuucggcag

SEQ ID NO: 1315523 - RNA, 13 nt, Mycobacterium tuberculosis H37Rv
gcccaccgaaacc

SEQ ID NO: 1315524 - RNA, 20 nt, Mycobacterium tuberculosis H37Rv
gcccacccgggugggccagu

SEQ ID NO: 1315525 - RNA, 17 nt, Mycobacterium tuberculosis H37Rv
gcccacccauggccucc

SEQ ID NO: 1315526 - RNA, 21 nt, Mycobacterium tuberculosis H37Rv
gcccaccacgcgacgcggggc

SEQ ID NO: 1315527 - RNA, 12 nt, Mycobacterium tuberculosis H37Rv
gcccaccacugu

SEQ ID NO: 1315528 - RNA, 23 nt, Mycobacterium tuberculosis H37Rv
gcccaccagcgcagccgaucguc

SEQ ID NO: 1315529 - RNA, 17 nt, Mycobacterium tuberculosis H37Rv
gcccaccaggcccaucu

SEQ ID NO: 1315530 - RNA, 20 nt, Mycobacterium tuberculosis H37Rv
gccauugccucccgcgccgg

SEQ ID NO: 1315531 - RNA, 14 nt, Mycobacterium tuberculosis H37Rv
gccauugccgccgg

SEQ ID NO: 1315532 - RNA, 18 nt, Mycobacterium tuberculosis H37Rv
gcccaaagcgccagcagc

SEQ ID NO: 1315533 - RNA, 21 nt, Mycobacterium tuberculosis H37Rv
gcccaaaggcuguaacacccg

SEQ ID NO: 1315534 - RNA, 23 nt, Mycobacterium tuberculosis H37Rv
gcccaaaggcuguaacacccggc

SEQ ID NO: 1315535 - RNA, 17 nt, Mycobacterium tuberculosis H37Rv
gcccaaaucccagagca

SEQ ID NO: 1315536 - RNA, 20 nt, Mycobacterium tuberculosis H37Rv
gcccaacagcaacccgccgu

SEQ ID NO: 1315537 - RNA, 18 nt, Mycobacterium tuberculosis H37Rv
gcccaacagcaacccgcc

SEQ ID NO: 1315538 - RNA, 22 nt, Mycobacterium tuberculosis H37Rv
gcccaauuucgugccgaaaugg

SEQ ID NO: 1315539 - RNA, 16 nt, Mycobacterium tuberculosis H37Rv
gcccacaaagauccgg

SEQ ID NO: 1315540 - RNA, 18 nt, Mycobacterium tuberculosis H37Rv
gcccaacucggccagcuu

SEQ ID NO: 1315541 - RNA, 17 nt, Mycobacterium tuberculosis H37Rv
gcccaagcucagggugg

SEQ ID NO: 1315542 - RNA, 14 nt, Mycobacterium tuberculosis H37Rv
gcccaagaucucgc

SEQ ID NO: 1315543 - RNA, 14 nt, Mycobacterium tuberculosis H37Rv
gcccacaccagcgc

SEQ ID NO: 1315544 - RNA, 22 nt, Mycobacterium tuberculosis H37Rv
gcccacaggggcagcgcggcca

SEQ ID NO: 1315545 - RNA, 17 nt, Mycobacterium tuberculosis H37Rv
gcccacagcuugcccga

SEQ ID NO: 1315546 - RNA, 22 nt, Mycobacterium tuberculosis H37Rv
gcccacaucgucggcgggcggc

SEQ ID NO: 1315547 - RNA, 17 nt, Mycobacterium tuberculosis H37Rv
gcccacaugaacgacca

SEQ ID NO: 1315548 - RNA, 16 nt, Mycobacterium tuberculosis H37Rv
gcccacaugcgcucgc

SEQ ID NO: 1315549 - RNA, 17 nt, Mycobacterium tuberculosis H37Rv
gcccaccacacagccgc

SEQ ID NO: 1315550 - RNA, 19 nt, Mycobacterium tuberculosis H37Rv
gcccaccacacagccgcgc

SEQ ID NO: 1315551 - RNA, 23 nt, Mycobacterium tuberculosis H37Rv
gcccaccaccgacagcacccggc

SEQ ID NO: 1315552 - RNA, 19 nt, Mycobacterium tuberculosis H37Rv
gcccaccacgcgacgcggg

SEQ ID NO: 1315553 - RNA, 17 nt, Mycobacterium tuberculosis H37Rv
gccaugucagcggccug

SEQ ID NO: 1315554 - RNA, 21 nt, Mycobacterium tuberculosis H37Rv
gccaugucuccgacauuggcc

SEQ ID NO: 1315555 - RNA, 20 nt, Mycobacterium tuberculosis H37Rv
gccauguagccguugccgcc

SEQ ID NO: 1315556 - RNA, 20 nt, Mycobacterium tuberculosis H37Rv
gccaugucuccgacauuggc

SEQ ID NO: 1315557 - RNA, 19 nt, Mycobacterium tuberculosis H37Rv
gccauuccagaucaacgcg

SEQ ID NO: 1315558 - RNA, 16 nt, Mycobacterium tuberculosis H37Rv
gccauucuucgaucag

SEQ ID NO: 1315559 - RNA, 14 nt, Mycobacterium tuberculosis H37Rv
gccaucugccugcc

SEQ ID NO: 1315560 - RNA, 11 nt, Mycobacterium tuberculosis H37Rv
gccaucuggcc

SEQ ID NO: 1315561 - RNA, 16 nt, Mycobacterium tuberculosis H37Rv
gccaugcuggucagcg

SEQ ID NO: 1315562 - RNA, 18 nt, Mycobacterium tuberculosis H37Rv
gccaugcuggucagcggc

SEQ ID NO: 1315563 - RNA, 19 nt, Mycobacterium tuberculosis H37Rv
gccauggcagcgccgcagc

SEQ ID NO: 1315564 - RNA, 14 nt, Mycobacterium tuberculosis H37Rv
gccauggucagaua

SEQ ID NO: 1315565 - RNA, 16 nt, Mycobacterium tuberculosis H37Rv
gccaucagaccaauga

SEQ ID NO: 1315566 - RNA, 20 nt, Mycobacterium tuberculosis H37Rv
gccaucacgacucccccggc

SEQ ID NO: 1315567 - RNA, 13 nt, Mycobacterium tuberculosis H37Rv
gccagucccacug

SEQ ID NO: 1315568 - RNA, 23 nt, Mycobacterium tuberculosis H37Rv
gccaguccagcgcgccacccagc

SEQ ID NO: 1315569 - RNA, 15 nt, Mycobacterium tuberculosis H37Rv
gccagucccggcgca

SEQ ID NO: 1315570 - RNA, 20 nt, Mycobacterium tuberculosis H37Rv
gccaguccgaaagccgccga

SEQ ID NO: 1315571 - RNA, 13 nt, Mycobacterium tuberculosis H37Rv
gccaguccgcagc

SEQ ID NO: 1315572 - RNA, 20 nt, Mycobacterium tuberculosis H37Rv
gccaucaacaaggggcagca

SEQ ID NO: 1315573 - RNA, 18 nt, Mycobacterium tuberculosis H37Rv
gccaguagucgccgggcg

SEQ ID NO: 1315574 - RNA, 21 nt, Mycobacterium tuberculosis H37Rv
gccaguagucgccgggcggcc

SEQ ID NO: 1315575 - RNA, 19 nt, Mycobacterium tuberculosis H37Rv
gccaguaugcggugcccgc

SEQ ID NO: 1315576 - RNA, 13 nt, Mycobacterium tuberculosis H37Rv
gccaguccagcgc

SEQ ID NO: 1315577 - RNA, 15 nt, Mycobacterium tuberculosis H37Rv
gccaguccagcgcgc

SEQ ID NO: 1315578 - RNA, 16 nt, Mycobacterium tuberculosis H37Rv
gccaucauggcggccc

SEQ ID NO: 1315579 - RNA, 18 nt, Mycobacterium tuberculosis H37Rv
gccaucaucgcuuggccu

SEQ ID NO: 1315580 - RNA, 12 nt, Mycobacterium tuberculosis H37Rv
gccaucaucgcu

SEQ ID NO: 1315581 - RNA, 21 nt, Mycobacterium tuberculosis H37Rv
gccaucagcccggcgcgccga

SEQ ID NO: 1315582 - RNA, 17 nt, Mycobacterium tuberculosis H37Rv
gccaucagaaccuccuc

SEQ ID NO: 1315583 - RNA, 17 nt, Mycobacterium tuberculosis H37Rv
gccaucgucgaagaccu

SEQ ID NO: 1315584 - RNA, 22 nt, Mycobacterium tuberculosis H37Rv
gccaucgucgagcgcgaaagcc

SEQ ID NO: 1315585 - RNA, 15 nt, Mycobacterium tuberculosis H37Rv
gccaucgaguccacc

SEQ ID NO: 1315586 - RNA, 15 nt, Mycobacterium tuberculosis H37Rv
gcccgcaacgccaac

SEQ ID NO: 1315587 - RNA, 15 nt, Mycobacterium tuberculosis H37Rv
gcccgccagcgccgc

SEQ ID NO: 1315588 - RNA, 16 nt, Mycobacterium tuberculosis H37Rv
gcccgccauccgccga

SEQ ID NO: 1315589 - RNA, 19 nt, Mycobacterium tuberculosis H37Rv
gcccgauucagcgccccau

SEQ ID NO: 1315590 - RNA, 15 nt, Mycobacterium tuberculosis H37Rv
gcccgauggugccga

SEQ ID NO: 1315591 - RNA, 18 nt, Mycobacterium tuberculosis H37Rv
gcccgauggugccgaccc

SEQ ID NO: 1315592 - RNA, 23 nt, Mycobacterium tuberculosis H37Rv
gcccgauggugccgacccgccgc

SEQ ID NO: 1315593 - RNA, 18 nt, Mycobacterium tuberculosis H37Rv
gcccgaugguacccgcgc

SEQ ID NO: 1315594 - RNA, 16 nt, Mycobacterium tuberculosis H37Rv
gcccgaugccgugccc

SEQ ID NO: 1315595 - RNA, 18 nt, Mycobacterium tuberculosis H37Rv
gcccgccguccggcgccc

SEQ ID NO: 1315596 - RNA, 20 nt, Mycobacterium tuberculosis H37Rv
gcccgccguccccgccgccg

SEQ ID NO: 1315597 - RNA, 18 nt, Mycobacterium tuberculosis H37Rv
gcccgccgucuuggcccg

SEQ ID NO: 1315598 - RNA, 20 nt, Mycobacterium tuberculosis H37Rv
gcccgccucugucuucagcu

SEQ ID NO: 1315599 - RNA, 14 nt, Mycobacterium tuberculosis H37Rv
gcccgccggccucu

SEQ ID NO: 1315600 - RNA, 13 nt, Mycobacterium tuberculosis H37Rv
gcccgccggcccc

SEQ ID NO: 1315601 - RNA, 13 nt, Mycobacterium tuberculosis H37Rv
gcccgccccgcgc

SEQ ID NO: 1315602 - RNA, 14 nt, Mycobacterium tuberculosis H37Rv
gcccgcccaccucg

SEQ ID NO: 1315603 - RNA, 19 nt, Mycobacterium tuberculosis H37Rv
gcccgcccgucuuccagcc

SEQ ID NO: 1315604 - RNA, 15 nt, Mycobacterium tuberculosis H37Rv
gcccgccggcaguga

SEQ ID NO: 1315605 - RNA, 20 nt, Mycobacterium tuberculosis H37Rv
gcccggaggguucggacggc

SEQ ID NO: 1315606 - RNA, 13 nt, Mycobacterium tuberculosis H37Rv
gcccggcaccccu

SEQ ID NO: 1315607 - RNA, 21 nt, Mycobacterium tuberculosis H37Rv
gcccggacugaucgucugaau

SEQ ID NO: 1315608 - RNA, 21 nt, Mycobacterium tuberculosis H37Rv
gcccggacaugcgggcagcac

SEQ ID NO: 1315609 - RNA, 20 nt, Mycobacterium tuberculosis H37Rv
gcccggaccacuguuggugc

SEQ ID NO: 1315610 - RNA, 22 nt, Mycobacterium tuberculosis H37Rv
gcccggaaccggcgugcagcac

SEQ ID NO: 1315611 - RNA, 19 nt, Mycobacterium tuberculosis H37Rv
gcccggacaugcgggcagc

SEQ ID NO: 1315612 - RNA, 21 nt, Mycobacterium tuberculosis H37Rv
gcccgcgggcaguggcagccc

SEQ ID NO: 1315613 - RNA, 23 nt, Mycobacterium tuberculosis H37Rv
gcccgcgcggccaaucagcccgc

SEQ ID NO: 1315614 - RNA, 12 nt, Mycobacterium tuberculosis H37Rv
gcccgcgcggcg

SEQ ID NO: 1315615 - RNA, 17 nt, Mycobacterium tuberculosis H37Rv
gcccgccucaucggcaa

SEQ ID NO: 1315616 - RNA, 16 nt, Mycobacterium tuberculosis H37Rv
gccccuccgggcgcac

SEQ ID NO: 1315617 - RNA, 15 nt, Mycobacterium tuberculosis H37Rv
gccccguugucgggg

SEQ ID NO: 1315618 - RNA, 17 nt, Mycobacterium tuberculosis H37Rv
gccccgguggcagggaa

SEQ ID NO: 1315619 - RNA, 16 nt, Mycobacterium tuberculosis H37Rv
gcccaggcauggccug

SEQ ID NO: 1315620 - RNA, 16 nt, Mycobacterium tuberculosis H37Rv
gccccggucggcgacg

SEQ ID NO: 1315621 - RNA, 19 nt, Mycobacterium tuberculosis H37Rv
gcccgaaucgccggcggcc

SEQ ID NO: 1315622 - RNA, 22 nt, Mycobacterium tuberculosis H37Rv
gcccgaaggcggcuccaccggg

SEQ ID NO: 1315623 - RNA, 16 nt, Mycobacterium tuberculosis H37Rv
gcccgaguugaaggug

SEQ ID NO: 1315624 - RNA, 18 nt, Mycobacterium tuberculosis H37Rv
gcccgaguugaagaagcc

SEQ ID NO: 1315625 - RNA, 22 nt, Mycobacterium tuberculosis H37Rv
gcccgagugugaaucgcacgac

SEQ ID NO: 1315626 - RNA, 19 nt, Mycobacterium tuberculosis H37Rv
gcccgaguuguugcugccc

SEQ ID NO: 1315627 - RNA, 23 nt, Mycobacterium tuberculosis H37Rv
gcccgaguuguggacgcccgagu

SEQ ID NO: 1315628 - RNA, 19 nt, Mycobacterium tuberculosis H37Rv
gcccgaguuggcgaagccc

SEQ ID NO: 1315629 - RNA, 19 nt, Mycobacterium tuberculosis H37Rv
gcccgaggcacccgugccg

SEQ ID NO: 1315630 - RNA, 20 nt, Mycobacterium tuberculosis H37Rv
gcccgauccggaucccacca

SEQ ID NO: 1315631 - RNA, 16 nt, Mycobacterium tuberculosis H37Rv
gcccgaucgaagaaac

SEQ ID NO: 1315632 - RNA, 14 nt, Mycobacterium tuberculosis H37Rv
gcccgauccccgga

SEQ ID NO: 1315633 - RNA, 14 nt, Mycobacterium tuberculosis H37Rv
gcccgaucugagcu

SEQ ID NO: 1315634 - RNA, 16 nt, Mycobacterium tuberculosis H37Rv
gccccugaaggccagc

SEQ ID NO: 1315635 - RNA, 22 nt, Mycobacterium tuberculosis H37Rv
gccccucgucgucaucgagcgg

SEQ ID NO: 1315636 - RNA, 19 nt, Mycobacterium tuberculosis H37Rv
gccccuugaccgcugccca

SEQ ID NO: 1315637 - RNA, 18 nt, Mycobacterium tuberculosis H37Rv
gccccuugaccgcugccc

SEQ ID NO: 1315638 - RNA, 14 nt, Mycobacterium tuberculosis H37Rv
gccccugcacagca

SEQ ID NO: 1315639 - RNA, 15 nt, Mycobacterium tuberculosis H37Rv
gccccugcacagcag

SEQ ID NO: 1315640 - RNA, 16 nt, Mycobacterium tuberculosis H37Rv
gccccugcacagcagg

SEQ ID NO: 1315641 - RNA, 17 nt, Mycobacterium tuberculosis H37Rv
gccccuuuugccgcagc

SEQ ID NO: 1315642 - RNA, 15 nt, Mycobacterium tuberculosis H37Rv
gccccuuucugaagc

SEQ ID NO: 1315643 - RNA, 12 nt, Mycobacterium tuberculosis H37Rv
gcccgaagagca

SEQ ID NO: 1315644 - RNA, 20 nt, Mycobacterium tuberculosis H37Rv
gcccgaagacgggguggugg

SEQ ID NO: 1315645 - RNA, 16 nt, Mycobacterium tuberculosis H37Rv
gcccgaaccccgggcg

SEQ ID NO: 1315646 - RNA, 16 nt, Mycobacterium tuberculosis H37Rv
gcccguagacccacag

SEQ ID NO: 1315647 - RNA, 16 nt, Mycobacterium tuberculosis H37Rv
gcccgugacuggugaa

SEQ ID NO: 1315648 - RNA, 16 nt, Mycobacterium tuberculosis H37Rv
gcccgucuccagcacc

SEQ ID NO: 1315649 - RNA, 16 nt, Mycobacterium tuberculosis H37Rv
gcccgguugggugugc

SEQ ID NO: 1315650 - RNA, 15 nt, Mycobacterium tuberculosis H37Rv
gcccgguucagcgcu

SEQ ID NO: 1315651 - RNA, 22 nt, Mycobacterium tuberculosis H37Rv
gcccgguguucaucacgccgcc

SEQ ID NO: 1315652 - RNA, 22 nt, Mycobacterium tuberculosis H37Rv
gcccggucauggucagcagaau

SEQ ID NO: 1315653 - RNA, 17 nt, Mycobacterium tuberculosis H37Rv
gcccgguccagccccau

SEQ ID NO: 1315654 - RNA, 16 nt, Mycobacterium tuberculosis H37Rv
gcccgguacgccgcgc

SEQ ID NO: 1315655 - RNA, 17 nt, Mycobacterium tuberculosis H37Rv
gcccgguaguacuagca

SEQ ID NO: 1315656 - RNA, 14 nt, Mycobacterium tuberculosis H37Rv
gcccgggcagcccc

SEQ ID NO: 1315657 - RNA, 13 nt, Mycobacterium tuberculosis H37Rv
gcccgggcagcac

SEQ ID NO: 1315658 - RNA, 23 nt, Mycobacterium tuberculosis H37Rv
gcccgggcauccuucaccagcug

SEQ ID NO: 1315659 - RNA, 18 nt, Mycobacterium tuberculosis H37Rv
gcccgguacgccgcgccg

SEQ ID NO: 1315660 - RNA, 19 nt, Mycobacterium tuberculosis H37Rv
gcccgguacgccgcgccga

SEQ ID NO: 1315661 - RNA, 13 nt, Mycobacterium tuberculosis H37Rv
gcccgggccaccg

SEQ ID NO: 1315662 - RNA, 23 nt, Mycobacterium tuberculosis H37Rv
gcccggucucgacggcggccgcg

SEQ ID NO: 1315663 - RNA, 22 nt, Mycobacterium tuberculosis H37Rv
gcccggucccuuuguggggccg

SEQ ID NO: 1315664 - RNA, 19 nt, Mycobacterium tuberculosis H37Rv
gcccgguccgccgcagacc

SEQ ID NO: 1315665 - RNA, 15 nt, Mycobacterium tuberculosis H37Rv
gcccggugcagcagu

SEQ ID NO: 1315666 - RNA, 21 nt, Mycobacterium tuberculosis H37Rv
gcccggucauggucagcagaa

SEQ ID NO: 1315667 - RNA, 14 nt, Mycobacterium tuberculosis H37Rv
gcccggugcuaccg

SEQ ID NO: 1315668 - RNA, 22 nt, Mycobacterium tuberculosis H37Rv
gcccggcgcaccaucgcggccg

SEQ ID NO: 1315669 - RNA, 15 nt, Mycobacterium tuberculosis H37Rv
gcccggccagccgca

SEQ ID NO: 1315670 - RNA, 22 nt, Mycobacterium tuberculosis H37Rv
gcccggccagccgcacgguugc

SEQ ID NO: 1315671 - RNA, 21 nt, Mycobacterium tuberculosis H37Rv
gcccggcauuaggccgggguc

SEQ ID NO: 1315672 - RNA, 18 nt, Mycobacterium tuberculosis H37Rv
gcccggccaaaauggcgc

SEQ ID NO: 1315673 - RNA, 14 nt, Mycobacterium tuberculosis H37Rv
gcccggccagccgc

SEQ ID NO: 1315674 - RNA, 21 nt, Mycobacterium tuberculosis H37Rv
gcccggcgauaaacccgaggc

SEQ ID NO: 1315675 - RNA, 23 nt, Mycobacterium tuberculosis H37Rv
gcccgggauaguuuucggccgcc

SEQ ID NO: 1315676 - RNA, 17 nt, Mycobacterium tuberculosis H37Rv
gcccggcugcgccgggc

SEQ ID NO: 1315677 - RNA, 20 nt, Mycobacterium tuberculosis H37Rv
gcccggcugcgccgggcucg

SEQ ID NO: 1315678 - RNA, 14 nt, Mycobacterium tuberculosis H37Rv
gcccggcucggugc

SEQ ID NO: 1315679 - RNA, 20 nt, Mycobacterium tuberculosis H37Rv
gcccggcuccuccccggccc

SEQ ID NO: 1315680 - RNA, 15 nt, Mycobacterium tuberculosis H37Rv
gcccggcgcggccgc

SEQ ID NO: 1315681 - RNA, 20 nt, Mycobacterium tuberculosis H37Rv
gcccggcgcgauccccgcgc

SEQ ID NO: 1315682 - RNA, 13 nt, Mycobacterium tuberculosis H37Rv
gcccggcgcgccg

SEQ ID NO: 1315683 - RNA, 21 nt, Mycobacterium tuberculosis H37Rv
gcccucgcuaauugcggccgc

SEQ ID NO: 1315684 - RNA, 13 nt, Mycobacterium tuberculosis H37Rv
gcccucggcggcg

SEQ ID NO: 1315685 - RNA, 18 nt, Mycobacterium tuberculosis H37Rv
gcccucgggacggccgcc

SEQ ID NO: 1315686 - RNA, 19 nt, Mycobacterium tuberculosis H37Rv
gcccucgggacggccgccg

SEQ ID NO: 1315687 - RNA, 20 nt, Mycobacterium tuberculosis H37Rv
gcccucgggacggccgccgc

SEQ ID NO: 1315688 - RNA, 22 nt, Mycobacterium tuberculosis H37Rv
gcccucgggacggccgccgccg

SEQ ID NO: 1315689 - RNA, 20 nt, Mycobacterium tuberculosis H37Rv
gcccucgggguagccaaccu

SEQ ID NO: 1315690 - RNA, 21 nt, Mycobacterium tuberculosis H37Rv
gcccucaacgaucgcgccguc

SEQ ID NO: 1315691 - RNA, 16 nt, Mycobacterium tuberculosis H37Rv
gcccuaucuggcggcc

SEQ ID NO: 1315692 - RNA, 14 nt, Mycobacterium tuberculosis H37Rv
gcccucgacgcgcu

SEQ ID NO: 1315693 - RNA, 15 nt, Mycobacterium tuberculosis H37Rv
gcccucgaucgccac

SEQ ID NO: 1315694 - RNA, 16 nt, Mycobacterium tuberculosis H37Rv
gcccuagccggcgcgc

SEQ ID NO: 1315695 - RNA, 22 nt, Mycobacterium tuberculosis H37Rv
gcccuauacgcaacaggccaac

SEQ ID NO: 1315696 - RNA, 21 nt, Mycobacterium tuberculosis H37Rv
gcccguggucgaucaugacga

SEQ ID NO: 1315697 - RNA, 15 nt, Mycobacterium tuberculosis H37Rv
gcccgugccacagcu

SEQ ID NO: 1315698 - RNA, 14 nt, Mycobacterium tuberculosis H37Rv
gcccgugccacagc

SEQ ID NO: 1315699 - RNA, 23 nt, Mycobacterium tuberculosis H37Rv
gcccguggcggugagccgccagg

SEQ ID NO: 1315700 - RNA, 22 nt, Mycobacterium tuberculosis H37Rv
gcccuggacauaccggcccggg

SEQ ID NO: 1315701 - RNA, 15 nt, Mycobacterium tuberculosis H37Rv
gcccuggccacccag

SEQ ID NO: 1315702 - RNA, 19 nt, Mycobacterium tuberculosis H37Rv
gcccuggccgcccuggccg

SEQ ID NO: 1315703 - RNA, 14 nt, Mycobacterium tuberculosis H37Rv
gcccuggccagccc

SEQ ID NO: 1315704 - RNA, 14 nt, Mycobacterium tuberculosis H37Rv
gcccuggcccaucu

SEQ ID NO: 1315705 - RNA, 19 nt, Mycobacterium tuberculosis H37Rv
gcccugagaacacguucgg

SEQ ID NO: 1315706 - RNA, 20 nt, Mycobacterium tuberculosis H37Rv
gcccugacgccccgccacaa

SEQ ID NO: 1315707 - RNA, 14 nt, Mycobacterium tuberculosis H37Rv
gcccugagccaccc

SEQ ID NO: 1315708 - RNA, 18 nt, Mycobacterium tuberculosis H37Rv
gcccugauugaagccccc

SEQ ID NO: 1315709 - RNA, 16 nt, Mycobacterium tuberculosis H37Rv
gcccugauugaagccc

SEQ ID NO: 1315710 - RNA, 17 nt, Mycobacterium tuberculosis H37Rv
gcccugauugaagcccc

SEQ ID NO: 1315711 - RNA, 12 nt, Mycobacterium tuberculosis H37Rv
gcccugcaaccc

SEQ ID NO: 1315712 - RNA, 14 nt, Mycobacterium tuberculosis H37Rv
gcccugcaacccgg

SEQ ID NO: 1315713 - RNA, 14 nt, Mycobacterium tuberculosis H37Rv
gcccugauugaagc

SEQ ID NO: 1315714 - RNA, 18 nt, Mycobacterium tuberculosis H37Rv
gcccuggaaugccgccac

SEQ ID NO: 1315715 - RNA, 22 nt, Mycobacterium tuberculosis H37Rv
gcccugcuugcaggcgaucugg

SEQ ID NO: 1315716 - RNA, 14 nt, Mycobacterium tuberculosis H37Rv
gcccugcacagcag

SEQ ID NO: 1315717 - RNA, 18 nt, Mycobacterium tuberculosis H37Rv
gccgacaggccggccacc

SEQ ID NO: 1315718 - RNA, 22 nt, Mycobacterium tuberculosis H37Rv
gccgacaccaccggcgccgccg

SEQ ID NO: 1315719 - RNA, 18 nt, Mycobacterium tuberculosis H37Rv
gccgacaccacggcgcgc

SEQ ID NO: 1315720 - RNA, 22 nt, Mycobacterium tuberculosis H37Rv
gccgacauugcugcucgugagc

SEQ ID NO: 1315721 - RNA, 21 nt, Mycobacterium tuberculosis H37Rv
gccgacaucgauguggaugga

SEQ ID NO: 1315722 - RNA, 15 nt, Mycobacterium tuberculosis H37Rv
gccgaccaccagcau

SEQ ID NO: 1315723 - RNA, 19 nt, Mycobacterium tuberculosis H37Rv
gccgaccacucgagcgcuc

SEQ ID NO: 1315724 - RNA, 20 nt, Mycobacterium tuberculosis H37Rv
gccgaccagaacgccagacc

SEQ ID NO: 1315725 - RNA, 14 nt, Mycobacterium tuberculosis H37Rv
gccgaccagcaccc

SEQ ID NO: 1315726 - RNA, 17 nt, Mycobacterium tuberculosis H37Rv
gccgaccagcacccgcu

SEQ ID NO: 1315727 - RNA, 22 nt, Mycobacterium tuberculosis H37Rv
gccgaccagagcuucgccgcgc

SEQ ID NO: 1315728 - RNA, 23 nt, Mycobacterium tuberculosis H37Rv
gccgaccagagcuucgccgcgca

SEQ ID NO: 1315729 - RNA, 14 nt, Mycobacterium tuberculosis H37Rv
gccgaccagcgcgc

SEQ ID NO: 1315730 - RNA, 19 nt, Mycobacterium tuberculosis H37Rv
gccgaccagcgcgcugcgc

SEQ ID NO: 1315731 - RNA, 22 nt, Mycobacterium tuberculosis H37Rv
gccgaccaucucaccgggcccg

SEQ ID NO: 1315732 - RNA, 15 nt, Mycobacterium tuberculosis H37Rv
gccgacccgccgcgc

SEQ ID NO: 1315733 - RNA, 22 nt, Mycobacterium tuberculosis H37Rv
gccgaccauaaaacucgggggc

SEQ ID NO: 1315734 - RNA, 14 nt, Mycobacterium tuberculosis H37Rv
gccgaccgcggguc

SEQ ID NO: 1315735 - RNA, 22 nt, Mycobacterium tuberculosis H37Rv
gccgaccgcguuuugcaggccc

SEQ ID NO: 1315736 - RNA, 15 nt, Mycobacterium tuberculosis H37Rv
gccgaccggagccgc

SEQ ID NO: 1315737 - RNA, 19 nt, Mycobacterium tuberculosis H37Rv
gccgaccggcacccgcggc

SEQ ID NO: 1315738 - RNA, 18 nt, Mycobacterium tuberculosis H37Rv
gccgaccggcagcgaugc

SEQ ID NO: 1315739 - RNA, 15 nt, Mycobacterium tuberculosis H37Rv
gccgacccgcgcgcc

SEQ ID NO: 1315740 - RNA, 22 nt, Mycobacterium tuberculosis H37Rv
gccgacccgccgcgcccggcgc

SEQ ID NO: 1315741 - RNA, 15 nt, Mycobacterium tuberculosis H37Rv
gccgacccgggggcg

SEQ ID NO: 1315742 - RNA, 13 nt, Mycobacterium tuberculosis H37Rv
gccgaagccgcgc

SEQ ID NO: 1315743 - RNA, 16 nt, Mycobacterium tuberculosis H37Rv
gccgaagccgaagggg

SEQ ID NO: 1315744 - RNA, 13 nt, Mycobacterium tuberculosis H37Rv
gccgaagccuugc

SEQ ID NO: 1315745 - RNA, 21 nt, Mycobacterium tuberculosis H37Rv
gccgaagccuugcagcgcccc

SEQ ID NO: 1315746 - RNA, 14 nt, Mycobacterium tuberculosis H37Rv
gccgaagcgcccgu

SEQ ID NO: 1315747 - RNA, 19 nt, Mycobacterium tuberculosis H37Rv
gccgaagaacucaaagacc

SEQ ID NO: 1315748 - RNA, 15 nt, Mycobacterium tuberculosis H37Rv
gccgaagaggagaac

SEQ ID NO: 1315749 - RNA, 15 nt, Mycobacterium tuberculosis H37Rv
gccgaacgacagcag

SEQ ID NO: 1315750 - RNA, 22 nt, Mycobacterium tuberculosis H37Rv
gccgaacgugcaaccauggcgg

SEQ ID NO: 1315751 - RNA, 15 nt, Mycobacterium tuberculosis H37Rv
gccgaacugccgcgc

SEQ ID NO: 1315752 - RNA, 21 nt, Mycobacterium tuberculosis H37Rv
gccgaagaaccggucgcagug

SEQ ID NO: 1315753 - RNA, 20 nt, Mycobacterium tuberculosis H37Rv
gccgaauaccgguggcagcc

SEQ ID NO: 1315754 - RNA, 21 nt, Mycobacterium tuberculosis H37Rv
gccgaaguuuuggaagcccga

SEQ ID NO: 1315755 - RNA, 16 nt, Mycobacterium tuberculosis H37Rv
gccgaaguggagcccc

SEQ ID NO: 1315756 - RNA, 20 nt, Mycobacterium tuberculosis H37Rv
gccgaaguagacggugguga

SEQ ID NO: 1315757 - RNA, 19 nt, Mycobacterium tuberculosis H37Rv
gccgacaaccccgccagga

SEQ ID NO: 1315758 - RNA, 21 nt, Mycobacterium tuberculosis H37Rv
gccgaauaccgguggcagccu

SEQ ID NO: 1315759 - RNA, 17 nt, Mycobacterium tuberculosis H37Rv
gccgaaucgcugaccgc

SEQ ID NO: 1315760 - RNA, 14 nt, Mycobacterium tuberculosis H37Rv
gcccuuaagccggc

SEQ ID NO: 1315761 - RNA, 20 nt, Mycobacterium tuberculosis H37Rv
gcccuucagcguccugguga

SEQ ID NO: 1315762 - RNA, 18 nt, Mycobacterium tuberculosis H37Rv
gcccuucaguucgacggu

SEQ ID NO: 1315763 - RNA, 19 nt, Mycobacterium tuberculosis H37Rv
gcccuugccgccuuggccc

SEQ ID NO: 1315764 - RNA, 22 nt, Mycobacterium tuberculosis H37Rv
gcccuugccggcgagagcguca

SEQ ID NO: 1315765 - RNA, 18 nt, Mycobacterium tuberculosis H37Rv
gcccuugccuuguuccag

SEQ ID NO: 1315766 - RNA, 14 nt, Mycobacterium tuberculosis H37Rv
gcccuugccgccuu

SEQ ID NO: 1315767 - RNA, 14 nt, Mycobacterium tuberculosis H37Rv
gcccuugccgccag

SEQ ID NO: 1315768 - RNA, 18 nt, Mycobacterium tuberculosis H37Rv
gcccuugggacugcggac

SEQ ID NO: 1315769 - RNA, 16 nt, Mycobacterium tuberculosis H37Rv
gcccuuggccagcagg

SEQ ID NO: 1315770 - RNA, 14 nt, Mycobacterium tuberculosis H37Rv
gcccuuggccagca

SEQ ID NO: 1315771 - RNA, 22 nt, Mycobacterium tuberculosis H37Rv
gccgaaaaagaccgacagcggc

SEQ ID NO: 1315772 - RNA, 16 nt, Mycobacterium tuberculosis H37Rv
gccgaaaaugccgccc

SEQ ID NO: 1315773 - RNA, 23 nt, Mycobacterium tuberculosis H37Rv
gccgaaaaugccgcccagcgacc

SEQ ID NO: 1315774 - RNA, 15 nt, Mycobacterium tuberculosis H37Rv
gccgaaacagcaccc

SEQ ID NO: 1315775 - RNA, 19 nt, Mycobacterium tuberculosis H37Rv
gccgaaacgccgaccgcgc

SEQ ID NO: 1315776 - RNA, 15 nt, Mycobacterium tuberculosis H37Rv
gccgaaagcaucacc

SEQ ID NO: 1315777 - RNA, 20 nt, Mycobacterium tuberculosis H37Rv
gccgaaaucggccagcuucc

SEQ ID NO: 1315778 - RNA, 13 nt, Mycobacterium tuberculosis H37Rv
gccgaacacaccg

SEQ ID NO: 1315779 - RNA, 19 nt, Mycobacterium tuberculosis H37Rv
gccgaacaccacaccgagc

SEQ ID NO: 1315780 - RNA, 21 nt, Mycobacterium tuberculosis H37Rv
gccgaacaaccuucgggcgcg

SEQ ID NO: 1315781 - RNA, 23 nt, Mycobacterium tuberculosis H37Rv
gccgaacaauaaggccgcacggg

SEQ ID NO: 1315782 - RNA, 20 nt, Mycobacterium tuberculosis H37Rv
gccgaacaccgucagcgucu

SEQ ID NO: 1315783 - RNA, 17 nt, Mycobacterium tuberculosis H37Rv
gccgaacaccgccgcgu

SEQ ID NO: 1315784 - RNA, 20 nt, Mycobacterium tuberculosis H37Rv
gccgaaccggcaccagcggc

SEQ ID NO: 1315785 - RNA, 14 nt, Mycobacterium tuberculosis H37Rv
gccgaaccagcgau

SEQ ID NO: 1315786 - RNA, 22 nt, Mycobacterium tuberculosis H37Rv
gccgaacccgccgucaccgcgc

SEQ ID NO: 1315787 - RNA, 21 nt, Mycobacterium tuberculosis H37Rv
gccgaacagcgaaccgccggc

SEQ ID NO: 1315788 - RNA, 14 nt, Mycobacterium tuberculosis H37Rv
gccgaacagcgacg

SEQ ID NO: 1315789 - RNA, 16 nt, Mycobacterium tuberculosis H37Rv
gccgaacagcagcccg

SEQ ID NO: 1315790 - RNA, 18 nt, Mycobacterium tuberculosis H37Rv
gccgaacagcaggccucc

SEQ ID NO: 1315791 - RNA, 23 nt, Mycobacterium tuberculosis H37Rv
gccgaacagcugcccgccagcgc

SEQ ID NO: 1315792 - RNA, 20 nt, Mycobacterium tuberculosis H37Rv
gccgaacagcaggccuccaa

SEQ ID NO: 1315793 - RNA, 20 nt, Mycobacterium tuberculosis H37Rv
gccgaacagggaggucgccg

SEQ ID NO: 1315794 - RNA, 13 nt, Mycobacterium tuberculosis H37Rv
gccgaggcaaccg

SEQ ID NO: 1315795 - RNA, 19 nt, Mycobacterium tuberculosis H37Rv
gccgaggucgaacgcccgc

SEQ ID NO: 1315796 - RNA, 21 nt, Mycobacterium tuberculosis H37Rv
gccgaggucgaaccgccggcu

SEQ ID NO: 1315797 - RNA, 14 nt, Mycobacterium tuberculosis H37Rv
gccgagcuccucca

SEQ ID NO: 1315798 - RNA, 20 nt, Mycobacterium tuberculosis H37Rv
gccgagcucggucaccacgg

SEQ ID NO: 1315799 - RNA, 19 nt, Mycobacterium tuberculosis H37Rv
gccgagcucguaguguucc

SEQ ID NO: 1315800 - RNA, 17 nt, Mycobacterium tuberculosis H37Rv
gccgagcucguugcugg

SEQ ID NO: 1315801 - RNA, 18 nt, Mycobacterium tuberculosis H37Rv
gccgagcuucagcgcgcu

SEQ ID NO: 1315802 - RNA, 19 nt, Mycobacterium tuberculosis H37Rv
gccgagcugguuggcgccg

SEQ ID NO: 1315803 - RNA, 19 nt, Mycobacterium tuberculosis H37Rv
gccgagcuggcgaccuggu

SEQ ID NO: 1315804 - RNA, 18 nt, Mycobacterium tuberculosis H37Rv
gccgaggaccagaggcgc

SEQ ID NO: 1315805 - RNA, 19 nt, Mycobacterium tuberculosis H37Rv
gccgaggaccagaggcgcu

SEQ ID NO: 1315806 - RNA, 15 nt, Mycobacterium tuberculosis H37Rv
gccgaggaccagagg

SEQ ID NO: 1315807 - RNA, 21 nt, Mycobacterium tuberculosis H37Rv
gccgagcuggcaacgccgcgc

SEQ ID NO: 1315808 - RNA, 23 nt, Mycobacterium tuberculosis H37Rv
gccgagcuugagcgugagcgccg

SEQ ID NO: 1315809 - RNA, 22 nt, Mycobacterium tuberculosis H37Rv
gccgaggacuggaaagcagcag

SEQ ID NO: 1315810 - RNA, 22 nt, Mycobacterium tuberculosis H37Rv
gccgaggacgccggcgccgcca

SEQ ID NO: 1315811 - RNA, 16 nt, Mycobacterium tuberculosis H37Rv
gccgaggacgccggcg

SEQ ID NO: 1315812 - RNA, 20 nt, Mycobacterium tuberculosis H37Rv
gccgaggacgccggcgccgc

SEQ ID NO: 1315813 - RNA, 15 nt, Mycobacterium tuberculosis H37Rv
gccgaucgacacccg

SEQ ID NO: 1315814 - RNA, 16 nt, Mycobacterium tuberculosis H37Rv
gccgaucccggcgagc

SEQ ID NO: 1315815 - RNA, 18 nt, Mycobacterium tuberculosis H37Rv
gccgauccaggagugauu

SEQ ID NO: 1315816 - RNA, 20 nt, Mycobacterium tuberculosis H37Rv
gccgaguaccggccagccgc

SEQ ID NO: 1315817 - RNA, 15 nt, Mycobacterium tuberculosis H37Rv
gccgaucagcuggcu

SEQ ID NO: 1315818 - RNA, 22 nt, Mycobacterium tuberculosis H37Rv
gccgauuacggugaucgccggc

SEQ ID NO: 1315819 - RNA, 15 nt, Mycobacterium tuberculosis H37Rv
gccgaucccguggug

SEQ ID NO: 1315820 - RNA, 23 nt, Mycobacterium tuberculosis H37Rv
gccgaugugauuauugauuacgu

SEQ ID NO: 1315821 - RNA, 23 nt, Mycobacterium tuberculosis H37Rv
gccgauugcuucuucgggccgcu

SEQ ID NO: 1315822 - RNA, 14 nt, Mycobacterium tuberculosis H37Rv
gccgcaaccggcga

SEQ ID NO: 1315823 - RNA, 23 nt, Mycobacterium tuberculosis H37Rv
gccgcaaccauguuaacgcgcgu

SEQ ID NO: 1315824 - RNA, 21 nt, Mycobacterium tuberculosis H37Rv
gccgagccagcuccggcgcuc

SEQ ID NO: 1315825 - RNA, 15 nt, Mycobacterium tuberculosis H37Rv
gccgagcccggugcu

SEQ ID NO: 1315826 - RNA, 11 nt, Mycobacterium tuberculosis H37Rv
gccgagcagcu

SEQ ID NO: 1315827 - RNA, 20 nt, Mycobacterium tuberculosis H37Rv
gccgagcagcuccuugaggu

SEQ ID NO: 1315828 - RNA, 16 nt, Mycobacterium tuberculosis H37Rv
gccgagcgcaaggucg

SEQ ID NO: 1315829 - RNA, 21 nt, Mycobacterium tuberculosis H37Rv
gccgagccgauauaccagggc

SEQ ID NO: 1315830 - RNA, 14 nt, Mycobacterium tuberculosis H37Rv
gccgagccgcccgc

SEQ ID NO: 1315831 - RNA, 19 nt, Mycobacterium tuberculosis H37Rv
gccgagagcagccagccac

SEQ ID NO: 1315832 - RNA, 18 nt, Mycobacterium tuberculosis H37Rv
gccgagaucacgccgggc

SEQ ID NO: 1315833 - RNA, 12 nt, Mycobacterium tuberculosis H37Rv
gccgagauccgc

SEQ ID NO: 1315834 - RNA, 17 nt, Mycobacterium tuberculosis H37Rv
gccgagcagcccgcgga

SEQ ID NO: 1315835 - RNA, 18 nt, Mycobacterium tuberculosis H37Rv
gccgagcacucggccacg

SEQ ID NO: 1315836 - RNA, 20 nt, Mycobacterium tuberculosis H37Rv
gccgagcacgccgagcccgc

SEQ ID NO: 1315837 - RNA, 22 nt, Mycobacterium tuberculosis H37Rv
gccgacuuccgcgucgccggcc

SEQ ID NO: 1315838 - RNA, 14 nt, Mycobacterium tuberculosis H37Rv
gccgacugggcgcg

SEQ ID NO: 1315839 - RNA, 21 nt, Mycobacterium tuberculosis H37Rv
gccgacugggcgcgaccccag

SEQ ID NO: 1315840 - RNA, 17 nt, Mycobacterium tuberculosis H37Rv
gccgacuucgucaacca

SEQ ID NO: 1315841 - RNA, 20 nt, Mycobacterium tuberculosis H37Rv
gccgagaauuccccagccgc

SEQ ID NO: 1315842 - RNA, 20 nt, Mycobacterium tuberculosis H37Rv
gccgaccucguucgucacca

SEQ ID NO: 1315843 - RNA, 21 nt, Mycobacterium tuberculosis H37Rv
gccgaccucaucggcaccguc

SEQ ID NO: 1315844 - RNA, 16 nt, Mycobacterium tuberculosis H37Rv
gccgaccggguugaug

SEQ ID NO: 1315845 - RNA, 18 nt, Mycobacterium tuberculosis H37Rv
gccgaccggucagcgcgc

SEQ ID NO: 1315846 - RNA, 21 nt, Mycobacterium tuberculosis H37Rv
gccgaccggucagcgcgcggc

SEQ ID NO: 1315847 - RNA, 22 nt, Mycobacterium tuberculosis H37Rv
gccgaccgucacugaugggccg

SEQ ID NO: 1315848 - RNA, 23 nt, Mycobacterium tuberculosis H37Rv
gccgaccgggcucuggccagucc

SEQ ID NO: 1315849 - RNA, 14 nt, Mycobacterium tuberculosis H37Rv
gccgaccgggcucu

SEQ ID NO: 1315850 - RNA, 21 nt, Mycobacterium tuberculosis H37Rv
gccgaccugcgcgacggcgcu

SEQ ID NO: 1315851 - RNA, 14 nt, Mycobacterium tuberculosis H37Rv
gccgaccggcggca

SEQ ID NO: 1315852 - RNA, 22 nt, Mycobacterium tuberculosis H37Rv
gccgaccugguaugccgcccgc

SEQ ID NO: 1315853 - RNA, 19 nt, Mycobacterium tuberculosis H37Rv
gccgaccuuuugcggcaag

SEQ ID NO: 1315854 - RNA, 19 nt, Mycobacterium tuberculosis H37Rv
gccgacgacaacagccagc

SEQ ID NO: 1315855 - RNA, 21 nt, Mycobacterium tuberculosis H37Rv
gccgacgaacgaaccgccgcc

SEQ ID NO: 1315856 - RNA, 23 nt, Mycobacterium tuberculosis H37Rv
gccgacgaacgaaccgccgccgc

SEQ ID NO: 1315857 - RNA, 19 nt, Mycobacterium tuberculosis H37Rv
gccgacgccgccggccccg

SEQ ID NO: 1315858 - RNA, 13 nt, Mycobacterium tuberculosis H37Rv
gccgacgcgcggc

SEQ ID NO: 1315859 - RNA, 19 nt, Mycobacterium tuberculosis H37Rv
gccgacgaucgacgccgcc

SEQ ID NO: 1315860 - RNA, 16 nt, Mycobacterium tuberculosis H37Rv
gccgacgagacggcag

SEQ ID NO: 1315861 - RNA, 17 nt, Mycobacterium tuberculosis H37Rv
gccgacgaccagcagau

SEQ ID NO: 1315862 - RNA, 21 nt, Mycobacterium tuberculosis H37Rv
gccgacgaccgccugcaacac

SEQ ID NO: 1315863 - RNA, 15 nt, Mycobacterium tuberculosis H37Rv
gccgacgucuaggcc

SEQ ID NO: 1315864 - RNA, 21 nt, Mycobacterium tuberculosis H37Rv
gccgacgucuaggccaaaccc

SEQ ID NO: 1315865 - RNA, 23 nt, Mycobacterium tuberculosis H37Rv
gccgacuagcuggggucaaagca

SEQ ID NO: 1315866 - RNA, 15 nt, Mycobacterium tuberculosis H37Rv
gccgacuaucggccg

SEQ ID NO: 1315867 - RNA, 19 nt, Mycobacterium tuberculosis H37Rv
gccgacucggcaccgcggc

SEQ ID NO: 1315868 - RNA, 16 nt, Mycobacterium tuberculosis H37Rv
gccgacucaucggccg

SEQ ID NO: 1315869 - RNA, 19 nt, Mycobacterium tuberculosis H37Rv
gccgacuaucggccgccgg

SEQ ID NO: 1315870 - RNA, 16 nt, Mycobacterium tuberculosis H37Rv
gccgacucaggucggu

SEQ ID NO: 1315871 - RNA, 18 nt, Mycobacterium tuberculosis H37Rv
gccgacuccccgccgggc

SEQ ID NO: 1315872 - RNA, 16 nt, Mycobacterium tuberculosis H37Rv
gccgacggccagcagg

SEQ ID NO: 1315873 - RNA, 17 nt, Mycobacterium tuberculosis H37Rv
gccgacgcgcggccagc

SEQ ID NO: 1315874 - RNA, 15 nt, Mycobacterium tuberculosis H37Rv
gccgacggcggcggc

SEQ ID NO: 1315875 - RNA, 21 nt, Mycobacterium tuberculosis H37Rv
gccgccuugaggcccugcggc

SEQ ID NO: 1315876 - RNA, 17 nt, Mycobacterium tuberculosis H37Rv
gccgcgaaacccugaaa

SEQ ID NO: 1315877 - RNA, 13 nt, Mycobacterium tuberculosis H37Rv
gccgcgagcgcgc

SEQ ID NO: 1315878 - RNA, 17 nt, Mycobacterium tuberculosis H37Rv
gccgcgagcgcgcgacu

SEQ ID NO: 1315879 - RNA, 23 nt, Mycobacterium tuberculosis H37Rv
gccgcgaaauuacuucggccaca

SEQ ID NO: 1315880 - RNA, 23 nt, Mycobacterium tuberculosis H37Rv
gccgcgagacgcaugucgggcca

SEQ ID NO: 1315881 - RNA, 16 nt, Mycobacterium tuberculosis H37Rv
gccgcgauggccccug

SEQ ID NO: 1315882 - RNA, 21 nt, Mycobacterium tuberculosis H37Rv
gccgccugcuccucggccagc

SEQ ID NO: 1315883 - RNA, 17 nt, Mycobacterium tuberculosis H37Rv
gccgccugcgccgccag

SEQ ID NO: 1315884 - RNA, 14 nt, Mycobacterium tuberculosis H37Rv
gccgccugucgggc

SEQ ID NO: 1315885 - RNA, 22 nt, Mycobacterium tuberculosis H37Rv
gccgccuucuucucggcgagcu

SEQ ID NO: 1315886 - RNA, 22 nt, Mycobacterium tuberculosis H37Rv
gccgccuuccuggcgggcgccu

SEQ ID NO: 1315887 - RNA, 17 nt, Mycobacterium tuberculosis H37Rv
gccgccuucgccgccgc

SEQ ID NO: 1315888 - RNA, 12 nt, Mycobacterium tuberculosis H37Rv
gccgccuucuug

SEQ ID NO: 1315889 - RNA, 19 nt, Mycobacterium tuberculosis H37Rv
gccgccuugacccuccgca

SEQ ID NO: 1315890 - RNA, 17 nt, Mycobacterium tuberculosis H37Rv
gccgccggugccgccgg

SEQ ID NO: 1315891 - RNA, 16 nt, Mycobacterium tuberculosis H37Rv
gccgccggugccgccu

SEQ ID NO: 1315892 - RNA, 17 nt, Mycobacterium tuberculosis H37Rv
gccgccggugccgccau

SEQ ID NO: 1315893 - RNA, 16 nt, Mycobacterium tuberculosis H37Rv
gccgccggugccgccc

SEQ ID NO: 1315894 - RNA, 16 nt, Mycobacterium tuberculosis H37Rv
gccgccgggugcgccg

SEQ ID NO: 1315895 - RNA, 19 nt, Mycobacterium tuberculosis H37Rv
gccgccggucaucccaagc

SEQ ID NO: 1315896 - RNA, 16 nt, Mycobacterium tuberculosis H37Rv
gccgccggugccaccg

SEQ ID NO: 1315897 - RNA, 22 nt, Mycobacterium tuberculosis H37Rv
gccgccgguuccgccggcccca

SEQ ID NO: 1315898 - RNA, 18 nt, Mycobacterium tuberculosis H37Rv
gccgccgguuccgccggc

SEQ ID NO: 1315899 - RNA, 14 nt, Mycobacterium tuberculosis H37Rv
gccgccgguguugc

SEQ ID NO: 1315900 - RNA, 16 nt, Mycobacterium tuberculosis H37Rv
gccgccggugucgggc

SEQ ID NO: 1315901 - RNA, 20 nt, Mycobacterium tuberculosis H37Rv
gccgccggugccgccugcgc

SEQ ID NO: 1315902 - RNA, 23 nt, Mycobacterium tuberculosis H37Rv
gccgccgguggugccggcgccgc

SEQ ID NO: 1315903 - RNA, 13 nt, Mycobacterium tuberculosis H37Rv
gccgcgcccggcg

SEQ ID NO: 1315904 - RNA, 18 nt, Mycobacterium tuberculosis H37Rv
gccgcgcccggcgcaagc

SEQ ID NO: 1315905 - RNA, 18 nt, Mycobacterium tuberculosis H37Rv
gccgcgcccggcgcuagc

SEQ ID NO: 1315906 - RNA, 22 nt, Mycobacterium tuberculosis H37Rv
gccgcgcccgagaccggcaccg

SEQ ID NO: 1315907 - RNA, 15 nt, Mycobacterium tuberculosis H37Rv
gccgcgccggcggcc

SEQ ID NO: 1315908 - RNA, 14 nt, Mycobacterium tuberculosis H37Rv
gccgcgccggcggc

SEQ ID NO: 1315909 - RNA, 13 nt, Mycobacterium tuberculosis H37Rv
gccgcgccgcaga

SEQ ID NO: 1315910 - RNA, 20 nt, Mycobacterium tuberculosis H37Rv
gccgcgccguagagccgcuc

SEQ ID NO: 1315911 - RNA, 24 nt, Mycobacterium tuberculosis H37Rv
gccgcgccguaguucuccgccaac

SEQ ID NO: 1315912 - RNA, 15 nt, Mycobacterium tuberculosis H37Rv
gccgcgccgucggcg

SEQ ID NO: 1315913 - RNA, 17 nt, Mycobacterium tuberculosis H37Rv
gccgcgccgcgccgccu

SEQ ID NO: 1315914 - RNA, 20 nt, Mycobacterium tuberculosis H37Rv
gccgcgcgcugccgcugcgc

SEQ ID NO: 1315915 - RNA, 14 nt, Mycobacterium tuberculosis H37Rv
gccgcgcgccggcc

SEQ ID NO: 1315916 - RNA, 14 nt, Mycobacterium tuberculosis H37Rv
gccgcgcgccgguu

SEQ ID NO: 1315917 - RNA, 22 nt, Mycobacterium tuberculosis H37Rv
gccgcgcgccaucgccuccagc

SEQ ID NO: 1315918 - RNA, 19 nt, Mycobacterium tuberculosis H37Rv
gccgcgcggacccagcacc

SEQ ID NO: 1315919 - RNA, 13 nt, Mycobacterium tuberculosis H37Rv
gccgcgcgcgccg

SEQ ID NO: 1315920 - RNA, 17 nt, Mycobacterium tuberculosis H37Rv
gccgcgcgggccgccgc

SEQ ID NO: 1315921 - RNA, 21 nt, Mycobacterium tuberculosis H37Rv
gccgcgcgggccgccgcaagu

SEQ ID NO: 1315922 - RNA, 16 nt, Mycobacterium tuberculosis H37Rv
gccgccgacaaccccg

SEQ ID NO: 1315923 - RNA, 14 nt, Mycobacterium tuberculosis H37Rv
gccgccgacaggga

SEQ ID NO: 1315924 - RNA, 16 nt, Mycobacterium tuberculosis H37Rv
gccgccgaccagaacg

SEQ ID NO: 1315925 - RNA, 17 nt, Mycobacterium tuberculosis H37Rv
gccgccgaagccgcgca

SEQ ID NO: 1315926 - RNA, 23 nt, Mycobacterium tuberculosis H37Rv
gccgccgacaccaccggcgccgc

SEQ ID NO: 1315927 - RNA, 18 nt, Mycobacterium tuberculosis H37Rv
gccgccgaccggagccgc

SEQ ID NO: 1315928 - RNA, 21 nt, Mycobacterium tuberculosis H37Rv
gccgccgauaccgccggcccc

SEQ ID NO: 1315929 - RNA, 14 nt, Mycobacterium tuberculosis H37Rv
gccgccgaucugcu

SEQ ID NO: 1315930 - RNA, 19 nt, Mycobacterium tuberculosis H37Rv
gccgccgaucugcugcagc

SEQ ID NO: 1315931 - RNA, 15 nt, Mycobacterium tuberculosis H37Rv
gccgccgaugccacc

SEQ ID NO: 1315932 - RNA, 17 nt, Mycobacterium tuberculosis H37Rv
gccgccgagcuggcgcg

SEQ ID NO: 1315933 - RNA, 23 nt, Mycobacterium tuberculosis H37Rv
gccgccgaggacacauugaccag

SEQ ID NO: 1315934 - RNA, 23 nt, Mycobacterium tuberculosis H37Rv
gccgccgaggucgguucggccgg

SEQ ID NO: 1315935 - RNA, 19 nt, Mycobacterium tuberculosis H37Rv
gccgcaagccucgugguga

SEQ ID NO: 1315936 - RNA, 22 nt, Mycobacterium tuberculosis H37Rv
gccgcacaaacgggcgugggcc

SEQ ID NO: 1315937 - RNA, 22 nt, Mycobacterium tuberculosis H37Rv
gccgccgaaacucaccagcacc

SEQ ID NO: 1315938 - RNA, 15 nt, Mycobacterium tuberculosis H37Rv
gccgccgaacagcug

SEQ ID NO: 1315939 - RNA, 12 nt, Mycobacterium tuberculosis H37Rv
gccgcccuugcc

SEQ ID NO: 1315940 - RNA, 18 nt, Mycobacterium tuberculosis H37Rv
gccgcccuugccgcccgc

SEQ ID NO: 1315941 - RNA, 17 nt, Mycobacterium tuberculosis H37Rv
gccgcccuugccgccgg

SEQ ID NO: 1315942 - RNA, 19 nt, Mycobacterium tuberculosis H37Rv
gccgcccuugccgccggcc

SEQ ID NO: 1315943 - RNA, 15 nt, Mycobacterium tuberculosis H37Rv
gccgccgcggccggc

SEQ ID NO: 1315944 - RNA, 19 nt, Mycobacterium tuberculosis H37Rv
gccgccgcuuucgccggcg

SEQ ID NO: 1315945 - RNA, 20 nt, Mycobacterium tuberculosis H37Rv
gccgccggcaccgccggcgc

SEQ ID NO: 1315946 - RNA, 22 nt, Mycobacterium tuberculosis H37Rv
gccgccggcaccgccggcgccg

SEQ ID NO: 1315947 - RNA, 16 nt, Mycobacterium tuberculosis H37Rv
gccgccggcaccgggg

SEQ ID NO: 1315948 - RNA, 16 nt, Mycobacterium tuberculosis H37Rv
gccgccggcaccuccc

SEQ ID NO: 1315949 - RNA, 12 nt, Mycobacterium tuberculosis H37Rv
gccgccggaggu

SEQ ID NO: 1315950 - RNA, 17 nt, Mycobacterium tuberculosis H37Rv
gccgccggaggucgggc

SEQ ID NO: 1315951 - RNA, 15 nt, Mycobacterium tuberculosis H37Rv
gccgccggccgcgca

SEQ ID NO: 1315952 - RNA, 11 nt, Mycobacterium tuberculosis H37Rv
gccgccggcca

SEQ ID NO: 1315953 - RNA, 15 nt, Mycobacterium tuberculosis H37Rv
gccgccggccccgcc

SEQ ID NO: 1315954 - RNA, 12 nt, Mycobacterium tuberculosis H37Rv
gccgccggccgc

SEQ ID NO: 1315955 - RNA, 14 nt, Mycobacterium tuberculosis H37Rv
gccgccggccgcca

SEQ ID NO: 1315956 - RNA, 18 nt, Mycobacterium tuberculosis H37Rv
gccgccgaugccaccgcu

SEQ ID NO: 1315957 - RNA, 18 nt, Mycobacterium tuberculosis H37Rv
gccgccgaugccgccggc

SEQ ID NO: 1315958 - RNA, 22 nt, Mycobacterium tuberculosis H37Rv
gccgccgauguagacgguggcg

SEQ ID NO: 1315959 - RNA, 23 nt, Mycobacterium tuberculosis H37Rv
gccgccgauguagacgguggcgc

SEQ ID NO: 1315960 - RNA, 16 nt, Mycobacterium tuberculosis H37Rv
gccgccgccggcgccg

SEQ ID NO: 1315961 - RNA, 18 nt, Mycobacterium tuberculosis H37Rv
gccgccgaucuugagccg

SEQ ID NO: 1315962 - RNA, 16 nt, Mycobacterium tuberculosis H37Rv
gccgccgccgucggcg

SEQ ID NO: 1315963 - RNA, 17 nt, Mycobacterium tuberculosis H37Rv
gccgccgcgagcgccgg

SEQ ID NO: 1315964 - RNA, 13 nt, Mycobacterium tuberculosis H37Rv
gccgccgcgagga

SEQ ID NO: 1315965 - RNA, 15 nt, Mycobacterium tuberculosis H37Rv
gccgccgcgacugac

SEQ ID NO: 1315966 - RNA, 21 nt, Mycobacterium tuberculosis H37Rv
gccgccgcgcguucggcgcug

SEQ ID NO: 1315967 - RNA, 12 nt, Mycobacterium tuberculosis H37Rv
gccgccgcggcc

SEQ ID NO: 1315968 - RNA, 12 nt, Mycobacterium tuberculosis H37Rv
gccgccgcgccg

SEQ ID NO: 1315969 - RNA, 14 nt, Mycobacterium tuberculosis H37Rv
gccgccgcgccggc

SEQ ID NO: 1315970 - RNA, 13 nt, Mycobacterium tuberculosis H37Rv
gccgccgcgggcg

SEQ ID NO: 1315971 - RNA, 19 nt, Mycobacterium tuberculosis H37Rv
gccgcgucgagcaccuugg

SEQ ID NO: 1315972 - RNA, 21 nt, Mycobacterium tuberculosis H37Rv
gccgcgucuuggugcgcguca

SEQ ID NO: 1315973 - RNA, 22 nt, Mycobacterium tuberculosis H37Rv
gccgcgugacguaccacggcga

SEQ ID NO: 1315974 - RNA, 14 nt, Mycobacterium tuberculosis H37Rv
gccgcgugccgccc

SEQ ID NO: 1315975 - RNA, 15 nt, Mycobacterium tuberculosis H37Rv
gccgcgucggccgcg

SEQ ID NO: 1315976 - RNA, 16 nt, Mycobacterium tuberculosis H37Rv
gccgcgucggccgcgc

SEQ ID NO: 1315977 - RNA, 16 nt, Mycobacterium tuberculosis H37Rv
gccgcgugccgcccgc

SEQ ID NO: 1315978 - RNA, 16 nt, Mycobacterium tuberculosis H37Rv
gccgcgucucggugca

SEQ ID NO: 1315979 - RNA, 18 nt, Mycobacterium tuberculosis H37Rv
gccgcugcauccgcagca

SEQ ID NO: 1315980 - RNA, 18 nt, Mycobacterium tuberculosis H37Rv
gccgcugccaugcgggug

SEQ ID NO: 1315981 - RNA, 13 nt, Mycobacterium tuberculosis H37Rv
gccgcugccacag

SEQ ID NO: 1315982 - RNA, 12 nt, Mycobacterium tuberculosis H37Rv
gccgcugccacu

SEQ ID NO: 1315983 - RNA, 13 nt, Mycobacterium tuberculosis H37Rv
gccgcugccuugg

SEQ ID NO: 1315984 - RNA, 21 nt, Mycobacterium tuberculosis H37Rv
gccgcugccgcccuugccgcc

SEQ ID NO: 1315985 - RNA, 13 nt, Mycobacterium tuberculosis H37Rv
gccgcugccgccg

SEQ ID NO: 1315986 - RNA, 17 nt, Mycobacterium tuberculosis H37Rv
gccgcugccgccgagcu

SEQ ID NO: 1315987 - RNA, 21 nt, Mycobacterium tuberculosis H37Rv
gccgcuccacguacgcggcug

SEQ ID NO: 1315988 - RNA, 22 nt, Mycobacterium tuberculosis H37Rv
gccgcuccaaaagccucagccg

SEQ ID NO: 1315989 - RNA, 18 nt, Mycobacterium tuberculosis H37Rv
gccgcucaucgaucccgu

SEQ ID NO: 1315990 - RNA, 23 nt, Mycobacterium tuberculosis H37Rv
gccgcuccacguacgcggcugcg

SEQ ID NO: 1315991 - RNA, 22 nt, Mycobacterium tuberculosis H37Rv
gccgcucccgcacaagcccagc

SEQ ID NO: 1315992 - RNA, 19 nt, Mycobacterium tuberculosis H37Rv
gccgcucgaaauccuggug

SEQ ID NO: 1315993 - RNA, 22 nt, Mycobacterium tuberculosis H37Rv
gccgcugauguacccggcgacg

SEQ ID NO: 1315994 - RNA, 15 nt, Mycobacterium tuberculosis H37Rv
gccgcgcuugcgauc

SEQ ID NO: 1315995 - RNA, 23 nt, Mycobacterium tuberculosis H37Rv
gccgcgcuggugauucgcagccg

SEQ ID NO: 1315996 - RNA, 18 nt, Mycobacterium tuberculosis H37Rv
gccgcgcucaucgcggcg

SEQ ID NO: 1315997 - RNA, 20 nt, Mycobacterium tuberculosis H37Rv
gccgcggagaaggcgcgggc

SEQ ID NO: 1315998 - RNA, 21 nt, Mycobacterium tuberculosis H37Rv
gccgcggagaaggcgcgggcg

SEQ ID NO: 1315999 - RNA, 14 nt, Mycobacterium tuberculosis H37Rv
gccgcggaccccga

SEQ ID NO: 1316000 - RNA, 19 nt, Mycobacterium tuberculosis H37Rv
gccgcggaggcggccagcc

SEQ ID NO: 1316001 - RNA, 22 nt, Mycobacterium tuberculosis H37Rv
gccgcggaguaggccgcgcccg

SEQ ID NO: 1316002 - RNA, 23 nt, Mycobacterium tuberculosis H37Rv
gccgcggaguaggccgcgcccga

SEQ ID NO: 1316003 - RNA, 14 nt, Mycobacterium tuberculosis H37Rv
gccgcggacggcga

SEQ ID NO: 1316004 - RNA, 14 nt, Mycobacterium tuberculosis H37Rv
gccgcggcagggcg

SEQ ID NO: 1316005 - RNA, 18 nt, Mycobacterium tuberculosis H37Rv
gccgcggcaccgccccgc

SEQ ID NO: 1316006 - RNA, 19 nt, Mycobacterium tuberculosis H37Rv
gccgcggcaccgccgagca

SEQ ID NO: 1316007 - RNA, 21 nt, Mycobacterium tuberculosis H37Rv
gccgcggcgccauagccgcga

SEQ ID NO: 1316008 - RNA, 16 nt, Mycobacterium tuberculosis H37Rv
gccgcggcccgcgugc

SEQ ID NO: 1316009 - RNA, 12 nt, Mycobacterium tuberculosis H37Rv
gccgcggcggca

SEQ ID NO: 1316010 - RNA, 11 nt, Mycobacterium tuberculosis H37Rv
gccgcggcggc

SEQ ID NO: 1316011 - RNA, 15 nt, Mycobacterium tuberculosis H37Rv
gccgcggcggccagc

SEQ ID NO: 1316012 - RNA, 18 nt, Mycobacterium tuberculosis H37Rv
gccgcggccggcgcucgc

SEQ ID NO: 1316013 - RNA, 13 nt, Mycobacterium tuberculosis H37Rv
gccgcggccggcg

SEQ ID NO: 1316014 - RNA, 12 nt, Mycobacterium tuberculosis H37Rv
gccgcggccacc

SEQ ID NO: 1316015 - RNA, 13 nt, Mycobacterium tuberculosis H37Rv
gccgcggccaccg

SEQ ID NO: 1316016 - RNA, 18 nt, Mycobacterium tuberculosis H37Rv
gccggagccgccggcccc

SEQ ID NO: 1316017 - RNA, 20 nt, Mycobacterium tuberculosis H37Rv
gccggagccgccggccccgc

SEQ ID NO: 1316018 - RNA, 19 nt, Mycobacterium tuberculosis H37Rv
gccggagccggugccgacg

SEQ ID NO: 1316019 - RNA, 14 nt, Mycobacterium tuberculosis H37Rv
gccggagacacccg

SEQ ID NO: 1316020 - RNA, 21 nt, Mycobacterium tuberculosis H37Rv
gccggacugaagccgcgagcg

SEQ ID NO: 1316021 - RNA, 17 nt, Mycobacterium tuberculosis H37Rv
gccggagaucuugcgca

SEQ ID NO: 1316022 - RNA, 20 nt, Mycobacterium tuberculosis H37Rv
gccggagacgucgccgcagu

SEQ ID NO: 1316023 - RNA, 15 nt, Mycobacterium tuberculosis H37Rv
gccggaugcgcuucc

SEQ ID NO: 1316024 - RNA, 20 nt, Mycobacterium tuberculosis H37Rv
gccggcaccgccgcccccgc

SEQ ID NO: 1316025 - RNA, 17 nt, Mycobacterium tuberculosis H37Rv
gccggcaccgccgcccc

SEQ ID NO: 1316026 - RNA, 15 nt, Mycobacterium tuberculosis H37Rv
gccggcaccgcagcg

SEQ ID NO: 1316027 - RNA, 14 nt, Mycobacterium tuberculosis H37Rv
gccggcaccggaug

SEQ ID NO: 1316028 - RNA, 12 nt, Mycobacterium tuberculosis H37Rv
gccggcaccggg

SEQ ID NO: 1316029 - RNA, 15 nt, Mycobacterium tuberculosis H37Rv
gccggcaccgccggc

SEQ ID NO: 1316030 - RNA, 20 nt, Mycobacterium tuberculosis H37Rv
gccggcaccgccggcgcccc

SEQ ID NO: 1316031 - RNA, 14 nt, Mycobacterium tuberculosis H37Rv
gccggccaacuggg

SEQ ID NO: 1316032 - RNA, 21 nt, Mycobacterium tuberculosis H37Rv
gccggcagcaucggcaccccg

SEQ ID NO: 1316033 - RNA, 12 nt, Mycobacterium tuberculosis H37Rv
gccggcagcagc

SEQ ID NO: 1316034 - RNA, 14 nt, Mycobacterium tuberculosis H37Rv
gccggcaccuccgg

SEQ ID NO: 1316035 - RNA, 21 nt, Mycobacterium tuberculosis H37Rv
gccggcaccuccggcaccgcc

SEQ ID NO: 1316036 - RNA, 21 nt, Mycobacterium tuberculosis H37Rv
gccggaauacccggcccauug

SEQ ID NO: 1316037 - RNA, 16 nt, Mycobacterium tuberculosis H37Rv
gccggaauacccgcug

SEQ ID NO: 1316038 - RNA, 18 nt, Mycobacterium tuberculosis H37Rv
gccggaauacccgcuggc

SEQ ID NO: 1316039 - RNA, 14 nt, Mycobacterium tuberculosis H37Rv
gccggaacugcgca

SEQ ID NO: 1316040 - RNA, 20 nt, Mycobacterium tuberculosis H37Rv
gccggaacgagcggccgcgc

SEQ ID NO: 1316041 - RNA, 21 nt, Mycobacterium tuberculosis H37Rv
gccggaacgcacgcccgccug

SEQ ID NO: 1316042 - RNA, 21 nt, Mycobacterium tuberculosis H37Rv
gccgcuuggccgcugccuucu

SEQ ID NO: 1316043 - RNA, 18 nt, Mycobacterium tuberculosis H37Rv
gccggaacgagcggccgc

SEQ ID NO: 1316044 - RNA, 14 nt, Mycobacterium tuberculosis H37Rv
gccggacugcggcc

SEQ ID NO: 1316045 - RNA, 17 nt, Mycobacterium tuberculosis H37Rv
gccggacuaccgccggc

SEQ ID NO: 1316046 - RNA, 20 nt, Mycobacterium tuberculosis H37Rv
gccggacguucuggaucgug

SEQ ID NO: 1316047 - RNA, 12 nt, Mycobacterium tuberculosis H37Rv
gccggacaacug

SEQ ID NO: 1316048 - RNA, 15 nt, Mycobacterium tuberculosis H37Rv
gccggacaaccuggg

SEQ ID NO: 1316049 - RNA, 21 nt, Mycobacterium tuberculosis H37Rv
gccgcuucggcggucagcggc

SEQ ID NO: 1316050 - RNA, 21 nt, Mycobacterium tuberculosis H37Rv
gccgcuucgggcgucauccgc

SEQ ID NO: 1316051 - RNA, 15 nt, Mycobacterium tuberculosis H37Rv
gccgcuugccccgcc

SEQ ID NO: 1316052 - RNA, 18 nt, Mycobacterium tuberculosis H37Rv
gccgcuugccccgccuug

SEQ ID NO: 1316053 - RNA, 18 nt, Mycobacterium tuberculosis H37Rv
gccgcuguugaucgacac

SEQ ID NO: 1316054 - RNA, 20 nt, Mycobacterium tuberculosis H37Rv
gccgcugccuuggcgcggca

SEQ ID NO: 1316055 - RNA, 16 nt, Mycobacterium tuberculosis H37Rv
gccgcugcgccgucgc

SEQ ID NO: 1316056 - RNA, 19 nt, Mycobacterium tuberculosis H37Rv
gccgcugcgccgucgcagc

SEQ ID NO: 1316057 - RNA, 21 nt, Mycobacterium tuberculosis H37Rv
gccggucaacccucgccacgc

SEQ ID NO: 1316058 - RNA, 22 nt, Mycobacterium tuberculosis H37Rv
gccggucagcaauacggcggcg

SEQ ID NO: 1316059 - RNA, 16 nt, Mycobacterium tuberculosis H37Rv
gccggucaggccgccg

SEQ ID NO: 1316060 - RNA, 20 nt, Mycobacterium tuberculosis H37Rv
gccggucaccucgccggcgg

SEQ ID NO: 1316061 - RNA, 18 nt, Mycobacterium tuberculosis H37Rv
gccgguccagacccagcu

SEQ ID NO: 1316062 - RNA, 13 nt, Mycobacterium tuberculosis H37Rv
gccgguccagcag

SEQ ID NO: 1316063 - RNA, 21 nt, Mycobacterium tuberculosis H37Rv
gccgguccccccguugccgcc

SEQ ID NO: 1316064 - RNA, 18 nt, Mycobacterium tuberculosis H37Rv
gccggucaccucgccggc

SEQ ID NO: 1316065 - RNA, 20 nt, Mycobacterium tuberculosis H37Rv
gccggucagggcuuguacga

SEQ ID NO: 1316066 - RNA, 17 nt, Mycobacterium tuberculosis H37Rv
gccggucaguauggcga

SEQ ID NO: 1316067 - RNA, 17 nt, Mycobacterium tuberculosis H37Rv
gccgguccccgccggcg

SEQ ID NO: 1316068 - RNA, 13 nt, Mycobacterium tuberculosis H37Rv
gccgguccccgcc

SEQ ID NO: 1316069 - RNA, 17 nt, Mycobacterium tuberculosis H37Rv
gccgguccccucggugc

SEQ ID NO: 1316070 - RNA, 17 nt, Mycobacterium tuberculosis H37Rv
gccgguaccgggacgaa

SEQ ID NO: 1316071 - RNA, 13 nt, Mycobacterium tuberculosis H37Rv
gccgggcuggcga

SEQ ID NO: 1316072 - RNA, 17 nt, Mycobacterium tuberculosis H37Rv
gccgguagcacagcagc

SEQ ID NO: 1316073 - RNA, 18 nt, Mycobacterium tuberculosis H37Rv
gccgguagcacagcagca

SEQ ID NO: 1316074 - RNA, 17 nt, Mycobacterium tuberculosis H37Rv
gccgguaggcggccagc

SEQ ID NO: 1316075 - RNA, 18 nt, Mycobacterium tuberculosis H37Rv
gccgguaggcggccagcg

SEQ ID NO: 1316076 - RNA, 23 nt, Mycobacterium tuberculosis H37Rv
gccgggcuccucugguugggagc

SEQ ID NO: 1316077 - RNA, 14 nt, Mycobacterium tuberculosis H37Rv
gccgggcucagcug

SEQ ID NO: 1316078 - RNA, 14 nt, Mycobacterium tuberculosis H37Rv
gccggucgagacgc

SEQ ID NO: 1316079 - RNA, 15 nt, Mycobacterium tuberculosis H37Rv
gccggucgaggugac

SEQ ID NO: 1316080 - RNA, 19 nt, Mycobacterium tuberculosis H37Rv
gccggucggugagccgugc

SEQ ID NO: 1316081 - RNA, 15 nt, Mycobacterium tuberculosis H37Rv
gccggucgugccggg

SEQ ID NO: 1316082 - RNA, 15 nt, Mycobacterium tuberculosis H37Rv
gccggugacgacguc

SEQ ID NO: 1316083 - RNA, 14 nt, Mycobacterium tuberculosis H37Rv
gccggugacucaga

SEQ ID NO: 1316084 - RNA, 16 nt, Mycobacterium tuberculosis H37Rv
gccggugagcgagcgc

SEQ ID NO: 1316085 - RNA, 18 nt, Mycobacterium tuberculosis H37Rv
gccggugaggcgaccgga

SEQ ID NO: 1316086 - RNA, 16 nt, Mycobacterium tuberculosis H37Rv
gccggugaccgcgaug

SEQ ID NO: 1316087 - RNA, 15 nt, Mycobacterium tuberculosis H37Rv
gccggugaacaggga

SEQ ID NO: 1316088 - RNA, 17 nt, Mycobacterium tuberculosis H37Rv
gccggugaacagggacu

SEQ ID NO: 1316089 - RNA, 22 nt, Mycobacterium tuberculosis H37Rv
gccggugauggccgaccagccg

SEQ ID NO: 1316090 - RNA, 13 nt, Mycobacterium tuberculosis H37Rv
gccggugccaccg

SEQ ID NO: 1316091 - RNA, 15 nt, Mycobacterium tuberculosis H37Rv
gccggugccaccggc

SEQ ID NO: 1316092 - RNA, 19 nt, Mycobacterium tuberculosis H37Rv
gccggugccaccggcuggu

SEQ ID NO: 1316093 - RNA, 18 nt, Mycobacterium tuberculosis H37Rv
gccggugcccgggcguca

SEQ ID NO: 1316094 - RNA, 17 nt, Mycobacterium tuberculosis H37Rv
gccggugccgccgccug

SEQ ID NO: 1316095 - RNA, 15 nt, Mycobacterium tuberculosis H37Rv
gccggugccgccauc

SEQ ID NO: 1316096 - RNA, 21 nt, Mycobacterium tuberculosis H37Rv
gccggugccgccaucgccgcc

SEQ ID NO: 1316097 - RNA, 15 nt, Mycobacterium tuberculosis H37Rv
gccggugccgccauu

SEQ ID NO: 1316098 - RNA, 15 nt, Mycobacterium tuberculosis H37Rv
gccggugcgcugguu

SEQ ID NO: 1316099 - RNA, 16 nt, Mycobacterium tuberculosis H37Rv
gccggugcgguggugc

SEQ ID NO: 1316100 - RNA, 22 nt, Mycobacterium tuberculosis H37Rv
gccggugccgccuccgccugcc

SEQ ID NO: 1316101 - RNA, 17 nt, Mycobacterium tuberculosis H37Rv
gccggugccgccugcgc

SEQ ID NO: 1316102 - RNA, 20 nt, Mycobacterium tuberculosis H37Rv
gccggugccgccugcgccgc

SEQ ID NO: 1316103 - RNA, 16 nt, Mycobacterium tuberculosis H37Rv
gccggugccgccgucg

SEQ ID NO: 1316104 - RNA, 17 nt, Mycobacterium tuberculosis H37Rv
gccggugccgccgucgc

SEQ ID NO: 1316105 - RNA, 12 nt, Mycobacterium tuberculosis H37Rv
gccggcgccggc

SEQ ID NO: 1316106 - RNA, 17 nt, Mycobacterium tuberculosis H37Rv
gccggcgccgccgugcg

SEQ ID NO: 1316107 - RNA, 16 nt, Mycobacterium tuberculosis H37Rv
gccggcgccgccgucg

SEQ ID NO: 1316108 - RNA, 14 nt, Mycobacterium tuberculosis H37Rv
gccggcgccgcccu

SEQ ID NO: 1316109 - RNA, 16 nt, Mycobacterium tuberculosis H37Rv
gccggcgccgccggcg

SEQ ID NO: 1316110 - RNA, 13 nt, Mycobacterium tuberculosis H37Rv
gccggccagcggc

SEQ ID NO: 1316111 - RNA, 12 nt, Mycobacterium tuberculosis H37Rv
gccggccaccuc

SEQ ID NO: 1316112 - RNA, 19 nt, Mycobacterium tuberculosis H37Rv
gccggccacgcauuccagc

SEQ ID NO: 1316113 - RNA, 20 nt, Mycobacterium tuberculosis H37Rv
gccggccaauggccugcagc

SEQ ID NO: 1316114 - RNA, 19 nt, Mycobacterium tuberculosis H37Rv
gccggccaccaccgcgccg

SEQ ID NO: 1316115 - RNA, 14 nt, Mycobacterium tuberculosis H37Rv
gccggccagcaggu

SEQ ID NO: 1316116 - RNA, 19 nt, Mycobacterium tuberculosis H37Rv
gccggccagacggugcagc

SEQ ID NO: 1316117 - RNA, 20 nt, Mycobacterium tuberculosis H37Rv
gccggcgccuuggucgccgc

SEQ ID NO: 1316118 - RNA, 16 nt, Mycobacterium tuberculosis H37Rv
gccggcgcgcaccccg

SEQ ID NO: 1316119 - RNA, 12 nt, Mycobacterium tuberculosis H37Rv
gccggcgcgccg

SEQ ID NO: 1316120 - RNA, 13 nt, Mycobacterium tuberculosis H37Rv
gccggcgcgcccc

SEQ ID NO: 1316121 - RNA, 14 nt, Mycobacterium tuberculosis H37Rv
gccggcggcggugc

SEQ ID NO: 1316122 - RNA, 15 nt, Mycobacterium tuberculosis H37Rv
gccggcggcgguggu

SEQ ID NO: 1316123 - RNA, 20 nt, Mycobacterium tuberculosis H37Rv
gccggcggcggcgcucggcc

SEQ ID NO: 1316124 - RNA, 23 nt, Mycobacterium tuberculosis H37Rv
gccggcggcucgggugcgcccgg

SEQ ID NO: 1316125 - RNA, 12 nt, Mycobacterium tuberculosis H37Rv
gccggcggcugu

SEQ ID NO: 1316126 - RNA, 21 nt, Mycobacterium tuberculosis H37Rv
gccggcggcggccgcagcggc

SEQ ID NO: 1316127 - RNA, 14 nt, Mycobacterium tuberculosis H37Rv
gccggcggcggccg

SEQ ID NO: 1316128 - RNA, 12 nt, Mycobacterium tuberculosis H37Rv
gccggcggcggc

SEQ ID NO: 1316129 - RNA, 23 nt, Mycobacterium tuberculosis H37Rv
gccggcguacuucgacagcggcg

SEQ ID NO: 1316130 - RNA, 15 nt, Mycobacterium tuberculosis H37Rv
gccggcgucagcccc

SEQ ID NO: 1316131 - RNA, 20 nt, Mycobacterium tuberculosis H37Rv
gccggcgguaagcccagaca

SEQ ID NO: 1316132 - RNA, 21 nt, Mycobacterium tuberculosis H37Rv
gccggcgguagucggccagcu

SEQ ID NO: 1316133 - RNA, 23 nt, Mycobacterium tuberculosis H37Rv
gccggcuagggcccuggcggccc

SEQ ID NO: 1316134 - RNA, 18 nt, Mycobacterium tuberculosis H37Rv
gccggcuagggcagcagc

SEQ ID NO: 1316135 - RNA, 16 nt, Mycobacterium tuberculosis H37Rv
gccggcgugcgcgaga

SEQ ID NO: 1316136 - RNA, 21 nt, Mycobacterium tuberculosis H37Rv
gccggcgucggcgcccagcuc

SEQ ID NO: 1316137 - RNA, 19 nt, Mycobacterium tuberculosis H37Rv
gccggcgucgacccugccc

SEQ ID NO: 1316138 - RNA, 19 nt, Mycobacterium tuberculosis H37Rv
gccggcuuugagccgcucg

SEQ ID NO: 1316139 - RNA, 17 nt, Mycobacterium tuberculosis H37Rv
gccgggaacaucccagc

SEQ ID NO: 1316140 - RNA, 17 nt, Mycobacterium tuberculosis H37Rv
gccgggagacgcugcgc

SEQ ID NO: 1316141 - RNA, 19 nt, Mycobacterium tuberculosis H37Rv
gccgggaucgccguccagc

SEQ ID NO: 1316142 - RNA, 16 nt, Mycobacterium tuberculosis H37Rv
gccgggauugccgucg

SEQ ID NO: 1316143 - RNA, 16 nt, Mycobacterium tuberculosis H37Rv
gccgggaugccgccgc

SEQ ID NO: 1316144 - RNA, 19 nt, Mycobacterium tuberculosis H37Rv
gccgggaugccgccgcuga

SEQ ID NO: 1316145 - RNA, 16 nt, Mycobacterium tuberculosis H37Rv
gccgggaugccggccc

SEQ ID NO: 1316146 - RNA, 16 nt, Mycobacterium tuberculosis H37Rv
gccgggaucaccgggg

SEQ ID NO: 1316147 - RNA, 15 nt, Mycobacterium tuberculosis H37Rv
gccgggcgcgccggc

SEQ ID NO: 1316148 - RNA, 22 nt, Mycobacterium tuberculosis H37Rv
gccgucgccaccagagucaaca

SEQ ID NO: 1316149 - RNA, 23 nt, Mycobacterium tuberculosis H37Rv
gccgucgcggcacgcccacagcu

SEQ ID NO: 1316150 - RNA, 11 nt, Mycobacterium tuberculosis H37Rv
gccgucgccgu

SEQ ID NO: 1316151 - RNA, 23 nt, Mycobacterium tuberculosis H37Rv
gccgucgccguacaaccacccac

SEQ ID NO: 1316152 - RNA, 15 nt, Mycobacterium tuberculosis H37Rv
gccgucgcagccagc

SEQ ID NO: 1316153 - RNA, 15 nt, Mycobacterium tuberculosis H37Rv
gccgucgccaccauc

SEQ ID NO: 1316154 - RNA, 23 nt, Mycobacterium tuberculosis H37Rv
gccgucgccgaacagcagcccgc

SEQ ID NO: 1316155 - RNA, 22 nt, Mycobacterium tuberculosis H37Rv
gccgucgaugaucugcuugcca

SEQ ID NO: 1316156 - RNA, 14 nt, Mycobacterium tuberculosis H37Rv
gccgucgcaccaga

SEQ ID NO: 1316157 - RNA, 22 nt, Mycobacterium tuberculosis H37Rv
gccgucgauguugccgagagcc

SEQ ID NO: 1316158 - RNA, 17 nt, Mycobacterium tuberculosis H37Rv
gccguccgaccagggau

SEQ ID NO: 1316159 - RNA, 15 nt, Mycobacterium tuberculosis H37Rv
gccguccgcaccggc

SEQ ID NO: 1316160 - RNA, 21 nt, Mycobacterium tuberculosis H37Rv
gccguccccgccgucgccacc

SEQ ID NO: 1316161 - RNA, 14 nt, Mycobacterium tuberculosis H37Rv
gccguccccgccgc

SEQ ID NO: 1316162 - RNA, 21 nt, Mycobacterium tuberculosis H37Rv
gccgucccgaaacgccggguu

SEQ ID NO: 1316163 - RNA, 17 nt, Mycobacterium tuberculosis H37Rv
gccguccucccacaggu

SEQ ID NO: 1316164 - RNA, 16 nt, Mycobacterium tuberculosis H37Rv
gccguccgggcggccu

SEQ ID NO: 1316165 - RNA, 19 nt, Mycobacterium tuberculosis H37Rv
gccguccggcuuggcggcg

SEQ ID NO: 1316166 - RNA, 15 nt, Mycobacterium tuberculosis H37Rv
gccguccgggcggcc

SEQ ID NO: 1316167 - RNA, 14 nt, Mycobacterium tuberculosis H37Rv
gccguccucccaca

SEQ ID NO: 1316168 - RNA, 15 nt, Mycobacterium tuberculosis H37Rv
gccgucgacgcaugg

SEQ ID NO: 1316169 - RNA, 17 nt, Mycobacterium tuberculosis H37Rv
gccgucgacccagcaug

SEQ ID NO: 1316170 - RNA, 17 nt, Mycobacterium tuberculosis H37Rv
gccgucgacgcgguccu

SEQ ID NO: 1316171 - RNA, 15 nt, Mycobacterium tuberculosis H37Rv
gccgucgaccggcgg

SEQ ID NO: 1316172 - RNA, 18 nt, Mycobacterium tuberculosis H37Rv
gccgugaccgagccgcga

SEQ ID NO: 1316173 - RNA, 17 nt, Mycobacterium tuberculosis H37Rv
gccgugaccaggugcca

SEQ ID NO: 1316174 - RNA, 14 nt, Mycobacterium tuberculosis H37Rv
gccgugaccaggug

SEQ ID NO: 1316175 - RNA, 23 nt, Mycobacterium tuberculosis H37Rv
gccgucugaucacucacccgggc

SEQ ID NO: 1316176 - RNA, 22 nt, Mycobacterium tuberculosis H37Rv
gccgugcugaacuccgccgcga

SEQ ID NO: 1316177 - RNA, 18 nt, Mycobacterium tuberculosis H37Rv
gccgugcggcggcugccg

SEQ ID NO: 1316178 - RNA, 17 nt, Mycobacterium tuberculosis H37Rv
gccgugcgggccggucg

SEQ ID NO: 1316179 - RNA, 19 nt, Mycobacterium tuberculosis H37Rv
gccgugcggucgcgcccuc

SEQ ID NO: 1316180 - RNA, 20 nt, Mycobacterium tuberculosis H37Rv
gccguggagcacagcacggc

SEQ ID NO: 1316181 - RNA, 20 nt, Mycobacterium tuberculosis H37Rv
gccguggcaucgccuccagg

SEQ ID NO: 1316182 - RNA, 17 nt, Mycobacterium tuberculosis H37Rv
gccguuaaucaagguga

SEQ ID NO: 1316183 - RNA, 15 nt, Mycobacterium tuberculosis H37Rv
gccguucccgccggc

SEQ ID NO: 1316184 - RNA, 13 nt, Mycobacterium tuberculosis H37Rv
gccgguggcccgc

SEQ ID NO: 1316185 - RNA, 22 nt, Mycobacterium tuberculosis H37Rv
gccgguggcccgccggcaguga

SEQ ID NO: 1316186 - RNA, 14 nt, Mycobacterium tuberculosis H37Rv
gccgguggcgccgc

SEQ ID NO: 1316187 - RNA, 15 nt, Mycobacterium tuberculosis H37Rv
gccgguggcgccgcc

SEQ ID NO: 1316188 - RNA, 17 nt, Mycobacterium tuberculosis H37Rv
gccgguggcgccgccgc

SEQ ID NO: 1316189 - RNA, 19 nt, Mycobacterium tuberculosis H37Rv
gccgguggugccggcgccg

SEQ ID NO: 1316190 - RNA, 23 nt, Mycobacterium tuberculosis H37Rv
gccggugggcgguccgcgucugg

SEQ ID NO: 1316191 - RNA, 13 nt, Mycobacterium tuberculosis H37Rv
gccgguggggccc

SEQ ID NO: 1316192 - RNA, 20 nt, Mycobacterium tuberculosis H37Rv
gccgguguaggccucggcag

SEQ ID NO: 1316193 - RNA, 18 nt, Mycobacterium tuberculosis H37Rv
gccggugucuggguggac

SEQ ID NO: 1316194 - RNA, 21 nt, Mycobacterium tuberculosis H37Rv
gccgguguugauuccggcgug

SEQ ID NO: 1316195 - RNA, 19 nt, Mycobacterium tuberculosis H37Rv
gccgguguugccgccggug

SEQ ID NO: 1316196 - RNA, 21 nt, Mycobacterium tuberculosis H37Rv
gccgguguuuccgaaacccgc

SEQ ID NO: 1316197 - RNA, 19 nt, Mycobacterium tuberculosis H37Rv
gccggugugcccgccugga

SEQ ID NO: 1316198 - RNA, 22 nt, Mycobacterium tuberculosis H37Rv
gccgguguuuccgaaacccgcc

SEQ ID NO: 1316199 - RNA, 18 nt, Mycobacterium tuberculosis H37Rv
gccgguuccgccggcccc

SEQ ID NO: 1316200 - RNA, 17 nt, Mycobacterium tuberculosis H37Rv
gccgguucccuuguucc

SEQ ID NO: 1316201 - RNA, 15 nt, Mycobacterium tuberculosis H37Rv
gccgguuccgcaaug

SEQ ID NO: 1316202 - RNA, 16 nt, Mycobacterium tuberculosis H37Rv
gccgguugucgcagcg

SEQ ID NO: 1316203 - RNA, 19 nt, Mycobacterium tuberculosis H37Rv
gccgguuggccagugacuc

SEQ ID NO: 1316204 - RNA, 15 nt, Mycobacterium tuberculosis H37Rv
gccgguuggcugccg

SEQ ID NO: 1316205 - RNA, 22 nt, Mycobacterium tuberculosis H37Rv
gccgguuccucagcggcccgcu

SEQ ID NO: 1316206 - RNA, 19 nt, Mycobacterium tuberculosis H37Rv
gccgguuugggcgcgugcc

SEQ ID NO: 1316207 - RNA, 14 nt, Mycobacterium tuberculosis H37Rv
gccguacaaccacc

SEQ ID NO: 1316208 - RNA, 17 nt, Mycobacterium tuberculosis H37Rv
gccguacaaccacccac

SEQ ID NO: 1316209 - RNA, 13 nt, Mycobacterium tuberculosis H37Rv
gccguacagcggc

SEQ ID NO: 1316210 - RNA, 15 nt, Mycobacterium tuberculosis H37Rv
gccguaccaguuauu

SEQ ID NO: 1316211 - RNA, 23 nt, Mycobacterium tuberculosis H37Rv
gccguacaaccacccacccgcac

SEQ ID NO: 1316212 - RNA, 16 nt, Mycobacterium tuberculosis H37Rv
gccguacacaccgagc

SEQ ID NO: 1316213 - RNA, 17 nt, Mycobacterium tuberculosis H37Rv
gccguacacaccgagca

SEQ ID NO: 1316214 - RNA, 16 nt, Mycobacterium tuberculosis H37Rv
gccguaguggccggcu

SEQ ID NO: 1316215 - RNA, 23 nt, Mycobacterium tuberculosis H37Rv
gccguagguugcgccccgacugc

SEQ ID NO: 1316216 - RNA, 19 nt, Mycobacterium tuberculosis H37Rv
gccguaugccgccaaccgc

SEQ ID NO: 1316217 - RNA, 18 nt, Mycobacterium tuberculosis H37Rv
gccgucaagauugaacga

SEQ ID NO: 1316218 - RNA, 14 nt, Mycobacterium tuberculosis H37Rv
gccguagccgccgu

SEQ ID NO: 1316219 - RNA, 20 nt, Mycobacterium tuberculosis H37Rv
gccgucagggucagcuggga

SEQ ID NO: 1316220 - RNA, 13 nt, Mycobacterium tuberculosis H37Rv
gccgucagggugu

SEQ ID NO: 1316221 - RNA, 15 nt, Mycobacterium tuberculosis H37Rv
gccgucagcaccgcu

SEQ ID NO: 1316222 - RNA, 18 nt, Mycobacterium tuberculosis H37Rv
gccgucaccgcugagccc

SEQ ID NO: 1316223 - RNA, 20 nt, Mycobacterium tuberculosis H37Rv
gccgucagcacaaacccagu

SEQ ID NO: 1316224 - RNA, 13 nt, Mycobacterium tuberculosis H37Rv
gccgucacccccg

SEQ ID NO: 1316225 - RNA, 22 nt, Mycobacterium tuberculosis H37Rv
gccgucagcucaccacccagau

SEQ ID NO: 1316226 - RNA, 19 nt, Mycobacterium tuberculosis H37Rv
gccguccagguucaugcaa

SEQ ID NO: 1316227 - RNA, 17 nt, Mycobacterium tuberculosis H37Rv
gccgucaucuggaagua

SEQ ID NO: 1316228 - RNA, 20 nt, Mycobacterium tuberculosis H37Rv
gccgucaugcccaucuccaa

SEQ ID NO: 1316229 - RNA, 12 nt, Mycobacterium tuberculosis H37Rv
gagugcagcacg

SEQ ID NO: 1316230 - RNA, 14 nt, Mycobacterium tuberculosis H37Rv
gagugccgccgucg

SEQ ID NO: 1316231 - RNA, 19 nt, Mycobacterium tuberculosis H37Rv
gagugcacgcuugaaagcg

SEQ ID NO: 1316232 - RNA, 19 nt, Mycobacterium tuberculosis H37Rv
gagucugauggccucgcga

SEQ ID NO: 1316233 - RNA, 22 nt, Mycobacterium tuberculosis H37Rv
gagucgguucagccacgcagca

SEQ ID NO: 1316234 - RNA, 15 nt, Mycobacterium tuberculosis H37Rv
gagucgggggccgcg

SEQ ID NO: 1316235 - RNA, 17 nt, Mycobacterium tuberculosis H37Rv
gagucggcugguccucc

SEQ ID NO: 1316236 - RNA, 15 nt, Mycobacterium tuberculosis H37Rv
gagucgcccgcacac

SEQ ID NO: 1316237 - RNA, 13 nt, Mycobacterium tuberculosis H37Rv
gagucgcccgcac

SEQ ID NO: 1316238 - RNA, 16 nt, Mycobacterium tuberculosis H37Rv
gagucaagcagcagca

SEQ ID NO: 1316239 - RNA, 12 nt, Mycobacterium tuberculosis H37Rv
gaguugaagaag

SEQ ID NO: 1316240 - RNA, 22 nt, Mycobacterium tuberculosis H37Rv
gaguucgguugcccccagggcc

SEQ ID NO: 1316241 - RNA, 14 nt, Mycobacterium tuberculosis H37Rv
gaguucggugcugu

SEQ ID NO: 1316242 - RNA, 14 nt, Mycobacterium tuberculosis H37Rv
gaguucggccgcgg

SEQ ID NO: 1316243 - RNA, 14 nt, Mycobacterium tuberculosis H37Rv
gauacagucgaccg

SEQ ID NO: 1316244 - RNA, 18 nt, Mycobacterium tuberculosis H37Rv
gauacagcacauccagcc

SEQ ID NO: 1316245 - RNA, 16 nt, Mycobacterium tuberculosis H37Rv
gaucagggucagcgcc

SEQ ID NO: 1316246 - RNA, 16 nt, Mycobacterium tuberculosis H37Rv
gaucaggggcccaccc

SEQ ID NO: 1316247 - RNA, 21 nt, Mycobacterium tuberculosis H37Rv
gaucaggcgggcaacgcagca

SEQ ID NO: 1316248 - RNA, 19 nt, Mycobacterium tuberculosis H37Rv
gaucagcgugaucugcagg

SEQ ID NO: 1316249 - RNA, 16 nt, Mycobacterium tuberculosis H37Rv
gaucagguuggcggcu

SEQ ID NO: 1316250 - RNA, 17 nt, Mycobacterium tuberculosis H37Rv
gaucaggucgucacgcc

SEQ ID NO: 1316251 - RNA, 15 nt, Mycobacterium tuberculosis H37Rv
gaucaggucuucgau

SEQ ID NO: 1316252 - RNA, 14 nt, Mycobacterium tuberculosis H37Rv
gaucaggguggcgc

SEQ ID NO: 1316253 - RNA, 17 nt, Mycobacterium tuberculosis H37Rv
gaucaggguggcgcggu

SEQ ID NO: 1316254 - RNA, 18 nt, Mycobacterium tuberculosis H37Rv
gaucauguucggccacca

SEQ ID NO: 1316255 - RNA, 15 nt, Mycobacterium tuberculosis H37Rv
gaucagcccgcgcag

SEQ ID NO: 1316256 - RNA, 14 nt, Mycobacterium tuberculosis H37Rv
gaucagcccgcgca

SEQ ID NO: 1316257 - RNA, 22 nt, Mycobacterium tuberculosis H37Rv
gaucagcaggaucggcagcaga

SEQ ID NO: 1316258 - RNA, 20 nt, Mycobacterium tuberculosis H37Rv
gaucagcaggaucggcagca

SEQ ID NO: 1316259 - RNA, 13 nt, Mycobacterium tuberculosis H37Rv
gaucagcagcaga

SEQ ID NO: 1316260 - RNA, 17 nt, Mycobacterium tuberculosis H37Rv
gaucagcagcgccagca

SEQ ID NO: 1316261 - RNA, 21 nt, Mycobacterium tuberculosis H37Rv
gaucagcgaaccaccggcgcc

SEQ ID NO: 1316262 - RNA, 22 nt, Mycobacterium tuberculosis H37Rv
gaucagcgaggaauuccgcuac

SEQ ID NO: 1316263 - RNA, 23 nt, Mycobacterium tuberculosis H37Rv
gaucaacaccaacgacagcgacg

SEQ ID NO: 1316264 - RNA, 21 nt, Mycobacterium tuberculosis H37Rv
gaucaacucgggcagcgcggc

SEQ ID NO: 1316265 - RNA, 20 nt, Mycobacterium tuberculosis H37Rv
gauaugcgucgauugccgcg

SEQ ID NO: 1316266 - RNA, 12 nt, Mycobacterium tuberculosis H37Rv
gauauugccauc

SEQ ID NO: 1316267 - RNA, 22 nt, Mycobacterium tuberculosis H37Rv
gauauuggacgcgcaugccccg

SEQ ID NO: 1316268 - RNA, 21 nt, Mycobacterium tuberculosis H37Rv
gauauccgugaauggcagcac

SEQ ID NO: 1316269 - RNA, 16 nt, Mycobacterium tuberculosis H37Rv
gauauccuuugccgcc

SEQ ID NO: 1316270 - RNA, 19 nt, Mycobacterium tuberculosis H37Rv
gauagcaacgaagccggcg

SEQ ID NO: 1316271 - RNA, 21 nt, Mycobacterium tuberculosis H37Rv
gauaucgccgagaaccagcga

SEQ ID NO: 1316272 - RNA, 14 nt, Mycobacterium tuberculosis H37Rv
gauaucggcggcuu

SEQ ID NO: 1316273 - RNA, 16 nt, Mycobacterium tuberculosis H37Rv
gauccggucgggggcg

SEQ ID NO: 1316274 - RNA, 18 nt, Mycobacterium tuberculosis H37Rv
gauccggucggccaggcc

SEQ ID NO: 1316275 - RNA, 13 nt, Mycobacterium tuberculosis H37Rv
gauccgggcgccg

SEQ ID NO: 1316276 - RNA, 16 nt, Mycobacterium tuberculosis H37Rv
gauccggucggccagc

SEQ ID NO: 1316277 - RNA, 15 nt, Mycobacterium tuberculosis H37Rv
gauccggcuccaccc

SEQ ID NO: 1316278 - RNA, 21 nt, Mycobacterium tuberculosis H37Rv
gauccggaggcggcuccugag

SEQ ID NO: 1316279 - RNA, 17 nt, Mycobacterium tuberculosis H37Rv
gauccucgccggguacg

SEQ ID NO: 1316280 - RNA, 22 nt, Mycobacterium tuberculosis H37Rv
gauccucggccgccaucgcccg

SEQ ID NO: 1316281 - RNA, 16 nt, Mycobacterium tuberculosis H37Rv
gaucgaccauggucga

SEQ ID NO: 1316282 - RNA, 13 nt, Mycobacterium tuberculosis H37Rv
gaucgacccgguc

SEQ ID NO: 1316283 - RNA, 22 nt, Mycobacterium tuberculosis H37Rv
gaucgacgccgccacccggcgg

SEQ ID NO: 1316284 - RNA, 21 nt, Mycobacterium tuberculosis H37Rv
gaucgaccaauucgaccgcgc

SEQ ID NO: 1316285 - RNA, 17 nt, Mycobacterium tuberculosis H37Rv
gauccuggccacuccca

SEQ ID NO: 1316286 - RNA, 21 nt, Mycobacterium tuberculosis H37Rv
gauccacaacagcccguagca

SEQ ID NO: 1316287 - RNA, 15 nt, Mycobacterium tuberculosis H37Rv
gauccacgccagagc

SEQ ID NO: 1316288 - RNA, 13 nt, Mycobacterium tuberculosis H37Rv
gauccacgccaga

SEQ ID NO: 1316289 - RNA, 15 nt, Mycobacterium tuberculosis H37Rv
gauccacccagugcc

SEQ ID NO: 1316290 - RNA, 22 nt, Mycobacterium tuberculosis H37Rv
gauccacggcgaugcagccaca

SEQ ID NO: 1316291 - RNA, 20 nt, Mycobacterium tuberculosis H37Rv
gauccagcccaugcgccacg

SEQ ID NO: 1316292 - RNA, 19 nt, Mycobacterium tuberculosis H37Rv
gauccagcccgacgcccga

SEQ ID NO: 1316293 - RNA, 18 nt, Mycobacterium tuberculosis H37Rv
gauccagcccaugcgcca

SEQ ID NO: 1316294 - RNA, 13 nt, Mycobacterium tuberculosis H37Rv
gaucccgcccaag

SEQ ID NO: 1316295 - RNA, 13 nt, Mycobacterium tuberculosis H37Rv
gauccagccaugc

SEQ ID NO: 1316296 - RNA, 18 nt, Mycobacterium tuberculosis H37Rv
gauccgaagagccagcaa

SEQ ID NO: 1316297 - RNA, 21 nt, Mycobacterium tuberculosis H37Rv
gaucccuugucgaaguacugg

SEQ ID NO: 1316298 - RNA, 14 nt, Mycobacterium tuberculosis H37Rv
gauccgcacagcaa

SEQ ID NO: 1316299 - RNA, 20 nt, Mycobacterium tuberculosis H37Rv
gauccgcggcguuccccgag

SEQ ID NO: 1316300 - RNA, 16 nt, Mycobacterium tuberculosis H37Rv
gaucccggccagcucc

SEQ ID NO: 1316301 - RNA, 15 nt, Mycobacterium tuberculosis H37Rv
gaucccggccaggcc

SEQ ID NO: 1316302 - RNA, 11 nt, Mycobacterium tuberculosis H37Rv
gaucccggcgg

SEQ ID NO: 1316303 - RNA, 17 nt, Mycobacterium tuberculosis H37Rv
gauccgaagagccagca

SEQ ID NO: 1316304 - RNA, 18 nt, Mycobacterium tuberculosis H37Rv
gaucccgguggcagcaca

SEQ ID NO: 1316305 - RNA, 23 nt, Mycobacterium tuberculosis H37Rv
gaucggcggguggcgccaguucg

SEQ ID NO: 1316306 - RNA, 12 nt, Mycobacterium tuberculosis H37Rv
gaucggcucacg

SEQ ID NO: 1316307 - RNA, 16 nt, Mycobacterium tuberculosis H37Rv
gaucggcugcgcgcuc

SEQ ID NO: 1316308 - RNA, 15 nt, Mycobacterium tuberculosis H37Rv
gaucggggcgcugca

SEQ ID NO: 1316309 - RNA, 16 nt, Mycobacterium tuberculosis H37Rv
gaucggguggcggguc

SEQ ID NO: 1316310 - RNA, 15 nt, Mycobacterium tuberculosis H37Rv
gaucggguggcgggu

SEQ ID NO: 1316311 - RNA, 21 nt, Mycobacterium tuberculosis H37Rv
gaucggcgcggccguagugca

SEQ ID NO: 1316312 - RNA, 13 nt, Mycobacterium tuberculosis H37Rv
gaucggcgcggcc

SEQ ID NO: 1316313 - RNA, 18 nt, Mycobacterium tuberculosis H37Rv
gaucggcggaccgcagcg

SEQ ID NO: 1316314 - RNA, 15 nt, Mycobacterium tuberculosis H37Rv
gaucggcgccgcaua

SEQ ID NO: 1316315 - RNA, 15 nt, Mycobacterium tuberculosis H37Rv
gaucggcaggccgcu

SEQ ID NO: 1316316 - RNA, 22 nt, Mycobacterium tuberculosis H37Rv
gaucggcagucccagcgccgca

SEQ ID NO: 1316317 - RNA, 11 nt, Mycobacterium tuberculosis H37Rv
gaucggcacuu

SEQ ID NO: 1316318 - RNA, 20 nt, Mycobacterium tuberculosis H37Rv
gaucggccacgucccagaga

SEQ ID NO: 1316319 - RNA, 15 nt, Mycobacterium tuberculosis H37Rv
gaucgcguccuccuc

SEQ ID NO: 1316320 - RNA, 17 nt, Mycobacterium tuberculosis H37Rv
gaucgcguccuccucgg

SEQ ID NO: 1316321 - RNA, 21 nt, Mycobacterium tuberculosis H37Rv
gaucgcuccgcggcgcagcac

SEQ ID NO: 1316322 - RNA, 20 nt, Mycobacterium tuberculosis H37Rv
gaucgcuccgcggcgcagca

SEQ ID NO: 1316323 - RNA, 13 nt, Mycobacterium tuberculosis H37Rv
gaucgcggcggcc

SEQ ID NO: 1316324 - RNA, 19 nt, Mycobacterium tuberculosis H37Rv
gaucgcggcggccuccacc

SEQ ID NO: 1316325 - RNA, 23 nt, Mycobacterium tuberculosis H37Rv
gaucgcggucaaauccagcagcc

SEQ ID NO: 1316326 - RNA, 14 nt, Mycobacterium tuberculosis H37Rv
gaucgcggucagcg

SEQ ID NO: 1316327 - RNA, 18 nt, Mycobacterium tuberculosis H37Rv
gaucgcgguccaacagcg

SEQ ID NO: 1316328 - RNA, 15 nt, Mycobacterium tuberculosis H37Rv
gaucgcgguccgagc

SEQ ID NO: 1316329 - RNA, 20 nt, Mycobacterium tuberculosis H37Rv
gaucgcugcgaagccgagca

SEQ ID NO: 1316330 - RNA, 20 nt, Mycobacterium tuberculosis H37Rv
gaucggauuuuccgcgugua

SEQ ID NO: 1316331 - RNA, 14 nt, Mycobacterium tuberculosis H37Rv
gaucggcaaaccgu

SEQ ID NO: 1316332 - RNA, 16 nt, Mycobacterium tuberculosis H37Rv
gaucggaccaccaggg

SEQ ID NO: 1316333 - RNA, 13 nt, Mycobacterium tuberculosis H37Rv
gaucggcacccca

SEQ ID NO: 1316334 - RNA, 17 nt, Mycobacterium tuberculosis H37Rv
gaucggaggcccgccac

SEQ ID NO: 1316335 - RNA, 14 nt, Mycobacterium tuberculosis H37Rv
gaucgcagugggca

SEQ ID NO: 1316336 - RNA, 16 nt, Mycobacterium tuberculosis H37Rv
gaucgcacaccaacac

SEQ ID NO: 1316337 - RNA, 13 nt, Mycobacterium tuberculosis H37Rv
gaucgcagcgcca

SEQ ID NO: 1316338 - RNA, 18 nt, Mycobacterium tuberculosis H37Rv
gaucgagagccgaccggg

SEQ ID NO: 1316339 - RNA, 22 nt, Mycobacterium tuberculosis H37Rv
gaucgauccggcuccaccccca

SEQ ID NO: 1316340 - RNA, 16 nt, Mycobacterium tuberculosis H37Rv
gaucgaggcggcgguc

SEQ ID NO: 1316341 - RNA, 21 nt, Mycobacterium tuberculosis H37Rv
gaucgagguugacgucaggcu

SEQ ID NO: 1316342 - RNA, 15 nt, Mycobacterium tuberculosis H37Rv
gaucgccgaggcagc

SEQ ID NO: 1316343 - RNA, 22 nt, Mycobacterium tuberculosis H37Rv
gaucgccgaguccggcgagcuc

SEQ ID NO: 1316344 - RNA, 21 nt, Mycobacterium tuberculosis H37Rv
gaucgccucggacacggcagc

SEQ ID NO: 1316345 - RNA, 12 nt, Mycobacterium tuberculosis H37Rv
gaucgccgagca

SEQ ID NO: 1316346 - RNA, 15 nt, Mycobacterium tuberculosis H37Rv
gaucgccguccagca

SEQ ID NO: 1316347 - RNA, 14 nt, Mycobacterium tuberculosis H37Rv
gaucgccugagacu

SEQ ID NO: 1316348 - RNA, 19 nt, Mycobacterium tuberculosis H37Rv
gaucgcgagcgagccaacu

SEQ ID NO: 1316349 - RNA, 14 nt, Mycobacterium tuberculosis H37Rv
gaucgcgccgggcu

SEQ ID NO: 1316350 - RNA, 17 nt, Mycobacterium tuberculosis H37Rv
gaugacguugcagccgg

SEQ ID NO: 1316351 - RNA, 21 nt, Mycobacterium tuberculosis H37Rv
gaugaauucauguggcgcggg

SEQ ID NO: 1316352 - RNA, 20 nt, Mycobacterium tuberculosis H37Rv
gaucgucgugcacggcggcc

SEQ ID NO: 1316353 - RNA, 14 nt, Mycobacterium tuberculosis H37Rv
gaucgucgggagca

SEQ ID NO: 1316354 - RNA, 14 nt, Mycobacterium tuberculosis H37Rv
gaucguccggccgg

SEQ ID NO: 1316355 - RNA, 16 nt, Mycobacterium tuberculosis H37Rv
gaucguccagcccaga

SEQ ID NO: 1316356 - RNA, 19 nt, Mycobacterium tuberculosis H37Rv
gaucguccagcccagaucc

SEQ ID NO: 1316357 - RNA, 21 nt, Mycobacterium tuberculosis H37Rv
gaucgguuucugcggccccga

SEQ ID NO: 1316358 - RNA, 15 nt, Mycobacterium tuberculosis H37Rv
gaucgguggcggcac

SEQ ID NO: 1316359 - RNA, 19 nt, Mycobacterium tuberculosis H37Rv
gaucggugccagaaugccg

SEQ ID NO: 1316360 - RNA, 19 nt, Mycobacterium tuberculosis H37Rv
gaugaucuugccgcggcgc

SEQ ID NO: 1316361 - RNA, 23 nt, Mycobacterium tuberculosis H37Rv
gaugaucaugaacgccagcagcg

SEQ ID NO: 1316362 - RNA, 21 nt, Mycobacterium tuberculosis H37Rv
gaugagccgauccaggaguga

SEQ ID NO: 1316363 - RNA, 13 nt, Mycobacterium tuberculosis H37Rv
gaugagcgaggcu

SEQ ID NO: 1316364 - RNA, 18 nt, Mycobacterium tuberculosis H37Rv
gaugaugacggcggcccg

SEQ ID NO: 1316365 - RNA, 22 nt, Mycobacterium tuberculosis H37Rv
gaugcagcgguccagacaucag

SEQ ID NO: 1316366 - RNA, 13 nt, Mycobacterium tuberculosis H37Rv
gaugcaucggugc

SEQ ID NO: 1316367 - RNA, 19 nt, Mycobacterium tuberculosis H37Rv
gaugcaugucuuguggugg

SEQ ID NO: 1316368 - RNA, 18 nt, Mycobacterium tuberculosis H37Rv
gaugcgcaccagcggcug

SEQ ID NO: 1316369 - RNA, 23 nt, Mycobacterium tuberculosis H37Rv
gaugcgcaacuucuucagcagcg

SEQ ID NO: 1316370 - RNA, 18 nt, Mycobacterium tuberculosis H37Rv
gaugcgacagcgcugggc

SEQ ID NO: 1316371 - RNA, 18 nt, Mycobacterium tuberculosis H37Rv
gaugcgggccgccaggcg

SEQ ID NO: 1316372 - RNA, 17 nt, Mycobacterium tuberculosis H37Rv
gaugcgguaaguggugu

SEQ ID NO: 1316373 - RNA, 22 nt, Mycobacterium tuberculosis H37Rv
gaugcgggccgccaggcggccg

SEQ ID NO: 1316374 - RNA, 19 nt, Mycobacterium tuberculosis H37Rv
gaugccgccggcaccgccg

SEQ ID NO: 1316375 - RNA, 20 nt, Mycobacterium tuberculosis H37Rv
gaugccgccgaagaggagaa

SEQ ID NO: 1316376 - RNA, 23 nt, Mycobacterium tuberculosis H37Rv
gaugccgcccgugagauccucca

SEQ ID NO: 1316377 - RNA, 20 nt, Mycobacterium tuberculosis H37Rv
gaugccgccccgcagcugcg

SEQ ID NO: 1316378 - RNA, 21 nt, Mycobacterium tuberculosis H37Rv
gaugcccgguuucuucuucaa

SEQ ID NO: 1316379 - RNA, 20 nt, Mycobacterium tuberculosis H37Rv
gaugcccuccucgaccgcgg

SEQ ID NO: 1316380 - RNA, 10 nt, Mycobacterium tuberculosis H37Rv
gaugcugggc

SEQ ID NO: 1316381 - RNA, 12 nt, Mycobacterium tuberculosis H37Rv
gaugcggugcgg

SEQ ID NO: 1316382 - RNA, 16 nt, Mycobacterium tuberculosis H37Rv
gaugcguucgggcucc

SEQ ID NO: 1316383 - RNA, 20 nt, Mycobacterium tuberculosis H37Rv
gaugcguccgcccagccgca

SEQ ID NO: 1316384 - RNA, 17 nt, Mycobacterium tuberculosis H37Rv
gauggcaaacgcaccca

SEQ ID NO: 1316385 - RNA, 21 nt, Mycobacterium tuberculosis H37Rv
gauggauuggcgucagcagca

SEQ ID NO: 1316386 - RNA, 14 nt, Mycobacterium tuberculosis H37Rv
gauggacagcugcg

SEQ ID NO: 1316387 - RNA, 14 nt, Mycobacterium tuberculosis H37Rv
gauggacaccaccu

SEQ ID NO: 1316388 - RNA, 21 nt, Mycobacterium tuberculosis H37Rv
gauggaccgccagggcuugcc

SEQ ID NO: 1316389 - RNA, 18 nt, Mycobacterium tuberculosis H37Rv
gauggaaggcggccaggu

SEQ ID NO: 1316390 - RNA, 14 nt, Mycobacterium tuberculosis H37Rv
gaugggcagccgcc

SEQ ID NO: 1316391 - RNA, 20 nt, Mycobacterium tuberculosis H37Rv
gaugggcccagcggccgcga

SEQ ID NO: 1316392 - RNA, 12 nt, Mycobacterium tuberculosis H37Rv
gaugggccaggc

SEQ ID NO: 1316393 - RNA, 15 nt, Mycobacterium tuberculosis H37Rv
gaugggccaggcgcc

SEQ ID NO: 1316394 - RNA, 23 nt, Mycobacterium tuberculosis H37Rv
gauggggaacggguagugcacgg

SEQ ID NO: 1316395 - RNA, 21 nt, Mycobacterium tuberculosis H37Rv
gauggucauccagccagcaag

SEQ ID NO: 1316396 - RNA, 19 nt, Mycobacterium tuberculosis H37Rv
gauggucaaugcgcuggcg

SEQ ID NO: 1316397 - RNA, 14 nt, Mycobacterium tuberculosis H37Rv
gaugguacucaggu

SEQ ID NO: 1316398 - RNA, 21 nt, Mycobacterium tuberculosis H37Rv
gauggcggaaguucuccucgu

SEQ ID NO: 1316399 - RNA, 17 nt, Mycobacterium tuberculosis H37Rv
gauggcgcugcaccgua

SEQ ID NO: 1316400 - RNA, 15 nt, Mycobacterium tuberculosis H37Rv
gaugggagcccggcg

SEQ ID NO: 1316401 - RNA, 14 nt, Mycobacterium tuberculosis H37Rv
gauggcggccacca

SEQ ID NO: 1316402 - RNA, 13 nt, Mycobacterium tuberculosis H37Rv
gauggcaggggcg

SEQ ID NO: 1316403 - RNA, 15 nt, Mycobacterium tuberculosis H37Rv
gauggcaggggcgau

SEQ ID NO: 1316404 - RNA, 21 nt, Mycobacterium tuberculosis H37Rv
gauggcgaucaugagcagcac

SEQ ID NO: 1316405 - RNA, 14 nt, Mycobacterium tuberculosis H37Rv
gauggcgcccugcg

SEQ ID NO: 1316406 - RNA, 18 nt, Mycobacterium tuberculosis H37Rv
gauggcgauacgcgcguc

SEQ ID NO: 1316407 - RNA, 14 nt, Mycobacterium tuberculosis H37Rv
gauguaccccagcg

SEQ ID NO: 1316408 - RNA, 23 nt, Mycobacterium tuberculosis H37Rv
gauguaaccguagcccugcucag

SEQ ID NO: 1316409 - RNA, 14 nt, Mycobacterium tuberculosis H37Rv
gauggugccgaccc

SEQ ID NO: 1316410 - RNA, 18 nt, Mycobacterium tuberculosis H37Rv
gauggugccgacccgccg

SEQ ID NO: 1316411 - RNA, 16 nt, Mycobacterium tuberculosis H37Rv
gaugguggucaccacc

SEQ ID NO: 1316412 - RNA, 17 nt, Mycobacterium tuberculosis H37Rv
gaugguguacugcugcu

SEQ ID NO: 1316413 - RNA, 14 nt, Mycobacterium tuberculosis H37Rv
gauggugugcagca

SEQ ID NO: 1316414 - RNA, 16 nt, Mycobacterium tuberculosis H37Rv
gauggugugcagcagc

SEQ ID NO: 1316415 - RNA, 16 nt, Mycobacterium tuberculosis H37Rv
gauggugugcccgcac

SEQ ID NO: 1316416 - RNA, 17 nt, Mycobacterium tuberculosis H37Rv
gaugguggugccgaccu

SEQ ID NO: 1316417 - RNA, 20 nt, Mycobacterium tuberculosis H37Rv
gaugguggugccaaccuggg

SEQ ID NO: 1316418 - RNA, 20 nt, Mycobacterium tuberculosis H37Rv
gaugguuauccccuggccaa

SEQ ID NO: 1316419 - RNA, 15 nt, Mycobacterium tuberculosis H37Rv
gaugguucuggaucc

SEQ ID NO: 1316420 - RNA, 21 nt, Mycobacterium tuberculosis H37Rv
gauguuuuccccgcccuugcc

SEQ ID NO: 1316421 - RNA, 14 nt, Mycobacterium tuberculosis H37Rv
gaugucgaagucgu

SEQ ID NO: 1316422 - RNA, 16 nt, Mycobacterium tuberculosis H37Rv
gaugucgcccaaccga

SEQ ID NO: 1316423 - RNA, 20 nt, Mycobacterium tuberculosis H37Rv
gaugucagugaucaccaacc

SEQ ID NO: 1316424 - RNA, 18 nt, Mycobacterium tuberculosis H37Rv
gauguccgcggccaccac

SEQ ID NO: 1316425 - RNA, 17 nt, Mycobacterium tuberculosis H37Rv
gauguccgacgcaccaa

SEQ ID NO: 1316426 - RNA, 15 nt, Mycobacterium tuberculosis H37Rv
gauguccgcagcacc

SEQ ID NO: 1316427 - RNA, 16 nt, Mycobacterium tuberculosis H37Rv
gauuaagucggcggcc

SEQ ID NO: 1316428 - RNA, 21 nt, Mycobacterium tuberculosis H37Rv
gauuacggccagugucagcac

SEQ ID NO: 1316429 - RNA, 15 nt, Mycobacterium tuberculosis H37Rv
gauugaccgcggccg

SEQ ID NO: 1316430 - RNA, 18 nt, Mycobacterium tuberculosis H37Rv
gauuauucgcgguagccg

SEQ ID NO: 1316431 - RNA, 18 nt, Mycobacterium tuberculosis H37Rv
gauuggaaugguggugcc

SEQ ID NO: 1316432 - RNA, 17 nt, Mycobacterium tuberculosis H37Rv
gauugcguucaucaucc

SEQ ID NO: 1316433 - RNA, 15 nt, Mycobacterium tuberculosis H37Rv
gauugcgggccugca

SEQ ID NO: 1316434 - RNA, 15 nt, Mycobacterium tuberculosis H37Rv
gauugcgaagggcac

SEQ ID NO: 1316435 - RNA, 14 nt, Mycobacterium tuberculosis H37Rv
gauugcgggccugc

SEQ ID NO: 1316436 - RNA, 22 nt, Mycobacterium tuberculosis H37Rv
gauugccgguuuugccgugcca

SEQ ID NO: 1316437 - RNA, 20 nt, Mycobacterium tuberculosis H37Rv
gauugccugacaacucccga

SEQ ID NO: 1316438 - RNA, 17 nt, Mycobacterium tuberculosis H37Rv
gauuguggccagcgcuu

SEQ ID NO: 1316439 - RNA, 16 nt, Mycobacterium tuberculosis H37Rv
gauugugcagcgaaau

SEQ ID NO: 1316440 - RNA, 16 nt, Mycobacterium tuberculosis H37Rv
gauuuugugucugcuc

SEQ ID NO: 1316441 - RNA, 13 nt, Mycobacterium tuberculosis H37Rv
gcaaaccacccgc

SEQ ID NO: 1316442 - RNA, 13 nt, Mycobacterium tuberculosis H37Rv
gcaaaccccggac

SEQ ID NO: 1316443 - RNA, 18 nt, Mycobacterium tuberculosis H37Rv
gcaaacaagaucagaccc

SEQ ID NO: 1316444 - RNA, 18 nt, Mycobacterium tuberculosis H37Rv
gcaaaagugcgaguagga

SEQ ID NO: 1316445 - RNA, 22 nt, Mycobacterium tuberculosis H37Rv
gcaaacuccagcuugccgaccu

SEQ ID NO: 1316446 - RNA, 17 nt, Mycobacterium tuberculosis H37Rv
gcaaacggaugguucug

SEQ ID NO: 1316447 - RNA, 17 nt, Mycobacterium tuberculosis H37Rv
gcaaacgugaucaggaa

SEQ ID NO: 1316448 - RNA, 16 nt, Mycobacterium tuberculosis H37Rv
gcaaagucggugucac

SEQ ID NO: 1316449 - RNA, 12 nt, Mycobacterium tuberculosis H37Rv
gcaaaggcgcuc

SEQ ID NO: 1316450 - RNA, 16 nt, Mycobacterium tuberculosis H37Rv
gcaaagcccuccucga

SEQ ID NO: 1316451 - RNA, 21 nt, Mycobacterium tuberculosis H37Rv
gcaaagccagcgcagccaggc

SEQ ID NO: 1316452 - RNA, 18 nt, Mycobacterium tuberculosis H37Rv
gcaaaucggugcgauccu

SEQ ID NO: 1316453 - RNA, 16 nt, Mycobacterium tuberculosis H37Rv
gcaaaucaagcacagc

SEQ ID NO: 1316454 - RNA, 16 nt, Mycobacterium tuberculosis H37Rv
gcagcaucgucgccac

SEQ ID NO: 1316455 - RNA, 18 nt, Mycobacterium tuberculosis H37Rv
gcagcaucggcgacagga

SEQ ID NO: 1316456 - RNA, 23 nt, Mycobacterium tuberculosis H37Rv
gcagcaucuccgucggccaggcc

SEQ ID NO: 1316457 - RNA, 16 nt, Mycobacterium tuberculosis H37Rv
gcagcauggcccuggc

SEQ ID NO: 1316458 - RNA, 19 nt, Mycobacterium tuberculosis H37Rv
gcagccaaguccgcccgcc

SEQ ID NO: 1316459 - RNA, 21 nt, Mycobacterium tuberculosis H37Rv
gcagccaaguccgcccgccga

SEQ ID NO: 1316460 - RNA, 19 nt, Mycobacterium tuberculosis H37Rv
gcagccacauacaggcccg

SEQ ID NO: 1316461 - RNA, 17 nt, Mycobacterium tuberculosis H37Rv
gcagccccugccgaucc

SEQ ID NO: 1316462 - RNA, 15 nt, Mycobacterium tuberculosis H37Rv
gcagcccgcccugac

SEQ ID NO: 1316463 - RNA, 16 nt, Mycobacterium tuberculosis H37Rv
gcagccccuccgcgcc

SEQ ID NO: 1316464 - RNA, 13 nt, Mycobacterium tuberculosis H37Rv
gcagcccgccgga

SEQ ID NO: 1316465 - RNA, 20 nt, Mycobacterium tuberculosis H37Rv
gcagcccgggcagccccucc

SEQ ID NO: 1316466 - RNA, 14 nt, Mycobacterium tuberculosis H37Rv
gcagcccgggcagc

SEQ ID NO: 1316467 - RNA, 15 nt, Mycobacterium tuberculosis H37Rv
gcagcccgggcagca

SEQ ID NO: 1316468 - RNA, 13 nt, Mycobacterium tuberculosis H37Rv
gcagccgcgcggu

SEQ ID NO: 1316469 - RNA, 13 nt, Mycobacterium tuberculosis H37Rv
gcagccgcggggc

SEQ ID NO: 1316470 - RNA, 16 nt, Mycobacterium tuberculosis H37Rv
gcagcccggugugcug

SEQ ID NO: 1316471 - RNA, 13 nt, Mycobacterium tuberculosis H37Rv
gcagcccggcggc

SEQ ID NO: 1316472 - RNA, 18 nt, Mycobacterium tuberculosis H37Rv
gcagcccugcgcagccgc

SEQ ID NO: 1316473 - RNA, 19 nt, Mycobacterium tuberculosis H37Rv
gcagcccgugacuggugaa

SEQ ID NO: 1316474 - RNA, 14 nt, Mycobacterium tuberculosis H37Rv
gcagccggcgggcc

SEQ ID NO: 1316475 - RNA, 15 nt, Mycobacterium tuberculosis H37Rv
gcagccgggcaccac

SEQ ID NO: 1316476 - RNA, 14 nt, Mycobacterium tuberculosis H37Rv
gcagccgggcgucg

SEQ ID NO: 1316477 - RNA, 20 nt, Mycobacterium tuberculosis H37Rv
gcagcgcaacggccagcgcu

SEQ ID NO: 1316478 - RNA, 22 nt, Mycobacterium tuberculosis H37Rv
gcagcgcaaugcaucgcggcgg

SEQ ID NO: 1316479 - RNA, 17 nt, Mycobacterium tuberculosis H37Rv
gcagccgggcaccaccc

SEQ ID NO: 1316480 - RNA, 16 nt, Mycobacterium tuberculosis H37Rv
gcagcgaucggggcgg

SEQ ID NO: 1316481 - RNA, 13 nt, Mycobacterium tuberculosis H37Rv
gcagcgccggucg

SEQ ID NO: 1316482 - RNA, 18 nt, Mycobacterium tuberculosis H37Rv
gcagcgccuaccagcacc

SEQ ID NO: 1316483 - RNA, 17 nt, Mycobacterium tuberculosis H37Rv
gcagcgccggcgggcuc

SEQ ID NO: 1316484 - RNA, 14 nt, Mycobacterium tuberculosis H37Rv
gcagcgcauccggu

SEQ ID NO: 1316485 - RNA, 16 nt, Mycobacterium tuberculosis H37Rv
gcagcgcccccgcugc

SEQ ID NO: 1316486 - RNA, 14 nt, Mycobacterium tuberculosis H37Rv
gcagcgccagcagc

SEQ ID NO: 1316487 - RNA, 19 nt, Mycobacterium tuberculosis H37Rv
gcagcgccaacgcccccau

SEQ ID NO: 1316488 - RNA, 12 nt, Mycobacterium tuberculosis H37Rv
gcagcgccaggc

SEQ ID NO: 1316489 - RNA, 15 nt, Mycobacterium tuberculosis H37Rv
gcagcauccggccgu

SEQ ID NO: 1316490 - RNA, 15 nt, Mycobacterium tuberculosis H37Rv
gcagcaucgccagca

SEQ ID NO: 1316491 - RNA, 12 nt, Mycobacterium tuberculosis H37Rv
gcagcaggugag

SEQ ID NO: 1316492 - RNA, 13 nt, Mycobacterium tuberculosis H37Rv
gcagcagccggcg

SEQ ID NO: 1316493 - RNA, 13 nt, Mycobacterium tuberculosis H37Rv
gcagcacccgcgc

SEQ ID NO: 1316494 - RNA, 17 nt, Mycobacterium tuberculosis H37Rv
gcagcacccgcgccagu

SEQ ID NO: 1316495 - RNA, 14 nt, Mycobacterium tuberculosis H37Rv
gcagcagcccgggc

SEQ ID NO: 1316496 - RNA, 21 nt, Mycobacterium tuberculosis H37Rv
gcagcagaugcgaaaguggug

SEQ ID NO: 1316497 - RNA, 18 nt, Mycobacterium tuberculosis H37Rv
gcagcaccgcugcggcca

SEQ ID NO: 1316498 - RNA, 22 nt, Mycobacterium tuberculosis H37Rv
gcagcagacgacgaucagcccc

SEQ ID NO: 1316499 - RNA, 20 nt, Mycobacterium tuberculosis H37Rv
gcagcaaaacccgagccugg

SEQ ID NO: 1316500 - RNA, 17 nt, Mycobacterium tuberculosis H37Rv
gcagcacauccugcagc

SEQ ID NO: 1316501 - RNA, 15 nt, Mycobacterium tuberculosis H37Rv
gcagcaccaaggucu

SEQ ID NO: 1316502 - RNA, 14 nt, Mycobacterium tuberculosis H37Rv
gcacuuaccgagcc

SEQ ID NO: 1316503 - RNA, 23 nt, Mycobacterium tuberculosis H37Rv
gcacugucgagguggucgacccg

SEQ ID NO: 1316504 - RNA, 14 nt, Mycobacterium tuberculosis H37Rv
gcagcgccugcggc

SEQ ID NO: 1316505 - RNA, 18 nt, Mycobacterium tuberculosis H37Rv
gcagcgccugcggcagca

SEQ ID NO: 1316506 - RNA, 20 nt, Mycobacterium tuberculosis H37Rv
gcagcgccugcggcagcacc

SEQ ID NO: 1316507 - RNA, 22 nt, Mycobacterium tuberculosis H37Rv
gcagcgcgacccguagcuuggc

SEQ ID NO: 1316508 - RNA, 14 nt, Mycobacterium tuberculosis H37Rv
gcagcgcgaucacc

SEQ ID NO: 1316509 - RNA, 13 nt, Mycobacterium tuberculosis H37Rv
gcagcgcggaugu

SEQ ID NO: 1316510 - RNA, 17 nt, Mycobacterium tuberculosis H37Rv
gcagcgcggccagagcc

SEQ ID NO: 1316511 - RNA, 22 nt, Mycobacterium tuberculosis H37Rv
gcagcgcggccagagccgcgcg

SEQ ID NO: 1316512 - RNA, 16 nt, Mycobacterium tuberculosis H37Rv
gcagcgcggccgggcg

SEQ ID NO: 1316513 - RNA, 15 nt, Mycobacterium tuberculosis H37Rv
gcagcgcgggaucug

SEQ ID NO: 1316514 - RNA, 20 nt, Mycobacterium tuberculosis H37Rv
gcagcggcgcauaggcggcc

SEQ ID NO: 1316515 - RNA, 13 nt, Mycobacterium tuberculosis H37Rv
gcagcggcgcggu

SEQ ID NO: 1316516 - RNA, 11 nt, Mycobacterium tuberculosis H37Rv
gcagcggcgga

SEQ ID NO: 1316517 - RNA, 17 nt, Mycobacterium tuberculosis H37Rv
gcagcggcacgucggcg

SEQ ID NO: 1316518 - RNA, 12 nt, Mycobacterium tuberculosis H37Rv
gcagcggccagc

SEQ ID NO: 1316519 - RNA, 12 nt, Mycobacterium tuberculosis H37Rv
gcagcgcuggcu

SEQ ID NO: 1316520 - RNA, 22 nt, Mycobacterium tuberculosis H37Rv
gcagcgcuggcuacgccuccuu

SEQ ID NO: 1316521 - RNA, 16 nt, Mycobacterium tuberculosis H37Rv
gcagcgcugcgaugga

SEQ ID NO: 1316522 - RNA, 23 nt, Mycobacterium tuberculosis H37Rv
gcagcggaccgcugccugccgcg

SEQ ID NO: 1316523 - RNA, 18 nt, Mycobacterium tuberculosis H37Rv
gcagcggguggugccagg

SEQ ID NO: 1316524 - RNA, 23 nt, Mycobacterium tuberculosis H37Rv
gcagcggguggugccaggucggc

SEQ ID NO: 1316525 - RNA, 17 nt, Mycobacterium tuberculosis H37Rv
gcagcggugcagcccgc

SEQ ID NO: 1316526 - RNA, 16 nt, Mycobacterium tuberculosis H37Rv
gcagcgguggcccgcc

SEQ ID NO: 1316527 - RNA, 19 nt, Mycobacterium tuberculosis H37Rv
gcagcgguggcccgccggc

SEQ ID NO: 1316528 - RNA, 22 nt, Mycobacterium tuberculosis H37Rv
gcagcgguggcuugccccgccg

SEQ ID NO: 1316529 - RNA, 16 nt, Mycobacterium tuberculosis H37Rv
gcagcgguccgccgcc

SEQ ID NO: 1316530 - RNA, 14 nt, Mycobacterium tuberculosis H37Rv
gcagcggugcagcc

SEQ ID NO: 1316531 - RNA, 15 nt, Mycobacterium tuberculosis H37Rv
gcagcggugcagccc

SEQ ID NO: 1316532 - RNA, 20 nt, Mycobacterium tuberculosis H37Rv
gcagcgguuuuaggcagccc

SEQ ID NO: 1316533 - RNA, 13 nt, Mycobacterium tuberculosis H37Rv
gcagcgucuccuu

SEQ ID NO: 1316534 - RNA, 19 nt, Mycobacterium tuberculosis H37Rv
gcagcgucgucuagcggga

SEQ ID NO: 1316535 - RNA, 17 nt, Mycobacterium tuberculosis H37Rv
gcagcugccgcaccccc

SEQ ID NO: 1316536 - RNA, 14 nt, Mycobacterium tuberculosis H37Rv
gcagcugcccggcg

SEQ ID NO: 1316537 - RNA, 13 nt, Mycobacterium tuberculosis H37Rv
gcagcugcaauag

SEQ ID NO: 1316538 - RNA, 15 nt, Mycobacterium tuberculosis H37Rv
gcagcugaaucguuc

SEQ ID NO: 1316539 - RNA, 22 nt, Mycobacterium tuberculosis H37Rv
gcagcugcucggucaggcggcu

SEQ ID NO: 1316540 - RNA, 22 nt, Mycobacterium tuberculosis H37Rv
gcagcugcgauauggucaccaa

SEQ ID NO: 1316541 - RNA, 14 nt, Mycobacterium tuberculosis H37Rv
gcagcgugagugca

SEQ ID NO: 1316542 - RNA, 12 nt, Mycobacterium tuberculosis H37Rv
gcagcucggugg

SEQ ID NO: 1316543 - RNA, 19 nt, Mycobacterium tuberculosis H37Rv
gcagcgucggugccaccac

SEQ ID NO: 1316544 - RNA, 21 nt, Mycobacterium tuberculosis H37Rv
gcagcugaaaauaggccgggc

SEQ ID NO: 1316545 - RNA, 17 nt, Mycobacterium tuberculosis H37Rv
gcaggcgcaagguggca

SEQ ID NO: 1316546 - RNA, 17 nt, Mycobacterium tuberculosis H37Rv
gcaggcgaugcgccagg

SEQ ID NO: 1316547 - RNA, 21 nt, Mycobacterium tuberculosis H37Rv
gcaggcgggaacgaucgauga

SEQ ID NO: 1316548 - RNA, 19 nt, Mycobacterium tuberculosis H37Rv
gcaggcuaaucagccaggc

SEQ ID NO: 1316549 - RNA, 18 nt, Mycobacterium tuberculosis H37Rv
gcaggccccacuggugca

SEQ ID NO: 1316550 - RNA, 18 nt, Mycobacterium tuberculosis H37Rv
gcaggcccgacggcgccc

SEQ ID NO: 1316551 - RNA, 12 nt, Mycobacterium tuberculosis H37Rv
gcaggcccaccc

SEQ ID NO: 1316552 - RNA, 16 nt, Mycobacterium tuberculosis H37Rv
gcaggcccacccgggc

SEQ ID NO: 1316553 - RNA, 17 nt, Mycobacterium tuberculosis H37Rv
gcaggcccacccgggcg

SEQ ID NO: 1316554 - RNA, 17 nt, Mycobacterium tuberculosis H37Rv
gcaggccccacuggugc

SEQ ID NO: 1316555 - RNA, 15 nt, Mycobacterium tuberculosis H37Rv
gcaggcgacggcucu

SEQ ID NO: 1316556 - RNA, 12 nt, Mycobacterium tuberculosis H37Rv
gcaggcgaguga

SEQ ID NO: 1316557 - RNA, 19 nt, Mycobacterium tuberculosis H37Rv
gcaggccuccaagcccgcc

SEQ ID NO: 1316558 - RNA, 21 nt, Mycobacterium tuberculosis H37Rv
gcaggccuccucuugggucca

SEQ ID NO: 1316559 - RNA, 14 nt, Mycobacterium tuberculosis H37Rv
gcaggccucggcgc

SEQ ID NO: 1316560 - RNA, 23 nt, Mycobacterium tuberculosis H37Rv
gcaggccagggucagcucgguga

SEQ ID NO: 1316561 - RNA, 16 nt, Mycobacterium tuberculosis H37Rv
gcaggcagggcagccc

SEQ ID NO: 1316562 - RNA, 10 nt, Mycobacterium tuberculosis H37Rv
gcaggcaggu

SEQ ID NO: 1316563 - RNA, 20 nt, Mycobacterium tuberculosis H37Rv
gcaggaaaaccccggccacc

SEQ ID NO: 1316564 - RNA, 18 nt, Mycobacterium tuberculosis H37Rv
gcagcuuggccagccacu

SEQ ID NO: 1316565 - RNA, 15 nt, Mycobacterium tuberculosis H37Rv
gcagcuuggccagcc

SEQ ID NO: 1316566 - RNA, 21 nt, Mycobacterium tuberculosis H37Rv
gcagcuugguggcguggcccu

SEQ ID NO: 1316567 - RNA, 15 nt, Mycobacterium tuberculosis H37Rv
gcagcuuguccggug

SEQ ID NO: 1316568 - RNA, 16 nt, Mycobacterium tuberculosis H37Rv
gcagcuuggacucauc

SEQ ID NO: 1316569 - RNA, 15 nt, Mycobacterium tuberculosis H37Rv
gcagugcaggcggcc

SEQ ID NO: 1316570 - RNA, 18 nt, Mycobacterium tuberculosis H37Rv
gcagugccgcacccagac

SEQ ID NO: 1316571 - RNA, 16 nt, Mycobacterium tuberculosis H37Rv
gcagugccgcacccag

SEQ ID NO: 1316572 - RNA, 23 nt, Mycobacterium tuberculosis H37Rv
gcagugccguguccagcaugccc

SEQ ID NO: 1316573 - RNA, 15 nt, Mycobacterium tuberculosis H37Rv
gcagugcgaacucau

SEQ ID NO: 1316574 - RNA, 15 nt, Mycobacterium tuberculosis H37Rv
gcauauccgcaggcc

SEQ ID NO: 1316575 - RNA, 19 nt, Mycobacterium tuberculosis H37Rv
gcauagggccaccgccgcc

SEQ ID NO: 1316576 - RNA, 20 nt, Mycobacterium tuberculosis H37Rv
gcauagguaguugcucggcu

SEQ ID NO: 1316577 - RNA, 15 nt, Mycobacterium tuberculosis H37Rv
gcagucgcacggugc

SEQ ID NO: 1316578 - RNA, 13 nt, Mycobacterium tuberculosis H37Rv
gcagucgcggcag

SEQ ID NO: 1316579 - RNA, 21 nt, Mycobacterium tuberculosis H37Rv
gcagucgcuaaagcccccgac

SEQ ID NO: 1316580 - RNA, 20 nt, Mycobacterium tuberculosis H37Rv
gcaguccgcacgcggcaaug

SEQ ID NO: 1316581 - RNA, 15 nt, Mycobacterium tuberculosis H37Rv
gcagucccggugggc

SEQ ID NO: 1316582 - RNA, 20 nt, Mycobacterium tuberculosis H37Rv
gcagucccaguucguuggug

SEQ ID NO: 1316583 - RNA, 21 nt, Mycobacterium tuberculosis H37Rv
gcaguccaccgcgcggcgcag

SEQ ID NO: 1316584 - RNA, 14 nt, Mycobacterium tuberculosis H37Rv
gcaguagccgacca

SEQ ID NO: 1316585 - RNA, 17 nt, Mycobacterium tuberculosis H37Rv
gcaguagccgaccagga

SEQ ID NO: 1316586 - RNA, 22 nt, Mycobacterium tuberculosis H37Rv
gcaguagcugcucaucgcgccc

SEQ ID NO: 1316587 - RNA, 14 nt, Mycobacterium tuberculosis H37Rv
gcaguagcuguggc

SEQ ID NO: 1316588 - RNA, 22 nt, Mycobacterium tuberculosis H37Rv
gcagggaucaccccggccggcu

SEQ ID NO: 1316589 - RNA, 14 nt, Mycobacterium tuberculosis H37Rv
gcagggaucacccc

SEQ ID NO: 1316590 - RNA, 19 nt, Mycobacterium tuberculosis H37Rv
gcagggcauugcggcccgc

SEQ ID NO: 1316591 - RNA, 20 nt, Mycobacterium tuberculosis H37Rv
gcagguuggucaccaccugg

SEQ ID NO: 1316592 - RNA, 17 nt, Mycobacterium tuberculosis H37Rv
gcagguuggucaccacc

SEQ ID NO: 1316593 - RNA, 18 nt, Mycobacterium tuberculosis H37Rv
gcagguugcguugcagga

SEQ ID NO: 1316594 - RNA, 16 nt, Mycobacterium tuberculosis H37Rv
gcaggugcccgaggug

SEQ ID NO: 1316595 - RNA, 15 nt, Mycobacterium tuberculosis H37Rv
gcagguugcccucac

SEQ ID NO: 1316596 - RNA, 19 nt, Mycobacterium tuberculosis H37Rv
gcaggugaacaacagcgcu

SEQ ID NO: 1316597 - RNA, 19 nt, Mycobacterium tuberculosis H37Rv
gcaggugaacgccggugcg

SEQ ID NO: 1316598 - RNA, 13 nt, Mycobacterium tuberculosis H37Rv
gcaggugccaccu

SEQ ID NO: 1316599 - RNA, 13 nt, Mycobacterium tuberculosis H37Rv
gcaggugccuucu

SEQ ID NO: 1316600 - RNA, 19 nt, Mycobacterium tuberculosis H37Rv
gcaucagauucgcgcuggc

SEQ ID NO: 1316601 - RNA, 14 nt, Mycobacterium tuberculosis H37Rv
gcaucaccuggcgu

SEQ ID NO: 1316602 - RNA, 14 nt, Mycobacterium tuberculosis H37Rv
gcaucagcggcgcc

SEQ ID NO: 1316603 - RNA, 17 nt, Mycobacterium tuberculosis H37Rv
gcaucagcggcgccagu

SEQ ID NO: 1316604 - RNA, 16 nt, Mycobacterium tuberculosis H37Rv
gcaucagcgccagcga

SEQ ID NO: 1316605 - RNA, 19 nt, Mycobacterium tuberculosis H37Rv
gcaucauagacagggccgc

SEQ ID NO: 1316606 - RNA, 22 nt, Mycobacterium tuberculosis H37Rv
gcaucaccacuggacccgccca

SEQ ID NO: 1316607 - RNA, 16 nt, Mycobacterium tuberculosis H37Rv
gcauauccgcaggccc

SEQ ID NO: 1316608 - RNA, 17 nt, Mycobacterium tuberculosis H37Rv
gcauaugccgccggcag

SEQ ID NO: 1316609 - RNA, 23 nt, Mycobacterium tuberculosis H37Rv
gcauauugcggcgccgugaucag

SEQ ID NO: 1316610 - RNA, 23 nt, Mycobacterium tuberculosis H37Rv
gcaucgauaauggccgaguccgg

SEQ ID NO: 1316611 - RNA, 18 nt, Mycobacterium tuberculosis H37Rv
gcaucgaggccagcagcu

SEQ ID NO: 1316612 - RNA, 17 nt, Mycobacterium tuberculosis H37Rv
gcaucgagcagcccggg

SEQ ID NO: 1316613 - RNA, 17 nt, Mycobacterium tuberculosis H37Rv
gcaucgagacgcacggc

SEQ ID NO: 1316614 - RNA, 17 nt, Mycobacterium tuberculosis H37Rv
gcaucgacguagcgaag

SEQ ID NO: 1316615 - RNA, 17 nt, Mycobacterium tuberculosis H37Rv
gcaucgacgugcgcggc

SEQ ID NO: 1316616 - RNA, 18 nt, Mycobacterium tuberculosis H37Rv
gcaucgacgugcgcggca

SEQ ID NO: 1316617 - RNA, 19 nt, Mycobacterium tuberculosis H37Rv
gcauccuugccaaucgccg

SEQ ID NO: 1316618 - RNA, 23 nt, Mycobacterium tuberculosis H37Rv
gcauccugcacgacccgcugguc

SEQ ID NO: 1316619 - RNA, 16 nt, Mycobacterium tuberculosis H37Rv
gcauccggucucggcc

SEQ ID NO: 1316620 - RNA, 16 nt, Mycobacterium tuberculosis H37Rv
gcauccucugaaccug

SEQ ID NO: 1316621 - RNA, 14 nt, Mycobacterium tuberculosis H37Rv
gcauccgcggggag

SEQ ID NO: 1316622 - RNA, 15 nt, Mycobacterium tuberculosis H37Rv
gcauccgccccgccc

SEQ ID NO: 1316623 - RNA, 15 nt, Mycobacterium tuberculosis H37Rv
gcaucccggccgcuc

SEQ ID NO: 1316624 - RNA, 17 nt, Mycobacterium tuberculosis H37Rv
gcaucccggccgcucag

SEQ ID NO: 1316625 - RNA, 13 nt, Mycobacterium tuberculosis H37Rv
gcaucccgggcag

SEQ ID NO: 1316626 - RNA, 23 nt, Mycobacterium tuberculosis H37Rv
gcaucccgggcaguccaggcacu

SEQ ID NO: 1316627 - RNA, 17 nt, Mycobacterium tuberculosis H37Rv
gcaucccgguccagccc

SEQ ID NO: 1316628 - RNA, 12 nt, Mycobacterium tuberculosis H37Rv
gcauccaggcug

SEQ ID NO: 1316629 - RNA, 17 nt, Mycobacterium tuberculosis H37Rv
gcauccaaaaucgccug

SEQ ID NO: 1316630 - RNA, 16 nt, Mycobacterium tuberculosis H37Rv
gcauccaacgcggcgc

SEQ ID NO: 1316631 - RNA, 16 nt, Mycobacterium tuberculosis H37Rv
gcauccacugcggcgc

SEQ ID NO: 1316632 - RNA, 13 nt, Mycobacterium tuberculosis H37Rv
gcaauggcgcggu

SEQ ID NO: 1316633 - RNA, 22 nt, Mycobacterium tuberculosis H37Rv
gcaaugucggcagggcccccag

SEQ ID NO: 1316634 - RNA, 23 nt, Mycobacterium tuberculosis H37Rv
gcaaugucggcagggcccccagu

SEQ ID NO: 1316635 - RNA, 21 nt, Mycobacterium tuberculosis H37Rv
gcacaauacggucagcagacu

SEQ ID NO: 1316636 - RNA, 20 nt, Mycobacterium tuberculosis H37Rv
gcacaauacggucagcagac

SEQ ID NO: 1316637 - RNA, 18 nt, Mycobacterium tuberculosis H37Rv
gcacaauacggucagcag

SEQ ID NO: 1316638 - RNA, 17 nt, Mycobacterium tuberculosis H37Rv
gcacaauacggucagca

SEQ ID NO: 1316639 - RNA, 17 nt, Mycobacterium tuberculosis H37Rv
gcacaaguucuucgaca

SEQ ID NO: 1316640 - RNA, 22 nt, Mycobacterium tuberculosis H37Rv
gcacaaguucuucgacagcgcg

SEQ ID NO: 1316641 - RNA, 23 nt, Mycobacterium tuberculosis H37Rv
gcacaacugcgccagcaacagcg

SEQ ID NO: 1316642 - RNA, 20 nt, Mycobacterium tuberculosis H37Rv
gcacaagcuggggaacagca

SEQ ID NO: 1316643 - RNA, 23 nt, Mycobacterium tuberculosis H37Rv
gcaauuucagccuuguugccgcc

SEQ ID NO: 1316644 - RNA, 22 nt, Mycobacterium tuberculosis H37Rv
gcacacagaggucggucagcca

SEQ ID NO: 1316645 - RNA, 12 nt, Mycobacterium tuberculosis H37Rv
gcacacagaccg

SEQ ID NO: 1316646 - RNA, 14 nt, Mycobacterium tuberculosis H37Rv
gcacaccaacaccg

SEQ ID NO: 1316647 - RNA, 20 nt, Mycobacterium tuberculosis H37Rv
gcacaccaacaccgcggcgc

SEQ ID NO: 1316648 - RNA, 11 nt, Mycobacterium tuberculosis H37Rv
gcacaccaccg

SEQ ID NO: 1316649 - RNA, 15 nt, Mycobacterium tuberculosis H37Rv
gcacacuccugcacc

SEQ ID NO: 1316650 - RNA, 15 nt, Mycobacterium tuberculosis H37Rv
gcacacuccuagcca

SEQ ID NO: 1316651 - RNA, 19 nt, Mycobacterium tuberculosis H37Rv
gcacacgucgggaguaagg

SEQ ID NO: 1316652 - RNA, 22 nt, Mycobacterium tuberculosis H37Rv
gcacacgcuuguacaagucgac

SEQ ID NO: 1316653 - RNA, 21 nt, Mycobacterium tuberculosis H37Rv
gcacauugguguccaccaccg

SEQ ID NO: 1316654 - RNA, 21 nt, Mycobacterium tuberculosis H37Rv
gcacauucugcagcgucuccu

SEQ ID NO: 1316655 - RNA, 15 nt, Mycobacterium tuberculosis H37Rv
gcaccaagacgccac

SEQ ID NO: 1316656 - RNA, 14 nt, Mycobacterium tuberculosis H37Rv
gcaccaccagcagc

SEQ ID NO: 1316657 - RNA, 20 nt, Mycobacterium tuberculosis H37Rv
gcaccaacgagauccagcgc

SEQ ID NO: 1316658 - RNA, 13 nt, Mycobacterium tuberculosis H37Rv
gcaccaacaccag

SEQ ID NO: 1316659 - RNA, 14 nt, Mycobacterium tuberculosis H37Rv
gcaccacgagcagc

SEQ ID NO: 1316660 - RNA, 15 nt, Mycobacterium tuberculosis H37Rv
gcaccacgagcagcc

SEQ ID NO: 1316661 - RNA, 22 nt, Mycobacterium tuberculosis H37Rv
gcaccacggcggccaccugcug

SEQ ID NO: 1316662 - RNA, 13 nt, Mycobacterium tuberculosis H37Rv
gcaccacggcggc

SEQ ID NO: 1316663 - RNA, 23 nt, Mycobacterium tuberculosis H37Rv
gcaccacgucgaccaauaccagu

SEQ ID NO: 1316664 - RNA, 16 nt, Mycobacterium tuberculosis H37Rv
gcaccaccgcggcggc

SEQ ID NO: 1316665 - RNA, 18 nt, Mycobacterium tuberculosis H37Rv
gcaccaccggccccaccg

SEQ ID NO: 1316666 - RNA, 16 nt, Mycobacterium tuberculosis H37Rv
gcaccaccggccccac

SEQ ID NO: 1316667 - RNA, 17 nt, Mycobacterium tuberculosis H37Rv
gcaccaccggccccacc

SEQ ID NO: 1316668 - RNA, 19 nt, Mycobacterium tuberculosis H37Rv
gcaagccggacagaucaac

SEQ ID NO: 1316669 - RNA, 22 nt, Mycobacterium tuberculosis H37Rv
gcaagccguugcacggccggga

SEQ ID NO: 1316670 - RNA, 16 nt, Mycobacterium tuberculosis H37Rv
gcaagccucgugguga

SEQ ID NO: 1316671 - RNA, 22 nt, Mycobacterium tuberculosis H37Rv
gcaagcccaaaaagaccgccgc

SEQ ID NO: 1316672 - RNA, 16 nt, Mycobacterium tuberculosis H37Rv
gcaagguugccaacgc

SEQ ID NO: 1316673 - RNA, 22 nt, Mycobacterium tuberculosis H37Rv
gcaaggucgcugcuugcgggcu

SEQ ID NO: 1316674 - RNA, 16 nt, Mycobacterium tuberculosis H37Rv
gcaagcgccgcgcuug

SEQ ID NO: 1316675 - RNA, 21 nt, Mycobacterium tuberculosis H37Rv
gcaagauuauggcgagcgcgc

SEQ ID NO: 1316676 - RNA, 22 nt, Mycobacterium tuberculosis H37Rv
gcaagaaccgugucgccgccgc

SEQ ID NO: 1316677 - RNA, 19 nt, Mycobacterium tuberculosis H37Rv
gcaacaaagguaccgcugg

SEQ ID NO: 1316678 - RNA, 14 nt, Mycobacterium tuberculosis H37Rv
gcaagucgaacgga

SEQ ID NO: 1316679 - RNA, 16 nt, Mycobacterium tuberculosis H37Rv
gcaaguccugcagcug

SEQ ID NO: 1316680 - RNA, 13 nt, Mycobacterium tuberculosis H37Rv
gcaagugcgggcu

SEQ ID NO: 1316681 - RNA, 20 nt, Mycobacterium tuberculosis H37Rv
gcaauaucuuuagcgcgugc

SEQ ID NO: 1316682 - RNA, 21 nt, Mycobacterium tuberculosis H37Rv
gcaauaucuuuagcgcgugcu

SEQ ID NO: 1316683 - RNA, 15 nt, Mycobacterium tuberculosis H37Rv
gcaauaugccacaga

SEQ ID NO: 1316684 - RNA, 12 nt, Mycobacterium tuberculosis H37Rv
gcaauggccagc

SEQ ID NO: 1316685 - RNA, 16 nt, Mycobacterium tuberculosis H37Rv
gcaauggccagcacca

SEQ ID NO: 1316686 - RNA, 15 nt, Mycobacterium tuberculosis H37Rv
gcaaugcuuccagca

SEQ ID NO: 1316687 - RNA, 15 nt, Mycobacterium tuberculosis H37Rv
gcacccugcgcggcg

SEQ ID NO: 1316688 - RNA, 15 nt, Mycobacterium tuberculosis H37Rv
gcacccugcggcacc

SEQ ID NO: 1316689 - RNA, 16 nt, Mycobacterium tuberculosis H37Rv
gcaccgagcugagcgg

SEQ ID NO: 1316690 - RNA, 17 nt, Mycobacterium tuberculosis H37Rv
gcaccgagcugagcggc

SEQ ID NO: 1316691 - RNA, 15 nt, Mycobacterium tuberculosis H37Rv
gcaccgauggcgcac

SEQ ID NO: 1316692 - RNA, 23 nt, Mycobacterium tuberculosis H37Rv
gcaccgaugccgaagcccccgac

SEQ ID NO: 1316693 - RNA, 21 nt, Mycobacterium tuberculosis H37Rv
gcaccgaugccgaagcccccg

SEQ ID NO: 1316694 - RNA, 18 nt, Mycobacterium tuberculosis H37Rv
gcaccgaugccgaagccc

SEQ ID NO: 1316695 - RNA, 19 nt, Mycobacterium tuberculosis H37Rv
gcaccgauuccuugaugcc

SEQ ID NO: 1316696 - RNA, 17 nt, Mycobacterium tuberculosis H37Rv
gcaccgccacccugacc

SEQ ID NO: 1316697 - RNA, 22 nt, Mycobacterium tuberculosis H37Rv
gcaccggccgugccgccgacac

SEQ ID NO: 1316698 - RNA, 20 nt, Mycobacterium tuberculosis H37Rv
gcaccgccggcgcccaggcc

SEQ ID NO: 1316699 - RNA, 17 nt, Mycobacterium tuberculosis H37Rv
gcaccgccggcgccccc

SEQ ID NO: 1316700 - RNA, 15 nt, Mycobacterium tuberculosis H37Rv
gcaccgccggcgccc

SEQ ID NO: 1316701 - RNA, 15 nt, Mycobacterium tuberculosis H37Rv
gcaccgccgccgccc

SEQ ID NO: 1316702 - RNA, 12 nt, Mycobacterium tuberculosis H37Rv
gcaccgccgccc

SEQ ID NO: 1316703 - RNA, 22 nt, Mycobacterium tuberculosis H37Rv
gcaccgccgcccccgccggccg

SEQ ID NO: 1316704 - RNA, 22 nt, Mycobacterium tuberculosis H37Rv
gcaccgccggcaauaccgccag

SEQ ID NO: 1316705 - RNA, 17 nt, Mycobacterium tuberculosis H37Rv
gcaccgccgcgccggcg

SEQ ID NO: 1316706 - RNA, 21 nt, Mycobacterium tuberculosis H37Rv
gcaccgccgcccccgccggcc

SEQ ID NO: 1316707 - RNA, 13 nt, Mycobacterium tuberculosis H37Rv
gcaccgccgcccc

SEQ ID NO: 1316708 - RNA, 21 nt, Mycobacterium tuberculosis H37Rv
gcacccguucgugagcggcca

SEQ ID NO: 1316709 - RNA, 23 nt, Mycobacterium tuberculosis H37Rv
gcacccguucgugagcggccagg

SEQ ID NO: 1316710 - RNA, 15 nt, Mycobacterium tuberculosis H37Rv
gcacccgugccgccg

SEQ ID NO: 1316711 - RNA, 19 nt, Mycobacterium tuberculosis H37Rv
gcacccggggugcccggcc

SEQ ID NO: 1316712 - RNA, 23 nt, Mycobacterium tuberculosis H37Rv
gcacccgggccugggacggcggc

SEQ ID NO: 1316713 - RNA, 17 nt, Mycobacterium tuberculosis H37Rv
gcacccggggggccucg

SEQ ID NO: 1316714 - RNA, 17 nt, Mycobacterium tuberculosis H37Rv
gcacccggggugcccgg

SEQ ID NO: 1316715 - RNA, 21 nt, Mycobacterium tuberculosis H37Rv
gcacccgguugugcgcgcgcc

SEQ ID NO: 1316716 - RNA, 22 nt, Mycobacterium tuberculosis H37Rv
gcacccgguugugcgcgcgccc

SEQ ID NO: 1316717 - RNA, 21 nt, Mycobacterium tuberculosis H37Rv
gcacccggcuucgccgcgcuu

SEQ ID NO: 1316718 - RNA, 19 nt, Mycobacterium tuberculosis H37Rv
gcacccggcuucgccgcgc

SEQ ID NO: 1316719 - RNA, 18 nt, Mycobacterium tuberculosis H37Rv
gcacccggcuguucucgc

SEQ ID NO: 1316720 - RNA, 12 nt, Mycobacterium tuberculosis H37Rv
gcaccagcggca

SEQ ID NO: 1316721 - RNA, 13 nt, Mycobacterium tuberculosis H37Rv
gcaccagaucagg

SEQ ID NO: 1316722 - RNA, 16 nt, Mycobacterium tuberculosis H37Rv
gcaccagaucagguga

SEQ ID NO: 1316723 - RNA, 21 nt, Mycobacterium tuberculosis H37Rv
gcaccagaucuucgagcgcau

SEQ ID NO: 1316724 - RNA, 22 nt, Mycobacterium tuberculosis H37Rv
gcaccagaaaugguucgcacac

SEQ ID NO: 1316725 - RNA, 20 nt, Mycobacterium tuberculosis H37Rv
gcacgacgcgacacgccggc

SEQ ID NO: 1316726 - RNA, 18 nt, Mycobacterium tuberculosis H37Rv
gcacgacgcgacacgccg

SEQ ID NO: 1316727 - RNA, 21 nt, Mycobacterium tuberculosis H37Rv
gcacgacugugcgccgcagcc

SEQ ID NO: 1316728 - RNA, 13 nt, Mycobacterium tuberculosis H37Rv
gcacgauccgcac

SEQ ID NO: 1316729 - RNA, 23 nt, Mycobacterium tuberculosis H37Rv
gcacgauccgcacccggccgcgc

SEQ ID NO: 1316730 - RNA, 14 nt, Mycobacterium tuberculosis H37Rv
gcacgaucgcaccg

SEQ ID NO: 1316731 - RNA, 14 nt, Mycobacterium tuberculosis H37Rv
gcaccuucuccacc

SEQ ID NO: 1316732 - RNA, 14 nt, Mycobacterium tuberculosis H37Rv
gcacgaccugguua

SEQ ID NO: 1316733 - RNA, 23 nt, Mycobacterium tuberculosis H37Rv
gcacgaccugguuauucgacucg

SEQ ID NO: 1316734 - RNA, 20 nt, Mycobacterium tuberculosis H37Rv
gcacgaccucgcgcggggcg

SEQ ID NO: 1316735 - RNA, 21 nt, Mycobacterium tuberculosis H37Rv
gcacgaccucgcgcggggcgg

SEQ ID NO: 1316736 - RNA, 19 nt, Mycobacterium tuberculosis H37Rv
gcacgacgacaaccggcca

SEQ ID NO: 1316737 - RNA, 23 nt, Mycobacterium tuberculosis H37Rv
gcaccucgucccagcgguagccg

SEQ ID NO: 1316738 - RNA, 15 nt, Mycobacterium tuberculosis H37Rv
gcaccucggccagcu

SEQ ID NO: 1316739 - RNA, 14 nt, Mycobacterium tuberculosis H37Rv
gcaccucgcccucc

SEQ ID NO: 1316740 - RNA, 15 nt, Mycobacterium tuberculosis H37Rv
gcaccgugccgacgc

SEQ ID NO: 1316741 - RNA, 17 nt, Mycobacterium tuberculosis H37Rv
gcaccgugccgacgccc

SEQ ID NO: 1316742 - RNA, 17 nt, Mycobacterium tuberculosis H37Rv
gcaccgucucgcaccgc

SEQ ID NO: 1316743 - RNA, 18 nt, Mycobacterium tuberculosis H37Rv
gcaccuccagcaccaccg

SEQ ID NO: 1316744 - RNA, 14 nt, Mycobacterium tuberculosis H37Rv
gcaccuccgacggc

SEQ ID NO: 1316745 - RNA, 14 nt, Mycobacterium tuberculosis H37Rv
gcaccuccgccggc

SEQ ID NO: 1316746 - RNA, 23 nt, Mycobacterium tuberculosis H37Rv
gcaccuccggcaccgcccuugcc

SEQ ID NO: 1316747 - RNA, 14 nt, Mycobacterium tuberculosis H37Rv
gcaccucccgggcg

SEQ ID NO: 1316748 - RNA, 17 nt, Mycobacterium tuberculosis H37Rv
gcaccucgaccgccaac

SEQ ID NO: 1316749 - RNA, 14 nt, Mycobacterium tuberculosis H37Rv
gcaccgucccagug

SEQ ID NO: 1316750 - RNA, 23 nt, Mycobacterium tuberculosis H37Rv
gcaccgucgggcccagccggacc

SEQ ID NO: 1316751 - RNA, 20 nt, Mycobacterium tuberculosis H37Rv
gcaccgguuuucgccggcuc

SEQ ID NO: 1316752 - RNA, 23 nt, Mycobacterium tuberculosis H37Rv
gcaccgguuugacguccagggcc

SEQ ID NO: 1316753 - RNA, 14 nt, Mycobacterium tuberculosis H37Rv
gcaccgccgguggc

SEQ ID NO: 1316754 - RNA, 20 nt, Mycobacterium tuberculosis H37Rv
gcaccggggcugcccgcgga

SEQ ID NO: 1316755 - RNA, 15 nt, Mycobacterium tuberculosis H37Rv
gcaccggggcugccc

SEQ ID NO: 1316756 - RNA, 14 nt, Mycobacterium tuberculosis H37Rv
gcaccgggcucaga

SEQ ID NO: 1316757 - RNA, 11 nt, Mycobacterium tuberculosis H37Rv
gcaccggggcu

SEQ ID NO: 1316758 - RNA, 17 nt, Mycobacterium tuberculosis H37Rv
gcaccggcuggcccagc

SEQ ID NO: 1316759 - RNA, 20 nt, Mycobacterium tuberculosis H37Rv
gcaccggcgucggcgcggcc

SEQ ID NO: 1316760 - RNA, 17 nt, Mycobacterium tuberculosis H37Rv
gcaccggcugcggggcg

SEQ ID NO: 1316761 - RNA, 19 nt, Mycobacterium tuberculosis H37Rv
gcacggcaaccagcgagcc

SEQ ID NO: 1316762 - RNA, 20 nt, Mycobacterium tuberculosis H37Rv
gcacggaaguacuccaccca

SEQ ID NO: 1316763 - RNA, 23 nt, Mycobacterium tuberculosis H37Rv
gcacggaaucgcaucuagguuca

SEQ ID NO: 1316764 - RNA, 22 nt, Mycobacterium tuberculosis H37Rv
gcacggaaggcccggcgcggcc

SEQ ID NO: 1316765 - RNA, 17 nt, Mycobacterium tuberculosis H37Rv
gcacggaaggcccggcg

SEQ ID NO: 1316766 - RNA, 19 nt, Mycobacterium tuberculosis H37Rv
gcacggaaggcccggcgcg

SEQ ID NO: 1316767 - RNA, 14 nt, Mycobacterium tuberculosis H37Rv
gcacggccgggacg

SEQ ID NO: 1316768 - RNA, 13 nt, Mycobacterium tuberculosis H37Rv
gcacggccgggac

SEQ ID NO: 1316769 - RNA, 12 nt, Mycobacterium tuberculosis H37Rv
gcacggccgggu

SEQ ID NO: 1316770 - RNA, 14 nt, Mycobacterium tuberculosis H37Rv
gcacggccccugcc

SEQ ID NO: 1316771 - RNA, 19 nt, Mycobacterium tuberculosis H37Rv
gcacggcagacacgcugca

SEQ ID NO: 1316772 - RNA, 18 nt, Mycobacterium tuberculosis H37Rv
gcacgcuagccgacagcu

SEQ ID NO: 1316773 - RNA, 12 nt, Mycobacterium tuberculosis H37Rv
gcacgcccggcg

SEQ ID NO: 1316774 - RNA, 15 nt, Mycobacterium tuberculosis H37Rv
gcacgccggccgcgc

SEQ ID NO: 1316775 - RNA, 14 nt, Mycobacterium tuberculosis H37Rv
gcacgcucgcgcac

SEQ ID NO: 1316776 - RNA, 19 nt, Mycobacterium tuberculosis H37Rv
gcacgcucggcggggaccg

SEQ ID NO: 1316777 - RNA, 22 nt, Mycobacterium tuberculosis H37Rv
gcacgcucggugaaggucaccg

SEQ ID NO: 1316778 - RNA, 17 nt, Mycobacterium tuberculosis H37Rv
gcacgccggcaugccag

SEQ ID NO: 1316779 - RNA, 15 nt, Mycobacterium tuberculosis H37Rv
gcacgccgccggccg

SEQ ID NO: 1316780 - RNA, 15 nt, Mycobacterium tuberculosis H37Rv
gcacgccgcgugccg

SEQ ID NO: 1316781 - RNA, 19 nt, Mycobacterium tuberculosis H37Rv
gcacgcugaguccccaggu

SEQ ID NO: 1316782 - RNA, 22 nt, Mycobacterium tuberculosis H37Rv
gcacgcugaguccccagguggg

SEQ ID NO: 1316783 - RNA, 21 nt, Mycobacterium tuberculosis H37Rv
gcacgcugagcguccgacaac

SEQ ID NO: 1316784 - RNA, 14 nt, Mycobacterium tuberculosis H37Rv
gcacgcuggcgggc

SEQ ID NO: 1316785 - RNA, 16 nt, Mycobacterium tuberculosis H37Rv
gcacgcuggcgggcac

SEQ ID NO: 1316786 - RNA, 15 nt, Mycobacterium tuberculosis H37Rv
gcacgcuugaaagcg

SEQ ID NO: 1316787 - RNA, 21 nt, Mycobacterium tuberculosis H37Rv
gcacguccucgacccggcgca

SEQ ID NO: 1316788 - RNA, 19 nt, Mycobacterium tuberculosis H37Rv
gcacguccgcggagcucaa

SEQ ID NO: 1316789 - RNA, 16 nt, Mycobacterium tuberculosis H37Rv
gcacgucgaaaucggu

SEQ ID NO: 1316790 - RNA, 19 nt, Mycobacterium tuberculosis H37Rv
gcacgucgaaaucggugca

SEQ ID NO: 1316791 - RNA, 20 nt, Mycobacterium tuberculosis H37Rv
gcacgucgaaaucggugcac

SEQ ID NO: 1316792 - RNA, 18 nt, Mycobacterium tuberculosis H37Rv
gcacgucaucggcuggcc

SEQ ID NO: 1316793 - RNA, 19 nt, Mycobacterium tuberculosis H37Rv
gcacgucgaccucggcaac

SEQ ID NO: 1316794 - RNA, 23 nt, Mycobacterium tuberculosis H37Rv
gcacgucggcccauaacagcugg

SEQ ID NO: 1316795 - RNA, 15 nt, Mycobacterium tuberculosis H37Rv
gcacgucggcgggcg

SEQ ID NO: 1316796 - RNA, 21 nt, Mycobacterium tuberculosis H37Rv
gcacgucggcgggcgugugca

SEQ ID NO: 1316797 - RNA, 17 nt, Mycobacterium tuberculosis H37Rv
gcacgucggcugccgca

SEQ ID NO: 1316798 - RNA, 22 nt, Mycobacterium tuberculosis H37Rv
gcacgucggcccauaacagcug

SEQ ID NO: 1316799 - RNA, 14 nt, Mycobacterium tuberculosis H37Rv
gcacguaacccagu

SEQ ID NO: 1316800 - RNA, 22 nt, Mycobacterium tuberculosis H37Rv
gcacguaacgccgcucauccag

SEQ ID NO: 1316801 - RNA, 19 nt, Mycobacterium tuberculosis H37Rv
gcacgguguacgcccgcuc

SEQ ID NO: 1316802 - RNA, 17 nt, Mycobacterium tuberculosis H37Rv
gcacguacucggccagc

SEQ ID NO: 1316803 - RNA, 12 nt, Mycobacterium tuberculosis H37Rv
gcacgucaaccu

SEQ ID NO: 1316804 - RNA, 17 nt, Mycobacterium tuberculosis H37Rv
gcacgucaaccucgcca

SEQ ID NO: 1316805 - RNA, 19 nt, Mycobacterium tuberculosis H37Rv
gcacggguagcguccaggu

SEQ ID NO: 1316806 - RNA, 20 nt, Mycobacterium tuberculosis H37Rv
gcacgggucgucaugccagu

SEQ ID NO: 1316807 - RNA, 20 nt, Mycobacterium tuberculosis H37Rv
gcacgguggcuucgacggcg

SEQ ID NO: 1316808 - RNA, 23 nt, Mycobacterium tuberculosis H37Rv
gcacgguggcuucgacggcggcc

SEQ ID NO: 1316809 - RNA, 17 nt, Mycobacterium tuberculosis H37Rv
gcacggugggcgcuggg

SEQ ID NO: 1316810 - RNA, 15 nt, Mycobacterium tuberculosis H37Rv
gcacggcggccacgu

SEQ ID NO: 1316811 - RNA, 18 nt, Mycobacterium tuberculosis H37Rv
gcacggcuucggcgagcg

SEQ ID NO: 1316812 - RNA, 20 nt, Mycobacterium tuberculosis H37Rv
gcacugcugguugaugaagg

SEQ ID NO: 1316813 - RNA, 14 nt, Mycobacterium tuberculosis H37Rv
gcacuggcccccac

SEQ ID NO: 1316814 - RNA, 22 nt, Mycobacterium tuberculosis H37Rv
gcacuggcccccacaccacgcu

SEQ ID NO: 1316815 - RNA, 16 nt, Mycobacterium tuberculosis H37Rv
gcacugcccggggugc

SEQ ID NO: 1316816 - RNA, 15 nt, Mycobacterium tuberculosis H37Rv
gcacugccgcggacg

SEQ ID NO: 1316817 - RNA, 18 nt, Mycobacterium tuberculosis H37Rv
gcacugcgccggccgcag

SEQ ID NO: 1316818 - RNA, 13 nt, Mycobacterium tuberculosis H37Rv
gcacugcggccag

SEQ ID NO: 1316819 - RNA, 18 nt, Mycobacterium tuberculosis H37Rv
gcacugcccagcagacca

SEQ ID NO: 1316820 - RNA, 13 nt, Mycobacterium tuberculosis H37Rv
gcacugcccagca

SEQ ID NO: 1316821 - RNA, 18 nt, Mycobacterium tuberculosis H37Rv
gcacuccggagcccacac

SEQ ID NO: 1316822 - RNA, 20 nt, Mycobacterium tuberculosis H37Rv
gcacuccagcggcgggggcg

SEQ ID NO: 1316823 - RNA, 16 nt, Mycobacterium tuberculosis H37Rv
gcacuccaccgcuggc

SEQ ID NO: 1316824 - RNA, 16 nt, Mycobacterium tuberculosis H37Rv
gcacucgguaaccgcg

SEQ ID NO: 1316825 - RNA, 19 nt, Mycobacterium tuberculosis H37Rv
gcacucguagaacgucugg

SEQ ID NO: 1316826 - RNA, 12 nt, Mycobacterium tuberculosis H37Rv
gcacucgaccag

SEQ ID NO: 1316827 - RNA, 16 nt, Mycobacterium tuberculosis H37Rv
gcacugaccgcggcug

SEQ ID NO: 1316828 - RNA, 22 nt, Mycobacterium tuberculosis H37Rv
gcacuccacgaucggcccagcc

SEQ ID NO: 1316829 - RNA, 18 nt, Mycobacterium tuberculosis H37Rv
gcacucaucgaggcgaaa

SEQ ID NO: 1316830 - RNA, 14 nt, Mycobacterium tuberculosis H37Rv
gcacgucuugcugc

SEQ ID NO: 1316831 - RNA, 24 nt, Mycobacterium tuberculosis H37Rv
gcacgucugcguccacgugagugc

SEQ ID NO: 1316832 - RNA, 16 nt, Mycobacterium tuberculosis H37Rv
gcacguggccacggca

SEQ ID NO: 1316833 - RNA, 19 nt, Mycobacterium tuberculosis H37Rv
gcacgucuugcugcacgcu

SEQ ID NO: 1316834 - RNA, 17 nt, Mycobacterium tuberculosis H37Rv
gcacguugauccgcgca

SEQ ID NO: 1316835 - RNA, 15 nt, Mycobacterium tuberculosis H37Rv
gcacguugauucggg

SEQ ID NO: 1316836 - RNA, 21 nt, Mycobacterium tuberculosis H37Rv
gcacguugauccgcgcaacuu

SEQ ID NO: 1316837 - RNA, 16 nt, Mycobacterium tuberculosis H37Rv
gcacguuuacauagac

SEQ ID NO: 1316838 - RNA, 14 nt, Mycobacterium tuberculosis H37Rv
gcacguuggcggcc

SEQ ID NO: 1316839 - RNA, 19 nt, Mycobacterium tuberculosis H37Rv
cuuuuccagugugaacugg

SEQ ID NO: 1316840 - RNA, 16 nt, Mycobacterium tuberculosis H37Rv
cuuugucgccuucuug

SEQ ID NO: 1316841 - RNA, 22 nt, Mycobacterium tuberculosis H37Rv
cuuuuucccggcggcgcgcccg

SEQ ID NO: 1316842 - RNA, 14 nt, Mycobacterium tuberculosis H37Rv
cuuuugcgucugcu

SEQ ID NO: 1316843 - RNA, 23 nt, Mycobacterium tuberculosis H37Rv
gaaaacaacccgaacacgcugga

SEQ ID NO: 1316844 - RNA, 21 nt, Mycobacterium tuberculosis H37Rv
gaaaacauguuccacccggug

SEQ ID NO: 1316845 - RNA, 18 nt, Mycobacterium tuberculosis H37Rv
gaaaaagggcuuccaggg

SEQ ID NO: 1316846 - RNA, 15 nt, Mycobacterium tuberculosis H37Rv
cuuuuugcgucuguu

SEQ ID NO: 1316847 - RNA, 17 nt, Mycobacterium tuberculosis H37Rv
gaaaaugauagcggcgc

SEQ ID NO: 1316848 - RNA, 21 nt, Mycobacterium tuberculosis H37Rv
gaaaaucgggucacacuccca

SEQ ID NO: 1316849 - RNA, 21 nt, Mycobacterium tuberculosis H37Rv
gaaaaucgguuguggucagcu

SEQ ID NO: 1316850 - RNA, 22 nt, Mycobacterium tuberculosis H37Rv
gaaacaacgucgccgcggcggc

SEQ ID NO: 1316851 - RNA, 22 nt, Mycobacterium tuberculosis H37Rv
gaaacaagcaagcguguuguuu

SEQ ID NO: 1316852 - RNA, 23 nt, Mycobacterium tuberculosis H37Rv
gaaaauugacccccuagaccggg

SEQ ID NO: 1316853 - RNA, 18 nt, Mycobacterium tuberculosis H37Rv
gaaaccucuucgggugca

SEQ ID NO: 1316854 - RNA, 19 nt, Mycobacterium tuberculosis H37Rv
gaaacgcccgggcggcguc

SEQ ID NO: 1316855 - RNA, 17 nt, Mycobacterium tuberculosis H37Rv
gaaacgcgaugguggcc

SEQ ID NO: 1316856 - RNA, 16 nt, Mycobacterium tuberculosis H37Rv
gaaaccaucgccagcc

SEQ ID NO: 1316857 - RNA, 14 nt, Mycobacterium tuberculosis H37Rv
gaaaccaucgccag

SEQ ID NO: 1316858 - RNA, 23 nt, Mycobacterium tuberculosis H37Rv
gaaaccaugccgccgaagccgcg

SEQ ID NO: 1316859 - RNA, 12 nt, Mycobacterium tuberculosis H37Rv
gaaaccacugga

SEQ ID NO: 1316860 - RNA, 14 nt, Mycobacterium tuberculosis H37Rv
gaaaccacagcgcc

SEQ ID NO: 1316861 - RNA, 15 nt, Mycobacterium tuberculosis H37Rv
gaaacagcuugcugc

SEQ ID NO: 1316862 - RNA, 12 nt, Mycobacterium tuberculosis H37Rv
gaaacaggccac

SEQ ID NO: 1316863 - RNA, 15 nt, Mycobacterium tuberculosis H37Rv
gaaacaccggccagc

SEQ ID NO: 1316864 - RNA, 17 nt, Mycobacterium tuberculosis H37Rv
gaaacagccgcagcggc

SEQ ID NO: 1316865 - RNA, 14 nt, Mycobacterium tuberculosis H37Rv
gaaacagcauggcg

SEQ ID NO: 1316866 - RNA, 15 nt, Mycobacterium tuberculosis H37Rv
gaaacagcauggcga

SEQ ID NO: 1316867 - RNA, 21 nt, Mycobacterium tuberculosis H37Rv
gaaacagguaagcagccagca

SEQ ID NO: 1316868 - RNA, 22 nt, Mycobacterium tuberculosis H37Rv
gaaacagguaagcagccagcaa

SEQ ID NO: 1316869 - RNA, 21 nt, Mycobacterium tuberculosis H37Rv
gaaacaucucggcgcagccgg

SEQ ID NO: 1316870 - RNA, 23 nt, Mycobacterium tuberculosis H37Rv
gaaacaucucggcgcagccggug

SEQ ID NO: 1316871 - RNA, 20 nt, Mycobacterium tuberculosis H37Rv
gaaacggauuggucgaccga

SEQ ID NO: 1316872 - RNA, 18 nt, Mycobacterium tuberculosis H37Rv
gaaacgguacgccgccgc

SEQ ID NO: 1316873 - RNA, 17 nt, Mycobacterium tuberculosis H37Rv
gaaacguccuugaacgu

SEQ ID NO: 1316874 - RNA, 18 nt, Mycobacterium tuberculosis H37Rv
gaaacucaccagcacccc

SEQ ID NO: 1316875 - RNA, 16 nt, Mycobacterium tuberculosis H37Rv
gaaacucaccagcacc

SEQ ID NO: 1316876 - RNA, 12 nt, Mycobacterium tuberculosis H37Rv
gaaacugacccg

SEQ ID NO: 1316877 - RNA, 15 nt, Mycobacterium tuberculosis H37Rv
gaaagacaacccgcu

SEQ ID NO: 1316878 - RNA, 18 nt, Mycobacterium tuberculosis H37Rv
gaaauacccagcgcagca

SEQ ID NO: 1316879 - RNA, 21 nt, Mycobacterium tuberculosis H37Rv
gaaauacccagcgcagcagcg

SEQ ID NO: 1316880 - RNA, 17 nt, Mycobacterium tuberculosis H37Rv
gaaauagcugcggaggg

SEQ ID NO: 1316881 - RNA, 22 nt, Mycobacterium tuberculosis H37Rv
gaaauaucucggugacgaugaa

SEQ ID NO: 1316882 - RNA, 15 nt, Mycobacterium tuberculosis H37Rv
gaaauauuggcccgu

SEQ ID NO: 1316883 - RNA, 16 nt, Mycobacterium tuberculosis H37Rv
gaaauaagggccggcg

SEQ ID NO: 1316884 - RNA, 19 nt, Mycobacterium tuberculosis H37Rv
gaaauaacggagcggccua

SEQ ID NO: 1316885 - RNA, 17 nt, Mycobacterium tuberculosis H37Rv
gaaagcaccgaugcuga

SEQ ID NO: 1316886 - RNA, 15 nt, Mycobacterium tuberculosis H37Rv
gaaagcagcagcggc

SEQ ID NO: 1316887 - RNA, 17 nt, Mycobacterium tuberculosis H37Rv
gaaagcguaaggccgga

SEQ ID NO: 1316888 - RNA, 21 nt, Mycobacterium tuberculosis H37Rv
gaaagcgccgaaacagcaccc

SEQ ID NO: 1316889 - RNA, 14 nt, Mycobacterium tuberculosis H37Rv
gaaagccaauagca

SEQ ID NO: 1316890 - RNA, 23 nt, Mycobacterium tuberculosis H37Rv
gaaagccuaguccuggcucggca

SEQ ID NO: 1316891 - RNA, 14 nt, Mycobacterium tuberculosis H37Rv
gaaaucggccagcu

SEQ ID NO: 1316892 - RNA, 18 nt, Mycobacterium tuberculosis H37Rv
gaaaucggccagcuuccc

SEQ ID NO: 1316893 - RNA, 19 nt, Mycobacterium tuberculosis H37Rv
gaaaucgcccugacccgga

SEQ ID NO: 1316894 - RNA, 15 nt, Mycobacterium tuberculosis H37Rv
gaaaucaccucacca

SEQ ID NO: 1316895 - RNA, 15 nt, Mycobacterium tuberculosis H37Rv
gaaaugccggugccg

SEQ ID NO: 1316896 - RNA, 16 nt, Mycobacterium tuberculosis H37Rv
gaaaugaggucuuugc

SEQ ID NO: 1316897 - RNA, 18 nt, Mycobacterium tuberculosis H37Rv
gaaauuccgggccuggcc

SEQ ID NO: 1316898 - RNA, 16 nt, Mycobacterium tuberculosis H37Rv
gaaauuccgggccugg

SEQ ID NO: 1316899 - RNA, 16 nt, Mycobacterium tuberculosis H37Rv
gaaauucucgcccuga

SEQ ID NO: 1316900 - RNA, 14 nt, Mycobacterium tuberculosis H37Rv
gaacaaaugccggu

SEQ ID NO: 1316901 - RNA, 15 nt, Mycobacterium tuberculosis H37Rv
gaacagccgagccag

SEQ ID NO: 1316902 - RNA, 21 nt, Mycobacterium tuberculosis H37Rv
gaacagcacauaugugcccgg

SEQ ID NO: 1316903 - RNA, 19 nt, Mycobacterium tuberculosis H37Rv
gaacagcaccgaacccgcc

SEQ ID NO: 1316904 - RNA, 15 nt, Mycobacterium tuberculosis H37Rv
gaacaccggccaggc

SEQ ID NO: 1316905 - RNA, 16 nt, Mycobacterium tuberculosis H37Rv
gaacaccggccaggcc

SEQ ID NO: 1316906 - RNA, 16 nt, Mycobacterium tuberculosis H37Rv
gaacaccagcgcgccg

SEQ ID NO: 1316907 - RNA, 15 nt, Mycobacterium tuberculosis H37Rv
gaacaccacaccgag

SEQ ID NO: 1316908 - RNA, 23 nt, Mycobacterium tuberculosis H37Rv
gaacaccacaccgagcaccugac

SEQ ID NO: 1316909 - RNA, 18 nt, Mycobacterium tuberculosis H37Rv
gaacaccagauggcucuc

SEQ ID NO: 1316910 - RNA, 13 nt, Mycobacterium tuberculosis H37Rv
gaacaccaccgcc

SEQ ID NO: 1316911 - RNA, 22 nt, Mycobacterium tuberculosis H37Rv
gaacaacggcgcggcaagggcu

SEQ ID NO: 1316912 - RNA, 20 nt, Mycobacterium tuberculosis H37Rv
gaacaacgcgacgaagcaga

SEQ ID NO: 1316913 - RNA, 24 nt, Mycobacterium tuberculosis H37Rv
gaacauggccagcaucagcgccag

SEQ ID NO: 1316914 - RNA, 18 nt, Mycobacterium tuberculosis H37Rv
gaacauuccggcaccucc

SEQ ID NO: 1316915 - RNA, 17 nt, Mycobacterium tuberculosis H37Rv
gaacagggaggucgccg

SEQ ID NO: 1316916 - RNA, 14 nt, Mycobacterium tuberculosis H37Rv
gaacagucgcagcc

SEQ ID NO: 1316917 - RNA, 22 nt, Mycobacterium tuberculosis H37Rv
gaacaguucgacauaaccggcc

SEQ ID NO: 1316918 - RNA, 21 nt, Mycobacterium tuberculosis H37Rv
gaacaguucggcgagcacaug

SEQ ID NO: 1316919 - RNA, 16 nt, Mycobacterium tuberculosis H37Rv
gaacagcgaaccggcu

SEQ ID NO: 1316920 - RNA, 11 nt, Mycobacterium tuberculosis H37Rv
gaacagcugga

SEQ ID NO: 1316921 - RNA, 23 nt, Mycobacterium tuberculosis H37Rv
gaacaggaucagcgacuugcugg

SEQ ID NO: 1316922 - RNA, 13 nt, Mycobacterium tuberculosis H37Rv
gaacaggccggcc

SEQ ID NO: 1316923 - RNA, 19 nt, Mycobacterium tuberculosis H37Rv
gaauaccacaccgugacca

SEQ ID NO: 1316924 - RNA, 13 nt, Mycobacterium tuberculosis H37Rv
gaauacaacagcu

SEQ ID NO: 1316925 - RNA, 17 nt, Mycobacterium tuberculosis H37Rv
gaauaccgguggcagcc

SEQ ID NO: 1316926 - RNA, 22 nt, Mycobacterium tuberculosis H37Rv
gaauacugaucuuggcccgggc

SEQ ID NO: 1316927 - RNA, 18 nt, Mycobacterium tuberculosis H37Rv
gaaggcgcgggcgacguc

SEQ ID NO: 1316928 - RNA, 15 nt, Mycobacterium tuberculosis H37Rv
gaaggcguggguguc

SEQ ID NO: 1316929 - RNA, 13 nt, Mycobacterium tuberculosis H37Rv
gaaggcugucagu

SEQ ID NO: 1316930 - RNA, 12 nt, Mycobacterium tuberculosis H37Rv
gaaggggcucag

SEQ ID NO: 1316931 - RNA, 16 nt, Mycobacterium tuberculosis H37Rv
gaaggguauccgugug

SEQ ID NO: 1316932 - RNA, 17 nt, Mycobacterium tuberculosis H37Rv
gaaguaauggaacggcu

SEQ ID NO: 1316933 - RNA, 16 nt, Mycobacterium tuberculosis H37Rv
gaaguaauagcuguug

SEQ ID NO: 1316934 - RNA, 13 nt, Mycobacterium tuberculosis H37Rv
gaaguacgugcac

SEQ ID NO: 1316935 - RNA, 14 nt, Mycobacterium tuberculosis H37Rv
gaaguacacggcgg

SEQ ID NO: 1316936 - RNA, 13 nt, Mycobacterium tuberculosis H37Rv
gaagucacaggau

SEQ ID NO: 1316937 - RNA, 16 nt, Mycobacterium tuberculosis H37Rv
gaagguguccgcuggu

SEQ ID NO: 1316938 - RNA, 17 nt, Mycobacterium tuberculosis H37Rv
gaaggugcugcgcgggu

SEQ ID NO: 1316939 - RNA, 14 nt, Mycobacterium tuberculosis H37Rv
gaagguuucccgcu

SEQ ID NO: 1316940 - RNA, 17 nt, Mycobacterium tuberculosis H37Rv
gaaggucuggccugccc

SEQ ID NO: 1316941 - RNA, 15 nt, Mycobacterium tuberculosis H37Rv
gaagugcgcgcugga

SEQ ID NO: 1316942 - RNA, 15 nt, Mycobacterium tuberculosis H37Rv
gaagucgcagcgagg

SEQ ID NO: 1316943 - RNA, 16 nt, Mycobacterium tuberculosis H37Rv
gaagucgacucgccac

SEQ ID NO: 1316944 - RNA, 15 nt, Mycobacterium tuberculosis H37Rv
gaagucgacucgcca

SEQ ID NO: 1316945 - RNA, 23 nt, Mycobacterium tuberculosis H37Rv
gaagucgacgaacucgcccaggg

SEQ ID NO: 1316946 - RNA, 17 nt, Mycobacterium tuberculosis H37Rv
gaagucggucugcgggg

SEQ ID NO: 1316947 - RNA, 17 nt, Mycobacterium tuberculosis H37Rv
gaagugucgcugcaacc

SEQ ID NO: 1316948 - RNA, 13 nt, Mycobacterium tuberculosis H37Rv
gaaguugaagaag

SEQ ID NO: 1316949 - RNA, 15 nt, Mycobacterium tuberculosis H37Rv
gaaguugaagaagcc

SEQ ID NO: 1316950 - RNA, 21 nt, Mycobacterium tuberculosis H37Rv
gaaguucgucgguugccacgc

SEQ ID NO: 1316951 - RNA, 13 nt, Mycobacterium tuberculosis H37Rv
gaaguugaucuug

SEQ ID NO: 1316952 - RNA, 14 nt, Mycobacterium tuberculosis H37Rv
gaaucgcacaaacc

SEQ ID NO: 1316953 - RNA, 22 nt, Mycobacterium tuberculosis H37Rv
gaaucgcacgcgaaaugccugc

SEQ ID NO: 1316954 - RNA, 13 nt, Mycobacterium tuberculosis H37Rv
gaaucccaacucc

SEQ ID NO: 1316955 - RNA, 19 nt, Mycobacterium tuberculosis H37Rv
gaaucccacagcaggagaa

SEQ ID NO: 1316956 - RNA, 13 nt, Mycobacterium tuberculosis H37Rv
gaauccagguggu

SEQ ID NO: 1316957 - RNA, 17 nt, Mycobacterium tuberculosis H37Rv
gaaucccgcgcccggcc

SEQ ID NO: 1316958 - RNA, 16 nt, Mycobacterium tuberculosis H37Rv
gaauccccgcggcggu

SEQ ID NO: 1316959 - RNA, 23 nt, Mycobacterium tuberculosis H37Rv
gaaucccguauugauacugcccg

SEQ ID NO: 1316960 - RNA, 17 nt, Mycobacterium tuberculosis H37Rv
gaauccgauagcccggu

SEQ ID NO: 1316961 - RNA, 16 nt, Mycobacterium tuberculosis H37Rv
gaauccaccagccggu

SEQ ID NO: 1316962 - RNA, 21 nt, Mycobacterium tuberculosis H37Rv
gaaucagcagcagcgugacca

SEQ ID NO: 1316963 - RNA, 13 nt, Mycobacterium tuberculosis H37Rv
gaaucagcagcag

SEQ ID NO: 1316964 - RNA, 13 nt, Mycobacterium tuberculosis H37Rv
gaaucagcacccc

SEQ ID NO: 1316965 - RNA, 19 nt, Mycobacterium tuberculosis H37Rv
gaaucagcaccccauggcc

SEQ ID NO: 1316966 - RNA, 22 nt, Mycobacterium tuberculosis H37Rv
gaaucagugaagacaccaggcc

SEQ ID NO: 1316967 - RNA, 15 nt, Mycobacterium tuberculosis H37Rv
gaaucaggcucgccg

SEQ ID NO: 1316968 - RNA, 13 nt, Mycobacterium tuberculosis H37Rv
gaaucggcggcgg

SEQ ID NO: 1316969 - RNA, 16 nt, Mycobacterium tuberculosis H37Rv
gaaucggcaguugaac

SEQ ID NO: 1316970 - RNA, 11 nt, Mycobacterium tuberculosis H37Rv
gaaucgcccgg

SEQ ID NO: 1316971 - RNA, 16 nt, Mycobacterium tuberculosis H37Rv
gaaucgcgcuucaggc

SEQ ID NO: 1316972 - RNA, 15 nt, Mycobacterium tuberculosis H37Rv
gaaucgccggcggcc

SEQ ID NO: 1316973 - RNA, 17 nt, Mycobacterium tuberculosis H37Rv
gaaucgcggagccagga

SEQ ID NO: 1316974 - RNA, 13 nt, Mycobacterium tuberculosis H37Rv
gaaucuccgcgcg

SEQ ID NO: 1316975 - RNA, 22 nt, Mycobacterium tuberculosis H37Rv
gaaucugaaaaagcaucaaagc

SEQ ID NO: 1316976 - RNA, 13 nt, Mycobacterium tuberculosis H37Rv
gaaucugccucuc

SEQ ID NO: 1316977 - RNA, 17 nt, Mycobacterium tuberculosis H37Rv
gaaugaccuugcccugc

SEQ ID NO: 1316978 - RNA, 20 nt, Mycobacterium tuberculosis H37Rv
gaaugaccuugcccugcgug

SEQ ID NO: 1316979 - RNA, 13 nt, Mycobacterium tuberculosis H37Rv
gaaugacgaucca

SEQ ID NO: 1316980 - RNA, 16 nt, Mycobacterium tuberculosis H37Rv
gaauggccgccgcagc

SEQ ID NO: 1316981 - RNA, 20 nt, Mycobacterium tuberculosis H37Rv
gaauguugccgccgcggcgc

SEQ ID NO: 1316982 - RNA, 18 nt, Mycobacterium tuberculosis H37Rv
gaaugcugggcccgccag

SEQ ID NO: 1316983 - RNA, 20 nt, Mycobacterium tuberculosis H37Rv
gaaugcugggcccgccagcc

SEQ ID NO: 1316984 - RNA, 14 nt, Mycobacterium tuberculosis H37Rv
gaaugcgggccucc

SEQ ID NO: 1316985 - RNA, 16 nt, Mycobacterium tuberculosis H37Rv
gaauggcagcacgacc

SEQ ID NO: 1316986 - RNA, 22 nt, Mycobacterium tuberculosis H37Rv
gaaugccgucgccggucaggcc

SEQ ID NO: 1316987 - RNA, 17 nt, Mycobacterium tuberculosis H37Rv
gaaugccgcggggauca

SEQ ID NO: 1316988 - RNA, 14 nt, Mycobacterium tuberculosis H37Rv
gaauucggccggcg

SEQ ID NO: 1316989 - RNA, 19 nt, Mycobacterium tuberculosis H37Rv
gaauucgccauagcgggcg

SEQ ID NO: 1316990 - RNA, 22 nt, Mycobacterium tuberculosis H37Rv
gaauuccggcggagcgggccag

SEQ ID NO: 1316991 - RNA, 14 nt, Mycobacterium tuberculosis H37Rv
gaauuccggcugcu

SEQ ID NO: 1316992 - RNA, 14 nt, Mycobacterium tuberculosis H37Rv
gaauuccuuccugg

SEQ ID NO: 1316993 - RNA, 22 nt, Mycobacterium tuberculosis H37Rv
gaauuccagccagccgcccuga

SEQ ID NO: 1316994 - RNA, 19 nt, Mycobacterium tuberculosis H37Rv
gaauucauccgggcucgca

SEQ ID NO: 1316995 - RNA, 23 nt, Mycobacterium tuberculosis H37Rv
gaauuaguuucguccccagaccg

SEQ ID NO: 1316996 - RNA, 17 nt, Mycobacterium tuberculosis H37Rv
gaaccgcagucaacgca

SEQ ID NO: 1316997 - RNA, 17 nt, Mycobacterium tuberculosis H37Rv
gaacccucagccgcgcc

SEQ ID NO: 1316998 - RNA, 14 nt, Mycobacterium tuberculosis H37Rv
gaacccuccgcagc

SEQ ID NO: 1316999 - RNA, 23 nt, Mycobacterium tuberculosis H37Rv
gaacccgauaacaaggccgccgc

SEQ ID NO: 1317000 - RNA, 19 nt, Mycobacterium tuberculosis H37Rv
gaacccgaucgucgagccg

SEQ ID NO: 1317001 - RNA, 13 nt, Mycobacterium tuberculosis H37Rv
gaacccgccggca

SEQ ID NO: 1317002 - RNA, 20 nt, Mycobacterium tuberculosis H37Rv
gaacccgccgucaccgcgcg

SEQ ID NO: 1317003 - RNA, 17 nt, Mycobacterium tuberculosis H37Rv
gaaccgggcaaaucaag

SEQ ID NO: 1317004 - RNA, 20 nt, Mycobacterium tuberculosis H37Rv
gaaccgggcaaaucaagcac

SEQ ID NO: 1317005 - RNA, 16 nt, Mycobacterium tuberculosis H37Rv
gaaccgggcaaaucaa

SEQ ID NO: 1317006 - RNA, 22 nt, Mycobacterium tuberculosis H37Rv
gaaccggccgcgacgacacgcc

SEQ ID NO: 1317007 - RNA, 20 nt, Mycobacterium tuberculosis H37Rv
gaaccggcugggcgccacca

SEQ ID NO: 1317008 - RNA, 18 nt, Mycobacterium tuberculosis H37Rv
gaaccggcugggcgccac

SEQ ID NO: 1317009 - RNA, 18 nt, Mycobacterium tuberculosis H37Rv
gaaccggcgugcagcacu

SEQ ID NO: 1317010 - RNA, 13 nt, Mycobacterium tuberculosis H37Rv
gaaccggcugggc

SEQ ID NO: 1317011 - RNA, 16 nt, Mycobacterium tuberculosis H37Rv
gaaccgcucagcgcag

SEQ ID NO: 1317012 - RNA, 20 nt, Mycobacterium tuberculosis H37Rv
gaaccgcggaucgaccgcca

SEQ ID NO: 1317013 - RNA, 19 nt, Mycobacterium tuberculosis H37Rv
gaaccgccggcugcgccag

SEQ ID NO: 1317014 - RNA, 14 nt, Mycobacterium tuberculosis H37Rv
gaaccgccccggug

SEQ ID NO: 1317015 - RNA, 19 nt, Mycobacterium tuberculosis H37Rv
gaaccgcguuaugccaggc

SEQ ID NO: 1317016 - RNA, 15 nt, Mycobacterium tuberculosis H37Rv
gaaccagcggucggc

SEQ ID NO: 1317017 - RNA, 20 nt, Mycobacterium tuberculosis H37Rv
gaaccagaggucacgcagca

SEQ ID NO: 1317018 - RNA, 16 nt, Mycobacterium tuberculosis H37Rv
gaaccagucgacccag

SEQ ID NO: 1317019 - RNA, 22 nt, Mycobacterium tuberculosis H37Rv
gaaccacuuuccgaggagggcc

SEQ ID NO: 1317020 - RNA, 17 nt, Mycobacterium tuberculosis H37Rv
gaaccacggucagcacg

SEQ ID NO: 1317021 - RNA, 12 nt, Mycobacterium tuberculosis H37Rv
gaaccaccaccg

SEQ ID NO: 1317022 - RNA, 19 nt, Mycobacterium tuberculosis H37Rv
gaaccacgccaucgagcag

SEQ ID NO: 1317023 - RNA, 14 nt, Mycobacterium tuberculosis H37Rv
gaaccccauaauca

SEQ ID NO: 1317024 - RNA, 16 nt, Mycobacterium tuberculosis H37Rv
gaaccccgagcugcca

SEQ ID NO: 1317025 - RNA, 14 nt, Mycobacterium tuberculosis H37Rv
gaacccacugcccg

SEQ ID NO: 1317026 - RNA, 17 nt, Mycobacterium tuberculosis H37Rv
gaacccacgcaugcacg

SEQ ID NO: 1317027 - RNA, 13 nt, Mycobacterium tuberculosis H37Rv
gaacccagcacug

SEQ ID NO: 1317028 - RNA, 15 nt, Mycobacterium tuberculosis H37Rv
gaacccagcacuggg

SEQ ID NO: 1317029 - RNA, 19 nt, Mycobacterium tuberculosis H37Rv
gaacccagcacugggauga

SEQ ID NO: 1317030 - RNA, 12 nt, Mycobacterium tuberculosis H37Rv
gaacccaggcac

SEQ ID NO: 1317031 - RNA, 13 nt, Mycobacterium tuberculosis H37Rv
gaacccaggcaca

SEQ ID NO: 1317032 - RNA, 14 nt, Mycobacterium tuberculosis H37Rv
gaacgccaccccca

SEQ ID NO: 1317033 - RNA, 16 nt, Mycobacterium tuberculosis H37Rv
gaacgccaccaccucc

SEQ ID NO: 1317034 - RNA, 13 nt, Mycobacterium tuberculosis H37Rv
gaacgccagaccg

SEQ ID NO: 1317035 - RNA, 16 nt, Mycobacterium tuberculosis H37Rv
gaacgccagaccgccg

SEQ ID NO: 1317036 - RNA, 13 nt, Mycobacterium tuberculosis H37Rv
gaacgccagcagc

SEQ ID NO: 1317037 - RNA, 14 nt, Mycobacterium tuberculosis H37Rv
gaacgcaucggucc

SEQ ID NO: 1317038 - RNA, 14 nt, Mycobacterium tuberculosis H37Rv
gaacgcagccagcg

SEQ ID NO: 1317039 - RNA, 22 nt, Mycobacterium tuberculosis H37Rv
gaacgaugccggcaagccugcg

SEQ ID NO: 1317040 - RNA, 18 nt, Mycobacterium tuberculosis H37Rv
gaacgcaaccgagggcau

SEQ ID NO: 1317041 - RNA, 14 nt, Mycobacterium tuberculosis H37Rv
gaacgccgccagca

SEQ ID NO: 1317042 - RNA, 14 nt, Mycobacterium tuberculosis H37Rv
gaacgccaggucau

SEQ ID NO: 1317043 - RNA, 18 nt, Mycobacterium tuberculosis H37Rv
gaacgccggugcgcugga

SEQ ID NO: 1317044 - RNA, 18 nt, Mycobacterium tuberculosis H37Rv
gaacgccggcaucgcgcg

SEQ ID NO: 1317045 - RNA, 13 nt, Mycobacterium tuberculosis H37Rv
gaacgccgucaga

SEQ ID NO: 1317046 - RNA, 15 nt, Mycobacterium tuberculosis H37Rv
gaacgccugcuggua

SEQ ID NO: 1317047 - RNA, 18 nt, Mycobacterium tuberculosis H37Rv
gaacgcgaucgaccuugg

SEQ ID NO: 1317048 - RNA, 23 nt, Mycobacterium tuberculosis H37Rv
gaacgcgagcaacaccagggccu

SEQ ID NO: 1317049 - RNA, 15 nt, Mycobacterium tuberculosis H37Rv
gaacgcgauccgggu

SEQ ID NO: 1317050 - RNA, 20 nt, Mycobacterium tuberculosis H37Rv
gaaccguucgcucagggugu

SEQ ID NO: 1317051 - RNA, 16 nt, Mycobacterium tuberculosis H37Rv
gaaccgguaucgccaa

SEQ ID NO: 1317052 - RNA, 16 nt, Mycobacterium tuberculosis H37Rv
gaaccggucagccgga

SEQ ID NO: 1317053 - RNA, 16 nt, Mycobacterium tuberculosis H37Rv
gaaccgguagucgccg

SEQ ID NO: 1317054 - RNA, 17 nt, Mycobacterium tuberculosis H37Rv
gaaccgguagucgccgu

SEQ ID NO: 1317055 - RNA, 16 nt, Mycobacterium tuberculosis H37Rv
gaaccgucucggcgac

SEQ ID NO: 1317056 - RNA, 21 nt, Mycobacterium tuberculosis H37Rv
gaaccucacagcuugagcaca

SEQ ID NO: 1317057 - RNA, 12 nt, Mycobacterium tuberculosis H37Rv
gaaccucacagc

SEQ ID NO: 1317058 - RNA, 15 nt, Mycobacterium tuberculosis H37Rv
gaaccugauccgcua

SEQ ID NO: 1317059 - RNA, 19 nt, Mycobacterium tuberculosis H37Rv
gaaccucaccugacacgcc

SEQ ID NO: 1317060 - RNA, 16 nt, Mycobacterium tuberculosis H37Rv
gaacgaccaggcgcac

SEQ ID NO: 1317061 - RNA, 20 nt, Mycobacterium tuberculosis H37Rv
gaacgaaagucuccggaacc

SEQ ID NO: 1317062 - RNA, 16 nt, Mycobacterium tuberculosis H37Rv
gaaccugcggcagcgg

SEQ ID NO: 1317063 - RNA, 23 nt, Mycobacterium tuberculosis H37Rv
gaacggcuuggcgucggccggca

SEQ ID NO: 1317064 - RNA, 22 nt, Mycobacterium tuberculosis H37Rv
gaacggcuugcgauuggcuggg

SEQ ID NO: 1317065 - RNA, 23 nt, Mycobacterium tuberculosis H37Rv
gaacggcuugcgauuggcugggu

SEQ ID NO: 1317066 - RNA, 16 nt, Mycobacterium tuberculosis H37Rv
gaacggcucggccgga

SEQ ID NO: 1317067 - RNA, 13 nt, Mycobacterium tuberculosis H37Rv
gaacggcucggcc

SEQ ID NO: 1317068 - RNA, 13 nt, Mycobacterium tuberculosis H37Rv
gaacgcuuccagc

SEQ ID NO: 1317069 - RNA, 20 nt, Mycobacterium tuberculosis H37Rv
gaacgcuuuccggcgguggu

SEQ ID NO: 1317070 - RNA, 14 nt, Mycobacterium tuberculosis H37Rv
gaacgcuccaggcc

SEQ ID NO: 1317071 - RNA, 20 nt, Mycobacterium tuberculosis H37Rv
gaacgcgucguagcgcucgu

SEQ ID NO: 1317072 - RNA, 19 nt, Mycobacterium tuberculosis H37Rv
gaacgcggcgaaugccagu

SEQ ID NO: 1317073 - RNA, 18 nt, Mycobacterium tuberculosis H37Rv
gaacgcgcgcagccgggc

SEQ ID NO: 1317074 - RNA, 14 nt, Mycobacterium tuberculosis H37Rv
gaacgcggaagccg

SEQ ID NO: 1317075 - RNA, 17 nt, Mycobacterium tuberculosis H37Rv
gaacgucgcggccagca

SEQ ID NO: 1317076 - RNA, 16 nt, Mycobacterium tuberculosis H37Rv
gaacgucucggccagc

SEQ ID NO: 1317077 - RNA, 22 nt, Mycobacterium tuberculosis H37Rv
gaacguuuucgucaccccacca

SEQ ID NO: 1317078 - RNA, 14 nt, Mycobacterium tuberculosis H37Rv
gaacgugucgggug

SEQ ID NO: 1317079 - RNA, 23 nt, Mycobacterium tuberculosis H37Rv
gaacgugacccccagcagggugu

SEQ ID NO: 1317080 - RNA, 16 nt, Mycobacterium tuberculosis H37Rv
gaacgugccuuccucg

SEQ ID NO: 1317081 - RNA, 17 nt, Mycobacterium tuberculosis H37Rv
gaacucaacaccagcaa

SEQ ID NO: 1317082 - RNA, 14 nt, Mycobacterium tuberculosis H37Rv
gaacucgugacagc

SEQ ID NO: 1317083 - RNA, 20 nt, Mycobacterium tuberculosis H37Rv
gaacugacguuaccgccgca

SEQ ID NO: 1317084 - RNA, 22 nt, Mycobacterium tuberculosis H37Rv
gaacugaaacgcuuggcccugg

SEQ ID NO: 1317085 - RNA, 16 nt, Mycobacterium tuberculosis H37Rv
gaacucgaccaccgcc

SEQ ID NO: 1317086 - RNA, 15 nt, Mycobacterium tuberculosis H37Rv
gaacucgaccaccgc

SEQ ID NO: 1317087 - RNA, 14 nt, Mycobacterium tuberculosis H37Rv
gaacucgcccaggg

SEQ ID NO: 1317088 - RNA, 15 nt, Mycobacterium tuberculosis H37Rv
gaacucggcccacac

SEQ ID NO: 1317089 - RNA, 18 nt, Mycobacterium tuberculosis H37Rv
gaacugggucggcacggg

SEQ ID NO: 1317090 - RNA, 18 nt, Mycobacterium tuberculosis H37Rv
gaacuggaccacagccgc

SEQ ID NO: 1317091 - RNA, 21 nt, Mycobacterium tuberculosis H37Rv
gaacuggacaagcuccucgcg

SEQ ID NO: 1317092 - RNA, 12 nt, Mycobacterium tuberculosis H37Rv
gaacuggcuggu

SEQ ID NO: 1317093 - RNA, 19 nt, Mycobacterium tuberculosis H37Rv
gaacuggcuguaguccgcu

SEQ ID NO: 1317094 - RNA, 18 nt, Mycobacterium tuberculosis H37Rv
gaacugggcgcccgcggu

SEQ ID NO: 1317095 - RNA, 24 nt, Mycobacterium tuberculosis H37Rv
gaacugggcccccaaucagugcag

SEQ ID NO: 1317096 - RNA, 13 nt, Mycobacterium tuberculosis H37Rv
gaacugggccuca

SEQ ID NO: 1317097 - RNA, 18 nt, Mycobacterium tuberculosis H37Rv
gaacugcaucauggccgu

SEQ ID NO: 1317098 - RNA, 11 nt, Mycobacterium tuberculosis H37Rv
gaacugcgcaa

SEQ ID NO: 1317099 - RNA, 22 nt, Mycobacterium tuberculosis H37Rv
gaagcgguggccucccacggcg

SEQ ID NO: 1317100 - RNA, 19 nt, Mycobacterium tuberculosis H37Rv
gaagcggcgacuacccagc

SEQ ID NO: 1317101 - RNA, 13 nt, Mycobacterium tuberculosis H37Rv
gaagcggcugcug

SEQ ID NO: 1317102 - RNA, 22 nt, Mycobacterium tuberculosis H37Rv
gaagcgggauugccgagaacac

SEQ ID NO: 1317103 - RNA, 20 nt, Mycobacterium tuberculosis H37Rv
gaagcgucuggucagccgcg

SEQ ID NO: 1317104 - RNA, 23 nt, Mycobacterium tuberculosis H37Rv
gaagcgucuggucagccgcggcg

SEQ ID NO: 1317105 - RNA, 20 nt, Mycobacterium tuberculosis H37Rv
gaagcgucgcuucggcaccg

SEQ ID NO: 1317106 - RNA, 19 nt, Mycobacterium tuberculosis H37Rv
gaagcguugcacugcuggu

SEQ ID NO: 1317107 - RNA, 20 nt, Mycobacterium tuberculosis H37Rv
gaaggagaucccccaggcga

SEQ ID NO: 1317108 - RNA, 23 nt, Mycobacterium tuberculosis H37Rv
gaaggaucagcgcacuggccgcu

SEQ ID NO: 1317109 - RNA, 16 nt, Mycobacterium tuberculosis H37Rv
gaaggcaaacaccagc

SEQ ID NO: 1317110 - RNA, 15 nt, Mycobacterium tuberculosis H37Rv
gaaggcaaacaccag

SEQ ID NO: 1317111 - RNA, 21 nt, Mycobacterium tuberculosis H37Rv
gaaggauuuggagcuuuuugc

SEQ ID NO: 1317112 - RNA, 15 nt, Mycobacterium tuberculosis H37Rv
gaaggccgcaccgcc

SEQ ID NO: 1317113 - RNA, 20 nt, Mycobacterium tuberculosis H37Rv
gaaggccgcgcgcagggcgu

SEQ ID NO: 1317114 - RNA, 23 nt, Mycobacterium tuberculosis H37Rv
gaaggccgaacugccgcgccgac

SEQ ID NO: 1317115 - RNA, 22 nt, Mycobacterium tuberculosis H37Rv
gaaggcaccgaaaaacaccagc

SEQ ID NO: 1317116 - RNA, 20 nt, Mycobacterium tuberculosis H37Rv
gaaggaaccgggcaaaucaa

SEQ ID NO: 1317117 - RNA, 22 nt, Mycobacterium tuberculosis H37Rv
gaaggaaccgggcaaaucaagc

SEQ ID NO: 1317118 - RNA, 23 nt, Mycobacterium tuberculosis H37Rv
gaaggacaucacgaaggcguucg

SEQ ID NO: 1317119 - RNA, 16 nt, Mycobacterium tuberculosis H37Rv
gaaggaccggcaccug

SEQ ID NO: 1317120 - RNA, 17 nt, Mycobacterium tuberculosis H37Rv
gaaggacggcagccacc

SEQ ID NO: 1317121 - RNA, 14 nt, Mycobacterium tuberculosis H37Rv
gaagcggaucuggc

SEQ ID NO: 1317122 - RNA, 20 nt, Mycobacterium tuberculosis H37Rv
gaagcgcucggcagccggcu

SEQ ID NO: 1317123 - RNA, 18 nt, Mycobacterium tuberculosis H37Rv
gaagcgcucggcagccgg

SEQ ID NO: 1317124 - RNA, 15 nt, Mycobacterium tuberculosis H37Rv
gaagcgcuccagcug

SEQ ID NO: 1317125 - RNA, 16 nt, Mycobacterium tuberculosis H37Rv
gaagcgcucggcagcc

SEQ ID NO: 1317126 - RNA, 19 nt, Mycobacterium tuberculosis H37Rv
gaagccuugcagcgccccc

SEQ ID NO: 1317127 - RNA, 18 nt, Mycobacterium tuberculosis H37Rv
gaagccuguagucccuca

SEQ ID NO: 1317128 - RNA, 18 nt, Mycobacterium tuberculosis H37Rv
gaagccgcaucuggcugu

SEQ ID NO: 1317129 - RNA, 14 nt, Mycobacterium tuberculosis H37Rv
gaagccgcaccgcu

SEQ ID NO: 1317130 - RNA, 14 nt, Mycobacterium tuberculosis H37Rv
gaagccggcgccgg

SEQ ID NO: 1317131 - RNA, 17 nt, Mycobacterium tuberculosis H37Rv
gaagccggcgccggcuu

SEQ ID NO: 1317132 - RNA, 15 nt, Mycobacterium tuberculosis H37Rv
gaagccgagcaucag

SEQ ID NO: 1317133 - RNA, 19 nt, Mycobacterium tuberculosis H37Rv
gaagccgacguugaagccg

SEQ ID NO: 1317134 - RNA, 22 nt, Mycobacterium tuberculosis H37Rv
gaagccgacguugaagccgccg

SEQ ID NO: 1317135 - RNA, 20 nt, Mycobacterium tuberculosis H37Rv
gaagccgacgauccacggcg

SEQ ID NO: 1317136 - RNA, 17 nt, Mycobacterium tuberculosis H37Rv
gaagcccuuguagcaca

SEQ ID NO: 1317137 - RNA, 15 nt, Mycobacterium tuberculosis H37Rv
gaagccccucaccuc

SEQ ID NO: 1317138 - RNA, 17 nt, Mycobacterium tuberculosis H37Rv
gaagcccggggcgcucg

SEQ ID NO: 1317139 - RNA, 18 nt, Mycobacterium tuberculosis H37Rv
gaagccagaucgcuagga

SEQ ID NO: 1317140 - RNA, 17 nt, Mycobacterium tuberculosis H37Rv
gaagccagcgcagcacc

SEQ ID NO: 1317141 - RNA, 23 nt, Mycobacterium tuberculosis H37Rv
gaagcaucgcguuguaggcuucc

SEQ ID NO: 1317142 - RNA, 18 nt, Mycobacterium tuberculosis H37Rv
gaagcccagaucuugcag

SEQ ID NO: 1317143 - RNA, 19 nt, Mycobacterium tuberculosis H37Rv
gaagcacacuguucccaca

SEQ ID NO: 1317144 - RNA, 22 nt, Mycobacterium tuberculosis H37Rv
gaagcaggugauguucagcgcc

SEQ ID NO: 1317145 - RNA, 20 nt, Mycobacterium tuberculosis H37Rv
gaagcaggugaaacaggacg

SEQ ID NO: 1317146 - RNA, 19 nt, Mycobacterium tuberculosis H37Rv
gaagaugucuuccugcgcc

SEQ ID NO: 1317147 - RNA, 21 nt, Mycobacterium tuberculosis H37Rv
gaagauccagcgcaccggcgu

SEQ ID NO: 1317148 - RNA, 22 nt, Mycobacterium tuberculosis H37Rv
gaagaucggcgcuagccaggga

SEQ ID NO: 1317149 - RNA, 19 nt, Mycobacterium tuberculosis H37Rv
gaagaucgcgugccacagc

SEQ ID NO: 1317150 - RNA, 16 nt, Mycobacterium tuberculosis H37Rv
gaagagggcgccgcgc

SEQ ID NO: 1317151 - RNA, 17 nt, Mycobacterium tuberculosis H37Rv
gaagaguccuuaaacgu

SEQ ID NO: 1317152 - RNA, 18 nt, Mycobacterium tuberculosis H37Rv
gaagagcggagccggcgc

SEQ ID NO: 1317153 - RNA, 14 nt, Mycobacterium tuberculosis H37Rv
gaagacaccaggcc

SEQ ID NO: 1317154 - RNA, 20 nt, Mycobacterium tuberculosis H37Rv
gaagaaguacaucugccggu

SEQ ID NO: 1317155 - RNA, 15 nt, Mycobacterium tuberculosis H37Rv
gaagaagugcucaca

SEQ ID NO: 1317156 - RNA, 14 nt, Mycobacterium tuberculosis H37Rv
gaagacggccaccg

SEQ ID NO: 1317157 - RNA, 17 nt, Mycobacterium tuberculosis H37Rv
gaagacaccaggcccgg

SEQ ID NO: 1317158 - RNA, 11 nt, Mycobacterium tuberculosis H37Rv
gaacuuggccg

SEQ ID NO: 1317159 - RNA, 19 nt, Mycobacterium tuberculosis H37Rv
gaacuuguugaccuccucc

SEQ ID NO: 1317160 - RNA, 12 nt, Mycobacterium tuberculosis H37Rv
gaacuucuccac

SEQ ID NO: 1317161 - RNA, 15 nt, Mycobacterium tuberculosis H37Rv
gaagaaaacgaaccc

SEQ ID NO: 1317162 - RNA, 13 nt, Mycobacterium tuberculosis H37Rv
gaagaagcccagg

SEQ ID NO: 1317163 - RNA, 12 nt, Mycobacterium tuberculosis H37Rv
gaagaacaacau

SEQ ID NO: 1317164 - RNA, 12 nt, Mycobacterium tuberculosis H37Rv
gaagaaaccgca

SEQ ID NO: 1317165 - RNA, 18 nt, Mycobacterium tuberculosis H37Rv
cuucucggcgggucaggc

SEQ ID NO: 1317166 - RNA, 14 nt, Mycobacterium tuberculosis H37Rv
cuucucgcggacgg

SEQ ID NO: 1317167 - RNA, 15 nt, Mycobacterium tuberculosis H37Rv
cuucucgagccgccg

SEQ ID NO: 1317168 - RNA, 15 nt, Mycobacterium tuberculosis H37Rv
cuucuccgagaucag

SEQ ID NO: 1317169 - RNA, 23 nt, Mycobacterium tuberculosis H37Rv
cuucuccgagaucagcggcccga

SEQ ID NO: 1317170 - RNA, 21 nt, Mycobacterium tuberculosis H37Rv
cuucgcggugugcggcagccc

SEQ ID NO: 1317171 - RNA, 19 nt, Mycobacterium tuberculosis H37Rv
cuucuccccgaucagcacc

SEQ ID NO: 1317172 - RNA, 18 nt, Mycobacterium tuberculosis H37Rv
cuucugccuuggccggcu

SEQ ID NO: 1317173 - RNA, 19 nt, Mycobacterium tuberculosis H37Rv
cuucugcacgaacgccugc

SEQ ID NO: 1317174 - RNA, 18 nt, Mycobacterium tuberculosis H37Rv
cuucugagacugccgccg

SEQ ID NO: 1317175 - RNA, 14 nt, Mycobacterium tuberculosis H37Rv
cuucugagacugcc

SEQ ID NO: 1317176 - RNA, 18 nt, Mycobacterium tuberculosis H37Rv
cuucuggcaggugaacug

SEQ ID NO: 1317177 - RNA, 15 nt, Mycobacterium tuberculosis H37Rv
cuucugguccagcac

SEQ ID NO: 1317178 - RNA, 18 nt, Mycobacterium tuberculosis H37Rv
cuucuuaccgcgggccgc

SEQ ID NO: 1317179 - RNA, 20 nt, Mycobacterium tuberculosis H37Rv
cuucuucaccgccuugguca

SEQ ID NO: 1317180 - RNA, 21 nt, Mycobacterium tuberculosis H37Rv
cuucuucgcuaccuucuuggc

SEQ ID NO: 1317181 - RNA, 19 nt, Mycobacterium tuberculosis H37Rv
cuucuuggcaggugccuuc

SEQ ID NO: 1317182 - RNA, 21 nt, Mycobacterium tuberculosis H37Rv
cuucuuggcaggugccuucuu

SEQ ID NO: 1317183 - RNA, 18 nt, Mycobacterium tuberculosis H37Rv
cuucuuggcugcacuggc

SEQ ID NO: 1317184 - RNA, 20 nt, Mycobacterium tuberculosis H37Rv
cuucuuggcugcacuggccc

SEQ ID NO: 1317185 - RNA, 13 nt, Mycobacterium tuberculosis H37Rv
cuucuucuugacc

SEQ ID NO: 1317186 - RNA, 14 nt, Mycobacterium tuberculosis H37Rv
cuugaggucaccca

SEQ ID NO: 1317187 - RNA, 12 nt, Mycobacterium tuberculosis H37Rv
cuugcacaagcu

SEQ ID NO: 1317188 - RNA, 22 nt, Mycobacterium tuberculosis H37Rv
cuugaaauugagccggcccugc

SEQ ID NO: 1317189 - RNA, 21 nt, Mycobacterium tuberculosis H37Rv
cuugagccgggcaaccagcag

SEQ ID NO: 1317190 - RNA, 19 nt, Mycobacterium tuberculosis H37Rv
cuugagccgggcaaccagc

SEQ ID NO: 1317191 - RNA, 13 nt, Mycobacterium tuberculosis H37Rv
cuugaaacccagg

SEQ ID NO: 1317192 - RNA, 20 nt, Mycobacterium tuberculosis H37Rv
cuugcgguucggacacacag

SEQ ID NO: 1317193 - RNA, 21 nt, Mycobacterium tuberculosis H37Rv
cuugcuaacgcaucuuggugc

SEQ ID NO: 1317194 - RNA, 18 nt, Mycobacterium tuberculosis H37Rv
cuugcgggcagccgcccg

SEQ ID NO: 1317195 - RNA, 16 nt, Mycobacterium tuberculosis H37Rv
cuugcgggcucucggc

SEQ ID NO: 1317196 - RNA, 18 nt, Mycobacterium tuberculosis H37Rv
cuugcggcugcccacccc

SEQ ID NO: 1317197 - RNA, 22 nt, Mycobacterium tuberculosis H37Rv
cuugcggccgcugaucaacaga

SEQ ID NO: 1317198 - RNA, 14 nt, Mycobacterium tuberculosis H37Rv
cuugcggccgggcg

SEQ ID NO: 1317199 - RNA, 18 nt, Mycobacterium tuberculosis H37Rv
cuugcggaagaagugcuc

SEQ ID NO: 1317200 - RNA, 23 nt, Mycobacterium tuberculosis H37Rv
cuugcucgacgaucugcagcacu

SEQ ID NO: 1317201 - RNA, 20 nt, Mycobacterium tuberculosis H37Rv
cuugcucagcucgaccccgg

SEQ ID NO: 1317202 - RNA, 23 nt, Mycobacterium tuberculosis H37Rv
cuugccgucgcugacgcccuccu

SEQ ID NO: 1317203 - RNA, 18 nt, Mycobacterium tuberculosis H37Rv
cuugccggccagcagguc

SEQ ID NO: 1317204 - RNA, 20 nt, Mycobacterium tuberculosis H37Rv
cuugccggguuugaucagcu

SEQ ID NO: 1317205 - RNA, 12 nt, Mycobacterium tuberculosis H37Rv
cuugcagcgccc

SEQ ID NO: 1317206 - RNA, 17 nt, Mycobacterium tuberculosis H37Rv
cuugcaggcgucccagc

SEQ ID NO: 1317207 - RNA, 21 nt, Mycobacterium tuberculosis H37Rv
cuugcgcgcaggugcugggcg

SEQ ID NO: 1317208 - RNA, 22 nt, Mycobacterium tuberculosis H37Rv
cuugcgccgcccaugccuccag

SEQ ID NO: 1317209 - RNA, 14 nt, Mycobacterium tuberculosis H37Rv
cuugcgccgcagcg

SEQ ID NO: 1317210 - RNA, 12 nt, Mycobacterium tuberculosis H37Rv
cuugccuccggc

SEQ ID NO: 1317211 - RNA, 16 nt, Mycobacterium tuberculosis H37Rv
cuugccuccggcgccg

SEQ ID NO: 1317212 - RNA, 15 nt, Mycobacterium tuberculosis H37Rv
cuugccuagccgcag

SEQ ID NO: 1317213 - RNA, 23 nt, Mycobacterium tuberculosis H37Rv
cuugccguagaagcgcuccagcu

SEQ ID NO: 1317214 - RNA, 13 nt, Mycobacterium tuberculosis H37Rv
cuuguuccagcgc

SEQ ID NO: 1317215 - RNA, 15 nt, Mycobacterium tuberculosis H37Rv
cuuguugaccaccac

SEQ ID NO: 1317216 - RNA, 17 nt, Mycobacterium tuberculosis H37Rv
cuuguucuuggccaccc

SEQ ID NO: 1317217 - RNA, 14 nt, Mycobacterium tuberculosis H37Rv
cuuuaaaccccugg

SEQ ID NO: 1317218 - RNA, 17 nt, Mycobacterium tuberculosis H37Rv
cuuguccgggccccacg

SEQ ID NO: 1317219 - RNA, 14 nt, Mycobacterium tuberculosis H37Rv
cuuguccggcccgu

SEQ ID NO: 1317220 - RNA, 14 nt, Mycobacterium tuberculosis H37Rv
cuuguccagggugg

SEQ ID NO: 1317221 - RNA, 14 nt, Mycobacterium tuberculosis H37Rv
cuuggaaggcgcgc

SEQ ID NO: 1317222 - RNA, 20 nt, Mycobacterium tuberculosis H37Rv
cuuggaaggcgcgcgcccgg

SEQ ID NO: 1317223 - RNA, 18 nt, Mycobacterium tuberculosis H37Rv
cuuggacccugcgccgcc

SEQ ID NO: 1317224 - RNA, 16 nt, Mycobacterium tuberculosis H37Rv
cuuggacccugcgccg

SEQ ID NO: 1317225 - RNA, 15 nt, Mycobacterium tuberculosis H37Rv
cuuggacucggcggg

SEQ ID NO: 1317226 - RNA, 14 nt, Mycobacterium tuberculosis H37Rv
cuuggacagcagca

SEQ ID NO: 1317227 - RNA, 17 nt, Mycobacterium tuberculosis H37Rv
cuuguaaacgaagaacu

SEQ ID NO: 1317228 - RNA, 19 nt, Mycobacterium tuberculosis H37Rv
cuuggacugucccaccagg

SEQ ID NO: 1317229 - RNA, 22 nt, Mycobacterium tuberculosis H37Rv
cuuggagaagguuucccgcuua

SEQ ID NO: 1317230 - RNA, 19 nt, Mycobacterium tuberculosis H37Rv
cuuggacgacccgggccgg

SEQ ID NO: 1317231 - RNA, 17 nt, Mycobacterium tuberculosis H37Rv
cuugugccccgagcugc

SEQ ID NO: 1317232 - RNA, 14 nt, Mycobacterium tuberculosis H37Rv
cuuguccuccgcgg

SEQ ID NO: 1317233 - RNA, 18 nt, Mycobacterium tuberculosis H37Rv
cuuguggugagcggaauc

SEQ ID NO: 1317234 - RNA, 18 nt, Mycobacterium tuberculosis H37Rv
cuuguucaucaucugguc

SEQ ID NO: 1317235 - RNA, 23 nt, Mycobacterium tuberculosis H37Rv
cuuuaauccagcgccgaccuccu

SEQ ID NO: 1317236 - RNA, 20 nt, Mycobacterium tuberculosis H37Rv
cuuucacaagccccgcgcgu

SEQ ID NO: 1317237 - RNA, 14 nt, Mycobacterium tuberculosis H37Rv
cuuucgaugauggg

SEQ ID NO: 1317238 - RNA, 24 nt, Mycobacterium tuberculosis H37Rv
cuuucgcgccgcgaggcaccgaca

SEQ ID NO: 1317239 - RNA, 22 nt, Mycobacterium tuberculosis H37Rv
cuuucggaaaaccgcaccgucc

SEQ ID NO: 1317240 - RNA, 19 nt, Mycobacterium tuberculosis H37Rv
cuuucccguugcugagcgu

SEQ ID NO: 1317241 - RNA, 16 nt, Mycobacterium tuberculosis H37Rv
cuuuccggccgccugc

SEQ ID NO: 1317242 - RNA, 22 nt, Mycobacterium tuberculosis H37Rv
cuuuccgcgaaucaacaggacc

SEQ ID NO: 1317243 - RNA, 21 nt, Mycobacterium tuberculosis H37Rv
cuuucauugacacugugcgcc

SEQ ID NO: 1317244 - RNA, 13 nt, Mycobacterium tuberculosis H37Rv
cuuccauaacgac

SEQ ID NO: 1317245 - RNA, 20 nt, Mycobacterium tuberculosis H37Rv
cuucauucgugggaaccacc

SEQ ID NO: 1317246 - RNA, 23 nt, Mycobacterium tuberculosis H37Rv
cuuccgcgacgcucgcugcagca

SEQ ID NO: 1317247 - RNA, 23 nt, Mycobacterium tuberculosis H37Rv
cuuccgcgcgcagaugagcgcgg

SEQ ID NO: 1317248 - RNA, 14 nt, Mycobacterium tuberculosis H37Rv
cuuccgcagcgcca

SEQ ID NO: 1317249 - RNA, 23 nt, Mycobacterium tuberculosis H37Rv
cuucccagccgacgccuuccagc

SEQ ID NO: 1317250 - RNA, 13 nt, Mycobacterium tuberculosis H37Rv
cuuccaucgccac

SEQ ID NO: 1317251 - RNA, 20 nt, Mycobacterium tuberculosis H37Rv
cuucgaucaucgaccuggcc

SEQ ID NO: 1317252 - RNA, 16 nt, Mycobacterium tuberculosis H37Rv
cuucgcaagucaucca

SEQ ID NO: 1317253 - RNA, 23 nt, Mycobacterium tuberculosis H37Rv
cuuccggauucggacucgccgac

SEQ ID NO: 1317254 - RNA, 16 nt, Mycobacterium tuberculosis H37Rv
cuuccggauucggacu

SEQ ID NO: 1317255 - RNA, 17 nt, Mycobacterium tuberculosis H37Rv
cuuccucggccacccgc

SEQ ID NO: 1317256 - RNA, 19 nt, Mycobacterium tuberculosis H37Rv
cuuccgggcagcugggcag

SEQ ID NO: 1317257 - RNA, 15 nt, Mycobacterium tuberculosis H37Rv
cuuccucggccaccc

SEQ ID NO: 1317258 - RNA, 20 nt, Mycobacterium tuberculosis H37Rv
cuucgccgcccgcagggccg

SEQ ID NO: 1317259 - RNA, 16 nt, Mycobacterium tuberculosis H37Rv
cuucgccggcgccagc

SEQ ID NO: 1317260 - RNA, 22 nt, Mycobacterium tuberculosis H37Rv
cuucgccggcgccagcagaucu

SEQ ID NO: 1317261 - RNA, 22 nt, Mycobacterium tuberculosis H37Rv
cuucgcgaagaacgacgccacc

SEQ ID NO: 1317262 - RNA, 19 nt, Mycobacterium tuberculosis H37Rv
cuucgcggauguccaggag

SEQ ID NO: 1317263 - RNA, 16 nt, Mycobacterium tuberculosis H37Rv
cuucgcgcgcugggcg

SEQ ID NO: 1317264 - RNA, 18 nt, Mycobacterium tuberculosis H37Rv
cuucgccaacugcggcag

SEQ ID NO: 1317265 - RNA, 19 nt, Mycobacterium tuberculosis H37Rv
cuucgccaacugcggcagg

SEQ ID NO: 1317266 - RNA, 22 nt, Mycobacterium tuberculosis H37Rv
cuucgcaguugagggugugagg

SEQ ID NO: 1317267 - RNA, 15 nt, Mycobacterium tuberculosis H37Rv
cuucgcccgggccgc

SEQ ID NO: 1317268 - RNA, 18 nt, Mycobacterium tuberculosis H37Rv
cuucgcccggcugcgccg

SEQ ID NO: 1317269 - RNA, 21 nt, Mycobacterium tuberculosis H37Rv
cuucgcccggcugcgccgggc

SEQ ID NO: 1317270 - RNA, 16 nt, Mycobacterium tuberculosis H37Rv
cuucgccgaagcgccg

SEQ ID NO: 1317271 - RNA, 22 nt, Mycobacterium tuberculosis H37Rv
cuucgccgaagcgccgcuuggc

SEQ ID NO: 1317272 - RNA, 15 nt, Mycobacterium tuberculosis H37Rv
cuucgccgcccgcag

SEQ ID NO: 1317273 - RNA, 17 nt, Mycobacterium tuberculosis H37Rv
cuucagcguccugguga

SEQ ID NO: 1317274 - RNA, 15 nt, Mycobacterium tuberculosis H37Rv
cuucaggccgcgcau

SEQ ID NO: 1317275 - RNA, 17 nt, Mycobacterium tuberculosis H37Rv
cuucaggcgccacugcu

SEQ ID NO: 1317276 - RNA, 15 nt, Mycobacterium tuberculosis H37Rv
cuucaggcgccacug

SEQ ID NO: 1317277 - RNA, 16 nt, Mycobacterium tuberculosis H37Rv
cuucaggcaccggaug

SEQ ID NO: 1317278 - RNA, 17 nt, Mycobacterium tuberculosis H37Rv
cuucaggcaucaccgga

SEQ ID NO: 1317279 - RNA, 15 nt, Mycobacterium tuberculosis H37Rv
cuucaguccggcccc

SEQ ID NO: 1317280 - RNA, 13 nt, Mycobacterium tuberculosis H37Rv
cuucaccacccug

SEQ ID NO: 1317281 - RNA, 12 nt, Mycobacterium tuberculosis H37Rv
cuuaucuccggc

SEQ ID NO: 1317282 - RNA, 20 nt, Mycobacterium tuberculosis H37Rv
cuucacgcuggccuccagcu

SEQ ID NO: 1317283 - RNA, 21 nt, Mycobacterium tuberculosis H37Rv
cuucacgcuggccuccagcuu

SEQ ID NO: 1317284 - RNA, 21 nt, Mycobacterium tuberculosis H37Rv
cuucacuaauaggcacuagac

SEQ ID NO: 1317285 - RNA, 21 nt, Mycobacterium tuberculosis H37Rv
cuucagcacgcgggagaucuc

SEQ ID NO: 1317286 - RNA, 14 nt, Mycobacterium tuberculosis H37Rv
cuucagcagcggcg

SEQ ID NO: 1317287 - RNA, 14 nt, Mycobacterium tuberculosis H37Rv
cuucagccagucca

SEQ ID NO: 1317288 - RNA, 19 nt, Mycobacterium tuberculosis H37Rv
cuucagccaguccagcgcg

SEQ ID NO: 1317289 - RNA, 13 nt, Mycobacterium tuberculosis H37Rv
cuguuguggugcg

SEQ ID NO: 1317290 - RNA, 20 nt, Mycobacterium tuberculosis H37Rv
cuguuggugccgccaccacc

SEQ ID NO: 1317291 - RNA, 21 nt, Mycobacterium tuberculosis H37Rv
cuguuggugccgccaccaccg

SEQ ID NO: 1317292 - RNA, 22 nt, Mycobacterium tuberculosis H37Rv
cuguuggcaugccgcccgcucc

SEQ ID NO: 1317293 - RNA, 13 nt, Mycobacterium tuberculosis H37Rv
cuguuggccacca

SEQ ID NO: 1317294 - RNA, 15 nt, Mycobacterium tuberculosis H37Rv
cuguugcguagcgcg

SEQ ID NO: 1317295 - RNA, 18 nt, Mycobacterium tuberculosis H37Rv
cuguugcaucgccgcgau

SEQ ID NO: 1317296 - RNA, 21 nt, Mycobacterium tuberculosis H37Rv
cugucgugauacagcucggug

SEQ ID NO: 1317297 - RNA, 21 nt, Mycobacterium tuberculosis H37Rv
cugucgugccucucgggggcc

SEQ ID NO: 1317298 - RNA, 14 nt, Mycobacterium tuberculosis H37Rv
cugucguuugacga

SEQ ID NO: 1317299 - RNA, 20 nt, Mycobacterium tuberculosis H37Rv
cugucuggucggcuacggcc

SEQ ID NO: 1317300 - RNA, 17 nt, Mycobacterium tuberculosis H37Rv
cuguugacuaccaccgc

SEQ ID NO: 1317301 - RNA, 20 nt, Mycobacterium tuberculosis H37Rv
cuguugaagccgcccgaguu

SEQ ID NO: 1317302 - RNA, 20 nt, Mycobacterium tuberculosis H37Rv
cuguugaagaagcccgaaga

SEQ ID NO: 1317303 - RNA, 15 nt, Mycobacterium tuberculosis H37Rv
cuguugaacggccgc

SEQ ID NO: 1317304 - RNA, 19 nt, Mycobacterium tuberculosis H37Rv
cuguucugcuggcuguggc

SEQ ID NO: 1317305 - RNA, 20 nt, Mycobacterium tuberculosis H37Rv
cuguucucgccgaagcccgg

SEQ ID NO: 1317306 - RNA, 14 nt, Mycobacterium tuberculosis H37Rv
cuguuucugagcgc

SEQ ID NO: 1317307 - RNA, 18 nt, Mycobacterium tuberculosis H37Rv
cuuauccggccagugaca

SEQ ID NO: 1317308 - RNA, 19 nt, Mycobacterium tuberculosis H37Rv
cuggaaguacacggcggcc

SEQ ID NO: 1317309 - RNA, 20 nt, Mycobacterium tuberculosis H37Rv
cuggaaggcgggcaguugac

SEQ ID NO: 1317310 - RNA, 16 nt, Mycobacterium tuberculosis H37Rv
cuggaaagggccgccg

SEQ ID NO: 1317311 - RNA, 17 nt, Mycobacterium tuberculosis H37Rv
cuggaaagggccgccgc

SEQ ID NO: 1317312 - RNA, 13 nt, Mycobacterium tuberculosis H37Rv
cuggaaagcagca

SEQ ID NO: 1317313 - RNA, 16 nt, Mycobacterium tuberculosis H37Rv
cuggaacggcagcacg

SEQ ID NO: 1317314 - RNA, 23 nt, Mycobacterium tuberculosis H37Rv
cuggacaacggcggucugguugu

SEQ ID NO: 1317315 - RNA, 11 nt, Mycobacterium tuberculosis H37Rv
cuggaccuccg

SEQ ID NO: 1317316 - RNA, 22 nt, Mycobacterium tuberculosis H37Rv
cuggacgccgccggagaucuug

SEQ ID NO: 1317317 - RNA, 15 nt, Mycobacterium tuberculosis H37Rv
cuggacggcgggccg

SEQ ID NO: 1317318 - RNA, 14 nt, Mycobacterium tuberculosis H37Rv
cuggacgucggcga

SEQ ID NO: 1317319 - RNA, 21 nt, Mycobacterium tuberculosis H37Rv
cuggacgggguacugcggcuc

SEQ ID NO: 1317320 - RNA, 13 nt, Mycobacterium tuberculosis H37Rv
cugcuugccaccg

SEQ ID NO: 1317321 - RNA, 19 nt, Mycobacterium tuberculosis H37Rv
cugcuugacuccgcgcgcu

SEQ ID NO: 1317322 - RNA, 21 nt, Mycobacterium tuberculosis H37Rv
cugcuugagcucgcugaucag

SEQ ID NO: 1317323 - RNA, 23 nt, Mycobacterium tuberculosis H37Rv
cugcuugaugguguccucgucga

SEQ ID NO: 1317324 - RNA, 20 nt, Mycobacterium tuberculosis H37Rv
cugcuuugccuuagcccggc

SEQ ID NO: 1317325 - RNA, 14 nt, Mycobacterium tuberculosis H37Rv
cuggaaaacccagg

SEQ ID NO: 1317326 - RNA, 17 nt, Mycobacterium tuberculosis H37Rv
cugcucagcgcggcccc

SEQ ID NO: 1317327 - RNA, 14 nt, Mycobacterium tuberculosis H37Rv
cugcucacgcgggu

SEQ ID NO: 1317328 - RNA, 20 nt, Mycobacterium tuberculosis H37Rv
cugcuauugguugaggaggu

SEQ ID NO: 1317329 - RNA, 23 nt, Mycobacterium tuberculosis H37Rv
cugcuagcagcagcccgacagug

SEQ ID NO: 1317330 - RNA, 21 nt, Mycobacterium tuberculosis H37Rv
cugcuagcuuggcggccagcg

SEQ ID NO: 1317331 - RNA, 14 nt, Mycobacterium tuberculosis H37Rv
cugcuacucugcaa

SEQ ID NO: 1317332 - RNA, 19 nt, Mycobacterium tuberculosis H37Rv
cuggcgaucuggucggcgg

SEQ ID NO: 1317333 - RNA, 21 nt, Mycobacterium tuberculosis H37Rv
cuggcgauggccguccgaccg

SEQ ID NO: 1317334 - RNA, 19 nt, Mycobacterium tuberculosis H37Rv
cuggcgaucucuaccagcc

SEQ ID NO: 1317335 - RNA, 18 nt, Mycobacterium tuberculosis H37Rv
cuggcgagggcuaccggc

SEQ ID NO: 1317336 - RNA, 18 nt, Mycobacterium tuberculosis H37Rv
cuggccucggggaucgca

SEQ ID NO: 1317337 - RNA, 12 nt, Mycobacterium tuberculosis H37Rv
cuggccuccagc

SEQ ID NO: 1317338 - RNA, 15 nt, Mycobacterium tuberculosis H37Rv
cuggccuccagcuug

SEQ ID NO: 1317339 - RNA, 16 nt, Mycobacterium tuberculosis H37Rv
cuggccguuucggcgc

SEQ ID NO: 1317340 - RNA, 15 nt, Mycobacterium tuberculosis H37Rv
cuggcccugcuccuc

SEQ ID NO: 1317341 - RNA, 16 nt, Mycobacterium tuberculosis H37Rv
cuggccgucgcuggug

SEQ ID NO: 1317342 - RNA, 21 nt, Mycobacterium tuberculosis H37Rv
cuggccccgguggugcugccg

SEQ ID NO: 1317343 - RNA, 23 nt, Mycobacterium tuberculosis H37Rv
cuggcccgcgacaucgggaaugu

SEQ ID NO: 1317344 - RNA, 20 nt, Mycobacterium tuberculosis H37Rv
cuggcccggcuacgacggcg

SEQ ID NO: 1317345 - RNA, 15 nt, Mycobacterium tuberculosis H37Rv
cuggcccgucggcgu

SEQ ID NO: 1317346 - RNA, 18 nt, Mycobacterium tuberculosis H37Rv
cuggcggauggccgccuu

SEQ ID NO: 1317347 - RNA, 11 nt, Mycobacterium tuberculosis H37Rv
cuggcggaugg

SEQ ID NO: 1317348 - RNA, 14 nt, Mycobacterium tuberculosis H37Rv
cuggcggcgccgca

SEQ ID NO: 1317349 - RNA, 15 nt, Mycobacterium tuberculosis H37Rv
cuggcggcgccgcag

SEQ ID NO: 1317350 - RNA, 19 nt, Mycobacterium tuberculosis H37Rv
cuggcgcuuugggcugccg

SEQ ID NO: 1317351 - RNA, 20 nt, Mycobacterium tuberculosis H37Rv
cuggcgcuuugggcugccgu

SEQ ID NO: 1317352 - RNA, 20 nt, Mycobacterium tuberculosis H37Rv
cuggcgcucauaggccggcg

SEQ ID NO: 1317353 - RNA, 19 nt, Mycobacterium tuberculosis H37Rv
cuggcgcugcuggcagacc

SEQ ID NO: 1317354 - RNA, 16 nt, Mycobacterium tuberculosis H37Rv
cuggcaggccagcaug

SEQ ID NO: 1317355 - RNA, 19 nt, Mycobacterium tuberculosis H37Rv
cuggcaggcuuagcuuccg

SEQ ID NO: 1317356 - RNA, 22 nt, Mycobacterium tuberculosis H37Rv
cuggcagugugggggucagggg

SEQ ID NO: 1317357 - RNA, 13 nt, Mycobacterium tuberculosis H37Rv
cuggcauaucccu

SEQ ID NO: 1317358 - RNA, 19 nt, Mycobacterium tuberculosis H37Rv
cuggcccaucuugaccaau

SEQ ID NO: 1317359 - RNA, 21 nt, Mycobacterium tuberculosis H37Rv
cuggccacgauccgcgguagc

SEQ ID NO: 1317360 - RNA, 17 nt, Mycobacterium tuberculosis H37Rv
cuggccccgccagcggc

SEQ ID NO: 1317361 - RNA, 20 nt, Mycobacterium tuberculosis H37Rv
cuggcccccgguaccgcccg

SEQ ID NO: 1317362 - RNA, 24 nt, Mycobacterium tuberculosis H37Rv
cuggccccgccagcggcagcggcg

SEQ ID NO: 1317363 - RNA, 15 nt, Mycobacterium tuberculosis H37Rv
cuggccccgguggug

SEQ ID NO: 1317364 - RNA, 17 nt, Mycobacterium tuberculosis H37Rv
cuggagcuguggcgggc

SEQ ID NO: 1317365 - RNA, 23 nt, Mycobacterium tuberculosis H37Rv
cuggaggggcaacaggggaaaac

SEQ ID NO: 1317366 - RNA, 22 nt, Mycobacterium tuberculosis H37Rv
cuggaggugaacucguucagcg

SEQ ID NO: 1317367 - RNA, 17 nt, Mycobacterium tuberculosis H37Rv
cuggagguguuugacgc

SEQ ID NO: 1317368 - RNA, 19 nt, Mycobacterium tuberculosis H37Rv
cuggagguguuugacgcgc

SEQ ID NO: 1317369 - RNA, 16 nt, Mycobacterium tuberculosis H37Rv
cuggagugaggcugug

SEQ ID NO: 1317370 - RNA, 13 nt, Mycobacterium tuberculosis H37Rv
cuggauacccagc

SEQ ID NO: 1317371 - RNA, 18 nt, Mycobacterium tuberculosis H37Rv
cuggcaccucccgggcga

SEQ ID NO: 1317372 - RNA, 22 nt, Mycobacterium tuberculosis H37Rv
cuggcacccggggugcccggcc

SEQ ID NO: 1317373 - RNA, 14 nt, Mycobacterium tuberculosis H37Rv
cuggcaggccggcg

SEQ ID NO: 1317374 - RNA, 19 nt, Mycobacterium tuberculosis H37Rv
cuggcaggccgggcaccaa

SEQ ID NO: 1317375 - RNA, 17 nt, Mycobacterium tuberculosis H37Rv
cuggcacacuccugcac

SEQ ID NO: 1317376 - RNA, 13 nt, Mycobacterium tuberculosis H37Rv
cugguccagcacc

SEQ ID NO: 1317377 - RNA, 14 nt, Mycobacterium tuberculosis H37Rv
cugguccagcaccg

SEQ ID NO: 1317378 - RNA, 19 nt, Mycobacterium tuberculosis H37Rv
cugguccaggcccuggcca

SEQ ID NO: 1317379 - RNA, 15 nt, Mycobacterium tuberculosis H37Rv
cuggucaagacccgc

SEQ ID NO: 1317380 - RNA, 17 nt, Mycobacterium tuberculosis H37Rv
cuggucaccagccaccg

SEQ ID NO: 1317381 - RNA, 14 nt, Mycobacterium tuberculosis H37Rv
cuggucacugcccu

SEQ ID NO: 1317382 - RNA, 17 nt, Mycobacterium tuberculosis H37Rv
cuggucagccgcggcgg

SEQ ID NO: 1317383 - RNA, 12 nt, Mycobacterium tuberculosis H37Rv
cugguagucgcc

SEQ ID NO: 1317384 - RNA, 14 nt, Mycobacterium tuberculosis H37Rv
cugguaggucaccg

SEQ ID NO: 1317385 - RNA, 19 nt, Mycobacterium tuberculosis H37Rv
cuggugaucagcucaguga

SEQ ID NO: 1317386 - RNA, 21 nt, Mycobacterium tuberculosis H37Rv
cuggugcccgacccgccgaug

SEQ ID NO: 1317387 - RNA, 23 nt, Mycobacterium tuberculosis H37Rv
cuggugcccgacccgccgaugau

SEQ ID NO: 1317388 - RNA, 22 nt, Mycobacterium tuberculosis H37Rv
cuggucgauggcguacagcacc

SEQ ID NO: 1317389 - RNA, 15 nt, Mycobacterium tuberculosis H37Rv
cuggucgcugcugcg

SEQ ID NO: 1317390 - RNA, 14 nt, Mycobacterium tuberculosis H37Rv
cuggucggccaggu

SEQ ID NO: 1317391 - RNA, 14 nt, Mycobacterium tuberculosis H37Rv
cuggucgugggcca

SEQ ID NO: 1317392 - RNA, 17 nt, Mycobacterium tuberculosis H37Rv
cugggcuggcugaccga

SEQ ID NO: 1317393 - RNA, 15 nt, Mycobacterium tuberculosis H37Rv
cugggcgagacggcg

SEQ ID NO: 1317394 - RNA, 14 nt, Mycobacterium tuberculosis H37Rv
cugggccugcggca

SEQ ID NO: 1317395 - RNA, 22 nt, Mycobacterium tuberculosis H37Rv
cuggcggguuggucccgaugac

SEQ ID NO: 1317396 - RNA, 20 nt, Mycobacterium tuberculosis H37Rv
cuggcguagugcucgccggc

SEQ ID NO: 1317397 - RNA, 18 nt, Mycobacterium tuberculosis H37Rv
cuggguggccaaccaacc

SEQ ID NO: 1317398 - RNA, 15 nt, Mycobacterium tuberculosis H37Rv
cugggugccgcagcu

SEQ ID NO: 1317399 - RNA, 23 nt, Mycobacterium tuberculosis H37Rv
cugggugagcaccugggcgcgcu

SEQ ID NO: 1317400 - RNA, 15 nt, Mycobacterium tuberculosis H37Rv
cugggugcgcgaagg

SEQ ID NO: 1317401 - RNA, 17 nt, Mycobacterium tuberculosis H37Rv
cugggugcgcggccgcc

SEQ ID NO: 1317402 - RNA, 20 nt, Mycobacterium tuberculosis H37Rv
cugguaccccagcacaaggc

SEQ ID NO: 1317403 - RNA, 19 nt, Mycobacterium tuberculosis H37Rv
cuggggcggauaugaugau

SEQ ID NO: 1317404 - RNA, 16 nt, Mycobacterium tuberculosis H37Rv
cuggguccacgcgcuc

SEQ ID NO: 1317405 - RNA, 24 nt, Mycobacterium tuberculosis H37Rv
cuggguccacgcgcucggugccgc

SEQ ID NO: 1317406 - RNA, 17 nt, Mycobacterium tuberculosis H37Rv
cuggggcagccgggcgu

SEQ ID NO: 1317407 - RNA, 21 nt, Mycobacterium tuberculosis H37Rv
cuggggaugcgauggcccggg

SEQ ID NO: 1317408 - RNA, 16 nt, Mycobacterium tuberculosis H37Rv
cuggggcccggccgcc

SEQ ID NO: 1317409 - RNA, 15 nt, Mycobacterium tuberculosis H37Rv
cugggcuuucagcac

SEQ ID NO: 1317410 - RNA, 15 nt, Mycobacterium tuberculosis H37Rv
cuggggaggccaacc

SEQ ID NO: 1317411 - RNA, 18 nt, Mycobacterium tuberculosis H37Rv
cuguaguucgaugacuga

SEQ ID NO: 1317412 - RNA, 19 nt, Mycobacterium tuberculosis H37Rv
cuguagucccucaucaccu

SEQ ID NO: 1317413 - RNA, 14 nt, Mycobacterium tuberculosis H37Rv
cuguaccgggcgac

SEQ ID NO: 1317414 - RNA, 18 nt, Mycobacterium tuberculosis H37Rv
cuguacaccgacacgccg

SEQ ID NO: 1317415 - RNA, 17 nt, Mycobacterium tuberculosis H37Rv
cuggugcgccacgccac

SEQ ID NO: 1317416 - RNA, 21 nt, Mycobacterium tuberculosis H37Rv
cuguaaaaaugcuucgccaac

SEQ ID NO: 1317417 - RNA, 20 nt, Mycobacterium tuberculosis H37Rv
cugucccugcaguccacuga

SEQ ID NO: 1317418 - RNA, 17 nt, Mycobacterium tuberculosis H37Rv
cugucccagcccggccc

SEQ ID NO: 1317419 - RNA, 23 nt, Mycobacterium tuberculosis H37Rv
cugucgcccucgaucgccacgac

SEQ ID NO: 1317420 - RNA, 20 nt, Mycobacterium tuberculosis H37Rv
cugucgccagggagcgcagc

SEQ ID NO: 1317421 - RNA, 21 nt, Mycobacterium tuberculosis H37Rv
cugucgccagggagcgcagcg

SEQ ID NO: 1317422 - RNA, 22 nt, Mycobacterium tuberculosis H37Rv
cugucgcgccgguggucagguu

SEQ ID NO: 1317423 - RNA, 18 nt, Mycobacterium tuberculosis H37Rv
cugucggcuuccuccucg

SEQ ID NO: 1317424 - RNA, 14 nt, Mycobacterium tuberculosis H37Rv
cugucguaccgcuc

SEQ ID NO: 1317425 - RNA, 23 nt, Mycobacterium tuberculosis H37Rv
cugccgacaguuuaccgugccgc

SEQ ID NO: 1317426 - RNA, 17 nt, Mycobacterium tuberculosis H37Rv
cugccgaccagcgcgcu

SEQ ID NO: 1317427 - RNA, 17 nt, Mycobacterium tuberculosis H37Rv
cugccgaagcggccacc

SEQ ID NO: 1317428 - RNA, 21 nt, Mycobacterium tuberculosis H37Rv
cugccgaaguugaagaagcca

SEQ ID NO: 1317429 - RNA, 17 nt, Mycobacterium tuberculosis H37Rv
cugcccgggcugccgcc

SEQ ID NO: 1317430 - RNA, 12 nt, Mycobacterium tuberculosis H37Rv
cugccgcugguc

SEQ ID NO: 1317431 - RNA, 20 nt, Mycobacterium tuberculosis H37Rv
cugccggaccaccgggccga

SEQ ID NO: 1317432 - RNA, 18 nt, Mycobacterium tuberculosis H37Rv
cugccggacuaccgccgg

SEQ ID NO: 1317433 - RNA, 23 nt, Mycobacterium tuberculosis H37Rv
cugccgcugccgaagcggccacc

SEQ ID NO: 1317434 - RNA, 20 nt, Mycobacterium tuberculosis H37Rv
cugccggccggcgggccugc

SEQ ID NO: 1317435 - RNA, 16 nt, Mycobacterium tuberculosis H37Rv
cugccggccggcgggc

SEQ ID NO: 1317436 - RNA, 15 nt, Mycobacterium tuberculosis H37Rv
cugccggccggcggg

SEQ ID NO: 1317437 - RNA, 18 nt, Mycobacterium tuberculosis H37Rv
cugccggccgcguaaacc

SEQ ID NO: 1317438 - RNA, 15 nt, Mycobacterium tuberculosis H37Rv
cugccggcacgcaug

SEQ ID NO: 1317439 - RNA, 19 nt, Mycobacterium tuberculosis H37Rv
cugccggcaacagcucgcc

SEQ ID NO: 1317440 - RNA, 21 nt, Mycobacterium tuberculosis H37Rv
cugccgguagcacagcagcaa

SEQ ID NO: 1317441 - RNA, 20 nt, Mycobacterium tuberculosis H37Rv
cugccggugugcggcguacu

SEQ ID NO: 1317442 - RNA, 19 nt, Mycobacterium tuberculosis H37Rv
cugccgggugggcaagcug

SEQ ID NO: 1317443 - RNA, 13 nt, Mycobacterium tuberculosis H37Rv
cugccgggcgcgc

SEQ ID NO: 1317444 - RNA, 16 nt, Mycobacterium tuberculosis H37Rv
cugccucaccgccgcu

SEQ ID NO: 1317445 - RNA, 16 nt, Mycobacterium tuberculosis H37Rv
cugcccaugcggcagg

SEQ ID NO: 1317446 - RNA, 15 nt, Mycobacterium tuberculosis H37Rv
cugcccagcaccacc

SEQ ID NO: 1317447 - RNA, 15 nt, Mycobacterium tuberculosis H37Rv
cugcccaguauaauu

SEQ ID NO: 1317448 - RNA, 18 nt, Mycobacterium tuberculosis H37Rv
cugcccaucacacccggu

SEQ ID NO: 1317449 - RNA, 20 nt, Mycobacterium tuberculosis H37Rv
cugcccaggcaaaccgauca

SEQ ID NO: 1317450 - RNA, 21 nt, Mycobacterium tuberculosis H37Rv
cugccacccagcacgcgcgcg

SEQ ID NO: 1317451 - RNA, 20 nt, Mycobacterium tuberculosis H37Rv
cugccaguucuuggcgaccu

SEQ ID NO: 1317452 - RNA, 22 nt, Mycobacterium tuberculosis H37Rv
cugccaguagucgccgggcggc

SEQ ID NO: 1317453 - RNA, 21 nt, Mycobacterium tuberculosis H37Rv
cugccaggcccgugccuggcc

SEQ ID NO: 1317454 - RNA, 15 nt, Mycobacterium tuberculosis H37Rv
cugccagugccgccc

SEQ ID NO: 1317455 - RNA, 21 nt, Mycobacterium tuberculosis H37Rv
cugcgcgcccaccgggcggcg

SEQ ID NO: 1317456 - RNA, 18 nt, Mycobacterium tuberculosis H37Rv
cugcgcgcguugcgguca

SEQ ID NO: 1317457 - RNA, 23 nt, Mycobacterium tuberculosis H37Rv
cugcgcgccguucacccuggugg

SEQ ID NO: 1317458 - RNA, 16 nt, Mycobacterium tuberculosis H37Rv
cugcgcgucgagcagc

SEQ ID NO: 1317459 - RNA, 22 nt, Mycobacterium tuberculosis H37Rv
cugcgcgggucguagaccuucu

SEQ ID NO: 1317460 - RNA, 15 nt, Mycobacterium tuberculosis H37Rv
cugcgcggcugccgu

SEQ ID NO: 1317461 - RNA, 16 nt, Mycobacterium tuberculosis H37Rv
cugcgccgccagcgcc

SEQ ID NO: 1317462 - RNA, 15 nt, Mycobacterium tuberculosis H37Rv
cugcgccgccacagc

SEQ ID NO: 1317463 - RNA, 19 nt, Mycobacterium tuberculosis H37Rv
cugcgccgccacagcaccc

SEQ ID NO: 1317464 - RNA, 20 nt, Mycobacterium tuberculosis H37Rv
cugcgccgaacgcuccaggc

SEQ ID NO: 1317465 - RNA, 22 nt, Mycobacterium tuberculosis H37Rv
cugcgccgauacccagcggguc

SEQ ID NO: 1317466 - RNA, 16 nt, Mycobacterium tuberculosis H37Rv
cugcgccgauacguga

SEQ ID NO: 1317467 - RNA, 16 nt, Mycobacterium tuberculosis H37Rv
cugcgcccggaccacu

SEQ ID NO: 1317468 - RNA, 19 nt, Mycobacterium tuberculosis H37Rv
cugcgccgaacaccacacc

SEQ ID NO: 1317469 - RNA, 18 nt, Mycobacterium tuberculosis H37Rv
cugcgccgaacgcuccag

SEQ ID NO: 1317470 - RNA, 18 nt, Mycobacterium tuberculosis H37Rv
cugcgcccguccgcgcgc

SEQ ID NO: 1317471 - RNA, 19 nt, Mycobacterium tuberculosis H37Rv
cugcgcccguccgcgcgcc

SEQ ID NO: 1317472 - RNA, 18 nt, Mycobacterium tuberculosis H37Rv
cugcgcgacgacauuggu

SEQ ID NO: 1317473 - RNA, 16 nt, Mycobacterium tuberculosis H37Rv
cugcgcgaaggggacg

SEQ ID NO: 1317474 - RNA, 18 nt, Mycobacterium tuberculosis H37Rv
cugcgcgauccgcgcgca

SEQ ID NO: 1317475 - RNA, 16 nt, Mycobacterium tuberculosis H37Rv
cugcgcgaagccacca

SEQ ID NO: 1317476 - RNA, 18 nt, Mycobacterium tuberculosis H37Rv
cugcgccuuggucgccgg

SEQ ID NO: 1317477 - RNA, 18 nt, Mycobacterium tuberculosis H37Rv
cugccuggccgggaccgc

SEQ ID NO: 1317478 - RNA, 21 nt, Mycobacterium tuberculosis H37Rv
cugccuggccgggaccgcccc

SEQ ID NO: 1317479 - RNA, 22 nt, Mycobacterium tuberculosis H37Rv
cugccucgccugcacgcccggc

SEQ ID NO: 1317480 - RNA, 22 nt, Mycobacterium tuberculosis H37Rv
cugccucggcgagccgcucgcu

SEQ ID NO: 1317481 - RNA, 15 nt, Mycobacterium tuberculosis H37Rv
cugcgcccauagcug

SEQ ID NO: 1317482 - RNA, 14 nt, Mycobacterium tuberculosis H37Rv
cugcgcccauagcu

SEQ ID NO: 1317483 - RNA, 19 nt, Mycobacterium tuberculosis H37Rv
cugcgcaucgguccaaagc

SEQ ID NO: 1317484 - RNA, 20 nt, Mycobacterium tuberculosis H37Rv
cugcgcaucgguccaaagca

SEQ ID NO: 1317485 - RNA, 15 nt, Mycobacterium tuberculosis H37Rv
cugcgcaucggucca

SEQ ID NO: 1317486 - RNA, 13 nt, Mycobacterium tuberculosis H37Rv
cugcgcaucacca

SEQ ID NO: 1317487 - RNA, 23 nt, Mycobacterium tuberculosis H37Rv
cugcgcagugaauugcccaagcg

SEQ ID NO: 1317488 - RNA, 13 nt, Mycobacterium tuberculosis H37Rv
cugcggugcgggc

SEQ ID NO: 1317489 - RNA, 15 nt, Mycobacterium tuberculosis H37Rv
cugcggucgcggagc

SEQ ID NO: 1317490 - RNA, 23 nt, Mycobacterium tuberculosis H37Rv
cugcggguucacuuccgggcagc

SEQ ID NO: 1317491 - RNA, 19 nt, Mycobacterium tuberculosis H37Rv
cugcgggugauugagcuca

SEQ ID NO: 1317492 - RNA, 18 nt, Mycobacterium tuberculosis H37Rv
cugcgguacugagccgcg

SEQ ID NO: 1317493 - RNA, 20 nt, Mycobacterium tuberculosis H37Rv
cugcggggguacgucaccgg

SEQ ID NO: 1317494 - RNA, 21 nt, Mycobacterium tuberculosis H37Rv
cugcggguagauguucacgcc

SEQ ID NO: 1317495 - RNA, 12 nt, Mycobacterium tuberculosis H37Rv
cugcgggccggc

SEQ ID NO: 1317496 - RNA, 15 nt, Mycobacterium tuberculosis H37Rv
cugcggaggcgggug

SEQ ID NO: 1317497 - RNA, 13 nt, Mycobacterium tuberculosis H37Rv
cugcggaggcggg

SEQ ID NO: 1317498 - RNA, 14 nt, Mycobacterium tuberculosis H37Rv
cugcggaagccacc

SEQ ID NO: 1317499 - RNA, 20 nt, Mycobacterium tuberculosis H37Rv
cugcggauacagccgccgcc

SEQ ID NO: 1317500 - RNA, 19 nt, Mycobacterium tuberculosis H37Rv
cugcggauacuguucugcu

SEQ ID NO: 1317501 - RNA, 12 nt, Mycobacterium tuberculosis H37Rv
cugcggcuuuca

SEQ ID NO: 1317502 - RNA, 17 nt, Mycobacterium tuberculosis H37Rv
cugcgcuuugcacagcg

SEQ ID NO: 1317503 - RNA, 14 nt, Mycobacterium tuberculosis H37Rv
cugcguugggaucc

SEQ ID NO: 1317504 - RNA, 13 nt, Mycobacterium tuberculosis H37Rv
cugcgugggccug

SEQ ID NO: 1317505 - RNA, 17 nt, Mycobacterium tuberculosis H37Rv
cugcguggcgggcugca

SEQ ID NO: 1317506 - RNA, 19 nt, Mycobacterium tuberculosis H37Rv
cugauaaagcccggcggca

SEQ ID NO: 1317507 - RNA, 19 nt, Mycobacterium tuberculosis H37Rv
cugauagacccuggggucc

SEQ ID NO: 1317508 - RNA, 22 nt, Mycobacterium tuberculosis H37Rv
cugaucaagugccagcguggug

SEQ ID NO: 1317509 - RNA, 17 nt, Mycobacterium tuberculosis H37Rv
cugaucccggccaggcc

SEQ ID NO: 1317510 - RNA, 18 nt, Mycobacterium tuberculosis H37Rv
cugaucccggccaggccg

SEQ ID NO: 1317511 - RNA, 16 nt, Mycobacterium tuberculosis H37Rv
cugaucccggccaggc

SEQ ID NO: 1317512 - RNA, 22 nt, Mycobacterium tuberculosis H37Rv
cugauccgccugccgacggcau

SEQ ID NO: 1317513 - RNA, 20 nt, Mycobacterium tuberculosis H37Rv
cugaucgaccgccuccucga

SEQ ID NO: 1317514 - RNA, 22 nt, Mycobacterium tuberculosis H37Rv
cugagguaggacucacgcagcg

SEQ ID NO: 1317515 - RNA, 23 nt, Mycobacterium tuberculosis H37Rv
cugaguccccaggugggcagcag

SEQ ID NO: 1317516 - RNA, 22 nt, Mycobacterium tuberculosis H37Rv
cugaguccccaggugggcagca

SEQ ID NO: 1317517 - RNA, 18 nt, Mycobacterium tuberculosis H37Rv
cugaguccccaggugggc

SEQ ID NO: 1317518 - RNA, 18 nt, Mycobacterium tuberculosis H37Rv
cugagucugauggccucg

SEQ ID NO: 1317519 - RNA, 12 nt, Mycobacterium tuberculosis H37Rv
cugaggcaccuc

SEQ ID NO: 1317520 - RNA, 11 nt, Mycobacterium tuberculosis H37Rv
cugagcuucca

SEQ ID NO: 1317521 - RNA, 22 nt, Mycobacterium tuberculosis H37Rv
cugagcugcucgccggccaacu

SEQ ID NO: 1317522 - RNA, 18 nt, Mycobacterium tuberculosis H37Rv
cugagcugcucgccggcc

SEQ ID NO: 1317523 - RNA, 15 nt, Mycobacterium tuberculosis H37Rv
cugaucuaccagugg

SEQ ID NO: 1317524 - RNA, 15 nt, Mycobacterium tuberculosis H37Rv
cugaucggcgcggcc

SEQ ID NO: 1317525 - RNA, 15 nt, Mycobacterium tuberculosis H37Rv
cugaucggcuucuuc

SEQ ID NO: 1317526 - RNA, 19 nt, Mycobacterium tuberculosis H37Rv
cugaucuugccgccgcgcc

SEQ ID NO: 1317527 - RNA, 21 nt, Mycobacterium tuberculosis H37Rv
cugaucugagaccucagccgg

SEQ ID NO: 1317528 - RNA, 18 nt, Mycobacterium tuberculosis H37Rv
cugcaagaaccacugcau

SEQ ID NO: 1317529 - RNA, 21 nt, Mycobacterium tuberculosis H37Rv
cugcaaggaauuccggcugcu

SEQ ID NO: 1317530 - RNA, 22 nt, Mycobacterium tuberculosis H37Rv
cugcaaggaauuccggcugcuu

SEQ ID NO: 1317531 - RNA, 20 nt, Mycobacterium tuberculosis H37Rv
cugcaagcuaagcgccugau

SEQ ID NO: 1317532 - RNA, 21 nt, Mycobacterium tuberculosis H37Rv
cugauuucuuuaaaccccugg

SEQ ID NO: 1317533 - RNA, 21 nt, Mycobacterium tuberculosis H37Rv
cugcagguuaggguccagguc

SEQ ID NO: 1317534 - RNA, 16 nt, Mycobacterium tuberculosis H37Rv
cugcagguccagggug

SEQ ID NO: 1317535 - RNA, 21 nt, Mycobacterium tuberculosis H37Rv
cugcaguguuuuugcagacuc

SEQ ID NO: 1317536 - RNA, 13 nt, Mycobacterium tuberculosis H37Rv
cugcagugaucgu

SEQ ID NO: 1317537 - RNA, 23 nt, Mycobacterium tuberculosis H37Rv
cugcagucuuucccggggcuggg

SEQ ID NO: 1317538 - RNA, 18 nt, Mycobacterium tuberculosis H37Rv
cugcagauaggacccagc

SEQ ID NO: 1317539 - RNA, 21 nt, Mycobacterium tuberculosis H37Rv
cugcaggcugucgagucgguc

SEQ ID NO: 1317540 - RNA, 18 nt, Mycobacterium tuberculosis H37Rv
cugcaggcggccuugccg

SEQ ID NO: 1317541 - RNA, 11 nt, Mycobacterium tuberculosis H37Rv
cugcaggcugu

SEQ ID NO: 1317542 - RNA, 15 nt, Mycobacterium tuberculosis H37Rv
cugcacggccaugau

SEQ ID NO: 1317543 - RNA, 19 nt, Mycobacterium tuberculosis H37Rv
cugcacggugcccagggcg

SEQ ID NO: 1317544 - RNA, 20 nt, Mycobacterium tuberculosis H37Rv
cugcacguacucggccagcu

SEQ ID NO: 1317545 - RNA, 23 nt, Mycobacterium tuberculosis H37Rv
cugcacuugaaauugagccggcc

SEQ ID NO: 1317546 - RNA, 15 nt, Mycobacterium tuberculosis H37Rv
cugcagaaaggccaa

SEQ ID NO: 1317547 - RNA, 19 nt, Mycobacterium tuberculosis H37Rv
cugcagaaaggccaacugg

SEQ ID NO: 1317548 - RNA, 15 nt, Mycobacterium tuberculosis H37Rv
cuccaugcccuguuc

SEQ ID NO: 1317549 - RNA, 14 nt, Mycobacterium tuberculosis H37Rv
cuccaugaagggcc

SEQ ID NO: 1317550 - RNA, 20 nt, Mycobacterium tuberculosis H37Rv
cuccaugacaaaccugcaug

SEQ ID NO: 1317551 - RNA, 23 nt, Mycobacterium tuberculosis H37Rv
cuccaucgcgacaucgguggcgg

SEQ ID NO: 1317552 - RNA, 22 nt, Mycobacterium tuberculosis H37Rv
cuccaggucgcauucugcugcc

SEQ ID NO: 1317553 - RNA, 22 nt, Mycobacterium tuberculosis H37Rv
cuccagguccacauccagggug

SEQ ID NO: 1317554 - RNA, 22 nt, Mycobacterium tuberculosis H37Rv
cuccaggcugaaaccuugcggc

SEQ ID NO: 1317555 - RNA, 12 nt, Mycobacterium tuberculosis H37Rv
cuccagggcccu

SEQ ID NO: 1317556 - RNA, 15 nt, Mycobacterium tuberculosis H37Rv
cuccagggcccugcu

SEQ ID NO: 1317557 - RNA, 20 nt, Mycobacterium tuberculosis H37Rv
cuccaguccuaucagugagc

SEQ ID NO: 1317558 - RNA, 15 nt, Mycobacterium tuberculosis H37Rv
cuccaguagccggug

SEQ ID NO: 1317559 - RNA, 21 nt, Mycobacterium tuberculosis H37Rv
cuccaguagccggugccggcg

SEQ ID NO: 1317560 - RNA, 14 nt, Mycobacterium tuberculosis H37Rv
cuccaguggcgcca

SEQ ID NO: 1317561 - RNA, 20 nt, Mycobacterium tuberculosis H37Rv
cuccaguggcgccagggccu

SEQ ID NO: 1317562 - RNA, 19 nt, Mycobacterium tuberculosis H37Rv
cuccagcgcgcgccgcagc

SEQ ID NO: 1317563 - RNA, 17 nt, Mycobacterium tuberculosis H37Rv
cuccagcgcaccgguga

SEQ ID NO: 1317564 - RNA, 23 nt, Mycobacterium tuberculosis H37Rv
cuccaccuucugguccagcaccg

SEQ ID NO: 1317565 - RNA, 20 nt, Mycobacterium tuberculosis H37Rv
cuccacgaucggcccagccc

SEQ ID NO: 1317566 - RNA, 15 nt, Mycobacterium tuberculosis H37Rv
cuccacugaccaggu

SEQ ID NO: 1317567 - RNA, 17 nt, Mycobacterium tuberculosis H37Rv
cuccacuuggggcgcca

SEQ ID NO: 1317568 - RNA, 13 nt, Mycobacterium tuberculosis H37Rv
cuccaccgggccc

SEQ ID NO: 1317569 - RNA, 15 nt, Mycobacterium tuberculosis H37Rv
cuccaccgggcccgc

SEQ ID NO: 1317570 - RNA, 23 nt, Mycobacterium tuberculosis H37Rv
cuccaccgggcccgccguccccg

SEQ ID NO: 1317571 - RNA, 17 nt, Mycobacterium tuberculosis H37Rv
cuccagagacagcgcca

SEQ ID NO: 1317572 - RNA, 18 nt, Mycobacterium tuberculosis H37Rv
cuccagcaaggccagcac

SEQ ID NO: 1317573 - RNA, 16 nt, Mycobacterium tuberculosis H37Rv
cuccagcaaggccagc

SEQ ID NO: 1317574 - RNA, 17 nt, Mycobacterium tuberculosis H37Rv
cuccagauacaggaaca

SEQ ID NO: 1317575 - RNA, 17 nt, Mycobacterium tuberculosis H37Rv
cuccagauaccaccgcc

SEQ ID NO: 1317576 - RNA, 16 nt, Mycobacterium tuberculosis H37Rv
cuccagauccacgccg

SEQ ID NO: 1317577 - RNA, 22 nt, Mycobacterium tuberculosis H37Rv
cuccagauccgggcaugcgccg

SEQ ID NO: 1317578 - RNA, 13 nt, Mycobacterium tuberculosis H37Rv
cuccagcagcccg

SEQ ID NO: 1317579 - RNA, 14 nt, Mycobacterium tuberculosis H37Rv
cuccagcagcgcca

SEQ ID NO: 1317580 - RNA, 15 nt, Mycobacterium tuberculosis H37Rv
cuccagcagcucgcc

SEQ ID NO: 1317581 - RNA, 20 nt, Mycobacterium tuberculosis H37Rv
cuccagcagcucgccggcac

SEQ ID NO: 1317582 - RNA, 21 nt, Mycobacterium tuberculosis H37Rv
cuccagcaggucgccugcccc

SEQ ID NO: 1317583 - RNA, 16 nt, Mycobacterium tuberculosis H37Rv
cuccgccaaggaggcc

SEQ ID NO: 1317584 - RNA, 16 nt, Mycobacterium tuberculosis H37Rv
cuccgccagcgccgcc

SEQ ID NO: 1317585 - RNA, 21 nt, Mycobacterium tuberculosis H37Rv
cuccgccgcgaucuccuuggc

SEQ ID NO: 1317586 - RNA, 17 nt, Mycobacterium tuberculosis H37Rv
cuccgccgaggaaacca

SEQ ID NO: 1317587 - RNA, 12 nt, Mycobacterium tuberculosis H37Rv
cuccgccggcac

SEQ ID NO: 1317588 - RNA, 20 nt, Mycobacterium tuberculosis H37Rv
cuccggcggcagcggcgccg

SEQ ID NO: 1317589 - RNA, 16 nt, Mycobacterium tuberculosis H37Rv
cuccggcgcaccuggg

SEQ ID NO: 1317590 - RNA, 21 nt, Mycobacterium tuberculosis H37Rv
cuccggcccugccgccggccc

SEQ ID NO: 1317591 - RNA, 12 nt, Mycobacterium tuberculosis H37Rv
cuccggccaggg

SEQ ID NO: 1317592 - RNA, 16 nt, Mycobacterium tuberculosis H37Rv
cuccggcccugccgcc

SEQ ID NO: 1317593 - RNA, 23 nt, Mycobacterium tuberculosis H37Rv
cuccggcgcuccacugaccaggu

SEQ ID NO: 1317594 - RNA, 14 nt, Mycobacterium tuberculosis H37Rv
cuccggcgccgccc

SEQ ID NO: 1317595 - RNA, 16 nt, Mycobacterium tuberculosis H37Rv
cuccggcgccgcccga

SEQ ID NO: 1317596 - RNA, 13 nt, Mycobacterium tuberculosis H37Rv
cuccggcgccacc

SEQ ID NO: 1317597 - RNA, 22 nt, Mycobacterium tuberculosis H37Rv
cuccggggugaacgcggacacc

SEQ ID NO: 1317598 - RNA, 23 nt, Mycobacterium tuberculosis H37Rv
cuccgguaucggcgaccagcugu

SEQ ID NO: 1317599 - RNA, 17 nt, Mycobacterium tuberculosis H37Rv
cuccggguggcggcggc

SEQ ID NO: 1317600 - RNA, 22 nt, Mycobacterium tuberculosis H37Rv
cuccggguggcggcggcggagc

SEQ ID NO: 1317601 - RNA, 22 nt, Mycobacterium tuberculosis H37Rv
cuccucgaaggcuucgcuggcu

SEQ ID NO: 1317602 - RNA, 13 nt, Mycobacterium tuberculosis H37Rv
cuccucgaauucg

SEQ ID NO: 1317603 - RNA, 21 nt, Mycobacterium tuberculosis H37Rv
cuccucgauagcggcgccuga

SEQ ID NO: 1317604 - RNA, 23 nt, Mycobacterium tuberculosis H37Rv
cuccucgaugaggcgcagcgcca

SEQ ID NO: 1317605 - RNA, 20 nt, Mycobacterium tuberculosis H37Rv
cuccucgaugcccuuggcga

SEQ ID NO: 1317606 - RNA, 18 nt, Mycobacterium tuberculosis H37Rv
cuccauugccggauuugu

SEQ ID NO: 1317607 - RNA, 22 nt, Mycobacterium tuberculosis H37Rv
cuccauggcauugcuccgguug

SEQ ID NO: 1317608 - RNA, 18 nt, Mycobacterium tuberculosis H37Rv
cuccauggccugauucca

SEQ ID NO: 1317609 - RNA, 22 nt, Mycobacterium tuberculosis H37Rv
cucccagggcucggcggcccgg

SEQ ID NO: 1317610 - RNA, 20 nt, Mycobacterium tuberculosis H37Rv
cucccagggcucggcggccc

SEQ ID NO: 1317611 - RNA, 11 nt, Mycobacterium tuberculosis H37Rv
cucccagccca

SEQ ID NO: 1317612 - RNA, 19 nt, Mycobacterium tuberculosis H37Rv
cucccacgcuucggccugu

SEQ ID NO: 1317613 - RNA, 22 nt, Mycobacterium tuberculosis H37Rv
cucccacgcuucggccugugcg

SEQ ID NO: 1317614 - RNA, 18 nt, Mycobacterium tuberculosis H37Rv
cucccagggcucggcggc

SEQ ID NO: 1317615 - RNA, 15 nt, Mycobacterium tuberculosis H37Rv
cucccuggggccguc

SEQ ID NO: 1317616 - RNA, 12 nt, Mycobacterium tuberculosis H37Rv
cucccugggcgu

SEQ ID NO: 1317617 - RNA, 22 nt, Mycobacterium tuberculosis H37Rv
cucccugcacccagccgugccc

SEQ ID NO: 1317618 - RNA, 17 nt, Mycobacterium tuberculosis H37Rv
cuccccgaucagcaccg

SEQ ID NO: 1317619 - RNA, 18 nt, Mycobacterium tuberculosis H37Rv
cucccccggcuccgcaac

SEQ ID NO: 1317620 - RNA, 12 nt, Mycobacterium tuberculosis H37Rv
cucccccacaca

SEQ ID NO: 1317621 - RNA, 14 nt, Mycobacterium tuberculosis H37Rv
cucccgaccgccga

SEQ ID NO: 1317622 - RNA, 15 nt, Mycobacterium tuberculosis H37Rv
cucccgagccacaaa

SEQ ID NO: 1317623 - RNA, 14 nt, Mycobacterium tuberculosis H37Rv
cucccgcgcgggcg

SEQ ID NO: 1317624 - RNA, 20 nt, Mycobacterium tuberculosis H37Rv
cucccgcgcuuggcuccaca

SEQ ID NO: 1317625 - RNA, 21 nt, Mycobacterium tuberculosis H37Rv
cucccgcggcgccacccgcgc

SEQ ID NO: 1317626 - RNA, 13 nt, Mycobacterium tuberculosis H37Rv
cucccgccggcag

SEQ ID NO: 1317627 - RNA, 18 nt, Mycobacterium tuberculosis H37Rv
cucccgccggcagcgucg

SEQ ID NO: 1317628 - RNA, 22 nt, Mycobacterium tuberculosis H37Rv
cucccgccggcagcgucggccg

SEQ ID NO: 1317629 - RNA, 18 nt, Mycobacterium tuberculosis H37Rv
cucggcccagcgcgccag

SEQ ID NO: 1317630 - RNA, 13 nt, Mycobacterium tuberculosis H37Rv
cucggccccgucc

SEQ ID NO: 1317631 - RNA, 18 nt, Mycobacterium tuberculosis H37Rv
cucggcccggcaggacuu

SEQ ID NO: 1317632 - RNA, 13 nt, Mycobacterium tuberculosis H37Rv
cucggccaggaug

SEQ ID NO: 1317633 - RNA, 20 nt, Mycobacterium tuberculosis H37Rv
cucggccagcgucagcuguu

SEQ ID NO: 1317634 - RNA, 15 nt, Mycobacterium tuberculosis H37Rv
cucggcgcagccggu

SEQ ID NO: 1317635 - RNA, 17 nt, Mycobacterium tuberculosis H37Rv
cucggcgcagccgguga

SEQ ID NO: 1317636 - RNA, 22 nt, Mycobacterium tuberculosis H37Rv
cucggcgcagcacauccugcag

SEQ ID NO: 1317637 - RNA, 18 nt, Mycobacterium tuberculosis H37Rv
cucggcgcccagcucguc

SEQ ID NO: 1317638 - RNA, 13 nt, Mycobacterium tuberculosis H37Rv
cucggccggcggc

SEQ ID NO: 1317639 - RNA, 14 nt, Mycobacterium tuberculosis H37Rv
cucggccggcggcg

SEQ ID NO: 1317640 - RNA, 14 nt, Mycobacterium tuberculosis H37Rv
cucggcgaugcuga

SEQ ID NO: 1317641 - RNA, 23 nt, Mycobacterium tuberculosis H37Rv
cucggcaaccaccucgugggcca

SEQ ID NO: 1317642 - RNA, 15 nt, Mycobacterium tuberculosis H37Rv
cucggccgcaccagc

SEQ ID NO: 1317643 - RNA, 16 nt, Mycobacterium tuberculosis H37Rv
cucggccgcaccagca

SEQ ID NO: 1317644 - RNA, 18 nt, Mycobacterium tuberculosis H37Rv
cucggccgaggaccagag

SEQ ID NO: 1317645 - RNA, 15 nt, Mycobacterium tuberculosis H37Rv
cucggccgccagccc

SEQ ID NO: 1317646 - RNA, 20 nt, Mycobacterium tuberculosis H37Rv
cucggccgccagccccaccc

SEQ ID NO: 1317647 - RNA, 17 nt, Mycobacterium tuberculosis H37Rv
cucggaucggcucgcca

SEQ ID NO: 1317648 - RNA, 16 nt, Mycobacterium tuberculosis H37Rv
cucggaucgccaggcc

SEQ ID NO: 1317649 - RNA, 15 nt, Mycobacterium tuberculosis H37Rv
cucggaguugagcug

SEQ ID NO: 1317650 - RNA, 18 nt, Mycobacterium tuberculosis H37Rv
cucggaccagacccacga

SEQ ID NO: 1317651 - RNA, 18 nt, Mycobacterium tuberculosis H37Rv
cucgcuucaggcaccgga

SEQ ID NO: 1317652 - RNA, 17 nt, Mycobacterium tuberculosis H37Rv
cucgcugggcucauggc

SEQ ID NO: 1317653 - RNA, 20 nt, Mycobacterium tuberculosis H37Rv
cucgcuguugaagccgcccg

SEQ ID NO: 1317654 - RNA, 15 nt, Mycobacterium tuberculosis H37Rv
cucggcggagaaaag

SEQ ID NO: 1317655 - RNA, 17 nt, Mycobacterium tuberculosis H37Rv
cucggcguacucgugca

SEQ ID NO: 1317656 - RNA, 20 nt, Mycobacterium tuberculosis H37Rv
cucggcguccgcccagcacc

SEQ ID NO: 1317657 - RNA, 17 nt, Mycobacterium tuberculosis H37Rv
cucggcgucgccgccau

SEQ ID NO: 1317658 - RNA, 21 nt, Mycobacterium tuberculosis H37Rv
cucggcgucgccgccauugcc

SEQ ID NO: 1317659 - RNA, 22 nt, Mycobacterium tuberculosis H37Rv
cucggcgucgugguggccacgg

SEQ ID NO: 1317660 - RNA, 16 nt, Mycobacterium tuberculosis H37Rv
cucggcgcgcucggcc

SEQ ID NO: 1317661 - RNA, 14 nt, Mycobacterium tuberculosis H37Rv
cucggcggaagacc

SEQ ID NO: 1317662 - RNA, 19 nt, Mycobacterium tuberculosis H37Rv
cucggcgcugcgcaccgcc

SEQ ID NO: 1317663 - RNA, 13 nt, Mycobacterium tuberculosis H37Rv
cucggcgccgccc

SEQ ID NO: 1317664 - RNA, 22 nt, Mycobacterium tuberculosis H37Rv
cucggcgccgucggagccggcc

SEQ ID NO: 1317665 - RNA, 14 nt, Mycobacterium tuberculosis H37Rv
cucggugacgauga

SEQ ID NO: 1317666 - RNA, 17 nt, Mycobacterium tuberculosis H37Rv
cucggugaacgccgccc

SEQ ID NO: 1317667 - RNA, 14 nt, Mycobacterium tuberculosis H37Rv
cucggucugcaugc

SEQ ID NO: 1317668 - RNA, 21 nt, Mycobacterium tuberculosis H37Rv
cucggugacaagcggcccgcu

SEQ ID NO: 1317669 - RNA, 20 nt, Mycobacterium tuberculosis H37Rv
cucggucccguugccgccca

SEQ ID NO: 1317670 - RNA, 13 nt, Mycobacterium tuberculosis H37Rv
cucggucccgccg

SEQ ID NO: 1317671 - RNA, 19 nt, Mycobacterium tuberculosis H37Rv
cucgggacucccgcgcggg

SEQ ID NO: 1317672 - RNA, 19 nt, Mycobacterium tuberculosis H37Rv
cucgggcagcgucacccug

SEQ ID NO: 1317673 - RNA, 23 nt, Mycobacterium tuberculosis H37Rv
cucggcugcucgacggcuccgau

SEQ ID NO: 1317674 - RNA, 19 nt, Mycobacterium tuberculosis H37Rv
cucggcuuggccggcggua

SEQ ID NO: 1317675 - RNA, 16 nt, Mycobacterium tuberculosis H37Rv
cucggucagccccaug

SEQ ID NO: 1317676 - RNA, 21 nt, Mycobacterium tuberculosis H37Rv
cucgguccaauuccagcucac

SEQ ID NO: 1317677 - RNA, 16 nt, Mycobacterium tuberculosis H37Rv
cucgggcaggccccac

SEQ ID NO: 1317678 - RNA, 18 nt, Mycobacterium tuberculosis H37Rv
cucgggacugcgcggcuu

SEQ ID NO: 1317679 - RNA, 17 nt, Mycobacterium tuberculosis H37Rv
cucgggcaggccccacu

SEQ ID NO: 1317680 - RNA, 20 nt, Mycobacterium tuberculosis H37Rv
cucgggcaggcggccagcga

SEQ ID NO: 1317681 - RNA, 17 nt, Mycobacterium tuberculosis H37Rv
cucguuugcgagcaggg

SEQ ID NO: 1317682 - RNA, 21 nt, Mycobacterium tuberculosis H37Rv
cucguggauggccgccaggcg

SEQ ID NO: 1317683 - RNA, 16 nt, Mycobacterium tuberculosis H37Rv
cucguggauggccgcc

SEQ ID NO: 1317684 - RNA, 23 nt, Mycobacterium tuberculosis H37Rv
cucgugcgugggcgcggcgccag

SEQ ID NO: 1317685 - RNA, 18 nt, Mycobacterium tuberculosis H37Rv
cucgugcaggaccagcac

SEQ ID NO: 1317686 - RNA, 13 nt, Mycobacterium tuberculosis H37Rv
cucgugcagcacu

SEQ ID NO: 1317687 - RNA, 15 nt, Mycobacterium tuberculosis H37Rv
cucuacucgcggccg

SEQ ID NO: 1317688 - RNA, 17 nt, Mycobacterium tuberculosis H37Rv
cucuaccagccgccccg

SEQ ID NO: 1317689 - RNA, 17 nt, Mycobacterium tuberculosis H37Rv
cucuacacccggacugc

SEQ ID NO: 1317690 - RNA, 23 nt, Mycobacterium tuberculosis H37Rv
cucgguucggagucacgcagccg

SEQ ID NO: 1317691 - RNA, 13 nt, Mycobacterium tuberculosis H37Rv
cucgguucgcccc

SEQ ID NO: 1317692 - RNA, 22 nt, Mycobacterium tuberculosis H37Rv
cucgguuugggaauccgcaucu

SEQ ID NO: 1317693 - RNA, 22 nt, Mycobacterium tuberculosis H37Rv
cucguccaggucggccgccucg

SEQ ID NO: 1317694 - RNA, 18 nt, Mycobacterium tuberculosis H37Rv
cucguccaggucggccgc

SEQ ID NO: 1317695 - RNA, 13 nt, Mycobacterium tuberculosis H37Rv
cucguacccggcc

SEQ ID NO: 1317696 - RNA, 16 nt, Mycobacterium tuberculosis H37Rv
cucguccggugcgauc

SEQ ID NO: 1317697 - RNA, 21 nt, Mycobacterium tuberculosis H37Rv
cucgugcacgcacagcccgau

SEQ ID NO: 1317698 - RNA, 21 nt, Mycobacterium tuberculosis H37Rv
cucgugacagcggcgaucucu

SEQ ID NO: 1317699 - RNA, 18 nt, Mycobacterium tuberculosis H37Rv
cucgugagccccagcgac

SEQ ID NO: 1317700 - RNA, 16 nt, Mycobacterium tuberculosis H37Rv
cucgucgccgguggca

SEQ ID NO: 1317701 - RNA, 15 nt, Mycobacterium tuberculosis H37Rv
cucgucgcaucacca

SEQ ID NO: 1317702 - RNA, 23 nt, Mycobacterium tuberculosis H37Rv
cucgucgaggaagaucaccuccc

SEQ ID NO: 1317703 - RNA, 17 nt, Mycobacterium tuberculosis H37Rv
cucgacguaggccaggu

SEQ ID NO: 1317704 - RNA, 17 nt, Mycobacterium tuberculosis H37Rv
cucgacgucgagcacgu

SEQ ID NO: 1317705 - RNA, 18 nt, Mycobacterium tuberculosis H37Rv
cucgaccaaguugaccuu

SEQ ID NO: 1317706 - RNA, 22 nt, Mycobacterium tuberculosis H37Rv
cucgaccagcgccgauaccagc

SEQ ID NO: 1317707 - RNA, 17 nt, Mycobacterium tuberculosis H37Rv
cucgaccaccgccggcc

SEQ ID NO: 1317708 - RNA, 16 nt, Mycobacterium tuberculosis H37Rv
cucgaccagacgcugc

SEQ ID NO: 1317709 - RNA, 18 nt, Mycobacterium tuberculosis H37Rv
cucgacggcccgccgucc

SEQ ID NO: 1317710 - RNA, 16 nt, Mycobacterium tuberculosis H37Rv
cucgaccaggaccggc

SEQ ID NO: 1317711 - RNA, 15 nt, Mycobacterium tuberculosis H37Rv
cuccugaguugcggu

SEQ ID NO: 1317712 - RNA, 16 nt, Mycobacterium tuberculosis H37Rv
cuccugcacacaggac

SEQ ID NO: 1317713 - RNA, 16 nt, Mycobacterium tuberculosis H37Rv
cuccugcagcccgggc

SEQ ID NO: 1317714 - RNA, 14 nt, Mycobacterium tuberculosis H37Rv
cucgacacugcagu

SEQ ID NO: 1317715 - RNA, 22 nt, Mycobacterium tuberculosis H37Rv
cucgacacccagccgcagcccg

SEQ ID NO: 1317716 - RNA, 16 nt, Mycobacterium tuberculosis H37Rv
cucgacacgccgugcg

SEQ ID NO: 1317717 - RNA, 23 nt, Mycobacterium tuberculosis H37Rv
cucgauaucguuggcgaccaccg

SEQ ID NO: 1317718 - RNA, 14 nt, Mycobacterium tuberculosis H37Rv
cucgaucagcgccg

SEQ ID NO: 1317719 - RNA, 15 nt, Mycobacterium tuberculosis H37Rv
cucgaugcgggcgcc

SEQ ID NO: 1317720 - RNA, 16 nt, Mycobacterium tuberculosis H37Rv
cucgaucagcgccgga

SEQ ID NO: 1317721 - RNA, 16 nt, Mycobacterium tuberculosis H37Rv
cucgaucacggcggcc

SEQ ID NO: 1317722 - RNA, 19 nt, Mycobacterium tuberculosis H37Rv
cucgaucacggcggccccg

SEQ ID NO: 1317723 - RNA, 20 nt, Mycobacterium tuberculosis H37Rv
cucgaggucgagcgccgcgg

SEQ ID NO: 1317724 - RNA, 18 nt, Mycobacterium tuberculosis H37Rv
cucgaggucgagcgccgc

SEQ ID NO: 1317725 - RNA, 11 nt, Mycobacterium tuberculosis H37Rv
cucgagcagga

SEQ ID NO: 1317726 - RNA, 19 nt, Mycobacterium tuberculosis H37Rv
cucgaguccaggcagcuug

SEQ ID NO: 1317727 - RNA, 16 nt, Mycobacterium tuberculosis H37Rv
cucgagucgcagcacg

SEQ ID NO: 1317728 - RNA, 16 nt, Mycobacterium tuberculosis H37Rv
cucgaugucagcggcc

SEQ ID NO: 1317729 - RNA, 19 nt, Mycobacterium tuberculosis H37Rv
cucgauggcggccaccagc

SEQ ID NO: 1317730 - RNA, 20 nt, Mycobacterium tuberculosis H37Rv
cucgauggcguagggcuguc

SEQ ID NO: 1317731 - RNA, 17 nt, Mycobacterium tuberculosis H37Rv
cucgauggcggccacca

SEQ ID NO: 1317732 - RNA, 23 nt, Mycobacterium tuberculosis H37Rv
cucgauggauccaaccgugcucu

SEQ ID NO: 1317733 - RNA, 18 nt, Mycobacterium tuberculosis H37Rv
cucgauggaccgccaggg

SEQ ID NO: 1317734 - RNA, 20 nt, Mycobacterium tuberculosis H37Rv
cucgccacacucccgcgccc

SEQ ID NO: 1317735 - RNA, 15 nt, Mycobacterium tuberculosis H37Rv
cucgcgcgcugggcg

SEQ ID NO: 1317736 - RNA, 19 nt, Mycobacterium tuberculosis H37Rv
cucgccgguaggcggccag

SEQ ID NO: 1317737 - RNA, 19 nt, Mycobacterium tuberculosis H37Rv
cucgcgcaggucgccuucu

SEQ ID NO: 1317738 - RNA, 21 nt, Mycobacterium tuberculosis H37Rv
cucgccguacaucagcgcgaa

SEQ ID NO: 1317739 - RNA, 19 nt, Mycobacterium tuberculosis H37Rv
cucgccagagucggagacc

SEQ ID NO: 1317740 - RNA, 14 nt, Mycobacterium tuberculosis H37Rv
cucgcccaagcgca

SEQ ID NO: 1317741 - RNA, 15 nt, Mycobacterium tuberculosis H37Rv
cucgcccaccaccac

SEQ ID NO: 1317742 - RNA, 15 nt, Mycobacterium tuberculosis H37Rv
cucgcccacccgcug

SEQ ID NO: 1317743 - RNA, 16 nt, Mycobacterium tuberculosis H37Rv
cucgccggccacccgc

SEQ ID NO: 1317744 - RNA, 15 nt, Mycobacterium tuberculosis H37Rv
cucgccggccgccag

SEQ ID NO: 1317745 - RNA, 18 nt, Mycobacterium tuberculosis H37Rv
cucgccggccgccagccg

SEQ ID NO: 1317746 - RNA, 14 nt, Mycobacterium tuberculosis H37Rv
cucgccggcacgca

SEQ ID NO: 1317747 - RNA, 16 nt, Mycobacterium tuberculosis H37Rv
cucgccggcacgcagc

SEQ ID NO: 1317748 - RNA, 15 nt, Mycobacterium tuberculosis H37Rv
cucgccggcgcgcac

SEQ ID NO: 1317749 - RNA, 20 nt, Mycobacterium tuberculosis H37Rv
cucgccggcggacgcccggc

SEQ ID NO: 1317750 - RNA, 14 nt, Mycobacterium tuberculosis H37Rv
cucgccgggcagcu

SEQ ID NO: 1317751 - RNA, 16 nt, Mycobacterium tuberculosis H37Rv
cucgcucugcgcggcu

SEQ ID NO: 1317752 - RNA, 22 nt, Mycobacterium tuberculosis H37Rv
cucgcugaucuggggcaccacg

SEQ ID NO: 1317753 - RNA, 13 nt, Mycobacterium tuberculosis H37Rv
cucgcugcagcag

SEQ ID NO: 1317754 - RNA, 16 nt, Mycobacterium tuberculosis H37Rv
cucgcggugggcuucc

SEQ ID NO: 1317755 - RNA, 20 nt, Mycobacterium tuberculosis H37Rv
cucgcguagggccagcgccu

SEQ ID NO: 1317756 - RNA, 18 nt, Mycobacterium tuberculosis H37Rv
cucgcggcgcggccgcag

SEQ ID NO: 1317757 - RNA, 14 nt, Mycobacterium tuberculosis H37Rv
cucgcggcgcggcc

SEQ ID NO: 1317758 - RNA, 23 nt, Mycobacterium tuberculosis H37Rv
cucgcggugcggcaacagcgcca

SEQ ID NO: 1317759 - RNA, 22 nt, Mycobacterium tuberculosis H37Rv
cucgcgggugcuggucaacagc

SEQ ID NO: 1317760 - RNA, 15 nt, Mycobacterium tuberculosis H37Rv
cuaccuaacccgcgc

SEQ ID NO: 1317761 - RNA, 16 nt, Mycobacterium tuberculosis H37Rv
cuaccguuguugagga

SEQ ID NO: 1317762 - RNA, 23 nt, Mycobacterium tuberculosis H37Rv
cuaccggccuuuccagcaccccg

SEQ ID NO: 1317763 - RNA, 12 nt, Mycobacterium tuberculosis H37Rv
cuaccggcccga

SEQ ID NO: 1317764 - RNA, 15 nt, Mycobacterium tuberculosis H37Rv
cuaccggccuuucca

SEQ ID NO: 1317765 - RNA, 20 nt, Mycobacterium tuberculosis H37Rv
cuaccggcgccgcgcggcuu

SEQ ID NO: 1317766 - RNA, 17 nt, Mycobacterium tuberculosis H37Rv
cuaccggcucguagcug

SEQ ID NO: 1317767 - RNA, 19 nt, Mycobacterium tuberculosis H37Rv
cuaccgucaguagccacgc

SEQ ID NO: 1317768 - RNA, 23 nt, Mycobacterium tuberculosis H37Rv
cuaccgccggcggcggccgcagc

SEQ ID NO: 1317769 - RNA, 17 nt, Mycobacterium tuberculosis H37Rv
cuaccgcccgcgccacc

SEQ ID NO: 1317770 - RNA, 12 nt, Mycobacterium tuberculosis H37Rv
cuacgggccgcg

SEQ ID NO: 1317771 - RNA, 14 nt, Mycobacterium tuberculosis H37Rv
cuacggccuggcca

SEQ ID NO: 1317772 - RNA, 16 nt, Mycobacterium tuberculosis H37Rv
cuacggccuggccacc

SEQ ID NO: 1317773 - RNA, 22 nt, Mycobacterium tuberculosis H37Rv
cuaccuguguugagcggcagcc

SEQ ID NO: 1317774 - RNA, 16 nt, Mycobacterium tuberculosis H37Rv
cuaccuguugacacaa

SEQ ID NO: 1317775 - RNA, 20 nt, Mycobacterium tuberculosis H37Rv
cuacgcagccguagcugggc

SEQ ID NO: 1317776 - RNA, 17 nt, Mycobacterium tuberculosis H37Rv
cuacgccccacugccgu

SEQ ID NO: 1317777 - RNA, 15 nt, Mycobacterium tuberculosis H37Rv
cuacgccccacugcc

SEQ ID NO: 1317778 - RNA, 16 nt, Mycobacterium tuberculosis H37Rv
cuacgccccacugccg

SEQ ID NO: 1317779 - RNA, 18 nt, Mycobacterium tuberculosis H37Rv
cuagcagguacucgcccc

SEQ ID NO: 1317780 - RNA, 21 nt, Mycobacterium tuberculosis H37Rv
cuagcagggugccggcgccgc

SEQ ID NO: 1317781 - RNA, 12 nt, Mycobacterium tuberculosis H37Rv
cuagcagcagcc

SEQ ID NO: 1317782 - RNA, 16 nt, Mycobacterium tuberculosis H37Rv
cuagcagcgcugcgau

SEQ ID NO: 1317783 - RNA, 20 nt, Mycobacterium tuberculosis H37Rv
cuagauauggaccgccgccg

SEQ ID NO: 1317784 - RNA, 16 nt, Mycobacterium tuberculosis H37Rv
cuagcgccaaauccgg

SEQ ID NO: 1317785 - RNA, 17 nt, Mycobacterium tuberculosis H37Rv
cuagcgcgggcucggug

SEQ ID NO: 1317786 - RNA, 17 nt, Mycobacterium tuberculosis H37Rv
cuagcgccccuggcacc

SEQ ID NO: 1317787 - RNA, 19 nt, Mycobacterium tuberculosis H37Rv
cuagcgccccuggcaccuc

SEQ ID NO: 1317788 - RNA, 21 nt, Mycobacterium tuberculosis H37Rv
cuagcgcccgaaccccgggcg

SEQ ID NO: 1317789 - RNA, 17 nt, Mycobacterium tuberculosis H37Rv
cuagccgcggcaccgcc

SEQ ID NO: 1317790 - RNA, 22 nt, Mycobacterium tuberculosis H37Rv
cuagccaccaggcggucagguc

SEQ ID NO: 1317791 - RNA, 14 nt, Mycobacterium tuberculosis H37Rv
cuagcccggcggcg

SEQ ID NO: 1317792 - RNA, 22 nt, Mycobacterium tuberculosis H37Rv
cuagccccugaaggccagccaa

SEQ ID NO: 1317793 - RNA, 14 nt, Mycobacterium tuberculosis H37Rv
cuaggcccagcacg

SEQ ID NO: 1317794 - RNA, 14 nt, Mycobacterium tuberculosis H37Rv
cuaggccucagaac

SEQ ID NO: 1317795 - RNA, 13 nt, Mycobacterium tuberculosis H37Rv
cuaggccagcacg

SEQ ID NO: 1317796 - RNA, 12 nt, Mycobacterium tuberculosis H37Rv
cuaggccaagcc

SEQ ID NO: 1317797 - RNA, 13 nt, Mycobacterium tuberculosis H37Rv
cuaggcaugccac

SEQ ID NO: 1317798 - RNA, 16 nt, Mycobacterium tuberculosis H37Rv
cuaggcaugccacaca

SEQ ID NO: 1317799 - RNA, 20 nt, Mycobacterium tuberculosis H37Rv
cuagcgcuugcgaccccggc

SEQ ID NO: 1317800 - RNA, 20 nt, Mycobacterium tuberculosis H37Rv
cuagcgccucgccggccacc

SEQ ID NO: 1317801 - RNA, 17 nt, Mycobacterium tuberculosis H37Rv
cuaggacgccgcccucu

SEQ ID NO: 1317802 - RNA, 22 nt, Mycobacterium tuberculosis H37Rv
cuaggacggcugccgucagccg

SEQ ID NO: 1317803 - RNA, 21 nt, Mycobacterium tuberculosis H37Rv
cuaggaccaccagcgcuccag

SEQ ID NO: 1317804 - RNA, 18 nt, Mycobacterium tuberculosis H37Rv
cuauacgcaacaggccaa

SEQ ID NO: 1317805 - RNA, 23 nt, Mycobacterium tuberculosis H37Rv
cuauccuugguuagccgcggccc

SEQ ID NO: 1317806 - RNA, 14 nt, Mycobacterium tuberculosis H37Rv
cuaucgccgcgcgu

SEQ ID NO: 1317807 - RNA, 17 nt, Mycobacterium tuberculosis H37Rv
cuaucgcagaacggacc

SEQ ID NO: 1317808 - RNA, 23 nt, Mycobacterium tuberculosis H37Rv
cuauaucccgccccgggccacca

SEQ ID NO: 1317809 - RNA, 14 nt, Mycobacterium tuberculosis H37Rv
cuaucgacaacaug

SEQ ID NO: 1317810 - RNA, 15 nt, Mycobacterium tuberculosis H37Rv
cuaugcuggcagcuc

SEQ ID NO: 1317811 - RNA, 21 nt, Mycobacterium tuberculosis H37Rv
cuauggaugaccgaaccuggu

SEQ ID NO: 1317812 - RNA, 19 nt, Mycobacterium tuberculosis H37Rv
cuauggcgccgcggcuggg

SEQ ID NO: 1317813 - RNA, 18 nt, Mycobacterium tuberculosis H37Rv
cucaaggcuucggcggcc

SEQ ID NO: 1317814 - RNA, 16 nt, Mycobacterium tuberculosis H37Rv
cucaagucucccggcc

SEQ ID NO: 1317815 - RNA, 18 nt, Mycobacterium tuberculosis H37Rv
cucaacccgugcgacuuc

SEQ ID NO: 1317816 - RNA, 13 nt, Mycobacterium tuberculosis H37Rv
cucaaccagcaga

SEQ ID NO: 1317817 - RNA, 19 nt, Mycobacterium tuberculosis H37Rv
cucaaggacgcaccgccag

SEQ ID NO: 1317818 - RNA, 15 nt, Mycobacterium tuberculosis H37Rv
cucaaggacgcaccg

SEQ ID NO: 1317819 - RNA, 18 nt, Mycobacterium tuberculosis H37Rv
cucaccacccgcacucca

SEQ ID NO: 1317820 - RNA, 14 nt, Mycobacterium tuberculosis H37Rv
cucaccaccgaccu

SEQ ID NO: 1317821 - RNA, 12 nt, Mycobacterium tuberculosis H37Rv
cucaccaccaga

SEQ ID NO: 1317822 - RNA, 20 nt, Mycobacterium tuberculosis H37Rv
cucaccacgaggcuugcggc

SEQ ID NO: 1317823 - RNA, 15 nt, Mycobacterium tuberculosis H37Rv
cucacaugcccggac

SEQ ID NO: 1317824 - RNA, 16 nt, Mycobacterium tuberculosis H37Rv
cucacauccugguuga

SEQ ID NO: 1317825 - RNA, 16 nt, Mycobacterium tuberculosis H37Rv
cucacauuggccaggu

SEQ ID NO: 1317826 - RNA, 18 nt, Mycobacterium tuberculosis H37Rv
cucaaaccggaaacagca

SEQ ID NO: 1317827 - RNA, 23 nt, Mycobacterium tuberculosis H37Rv
cucaucaaacccccggggcgcuc

SEQ ID NO: 1317828 - RNA, 14 nt, Mycobacterium tuberculosis H37Rv
cucagucacgcacu

SEQ ID NO: 1317829 - RNA, 17 nt, Mycobacterium tuberculosis H37Rv
cucaggucaccggccgc

SEQ ID NO: 1317830 - RNA, 15 nt, Mycobacterium tuberculosis H37Rv
cucagguucagcuug

SEQ ID NO: 1317831 - RNA, 22 nt, Mycobacterium tuberculosis H37Rv
cucaucgaagcuucggccuucu

SEQ ID NO: 1317832 - RNA, 14 nt, Mycobacterium tuberculosis H37Rv
cucaucaccucucc

SEQ ID NO: 1317833 - RNA, 16 nt, Mycobacterium tuberculosis H37Rv
cucaucgcggucgcca

SEQ ID NO: 1317834 - RNA, 13 nt, Mycobacterium tuberculosis H37Rv
cucaucgccgcua

SEQ ID NO: 1317835 - RNA, 21 nt, Mycobacterium tuberculosis H37Rv
cucaucggacagcgccuggcc

SEQ ID NO: 1317836 - RNA, 21 nt, Mycobacterium tuberculosis H37Rv
cucaucggccgcggucggcca

SEQ ID NO: 1317837 - RNA, 17 nt, Mycobacterium tuberculosis H37Rv
cucaucggcgugcuugc

SEQ ID NO: 1317838 - RNA, 13 nt, Mycobacterium tuberculosis H37Rv
cucaugcuggaag

SEQ ID NO: 1317839 - RNA, 22 nt, Mycobacterium tuberculosis H37Rv
cucaccucggcuuugccgcugu

SEQ ID NO: 1317840 - RNA, 20 nt, Mycobacterium tuberculosis H37Rv
cucaccggcgcccagcgccu

SEQ ID NO: 1317841 - RNA, 13 nt, Mycobacterium tuberculosis H37Rv
cucaccggcuggu

SEQ ID NO: 1317842 - RNA, 12 nt, Mycobacterium tuberculosis H37Rv
cucaccaggcga

SEQ ID NO: 1317843 - RNA, 20 nt, Mycobacterium tuberculosis H37Rv
cucaccgcgcaucaucgccc

SEQ ID NO: 1317844 - RNA, 13 nt, Mycobacterium tuberculosis H37Rv
cucagcugcucgu

SEQ ID NO: 1317845 - RNA, 20 nt, Mycobacterium tuberculosis H37Rv
cucagcacgcguucaacgaa

SEQ ID NO: 1317846 - RNA, 13 nt, Mycobacterium tuberculosis H37Rv
cucagccgcggcc

SEQ ID NO: 1317847 - RNA, 13 nt, Mycobacterium tuberculosis H37Rv
cucagccggcggc

SEQ ID NO: 1317848 - RNA, 14 nt, Mycobacterium tuberculosis H37Rv
cucagccggcggcu

SEQ ID NO: 1317849 - RNA, 19 nt, Mycobacterium tuberculosis H37Rv
cucagccguccgggcggcc

SEQ ID NO: 1317850 - RNA, 14 nt, Mycobacterium tuberculosis H37Rv
cguggcgcaccacc

SEQ ID NO: 1317851 - RNA, 17 nt, Mycobacterium tuberculosis H37Rv
cguggcgcaccaccgcc

SEQ ID NO: 1317852 - RNA, 15 nt, Mycobacterium tuberculosis H37Rv
cguggcgcccgugcc

SEQ ID NO: 1317853 - RNA, 18 nt, Mycobacterium tuberculosis H37Rv
cguggcgcccgugccgcc

SEQ ID NO: 1317854 - RNA, 15 nt, Mycobacterium tuberculosis H37Rv
cguggcgaccacgau

SEQ ID NO: 1317855 - RNA, 21 nt, Mycobacterium tuberculosis H37Rv
cguggccggucacguccgcgg

SEQ ID NO: 1317856 - RNA, 22 nt, Mycobacterium tuberculosis H37Rv
cguggcccgcucccugcaccca

SEQ ID NO: 1317857 - RNA, 17 nt, Mycobacterium tuberculosis H37Rv
cguggcccgcucccugc

SEQ ID NO: 1317858 - RNA, 21 nt, Mycobacterium tuberculosis H37Rv
cguggcccgcucccugcaccc

SEQ ID NO: 1317859 - RNA, 17 nt, Mycobacterium tuberculosis H37Rv
cguggccaauccggcgg

SEQ ID NO: 1317860 - RNA, 19 nt, Mycobacterium tuberculosis H37Rv
cguggccaauccggcggcg

SEQ ID NO: 1317861 - RNA, 16 nt, Mycobacterium tuberculosis H37Rv
cguggcgucggcguca

SEQ ID NO: 1317862 - RNA, 15 nt, Mycobacterium tuberculosis H37Rv
cguggcggcgggccu

SEQ ID NO: 1317863 - RNA, 16 nt, Mycobacterium tuberculosis H37Rv
cguggcggccuccucc

SEQ ID NO: 1317864 - RNA, 12 nt, Mycobacterium tuberculosis H37Rv
cguggcggccuc

SEQ ID NO: 1317865 - RNA, 13 nt, Mycobacterium tuberculosis H37Rv
cguggcgcgccgc

SEQ ID NO: 1317866 - RNA, 20 nt, Mycobacterium tuberculosis H37Rv
cguggcgccggacaaaccgg

SEQ ID NO: 1317867 - RNA, 14 nt, Mycobacterium tuberculosis H37Rv
cguggucaguugug

SEQ ID NO: 1317868 - RNA, 13 nt, Mycobacterium tuberculosis H37Rv
cguggucgagcag

SEQ ID NO: 1317869 - RNA, 17 nt, Mycobacterium tuberculosis H37Rv
cgugguaaccagggcag

SEQ ID NO: 1317870 - RNA, 17 nt, Mycobacterium tuberculosis H37Rv
cguggugcugaccgcgc

SEQ ID NO: 1317871 - RNA, 14 nt, Mycobacterium tuberculosis H37Rv
cguggugucucggc

SEQ ID NO: 1317872 - RNA, 15 nt, Mycobacterium tuberculosis H37Rv
cguggucgcgcggca

SEQ ID NO: 1317873 - RNA, 18 nt, Mycobacterium tuberculosis H37Rv
cgugggugucggcuagca

SEQ ID NO: 1317874 - RNA, 22 nt, Mycobacterium tuberculosis H37Rv
cgugguaaccauauggcccgcg

SEQ ID NO: 1317875 - RNA, 21 nt, Mycobacterium tuberculosis H37Rv
cguggguguugaugggcagcc

SEQ ID NO: 1317876 - RNA, 17 nt, Mycobacterium tuberculosis H37Rv
cgugggcgugagcgcgc

SEQ ID NO: 1317877 - RNA, 18 nt, Mycobacterium tuberculosis H37Rv
cguggggccgccaccagc

SEQ ID NO: 1317878 - RNA, 17 nt, Mycobacterium tuberculosis H37Rv
cguggggacuggcaggc

SEQ ID NO: 1317879 - RNA, 18 nt, Mycobacterium tuberculosis H37Rv
cguggggacuggcaggcc

SEQ ID NO: 1317880 - RNA, 16 nt, Mycobacterium tuberculosis H37Rv
cguggguaccgagcag

SEQ ID NO: 1317881 - RNA, 23 nt, Mycobacterium tuberculosis H37Rv
cgugggagguggcgcggggccgc

SEQ ID NO: 1317882 - RNA, 13 nt, Mycobacterium tuberculosis H37Rv
cgugggccacgau

SEQ ID NO: 1317883 - RNA, 16 nt, Mycobacterium tuberculosis H37Rv
cgugggaaccaccagc

SEQ ID NO: 1317884 - RNA, 16 nt, Mycobacterium tuberculosis H37Rv
cgugggcgcggcgcca

SEQ ID NO: 1317885 - RNA, 23 nt, Mycobacterium tuberculosis H37Rv
cgugggcaugcggauucgcgcug

SEQ ID NO: 1317886 - RNA, 21 nt, Mycobacterium tuberculosis H37Rv
cgugcuuaacacaugcaaguc

SEQ ID NO: 1317887 - RNA, 13 nt, Mycobacterium tuberculosis H37Rv
cgugcuuccauuc

SEQ ID NO: 1317888 - RNA, 17 nt, Mycobacterium tuberculosis H37Rv
cguggacaucgggcggc

SEQ ID NO: 1317889 - RNA, 22 nt, Mycobacterium tuberculosis H37Rv
cguggaagccgacgaccagcag

SEQ ID NO: 1317890 - RNA, 21 nt, Mycobacterium tuberculosis H37Rv
cgugcugccgauagcgcggca

SEQ ID NO: 1317891 - RNA, 19 nt, Mycobacterium tuberculosis H37Rv
cgugcugcccgcaacacug

SEQ ID NO: 1317892 - RNA, 14 nt, Mycobacterium tuberculosis H37Rv
cgugcuggaacagg

SEQ ID NO: 1317893 - RNA, 17 nt, Mycobacterium tuberculosis H37Rv
cguggacaagcacagcg

SEQ ID NO: 1317894 - RNA, 19 nt, Mycobacterium tuberculosis H37Rv
cguggagcgcaaguugagc

SEQ ID NO: 1317895 - RNA, 20 nt, Mycobacterium tuberculosis H37Rv
cguggauggccgccaggcgc

SEQ ID NO: 1317896 - RNA, 15 nt, Mycobacterium tuberculosis H37Rv
cguggaucuuggcca

SEQ ID NO: 1317897 - RNA, 17 nt, Mycobacterium tuberculosis H37Rv
cguggaucuuggccagc

SEQ ID NO: 1317898 - RNA, 14 nt, Mycobacterium tuberculosis H37Rv
cguggauggccgcc

SEQ ID NO: 1317899 - RNA, 13 nt, Mycobacterium tuberculosis H37Rv
cguggcagugcag

SEQ ID NO: 1317900 - RNA, 14 nt, Mycobacterium tuberculosis H37Rv
cgugcuccugcccg

SEQ ID NO: 1317901 - RNA, 15 nt, Mycobacterium tuberculosis H37Rv
cgugcgucggcccgg

SEQ ID NO: 1317902 - RNA, 16 nt, Mycobacterium tuberculosis H37Rv
cgugcgugcgggggcu

SEQ ID NO: 1317903 - RNA, 15 nt, Mycobacterium tuberculosis H37Rv
cgugcggucgcgccc

SEQ ID NO: 1317904 - RNA, 21 nt, Mycobacterium tuberculosis H37Rv
cgugcggguaauacggcgccu

SEQ ID NO: 1317905 - RNA, 18 nt, Mycobacterium tuberculosis H37Rv
cgugcggcacucccuggg

SEQ ID NO: 1317906 - RNA, 22 nt, Mycobacterium tuberculosis H37Rv
cgugcggguucacugccggcca

SEQ ID NO: 1317907 - RNA, 13 nt, Mycobacterium tuberculosis H37Rv
cgugcgggcgggc

SEQ ID NO: 1317908 - RNA, 17 nt, Mycobacterium tuberculosis H37Rv
cgugcggcgcggcgaca

SEQ ID NO: 1317909 - RNA, 18 nt, Mycobacterium tuberculosis H37Rv
cgugcgcacugaggcuca

SEQ ID NO: 1317910 - RNA, 17 nt, Mycobacterium tuberculosis H37Rv
cgugccuuccucgccgg

SEQ ID NO: 1317911 - RNA, 24 nt, Mycobacterium tuberculosis H37Rv
cgugcgauucacacucgggcggcu

SEQ ID NO: 1317912 - RNA, 21 nt, Mycobacterium tuberculosis H37Rv
cgugccuugaucugagcgcgg

SEQ ID NO: 1317913 - RNA, 14 nt, Mycobacterium tuberculosis H37Rv
cgugcgcgcgcagc

SEQ ID NO: 1317914 - RNA, 13 nt, Mycobacterium tuberculosis H37Rv
cgugcgcgcgcag

SEQ ID NO: 1317915 - RNA, 20 nt, Mycobacterium tuberculosis H37Rv
cgugcgccggggacacagcg

SEQ ID NO: 1317916 - RNA, 19 nt, Mycobacterium tuberculosis H37Rv
cgugugcucgaaggaccgg

SEQ ID NO: 1317917 - RNA, 21 nt, Mycobacterium tuberculosis H37Rv
cgugugccacggggcaggucc

SEQ ID NO: 1317918 - RNA, 22 nt, Mycobacterium tuberculosis H37Rv
cgugugcaccaucaucaccucu

SEQ ID NO: 1317919 - RNA, 19 nt, Mycobacterium tuberculosis H37Rv
cguguggugugucaccgga

SEQ ID NO: 1317920 - RNA, 19 nt, Mycobacterium tuberculosis H37Rv
cgugucuggcgaacaguga

SEQ ID NO: 1317921 - RNA, 17 nt, Mycobacterium tuberculosis H37Rv
cgugucuugucgcgcag

SEQ ID NO: 1317922 - RNA, 23 nt, Mycobacterium tuberculosis H37Rv
cgugucuugucgcgcagcaucuc

SEQ ID NO: 1317923 - RNA, 22 nt, Mycobacterium tuberculosis H37Rv
cgugucgccgccaccagcgcac

SEQ ID NO: 1317924 - RNA, 18 nt, Mycobacterium tuberculosis H37Rv
cguguccuuugccaccuc

SEQ ID NO: 1317925 - RNA, 23 nt, Mycobacterium tuberculosis H37Rv
cguguccccccagauccgcagcg

SEQ ID NO: 1317926 - RNA, 21 nt, Mycobacterium tuberculosis H37Rv
cguguaaccccaggcgcugcc

SEQ ID NO: 1317927 - RNA, 17 nt, Mycobacterium tuberculosis H37Rv
cgugguuccggcgugca

SEQ ID NO: 1317928 - RNA, 12 nt, Mycobacterium tuberculosis H37Rv
cgugguuccggc

SEQ ID NO: 1317929 - RNA, 16 nt, Mycobacterium tuberculosis H37Rv
cgugguuguaccagcc

SEQ ID NO: 1317930 - RNA, 11 nt, Mycobacterium tuberculosis H37Rv
cguguaggucc

SEQ ID NO: 1317931 - RNA, 21 nt, Mycobacterium tuberculosis H37Rv
cgugucacccaauggagccgc

SEQ ID NO: 1317932 - RNA, 19 nt, Mycobacterium tuberculosis H37Rv
cguuaccgccggcgccggu

SEQ ID NO: 1317933 - RNA, 20 nt, Mycobacterium tuberculosis H37Rv
cguuaccaccgucaccgccg

SEQ ID NO: 1317934 - RNA, 21 nt, Mycobacterium tuberculosis H37Rv
cguuaaucaaggugaucagca

SEQ ID NO: 1317935 - RNA, 18 nt, Mycobacterium tuberculosis H37Rv
cguuacgcucgcgggcca

SEQ ID NO: 1317936 - RNA, 19 nt, Mycobacterium tuberculosis H37Rv
cguuagcguagcccgaguu

SEQ ID NO: 1317937 - RNA, 21 nt, Mycobacterium tuberculosis H37Rv
cguuagcauugaguucggcca

SEQ ID NO: 1317938 - RNA, 17 nt, Mycobacterium tuberculosis H37Rv
cguuagcuuagcugccg

SEQ ID NO: 1317939 - RNA, 13 nt, Mycobacterium tuberculosis H37Rv
cguucaaggucuc

SEQ ID NO: 1317940 - RNA, 18 nt, Mycobacterium tuberculosis H37Rv
cguucaaggucuccagac

SEQ ID NO: 1317941 - RNA, 18 nt, Mycobacterium tuberculosis H37Rv
cguucaacgacggcaagc

SEQ ID NO: 1317942 - RNA, 21 nt, Mycobacterium tuberculosis H37Rv
cguuccagcaguacaccgccc

SEQ ID NO: 1317943 - RNA, 23 nt, Mycobacterium tuberculosis H37Rv
cguuccagcaguacaccgcccgg

SEQ ID NO: 1317944 - RNA, 22 nt, Mycobacterium tuberculosis H37Rv
cguuccaucagggccuuggcgg

SEQ ID NO: 1317945 - RNA, 14 nt, Mycobacterium tuberculosis H37Rv
cguucgccgcccgg

SEQ ID NO: 1317946 - RNA, 14 nt, Mycobacterium tuberculosis H37Rv
cguucgcccgcccg

SEQ ID NO: 1317947 - RNA, 22 nt, Mycobacterium tuberculosis H37Rv
cguucccgccauugccgccguc

SEQ ID NO: 1317948 - RNA, 13 nt, Mycobacterium tuberculosis H37Rv
cguucccgccggc

SEQ ID NO: 1317949 - RNA, 15 nt, Mycobacterium tuberculosis H37Rv
cguucccgccggccc

SEQ ID NO: 1317950 - RNA, 16 nt, Mycobacterium tuberculosis H37Rv
cguucccgccggcccc

SEQ ID NO: 1317951 - RNA, 23 nt, Mycobacterium tuberculosis H37Rv
cguucacgccagucccacugggc

SEQ ID NO: 1317952 - RNA, 14 nt, Mycobacterium tuberculosis H37Rv
cguucacuggucuc

SEQ ID NO: 1317953 - RNA, 18 nt, Mycobacterium tuberculosis H37Rv
cguucagcgaccaaugca

SEQ ID NO: 1317954 - RNA, 23 nt, Mycobacterium tuberculosis H37Rv
cuaaccgcuuggugugauacaac

SEQ ID NO: 1317955 - RNA, 15 nt, Mycobacterium tuberculosis H37Rv
cuaacggcagccacc

SEQ ID NO: 1317956 - RNA, 16 nt, Mycobacterium tuberculosis H37Rv
cuaacggcagccaccg

SEQ ID NO: 1317957 - RNA, 15 nt, Mycobacterium tuberculosis H37Rv
cuaacuggcccggac

SEQ ID NO: 1317958 - RNA, 19 nt, Mycobacterium tuberculosis H37Rv
cuaagcauucagcgcgccg

SEQ ID NO: 1317959 - RNA, 21 nt, Mycobacterium tuberculosis H37Rv
cuaacagccggcucccguacu

SEQ ID NO: 1317960 - RNA, 19 nt, Mycobacterium tuberculosis H37Rv
cuaacaacaccaccagcac

SEQ ID NO: 1317961 - RNA, 14 nt, Mycobacterium tuberculosis H37Rv
cuaacaacaccacc

SEQ ID NO: 1317962 - RNA, 23 nt, Mycobacterium tuberculosis H37Rv
cuaaaucuggccgauuuaguggg

SEQ ID NO: 1317963 - RNA, 18 nt, Mycobacterium tuberculosis H37Rv
cuaaaccagccaccacca

SEQ ID NO: 1317964 - RNA, 15 nt, Mycobacterium tuberculosis H37Rv
cguuugcgaagccca

SEQ ID NO: 1317965 - RNA, 15 nt, Mycobacterium tuberculosis H37Rv
cguuuccgccgccgc

SEQ ID NO: 1317966 - RNA, 17 nt, Mycobacterium tuberculosis H37Rv
cguuuccgccgccgcca

SEQ ID NO: 1317967 - RNA, 15 nt, Mycobacterium tuberculosis H37Rv
cguuuggcgccgccg

SEQ ID NO: 1317968 - RNA, 15 nt, Mycobacterium tuberculosis H37Rv
cguuuggcugccgaa

SEQ ID NO: 1317969 - RNA, 18 nt, Mycobacterium tuberculosis H37Rv
cguuucgcgaugugcgcc

SEQ ID NO: 1317970 - RNA, 16 nt, Mycobacterium tuberculosis H37Rv
cguuggcgccaccagu

SEQ ID NO: 1317971 - RNA, 23 nt, Mycobacterium tuberculosis H37Rv
cguuggccgagcagggccggcac

SEQ ID NO: 1317972 - RNA, 18 nt, Mycobacterium tuberculosis H37Rv
cguuggagccgccaccga

SEQ ID NO: 1317973 - RNA, 13 nt, Mycobacterium tuberculosis H37Rv
cguuggccagcag

SEQ ID NO: 1317974 - RNA, 15 nt, Mycobacterium tuberculosis H37Rv
cguuggacggcaccg

SEQ ID NO: 1317975 - RNA, 21 nt, Mycobacterium tuberculosis H37Rv
cguuggaaaagucgggcacug

SEQ ID NO: 1317976 - RNA, 17 nt, Mycobacterium tuberculosis H37Rv
cguucuugcggguuuuc

SEQ ID NO: 1317977 - RNA, 16 nt, Mycobacterium tuberculosis H37Rv
cguucugcaccagcuc

SEQ ID NO: 1317978 - RNA, 18 nt, Mycobacterium tuberculosis H37Rv
cguucgcugguccuuguc

SEQ ID NO: 1317979 - RNA, 20 nt, Mycobacterium tuberculosis H37Rv
cguucgcgggugcgcugcag

SEQ ID NO: 1317980 - RNA, 18 nt, Mycobacterium tuberculosis H37Rv
cguucggcacaaccaacg

SEQ ID NO: 1317981 - RNA, 16 nt, Mycobacterium tuberculosis H37Rv
cguucggcaccugguu

SEQ ID NO: 1317982 - RNA, 17 nt, Mycobacterium tuberculosis H37Rv
cguuggcgugcaccgca

SEQ ID NO: 1317983 - RNA, 18 nt, Mycobacterium tuberculosis H37Rv
cguuggcggccagcgcac

SEQ ID NO: 1317984 - RNA, 21 nt, Mycobacterium tuberculosis H37Rv
cguuggcggcggucggcuggg

SEQ ID NO: 1317985 - RNA, 14 nt, Mycobacterium tuberculosis H37Rv
cguugggaaacauc

SEQ ID NO: 1317986 - RNA, 17 nt, Mycobacterium tuberculosis H37Rv
cguuggugaggcccccc

SEQ ID NO: 1317987 - RNA, 22 nt, Mycobacterium tuberculosis H37Rv
cguugggcguacucggcgcgca

SEQ ID NO: 1317988 - RNA, 19 nt, Mycobacterium tuberculosis H37Rv
cguuguaugcugcgcgccg

SEQ ID NO: 1317989 - RNA, 16 nt, Mycobacterium tuberculosis H37Rv
cguuguaggcuuccag

SEQ ID NO: 1317990 - RNA, 17 nt, Mycobacterium tuberculosis H37Rv
cguuguagacggcggca

SEQ ID NO: 1317991 - RNA, 13 nt, Mycobacterium tuberculosis H37Rv
cguuguugaggau

SEQ ID NO: 1317992 - RNA, 14 nt, Mycobacterium tuberculosis H37Rv
cguccacgcugacc

SEQ ID NO: 1317993 - RNA, 18 nt, Mycobacterium tuberculosis H37Rv
cguccacgcugaccaacg

SEQ ID NO: 1317994 - RNA, 13 nt, Mycobacterium tuberculosis H37Rv
cguacugaucuuc

SEQ ID NO: 1317995 - RNA, 14 nt, Mycobacterium tuberculosis H37Rv
cguacugaucuucg

SEQ ID NO: 1317996 - RNA, 18 nt, Mycobacterium tuberculosis H37Rv
cguacucggcgcgcagcg

SEQ ID NO: 1317997 - RNA, 18 nt, Mycobacterium tuberculosis H37Rv
cguacucggcggccacca

SEQ ID NO: 1317998 - RNA, 15 nt, Mycobacterium tuberculosis H37Rv
cguacucgugcaccg

SEQ ID NO: 1317999 - RNA, 22 nt, Mycobacterium tuberculosis H37Rv
cguccagggcgacgagaucugc

SEQ ID NO: 1318000 - RNA, 13 nt, Mycobacterium tuberculosis H37Rv
cguccagggcgcc

SEQ ID NO: 1318001 - RNA, 16 nt, Mycobacterium tuberculosis H37Rv
cguccagccguggcgg

SEQ ID NO: 1318002 - RNA, 19 nt, Mycobacterium tuberculosis H37Rv
cguccagcccagauccagc

SEQ ID NO: 1318003 - RNA, 18 nt, Mycobacterium tuberculosis H37Rv
cguccagcagcucggggc

SEQ ID NO: 1318004 - RNA, 17 nt, Mycobacterium tuberculosis H37Rv
cguccagcccagaucca

SEQ ID NO: 1318005 - RNA, 16 nt, Mycobacterium tuberculosis H37Rv
cguccagcgccgcggc

SEQ ID NO: 1318006 - RNA, 12 nt, Mycobacterium tuberculosis H37Rv
cgucccgcccgg

SEQ ID NO: 1318007 - RNA, 17 nt, Mycobacterium tuberculosis H37Rv
cgucccgcccggaugcg

SEQ ID NO: 1318008 - RNA, 15 nt, Mycobacterium tuberculosis H37Rv
cgucccgccggcccc

SEQ ID NO: 1318009 - RNA, 17 nt, Mycobacterium tuberculosis H37Rv
cgucccgccggccccgc

SEQ ID NO: 1318010 - RNA, 20 nt, Mycobacterium tuberculosis H37Rv
cgucccgcgagcagcccggc

SEQ ID NO: 1318011 - RNA, 22 nt, Mycobacterium tuberculosis H37Rv
cgucccgcgagcagcccggcga

SEQ ID NO: 1318012 - RNA, 18 nt, Mycobacterium tuberculosis H37Rv
cgucccgauacggccggc

SEQ ID NO: 1318013 - RNA, 19 nt, Mycobacterium tuberculosis H37Rv
cgucccgauacggccggcc

SEQ ID NO: 1318014 - RNA, 17 nt, Mycobacterium tuberculosis H37Rv
cgucccggaaaaaguca

SEQ ID NO: 1318015 - RNA, 15 nt, Mycobacterium tuberculosis H37Rv
cgucccggcgaccgg

SEQ ID NO: 1318016 - RNA, 22 nt, Mycobacterium tuberculosis H37Rv
cgucccgauggcgguggggcug

SEQ ID NO: 1318017 - RNA, 14 nt, Mycobacterium tuberculosis H37Rv
cguccccaccgacg

SEQ ID NO: 1318018 - RNA, 18 nt, Mycobacterium tuberculosis H37Rv
cguccccaccgacgccga

SEQ ID NO: 1318019 - RNA, 12 nt, Mycobacterium tuberculosis H37Rv
cguccccgcagc

SEQ ID NO: 1318020 - RNA, 23 nt, Mycobacterium tuberculosis H37Rv
cguccccgccgucgccaccaucg

SEQ ID NO: 1318021 - RNA, 13 nt, Mycobacterium tuberculosis H37Rv
cguccccggccga

SEQ ID NO: 1318022 - RNA, 15 nt, Mycobacterium tuberculosis H37Rv
cguccccgacgucag

SEQ ID NO: 1318023 - RNA, 12 nt, Mycobacterium tuberculosis H37Rv
cgucccagaagu

SEQ ID NO: 1318024 - RNA, 14 nt, Mycobacterium tuberculosis H37Rv
cgucccagagaauc

SEQ ID NO: 1318025 - RNA, 19 nt, Mycobacterium tuberculosis H37Rv
cgucccagagaaucagcgu

SEQ ID NO: 1318026 - RNA, 21 nt, Mycobacterium tuberculosis H37Rv
cgucccaggacuccggccgca

SEQ ID NO: 1318027 - RNA, 13 nt, Mycobacterium tuberculosis H37Rv
cgucccagcgccg

SEQ ID NO: 1318028 - RNA, 22 nt, Mycobacterium tuberculosis H37Rv
cguccaucgcgucgucuucuuc

SEQ ID NO: 1318029 - RNA, 16 nt, Mycobacterium tuberculosis H37Rv
cguccaucgcgcgccg

SEQ ID NO: 1318030 - RNA, 22 nt, Mycobacterium tuberculosis H37Rv
cguccaguggcagccagcggcg

SEQ ID NO: 1318031 - RNA, 18 nt, Mycobacterium tuberculosis H37Rv
cguccgcgggcggaggcc

SEQ ID NO: 1318032 - RNA, 21 nt, Mycobacterium tuberculosis H37Rv
cguccgcgggggaccgcccga

SEQ ID NO: 1318033 - RNA, 18 nt, Mycobacterium tuberculosis H37Rv
cguccgcggucgcagcag

SEQ ID NO: 1318034 - RNA, 18 nt, Mycobacterium tuberculosis H37Rv
cguccggaucggucggca

SEQ ID NO: 1318035 - RNA, 14 nt, Mycobacterium tuberculosis H37Rv
cguccggcgccugc

SEQ ID NO: 1318036 - RNA, 17 nt, Mycobacterium tuberculosis H37Rv
cguccggcgccugcugc

SEQ ID NO: 1318037 - RNA, 18 nt, Mycobacterium tuberculosis H37Rv
cguccgguggaccgccga

SEQ ID NO: 1318038 - RNA, 23 nt, Mycobacterium tuberculosis H37Rv
cguccggucgccucaccggcgcg

SEQ ID NO: 1318039 - RNA, 18 nt, Mycobacterium tuberculosis H37Rv
cguccggucgccucaccg

SEQ ID NO: 1318040 - RNA, 18 nt, Mycobacterium tuberculosis H37Rv
cguccgggcggccucccg

SEQ ID NO: 1318041 - RNA, 20 nt, Mycobacterium tuberculosis H37Rv
cguccgggcggccucccggg

SEQ ID NO: 1318042 - RNA, 16 nt, Mycobacterium tuberculosis H37Rv
cguccgggaucucccc

SEQ ID NO: 1318043 - RNA, 15 nt, Mycobacterium tuberculosis H37Rv
cguccgccugcaccg

SEQ ID NO: 1318044 - RNA, 18 nt, Mycobacterium tuberculosis H37Rv
cguccgccugcaccgccg

SEQ ID NO: 1318045 - RNA, 15 nt, Mycobacterium tuberculosis H37Rv
cguccgcccagcacc

SEQ ID NO: 1318046 - RNA, 17 nt, Mycobacterium tuberculosis H37Rv
cguccgcccagccgcag

SEQ ID NO: 1318047 - RNA, 20 nt, Mycobacterium tuberculosis H37Rv
cguccgcccagccgcagcac

SEQ ID NO: 1318048 - RNA, 14 nt, Mycobacterium tuberculosis H37Rv
cguccgccgcagcg

SEQ ID NO: 1318049 - RNA, 14 nt, Mycobacterium tuberculosis H37Rv
cguccgcccagcac

SEQ ID NO: 1318050 - RNA, 20 nt, Mycobacterium tuberculosis H37Rv
cguccgcaccggcggcgccg

SEQ ID NO: 1318051 - RNA, 16 nt, Mycobacterium tuberculosis H37Rv
cguccgaucggcgcgc

SEQ ID NO: 1318052 - RNA, 18 nt, Mycobacterium tuberculosis H37Rv
cguccuuuuccgccgggc

SEQ ID NO: 1318053 - RNA, 14 nt, Mycobacterium tuberculosis H37Rv
cguccuuuccagga

SEQ ID NO: 1318054 - RNA, 13 nt, Mycobacterium tuberculosis H37Rv
cgucgaagcacau

SEQ ID NO: 1318055 - RNA, 19 nt, Mycobacterium tuberculosis H37Rv
cgucgacaacgaucgcgcg

SEQ ID NO: 1318056 - RNA, 14 nt, Mycobacterium tuberculosis H37Rv
cgucgaauuccggc

SEQ ID NO: 1318057 - RNA, 14 nt, Mycobacterium tuberculosis H37Rv
cgucgaccaggcca

SEQ ID NO: 1318058 - RNA, 13 nt, Mycobacterium tuberculosis H37Rv
cgucgaccaggcc

SEQ ID NO: 1318059 - RNA, 11 nt, Mycobacterium tuberculosis H37Rv
cgucgaccagg

SEQ ID NO: 1318060 - RNA, 13 nt, Mycobacterium tuberculosis H37Rv
cgucgacacggug

SEQ ID NO: 1318061 - RNA, 14 nt, Mycobacterium tuberculosis H37Rv
cguccgucggcgcu

SEQ ID NO: 1318062 - RNA, 18 nt, Mycobacterium tuberculosis H37Rv
cguccugccaguccgcag

SEQ ID NO: 1318063 - RNA, 21 nt, Mycobacterium tuberculosis H37Rv
cguccugacgguacagcucca

SEQ ID NO: 1318064 - RNA, 15 nt, Mycobacterium tuberculosis H37Rv
cguccuucgcuggua

SEQ ID NO: 1318065 - RNA, 14 nt, Mycobacterium tuberculosis H37Rv
cgucggcgaaggug

SEQ ID NO: 1318066 - RNA, 20 nt, Mycobacterium tuberculosis H37Rv
cgucggcgagcagacgccgc

SEQ ID NO: 1318067 - RNA, 13 nt, Mycobacterium tuberculosis H37Rv
cgucggcgcggcc

SEQ ID NO: 1318068 - RNA, 17 nt, Mycobacterium tuberculosis H37Rv
cgucggcgccggcggcc

SEQ ID NO: 1318069 - RNA, 20 nt, Mycobacterium tuberculosis H37Rv
cgucggccgacaccgccacc

SEQ ID NO: 1318070 - RNA, 16 nt, Mycobacterium tuberculosis H37Rv
cgucggccgacaccgc

SEQ ID NO: 1318071 - RNA, 17 nt, Mycobacterium tuberculosis H37Rv
cgucggccgaacaaccu

SEQ ID NO: 1318072 - RNA, 22 nt, Mycobacterium tuberculosis H37Rv
cgucggccaugguguucggcag

SEQ ID NO: 1318073 - RNA, 12 nt, Mycobacterium tuberculosis H37Rv
cgucggccugga

SEQ ID NO: 1318074 - RNA, 15 nt, Mycobacterium tuberculosis H37Rv
cgucggccgcgcugc

SEQ ID NO: 1318075 - RNA, 20 nt, Mycobacterium tuberculosis H37Rv
cgucgcuguaggccagcccg

SEQ ID NO: 1318076 - RNA, 21 nt, Mycobacterium tuberculosis H37Rv
cgucgcuuggaucgucgcugu

SEQ ID NO: 1318077 - RNA, 22 nt, Mycobacterium tuberculosis H37Rv
cgucgcuuggaucgucgcugug

SEQ ID NO: 1318078 - RNA, 13 nt, Mycobacterium tuberculosis H37Rv
cgucgcuugcugg

SEQ ID NO: 1318079 - RNA, 20 nt, Mycobacterium tuberculosis H37Rv
cgucgcuucggcaccgacug

SEQ ID NO: 1318080 - RNA, 21 nt, Mycobacterium tuberculosis H37Rv
cgucggaauacaacagcuggg

SEQ ID NO: 1318081 - RNA, 15 nt, Mycobacterium tuberculosis H37Rv
cgucggacagcuuuc

SEQ ID NO: 1318082 - RNA, 16 nt, Mycobacterium tuberculosis H37Rv
cgucggagccggccac

SEQ ID NO: 1318083 - RNA, 17 nt, Mycobacterium tuberculosis H37Rv
cgucggcaccagcagcc

SEQ ID NO: 1318084 - RNA, 14 nt, Mycobacterium tuberculosis H37Rv
cgucggcagcagcg

SEQ ID NO: 1318085 - RNA, 14 nt, Mycobacterium tuberculosis H37Rv
cgucggaccagcug

SEQ ID NO: 1318086 - RNA, 17 nt, Mycobacterium tuberculosis H37Rv
cgucggccagcagcaau

SEQ ID NO: 1318087 - RNA, 24 nt, Mycobacterium tuberculosis H37Rv
cgucggccacccgguccaccgacc

SEQ ID NO: 1318088 - RNA, 14 nt, Mycobacterium tuberculosis H37Rv
cgucggccagcagc

SEQ ID NO: 1318089 - RNA, 23 nt, Mycobacterium tuberculosis H37Rv
cgucggcaugggccggcgccgca

SEQ ID NO: 1318090 - RNA, 22 nt, Mycobacterium tuberculosis H37Rv
cgucggcaccgguuuucgccgg

SEQ ID NO: 1318091 - RNA, 16 nt, Mycobacterium tuberculosis H37Rv
cgucggcauugcgcag

SEQ ID NO: 1318092 - RNA, 20 nt, Mycobacterium tuberculosis H37Rv
cgucgccggucaggccgccg

SEQ ID NO: 1318093 - RNA, 20 nt, Mycobacterium tuberculosis H37Rv
cgucgccgucggugccgccg

SEQ ID NO: 1318094 - RNA, 14 nt, Mycobacterium tuberculosis H37Rv
cgucgccgugcugu

SEQ ID NO: 1318095 - RNA, 18 nt, Mycobacterium tuberculosis H37Rv
cgucgcgacgucggccgu

SEQ ID NO: 1318096 - RNA, 19 nt, Mycobacterium tuberculosis H37Rv
cgucgcgauccacuccggc

SEQ ID NO: 1318097 - RNA, 22 nt, Mycobacterium tuberculosis H37Rv
cgucgcgccgcgugguuccggc

SEQ ID NO: 1318098 - RNA, 22 nt, Mycobacterium tuberculosis H37Rv
cgucgcugccccuugggcucga

SEQ ID NO: 1318099 - RNA, 15 nt, Mycobacterium tuberculosis H37Rv
cgucgcugagcagcg

SEQ ID NO: 1318100 - RNA, 22 nt, Mycobacterium tuberculosis H37Rv
cgucgcucacggcccgagccgc

SEQ ID NO: 1318101 - RNA, 14 nt, Mycobacterium tuberculosis H37Rv
cgucgcugacgccc

SEQ ID NO: 1318102 - RNA, 19 nt, Mycobacterium tuberculosis H37Rv
cgucgcugacgcccuccug

SEQ ID NO: 1318103 - RNA, 20 nt, Mycobacterium tuberculosis H37Rv
cgucgcggguaaccggcucc

SEQ ID NO: 1318104 - RNA, 22 nt, Mycobacterium tuberculosis H37Rv
cgucgcggaaucgcgacacgcg

SEQ ID NO: 1318105 - RNA, 22 nt, Mycobacterium tuberculosis H37Rv
cgucgcguuggcgguagacacc

SEQ ID NO: 1318106 - RNA, 15 nt, Mycobacterium tuberculosis H37Rv
cgucgcgcugccggc

SEQ ID NO: 1318107 - RNA, 19 nt, Mycobacterium tuberculosis H37Rv
cgucgcggaguagccgcag

SEQ ID NO: 1318108 - RNA, 20 nt, Mycobacterium tuberculosis H37Rv
cgucgcggaguagccgcagc

SEQ ID NO: 1318109 - RNA, 15 nt, Mycobacterium tuberculosis H37Rv
cgucgcggccagcag

SEQ ID NO: 1318110 - RNA, 19 nt, Mycobacterium tuberculosis H37Rv
cgucgcggccgagacggcg

SEQ ID NO: 1318111 - RNA, 17 nt, Mycobacterium tuberculosis H37Rv
cgucgcggccggcggcc

SEQ ID NO: 1318112 - RNA, 19 nt, Mycobacterium tuberculosis H37Rv
cgucgcgcucgcaccacca

SEQ ID NO: 1318113 - RNA, 14 nt, Mycobacterium tuberculosis H37Rv
cgucgagcgcgucg

SEQ ID NO: 1318114 - RNA, 19 nt, Mycobacterium tuberculosis H37Rv
cgucgagcgcgucggucac

SEQ ID NO: 1318115 - RNA, 13 nt, Mycobacterium tuberculosis H37Rv
cgucgaggcggca

SEQ ID NO: 1318116 - RNA, 20 nt, Mycobacterium tuberculosis H37Rv
cgucgaggaagaucaccucc

SEQ ID NO: 1318117 - RNA, 14 nt, Mycobacterium tuberculosis H37Rv
cgucgaggcugacc

SEQ ID NO: 1318118 - RNA, 17 nt, Mycobacterium tuberculosis H37Rv
cgucgagggagcgccgc

SEQ ID NO: 1318119 - RNA, 16 nt, Mycobacterium tuberculosis H37Rv
cgucgaggucagcucc

SEQ ID NO: 1318120 - RNA, 16 nt, Mycobacterium tuberculosis H37Rv
cgucgagguucucccg

SEQ ID NO: 1318121 - RNA, 22 nt, Mycobacterium tuberculosis H37Rv
cgucgaguccaggccggcagcu

SEQ ID NO: 1318122 - RNA, 21 nt, Mycobacterium tuberculosis H37Rv
cgucgagucgccgaggacgcc

SEQ ID NO: 1318123 - RNA, 22 nt, Mycobacterium tuberculosis H37Rv
cgucgaguagugcaggugcccg

SEQ ID NO: 1318124 - RNA, 18 nt, Mycobacterium tuberculosis H37Rv
cgucgaguuuugcggcca

SEQ ID NO: 1318125 - RNA, 17 nt, Mycobacterium tuberculosis H37Rv
cgucgaguuccggccgg

SEQ ID NO: 1318126 - RNA, 14 nt, Mycobacterium tuberculosis H37Rv
cgucgagcagcgcc

SEQ ID NO: 1318127 - RNA, 13 nt, Mycobacterium tuberculosis H37Rv
cgucgagcagccg

SEQ ID NO: 1318128 - RNA, 14 nt, Mycobacterium tuberculosis H37Rv
cgucgagcaccucc

SEQ ID NO: 1318129 - RNA, 14 nt, Mycobacterium tuberculosis H37Rv
cgucgacgagcgcc

SEQ ID NO: 1318130 - RNA, 12 nt, Mycobacterium tuberculosis H37Rv
cgucgagcgcgc

SEQ ID NO: 1318131 - RNA, 14 nt, Mycobacterium tuberculosis H37Rv
cgucgagccgccag

SEQ ID NO: 1318132 - RNA, 12 nt, Mycobacterium tuberculosis H37Rv
cgucgagcgcgu

SEQ ID NO: 1318133 - RNA, 22 nt, Mycobacterium tuberculosis H37Rv
cgucgaccuguugucguggcgg

SEQ ID NO: 1318134 - RNA, 15 nt, Mycobacterium tuberculosis H37Rv
cgucgaccggcggga

SEQ ID NO: 1318135 - RNA, 21 nt, Mycobacterium tuberculosis H37Rv
cgucgaccgugucaccgccgg

SEQ ID NO: 1318136 - RNA, 14 nt, Mycobacterium tuberculosis H37Rv
cgucgaccggcggg

SEQ ID NO: 1318137 - RNA, 15 nt, Mycobacterium tuberculosis H37Rv
cgucgaccgcggccc

SEQ ID NO: 1318138 - RNA, 18 nt, Mycobacterium tuberculosis H37Rv
cgucgacaacgaucgcgc

SEQ ID NO: 1318139 - RNA, 21 nt, Mycobacterium tuberculosis H37Rv
cgucgacccccugccacagcg

SEQ ID NO: 1318140 - RNA, 18 nt, Mycobacterium tuberculosis H37Rv
cgucgccgacccgggggc

SEQ ID NO: 1318141 - RNA, 13 nt, Mycobacterium tuberculosis H37Rv
cgucgccaugcug

SEQ ID NO: 1318142 - RNA, 13 nt, Mycobacterium tuberculosis H37Rv
cgucgccccacca

SEQ ID NO: 1318143 - RNA, 14 nt, Mycobacterium tuberculosis H37Rv
cgucgcccagcgug

SEQ ID NO: 1318144 - RNA, 15 nt, Mycobacterium tuberculosis H37Rv
cgucgccggccccgc

SEQ ID NO: 1318145 - RNA, 16 nt, Mycobacterium tuberculosis H37Rv
cgucgccgcggcggca

SEQ ID NO: 1318146 - RNA, 13 nt, Mycobacterium tuberculosis H37Rv
cgucgccgcccgu

SEQ ID NO: 1318147 - RNA, 18 nt, Mycobacterium tuberculosis H37Rv
cgucgccgccggcgccgc

SEQ ID NO: 1318148 - RNA, 16 nt, Mycobacterium tuberculosis H37Rv
cgucgccgccgguccc

SEQ ID NO: 1318149 - RNA, 11 nt, Mycobacterium tuberculosis H37Rv
cgucgccgccg

SEQ ID NO: 1318150 - RNA, 13 nt, Mycobacterium tuberculosis H37Rv
cgucgccgccgcu

SEQ ID NO: 1318151 - RNA, 16 nt, Mycobacterium tuberculosis H37Rv
cgucgccgccggcgcc

SEQ ID NO: 1318152 - RNA, 15 nt, Mycobacterium tuberculosis H37Rv
cgucgaugucauccg

SEQ ID NO: 1318153 - RNA, 15 nt, Mycobacterium tuberculosis H37Rv
cgucgaugucgccgc

SEQ ID NO: 1318154 - RNA, 14 nt, Mycobacterium tuberculosis H37Rv
cgucgcaacggccc

SEQ ID NO: 1318155 - RNA, 19 nt, Mycobacterium tuberculosis H37Rv
cgucgcaacguguccgcag

SEQ ID NO: 1318156 - RNA, 22 nt, Mycobacterium tuberculosis H37Rv
cgucgcaacguguccgcagucc

SEQ ID NO: 1318157 - RNA, 21 nt, Mycobacterium tuberculosis H37Rv
cgucgcaauaugccacagacc

SEQ ID NO: 1318158 - RNA, 19 nt, Mycobacterium tuberculosis H37Rv
cgucgauguauccgaugcg

SEQ ID NO: 1318159 - RNA, 17 nt, Mycobacterium tuberculosis H37Rv
cgucgauggucuccgga

SEQ ID NO: 1318160 - RNA, 14 nt, Mycobacterium tuberculosis H37Rv
cgucgaugucgucg

SEQ ID NO: 1318161 - RNA, 15 nt, Mycobacterium tuberculosis H37Rv
cgucgcaucaccagg

SEQ ID NO: 1318162 - RNA, 23 nt, Mycobacterium tuberculosis H37Rv
cgucgcacccaacuccaucagcg

SEQ ID NO: 1318163 - RNA, 12 nt, Mycobacterium tuberculosis H37Rv
cgucgccaccga

SEQ ID NO: 1318164 - RNA, 17 nt, Mycobacterium tuberculosis H37Rv
cgucgccaagcccaggc

SEQ ID NO: 1318165 - RNA, 18 nt, Mycobacterium tuberculosis H37Rv
cgugccgcccgccucugu

SEQ ID NO: 1318166 - RNA, 17 nt, Mycobacterium tuberculosis H37Rv
cgugccgcccggucggg

SEQ ID NO: 1318167 - RNA, 19 nt, Mycobacterium tuberculosis H37Rv
cgugccgccgacaccaccg

SEQ ID NO: 1318168 - RNA, 21 nt, Mycobacterium tuberculosis H37Rv
cgugccgccgaugccgccggc

SEQ ID NO: 1318169 - RNA, 12 nt, Mycobacterium tuberculosis H37Rv
cgugccgcagcg

SEQ ID NO: 1318170 - RNA, 20 nt, Mycobacterium tuberculosis H37Rv
cgugcccguauaaccggcca

SEQ ID NO: 1318171 - RNA, 18 nt, Mycobacterium tuberculosis H37Rv
cgugccgaccaccagcau

SEQ ID NO: 1318172 - RNA, 13 nt, Mycobacterium tuberculosis H37Rv
cgugccgaccagc

SEQ ID NO: 1318173 - RNA, 15 nt, Mycobacterium tuberculosis H37Rv
cgugccgaccagcau

SEQ ID NO: 1318174 - RNA, 18 nt, Mycobacterium tuberculosis H37Rv
cgugccgaugccggcgag

SEQ ID NO: 1318175 - RNA, 12 nt, Mycobacterium tuberculosis H37Rv
cgugccgcacag

SEQ ID NO: 1318176 - RNA, 14 nt, Mycobacterium tuberculosis H37Rv
cgugccgcacagcg

SEQ ID NO: 1318177 - RNA, 22 nt, Mycobacterium tuberculosis H37Rv
cgugccgggccauucaccgcgc

SEQ ID NO: 1318178 - RNA, 18 nt, Mycobacterium tuberculosis H37Rv
cgugccggggcugccgaa

SEQ ID NO: 1318179 - RNA, 14 nt, Mycobacterium tuberculosis H37Rv
cgugccgguccccc

SEQ ID NO: 1318180 - RNA, 13 nt, Mycobacterium tuberculosis H37Rv
cgugccagcgccc

SEQ ID NO: 1318181 - RNA, 23 nt, Mycobacterium tuberculosis H37Rv
cgugccgaacgccagaccgccga

SEQ ID NO: 1318182 - RNA, 16 nt, Mycobacterium tuberculosis H37Rv
cgugcccgccaccggc

SEQ ID NO: 1318183 - RNA, 18 nt, Mycobacterium tuberculosis H37Rv
cgugccccgggcccaggu

SEQ ID NO: 1318184 - RNA, 20 nt, Mycobacterium tuberculosis H37Rv
cgugcagggcauugcggccc

SEQ ID NO: 1318185 - RNA, 19 nt, Mycobacterium tuberculosis H37Rv
cgugcacaggucagcgcug

SEQ ID NO: 1318186 - RNA, 15 nt, Mycobacterium tuberculosis H37Rv
cgugcaaccacggcg

SEQ ID NO: 1318187 - RNA, 17 nt, Mycobacterium tuberculosis H37Rv
cgugcacggcggccagg

SEQ ID NO: 1318188 - RNA, 15 nt, Mycobacterium tuberculosis H37Rv
cgugcaccagcucac

SEQ ID NO: 1318189 - RNA, 14 nt, Mycobacterium tuberculosis H37Rv
cgugcaccgcgacc

SEQ ID NO: 1318190 - RNA, 20 nt, Mycobacterium tuberculosis H37Rv
cgugcaccgcgaccgcgcac

SEQ ID NO: 1318191 - RNA, 15 nt, Mycobacterium tuberculosis H37Rv
cgugcacgcugagcc

SEQ ID NO: 1318192 - RNA, 15 nt, Mycobacterium tuberculosis H37Rv
cgugagugcagcacg

SEQ ID NO: 1318193 - RNA, 21 nt, Mycobacterium tuberculosis H37Rv
cgugaggucccggcugggauc

SEQ ID NO: 1318194 - RNA, 15 nt, Mycobacterium tuberculosis H37Rv
cgugagcggccaggu

SEQ ID NO: 1318195 - RNA, 16 nt, Mycobacterium tuberculosis H37Rv
cgugagccaugccgcu

SEQ ID NO: 1318196 - RNA, 17 nt, Mycobacterium tuberculosis H37Rv
cgugagcaccagcagca

SEQ ID NO: 1318197 - RNA, 13 nt, Mycobacterium tuberculosis H37Rv
cgugagcaccagc

SEQ ID NO: 1318198 - RNA, 14 nt, Mycobacterium tuberculosis H37Rv
cgugagccagcuug

SEQ ID NO: 1318199 - RNA, 22 nt, Mycobacterium tuberculosis H37Rv
cgugaucaacuuccgcagcgcc

SEQ ID NO: 1318200 - RNA, 17 nt, Mycobacterium tuberculosis H37Rv
cgugaucggcgaaccca

SEQ ID NO: 1318201 - RNA, 15 nt, Mycobacterium tuberculosis H37Rv
cgugaucuggccgaa

SEQ ID NO: 1318202 - RNA, 23 nt, Mycobacterium tuberculosis H37Rv
cgugaugucaacgugucccaagc

SEQ ID NO: 1318203 - RNA, 15 nt, Mycobacterium tuberculosis H37Rv
cgugaauggcagcac

SEQ ID NO: 1318204 - RNA, 19 nt, Mycobacterium tuberculosis H37Rv
cgugaccaccgccgacagg

SEQ ID NO: 1318205 - RNA, 17 nt, Mycobacterium tuberculosis H37Rv
cgugacauucugcagcg

SEQ ID NO: 1318206 - RNA, 13 nt, Mycobacterium tuberculosis H37Rv
cgugacagcggcg

SEQ ID NO: 1318207 - RNA, 15 nt, Mycobacterium tuberculosis H37Rv
cgugacagcggcgau

SEQ ID NO: 1318208 - RNA, 21 nt, Mycobacterium tuberculosis H37Rv
cgugaacggcgcgggccacca

SEQ ID NO: 1318209 - RNA, 12 nt, Mycobacterium tuberculosis H37Rv
cgugagaggcca

SEQ ID NO: 1318210 - RNA, 15 nt, Mycobacterium tuberculosis H37Rv
cgugagaccuagcag

SEQ ID NO: 1318211 - RNA, 13 nt, Mycobacterium tuberculosis H37Rv
cgugagacgccgu

SEQ ID NO: 1318212 - RNA, 14 nt, Mycobacterium tuberculosis H37Rv
cgugacccuggggu

SEQ ID NO: 1318213 - RNA, 17 nt, Mycobacterium tuberculosis H37Rv
cgugaccgagccgcgau

SEQ ID NO: 1318214 - RNA, 14 nt, Mycobacterium tuberculosis H37Rv
cgugaccgagccgc

SEQ ID NO: 1318215 - RNA, 13 nt, Mycobacterium tuberculosis H37Rv
cgugacgaccagc

SEQ ID NO: 1318216 - RNA, 20 nt, Mycobacterium tuberculosis H37Rv
cgugacgaccagccccgcug

SEQ ID NO: 1318217 - RNA, 19 nt, Mycobacterium tuberculosis H37Rv
cgugacgaguucgcugacc

SEQ ID NO: 1318218 - RNA, 15 nt, Mycobacterium tuberculosis H37Rv
cgucguaguccaggc

SEQ ID NO: 1318219 - RNA, 15 nt, Mycobacterium tuberculosis H37Rv
cgucguaugcgguga

SEQ ID NO: 1318220 - RNA, 15 nt, Mycobacterium tuberculosis H37Rv
cgucgucccagcgcg

SEQ ID NO: 1318221 - RNA, 17 nt, Mycobacterium tuberculosis H37Rv
cgucguacucggcggcc

SEQ ID NO: 1318222 - RNA, 16 nt, Mycobacterium tuberculosis H37Rv
cgucguacaugggcag

SEQ ID NO: 1318223 - RNA, 14 nt, Mycobacterium tuberculosis H37Rv
cgucguacucggcg

SEQ ID NO: 1318224 - RNA, 18 nt, Mycobacterium tuberculosis H37Rv
cgucggugcgcgcggcga

SEQ ID NO: 1318225 - RNA, 15 nt, Mycobacterium tuberculosis H37Rv
cgucggugccgccgc

SEQ ID NO: 1318226 - RNA, 16 nt, Mycobacterium tuberculosis H37Rv
cgucggugccaccacg

SEQ ID NO: 1318227 - RNA, 21 nt, Mycobacterium tuberculosis H37Rv
cgucggugagcugcgccagaa

SEQ ID NO: 1318228 - RNA, 21 nt, Mycobacterium tuberculosis H37Rv
cgucggguuccuccucggcag

SEQ ID NO: 1318229 - RNA, 20 nt, Mycobacterium tuberculosis H37Rv
cgucggucucaugcacccgg

SEQ ID NO: 1318230 - RNA, 23 nt, Mycobacterium tuberculosis H37Rv
cgucggucgacuguucgggaugc

SEQ ID NO: 1318231 - RNA, 13 nt, Mycobacterium tuberculosis H37Rv
cgucggcgcggcu

SEQ ID NO: 1318232 - RNA, 14 nt, Mycobacterium tuberculosis H37Rv
cgucgggcacaccg

SEQ ID NO: 1318233 - RNA, 23 nt, Mycobacterium tuberculosis H37Rv
cgucgggcaccgccaaaaacgcc

SEQ ID NO: 1318234 - RNA, 12 nt, Mycobacterium tuberculosis H37Rv
cgucgggcaccg

SEQ ID NO: 1318235 - RNA, 19 nt, Mycobacterium tuberculosis H37Rv
cgucggggaguucgcgcag

SEQ ID NO: 1318236 - RNA, 17 nt, Mycobacterium tuberculosis H37Rv
cgucggguccgcggccc

SEQ ID NO: 1318237 - RNA, 19 nt, Mycobacterium tuberculosis H37Rv
cgucgggaacuucuccgag

SEQ ID NO: 1318238 - RNA, 18 nt, Mycobacterium tuberculosis H37Rv
cgucggcguacagcgccu

SEQ ID NO: 1318239 - RNA, 15 nt, Mycobacterium tuberculosis H37Rv
cgucggcgggcggca

SEQ ID NO: 1318240 - RNA, 21 nt, Mycobacterium tuberculosis H37Rv
cgucggcggcgaacagcccca

SEQ ID NO: 1318241 - RNA, 22 nt, Mycobacterium tuberculosis H37Rv
cgucggcggcgaacagccccag

SEQ ID NO: 1318242 - RNA, 15 nt, Mycobacterium tuberculosis H37Rv
cgucuccaccgcgau

SEQ ID NO: 1318243 - RNA, 18 nt, Mycobacterium tuberculosis H37Rv
cgucuccggcgccaccgc

SEQ ID NO: 1318244 - RNA, 22 nt, Mycobacterium tuberculosis H37Rv
cgucucgacaguggcgacggac

SEQ ID NO: 1318245 - RNA, 17 nt, Mycobacterium tuberculosis H37Rv
cgucucgaagcucagcu

SEQ ID NO: 1318246 - RNA, 18 nt, Mycobacterium tuberculosis H37Rv
cgucucgagcgcgccgcg

SEQ ID NO: 1318247 - RNA, 18 nt, Mycobacterium tuberculosis H37Rv
cgucuaccccgagccuug

SEQ ID NO: 1318248 - RNA, 17 nt, Mycobacterium tuberculosis H37Rv
cgucuaucuggucgggu

SEQ ID NO: 1318249 - RNA, 18 nt, Mycobacterium tuberculosis H37Rv
cgucguugcccgacccgc

SEQ ID NO: 1318250 - RNA, 16 nt, Mycobacterium tuberculosis H37Rv
cgucguugaggaagcc

SEQ ID NO: 1318251 - RNA, 13 nt, Mycobacterium tuberculosis H37Rv
cgucguugaggaa

SEQ ID NO: 1318252 - RNA, 20 nt, Mycobacterium tuberculosis H37Rv
cgucguucgagaccccgacg

SEQ ID NO: 1318253 - RNA, 14 nt, Mycobacterium tuberculosis H37Rv
cgucguugucgucg

SEQ ID NO: 1318254 - RNA, 18 nt, Mycobacterium tuberculosis H37Rv
cgucgucguuucgccagc

SEQ ID NO: 1318255 - RNA, 18 nt, Mycobacterium tuberculosis H37Rv
cgucgucgucgacggccu

SEQ ID NO: 1318256 - RNA, 17 nt, Mycobacterium tuberculosis H37Rv
cgucgucgucggcagcg

SEQ ID NO: 1318257 - RNA, 14 nt, Mycobacterium tuberculosis H37Rv
cgucgucgugcacg

SEQ ID NO: 1318258 - RNA, 23 nt, Mycobacterium tuberculosis H37Rv
cgucgucgccgccgaaaaccucg

SEQ ID NO: 1318259 - RNA, 15 nt, Mycobacterium tuberculosis H37Rv
cgucgucggcaggca

SEQ ID NO: 1318260 - RNA, 16 nt, Mycobacterium tuberculosis H37Rv
cgucguucgcgggugc

SEQ ID NO: 1318261 - RNA, 15 nt, Mycobacterium tuberculosis H37Rv
cgucguggucggcga

SEQ ID NO: 1318262 - RNA, 14 nt, Mycobacterium tuberculosis H37Rv
cgucgugucgccgc

SEQ ID NO: 1318263 - RNA, 15 nt, Mycobacterium tuberculosis H37Rv
cgucguggaucuucg

SEQ ID NO: 1318264 - RNA, 14 nt, Mycobacterium tuberculosis H37Rv
cgucgugccaccgu

SEQ ID NO: 1318265 - RNA, 19 nt, Mycobacterium tuberculosis H37Rv
cgucgugcacgacgacauc

SEQ ID NO: 1318266 - RNA, 14 nt, Mycobacterium tuberculosis H37Rv
cgucgugcacggcg

SEQ ID NO: 1318267 - RNA, 19 nt, Mycobacterium tuberculosis H37Rv
cgucgugcacggcggccag

SEQ ID NO: 1318268 - RNA, 18 nt, Mycobacterium tuberculosis H37Rv
cgucucgcccccucuagc

SEQ ID NO: 1318269 - RNA, 15 nt, Mycobacterium tuberculosis H37Rv
cgucucgccgcgcac

SEQ ID NO: 1318270 - RNA, 14 nt, Mycobacterium tuberculosis H37Rv
cgucucggccagcu

SEQ ID NO: 1318271 - RNA, 20 nt, Mycobacterium tuberculosis H37Rv
cgucucggccagcucggccu

SEQ ID NO: 1318272 - RNA, 23 nt, Mycobacterium tuberculosis H37Rv
cgucucggccagcucggccuggu

SEQ ID NO: 1318273 - RNA, 18 nt, Mycobacterium tuberculosis H37Rv
cgucucggugcagcagcg

SEQ ID NO: 1318274 - RNA, 15 nt, Mycobacterium tuberculosis H37Rv
cgucucggugaucuc

SEQ ID NO: 1318275 - RNA, 16 nt, Mycobacterium tuberculosis H37Rv
cgucucggugcagcag

SEQ ID NO: 1318276 - RNA, 16 nt, Mycobacterium tuberculosis H37Rv
cgucucgguggcugcg

SEQ ID NO: 1318277 - RNA, 14 nt, Mycobacterium tuberculosis H37Rv
cgucucggugguga

SEQ ID NO: 1318278 - RNA, 15 nt, Mycobacterium tuberculosis H37Rv
cgucugcccgcccag

SEQ ID NO: 1318279 - RNA, 17 nt, Mycobacterium tuberculosis H37Rv
cgucugccaggcgcagc

SEQ ID NO: 1318280 - RNA, 14 nt, Mycobacterium tuberculosis H37Rv
cgucugccaggcgc

SEQ ID NO: 1318281 - RNA, 22 nt, Mycobacterium tuberculosis H37Rv
cgucugccacgucggcgaacgg

SEQ ID NO: 1318282 - RNA, 19 nt, Mycobacterium tuberculosis H37Rv
cgucugcacguacucggcc

SEQ ID NO: 1318283 - RNA, 21 nt, Mycobacterium tuberculosis H37Rv
cgucuggaguucgucaccguu

SEQ ID NO: 1318284 - RNA, 22 nt, Mycobacterium tuberculosis H37Rv
cgucuggucagccgcggcggca

SEQ ID NO: 1318285 - RNA, 15 nt, Mycobacterium tuberculosis H37Rv
cgucugcucggcgga

SEQ ID NO: 1318286 - RNA, 17 nt, Mycobacterium tuberculosis H37Rv
cgucugcuuggcggggc

SEQ ID NO: 1318287 - RNA, 21 nt, Mycobacterium tuberculosis H37Rv
cgucugcucgccagccggccu

SEQ ID NO: 1318288 - RNA, 18 nt, Mycobacterium tuberculosis H37Rv
cgucugcucgccgggcuu

SEQ ID NO: 1318289 - RNA, 22 nt, Mycobacterium tuberculosis H37Rv
cgucugcucgcgaggcucgcgu

SEQ ID NO: 1318290 - RNA, 11 nt, Mycobacterium tuberculosis H37Rv
cgucugcucgg

SEQ ID NO: 1318291 - RNA, 16 nt, Mycobacterium tuberculosis H37Rv
cgucugcggaccggcg

SEQ ID NO: 1318292 - RNA, 20 nt, Mycobacterium tuberculosis H37Rv
cgucugcggaccggcgcgcu

SEQ ID NO: 1318293 - RNA, 18 nt, Mycobacterium tuberculosis H37Rv
cgucugcggggugaguga

SEQ ID NO: 1318294 - RNA, 16 nt, Mycobacterium tuberculosis H37Rv
cgucugcucacgcggu

SEQ ID NO: 1318295 - RNA, 23 nt, Mycobacterium tuberculosis H37Rv
cgucuugauguaaugcgggcgca

SEQ ID NO: 1318296 - RNA, 15 nt, Mycobacterium tuberculosis H37Rv
cgucuuccagccagg

SEQ ID NO: 1318297 - RNA, 23 nt, Mycobacterium tuberculosis H37Rv
cgucuugggccgggaugaagcca

SEQ ID NO: 1318298 - RNA, 19 nt, Mycobacterium tuberculosis H37Rv
cgcgccggcugccacacag

SEQ ID NO: 1318299 - RNA, 16 nt, Mycobacterium tuberculosis H37Rv
cgcgccggguccgcgg

SEQ ID NO: 1318300 - RNA, 17 nt, Mycobacterium tuberculosis H37Rv
cgcgccgguucagacgg

SEQ ID NO: 1318301 - RNA, 17 nt, Mycobacterium tuberculosis H37Rv
cgcgccuaugggccugc

SEQ ID NO: 1318302 - RNA, 24 nt, Mycobacterium tuberculosis H37Rv
cgcgccgucggguuccuccucggc

SEQ ID NO: 1318303 - RNA, 23 nt, Mycobacterium tuberculosis H37Rv
cgccagcaccaccggcucccggg

SEQ ID NO: 1318304 - RNA, 21 nt, Mycobacterium tuberculosis H37Rv
cgcgcgagaacacccgugccu

SEQ ID NO: 1318305 - RNA, 13 nt, Mycobacterium tuberculosis H37Rv
cgcgcgccacggu

SEQ ID NO: 1318306 - RNA, 13 nt, Mycobacterium tuberculosis H37Rv
cgcgcgcacggcg

SEQ ID NO: 1318307 - RNA, 11 nt, Mycobacterium tuberculosis H37Rv
cgcgcgcgcca

SEQ ID NO: 1318308 - RNA, 13 nt, Mycobacterium tuberculosis H37Rv
cgcgcgccgcgac

SEQ ID NO: 1318309 - RNA, 14 nt, Mycobacterium tuberculosis H37Rv
cgcgccugcccggg

SEQ ID NO: 1318310 - RNA, 12 nt, Mycobacterium tuberculosis H37Rv
cgcgccugccuc

SEQ ID NO: 1318311 - RNA, 19 nt, Mycobacterium tuberculosis H37Rv
cgcgccugccucaccgccg

SEQ ID NO: 1318312 - RNA, 21 nt, Mycobacterium tuberculosis H37Rv
cgcgccuuggcacccuccgcc

SEQ ID NO: 1318313 - RNA, 23 nt, Mycobacterium tuberculosis H37Rv
cgcgccuuggcacccuccgccgg

SEQ ID NO: 1318314 - RNA, 13 nt, Mycobacterium tuberculosis H37Rv
cgcgcgacgagca

SEQ ID NO: 1318315 - RNA, 18 nt, Mycobacterium tuberculosis H37Rv
cgcgcgaagaucggcgcu

SEQ ID NO: 1318316 - RNA, 14 nt, Mycobacterium tuberculosis H37Rv
cgcgcgcugggccc

SEQ ID NO: 1318317 - RNA, 14 nt, Mycobacterium tuberculosis H37Rv
cgcgcggaccagag

SEQ ID NO: 1318318 - RNA, 13 nt, Mycobacterium tuberculosis H37Rv
cgcgcggaacacc

SEQ ID NO: 1318319 - RNA, 14 nt, Mycobacterium tuberculosis H37Rv
cgcgcgcugggcgc

SEQ ID NO: 1318320 - RNA, 17 nt, Mycobacterium tuberculosis H37Rv
cgcgcggccagcccacu

SEQ ID NO: 1318321 - RNA, 14 nt, Mycobacterium tuberculosis H37Rv
cgcgcggccgcgcu

SEQ ID NO: 1318322 - RNA, 16 nt, Mycobacterium tuberculosis H37Rv
cgcgcggccagcccac

SEQ ID NO: 1318323 - RNA, 14 nt, Mycobacterium tuberculosis H37Rv
cgcgcggcgccgca

SEQ ID NO: 1318324 - RNA, 15 nt, Mycobacterium tuberculosis H37Rv
cgcgcggcgcagcac

SEQ ID NO: 1318325 - RNA, 15 nt, Mycobacterium tuberculosis H37Rv
cgcgcggcggccgcg

SEQ ID NO: 1318326 - RNA, 15 nt, Mycobacterium tuberculosis H37Rv
cgcgcggguggcggc

SEQ ID NO: 1318327 - RNA, 22 nt, Mycobacterium tuberculosis H37Rv
cgcgcggggcggcugcgggccc

SEQ ID NO: 1318328 - RNA, 16 nt, Mycobacterium tuberculosis H37Rv
cgcgcgucauaacgcu

SEQ ID NO: 1318329 - RNA, 19 nt, Mycobacterium tuberculosis H37Rv
cgcgcgguacugcgcagcg

SEQ ID NO: 1318330 - RNA, 15 nt, Mycobacterium tuberculosis H37Rv
cgcgcucaccggggc

SEQ ID NO: 1318331 - RNA, 16 nt, Mycobacterium tuberculosis H37Rv
cgcgcucagcuccggc

SEQ ID NO: 1318332 - RNA, 17 nt, Mycobacterium tuberculosis H37Rv
cgcgcucagcuccggcg

SEQ ID NO: 1318333 - RNA, 23 nt, Mycobacterium tuberculosis H37Rv
cgcgcucgauggcggccaccagc

SEQ ID NO: 1318334 - RNA, 14 nt, Mycobacterium tuberculosis H37Rv
cgcgcguccgucgg

SEQ ID NO: 1318335 - RNA, 19 nt, Mycobacterium tuberculosis H37Rv
cgcgcguucggcgagcagc

SEQ ID NO: 1318336 - RNA, 21 nt, Mycobacterium tuberculosis H37Rv
cgcgcguucggcgagcagcgc

SEQ ID NO: 1318337 - RNA, 19 nt, Mycobacterium tuberculosis H37Rv
cgcgcguugaagucgccgg

SEQ ID NO: 1318338 - RNA, 15 nt, Mycobacterium tuberculosis H37Rv
cgcgcugagcacgcg

SEQ ID NO: 1318339 - RNA, 19 nt, Mycobacterium tuberculosis H37Rv
cgcgcugagcacgcggauc

SEQ ID NO: 1318340 - RNA, 14 nt, Mycobacterium tuberculosis H37Rv
cgcgcugcagcacg

SEQ ID NO: 1318341 - RNA, 13 nt, Mycobacterium tuberculosis H37Rv
cgcgcugccggcc

SEQ ID NO: 1318342 - RNA, 15 nt, Mycobacterium tuberculosis H37Rv
cgcgcugccggccgc

SEQ ID NO: 1318343 - RNA, 17 nt, Mycobacterium tuberculosis H37Rv
cgcgcucgggcccagcg

SEQ ID NO: 1318344 - RNA, 17 nt, Mycobacterium tuberculosis H37Rv
cgcgcucgcucaccggc

SEQ ID NO: 1318345 - RNA, 19 nt, Mycobacterium tuberculosis H37Rv
cgcgggaucgguggcggca

SEQ ID NO: 1318346 - RNA, 24 nt, Mycobacterium tuberculosis H37Rv
cgcgggauaccaauggacacaggu

SEQ ID NO: 1318347 - RNA, 20 nt, Mycobacterium tuberculosis H37Rv
cgcgggcgccgggaagcccc

SEQ ID NO: 1318348 - RNA, 20 nt, Mycobacterium tuberculosis H37Rv
cgcgggauguaccccggccc

SEQ ID NO: 1318349 - RNA, 16 nt, Mycobacterium tuberculosis H37Rv
cgcgggcggaggccgc

SEQ ID NO: 1318350 - RNA, 15 nt, Mycobacterium tuberculosis H37Rv
cgcggcuugucgccc

SEQ ID NO: 1318351 - RNA, 16 nt, Mycobacterium tuberculosis H37Rv
cgcggcuugucgcccc

SEQ ID NO: 1318352 - RNA, 20 nt, Mycobacterium tuberculosis H37Rv
cgcgggacacgucgcgccag

SEQ ID NO: 1318353 - RNA, 16 nt, Mycobacterium tuberculosis H37Rv
cgcgggacaccaccgc

SEQ ID NO: 1318354 - RNA, 19 nt, Mycobacterium tuberculosis H37Rv
cgcgggaccuucgagccgc

SEQ ID NO: 1318355 - RNA, 19 nt, Mycobacterium tuberculosis H37Rv
cgcggcuucaguccggccc

SEQ ID NO: 1318356 - RNA, 22 nt, Mycobacterium tuberculosis H37Rv
cgcggcuucaguccggcccccc

SEQ ID NO: 1318357 - RNA, 23 nt, Mycobacterium tuberculosis H37Rv
cgcggcuucaguccggccccccg

SEQ ID NO: 1318358 - RNA, 16 nt, Mycobacterium tuberculosis H37Rv
cgcggcuaggccaagc

SEQ ID NO: 1318359 - RNA, 18 nt, Mycobacterium tuberculosis H37Rv
cgcggcuacaucggcggc

SEQ ID NO: 1318360 - RNA, 15 nt, Mycobacterium tuberculosis H37Rv
cgcggcguucgccgg

SEQ ID NO: 1318361 - RNA, 20 nt, Mycobacterium tuberculosis H37Rv
cgcggcggguccucgcggag

SEQ ID NO: 1318362 - RNA, 21 nt, Mycobacterium tuberculosis H37Rv
cgcggcggguccucgcggagc

SEQ ID NO: 1318363 - RNA, 17 nt, Mycobacterium tuberculosis H37Rv
cgcggcggucuggguga

SEQ ID NO: 1318364 - RNA, 15 nt, Mycobacterium tuberculosis H37Rv
cgcggcgggcccgau

SEQ ID NO: 1318365 - RNA, 14 nt, Mycobacterium tuberculosis H37Rv
cgcggcggcgugcu

SEQ ID NO: 1318366 - RNA, 19 nt, Mycobacterium tuberculosis H37Rv
cgcggcggcguccaccugc

SEQ ID NO: 1318367 - RNA, 14 nt, Mycobacterium tuberculosis H37Rv
cgcggccacccgcg

SEQ ID NO: 1318368 - RNA, 15 nt, Mycobacterium tuberculosis H37Rv
cgcggccaccaccgc

SEQ ID NO: 1318369 - RNA, 19 nt, Mycobacterium tuberculosis H37Rv
cgcggccacccgcgacgau

SEQ ID NO: 1318370 - RNA, 16 nt, Mycobacterium tuberculosis H37Rv
cgcggccaccgaccgc

SEQ ID NO: 1318371 - RNA, 17 nt, Mycobacterium tuberculosis H37Rv
cgcggccaccgccgccg

SEQ ID NO: 1318372 - RNA, 15 nt, Mycobacterium tuberculosis H37Rv
cgcggccaccgccgc

SEQ ID NO: 1318373 - RNA, 13 nt, Mycobacterium tuberculosis H37Rv
cgcggccagcagc

SEQ ID NO: 1318374 - RNA, 16 nt, Mycobacterium tuberculosis H37Rv
cgcggccagagccgcg

SEQ ID NO: 1318375 - RNA, 16 nt, Mycobacterium tuberculosis H37Rv
cgcggccagcaccagc

SEQ ID NO: 1318376 - RNA, 19 nt, Mycobacterium tuberculosis H37Rv
cgcggccacggucagccag

SEQ ID NO: 1318377 - RNA, 18 nt, Mycobacterium tuberculosis H37Rv
cgcggcgaccuguccggu

SEQ ID NO: 1318378 - RNA, 20 nt, Mycobacterium tuberculosis H37Rv
cgcggcgaaccgucucgccc

SEQ ID NO: 1318379 - RNA, 20 nt, Mycobacterium tuberculosis H37Rv
cgcggcgacaagccgagccc

SEQ ID NO: 1318380 - RNA, 20 nt, Mycobacterium tuberculosis H37Rv
cgcggcggcgcuggcgggca

SEQ ID NO: 1318381 - RNA, 18 nt, Mycobacterium tuberculosis H37Rv
cgcggcggccuccaccac

SEQ ID NO: 1318382 - RNA, 17 nt, Mycobacterium tuberculosis H37Rv
cgcggcggccgcggcuu

SEQ ID NO: 1318383 - RNA, 12 nt, Mycobacterium tuberculosis H37Rv
cgcggcggcgcu

SEQ ID NO: 1318384 - RNA, 16 nt, Mycobacterium tuberculosis H37Rv
cgcggcgagccucgcg

SEQ ID NO: 1318385 - RNA, 18 nt, Mycobacterium tuberculosis H37Rv
cgcggcgagccucgcgcg

SEQ ID NO: 1318386 - RNA, 14 nt, Mycobacterium tuberculosis H37Rv
cgcggcgagagccu

SEQ ID NO: 1318387 - RNA, 15 nt, Mycobacterium tuberculosis H37Rv
cgcggcggccagcgc

SEQ ID NO: 1318388 - RNA, 22 nt, Mycobacterium tuberculosis H37Rv
cgcggcacgcuccagcucggcc

SEQ ID NO: 1318389 - RNA, 17 nt, Mycobacterium tuberculosis H37Rv
cgcggcagcauccucga

SEQ ID NO: 1318390 - RNA, 18 nt, Mycobacterium tuberculosis H37Rv
cgcggcaccgauggcgca

SEQ ID NO: 1318391 - RNA, 14 nt, Mycobacterium tuberculosis H37Rv
cgcggcaccgccga

SEQ ID NO: 1318392 - RNA, 19 nt, Mycobacterium tuberculosis H37Rv
cgcggcacgcuccagcucg

SEQ ID NO: 1318393 - RNA, 17 nt, Mycobacterium tuberculosis H37Rv
cgcggcacgcccacagc

SEQ ID NO: 1318394 - RNA, 12 nt, Mycobacterium tuberculosis H37Rv
cgcggcaagagu

SEQ ID NO: 1318395 - RNA, 21 nt, Mycobacterium tuberculosis H37Rv
cgcggcaacgcggucugcucc

SEQ ID NO: 1318396 - RNA, 16 nt, Mycobacterium tuberculosis H37Rv
cgcggaucagcccgcg

SEQ ID NO: 1318397 - RNA, 18 nt, Mycobacterium tuberculosis H37Rv
cgcggauagaugacgggc

SEQ ID NO: 1318398 - RNA, 15 nt, Mycobacterium tuberculosis H37Rv
cgcggauaggccgcg

SEQ ID NO: 1318399 - RNA, 20 nt, Mycobacterium tuberculosis H37Rv
cgcggauaggccgcgcggcg

SEQ ID NO: 1318400 - RNA, 22 nt, Mycobacterium tuberculosis H37Rv
cgcggaguucgcugacggccau

SEQ ID NO: 1318401 - RNA, 12 nt, Mycobacterium tuberculosis H37Rv
cgcggagggcgc

SEQ ID NO: 1318402 - RNA, 20 nt, Mycobacterium tuberculosis H37Rv
cgcggacucguagcaccggu

SEQ ID NO: 1318403 - RNA, 21 nt, Mycobacterium tuberculosis H37Rv
cgcggacuucguuccgugccg

SEQ ID NO: 1318404 - RNA, 23 nt, Mycobacterium tuberculosis H37Rv
cgcggacgauuacgccggaggca

SEQ ID NO: 1318405 - RNA, 23 nt, Mycobacterium tuberculosis H37Rv
cgcggacucgggcaggccccacu

SEQ ID NO: 1318406 - RNA, 12 nt, Mycobacterium tuberculosis H37Rv
cgcggacagccc

SEQ ID NO: 1318407 - RNA, 20 nt, Mycobacterium tuberculosis H37Rv
cgcggacagcccggacgcgc

SEQ ID NO: 1318408 - RNA, 15 nt, Mycobacterium tuberculosis H37Rv
cgcggaccagagugg

SEQ ID NO: 1318409 - RNA, 22 nt, Mycobacterium tuberculosis H37Rv
cgcggacccgccgugaguaggu

SEQ ID NO: 1318410 - RNA, 21 nt, Mycobacterium tuberculosis H37Rv
cgcggacccgcagcugcggau

SEQ ID NO: 1318411 - RNA, 13 nt, Mycobacterium tuberculosis H37Rv
cgcggacccgcgc

SEQ ID NO: 1318412 - RNA, 20 nt, Mycobacterium tuberculosis H37Rv
cgcggacccgcgcgucgccc

SEQ ID NO: 1318413 - RNA, 15 nt, Mycobacterium tuberculosis H37Rv
cgcggaccggcgucg

SEQ ID NO: 1318414 - RNA, 16 nt, Mycobacterium tuberculosis H37Rv
cgcggaauccgcggcg

SEQ ID NO: 1318415 - RNA, 20 nt, Mycobacterium tuberculosis H37Rv
cgcggaaucgcaucggcggg

SEQ ID NO: 1318416 - RNA, 16 nt, Mycobacterium tuberculosis H37Rv
cgcggacaccgcggcg

SEQ ID NO: 1318417 - RNA, 19 nt, Mycobacterium tuberculosis H37Rv
cgcggacaugacagccccg

SEQ ID NO: 1318418 - RNA, 20 nt, Mycobacterium tuberculosis H37Rv
cgcggaagccgccuaggacu

SEQ ID NO: 1318419 - RNA, 15 nt, Mycobacterium tuberculosis H37Rv
cgcggaaaggcuucc

SEQ ID NO: 1318420 - RNA, 20 nt, Mycobacterium tuberculosis H37Rv
cgcgcuugcgaucgccgcua

SEQ ID NO: 1318421 - RNA, 18 nt, Mycobacterium tuberculosis H37Rv
cgcgcuugcgaucggcac

SEQ ID NO: 1318422 - RNA, 22 nt, Mycobacterium tuberculosis H37Rv
cgcgcugcuucuucggacagca

SEQ ID NO: 1318423 - RNA, 20 nt, Mycobacterium tuberculosis H37Rv
cgcgcuucacagccaccagc

SEQ ID NO: 1318424 - RNA, 20 nt, Mycobacterium tuberculosis H37Rv
cgcgcuucaggcaucaccgg

SEQ ID NO: 1318425 - RNA, 20 nt, Mycobacterium tuberculosis H37Rv
cgcgcuggaccugaugagcu

SEQ ID NO: 1318426 - RNA, 23 nt, Mycobacterium tuberculosis H37Rv
cgcgcugcggcccacaccagcgc

SEQ ID NO: 1318427 - RNA, 13 nt, Mycobacterium tuberculosis H37Rv
cgcgcuggcgccc

SEQ ID NO: 1318428 - RNA, 19 nt, Mycobacterium tuberculosis H37Rv
cgcguagugcuccguccga

SEQ ID NO: 1318429 - RNA, 19 nt, Mycobacterium tuberculosis H37Rv
cgcguagugccacgaggac

SEQ ID NO: 1318430 - RNA, 23 nt, Mycobacterium tuberculosis H37Rv
cgcguagcucgcggggcgcaccg

SEQ ID NO: 1318431 - RNA, 15 nt, Mycobacterium tuberculosis H37Rv
cgcgucaaacaccuc

SEQ ID NO: 1318432 - RNA, 23 nt, Mycobacterium tuberculosis H37Rv
cgcgucagccgcaccccgcccga

SEQ ID NO: 1318433 - RNA, 14 nt, Mycobacterium tuberculosis H37Rv
cgcgucagccgcac

SEQ ID NO: 1318434 - RNA, 19 nt, Mycobacterium tuberculosis H37Rv
cgcgucagccgcaccccgc

SEQ ID NO: 1318435 - RNA, 13 nt, Mycobacterium tuberculosis H37Rv
cgcgucggcggcc

SEQ ID NO: 1318436 - RNA, 17 nt, Mycobacterium tuberculosis H37Rv
cgcgucagcggcgagca

SEQ ID NO: 1318437 - RNA, 20 nt, Mycobacterium tuberculosis H37Rv
cgcgugguucggucgggggc

SEQ ID NO: 1318438 - RNA, 16 nt, Mycobacterium tuberculosis H37Rv
cgcguguacggcggcu

SEQ ID NO: 1318439 - RNA, 17 nt, Mycobacterium tuberculosis H37Rv
cgcgugguaccgcuugu

SEQ ID NO: 1318440 - RNA, 20 nt, Mycobacterium tuberculosis H37Rv
cgcgugggcgugcaggcugg

SEQ ID NO: 1318441 - RNA, 18 nt, Mycobacterium tuberculosis H37Rv
cgcguggccgccggcgcu

SEQ ID NO: 1318442 - RNA, 14 nt, Mycobacterium tuberculosis H37Rv
cgcguggcgcacca

SEQ ID NO: 1318443 - RNA, 21 nt, Mycobacterium tuberculosis H37Rv
cgcguggcgcaccaccgcccc

SEQ ID NO: 1318444 - RNA, 20 nt, Mycobacterium tuberculosis H37Rv
cgcguggcuggcggcgaccg

SEQ ID NO: 1318445 - RNA, 21 nt, Mycobacterium tuberculosis H37Rv
cgcgugcugcagaucggccgg

SEQ ID NO: 1318446 - RNA, 21 nt, Mycobacterium tuberculosis H37Rv
cgcgucuuggugcgcgucagc

SEQ ID NO: 1318447 - RNA, 14 nt, Mycobacterium tuberculosis H37Rv
cgcgucggucaccg

SEQ ID NO: 1318448 - RNA, 13 nt, Mycobacterium tuberculosis H37Rv
cgcgucgggccgc

SEQ ID NO: 1318449 - RNA, 14 nt, Mycobacterium tuberculosis H37Rv
cgcgucgucacgau

SEQ ID NO: 1318450 - RNA, 23 nt, Mycobacterium tuberculosis H37Rv
cgcgucuacgucguccagcacca

SEQ ID NO: 1318451 - RNA, 16 nt, Mycobacterium tuberculosis H37Rv
cgcggugggccccgau

SEQ ID NO: 1318452 - RNA, 17 nt, Mycobacterium tuberculosis H37Rv
cgcggugggcacagcca

SEQ ID NO: 1318453 - RNA, 22 nt, Mycobacterium tuberculosis H37Rv
cgcgguggcggugucggcgccg

SEQ ID NO: 1318454 - RNA, 15 nt, Mycobacterium tuberculosis H37Rv
cgcggugggcacagc

SEQ ID NO: 1318455 - RNA, 17 nt, Mycobacterium tuberculosis H37Rv
cgcgguggggcgcgccg

SEQ ID NO: 1318456 - RNA, 16 nt, Mycobacterium tuberculosis H37Rv
cgcggugugcggcagc

SEQ ID NO: 1318457 - RNA, 18 nt, Mycobacterium tuberculosis H37Rv
cgcggugugcggcagccc

SEQ ID NO: 1318458 - RNA, 22 nt, Mycobacterium tuberculosis H37Rv
cgcguaauccgagcgcggcggc

SEQ ID NO: 1318459 - RNA, 15 nt, Mycobacterium tuberculosis H37Rv
cgcguagagcagcag

SEQ ID NO: 1318460 - RNA, 13 nt, Mycobacterium tuberculosis H37Rv
cgcgggcggcgcu

SEQ ID NO: 1318461 - RNA, 12 nt, Mycobacterium tuberculosis H37Rv
cgcgggcugacc

SEQ ID NO: 1318462 - RNA, 21 nt, Mycobacterium tuberculosis H37Rv
cgcgggcguuggccagcaggu

SEQ ID NO: 1318463 - RNA, 16 nt, Mycobacterium tuberculosis H37Rv
cgcgggcgugccgacc

SEQ ID NO: 1318464 - RNA, 19 nt, Mycobacterium tuberculosis H37Rv
cgcgggcgguaaucgcgag

SEQ ID NO: 1318465 - RNA, 12 nt, Mycobacterium tuberculosis H37Rv
cgcggggccgcc

SEQ ID NO: 1318466 - RNA, 23 nt, Mycobacterium tuberculosis H37Rv
cgcgguggaugcgaugcgcgccg

SEQ ID NO: 1318467 - RNA, 17 nt, Mycobacterium tuberculosis H37Rv
cgcgguggcggcgagca

SEQ ID NO: 1318468 - RNA, 13 nt, Mycobacterium tuberculosis H37Rv
cgcggugcccgcg

SEQ ID NO: 1318469 - RNA, 13 nt, Mycobacterium tuberculosis H37Rv
cgcggugccgcca

SEQ ID NO: 1318470 - RNA, 18 nt, Mycobacterium tuberculosis H37Rv
cgcggugccgccaccggc

SEQ ID NO: 1318471 - RNA, 17 nt, Mycobacterium tuberculosis H37Rv
cgcuacaccugcggcgu

SEQ ID NO: 1318472 - RNA, 22 nt, Mycobacterium tuberculosis H37Rv
cgcuagccggcucaucgcagcc

SEQ ID NO: 1318473 - RNA, 17 nt, Mycobacterium tuberculosis H37Rv
cgcuagccgggcgcgcc

SEQ ID NO: 1318474 - RNA, 21 nt, Mycobacterium tuberculosis H37Rv
cgcuagccgacagcucaucga

SEQ ID NO: 1318475 - RNA, 21 nt, Mycobacterium tuberculosis H37Rv
cgcuaggacggcgcgagccgc

SEQ ID NO: 1318476 - RNA, 20 nt, Mycobacterium tuberculosis H37Rv
cgcuaggacggcgcgagccg

SEQ ID NO: 1318477 - RNA, 23 nt, Mycobacterium tuberculosis H37Rv
cgcuagcggauucagcgucgcca

SEQ ID NO: 1318478 - RNA, 15 nt, Mycobacterium tuberculosis H37Rv
cgcuagggugagccc

SEQ ID NO: 1318479 - RNA, 23 nt, Mycobacterium tuberculosis H37Rv
cgcuaggugacgccgccagcacc

SEQ ID NO: 1318480 - RNA, 19 nt, Mycobacterium tuberculosis H37Rv
cgcucaaugaucgcggcgg

SEQ ID NO: 1318481 - RNA, 15 nt, Mycobacterium tuberculosis H37Rv
cgcucacccgcccgg

SEQ ID NO: 1318482 - RNA, 21 nt, Mycobacterium tuberculosis H37Rv
cgcucaccuuuggccgcgacc

SEQ ID NO: 1318483 - RNA, 22 nt, Mycobacterium tuberculosis H37Rv
cgcucauccauucggcggcggc

SEQ ID NO: 1318484 - RNA, 22 nt, Mycobacterium tuberculosis H37Rv
cgcucacgaagaccgcgucggc

SEQ ID NO: 1318485 - RNA, 18 nt, Mycobacterium tuberculosis H37Rv
cgcucagggugcgccgca

SEQ ID NO: 1318486 - RNA, 20 nt, Mycobacterium tuberculosis H37Rv
cgcucagggugcgccgcagc

SEQ ID NO: 1318487 - RNA, 16 nt, Mycobacterium tuberculosis H37Rv
cgcucaggucaucggc

SEQ ID NO: 1318488 - RNA, 18 nt, Mycobacterium tuberculosis H37Rv
cgcucaguuuggccuggu

SEQ ID NO: 1318489 - RNA, 20 nt, Mycobacterium tuberculosis H37Rv
cgcuaauggauccagcccga

SEQ ID NO: 1318490 - RNA, 15 nt, Mycobacterium tuberculosis H37Rv
cgcuaccccagccgg

SEQ ID NO: 1318491 - RNA, 19 nt, Mycobacterium tuberculosis H37Rv
cgcuaccccagccggcagc

SEQ ID NO: 1318492 - RNA, 19 nt, Mycobacterium tuberculosis H37Rv
cgcguugaccaucacgccc

SEQ ID NO: 1318493 - RNA, 15 nt, Mycobacterium tuberculosis H37Rv
cgcguugccaaagcc

SEQ ID NO: 1318494 - RNA, 22 nt, Mycobacterium tuberculosis H37Rv
cgcguucgcgcaaaugccugcu

SEQ ID NO: 1318495 - RNA, 16 nt, Mycobacterium tuberculosis H37Rv
cgcguuggcccgccug

SEQ ID NO: 1318496 - RNA, 14 nt, Mycobacterium tuberculosis H37Rv
cgcguugggcaccu

SEQ ID NO: 1318497 - RNA, 17 nt, Mycobacterium tuberculosis H37Rv
cgcguuguccgcggcca

SEQ ID NO: 1318498 - RNA, 22 nt, Mycobacterium tuberculosis H37Rv
cgcguugcguaucgacccgcgc

SEQ ID NO: 1318499 - RNA, 20 nt, Mycobacterium tuberculosis H37Rv
cgcguugaugaccgccgccg

SEQ ID NO: 1318500 - RNA, 16 nt, Mycobacterium tuberculosis H37Rv
cgcguucaggaugcca

SEQ ID NO: 1318501 - RNA, 15 nt, Mycobacterium tuberculosis H37Rv
cgcguuccgggccgg

SEQ ID NO: 1318502 - RNA, 20 nt, Mycobacterium tuberculosis H37Rv
cgcugagcacggcgcggcgg

SEQ ID NO: 1318503 - RNA, 12 nt, Mycobacterium tuberculosis H37Rv
cgcugagccccc

SEQ ID NO: 1318504 - RNA, 22 nt, Mycobacterium tuberculosis H37Rv
cgcugagccccccgagcccgcc

SEQ ID NO: 1318505 - RNA, 15 nt, Mycobacterium tuberculosis H37Rv
cgcugagccgcucau

SEQ ID NO: 1318506 - RNA, 18 nt, Mycobacterium tuberculosis H37Rv
cgcugcagacgccccuuc

SEQ ID NO: 1318507 - RNA, 20 nt, Mycobacterium tuberculosis H37Rv
cgcugcagacgccccuuccc

SEQ ID NO: 1318508 - RNA, 21 nt, Mycobacterium tuberculosis H37Rv
cgcugcauccgcagcaccaag

SEQ ID NO: 1318509 - RNA, 15 nt, Mycobacterium tuberculosis H37Rv
cgcucuugaauagga

SEQ ID NO: 1318510 - RNA, 20 nt, Mycobacterium tuberculosis H37Rv
cgcucggcgaucugcguuug

SEQ ID NO: 1318511 - RNA, 17 nt, Mycobacterium tuberculosis H37Rv
cgcugacgcccuccugg

SEQ ID NO: 1318512 - RNA, 21 nt, Mycobacterium tuberculosis H37Rv
cgcugaccuuuucccgcaggc

SEQ ID NO: 1318513 - RNA, 19 nt, Mycobacterium tuberculosis H37Rv
cgcugaccuuuucccgcag

SEQ ID NO: 1318514 - RNA, 16 nt, Mycobacterium tuberculosis H37Rv
cgcucgcgcacccugc

SEQ ID NO: 1318515 - RNA, 20 nt, Mycobacterium tuberculosis H37Rv
cgcucggagaucgccacuac

SEQ ID NO: 1318516 - RNA, 12 nt, Mycobacterium tuberculosis H37Rv
cgcucggcagcc

SEQ ID NO: 1318517 - RNA, 14 nt, Mycobacterium tuberculosis H37Rv
cgcucggccgcagc

SEQ ID NO: 1318518 - RNA, 14 nt, Mycobacterium tuberculosis H37Rv
cgcucugcgcggcu

SEQ ID NO: 1318519 - RNA, 20 nt, Mycobacterium tuberculosis H37Rv
cgcucccaugaucgccgacc

SEQ ID NO: 1318520 - RNA, 21 nt, Mycobacterium tuberculosis H37Rv
cgcucccccgcuacgcgcgcu

SEQ ID NO: 1318521 - RNA, 22 nt, Mycobacterium tuberculosis H37Rv
cgcuccccagcgaaucacccgc

SEQ ID NO: 1318522 - RNA, 15 nt, Mycobacterium tuberculosis H37Rv
cgcucccccgccaac

SEQ ID NO: 1318523 - RNA, 20 nt, Mycobacterium tuberculosis H37Rv
cgcuccauaucgucgggcgu

SEQ ID NO: 1318524 - RNA, 21 nt, Mycobacterium tuberculosis H37Rv
cgcucaucuguaaccuccucg

SEQ ID NO: 1318525 - RNA, 13 nt, Mycobacterium tuberculosis H37Rv
cgcucaucgaccg

SEQ ID NO: 1318526 - RNA, 22 nt, Mycobacterium tuberculosis H37Rv
cgcucauucgugcccgggcggu

SEQ ID NO: 1318527 - RNA, 18 nt, Mycobacterium tuberculosis H37Rv
cgcucauucgugcccggg

SEQ ID NO: 1318528 - RNA, 15 nt, Mycobacterium tuberculosis H37Rv
cgcuccaaaagccuc

SEQ ID NO: 1318529 - RNA, 19 nt, Mycobacterium tuberculosis H37Rv
cgcuccaaaagccucagcc

SEQ ID NO: 1318530 - RNA, 18 nt, Mycobacterium tuberculosis H37Rv
cgcucauguucucgaccg

SEQ ID NO: 1318531 - RNA, 18 nt, Mycobacterium tuberculosis H37Rv
cgcuccacguacgcggcu

SEQ ID NO: 1318532 - RNA, 15 nt, Mycobacterium tuberculosis H37Rv
cgcuccacugaccag

SEQ ID NO: 1318533 - RNA, 17 nt, Mycobacterium tuberculosis H37Rv
cgcuccaacaacuccag

SEQ ID NO: 1318534 - RNA, 13 nt, Mycobacterium tuberculosis H37Rv
cgcuccgcggcgc

SEQ ID NO: 1318535 - RNA, 12 nt, Mycobacterium tuberculosis H37Rv
cgcuccgcggcu

SEQ ID NO: 1318536 - RNA, 23 nt, Mycobacterium tuberculosis H37Rv
cgcuccgcggcucaaucuccucc

SEQ ID NO: 1318537 - RNA, 23 nt, Mycobacterium tuberculosis H37Rv
cgcuccgccgucgccgccggcgc

SEQ ID NO: 1318538 - RNA, 19 nt, Mycobacterium tuberculosis H37Rv
cgcucgaucacuagcgccc

SEQ ID NO: 1318539 - RNA, 23 nt, Mycobacterium tuberculosis H37Rv
cgcucgauggcggccaccagcgc

SEQ ID NO: 1318540 - RNA, 21 nt, Mycobacterium tuberculosis H37Rv
cgcucgaacucggcggccagc

SEQ ID NO: 1318541 - RNA, 18 nt, Mycobacterium tuberculosis H37Rv
cgcucgacgaccacggug

SEQ ID NO: 1318542 - RNA, 22 nt, Mycobacterium tuberculosis H37Rv
cgcucgacguacagcgcggcgu

SEQ ID NO: 1318543 - RNA, 15 nt, Mycobacterium tuberculosis H37Rv
cgcucgacggcccgc

SEQ ID NO: 1318544 - RNA, 18 nt, Mycobacterium tuberculosis H37Rv
cgcucgaugucccgagcc

SEQ ID NO: 1318545 - RNA, 14 nt, Mycobacterium tuberculosis H37Rv
cgcucgcaccgccc

SEQ ID NO: 1318546 - RNA, 14 nt, Mycobacterium tuberculosis H37Rv
cgcucgcccgccgc

SEQ ID NO: 1318547 - RNA, 16 nt, Mycobacterium tuberculosis H37Rv
cggacccgcagcugcg

SEQ ID NO: 1318548 - RNA, 14 nt, Mycobacterium tuberculosis H37Rv
cggacccgcagcug

SEQ ID NO: 1318549 - RNA, 23 nt, Mycobacterium tuberculosis H37Rv
cggaccacuguuggugccgccac

SEQ ID NO: 1318550 - RNA, 13 nt, Mycobacterium tuberculosis H37Rv
cggaccaccgcuc

SEQ ID NO: 1318551 - RNA, 18 nt, Mycobacterium tuberculosis H37Rv
cggaccaucgccaggccc

SEQ ID NO: 1318552 - RNA, 23 nt, Mycobacterium tuberculosis H37Rv
cggaccguggcagcugcucuccg

SEQ ID NO: 1318553 - RNA, 23 nt, Mycobacterium tuberculosis H37Rv
cggaccgucuuuggugccgagca

SEQ ID NO: 1318554 - RNA, 12 nt, Mycobacterium tuberculosis H37Rv
cggaccgcuucg

SEQ ID NO: 1318555 - RNA, 22 nt, Mycobacterium tuberculosis H37Rv
cggaccgggccaagacggcggg

SEQ ID NO: 1318556 - RNA, 20 nt, Mycobacterium tuberculosis H37Rv
cggaccgauugucggcaacg

SEQ ID NO: 1318557 - RNA, 16 nt, Mycobacterium tuberculosis H37Rv
cggaccgaugguugag

SEQ ID NO: 1318558 - RNA, 22 nt, Mycobacterium tuberculosis H37Rv
cggaccgcagcgugaucuggcc

SEQ ID NO: 1318559 - RNA, 18 nt, Mycobacterium tuberculosis H37Rv
cggaccgccaccuuggcg

SEQ ID NO: 1318560 - RNA, 20 nt, Mycobacterium tuberculosis H37Rv
cggaccgcgacggcgccggc

SEQ ID NO: 1318561 - RNA, 16 nt, Mycobacterium tuberculosis H37Rv
cggaccgcugccugcc

SEQ ID NO: 1318562 - RNA, 14 nt, Mycobacterium tuberculosis H37Rv
cggacggcaggcug

SEQ ID NO: 1318563 - RNA, 17 nt, Mycobacterium tuberculosis H37Rv
cggacgcgggugccaga

SEQ ID NO: 1318564 - RNA, 22 nt, Mycobacterium tuberculosis H37Rv
cggacgauggcgucggccagga

SEQ ID NO: 1318565 - RNA, 23 nt, Mycobacterium tuberculosis H37Rv
cggaccugaccgguggccaucgc

SEQ ID NO: 1318566 - RNA, 16 nt, Mycobacterium tuberculosis H37Rv
cggaccucgaagccca

SEQ ID NO: 1318567 - RNA, 12 nt, Mycobacterium tuberculosis H37Rv
cggacaaccugg

SEQ ID NO: 1318568 - RNA, 14 nt, Mycobacterium tuberculosis H37Rv
cggacaaccugggg

SEQ ID NO: 1318569 - RNA, 23 nt, Mycobacterium tuberculosis H37Rv
cggaauggucccggguccaagaa

SEQ ID NO: 1318570 - RNA, 17 nt, Mycobacterium tuberculosis H37Rv
cggaauggaggccgccg

SEQ ID NO: 1318571 - RNA, 20 nt, Mycobacterium tuberculosis H37Rv
cggaaugcccgagcaggacg

SEQ ID NO: 1318572 - RNA, 15 nt, Mycobacterium tuberculosis H37Rv
cggaaucgucggcgc

SEQ ID NO: 1318573 - RNA, 14 nt, Mycobacterium tuberculosis H37Rv
cggacagggcggcg

SEQ ID NO: 1318574 - RNA, 15 nt, Mycobacterium tuberculosis H37Rv
cggacaccgcggcga

SEQ ID NO: 1318575 - RNA, 20 nt, Mycobacterium tuberculosis H37Rv
cggacagcgcauccacaauc

SEQ ID NO: 1318576 - RNA, 16 nt, Mycobacterium tuberculosis H37Rv
cggacagcgccuggcc

SEQ ID NO: 1318577 - RNA, 16 nt, Mycobacterium tuberculosis H37Rv
cggacaguuccccggg

SEQ ID NO: 1318578 - RNA, 12 nt, Mycobacterium tuberculosis H37Rv
cggaccaccagg

SEQ ID NO: 1318579 - RNA, 14 nt, Mycobacterium tuberculosis H37Rv
cggacacacaggcg

SEQ ID NO: 1318580 - RNA, 20 nt, Mycobacterium tuberculosis H37Rv
cggagucgucggcaacgcug

SEQ ID NO: 1318581 - RNA, 21 nt, Mycobacterium tuberculosis H37Rv
cggagucgucggcaacgcugg

SEQ ID NO: 1318582 - RNA, 14 nt, Mycobacterium tuberculosis H37Rv
cggagucggggggc

SEQ ID NO: 1318583 - RNA, 23 nt, Mycobacterium tuberculosis H37Rv
cggagucgagcacaccgaggucg

SEQ ID NO: 1318584 - RNA, 17 nt, Mycobacterium tuberculosis H37Rv
cggaguaggccgcgccc

SEQ ID NO: 1318585 - RNA, 18 nt, Mycobacterium tuberculosis H37Rv
cggagucacgcagccgcg

SEQ ID NO: 1318586 - RNA, 14 nt, Mycobacterium tuberculosis H37Rv
cggagucaagcagc

SEQ ID NO: 1318587 - RNA, 18 nt, Mycobacterium tuberculosis H37Rv
cggagucaagcagcagca

SEQ ID NO: 1318588 - RNA, 15 nt, Mycobacterium tuberculosis H37Rv
cggaguccgucgggg

SEQ ID NO: 1318589 - RNA, 18 nt, Mycobacterium tuberculosis H37Rv
cggauaauucaacagcac

SEQ ID NO: 1318590 - RNA, 15 nt, Mycobacterium tuberculosis H37Rv
cggauacaccggcac

SEQ ID NO: 1318591 - RNA, 19 nt, Mycobacterium tuberculosis H37Rv
cggauacagccgccgccgg

SEQ ID NO: 1318592 - RNA, 21 nt, Mycobacterium tuberculosis H37Rv
cggaguugaagaagcccgacg

SEQ ID NO: 1318593 - RNA, 13 nt, Mycobacterium tuberculosis H37Rv
cggaguggccagu

SEQ ID NO: 1318594 - RNA, 16 nt, Mycobacterium tuberculosis H37Rv
cggagugguauccagg

SEQ ID NO: 1318595 - RNA, 19 nt, Mycobacterium tuberculosis H37Rv
cggagauacgggccaccgu

SEQ ID NO: 1318596 - RNA, 20 nt, Mycobacterium tuberculosis H37Rv
cggagagccugcucgcagcg

SEQ ID NO: 1318597 - RNA, 13 nt, Mycobacterium tuberculosis H37Rv
cggaggcaagcaa

SEQ ID NO: 1318598 - RNA, 18 nt, Mycobacterium tuberculosis H37Rv
cggaggaucgcugguugg

SEQ ID NO: 1318599 - RNA, 19 nt, Mycobacterium tuberculosis H37Rv
cggaggccgccgcgccggu

SEQ ID NO: 1318600 - RNA, 20 nt, Mycobacterium tuberculosis H37Rv
cggaggugggguggggagcu

SEQ ID NO: 1318601 - RNA, 16 nt, Mycobacterium tuberculosis H37Rv
cggaggucgggcggcg

SEQ ID NO: 1318602 - RNA, 19 nt, Mycobacterium tuberculosis H37Rv
cggaggugggguggggagc

SEQ ID NO: 1318603 - RNA, 12 nt, Mycobacterium tuberculosis H37Rv
cggaggcggcca

SEQ ID NO: 1318604 - RNA, 13 nt, Mycobacterium tuberculosis H37Rv
cggaggcggacca

SEQ ID NO: 1318605 - RNA, 17 nt, Mycobacterium tuberculosis H37Rv
cggacugcagcgcggcc

SEQ ID NO: 1318606 - RNA, 14 nt, Mycobacterium tuberculosis H37Rv
cggacugcggaaca

SEQ ID NO: 1318607 - RNA, 20 nt, Mycobacterium tuberculosis H37Rv
cggacuggcauccgccccgc

SEQ ID NO: 1318608 - RNA, 21 nt, Mycobacterium tuberculosis H37Rv
cggacuggccucggggaucgc

SEQ ID NO: 1318609 - RNA, 14 nt, Mycobacterium tuberculosis H37Rv
cggacucccucgau

SEQ ID NO: 1318610 - RNA, 14 nt, Mycobacterium tuberculosis H37Rv
cggacucagcggcg

SEQ ID NO: 1318611 - RNA, 13 nt, Mycobacterium tuberculosis H37Rv
cggacggucgggc

SEQ ID NO: 1318612 - RNA, 20 nt, Mycobacterium tuberculosis H37Rv
cggagaaggcgcgggcgacg

SEQ ID NO: 1318613 - RNA, 17 nt, Mycobacterium tuberculosis H37Rv
cggagaaguucgugagc

SEQ ID NO: 1318614 - RNA, 20 nt, Mycobacterium tuberculosis H37Rv
cggagacaccgcaacgcgug

SEQ ID NO: 1318615 - RNA, 15 nt, Mycobacterium tuberculosis H37Rv
cggagacacccgcca

SEQ ID NO: 1318616 - RNA, 14 nt, Mycobacterium tuberculosis H37Rv
cggagacugguugc

SEQ ID NO: 1318617 - RNA, 15 nt, Mycobacterium tuberculosis H37Rv
cggagacggcggcca

SEQ ID NO: 1318618 - RNA, 17 nt, Mycobacterium tuberculosis H37Rv
cggacuucgccgcccgc

SEQ ID NO: 1318619 - RNA, 17 nt, Mycobacterium tuberculosis H37Rv
cggacuugaccagagca

SEQ ID NO: 1318620 - RNA, 21 nt, Mycobacterium tuberculosis H37Rv
cggagaacgcgucgcgcgccu

SEQ ID NO: 1318621 - RNA, 12 nt, Mycobacterium tuberculosis H37Rv
cggaagcgccgg

SEQ ID NO: 1318622 - RNA, 17 nt, Mycobacterium tuberculosis H37Rv
cggaagccgccuaggac

SEQ ID NO: 1318623 - RNA, 22 nt, Mycobacterium tuberculosis H37Rv
cggaaguagcgcaaugcggccc

SEQ ID NO: 1318624 - RNA, 20 nt, Mycobacterium tuberculosis H37Rv
cggaaggacggcagccacca

SEQ ID NO: 1318625 - RNA, 13 nt, Mycobacterium tuberculosis H37Rv
cggaaggccagcu

SEQ ID NO: 1318626 - RNA, 17 nt, Mycobacterium tuberculosis H37Rv
cggaaggacggcagcca

SEQ ID NO: 1318627 - RNA, 22 nt, Mycobacterium tuberculosis H37Rv
cggaaguucuccucgugcagca

SEQ ID NO: 1318628 - RNA, 14 nt, Mycobacterium tuberculosis H37Rv
cggaaucagcaccc

SEQ ID NO: 1318629 - RNA, 15 nt, Mycobacterium tuberculosis H37Rv
cggaaucggagucuu

SEQ ID NO: 1318630 - RNA, 23 nt, Mycobacterium tuberculosis H37Rv
cggaaucgcaucuagguucaguu

SEQ ID NO: 1318631 - RNA, 14 nt, Mycobacterium tuberculosis H37Rv
cggaacccagcacu

SEQ ID NO: 1318632 - RNA, 18 nt, Mycobacterium tuberculosis H37Rv
cggaaccgauaccucgcc

SEQ ID NO: 1318633 - RNA, 21 nt, Mycobacterium tuberculosis H37Rv
cggaacaccgacgucaggcuc

SEQ ID NO: 1318634 - RNA, 13 nt, Mycobacterium tuberculosis H37Rv
cgcuuucuuggcg

SEQ ID NO: 1318635 - RNA, 16 nt, Mycobacterium tuberculosis H37Rv
cgcugccuuggcgcgg

SEQ ID NO: 1318636 - RNA, 16 nt, Mycobacterium tuberculosis H37Rv
cgcugccggcgccgcc

SEQ ID NO: 1318637 - RNA, 22 nt, Mycobacterium tuberculosis H37Rv
cgcugccggugucucccuugcc

SEQ ID NO: 1318638 - RNA, 23 nt, Mycobacterium tuberculosis H37Rv
cgcugccucuugcucggcgugcu

SEQ ID NO: 1318639 - RNA, 13 nt, Mycobacterium tuberculosis H37Rv
cgcugccggcgcc

SEQ ID NO: 1318640 - RNA, 13 nt, Mycobacterium tuberculosis H37Rv
cgcugccggccgc

SEQ ID NO: 1318641 - RNA, 14 nt, Mycobacterium tuberculosis H37Rv
cgcugccggcagcg

SEQ ID NO: 1318642 - RNA, 22 nt, Mycobacterium tuberculosis H37Rv
cgcugccgccgaucgacacccg

SEQ ID NO: 1318643 - RNA, 21 nt, Mycobacterium tuberculosis H37Rv
cgcugccaaacuaacggcagc

SEQ ID NO: 1318644 - RNA, 18 nt, Mycobacterium tuberculosis H37Rv
cgcugccgccgccggcgg

SEQ ID NO: 1318645 - RNA, 24 nt, Mycobacterium tuberculosis H37Rv
cgcuucacgggccguccaggacgg

SEQ ID NO: 1318646 - RNA, 18 nt, Mycobacterium tuberculosis H37Rv
cgcuucacagccaccagc

SEQ ID NO: 1318647 - RNA, 15 nt, Mycobacterium tuberculosis H37Rv
cgcuucacgggccgu

SEQ ID NO: 1318648 - RNA, 16 nt, Mycobacterium tuberculosis H37Rv
cgcuucgccacaccau

SEQ ID NO: 1318649 - RNA, 18 nt, Mycobacterium tuberculosis H37Rv
cgcuucgcaagucaucca

SEQ ID NO: 1318650 - RNA, 18 nt, Mycobacterium tuberculosis H37Rv
cgcuuggcaaucaucucc

SEQ ID NO: 1318651 - RNA, 16 nt, Mycobacterium tuberculosis H37Rv
cgcuuggcgugaccua

SEQ ID NO: 1318652 - RNA, 18 nt, Mycobacterium tuberculosis H37Rv
cgcuuggccgcugccuuc

SEQ ID NO: 1318653 - RNA, 20 nt, Mycobacterium tuberculosis H37Rv
cgcuuggccgcugccuucuu

SEQ ID NO: 1318654 - RNA, 19 nt, Mycobacterium tuberculosis H37Rv
cgcuuggccggauccucga

SEQ ID NO: 1318655 - RNA, 23 nt, Mycobacterium tuberculosis H37Rv
cgcuugcugcauguccuccccga

SEQ ID NO: 1318656 - RNA, 18 nt, Mycobacterium tuberculosis H37Rv
cgcuugcuggguaguuca

SEQ ID NO: 1318657 - RNA, 13 nt, Mycobacterium tuberculosis H37Rv
cgcuugcggccgc

SEQ ID NO: 1318658 - RNA, 20 nt, Mycobacterium tuberculosis H37Rv
cgcuucggcagcucccgcca

SEQ ID NO: 1318659 - RNA, 16 nt, Mycobacterium tuberculosis H37Rv
cgcuucggccugugcg

SEQ ID NO: 1318660 - RNA, 16 nt, Mycobacterium tuberculosis H37Rv
cggcagauacucggcg

SEQ ID NO: 1318661 - RNA, 11 nt, Mycobacterium tuberculosis H37Rv
cggcagauggu

SEQ ID NO: 1318662 - RNA, 14 nt, Mycobacterium tuberculosis H37Rv
cggcagcacggucu

SEQ ID NO: 1318663 - RNA, 21 nt, Mycobacterium tuberculosis H37Rv
cggcagcaucggcaccccggc

SEQ ID NO: 1318664 - RNA, 14 nt, Mycobacterium tuberculosis H37Rv
cggcagcaggacac

SEQ ID NO: 1318665 - RNA, 21 nt, Mycobacterium tuberculosis H37Rv
cggcagcaggacacucuuuug

SEQ ID NO: 1318666 - RNA, 19 nt, Mycobacterium tuberculosis H37Rv
cggcagcagcggugcagcc

SEQ ID NO: 1318667 - RNA, 13 nt, Mycobacterium tuberculosis H37Rv
cggcagcggcgcu

SEQ ID NO: 1318668 - RNA, 15 nt, Mycobacterium tuberculosis H37Rv
cggcagcggcgcgcu

SEQ ID NO: 1318669 - RNA, 14 nt, Mycobacterium tuberculosis H37Rv
cggcagcccggcgg

SEQ ID NO: 1318670 - RNA, 23 nt, Mycobacterium tuberculosis H37Rv
cggcagcccaaagcgccagcagc

SEQ ID NO: 1318671 - RNA, 20 nt, Mycobacterium tuberculosis H37Rv
cggcacacccaucaccgcca

SEQ ID NO: 1318672 - RNA, 23 nt, Mycobacterium tuberculosis H37Rv
cggcacacccaucagcccucggc

SEQ ID NO: 1318673 - RNA, 23 nt, Mycobacterium tuberculosis H37Rv
cggcacacccuccacagcggcca

SEQ ID NO: 1318674 - RNA, 16 nt, Mycobacterium tuberculosis H37Rv
cggcacacggccuugc

SEQ ID NO: 1318675 - RNA, 18 nt, Mycobacterium tuberculosis H37Rv
cggcaauucgggcauggu

SEQ ID NO: 1318676 - RNA, 14 nt, Mycobacterium tuberculosis H37Rv
cggcaccgccgccc

SEQ ID NO: 1318677 - RNA, 16 nt, Mycobacterium tuberculosis H37Rv
cggcacaucaugggcg

SEQ ID NO: 1318678 - RNA, 19 nt, Mycobacterium tuberculosis H37Rv
cggcaccgccgcccccgcc

SEQ ID NO: 1318679 - RNA, 18 nt, Mycobacterium tuberculosis H37Rv
cggcaccgccgcccccgc

SEQ ID NO: 1318680 - RNA, 20 nt, Mycobacterium tuberculosis H37Rv
cggcaccgccggcuccgccg

SEQ ID NO: 1318681 - RNA, 19 nt, Mycobacterium tuberculosis H37Rv
cggcaccgccugcgccgcc

SEQ ID NO: 1318682 - RNA, 20 nt, Mycobacterium tuberculosis H37Rv
cggcaccgccugcgccgccc

SEQ ID NO: 1318683 - RNA, 22 nt, Mycobacterium tuberculosis H37Rv
cggcaccgccgguggcgccggg

SEQ ID NO: 1318684 - RNA, 21 nt, Mycobacterium tuberculosis H37Rv
cggcaccgccggcgcccaggc

SEQ ID NO: 1318685 - RNA, 15 nt, Mycobacterium tuberculosis H37Rv
cggcaccgcggccgc

SEQ ID NO: 1318686 - RNA, 16 nt, Mycobacterium tuberculosis H37Rv
cggcaccgcggccagc

SEQ ID NO: 1318687 - RNA, 13 nt, Mycobacterium tuberculosis H37Rv
cggcaccgcuuca

SEQ ID NO: 1318688 - RNA, 17 nt, Mycobacterium tuberculosis H37Rv
cggcaccgcuucaggcg

SEQ ID NO: 1318689 - RNA, 13 nt, Mycobacterium tuberculosis H37Rv
cggcaccgcugcc

SEQ ID NO: 1318690 - RNA, 22 nt, Mycobacterium tuberculosis H37Rv
cggcaccgguuuucgccggcuc

SEQ ID NO: 1318691 - RNA, 12 nt, Mycobacterium tuberculosis H37Rv
cggcaccggcuc

SEQ ID NO: 1318692 - RNA, 15 nt, Mycobacterium tuberculosis H37Rv
cggcaccggcucagg

SEQ ID NO: 1318693 - RNA, 16 nt, Mycobacterium tuberculosis H37Rv
cggcaccggcucaggg

SEQ ID NO: 1318694 - RNA, 13 nt, Mycobacterium tuberculosis H37Rv
cggcaccggggcu

SEQ ID NO: 1318695 - RNA, 16 nt, Mycobacterium tuberculosis H37Rv
cggcaccggggcugcc

SEQ ID NO: 1318696 - RNA, 20 nt, Mycobacterium tuberculosis H37Rv
cggcaccuccagcaccaccg

SEQ ID NO: 1318697 - RNA, 22 nt, Mycobacterium tuberculosis H37Rv
cggcacgcugaccggaucugac

SEQ ID NO: 1318698 - RNA, 23 nt, Mycobacterium tuberculosis H37Rv
cggcacggugaacaauccgagga

SEQ ID NO: 1318699 - RNA, 18 nt, Mycobacterium tuberculosis H37Rv
cggcaagcgcacgcugag

SEQ ID NO: 1318700 - RNA, 18 nt, Mycobacterium tuberculosis H37Rv
cggcaagaaacagguaag

SEQ ID NO: 1318701 - RNA, 12 nt, Mycobacterium tuberculosis H37Rv
cggcaagucgac

SEQ ID NO: 1318702 - RNA, 14 nt, Mycobacterium tuberculosis H37Rv
cggcaaguuccacg

SEQ ID NO: 1318703 - RNA, 17 nt, Mycobacterium tuberculosis H37Rv
cggcaaggacggagccc

SEQ ID NO: 1318704 - RNA, 23 nt, Mycobacterium tuberculosis H37Rv
cggcaaugcacaaaaaccgaccg

SEQ ID NO: 1318705 - RNA, 17 nt, Mycobacterium tuberculosis H37Rv
cggcaaucgggucugga

SEQ ID NO: 1318706 - RNA, 19 nt, Mycobacterium tuberculosis H37Rv
cggcaaucucaugcccggg

SEQ ID NO: 1318707 - RNA, 21 nt, Mycobacterium tuberculosis H37Rv
cggcaaucgacucagcccggc

SEQ ID NO: 1318708 - RNA, 19 nt, Mycobacterium tuberculosis H37Rv
cggauccaccacgcuggcc

SEQ ID NO: 1318709 - RNA, 15 nt, Mycobacterium tuberculosis H37Rv
cggaucccgaggcgc

SEQ ID NO: 1318710 - RNA, 21 nt, Mycobacterium tuberculosis H37Rv
cggaucccugugccagcagca

SEQ ID NO: 1318711 - RNA, 14 nt, Mycobacterium tuberculosis H37Rv
cggaucccagugcc

SEQ ID NO: 1318712 - RNA, 23 nt, Mycobacterium tuberculosis H37Rv
cggaucgaaacucagcccgucgg

SEQ ID NO: 1318713 - RNA, 23 nt, Mycobacterium tuberculosis H37Rv
cggcaacgcggucugcuccaggc

SEQ ID NO: 1318714 - RNA, 14 nt, Mycobacterium tuberculosis H37Rv
cggcaacgcggucu

SEQ ID NO: 1318715 - RNA, 17 nt, Mycobacterium tuberculosis H37Rv
cggcaacgccuccggag

SEQ ID NO: 1318716 - RNA, 23 nt, Mycobacterium tuberculosis H37Rv
cggcaacgaucgacaccagggcg

SEQ ID NO: 1318717 - RNA, 14 nt, Mycobacterium tuberculosis H37Rv
cggauauuccuuua

SEQ ID NO: 1318718 - RNA, 16 nt, Mycobacterium tuberculosis H37Rv
cggauaucgaccaccg

SEQ ID NO: 1318719 - RNA, 22 nt, Mycobacterium tuberculosis H37Rv
cggaucagcccgcgcagcagug

SEQ ID NO: 1318720 - RNA, 14 nt, Mycobacterium tuberculosis H37Rv
cggaucaaaaacca

SEQ ID NO: 1318721 - RNA, 20 nt, Mycobacterium tuberculosis H37Rv
cggauaggacgaacaacgcg

SEQ ID NO: 1318722 - RNA, 17 nt, Mycobacterium tuberculosis H37Rv
cggccagaaacccggcg

SEQ ID NO: 1318723 - RNA, 13 nt, Mycobacterium tuberculosis H37Rv
cggccagagccgc

SEQ ID NO: 1318724 - RNA, 17 nt, Mycobacterium tuberculosis H37Rv
cggccagagccgcgcgc

SEQ ID NO: 1318725 - RNA, 19 nt, Mycobacterium tuberculosis H37Rv
cggccacugauucgcaggc

SEQ ID NO: 1318726 - RNA, 21 nt, Mycobacterium tuberculosis H37Rv
cggccacugauucgcaggcuc

SEQ ID NO: 1318727 - RNA, 22 nt, Mycobacterium tuberculosis H37Rv
cggccacggcgucggccacccg

SEQ ID NO: 1318728 - RNA, 15 nt, Mycobacterium tuberculosis H37Rv
cggccacgguccggc

SEQ ID NO: 1318729 - RNA, 13 nt, Mycobacterium tuberculosis H37Rv
cggccacggccau

SEQ ID NO: 1318730 - RNA, 13 nt, Mycobacterium tuberculosis H37Rv
cggccaccugcuc

SEQ ID NO: 1318731 - RNA, 21 nt, Mycobacterium tuberculosis H37Rv
cggccaccggcgucugcccgc

SEQ ID NO: 1318732 - RNA, 20 nt, Mycobacterium tuberculosis H37Rv
cggccaccgaggcguucagu

SEQ ID NO: 1318733 - RNA, 21 nt, Mycobacterium tuberculosis H37Rv
cggccaccgcacgcuggcggg

SEQ ID NO: 1318734 - RNA, 15 nt, Mycobacterium tuberculosis H37Rv
cggccaccgccgccg

SEQ ID NO: 1318735 - RNA, 20 nt, Mycobacterium tuberculosis H37Rv
cggccaccgucagcgcgacc

SEQ ID NO: 1318736 - RNA, 14 nt, Mycobacterium tuberculosis H37Rv
cggccaccucggug

SEQ ID NO: 1318737 - RNA, 17 nt, Mycobacterium tuberculosis H37Rv
cggccaccgccugagcg

SEQ ID NO: 1318738 - RNA, 13 nt, Mycobacterium tuberculosis H37Rv
cggccaccggcgu

SEQ ID NO: 1318739 - RNA, 15 nt, Mycobacterium tuberculosis H37Rv
cggccaccagggcca

SEQ ID NO: 1318740 - RNA, 20 nt, Mycobacterium tuberculosis H37Rv
cggccaccagggccaccgcg

SEQ ID NO: 1318741 - RNA, 15 nt, Mycobacterium tuberculosis H37Rv
cggccaccagcgccu

SEQ ID NO: 1318742 - RNA, 16 nt, Mycobacterium tuberculosis H37Rv
cggccaccaggugccg

SEQ ID NO: 1318743 - RNA, 18 nt, Mycobacterium tuberculosis H37Rv
cggccaccaccgccgccg

SEQ ID NO: 1318744 - RNA, 14 nt, Mycobacterium tuberculosis H37Rv
cggccaccagcccg

SEQ ID NO: 1318745 - RNA, 22 nt, Mycobacterium tuberculosis H37Rv
cggccauagcgccgcgcccacc

SEQ ID NO: 1318746 - RNA, 15 nt, Mycobacterium tuberculosis H37Rv
cggccauacgcgcgc

SEQ ID NO: 1318747 - RNA, 20 nt, Mycobacterium tuberculosis H37Rv
cggccaguugguagccgccc

SEQ ID NO: 1318748 - RNA, 15 nt, Mycobacterium tuberculosis H37Rv
cggccaguuuccaga

SEQ ID NO: 1318749 - RNA, 22 nt, Mycobacterium tuberculosis H37Rv
cggccaggaguuugaccaccug

SEQ ID NO: 1318750 - RNA, 20 nt, Mycobacterium tuberculosis H37Rv
cggccaggaucaaccggccc

SEQ ID NO: 1318751 - RNA, 23 nt, Mycobacterium tuberculosis H37Rv
cggccaggaugccugccacccgu

SEQ ID NO: 1318752 - RNA, 23 nt, Mycobacterium tuberculosis H37Rv
cggccaggaugaauuuggugaag

SEQ ID NO: 1318753 - RNA, 18 nt, Mycobacterium tuberculosis H37Rv
cggccaggccgucggcgu

SEQ ID NO: 1318754 - RNA, 15 nt, Mycobacterium tuberculosis H37Rv
cggccaggccggcgg

SEQ ID NO: 1318755 - RNA, 12 nt, Mycobacterium tuberculosis H37Rv
cggccagcagca

SEQ ID NO: 1318756 - RNA, 21 nt, Mycobacterium tuberculosis H37Rv
cggccagcggccauccggcgg

SEQ ID NO: 1318757 - RNA, 21 nt, Mycobacterium tuberculosis H37Rv
cggccaggaguuugaccaccu

SEQ ID NO: 1318758 - RNA, 17 nt, Mycobacterium tuberculosis H37Rv
cggccagcuugcggagc

SEQ ID NO: 1318759 - RNA, 12 nt, Mycobacterium tuberculosis H37Rv
cggccaggacaa

SEQ ID NO: 1318760 - RNA, 20 nt, Mycobacterium tuberculosis H37Rv
cggccagcuugcggagccgc

SEQ ID NO: 1318761 - RNA, 21 nt, Mycobacterium tuberculosis H37Rv
cggccagcuugcggagccgcc

SEQ ID NO: 1318762 - RNA, 16 nt, Mycobacterium tuberculosis H37Rv
cggccagcuccgccug

SEQ ID NO: 1318763 - RNA, 19 nt, Mycobacterium tuberculosis H37Rv
cggccagcgugucccaacg

SEQ ID NO: 1318764 - RNA, 20 nt, Mycobacterium tuberculosis H37Rv
cggccagcgugucccaacgc

SEQ ID NO: 1318765 - RNA, 15 nt, Mycobacterium tuberculosis H37Rv
cggccagcuccagcg

SEQ ID NO: 1318766 - RNA, 13 nt, Mycobacterium tuberculosis H37Rv
cggccagcucccg

SEQ ID NO: 1318767 - RNA, 18 nt, Mycobacterium tuberculosis H37Rv
cggccagcgugucccaac

SEQ ID NO: 1318768 - RNA, 19 nt, Mycobacterium tuberculosis H37Rv
cggcagcuggucggugggc

SEQ ID NO: 1318769 - RNA, 20 nt, Mycobacterium tuberculosis H37Rv
cggcagcuggcgcagccugc

SEQ ID NO: 1318770 - RNA, 21 nt, Mycobacterium tuberculosis H37Rv
cggcagcuggggcccggccgc

SEQ ID NO: 1318771 - RNA, 13 nt, Mycobacterium tuberculosis H37Rv
cggcaucuccacc

SEQ ID NO: 1318772 - RNA, 17 nt, Mycobacterium tuberculosis H37Rv
cggcaucggugguaaca

SEQ ID NO: 1318773 - RNA, 16 nt, Mycobacterium tuberculosis H37Rv
cggcagcgugcggggc

SEQ ID NO: 1318774 - RNA, 22 nt, Mycobacterium tuberculosis H37Rv
cggcagcgguuuuaggcagccc

SEQ ID NO: 1318775 - RNA, 15 nt, Mycobacterium tuberculosis H37Rv
cggcagcucccgcca

SEQ ID NO: 1318776 - RNA, 20 nt, Mycobacterium tuberculosis H37Rv
cggcagcguccgaaccaccu

SEQ ID NO: 1318777 - RNA, 23 nt, Mycobacterium tuberculosis H37Rv
cggcagcggguuugccgggcgcu

SEQ ID NO: 1318778 - RNA, 22 nt, Mycobacterium tuberculosis H37Rv
cggcauguuccuugcggccgcu

SEQ ID NO: 1318779 - RNA, 19 nt, Mycobacterium tuberculosis H37Rv
cggcaugggccggcgccgc

SEQ ID NO: 1318780 - RNA, 15 nt, Mycobacterium tuberculosis H37Rv
cggcaugggcccugc

SEQ ID NO: 1318781 - RNA, 22 nt, Mycobacterium tuberculosis H37Rv
cggcaugccgccaugcgcacca

SEQ ID NO: 1318782 - RNA, 20 nt, Mycobacterium tuberculosis H37Rv
cggcaugcgugccggcagcg

SEQ ID NO: 1318783 - RNA, 20 nt, Mycobacterium tuberculosis H37Rv
cggcauucucgagcacccgc

SEQ ID NO: 1318784 - RNA, 18 nt, Mycobacterium tuberculosis H37Rv
cggcauuggcgucgucgc

SEQ ID NO: 1318785 - RNA, 23 nt, Mycobacterium tuberculosis H37Rv
cggccaaaauuuugucggccgcc

SEQ ID NO: 1318786 - RNA, 17 nt, Mycobacterium tuberculosis H37Rv
cggccaaagacccggca

SEQ ID NO: 1318787 - RNA, 17 nt, Mycobacterium tuberculosis H37Rv
cggccaacccaucccga

SEQ ID NO: 1318788 - RNA, 16 nt, Mycobacterium tuberculosis H37Rv
cggccaaccaccaacu

SEQ ID NO: 1318789 - RNA, 21 nt, Mycobacterium tuberculosis H37Rv
cggccaaccccgaugaggcgc

SEQ ID NO: 1318790 - RNA, 14 nt, Mycobacterium tuberculosis H37Rv
cggccaaccaccaa

SEQ ID NO: 1318791 - RNA, 15 nt, Mycobacterium tuberculosis H37Rv
cggccaacaccacua

SEQ ID NO: 1318792 - RNA, 21 nt, Mycobacterium tuberculosis H37Rv
cggccaacggcuccgggcgcu

SEQ ID NO: 1318793 - RNA, 21 nt, Mycobacterium tuberculosis H37Rv
cggccaacuucugcacgaacg

SEQ ID NO: 1318794 - RNA, 18 nt, Mycobacterium tuberculosis H37Rv
cggccaagaccgcggccc

SEQ ID NO: 1318795 - RNA, 16 nt, Mycobacterium tuberculosis H37Rv
cggccaaucagcccgc

SEQ ID NO: 1318796 - RNA, 20 nt, Mycobacterium tuberculosis H37Rv
cggccaaucagcccgccgga

SEQ ID NO: 1318797 - RNA, 18 nt, Mycobacterium tuberculosis H37Rv
cggccaagaucggcgccc

SEQ ID NO: 1318798 - RNA, 22 nt, Mycobacterium tuberculosis H37Rv
cggccaagaucggcgccccugc

SEQ ID NO: 1318799 - RNA, 23 nt, Mycobacterium tuberculosis H37Rv
cggccaacgaacgugccccggcg

SEQ ID NO: 1318800 - RNA, 22 nt, Mycobacterium tuberculosis H37Rv
cggccaacgaacgugccccggc

SEQ ID NO: 1318801 - RNA, 13 nt, Mycobacterium tuberculosis H37Rv
cggccaacugggc

SEQ ID NO: 1318802 - RNA, 12 nt, Mycobacterium tuberculosis H37Rv
cggccaccaacc

SEQ ID NO: 1318803 - RNA, 13 nt, Mycobacterium tuberculosis H37Rv
cggccaccaaccu

SEQ ID NO: 1318804 - RNA, 13 nt, Mycobacterium tuberculosis H37Rv
cggccaccaacuc

SEQ ID NO: 1318805 - RNA, 14 nt, Mycobacterium tuberculosis H37Rv
cggccaccacaacg

SEQ ID NO: 1318806 - RNA, 16 nt, Mycobacterium tuberculosis H37Rv
cggccacaucgccagc

SEQ ID NO: 1318807 - RNA, 21 nt, Mycobacterium tuberculosis H37Rv
cggccaccaccgagcgcaacc

SEQ ID NO: 1318808 - RNA, 17 nt, Mycobacterium tuberculosis H37Rv
cggccacauaccaccac

SEQ ID NO: 1318809 - RNA, 18 nt, Mycobacterium tuberculosis H37Rv
cggccacauaccaccacg

SEQ ID NO: 1318810 - RNA, 14 nt, Mycobacterium tuberculosis H37Rv
cggcgccagcgccg

SEQ ID NO: 1318811 - RNA, 14 nt, Mycobacterium tuberculosis H37Rv
cggcgcccagcucg

SEQ ID NO: 1318812 - RNA, 17 nt, Mycobacterium tuberculosis H37Rv
cggcgccauuggcgucc

SEQ ID NO: 1318813 - RNA, 12 nt, Mycobacterium tuberculosis H37Rv
cggcgcccagga

SEQ ID NO: 1318814 - RNA, 15 nt, Mycobacterium tuberculosis H37Rv
cggcgcccaggaacu

SEQ ID NO: 1318815 - RNA, 22 nt, Mycobacterium tuberculosis H37Rv
cggcgcccacaucgucggcggg

SEQ ID NO: 1318816 - RNA, 15 nt, Mycobacterium tuberculosis H37Rv
cggcgcccagcgccu

SEQ ID NO: 1318817 - RNA, 13 nt, Mycobacterium tuberculosis H37Rv
cggcgcccggcuu

SEQ ID NO: 1318818 - RNA, 24 nt, Mycobacterium tuberculosis H37Rv
cggcgcccgcucggccgcagccag

SEQ ID NO: 1318819 - RNA, 21 nt, Mycobacterium tuberculosis H37Rv
cggcgcccgcucggccgcagc

SEQ ID NO: 1318820 - RNA, 12 nt, Mycobacterium tuberculosis H37Rv
cggcgcccaggc

SEQ ID NO: 1318821 - RNA, 17 nt, Mycobacterium tuberculosis H37Rv
cggcgcccgccgcgaac

SEQ ID NO: 1318822 - RNA, 17 nt, Mycobacterium tuberculosis H37Rv
cggcgccgcccuugccg

SEQ ID NO: 1318823 - RNA, 13 nt, Mycobacterium tuberculosis H37Rv
cggcgccgcccga

SEQ ID NO: 1318824 - RNA, 18 nt, Mycobacterium tuberculosis H37Rv
cggcgccgcccgcgccgc

SEQ ID NO: 1318825 - RNA, 11 nt, Mycobacterium tuberculosis H37Rv
cggcgccgccc

SEQ ID NO: 1318826 - RNA, 19 nt, Mycobacterium tuberculosis H37Rv
cggcgccgcccaacgcgag

SEQ ID NO: 1318827 - RNA, 20 nt, Mycobacterium tuberculosis H37Rv
cggcgccgccagcaccaccg

SEQ ID NO: 1318828 - RNA, 22 nt, Mycobacterium tuberculosis H37Rv
cggcgccgccacugccggcagc

SEQ ID NO: 1318829 - RNA, 16 nt, Mycobacterium tuberculosis H37Rv
cggcgccgccacggau

SEQ ID NO: 1318830 - RNA, 20 nt, Mycobacterium tuberculosis H37Rv
cggcgccgccguccagcgcc

SEQ ID NO: 1318831 - RNA, 14 nt, Mycobacterium tuberculosis H37Rv
cggcgccgcauacc

SEQ ID NO: 1318832 - RNA, 14 nt, Mycobacterium tuberculosis H37Rv
cggcgccgcagauc

SEQ ID NO: 1318833 - RNA, 14 nt, Mycobacterium tuberculosis H37Rv
cggcgccgagcagc

SEQ ID NO: 1318834 - RNA, 17 nt, Mycobacterium tuberculosis H37Rv
cggcgcccuggccgccc

SEQ ID NO: 1318835 - RNA, 14 nt, Mycobacterium tuberculosis H37Rv
cggcgcccggucga

SEQ ID NO: 1318836 - RNA, 18 nt, Mycobacterium tuberculosis H37Rv
cggcgccgaaaccgccgg

SEQ ID NO: 1318837 - RNA, 22 nt, Mycobacterium tuberculosis H37Rv
cggcgcaccuugaccgucgcgc

SEQ ID NO: 1318838 - RNA, 22 nt, Mycobacterium tuberculosis H37Rv
cggcgaugaacagcgacgccau

SEQ ID NO: 1318839 - RNA, 21 nt, Mycobacterium tuberculosis H37Rv
cggcgcagcacauccugcagc

SEQ ID NO: 1318840 - RNA, 19 nt, Mycobacterium tuberculosis H37Rv
cggcgcacgaaaccgcagc

SEQ ID NO: 1318841 - RNA, 17 nt, Mycobacterium tuberculosis H37Rv
cggcgcaguagccgacc

SEQ ID NO: 1318842 - RNA, 14 nt, Mycobacterium tuberculosis H37Rv
cggcgcagugcagg

SEQ ID NO: 1318843 - RNA, 14 nt, Mycobacterium tuberculosis H37Rv
cggcgccagaugcc

SEQ ID NO: 1318844 - RNA, 13 nt, Mycobacterium tuberculosis H37Rv
cggcgccagcaga

SEQ ID NO: 1318845 - RNA, 20 nt, Mycobacterium tuberculosis H37Rv
cggcgccaccggcgccgccc

SEQ ID NO: 1318846 - RNA, 19 nt, Mycobacterium tuberculosis H37Rv
cggcgccaccggcgccgcc

SEQ ID NO: 1318847 - RNA, 16 nt, Mycobacterium tuberculosis H37Rv
cggcgccaccgccgcu

SEQ ID NO: 1318848 - RNA, 17 nt, Mycobacterium tuberculosis H37Rv
cggcgccaauucagcgg

SEQ ID NO: 1318849 - RNA, 17 nt, Mycobacterium tuberculosis H37Rv
cggcgccacccgcgccg

SEQ ID NO: 1318850 - RNA, 13 nt, Mycobacterium tuberculosis H37Rv
cggcgccaccgag

SEQ ID NO: 1318851 - RNA, 23 nt, Mycobacterium tuberculosis H37Rv
cggcgccaauggcggaccgggcc

SEQ ID NO: 1318852 - RNA, 23 nt, Mycobacterium tuberculosis H37Rv
cggcgcgguggggcgcgccggcu

SEQ ID NO: 1318853 - RNA, 21 nt, Mycobacterium tuberculosis H37Rv
cggcgcgguuuccagacgacc

SEQ ID NO: 1318854 - RNA, 19 nt, Mycobacterium tuberculosis H37Rv
cggcgcgguggggcgcgcc

SEQ ID NO: 1318855 - RNA, 16 nt, Mycobacterium tuberculosis H37Rv
cggcgcgggucggcga

SEQ ID NO: 1318856 - RNA, 14 nt, Mycobacterium tuberculosis H37Rv
cggcgcgcgcgccg

SEQ ID NO: 1318857 - RNA, 16 nt, Mycobacterium tuberculosis H37Rv
cggcgcggcgggcagc

SEQ ID NO: 1318858 - RNA, 13 nt, Mycobacterium tuberculosis H37Rv
cggcgcugcugcc

SEQ ID NO: 1318859 - RNA, 17 nt, Mycobacterium tuberculosis H37Rv
cggcgcgggucacgccg

SEQ ID NO: 1318860 - RNA, 21 nt, Mycobacterium tuberculosis H37Rv
cggcgcguccgggcucgcgcu

SEQ ID NO: 1318861 - RNA, 14 nt, Mycobacterium tuberculosis H37Rv
cggcgcggcugccg

SEQ ID NO: 1318862 - RNA, 21 nt, Mycobacterium tuberculosis H37Rv
cggcgcgccgaguugcccggg

SEQ ID NO: 1318863 - RNA, 21 nt, Mycobacterium tuberculosis H37Rv
cggcgcgccgaucggcaccgu

SEQ ID NO: 1318864 - RNA, 12 nt, Mycobacterium tuberculosis H37Rv
cggcgcgccccg

SEQ ID NO: 1318865 - RNA, 13 nt, Mycobacterium tuberculosis H37Rv
cggcgcgccccgc

SEQ ID NO: 1318866 - RNA, 21 nt, Mycobacterium tuberculosis H37Rv
cggcgcgaggaacgccggggc

SEQ ID NO: 1318867 - RNA, 15 nt, Mycobacterium tuberculosis H37Rv
cggcgcgacgcccga

SEQ ID NO: 1318868 - RNA, 12 nt, Mycobacterium tuberculosis H37Rv
cggcgcgcaccc

SEQ ID NO: 1318869 - RNA, 16 nt, Mycobacterium tuberculosis H37Rv
cggcgcgcaccccggc

SEQ ID NO: 1318870 - RNA, 18 nt, Mycobacterium tuberculosis H37Rv
cggcgccucggaccagac

SEQ ID NO: 1318871 - RNA, 20 nt, Mycobacterium tuberculosis H37Rv
cggcgccucggaccagaccc

SEQ ID NO: 1318872 - RNA, 16 nt, Mycobacterium tuberculosis H37Rv
cggcgccuggcggcgc

SEQ ID NO: 1318873 - RNA, 21 nt, Mycobacterium tuberculosis H37Rv
cggcgccgucguugugccggu

SEQ ID NO: 1318874 - RNA, 17 nt, Mycobacterium tuberculosis H37Rv
cggcgccguugccgccg

SEQ ID NO: 1318875 - RNA, 21 nt, Mycobacterium tuberculosis H37Rv
cggcgccuuggucgccgccuu

SEQ ID NO: 1318876 - RNA, 16 nt, Mycobacterium tuberculosis H37Rv
cggcgccggcggccgc

SEQ ID NO: 1318877 - RNA, 13 nt, Mycobacterium tuberculosis H37Rv
cggcgccggcggc

SEQ ID NO: 1318878 - RNA, 20 nt, Mycobacterium tuberculosis H37Rv
cggcgccggcgucggcgccc

SEQ ID NO: 1318879 - RNA, 23 nt, Mycobacterium tuberculosis H37Rv
cggcgccggcgucggcgcccagc

SEQ ID NO: 1318880 - RNA, 17 nt, Mycobacterium tuberculosis H37Rv
cggcgccgucgcccagc

SEQ ID NO: 1318881 - RNA, 13 nt, Mycobacterium tuberculosis H37Rv
cggcgccgguggg

SEQ ID NO: 1318882 - RNA, 12 nt, Mycobacterium tuberculosis H37Rv
cggcgccgucga

SEQ ID NO: 1318883 - RNA, 18 nt, Mycobacterium tuberculosis H37Rv
cggcgccggugccgccuc

SEQ ID NO: 1318884 - RNA, 19 nt, Mycobacterium tuberculosis H37Rv
cggcgccgcgccgucccga

SEQ ID NO: 1318885 - RNA, 13 nt, Mycobacterium tuberculosis H37Rv
cggcgccggcauc

SEQ ID NO: 1318886 - RNA, 14 nt, Mycobacterium tuberculosis H37Rv
cggcgccgcgggug

SEQ ID NO: 1318887 - RNA, 15 nt, Mycobacterium tuberculosis H37Rv
cggcgccgcgcggcu

SEQ ID NO: 1318888 - RNA, 12 nt, Mycobacterium tuberculosis H37Rv
cggcgccgcggg

SEQ ID NO: 1318889 - RNA, 22 nt, Mycobacterium tuberculosis H37Rv
cggcgaucaacucgggcagcgc

SEQ ID NO: 1318890 - RNA, 15 nt, Mycobacterium tuberculosis H37Rv
cggcgaucaagccuc

SEQ ID NO: 1318891 - RNA, 21 nt, Mycobacterium tuberculosis H37Rv
cggcgaucgcuccgcggcgca

SEQ ID NO: 1318892 - RNA, 17 nt, Mycobacterium tuberculosis H37Rv
cggcgaucuccggcgga

SEQ ID NO: 1318893 - RNA, 16 nt, Mycobacterium tuberculosis H37Rv
cggcgaucaacucggg

SEQ ID NO: 1318894 - RNA, 17 nt, Mycobacterium tuberculosis H37Rv
cggcgaucaacgcgcac

SEQ ID NO: 1318895 - RNA, 16 nt, Mycobacterium tuberculosis H37Rv
cggcgaucaacgcgca

SEQ ID NO: 1318896 - RNA, 19 nt, Mycobacterium tuberculosis H37Rv
cggcgauauaggacgccgc

SEQ ID NO: 1318897 - RNA, 23 nt, Mycobacterium tuberculosis H37Rv
cggcgaggugcccaaggccagga

SEQ ID NO: 1318898 - RNA, 19 nt, Mycobacterium tuberculosis H37Rv
cggcgagugguccagccag

SEQ ID NO: 1318899 - RNA, 18 nt, Mycobacterium tuberculosis H37Rv
cggcgaugaccgggcgau

SEQ ID NO: 1318900 - RNA, 17 nt, Mycobacterium tuberculosis H37Rv
cggcgauuacggccagu

SEQ ID NO: 1318901 - RNA, 19 nt, Mycobacterium tuberculosis H37Rv
cggcgaugcguccgcccag

SEQ ID NO: 1318902 - RNA, 20 nt, Mycobacterium tuberculosis H37Rv
cggcgaugcuaugcaguucc

SEQ ID NO: 1318903 - RNA, 17 nt, Mycobacterium tuberculosis H37Rv
cggcgaugcggucggcc

SEQ ID NO: 1318904 - RNA, 18 nt, Mycobacterium tuberculosis H37Rv
cggcgaugcggucggcca

SEQ ID NO: 1318905 - RNA, 15 nt, Mycobacterium tuberculosis H37Rv
cggcgaugcggucgg

SEQ ID NO: 1318906 - RNA, 15 nt, Mycobacterium tuberculosis H37Rv
cggcgauggcgcgca

SEQ ID NO: 1318907 - RNA, 15 nt, Mycobacterium tuberculosis H37Rv
cggcgaugcugagcc

SEQ ID NO: 1318908 - RNA, 17 nt, Mycobacterium tuberculosis H37Rv
cggcgaccucggcggcg

SEQ ID NO: 1318909 - RNA, 23 nt, Mycobacterium tuberculosis H37Rv
cggcgaccucggguugcagcagc

SEQ ID NO: 1318910 - RNA, 23 nt, Mycobacterium tuberculosis H37Rv
cggcgaccgacgccggugucggc

SEQ ID NO: 1318911 - RNA, 14 nt, Mycobacterium tuberculosis H37Rv
cggcgacgaaccgc

SEQ ID NO: 1318912 - RNA, 15 nt, Mycobacterium tuberculosis H37Rv
cggcgacgccgcugg

SEQ ID NO: 1318913 - RNA, 19 nt, Mycobacterium tuberculosis H37Rv
cggcgacgaugucgagcgc

SEQ ID NO: 1318914 - RNA, 17 nt, Mycobacterium tuberculosis H37Rv
cggcgacgaaugcagca

SEQ ID NO: 1318915 - RNA, 17 nt, Mycobacterium tuberculosis H37Rv
cggcgacgagcgcagcg

SEQ ID NO: 1318916 - RNA, 19 nt, Mycobacterium tuberculosis H37Rv
cggcgacgaccgucggcuc

SEQ ID NO: 1318917 - RNA, 12 nt, Mycobacterium tuberculosis H37Rv
cggcgacgcgga

SEQ ID NO: 1318918 - RNA, 14 nt, Mycobacterium tuberculosis H37Rv
cggcgacgcguagc

SEQ ID NO: 1318919 - RNA, 14 nt, Mycobacterium tuberculosis H37Rv
cggcgacgcgucga

SEQ ID NO: 1318920 - RNA, 20 nt, Mycobacterium tuberculosis H37Rv
cggcgacugcgcaccugggu

SEQ ID NO: 1318921 - RNA, 17 nt, Mycobacterium tuberculosis H37Rv
cggcgacguggcgccga

SEQ ID NO: 1318922 - RNA, 14 nt, Mycobacterium tuberculosis H37Rv
cggcgacggccgcu

SEQ ID NO: 1318923 - RNA, 19 nt, Mycobacterium tuberculosis H37Rv
cggcgacguuccgcucgag

SEQ ID NO: 1318924 - RNA, 17 nt, Mycobacterium tuberculosis H37Rv
cggcgacuacccagcca

SEQ ID NO: 1318925 - RNA, 22 nt, Mycobacterium tuberculosis H37Rv
cggcgacuacccagccagccgc

SEQ ID NO: 1318926 - RNA, 20 nt, Mycobacterium tuberculosis H37Rv
cggcgagcagacgcaaaagc

SEQ ID NO: 1318927 - RNA, 23 nt, Mycobacterium tuberculosis H37Rv
cggcgagcgcaucggccaacacc

SEQ ID NO: 1318928 - RNA, 15 nt, Mycobacterium tuberculosis H37Rv
cggcgagccgcgccc

SEQ ID NO: 1318929 - RNA, 18 nt, Mycobacterium tuberculosis H37Rv
cggcgagccucgcgcgcc

SEQ ID NO: 1318930 - RNA, 17 nt, Mycobacterium tuberculosis H37Rv
cggcgagcacccgcugg

SEQ ID NO: 1318931 - RNA, 16 nt, Mycobacterium tuberculosis H37Rv
cggcgagcacgcgggc

SEQ ID NO: 1318932 - RNA, 22 nt, Mycobacterium tuberculosis H37Rv
cggcgagcacgucacgcgcggc

SEQ ID NO: 1318933 - RNA, 14 nt, Mycobacterium tuberculosis H37Rv
cggcgagcagggcg

SEQ ID NO: 1318934 - RNA, 14 nt, Mycobacterium tuberculosis H37Rv
cggcgagcagagaa

SEQ ID NO: 1318935 - RNA, 18 nt, Mycobacterium tuberculosis H37Rv
cggcgagagggcggggca

SEQ ID NO: 1318936 - RNA, 21 nt, Mycobacterium tuberculosis H37Rv
cggcgagcaauuccucagccg

SEQ ID NO: 1318937 - RNA, 20 nt, Mycobacterium tuberculosis H37Rv
cggccuuggcggccgcgacc

SEQ ID NO: 1318938 - RNA, 16 nt, Mycobacterium tuberculosis H37Rv
cggccuuuacccgggc

SEQ ID NO: 1318939 - RNA, 22 nt, Mycobacterium tuberculosis H37Rv
cggccuuugucgccuucuuggc

SEQ ID NO: 1318940 - RNA, 19 nt, Mycobacterium tuberculosis H37Rv
cggccuuugucgccuucuu

SEQ ID NO: 1318941 - RNA, 21 nt, Mycobacterium tuberculosis H37Rv
cggcgaaaacaacaccaccgc

SEQ ID NO: 1318942 - RNA, 17 nt, Mycobacterium tuberculosis H37Rv
cggccccaugcgccagc

SEQ ID NO: 1318943 - RNA, 17 nt, Mycobacterium tuberculosis H37Rv
cggccuugcgcacaggc

SEQ ID NO: 1318944 - RNA, 20 nt, Mycobacterium tuberculosis H37Rv
cggccuugcgggcucucggc

SEQ ID NO: 1318945 - RNA, 20 nt, Mycobacterium tuberculosis H37Rv
cggcccaugaaggagauccc

SEQ ID NO: 1318946 - RNA, 20 nt, Mycobacterium tuberculosis H37Rv
cggccccaccggugccgccg

SEQ ID NO: 1318947 - RNA, 23 nt, Mycobacterium tuberculosis H37Rv
cggccauauugggaguccggccg

SEQ ID NO: 1318948 - RNA, 19 nt, Mycobacterium tuberculosis H37Rv
cggccaucagaaccuccuc

SEQ ID NO: 1318949 - RNA, 20 nt, Mycobacterium tuberculosis H37Rv
cggcccagugggacaggucg

SEQ ID NO: 1318950 - RNA, 20 nt, Mycobacterium tuberculosis H37Rv
cggcccagguugccuuggcg

SEQ ID NO: 1318951 - RNA, 21 nt, Mycobacterium tuberculosis H37Rv
cggcccagguugccuuggcgg

SEQ ID NO: 1318952 - RNA, 20 nt, Mycobacterium tuberculosis H37Rv
cggcccaguucugcaggaag

SEQ ID NO: 1318953 - RNA, 14 nt, Mycobacterium tuberculosis H37Rv
cggccauggacgcc

SEQ ID NO: 1318954 - RNA, 21 nt, Mycobacterium tuberculosis H37Rv
cggccaugguguucggcagcg

SEQ ID NO: 1318955 - RNA, 15 nt, Mycobacterium tuberculosis H37Rv
cggcccagcgccccc

SEQ ID NO: 1318956 - RNA, 21 nt, Mycobacterium tuberculosis H37Rv
cggcgaacagccccagggugc

SEQ ID NO: 1318957 - RNA, 14 nt, Mycobacterium tuberculosis H37Rv
cggcgaacccagcg

SEQ ID NO: 1318958 - RNA, 23 nt, Mycobacterium tuberculosis H37Rv
cggcgaacccagcggagccacuc

SEQ ID NO: 1318959 - RNA, 21 nt, Mycobacterium tuberculosis H37Rv
cggcgaacccgccgaugccgc

SEQ ID NO: 1318960 - RNA, 21 nt, Mycobacterium tuberculosis H37Rv
cggcgaacgcgaaugucgcgc

SEQ ID NO: 1318961 - RNA, 23 nt, Mycobacterium tuberculosis H37Rv
cggcgaacgcguccagcgcggcc

SEQ ID NO: 1318962 - RNA, 21 nt, Mycobacterium tuberculosis H37Rv
cggcgaacggauucccgccca

SEQ ID NO: 1318963 - RNA, 15 nt, Mycobacterium tuberculosis H37Rv
cggcgaagccggccg

SEQ ID NO: 1318964 - RNA, 13 nt, Mycobacterium tuberculosis H37Rv
cggcgaagguagu

SEQ ID NO: 1318965 - RNA, 14 nt, Mycobacterium tuberculosis H37Rv
cggcgaagcgggcg

SEQ ID NO: 1318966 - RNA, 15 nt, Mycobacterium tuberculosis H37Rv
cggcgaagcgggcgu

SEQ ID NO: 1318967 - RNA, 14 nt, Mycobacterium tuberculosis H37Rv
cggcgaauacgacc

SEQ ID NO: 1318968 - RNA, 20 nt, Mycobacterium tuberculosis H37Rv
cggcgaagucacgcacccgg

SEQ ID NO: 1318969 - RNA, 19 nt, Mycobacterium tuberculosis H37Rv
cggcgacagcuuggccggu

SEQ ID NO: 1318970 - RNA, 15 nt, Mycobacterium tuberculosis H37Rv
cggcgaccaccagcg

SEQ ID NO: 1318971 - RNA, 15 nt, Mycobacterium tuberculosis H37Rv
cggcgaccacgccgc

SEQ ID NO: 1318972 - RNA, 19 nt, Mycobacterium tuberculosis H37Rv
cggcgaccggcgagcccgc

SEQ ID NO: 1318973 - RNA, 13 nt, Mycobacterium tuberculosis H37Rv
cggcgaccacggc

SEQ ID NO: 1318974 - RNA, 22 nt, Mycobacterium tuberculosis H37Rv
cggcgaccagcucagcugcgga

SEQ ID NO: 1318975 - RNA, 16 nt, Mycobacterium tuberculosis H37Rv
cggcuccaccgggccc

SEQ ID NO: 1318976 - RNA, 13 nt, Mycobacterium tuberculosis H37Rv
cggcuccgccagc

SEQ ID NO: 1318977 - RNA, 17 nt, Mycobacterium tuberculosis H37Rv
cggcuccgccagcgccg

SEQ ID NO: 1318978 - RNA, 13 nt, Mycobacterium tuberculosis H37Rv
cggcuccgaugca

SEQ ID NO: 1318979 - RNA, 18 nt, Mycobacterium tuberculosis H37Rv
cggcucggaaaccgcccc

SEQ ID NO: 1318980 - RNA, 19 nt, Mycobacterium tuberculosis H37Rv
cggcucggaaaccgccccg

SEQ ID NO: 1318981 - RNA, 20 nt, Mycobacterium tuberculosis H37Rv
cggcucggcgggggaccccg

SEQ ID NO: 1318982 - RNA, 22 nt, Mycobacterium tuberculosis H37Rv
cggcucggcgggggaccccgcc

SEQ ID NO: 1318983 - RNA, 19 nt, Mycobacterium tuberculosis H37Rv
cggcucggguaccggcggc

SEQ ID NO: 1318984 - RNA, 22 nt, Mycobacterium tuberculosis H37Rv
cggcugaccuucucacgcacca

SEQ ID NO: 1318985 - RNA, 18 nt, Mycobacterium tuberculosis H37Rv
cggcugaccucccacccc

SEQ ID NO: 1318986 - RNA, 21 nt, Mycobacterium tuberculosis H37Rv
cggcugaccucccacccccgg

SEQ ID NO: 1318987 - RNA, 18 nt, Mycobacterium tuberculosis H37Rv
cggcugaccgacccggac

SEQ ID NO: 1318988 - RNA, 14 nt, Mycobacterium tuberculosis H37Rv
cggcugaccuccca

SEQ ID NO: 1318989 - RNA, 17 nt, Mycobacterium tuberculosis H37Rv
cggcucucuucgcgcgc

SEQ ID NO: 1318990 - RNA, 22 nt, Mycobacterium tuberculosis H37Rv
cggcucucuucgcgcgcugggc

SEQ ID NO: 1318991 - RNA, 23 nt, Mycobacterium tuberculosis H37Rv
cggcucucuucgcgcgcugggcg

SEQ ID NO: 1318992 - RNA, 20 nt, Mycobacterium tuberculosis H37Rv
cggcucuagaucgccgagcg

SEQ ID NO: 1318993 - RNA, 23 nt, Mycobacterium tuberculosis H37Rv
cggcguugccggagaaguucgug

SEQ ID NO: 1318994 - RNA, 18 nt, Mycobacterium tuberculosis H37Rv
cggcguugugaccgccga

SEQ ID NO: 1318995 - RNA, 23 nt, Mycobacterium tuberculosis H37Rv
cggcguugaucagugccaggugg

SEQ ID NO: 1318996 - RNA, 20 nt, Mycobacterium tuberculosis H37Rv
cggcguuggaaaagucgggc

SEQ ID NO: 1318997 - RNA, 18 nt, Mycobacterium tuberculosis H37Rv
cggcuccaccgggcccgc

SEQ ID NO: 1318998 - RNA, 18 nt, Mycobacterium tuberculosis H37Rv
cggcuccacccaccugga

SEQ ID NO: 1318999 - RNA, 16 nt, Mycobacterium tuberculosis H37Rv
cggcguuugagaacaa

SEQ ID NO: 1319000 - RNA, 12 nt, Mycobacterium tuberculosis H37Rv
cggcguuuauca

SEQ ID NO: 1319001 - RNA, 17 nt, Mycobacterium tuberculosis H37Rv
cggcgucggcgcccagc

SEQ ID NO: 1319002 - RNA, 15 nt, Mycobacterium tuberculosis H37Rv
cggcgucggccaccg

SEQ ID NO: 1319003 - RNA, 21 nt, Mycobacterium tuberculosis H37Rv
cggcgucguugaggaagcccg

SEQ ID NO: 1319004 - RNA, 20 nt, Mycobacterium tuberculosis H37Rv
cggcgucguucgagaccccg

SEQ ID NO: 1319005 - RNA, 16 nt, Mycobacterium tuberculosis H37Rv
cggcgucucgcagcaa

SEQ ID NO: 1319006 - RNA, 19 nt, Mycobacterium tuberculosis H37Rv
cggcgucugcccgcccagc

SEQ ID NO: 1319007 - RNA, 16 nt, Mycobacterium tuberculosis H37Rv
cggcgucugcccgccc

SEQ ID NO: 1319008 - RNA, 21 nt, Mycobacterium tuberculosis H37Rv
cggcgucuuccucggccaccc

SEQ ID NO: 1319009 - RNA, 23 nt, Mycobacterium tuberculosis H37Rv
cggcgucuuccucggccacccgc

SEQ ID NO: 1319010 - RNA, 21 nt, Mycobacterium tuberculosis H37Rv
cggcgucuucgucggagucuu

SEQ ID NO: 1319011 - RNA, 16 nt, Mycobacterium tuberculosis H37Rv
cggcgggggaccccgc

SEQ ID NO: 1319012 - RNA, 20 nt, Mycobacterium tuberculosis H37Rv
cggcgggggaccccgccagc

SEQ ID NO: 1319013 - RNA, 17 nt, Mycobacterium tuberculosis H37Rv
cggcgggggcggcggcu

SEQ ID NO: 1319014 - RNA, 15 nt, Mycobacterium tuberculosis H37Rv
cggcggggccggcgg

SEQ ID NO: 1319015 - RNA, 20 nt, Mycobacterium tuberculosis H37Rv
cggcggguagaaccagcccg

SEQ ID NO: 1319016 - RNA, 22 nt, Mycobacterium tuberculosis H37Rv
cggcggggguggaaucaggguc

SEQ ID NO: 1319017 - RNA, 19 nt, Mycobacterium tuberculosis H37Rv
cggcggguccucgcggagc

SEQ ID NO: 1319018 - RNA, 13 nt, Mycobacterium tuberculosis H37Rv
cggcggguggcgc

SEQ ID NO: 1319019 - RNA, 23 nt, Mycobacterium tuberculosis H37Rv
cggcggcaaagagcagccggcca

SEQ ID NO: 1319020 - RNA, 19 nt, Mycobacterium tuberculosis H37Rv
cggcggcacuacgcagccg

SEQ ID NO: 1319021 - RNA, 18 nt, Mycobacterium tuberculosis H37Rv
cggcguccuugcgcagca

SEQ ID NO: 1319022 - RNA, 17 nt, Mycobacterium tuberculosis H37Rv
cggcguccuugcgcagc

SEQ ID NO: 1319023 - RNA, 18 nt, Mycobacterium tuberculosis H37Rv
cggcgucgccuuggaacu

SEQ ID NO: 1319024 - RNA, 16 nt, Mycobacterium tuberculosis H37Rv
cggcgucgccgugcug

SEQ ID NO: 1319025 - RNA, 19 nt, Mycobacterium tuberculosis H37Rv
cggcgucacggcgugacca

SEQ ID NO: 1319026 - RNA, 13 nt, Mycobacterium tuberculosis H37Rv
cggcguccgaccg

SEQ ID NO: 1319027 - RNA, 16 nt, Mycobacterium tuberculosis H37Rv
cggcguccaggcagcg

SEQ ID NO: 1319028 - RNA, 20 nt, Mycobacterium tuberculosis H37Rv
cggcggugguaccggcgcca

SEQ ID NO: 1319029 - RNA, 12 nt, Mycobacterium tuberculosis H37Rv
cggcggugggcg

SEQ ID NO: 1319030 - RNA, 23 nt, Mycobacterium tuberculosis H37Rv
cggcgguguuggcgccagccccg

SEQ ID NO: 1319031 - RNA, 22 nt, Mycobacterium tuberculosis H37Rv
cggcgguggugucgcucgcgag

SEQ ID NO: 1319032 - RNA, 14 nt, Mycobacterium tuberculosis H37Rv
cggcggugcagcag

SEQ ID NO: 1319033 - RNA, 22 nt, Mycobacterium tuberculosis H37Rv
cggcggugcagaucggcucacc

SEQ ID NO: 1319034 - RNA, 15 nt, Mycobacterium tuberculosis H37Rv
cggcggguggcgcca

SEQ ID NO: 1319035 - RNA, 22 nt, Mycobacterium tuberculosis H37Rv
cggcgguggcguuacgggcgau

SEQ ID NO: 1319036 - RNA, 18 nt, Mycobacterium tuberculosis H37Rv
cggcggugguaccggcgc

SEQ ID NO: 1319037 - RNA, 22 nt, Mycobacterium tuberculosis H37Rv
cgggcaacggcggggccggcgg

SEQ ID NO: 1319038 - RNA, 15 nt, Mycobacterium tuberculosis H37Rv
cgggcaaggccaccg

SEQ ID NO: 1319039 - RNA, 17 nt, Mycobacterium tuberculosis H37Rv
cgggcaacucggugacg

SEQ ID NO: 1319040 - RNA, 15 nt, Mycobacterium tuberculosis H37Rv
cgggcaacugcagca

SEQ ID NO: 1319041 - RNA, 15 nt, Mycobacterium tuberculosis H37Rv
cgggcaaccagcagc

SEQ ID NO: 1319042 - RNA, 19 nt, Mycobacterium tuberculosis H37Rv
cgggcaaccacaucaccgg

SEQ ID NO: 1319043 - RNA, 23 nt, Mycobacterium tuberculosis H37Rv
cgggcaaccacaucaccggcgau

SEQ ID NO: 1319044 - RNA, 14 nt, Mycobacterium tuberculosis H37Rv
cgggcaacggcagc

SEQ ID NO: 1319045 - RNA, 15 nt, Mycobacterium tuberculosis H37Rv
cgggcaacggcagcc

SEQ ID NO: 1319046 - RNA, 15 nt, Mycobacterium tuberculosis H37Rv
cgggcaacgcagcac

SEQ ID NO: 1319047 - RNA, 17 nt, Mycobacterium tuberculosis H37Rv
cgggcaacgcagcacgu

SEQ ID NO: 1319048 - RNA, 16 nt, Mycobacterium tuberculosis H37Rv
cgggauuggaggcggg

SEQ ID NO: 1319049 - RNA, 19 nt, Mycobacterium tuberculosis H37Rv
cgggauuggaggcgggcgu

SEQ ID NO: 1319050 - RNA, 18 nt, Mycobacterium tuberculosis H37Rv
cgggcaaaucaagcacag

SEQ ID NO: 1319051 - RNA, 17 nt, Mycobacterium tuberculosis H37Rv
cgggcaaaucaagcaca

SEQ ID NO: 1319052 - RNA, 13 nt, Mycobacterium tuberculosis H37Rv
cgggcacugugau

SEQ ID NO: 1319053 - RNA, 22 nt, Mycobacterium tuberculosis H37Rv
cgggcagcaacaggcccacggc

SEQ ID NO: 1319054 - RNA, 21 nt, Mycobacterium tuberculosis H37Rv
cgggcagauaugacggcagac

SEQ ID NO: 1319055 - RNA, 16 nt, Mycobacterium tuberculosis H37Rv
cgggcaagucgcccag

SEQ ID NO: 1319056 - RNA, 22 nt, Mycobacterium tuberculosis H37Rv
cgggcaagucgcccagccgagc

SEQ ID NO: 1319057 - RNA, 20 nt, Mycobacterium tuberculosis H37Rv
cgggcaaucaccgccggcgg

SEQ ID NO: 1319058 - RNA, 15 nt, Mycobacterium tuberculosis H37Rv
cgggcaaucgcucug

SEQ ID NO: 1319059 - RNA, 15 nt, Mycobacterium tuberculosis H37Rv
cgggcagccugcugc

SEQ ID NO: 1319060 - RNA, 17 nt, Mycobacterium tuberculosis H37Rv
cgggcagccugcugcau

SEQ ID NO: 1319061 - RNA, 13 nt, Mycobacterium tuberculosis H37Rv
cgggcagccccuc

SEQ ID NO: 1319062 - RNA, 16 nt, Mycobacterium tuberculosis H37Rv
cgggcauccuucacca

SEQ ID NO: 1319063 - RNA, 15 nt, Mycobacterium tuberculosis H37Rv
cgggcagccgcccgc

SEQ ID NO: 1319064 - RNA, 12 nt, Mycobacterium tuberculosis H37Rv
cgggcagccugc

SEQ ID NO: 1319065 - RNA, 15 nt, Mycobacterium tuberculosis H37Rv
cgggaucgcugccag

SEQ ID NO: 1319066 - RNA, 20 nt, Mycobacterium tuberculosis H37Rv
cgggaucugagggcucggug

SEQ ID NO: 1319067 - RNA, 21 nt, Mycobacterium tuberculosis H37Rv
cgggaucgucaggcccauggc

SEQ ID NO: 1319068 - RNA, 15 nt, Mycobacterium tuberculosis H37Rv
cgggaucugcgccgc

SEQ ID NO: 1319069 - RNA, 19 nt, Mycobacterium tuberculosis H37Rv
cgggaucugacccagcagc

SEQ ID NO: 1319070 - RNA, 17 nt, Mycobacterium tuberculosis H37Rv
cgggaucugcgccgcgc

SEQ ID NO: 1319071 - RNA, 13 nt, Mycobacterium tuberculosis H37Rv
cgggaugaccacc

SEQ ID NO: 1319072 - RNA, 15 nt, Mycobacterium tuberculosis H37Rv
cgggaugcucgaucc

SEQ ID NO: 1319073 - RNA, 22 nt, Mycobacterium tuberculosis H37Rv
cgggaugccggcgaaggccagc

SEQ ID NO: 1319074 - RNA, 14 nt, Mycobacterium tuberculosis H37Rv
cgggaugccgccgc

SEQ ID NO: 1319075 - RNA, 14 nt, Mycobacterium tuberculosis H37Rv
cgggauggacacca

SEQ ID NO: 1319076 - RNA, 14 nt, Mycobacterium tuberculosis H37Rv
cgggauggccgccg

SEQ ID NO: 1319077 - RNA, 19 nt, Mycobacterium tuberculosis H37Rv
cgggauaccgcucagggug

SEQ ID NO: 1319078 - RNA, 15 nt, Mycobacterium tuberculosis H37Rv
cgggaguguguccga

SEQ ID NO: 1319079 - RNA, 17 nt, Mycobacterium tuberculosis H37Rv
cgggagucgucgagcug

SEQ ID NO: 1319080 - RNA, 17 nt, Mycobacterium tuberculosis H37Rv
cgggagguacccccagc

SEQ ID NO: 1319081 - RNA, 16 nt, Mycobacterium tuberculosis H37Rv
cgggaucgcccaggcg

SEQ ID NO: 1319082 - RNA, 15 nt, Mycobacterium tuberculosis H37Rv
cgggaucgcccaggc

SEQ ID NO: 1319083 - RNA, 19 nt, Mycobacterium tuberculosis H37Rv
cggcugcguuggcuggugc

SEQ ID NO: 1319084 - RNA, 22 nt, Mycobacterium tuberculosis H37Rv
cggcugcgguaaucgccaccgc

SEQ ID NO: 1319085 - RNA, 23 nt, Mycobacterium tuberculosis H37Rv
cggcugcguuguguuccguugcg

SEQ ID NO: 1319086 - RNA, 18 nt, Mycobacterium tuberculosis H37Rv
cggcugcguuguguuccg

SEQ ID NO: 1319087 - RNA, 18 nt, Mycobacterium tuberculosis H37Rv
cggcugauucgagccaca

SEQ ID NO: 1319088 - RNA, 20 nt, Mycobacterium tuberculosis H37Rv
cggcugcgcuuugcacagcg

SEQ ID NO: 1319089 - RNA, 18 nt, Mycobacterium tuberculosis H37Rv
cggcuggacggcgccggu

SEQ ID NO: 1319090 - RNA, 19 nt, Mycobacterium tuberculosis H37Rv
cggcugcuuggucgcccag

SEQ ID NO: 1319091 - RNA, 23 nt, Mycobacterium tuberculosis H37Rv
cggcugcuuggucgcccagccac

SEQ ID NO: 1319092 - RNA, 21 nt, Mycobacterium tuberculosis H37Rv
cggcuucguggcggcgcgcgc

SEQ ID NO: 1319093 - RNA, 22 nt, Mycobacterium tuberculosis H37Rv
cgggaaaguuguaucgcagcau

SEQ ID NO: 1319094 - RNA, 18 nt, Mycobacterium tuberculosis H37Rv
cggcuugggccaggccca

SEQ ID NO: 1319095 - RNA, 23 nt, Mycobacterium tuberculosis H37Rv
cggcuuggccuagccgcggcacc

SEQ ID NO: 1319096 - RNA, 16 nt, Mycobacterium tuberculosis H37Rv
cggcuuggcugccucc

SEQ ID NO: 1319097 - RNA, 19 nt, Mycobacterium tuberculosis H37Rv
cggcuugggaaacccggcc

SEQ ID NO: 1319098 - RNA, 19 nt, Mycobacterium tuberculosis H37Rv
cggcuuggccuagccgcgg

SEQ ID NO: 1319099 - RNA, 21 nt, Mycobacterium tuberculosis H37Rv
cggcuuggccgccccggccgc

SEQ ID NO: 1319100 - RNA, 13 nt, Mycobacterium tuberculosis H37Rv
cggcuugcugccc

SEQ ID NO: 1319101 - RNA, 23 nt, Mycobacterium tuberculosis H37Rv
cggcuugcagugaggucaucguc

SEQ ID NO: 1319102 - RNA, 13 nt, Mycobacterium tuberculosis H37Rv
cgggaggccaccg

SEQ ID NO: 1319103 - RNA, 15 nt, Mycobacterium tuberculosis H37Rv
cgggaggacaccagc

SEQ ID NO: 1319104 - RNA, 22 nt, Mycobacterium tuberculosis H37Rv
cgggaggacaccagcuggaaga

SEQ ID NO: 1319105 - RNA, 18 nt, Mycobacterium tuberculosis H37Rv
cgggacguuguccaccgc

SEQ ID NO: 1319106 - RNA, 15 nt, Mycobacterium tuberculosis H37Rv
cgggacugcagcgcg

SEQ ID NO: 1319107 - RNA, 13 nt, Mycobacterium tuberculosis H37Rv
cgggacguugucc

SEQ ID NO: 1319108 - RNA, 13 nt, Mycobacterium tuberculosis H37Rv
cgggacgccgccc

SEQ ID NO: 1319109 - RNA, 17 nt, Mycobacterium tuberculosis H37Rv
cgggaccggggacgcgc

SEQ ID NO: 1319110 - RNA, 15 nt, Mycobacterium tuberculosis H37Rv
cgggaccgccccggc

SEQ ID NO: 1319111 - RNA, 21 nt, Mycobacterium tuberculosis H37Rv
cgggaccgaucuuggccaccg

SEQ ID NO: 1319112 - RNA, 17 nt, Mycobacterium tuberculosis H37Rv
cgggaccuucgagccgc

SEQ ID NO: 1319113 - RNA, 19 nt, Mycobacterium tuberculosis H37Rv
cgggacgaaucccgcgccc

SEQ ID NO: 1319114 - RNA, 19 nt, Mycobacterium tuberculosis H37Rv
cgggacaucugcccaccgc

SEQ ID NO: 1319115 - RNA, 21 nt, Mycobacterium tuberculosis H37Rv
cgggaccaggccaacggcgcu

SEQ ID NO: 1319116 - RNA, 16 nt, Mycobacterium tuberculosis H37Rv
cgggaccauagucgcc

SEQ ID NO: 1319117 - RNA, 19 nt, Mycobacterium tuberculosis H37Rv
cgggacaaaaucagcagcc

SEQ ID NO: 1319118 - RNA, 23 nt, Mycobacterium tuberculosis H37Rv
cgggaaacacguucucaccacca

SEQ ID NO: 1319119 - RNA, 16 nt, Mycobacterium tuberculosis H37Rv
cgggaaccacggucag

SEQ ID NO: 1319120 - RNA, 15 nt, Mycobacterium tuberculosis H37Rv
cgggaacgaugccgc

SEQ ID NO: 1319121 - RNA, 22 nt, Mycobacterium tuberculosis H37Rv
cggguggugccaggucggcggg

SEQ ID NO: 1319122 - RNA, 24 nt, Mycobacterium tuberculosis H37Rv
cggguggugcggccguggcguggc

SEQ ID NO: 1319123 - RNA, 16 nt, Mycobacterium tuberculosis H37Rv
cgggugggagcagccg

SEQ ID NO: 1319124 - RNA, 17 nt, Mycobacterium tuberculosis H37Rv
cggguuccauguccggc

SEQ ID NO: 1319125 - RNA, 17 nt, Mycobacterium tuberculosis H37Rv
cgggugugacgcgcgcc

SEQ ID NO: 1319126 - RNA, 21 nt, Mycobacterium tuberculosis H37Rv
cggguugggcaucaggccgcg

SEQ ID NO: 1319127 - RNA, 17 nt, Mycobacterium tuberculosis H37Rv
cggguuggaagccgcac

SEQ ID NO: 1319128 - RNA, 14 nt, Mycobacterium tuberculosis H37Rv
cggguuggccaccu

SEQ ID NO: 1319129 - RNA, 14 nt, Mycobacterium tuberculosis H37Rv
cggguuugaucucc

SEQ ID NO: 1319130 - RNA, 18 nt, Mycobacterium tuberculosis H37Rv
cggguuugaucuccaccu

SEQ ID NO: 1319131 - RNA, 15 nt, Mycobacterium tuberculosis H37Rv
cgguaauggccgccg

SEQ ID NO: 1319132 - RNA, 22 nt, Mycobacterium tuberculosis H37Rv
cgguaaugccagcggcacaccc

SEQ ID NO: 1319133 - RNA, 19 nt, Mycobacterium tuberculosis H37Rv
cgguaacggcgguaagggc

SEQ ID NO: 1319134 - RNA, 17 nt, Mycobacterium tuberculosis H37Rv
cgguaacuguccgcccg

SEQ ID NO: 1319135 - RNA, 18 nt, Mycobacterium tuberculosis H37Rv
cgguaacuguccgcccgg

SEQ ID NO: 1319136 - RNA, 19 nt, Mycobacterium tuberculosis H37Rv
cgguaggugcaugucgaug

SEQ ID NO: 1319137 - RNA, 15 nt, Mycobacterium tuberculosis H37Rv
cgguaguagcugacc

SEQ ID NO: 1319138 - RNA, 17 nt, Mycobacterium tuberculosis H37Rv
cgguaguuaacccaggg

SEQ ID NO: 1319139 - RNA, 19 nt, Mycobacterium tuberculosis H37Rv
cgguagucgccgucggguc

SEQ ID NO: 1319140 - RNA, 20 nt, Mycobacterium tuberculosis H37Rv
cgguaguugcgcggcauccc

SEQ ID NO: 1319141 - RNA, 20 nt, Mycobacterium tuberculosis H37Rv
cgguaucgucccggcgaccg

SEQ ID NO: 1319142 - RNA, 17 nt, Mycobacterium tuberculosis H37Rv
cgguaucccccagccgc

SEQ ID NO: 1319143 - RNA, 20 nt, Mycobacterium tuberculosis H37Rv
cggucaaagaugucgcuggg

SEQ ID NO: 1319144 - RNA, 20 nt, Mycobacterium tuberculosis H37Rv
cggucaacacccgcccgggc

SEQ ID NO: 1319145 - RNA, 17 nt, Mycobacterium tuberculosis H37Rv
cggucaaacgcgcgcgc

SEQ ID NO: 1319146 - RNA, 15 nt, Mycobacterium tuberculosis H37Rv
cggucaacgcuagcg

SEQ ID NO: 1319147 - RNA, 21 nt, Mycobacterium tuberculosis H37Rv
cgguaugcgcguccccagcgc

SEQ ID NO: 1319148 - RNA, 16 nt, Mycobacterium tuberculosis H37Rv
cgguagcacagcagca

SEQ ID NO: 1319149 - RNA, 20 nt, Mycobacterium tuberculosis H37Rv
cgguagaucuucggccgcac

SEQ ID NO: 1319150 - RNA, 16 nt, Mycobacterium tuberculosis H37Rv
cgguagccgaccagcg

SEQ ID NO: 1319151 - RNA, 13 nt, Mycobacterium tuberculosis H37Rv
cgguacgccgccg

SEQ ID NO: 1319152 - RNA, 13 nt, Mycobacterium tuberculosis H37Rv
cgguacggacagc

SEQ ID NO: 1319153 - RNA, 13 nt, Mycobacterium tuberculosis H37Rv
cgguaccgggauc

SEQ ID NO: 1319154 - RNA, 13 nt, Mycobacterium tuberculosis H37Rv
cgguaccgcccgc

SEQ ID NO: 1319155 - RNA, 19 nt, Mycobacterium tuberculosis H37Rv
cgguaccgcccgcaccgug

SEQ ID NO: 1319156 - RNA, 21 nt, Mycobacterium tuberculosis H37Rv
cgguacccaccucccgcagcc

SEQ ID NO: 1319157 - RNA, 17 nt, Mycobacterium tuberculosis H37Rv
cgguaccaaccugcgcg

SEQ ID NO: 1319158 - RNA, 24 nt, Mycobacterium tuberculosis H37Rv
cgguaccaucaccgcgccagccuc

SEQ ID NO: 1319159 - RNA, 13 nt, Mycobacterium tuberculosis H37Rv
cgggugccgagcu

SEQ ID NO: 1319160 - RNA, 15 nt, Mycobacterium tuberculosis H37Rv
cgggugccgagcugg

SEQ ID NO: 1319161 - RNA, 23 nt, Mycobacterium tuberculosis H37Rv
cgggugccgcgccguagagccgc

SEQ ID NO: 1319162 - RNA, 11 nt, Mycobacterium tuberculosis H37Rv
cgggugaucuu

SEQ ID NO: 1319163 - RNA, 18 nt, Mycobacterium tuberculosis H37Rv
cgggugaucuuggcgccc

SEQ ID NO: 1319164 - RNA, 22 nt, Mycobacterium tuberculosis H37Rv
cgggugaugacgccgucggcgc

SEQ ID NO: 1319165 - RNA, 15 nt, Mycobacterium tuberculosis H37Rv
cgggugaugcaguga

SEQ ID NO: 1319166 - RNA, 19 nt, Mycobacterium tuberculosis H37Rv
cggguggccacgcccaggc

SEQ ID NO: 1319167 - RNA, 17 nt, Mycobacterium tuberculosis H37Rv
cgggugcuggucaacag

SEQ ID NO: 1319168 - RNA, 23 nt, Mycobacterium tuberculosis H37Rv
cgggugcuacuggguggguagcu

SEQ ID NO: 1319169 - RNA, 18 nt, Mycobacterium tuberculosis H37Rv
cgggugcuacuggguggg

SEQ ID NO: 1319170 - RNA, 19 nt, Mycobacterium tuberculosis H37Rv
cgggugcuacugggugggu

SEQ ID NO: 1319171 - RNA, 19 nt, Mycobacterium tuberculosis H37Rv
cgggugaaggaugcggccc

SEQ ID NO: 1319172 - RNA, 19 nt, Mycobacterium tuberculosis H37Rv
cgggugacucgggcacggg

SEQ ID NO: 1319173 - RNA, 14 nt, Mycobacterium tuberculosis H37Rv
cgggugacccgcca

SEQ ID NO: 1319174 - RNA, 21 nt, Mycobacterium tuberculosis H37Rv
cgggugaguaacacgugggug

SEQ ID NO: 1319175 - RNA, 16 nt, Mycobacterium tuberculosis H37Rv
cgggucgugccccggc

SEQ ID NO: 1319176 - RNA, 22 nt, Mycobacterium tuberculosis H37Rv
cgggucuacagcguugccaggu

SEQ ID NO: 1319177 - RNA, 17 nt, Mycobacterium tuberculosis H37Rv
cgggucuccggcgcacc

SEQ ID NO: 1319178 - RNA, 23 nt, Mycobacterium tuberculosis H37Rv
cgggucccuuguggucugccagc

SEQ ID NO: 1319179 - RNA, 21 nt, Mycobacterium tuberculosis H37Rv
cgggucccuuguggucugcca

SEQ ID NO: 1319180 - RNA, 22 nt, Mycobacterium tuberculosis H37Rv
cggguccgaaguacuggccgcc

SEQ ID NO: 1319181 - RNA, 12 nt, Mycobacterium tuberculosis H37Rv
cgggucggcaga

SEQ ID NO: 1319182 - RNA, 17 nt, Mycobacterium tuberculosis H37Rv
cgggucggcgaccgcgc

SEQ ID NO: 1319183 - RNA, 24 nt, Mycobacterium tuberculosis H37Rv
cgggucgguccacuucagaucggc

SEQ ID NO: 1319184 - RNA, 14 nt, Mycobacterium tuberculosis H37Rv
cgggucgucggcgu

SEQ ID NO: 1319185 - RNA, 16 nt, Mycobacterium tuberculosis H37Rv
cgggucgugccagcag

SEQ ID NO: 1319186 - RNA, 23 nt, Mycobacterium tuberculosis H37Rv
cgggucguccgccugcaccgccg

SEQ ID NO: 1319187 - RNA, 15 nt, Mycobacterium tuberculosis H37Rv
cgggucagcaccacc

SEQ ID NO: 1319188 - RNA, 18 nt, Mycobacterium tuberculosis H37Rv
cgggucagcaccaccagc

SEQ ID NO: 1319189 - RNA, 19 nt, Mycobacterium tuberculosis H37Rv
cggguacacccgcucgccc

SEQ ID NO: 1319190 - RNA, 15 nt, Mycobacterium tuberculosis H37Rv
cggguacgccgggca

SEQ ID NO: 1319191 - RNA, 18 nt, Mycobacterium tuberculosis H37Rv
cggguaaugcgacgccgg

SEQ ID NO: 1319192 - RNA, 14 nt, Mycobacterium tuberculosis H37Rv
cggguaaccggcuc

SEQ ID NO: 1319193 - RNA, 14 nt, Mycobacterium tuberculosis H37Rv
cggguccaacgccg

SEQ ID NO: 1319194 - RNA, 21 nt, Mycobacterium tuberculosis H37Rv
cgggucagcgccgagagcacc

SEQ ID NO: 1319195 - RNA, 13 nt, Mycobacterium tuberculosis H37Rv
cgggucagcccgg

SEQ ID NO: 1319196 - RNA, 14 nt, Mycobacterium tuberculosis H37Rv
cgggucagcccagc

SEQ ID NO: 1319197 - RNA, 18 nt, Mycobacterium tuberculosis H37Rv
cgggggaucucgagccgc

SEQ ID NO: 1319198 - RNA, 13 nt, Mycobacterium tuberculosis H37Rv
cgggggcagcgcg

SEQ ID NO: 1319199 - RNA, 17 nt, Mycobacterium tuberculosis H37Rv
cgggggaccccgccagc

SEQ ID NO: 1319200 - RNA, 17 nt, Mycobacterium tuberculosis H37Rv
cggggcuuggcgacguc

SEQ ID NO: 1319201 - RNA, 23 nt, Mycobacterium tuberculosis H37Rv
cggggcugggcgccaugcgccaa

SEQ ID NO: 1319202 - RNA, 21 nt, Mycobacterium tuberculosis H37Rv
cggggcugggggccggcagcg

SEQ ID NO: 1319203 - RNA, 17 nt, Mycobacterium tuberculosis H37Rv
cggggcugccgaacagc

SEQ ID NO: 1319204 - RNA, 22 nt, Mycobacterium tuberculosis H37Rv
cggggcucucgaguccaggcag

SEQ ID NO: 1319205 - RNA, 11 nt, Mycobacterium tuberculosis H37Rv
cggggcugccc

SEQ ID NO: 1319206 - RNA, 16 nt, Mycobacterium tuberculosis H37Rv
cgggggccgagccgac

SEQ ID NO: 1319207 - RNA, 20 nt, Mycobacterium tuberculosis H37Rv
cgggggaccccgccagccgg

SEQ ID NO: 1319208 - RNA, 19 nt, Mycobacterium tuberculosis H37Rv
cgggggagcgaacggcgca

SEQ ID NO: 1319209 - RNA, 17 nt, Mycobacterium tuberculosis H37Rv
cgggguugggcggagca

SEQ ID NO: 1319210 - RNA, 22 nt, Mycobacterium tuberculosis H37Rv
cgggguuguccucggcgaucac

SEQ ID NO: 1319211 - RNA, 15 nt, Mycobacterium tuberculosis H37Rv
cgggccagcacccgc

SEQ ID NO: 1319212 - RNA, 13 nt, Mycobacterium tuberculosis H37Rv
cgggccagcaccu

SEQ ID NO: 1319213 - RNA, 18 nt, Mycobacterium tuberculosis H37Rv
cgggccaccacgcgccgc

SEQ ID NO: 1319214 - RNA, 20 nt, Mycobacterium tuberculosis H37Rv
cgggccacgucgagcacccg

SEQ ID NO: 1319215 - RNA, 21 nt, Mycobacterium tuberculosis H37Rv
cgggccagaucgaagcgcagc

SEQ ID NO: 1319216 - RNA, 10 nt, Mycobacterium tuberculosis H37Rv
cgggcugcag

SEQ ID NO: 1319217 - RNA, 18 nt, Mycobacterium tuberculosis H37Rv
cgggcucguguccgccgu

SEQ ID NO: 1319218 - RNA, 17 nt, Mycobacterium tuberculosis H37Rv
cgggcucguccagcaac

SEQ ID NO: 1319219 - RNA, 20 nt, Mycobacterium tuberculosis H37Rv
cgggccaaugccguugaucg

SEQ ID NO: 1319220 - RNA, 15 nt, Mycobacterium tuberculosis H37Rv
cgggcaugauccccg

SEQ ID NO: 1319221 - RNA, 19 nt, Mycobacterium tuberculosis H37Rv
cgggcaugcucuggcaaug

SEQ ID NO: 1319222 - RNA, 22 nt, Mycobacterium tuberculosis H37Rv
cggggaacgugacccccagcag

SEQ ID NO: 1319223 - RNA, 11 nt, Mycobacterium tuberculosis H37Rv
cggggaacacc

SEQ ID NO: 1319224 - RNA, 13 nt, Mycobacterium tuberculosis H37Rv
cgggcugccgccc

SEQ ID NO: 1319225 - RNA, 22 nt, Mycobacterium tuberculosis H37Rv
cgggcuggauaugagccaaccc

SEQ ID NO: 1319226 - RNA, 21 nt, Mycobacterium tuberculosis H37Rv
cgggcugccccuccgggcgca

SEQ ID NO: 1319227 - RNA, 14 nt, Mycobacterium tuberculosis H37Rv
cgggcugcagugac

SEQ ID NO: 1319228 - RNA, 20 nt, Mycobacterium tuberculosis H37Rv
cggggauaucacgacgccga

SEQ ID NO: 1319229 - RNA, 18 nt, Mycobacterium tuberculosis H37Rv
cggggauguccgcggcca

SEQ ID NO: 1319230 - RNA, 21 nt, Mycobacterium tuberculosis H37Rv
cggggauguccgcggccacca

SEQ ID NO: 1319231 - RNA, 23 nt, Mycobacterium tuberculosis H37Rv
cggggauucgucgugcgggcggg

SEQ ID NO: 1319232 - RNA, 18 nt, Mycobacterium tuberculosis H37Rv
cggggcaccacgccagcc

SEQ ID NO: 1319233 - RNA, 18 nt, Mycobacterium tuberculosis H37Rv
cggggauaccggucagca

SEQ ID NO: 1319234 - RNA, 23 nt, Mycobacterium tuberculosis H37Rv
cggggaguuccaaaucgguggca

SEQ ID NO: 1319235 - RNA, 19 nt, Mycobacterium tuberculosis H37Rv
cggggagcugcggcggcca

SEQ ID NO: 1319236 - RNA, 13 nt, Mycobacterium tuberculosis H37Rv
cggggacgcgccc

SEQ ID NO: 1319237 - RNA, 10 nt, Mycobacterium tuberculosis H37Rv
cggggccggu

SEQ ID NO: 1319238 - RNA, 20 nt, Mycobacterium tuberculosis H37Rv
cggggccgccgcggccggcg

SEQ ID NO: 1319239 - RNA, 14 nt, Mycobacterium tuberculosis H37Rv
cggggccgucggca

SEQ ID NO: 1319240 - RNA, 13 nt, Mycobacterium tuberculosis H37Rv
cggggccacccgc

SEQ ID NO: 1319241 - RNA, 15 nt, Mycobacterium tuberculosis H37Rv
cggugccgccuccgc

SEQ ID NO: 1319242 - RNA, 23 nt, Mycobacterium tuberculosis H37Rv
cggugccgccuccgccugcccca

SEQ ID NO: 1319243 - RNA, 16 nt, Mycobacterium tuberculosis H37Rv
cggugccgccugcgcc

SEQ ID NO: 1319244 - RNA, 23 nt, Mycobacterium tuberculosis H37Rv
cggugccgccguucccaccacca

SEQ ID NO: 1319245 - RNA, 15 nt, Mycobacterium tuberculosis H37Rv
cggugccgccgucga

SEQ ID NO: 1319246 - RNA, 23 nt, Mycobacterium tuberculosis H37Rv
cggugccgccgcggccaccaccg

SEQ ID NO: 1319247 - RNA, 13 nt, Mycobacterium tuberculosis H37Rv
cggugccgcccgc

SEQ ID NO: 1319248 - RNA, 20 nt, Mycobacterium tuberculosis H37Rv
cggugccgcccgcgccuccg

SEQ ID NO: 1319249 - RNA, 22 nt, Mycobacterium tuberculosis H37Rv
cggugccgccgccggcgccgga

SEQ ID NO: 1319250 - RNA, 23 nt, Mycobacterium tuberculosis H37Rv
cggugccgcagcaggggacgacc

SEQ ID NO: 1319251 - RNA, 15 nt, Mycobacterium tuberculosis H37Rv
cggugccguggugga

SEQ ID NO: 1319252 - RNA, 12 nt, Mycobacterium tuberculosis H37Rv
cggugccgucga

SEQ ID NO: 1319253 - RNA, 14 nt, Mycobacterium tuberculosis H37Rv
cggugccggccgca

SEQ ID NO: 1319254 - RNA, 17 nt, Mycobacterium tuberculosis H37Rv
cggugaaucgucugacg

SEQ ID NO: 1319255 - RNA, 20 nt, Mycobacterium tuberculosis H37Rv
cggugacaagcggcccgcug

SEQ ID NO: 1319256 - RNA, 21 nt, Mycobacterium tuberculosis H37Rv
cggugagcucuucggacacag

SEQ ID NO: 1319257 - RNA, 18 nt, Mycobacterium tuberculosis H37Rv
cggugaucgagguugacg

SEQ ID NO: 1319258 - RNA, 23 nt, Mycobacterium tuberculosis H37Rv
cggugaucgauccggcuccaccc

SEQ ID NO: 1319259 - RNA, 16 nt, Mycobacterium tuberculosis H37Rv
cggugaucgcgguggc

SEQ ID NO: 1319260 - RNA, 18 nt, Mycobacterium tuberculosis H37Rv
cggugaucaccgcggcgg

SEQ ID NO: 1319261 - RNA, 17 nt, Mycobacterium tuberculosis H37Rv
cggugauccaacuggcc

SEQ ID NO: 1319262 - RNA, 19 nt, Mycobacterium tuberculosis H37Rv
cggucagcggccaacccau

SEQ ID NO: 1319263 - RNA, 23 nt, Mycobacterium tuberculosis H37Rv
cggucucggaaacggaccuccuc

SEQ ID NO: 1319264 - RNA, 15 nt, Mycobacterium tuberculosis H37Rv
cggucugcuccaggc

SEQ ID NO: 1319265 - RNA, 15 nt, Mycobacterium tuberculosis H37Rv
cggucagcagcgccg

SEQ ID NO: 1319266 - RNA, 19 nt, Mycobacterium tuberculosis H37Rv
cggucagccagcccagggu

SEQ ID NO: 1319267 - RNA, 12 nt, Mycobacterium tuberculosis H37Rv
cggucagccagg

SEQ ID NO: 1319268 - RNA, 15 nt, Mycobacterium tuberculosis H37Rv
cggucagcgcggcgc

SEQ ID NO: 1319269 - RNA, 13 nt, Mycobacterium tuberculosis H37Rv
cggucagccgcgg

SEQ ID NO: 1319270 - RNA, 14 nt, Mycobacterium tuberculosis H37Rv
cggucagccgcggg

SEQ ID NO: 1319271 - RNA, 16 nt, Mycobacterium tuberculosis H37Rv
cggucagccgcggggc

SEQ ID NO: 1319272 - RNA, 16 nt, Mycobacterium tuberculosis H37Rv
cggucagcgcgcggcu

SEQ ID NO: 1319273 - RNA, 17 nt, Mycobacterium tuberculosis H37Rv
cggucugcuccaggcgc

SEQ ID NO: 1319274 - RNA, 18 nt, Mycobacterium tuberculosis H37Rv
cggucuugggcgcgggug

SEQ ID NO: 1319275 - RNA, 20 nt, Mycobacterium tuberculosis H37Rv
cggugaacaccagcaggaag

SEQ ID NO: 1319276 - RNA, 19 nt, Mycobacterium tuberculosis H37Rv
cggugaaccgggacagcag

SEQ ID NO: 1319277 - RNA, 15 nt, Mycobacterium tuberculosis H37Rv
cggugaacgccgccc

SEQ ID NO: 1319278 - RNA, 16 nt, Mycobacterium tuberculosis H37Rv
cggugaacggcaaggu

SEQ ID NO: 1319279 - RNA, 18 nt, Mycobacterium tuberculosis H37Rv
cggugaaauucgcggcgg

SEQ ID NO: 1319280 - RNA, 14 nt, Mycobacterium tuberculosis H37Rv
cggugaaccaacgc

SEQ ID NO: 1319281 - RNA, 16 nt, Mycobacterium tuberculosis H37Rv
cggugaaccaacgcga

SEQ ID NO: 1319282 - RNA, 21 nt, Mycobacterium tuberculosis H37Rv
cggugaacuucuccaccagcg

SEQ ID NO: 1319283 - RNA, 19 nt, Mycobacterium tuberculosis H37Rv
cgguggaauccaccagccg

SEQ ID NO: 1319284 - RNA, 15 nt, Mycobacterium tuberculosis H37Rv
cgguggcgcggugcc

SEQ ID NO: 1319285 - RNA, 17 nt, Mycobacterium tuberculosis H37Rv
cgguggcgccggggcgc

SEQ ID NO: 1319286 - RNA, 15 nt, Mycobacterium tuberculosis H37Rv
cggugcugguccagg

SEQ ID NO: 1319287 - RNA, 16 nt, Mycobacterium tuberculosis H37Rv
cggugcugaccccgcc

SEQ ID NO: 1319288 - RNA, 14 nt, Mycobacterium tuberculosis H37Rv
cgguggccgucggg

SEQ ID NO: 1319289 - RNA, 21 nt, Mycobacterium tuberculosis H37Rv
cgguggccgucgggugcagca

SEQ ID NO: 1319290 - RNA, 17 nt, Mycobacterium tuberculosis H37Rv
cggugcgguggugcgca

SEQ ID NO: 1319291 - RNA, 16 nt, Mycobacterium tuberculosis H37Rv
cggugcgucagcuggu

SEQ ID NO: 1319292 - RNA, 15 nt, Mycobacterium tuberculosis H37Rv
cggugcggcaacagc

SEQ ID NO: 1319293 - RNA, 16 nt, Mycobacterium tuberculosis H37Rv
cggugcggaacaccgc

SEQ ID NO: 1319294 - RNA, 20 nt, Mycobacterium tuberculosis H37Rv
cggugcgcuggcggcgcagc

SEQ ID NO: 1319295 - RNA, 15 nt, Mycobacterium tuberculosis H37Rv
cggugcgcuggaugu

SEQ ID NO: 1319296 - RNA, 16 nt, Mycobacterium tuberculosis H37Rv
cggugcgcaccaccga

SEQ ID NO: 1319297 - RNA, 14 nt, Mycobacterium tuberculosis H37Rv
cggugcgccacgac

SEQ ID NO: 1319298 - RNA, 17 nt, Mycobacterium tuberculosis H37Rv
cgguguggccgugggug

SEQ ID NO: 1319299 - RNA, 15 nt, Mycobacterium tuberculosis H37Rv
cgguguuccgcccag

SEQ ID NO: 1319300 - RNA, 18 nt, Mycobacterium tuberculosis H37Rv
cgguguugccgaagcccg

SEQ ID NO: 1319301 - RNA, 23 nt, Mycobacterium tuberculosis H37Rv
cgguguguuccaacuccugcagc

SEQ ID NO: 1319302 - RNA, 19 nt, Mycobacterium tuberculosis H37Rv
cggugugugcaagccgaac

SEQ ID NO: 1319303 - RNA, 15 nt, Mycobacterium tuberculosis H37Rv
cgguguuggacacuc

SEQ ID NO: 1319304 - RNA, 22 nt, Mycobacterium tuberculosis H37Rv
cgguguuggcgccagccccgcc

SEQ ID NO: 1319305 - RNA, 14 nt, Mycobacterium tuberculosis H37Rv
cgguguugcgcacc

SEQ ID NO: 1319306 - RNA, 22 nt, Mycobacterium tuberculosis H37Rv
cgguguuucgacguaaugcgcu

SEQ ID NO: 1319307 - RNA, 19 nt, Mycobacterium tuberculosis H37Rv
cgguguugcucgccgucgu

SEQ ID NO: 1319308 - RNA, 16 nt, Mycobacterium tuberculosis H37Rv
cggugguuccggcugg

SEQ ID NO: 1319309 - RNA, 19 nt, Mycobacterium tuberculosis H37Rv
cgguguaauugccgacgcu

SEQ ID NO: 1319310 - RNA, 21 nt, Mycobacterium tuberculosis H37Rv
cgguguauccgacuggccccg

SEQ ID NO: 1319311 - RNA, 20 nt, Mycobacterium tuberculosis H37Rv
cgguguaggccucggcagca

SEQ ID NO: 1319312 - RNA, 23 nt, Mycobacterium tuberculosis H37Rv
cgguggcgugguggaaacugaug

SEQ ID NO: 1319313 - RNA, 23 nt, Mycobacterium tuberculosis H37Rv
cgguggcgucgucggcgggcugc

SEQ ID NO: 1319314 - RNA, 19 nt, Mycobacterium tuberculosis H37Rv
cgguggugaccgcgggcgc

SEQ ID NO: 1319315 - RNA, 14 nt, Mycobacterium tuberculosis H37Rv
cgguggugaggauc

SEQ ID NO: 1319316 - RNA, 16 nt, Mycobacterium tuberculosis H37Rv
cgguggugaccgcggg

SEQ ID NO: 1319317 - RNA, 23 nt, Mycobacterium tuberculosis H37Rv
cgguggugccggcgccgccagca

SEQ ID NO: 1319318 - RNA, 14 nt, Mycobacterium tuberculosis H37Rv
cgguggugcggccc

SEQ ID NO: 1319319 - RNA, 14 nt, Mycobacterium tuberculosis H37Rv
cggugguggccaug

SEQ ID NO: 1319320 - RNA, 13 nt, Mycobacterium tuberculosis H37Rv
cgguggugucggu

SEQ ID NO: 1319321 - RNA, 16 nt, Mycobacterium tuberculosis H37Rv
cguaauagcugcgucc

SEQ ID NO: 1319322 - RNA, 13 nt, Mycobacterium tuberculosis H37Rv
cguaagcaccagc

SEQ ID NO: 1319323 - RNA, 13 nt, Mycobacterium tuberculosis H37Rv
cguaacagccggc

SEQ ID NO: 1319324 - RNA, 23 nt, Mycobacterium tuberculosis H37Rv
cguaaauagcgcccugccauggg

SEQ ID NO: 1319325 - RNA, 16 nt, Mycobacterium tuberculosis H37Rv
cgguuccgccggcccc

SEQ ID NO: 1319326 - RNA, 22 nt, Mycobacterium tuberculosis H37Rv
cgguucgcccgaggcgagacgc

SEQ ID NO: 1319327 - RNA, 22 nt, Mycobacterium tuberculosis H37Rv
cgguucggagucacgcagccgc

SEQ ID NO: 1319328 - RNA, 16 nt, Mycobacterium tuberculosis H37Rv
cgguuccggccggcuc

SEQ ID NO: 1319329 - RNA, 16 nt, Mycobacterium tuberculosis H37Rv
cgguuccggucggguu

SEQ ID NO: 1319330 - RNA, 22 nt, Mycobacterium tuberculosis H37Rv
cgguugcauccauccugccuua

SEQ ID NO: 1319331 - RNA, 14 nt, Mycobacterium tuberculosis H37Rv
cgguugauucgugc

SEQ ID NO: 1319332 - RNA, 22 nt, Mycobacterium tuberculosis H37Rv
cguaauuccccaggugugugcc

SEQ ID NO: 1319333 - RNA, 21 nt, Mycobacterium tuberculosis H37Rv
cguacaggacgguugagaugg

SEQ ID NO: 1319334 - RNA, 14 nt, Mycobacterium tuberculosis H37Rv
cguacagcgccugg

SEQ ID NO: 1319335 - RNA, 12 nt, Mycobacterium tuberculosis H37Rv
cguacagcgccu

SEQ ID NO: 1319336 - RNA, 17 nt, Mycobacterium tuberculosis H37Rv
cguacaaccacccaccc

SEQ ID NO: 1319337 - RNA, 15 nt, Mycobacterium tuberculosis H37Rv
cguacacaccgagca

SEQ ID NO: 1319338 - RNA, 16 nt, Mycobacterium tuberculosis H37Rv
cguacgcacgcagccc

SEQ ID NO: 1319339 - RNA, 13 nt, Mycobacterium tuberculosis H37Rv
cguaccgggcgag

SEQ ID NO: 1319340 - RNA, 14 nt, Mycobacterium tuberculosis H37Rv
cguaccggccuuca

SEQ ID NO: 1319341 - RNA, 18 nt, Mycobacterium tuberculosis H37Rv
cguacucggcauccaggc

SEQ ID NO: 1319342 - RNA, 15 nt, Mycobacterium tuberculosis H37Rv
cguacucggcgcgca

SEQ ID NO: 1319343 - RNA, 15 nt, Mycobacterium tuberculosis H37Rv
cguaccagcuggcca

SEQ ID NO: 1319344 - RNA, 12 nt, Mycobacterium tuberculosis H37Rv
cguaccgacagg

SEQ ID NO: 1319345 - RNA, 21 nt, Mycobacterium tuberculosis H37Rv
cguacccguuaugcgccgccc

SEQ ID NO: 1319346 - RNA, 13 nt, Mycobacterium tuberculosis H37Rv
cccugagcucccg

SEQ ID NO: 1319347 - RNA, 14 nt, Mycobacterium tuberculosis H37Rv
cccugacgguggug

SEQ ID NO: 1319348 - RNA, 21 nt, Mycobacterium tuberculosis H37Rv
cccugacacccaucgaccgcc

SEQ ID NO: 1319349 - RNA, 20 nt, Mycobacterium tuberculosis H37Rv
cccugaaaagggcuggucua

SEQ ID NO: 1319350 - RNA, 22 nt, Mycobacterium tuberculosis H37Rv
cccugaaauaccaguccggcgg

SEQ ID NO: 1319351 - RNA, 20 nt, Mycobacterium tuberculosis H37Rv
cccugaugugaguccagccg

SEQ ID NO: 1319352 - RNA, 16 nt, Mycobacterium tuberculosis H37Rv
cccugauugaagcccc

SEQ ID NO: 1319353 - RNA, 13 nt, Mycobacterium tuberculosis H37Rv
cccugcacagcag

SEQ ID NO: 1319354 - RNA, 22 nt, Mycobacterium tuberculosis H37Rv
cccugcaacccggucggcagcu

SEQ ID NO: 1319355 - RNA, 18 nt, Mycobacterium tuberculosis H37Rv
cccugcacccagccgugc

SEQ ID NO: 1319356 - RNA, 22 nt, Mycobacterium tuberculosis H37Rv
cccugcacggugcccagggcga

SEQ ID NO: 1319357 - RNA, 17 nt, Mycobacterium tuberculosis H37Rv
ccccuggccgccggcgc

SEQ ID NO: 1319358 - RNA, 20 nt, Mycobacterium tuberculosis H37Rv
ccccuggaaagggccgccgc

SEQ ID NO: 1319359 - RNA, 15 nt, Mycobacterium tuberculosis H37Rv
ccccuguugccccuc

SEQ ID NO: 1319360 - RNA, 14 nt, Mycobacterium tuberculosis H37Rv
ccccuggccgccgg

SEQ ID NO: 1319361 - RNA, 15 nt, Mycobacterium tuberculosis H37Rv
cccucggcgaccugg

SEQ ID NO: 1319362 - RNA, 16 nt, Mycobacterium tuberculosis H37Rv
cccucgggacggccgc

SEQ ID NO: 1319363 - RNA, 19 nt, Mycobacterium tuberculosis H37Rv
cccucgggacggccgccgc

SEQ ID NO: 1319364 - RNA, 21 nt, Mycobacterium tuberculosis H37Rv
cccucgggacggccgccgccg

SEQ ID NO: 1319365 - RNA, 12 nt, Mycobacterium tuberculosis H37Rv
cccucggugcca

SEQ ID NO: 1319366 - RNA, 19 nt, Mycobacterium tuberculosis H37Rv
ccccuggacuucgggggcc

SEQ ID NO: 1319367 - RNA, 14 nt, Mycobacterium tuberculosis H37Rv
cccucuagcgccuc

SEQ ID NO: 1319368 - RNA, 20 nt, Mycobacterium tuberculosis H37Rv
cccucuagcgccucgccggc

SEQ ID NO: 1319369 - RNA, 18 nt, Mycobacterium tuberculosis H37Rv
cccucguuaucgaccgcc

SEQ ID NO: 1319370 - RNA, 16 nt, Mycobacterium tuberculosis H37Rv
cccucuacacccggac

SEQ ID NO: 1319371 - RNA, 15 nt, Mycobacterium tuberculosis H37Rv
cccucuagcgcccga

SEQ ID NO: 1319372 - RNA, 23 nt, Mycobacterium tuberculosis H37Rv
cccucgguguacaccgcgcccgc

SEQ ID NO: 1319373 - RNA, 20 nt, Mycobacterium tuberculosis H37Rv
cccuggauggcgcccugcgc

SEQ ID NO: 1319374 - RNA, 17 nt, Mycobacterium tuberculosis H37Rv
cccuggaaugccgccac

SEQ ID NO: 1319375 - RNA, 18 nt, Mycobacterium tuberculosis H37Rv
cccuggaaagggccgccg

SEQ ID NO: 1319376 - RNA, 16 nt, Mycobacterium tuberculosis H37Rv
cccuggcgaccagccg

SEQ ID NO: 1319377 - RNA, 15 nt, Mycobacterium tuberculosis H37Rv
cccuggccaaccggg

SEQ ID NO: 1319378 - RNA, 14 nt, Mycobacterium tuberculosis H37Rv
cccuggccagcaga

SEQ ID NO: 1319379 - RNA, 14 nt, Mycobacterium tuberculosis H37Rv
cccugcuggcccaa

SEQ ID NO: 1319380 - RNA, 20 nt, Mycobacterium tuberculosis H37Rv
cccugcuggugucggcucga

SEQ ID NO: 1319381 - RNA, 17 nt, Mycobacterium tuberculosis H37Rv
cccugcuccucgcgggc

SEQ ID NO: 1319382 - RNA, 15 nt, Mycobacterium tuberculosis H37Rv
cccugcccggcccgc

SEQ ID NO: 1319383 - RNA, 18 nt, Mycobacterium tuberculosis H37Rv
cccugccgccggccccgc

SEQ ID NO: 1319384 - RNA, 17 nt, Mycobacterium tuberculosis H37Rv
cccugccgccggccccg

SEQ ID NO: 1319385 - RNA, 16 nt, Mycobacterium tuberculosis H37Rv
cccugccgccggcccc

SEQ ID NO: 1319386 - RNA, 20 nt, Mycobacterium tuberculosis H37Rv
cccugcccagcacccccugc

SEQ ID NO: 1319387 - RNA, 14 nt, Mycobacterium tuberculosis H37Rv
cccugcccggcccg

SEQ ID NO: 1319388 - RNA, 16 nt, Mycobacterium tuberculosis H37Rv
cccugcauaggcgcgg

SEQ ID NO: 1319389 - RNA, 15 nt, Mycobacterium tuberculosis H37Rv
cccugcgcagccgcc

SEQ ID NO: 1319390 - RNA, 19 nt, Mycobacterium tuberculosis H37Rv
cccugcgccacacccggca

SEQ ID NO: 1319391 - RNA, 14 nt, Mycobacterium tuberculosis H37Rv
cccugccggcagcg

SEQ ID NO: 1319392 - RNA, 19 nt, Mycobacterium tuberculosis H37Rv
cccugcgccgccacagcac

SEQ ID NO: 1319393 - RNA, 14 nt, Mycobacterium tuberculosis H37Rv
cccugcgccgccac

SEQ ID NO: 1319394 - RNA, 20 nt, Mycobacterium tuberculosis H37Rv
cccuguugccccuccagggg

SEQ ID NO: 1319395 - RNA, 16 nt, Mycobacterium tuberculosis H37Rv
cccugugucgccgucg

SEQ ID NO: 1319396 - RNA, 13 nt, Mycobacterium tuberculosis H37Rv
cccugucgcgcac

SEQ ID NO: 1319397 - RNA, 19 nt, Mycobacterium tuberculosis H37Rv
cccugucauguccugggcc

SEQ ID NO: 1319398 - RNA, 17 nt, Mycobacterium tuberculosis H37Rv
cccuggugugccgcguu

SEQ ID NO: 1319399 - RNA, 18 nt, Mycobacterium tuberculosis H37Rv
cccugguacaccaggccg

SEQ ID NO: 1319400 - RNA, 14 nt, Mycobacterium tuberculosis H37Rv
cccugggguccagc

SEQ ID NO: 1319401 - RNA, 16 nt, Mycobacterium tuberculosis H37Rv
cccuggggguggcagc

SEQ ID NO: 1319402 - RNA, 14 nt, Mycobacterium tuberculosis H37Rv
cccuggcgugugug

SEQ ID NO: 1319403 - RNA, 14 nt, Mycobacterium tuberculosis H37Rv
cccuggcggcccgg

SEQ ID NO: 1319404 - RNA, 17 nt, Mycobacterium tuberculosis H37Rv
cccuggcggcccggguu

SEQ ID NO: 1319405 - RNA, 23 nt, Mycobacterium tuberculosis H37Rv
cccugggcgucgaccacgcaagg

SEQ ID NO: 1319406 - RNA, 15 nt, Mycobacterium tuberculosis H37Rv
cccugggcgccggcg

SEQ ID NO: 1319407 - RNA, 21 nt, Mycobacterium tuberculosis H37Rv
cccugggcaaacugggcaccg

SEQ ID NO: 1319408 - RNA, 16 nt, Mycobacterium tuberculosis H37Rv
cccuucaaagcggccu

SEQ ID NO: 1319409 - RNA, 14 nt, Mycobacterium tuberculosis H37Rv
cccuucgcggugug

SEQ ID NO: 1319410 - RNA, 20 nt, Mycobacterium tuberculosis H37Rv
cccuucgcgagcagacgcgg

SEQ ID NO: 1319411 - RNA, 18 nt, Mycobacterium tuberculosis H37Rv
ccgaacuugcggaccugg

SEQ ID NO: 1319412 - RNA, 21 nt, Mycobacterium tuberculosis H37Rv
ccgaagaaugggauggcacca

SEQ ID NO: 1319413 - RNA, 15 nt, Mycobacterium tuberculosis H37Rv
ccgaagaaaacgaac

SEQ ID NO: 1319414 - RNA, 16 nt, Mycobacterium tuberculosis H37Rv
ccgaaccgcaaggccc

SEQ ID NO: 1319415 - RNA, 19 nt, Mycobacterium tuberculosis H37Rv
ccgaacauugcgcccagcg

SEQ ID NO: 1319416 - RNA, 11 nt, Mycobacterium tuberculosis H37Rv
ccgaacauggc

SEQ ID NO: 1319417 - RNA, 18 nt, Mycobacterium tuberculosis H37Rv
ccgaaccccgggcggcgc

SEQ ID NO: 1319418 - RNA, 15 nt, Mycobacterium tuberculosis H37Rv
ccgaacccgccaccg

SEQ ID NO: 1319419 - RNA, 21 nt, Mycobacterium tuberculosis H37Rv
ccgaacagcugcccgccagcg

SEQ ID NO: 1319420 - RNA, 16 nt, Mycobacterium tuberculosis H37Rv
ccgaagagcgcgcgca

SEQ ID NO: 1319421 - RNA, 15 nt, Mycobacterium tuberculosis H37Rv
ccgaagaugaccgcu

SEQ ID NO: 1319422 - RNA, 16 nt, Mycobacterium tuberculosis H37Rv
ccgaagaugccuggaa

SEQ ID NO: 1319423 - RNA, 18 nt, Mycobacterium tuberculosis H37Rv
ccgaaguacuggccgccg

SEQ ID NO: 1319424 - RNA, 14 nt, Mycobacterium tuberculosis H37Rv
ccgaaguacuggcc

SEQ ID NO: 1319425 - RNA, 21 nt, Mycobacterium tuberculosis H37Rv
ccgaauaccacaccgugacca

SEQ ID NO: 1319426 - RNA, 22 nt, Mycobacterium tuberculosis H37Rv
ccgaaguccacgcaccacgagc

SEQ ID NO: 1319427 - RNA, 17 nt, Mycobacterium tuberculosis H37Rv
ccgaaguagaagcccag

SEQ ID NO: 1319428 - RNA, 22 nt, Mycobacterium tuberculosis H37Rv
ccgaaguacuggccgccgcgca

SEQ ID NO: 1319429 - RNA, 19 nt, Mycobacterium tuberculosis H37Rv
ccgaaguagaagcccagga

SEQ ID NO: 1319430 - RNA, 17 nt, Mycobacterium tuberculosis H37Rv
ccgaacagcagcccgcc

SEQ ID NO: 1319431 - RNA, 16 nt, Mycobacterium tuberculosis H37Rv
ccgaaaccaugccgcc

SEQ ID NO: 1319432 - RNA, 15 nt, Mycobacterium tuberculosis H37Rv
ccgaaaaacaccagc

SEQ ID NO: 1319433 - RNA, 19 nt, Mycobacterium tuberculosis H37Rv
ccgaaaaacaccagcgagg

SEQ ID NO: 1319434 - RNA, 18 nt, Mycobacterium tuberculosis H37Rv
ccgaaaaguccgccgccu

SEQ ID NO: 1319435 - RNA, 18 nt, Mycobacterium tuberculosis H37Rv
cccuugccgccuuggccc

SEQ ID NO: 1319436 - RNA, 16 nt, Mycobacterium tuberculosis H37Rv
cccuugccgccuuggc

SEQ ID NO: 1319437 - RNA, 16 nt, Mycobacterium tuberculosis H37Rv
cccuugccgcccgcuc

SEQ ID NO: 1319438 - RNA, 14 nt, Mycobacterium tuberculosis H37Rv
cccuugccgccauu

SEQ ID NO: 1319439 - RNA, 11 nt, Mycobacterium tuberculosis H37Rv
cccuugccgcc

SEQ ID NO: 1319440 - RNA, 13 nt, Mycobacterium tuberculosis H37Rv
cccuucgucacau

SEQ ID NO: 1319441 - RNA, 21 nt, Mycobacterium tuberculosis H37Rv
ccgcaggucggccaccugcuc

SEQ ID NO: 1319442 - RNA, 23 nt, Mycobacterium tuberculosis H37Rv
ccgcaguccggggcgcaggucgu

SEQ ID NO: 1319443 - RNA, 16 nt, Mycobacterium tuberculosis H37Rv
ccgcagucgcggcaga

SEQ ID NO: 1319444 - RNA, 13 nt, Mycobacterium tuberculosis H37Rv
ccgcagucccagc

SEQ ID NO: 1319445 - RNA, 13 nt, Mycobacterium tuberculosis H37Rv
ccgcagggccgcc

SEQ ID NO: 1319446 - RNA, 15 nt, Mycobacterium tuberculosis H37Rv
ccgcagggccgccgc

SEQ ID NO: 1319447 - RNA, 21 nt, Mycobacterium tuberculosis H37Rv
ccgcaggcgaacaccagaugg

SEQ ID NO: 1319448 - RNA, 13 nt, Mycobacterium tuberculosis H37Rv
ccgcaggcccgcc

SEQ ID NO: 1319449 - RNA, 16 nt, Mycobacterium tuberculosis H37Rv
ccgcagcccgugacug

SEQ ID NO: 1319450 - RNA, 20 nt, Mycobacterium tuberculosis H37Rv
ccgcagcccgugacugguga

SEQ ID NO: 1319451 - RNA, 20 nt, Mycobacterium tuberculosis H37Rv
ccgcagccccgacaguugug

SEQ ID NO: 1319452 - RNA, 18 nt, Mycobacterium tuberculosis H37Rv
ccgcagcgugaucuggcc

SEQ ID NO: 1319453 - RNA, 16 nt, Mycobacterium tuberculosis H37Rv
ccgcagcucgaccagg

SEQ ID NO: 1319454 - RNA, 23 nt, Mycobacterium tuberculosis H37Rv
ccgcagcuuuaaucguggcacug

SEQ ID NO: 1319455 - RNA, 19 nt, Mycobacterium tuberculosis H37Rv
ccgcagccagaucuccccg

SEQ ID NO: 1319456 - RNA, 15 nt, Mycobacterium tuberculosis H37Rv
ccgcagccagaucuc

SEQ ID NO: 1319457 - RNA, 23 nt, Mycobacterium tuberculosis H37Rv
ccgcagcaggugcaucgccacag

SEQ ID NO: 1319458 - RNA, 22 nt, Mycobacterium tuberculosis H37Rv
ccgcagcccaaaucccagagca

SEQ ID NO: 1319459 - RNA, 22 nt, Mycobacterium tuberculosis H37Rv
ccgcaccacaccgugggcgacg

SEQ ID NO: 1319460 - RNA, 17 nt, Mycobacterium tuberculosis H37Rv
ccgcaccaccggcccca

SEQ ID NO: 1319461 - RNA, 18 nt, Mycobacterium tuberculosis H37Rv
ccgcaccaccggccccac

SEQ ID NO: 1319462 - RNA, 19 nt, Mycobacterium tuberculosis H37Rv
ccgcaccaccggccccacc

SEQ ID NO: 1319463 - RNA, 14 nt, Mycobacterium tuberculosis H37Rv
ccgcaagaaucagc

SEQ ID NO: 1319464 - RNA, 14 nt, Mycobacterium tuberculosis H37Rv
ccgcaccaguggcg

SEQ ID NO: 1319465 - RNA, 15 nt, Mycobacterium tuberculosis H37Rv
ccgcaccaguggcgc

SEQ ID NO: 1319466 - RNA, 19 nt, Mycobacterium tuberculosis H37Rv
ccgcaccagucgcgcagcg

SEQ ID NO: 1319467 - RNA, 13 nt, Mycobacterium tuberculosis H37Rv
ccgcaccaggugu

SEQ ID NO: 1319468 - RNA, 20 nt, Mycobacterium tuberculosis H37Rv
ccgcaccagguguccccgcc

SEQ ID NO: 1319469 - RNA, 16 nt, Mycobacterium tuberculosis H37Rv
ccgcaccccggccgcg

SEQ ID NO: 1319470 - RNA, 21 nt, Mycobacterium tuberculosis H37Rv
ccgcacccccgucgaucagcg

SEQ ID NO: 1319471 - RNA, 13 nt, Mycobacterium tuberculosis H37Rv
ccgcaccccgccc

SEQ ID NO: 1319472 - RNA, 17 nt, Mycobacterium tuberculosis H37Rv
ccgcaccaguggcgccc

SEQ ID NO: 1319473 - RNA, 15 nt, Mycobacterium tuberculosis H37Rv
ccgcacuuucuuccu

SEQ ID NO: 1319474 - RNA, 11 nt, Mycobacterium tuberculosis H37Rv
ccgcagcagca

SEQ ID NO: 1319475 - RNA, 14 nt, Mycobacterium tuberculosis H37Rv
ccgcacggugacca

SEQ ID NO: 1319476 - RNA, 14 nt, Mycobacterium tuberculosis H37Rv
ccgcacccgcuccc

SEQ ID NO: 1319477 - RNA, 18 nt, Mycobacterium tuberculosis H37Rv
ccgcacccgcgcggacac

SEQ ID NO: 1319478 - RNA, 20 nt, Mycobacterium tuberculosis H37Rv
ccgcacuccacgaucggccc

SEQ ID NO: 1319479 - RNA, 15 nt, Mycobacterium tuberculosis H37Rv
ccgcacugccgccgg

SEQ ID NO: 1319480 - RNA, 20 nt, Mycobacterium tuberculosis H37Rv
ccgcacugcuagucgugccg

SEQ ID NO: 1319481 - RNA, 22 nt, Mycobacterium tuberculosis H37Rv
ccgaugauggacaccagccaga

SEQ ID NO: 1319482 - RNA, 18 nt, Mycobacterium tuberculosis H37Rv
ccgaugccgacggcgccc

SEQ ID NO: 1319483 - RNA, 21 nt, Mycobacterium tuberculosis H37Rv
ccgaugacuacuccugagaug

SEQ ID NO: 1319484 - RNA, 20 nt, Mycobacterium tuberculosis H37Rv
ccgaugauaauuccagcacc

SEQ ID NO: 1319485 - RNA, 19 nt, Mycobacterium tuberculosis H37Rv
ccgaugacguacggcugug

SEQ ID NO: 1319486 - RNA, 15 nt, Mycobacterium tuberculosis H37Rv
ccgaugacggucccc

SEQ ID NO: 1319487 - RNA, 16 nt, Mycobacterium tuberculosis H37Rv
ccgaugaagccaagaa

SEQ ID NO: 1319488 - RNA, 20 nt, Mycobacterium tuberculosis H37Rv
ccgaugaccagggucugcuc

SEQ ID NO: 1319489 - RNA, 22 nt, Mycobacterium tuberculosis H37Rv
ccgaugacgaucggcggcgcgc

SEQ ID NO: 1319490 - RNA, 20 nt, Mycobacterium tuberculosis H37Rv
ccgaucuggaugucccaugc

SEQ ID NO: 1319491 - RNA, 20 nt, Mycobacterium tuberculosis H37Rv
ccgauggugccgacccgccg

SEQ ID NO: 1319492 - RNA, 16 nt, Mycobacterium tuberculosis H37Rv
ccgauuggccaacccc

SEQ ID NO: 1319493 - RNA, 15 nt, Mycobacterium tuberculosis H37Rv
ccgaugccgccggcc

SEQ ID NO: 1319494 - RNA, 15 nt, Mycobacterium tuberculosis H37Rv
ccgaugccgccgccg

SEQ ID NO: 1319495 - RNA, 16 nt, Mycobacterium tuberculosis H37Rv
ccgaugcgcagugcac

SEQ ID NO: 1319496 - RNA, 21 nt, Mycobacterium tuberculosis H37Rv
ccgaugguggugccaaccugg

SEQ ID NO: 1319497 - RNA, 13 nt, Mycobacterium tuberculosis H37Rv
ccgauuucccagc

SEQ ID NO: 1319498 - RNA, 14 nt, Mycobacterium tuberculosis H37Rv
ccgauuuugggauc

SEQ ID NO: 1319499 - RNA, 16 nt, Mycobacterium tuberculosis H37Rv
ccgcaacucgccgaaa

SEQ ID NO: 1319500 - RNA, 23 nt, Mycobacterium tuberculosis H37Rv
ccgcaacucgccgaaaucggcca

SEQ ID NO: 1319501 - RNA, 18 nt, Mycobacterium tuberculosis H37Rv
ccgcaacgcgucggucgc

SEQ ID NO: 1319502 - RNA, 18 nt, Mycobacterium tuberculosis H37Rv
ccgcaacgcuucggcagc

SEQ ID NO: 1319503 - RNA, 22 nt, Mycobacterium tuberculosis H37Rv
ccgaggguagacggggcgagca

SEQ ID NO: 1319504 - RNA, 16 nt, Mycobacterium tuberculosis H37Rv
ccgagguaacgcagcg

SEQ ID NO: 1319505 - RNA, 16 nt, Mycobacterium tuberculosis H37Rv
ccgagggcgucgccgc

SEQ ID NO: 1319506 - RNA, 20 nt, Mycobacterium tuberculosis H37Rv
ccgagggcgccgggggcgcc

SEQ ID NO: 1319507 - RNA, 16 nt, Mycobacterium tuberculosis H37Rv
ccgaggcuggcauccc

SEQ ID NO: 1319508 - RNA, 22 nt, Mycobacterium tuberculosis H37Rv
ccgagcuugggccggugcagca

SEQ ID NO: 1319509 - RNA, 18 nt, Mycobacterium tuberculosis H37Rv
ccgagcuugucgagcagg

SEQ ID NO: 1319510 - RNA, 19 nt, Mycobacterium tuberculosis H37Rv
ccgagcuugucgagcaggc

SEQ ID NO: 1319511 - RNA, 19 nt, Mycobacterium tuberculosis H37Rv
ccgagcuuggccgccgcca

SEQ ID NO: 1319512 - RNA, 22 nt, Mycobacterium tuberculosis H37Rv
ccgagcuuggccgccgccaccu

SEQ ID NO: 1319513 - RNA, 18 nt, Mycobacterium tuberculosis H37Rv
ccgagcuuggccgccgcc

SEQ ID NO: 1319514 - RNA, 21 nt, Mycobacterium tuberculosis H37Rv
ccgagcuucagcgcgcugcag

SEQ ID NO: 1319515 - RNA, 22 nt, Mycobacterium tuberculosis H37Rv
ccgagcuugagcgugagcgccg

SEQ ID NO: 1319516 - RNA, 18 nt, Mycobacterium tuberculosis H37Rv
ccgagcgcccuccucgau

SEQ ID NO: 1319517 - RNA, 16 nt, Mycobacterium tuberculosis H37Rv
ccgagccguccaagcc

SEQ ID NO: 1319518 - RNA, 17 nt, Mycobacterium tuberculosis H37Rv
ccgagccguugcgccuc

SEQ ID NO: 1319519 - RNA, 22 nt, Mycobacterium tuberculosis H37Rv
ccgagccgcuaggacggcgcga

SEQ ID NO: 1319520 - RNA, 18 nt, Mycobacterium tuberculosis H37Rv
ccgagccgaccggcggca

SEQ ID NO: 1319521 - RNA, 22 nt, Mycobacterium tuberculosis H37Rv
ccgagccgauauaccagggcau

SEQ ID NO: 1319522 - RNA, 21 nt, Mycobacterium tuberculosis H37Rv
ccgagcucuuggagcuuggcc

SEQ ID NO: 1319523 - RNA, 22 nt, Mycobacterium tuberculosis H37Rv
ccgagcucguugcuggcggcca

SEQ ID NO: 1319524 - RNA, 15 nt, Mycobacterium tuberculosis H37Rv
ccgagcuccuccacc

SEQ ID NO: 1319525 - RNA, 18 nt, Mycobacterium tuberculosis H37Rv
ccgagcuccuccaccaac

SEQ ID NO: 1319526 - RNA, 21 nt, Mycobacterium tuberculosis H37Rv
ccgagcucaccgcacaccugc

SEQ ID NO: 1319527 - RNA, 16 nt, Mycobacterium tuberculosis H37Rv
ccgagcucggcgccca

SEQ ID NO: 1319528 - RNA, 19 nt, Mycobacterium tuberculosis H37Rv
ccgagcugagcggccagca

SEQ ID NO: 1319529 - RNA, 15 nt, Mycobacterium tuberculosis H37Rv
ccgagcugagcggcc

SEQ ID NO: 1319530 - RNA, 18 nt, Mycobacterium tuberculosis H37Rv
ccgagcugauccgggugg

SEQ ID NO: 1319531 - RNA, 19 nt, Mycobacterium tuberculosis H37Rv
ccgagcuggcaacgccgcg

SEQ ID NO: 1319532 - RNA, 23 nt, Mycobacterium tuberculosis H37Rv
ccgagcugguuggcgccgaaaag

SEQ ID NO: 1319533 - RNA, 16 nt, Mycobacterium tuberculosis H37Rv
ccgagcugguuggcgc

SEQ ID NO: 1319534 - RNA, 14 nt, Mycobacterium tuberculosis H37Rv
ccgaucggcaaccc

SEQ ID NO: 1319535 - RNA, 14 nt, Mycobacterium tuberculosis H37Rv
ccgaucagccgugg

SEQ ID NO: 1319536 - RNA, 15 nt, Mycobacterium tuberculosis H37Rv
ccgaucagcccggcc

SEQ ID NO: 1319537 - RNA, 16 nt, Mycobacterium tuberculosis H37Rv
ccgaucagcguggcgc

SEQ ID NO: 1319538 - RNA, 16 nt, Mycobacterium tuberculosis H37Rv
ccgaucagcccggccu

SEQ ID NO: 1319539 - RNA, 13 nt, Mycobacterium tuberculosis H37Rv
ccgaucagcagcu

SEQ ID NO: 1319540 - RNA, 22 nt, Mycobacterium tuberculosis H37Rv
ccgaucaccuucggccgaccgg

SEQ ID NO: 1319541 - RNA, 18 nt, Mycobacterium tuberculosis H37Rv
ccgaguugaacguucccu

SEQ ID NO: 1319542 - RNA, 17 nt, Mycobacterium tuberculosis H37Rv
ccgauaacacccgggcc

SEQ ID NO: 1319543 - RNA, 16 nt, Mycobacterium tuberculosis H37Rv
ccgagugcggugugug

SEQ ID NO: 1319544 - RNA, 21 nt, Mycobacterium tuberculosis H37Rv
ccgaguggccggugggccgcc

SEQ ID NO: 1319545 - RNA, 20 nt, Mycobacterium tuberculosis H37Rv
ccgaguugcccgggucggcc

SEQ ID NO: 1319546 - RNA, 17 nt, Mycobacterium tuberculosis H37Rv
ccgaguugcccucuggc

SEQ ID NO: 1319547 - RNA, 17 nt, Mycobacterium tuberculosis H37Rv
ccgaguuguaggccgcc

SEQ ID NO: 1319548 - RNA, 14 nt, Mycobacterium tuberculosis H37Rv
ccgaguugucgcgc

SEQ ID NO: 1319549 - RNA, 18 nt, Mycobacterium tuberculosis H37Rv
ccgaguuucugaagcccg

SEQ ID NO: 1319550 - RNA, 20 nt, Mycobacterium tuberculosis H37Rv
ccgagacuugcuggcccgca

SEQ ID NO: 1319551 - RNA, 14 nt, Mycobacterium tuberculosis H37Rv
ccgagagcaccgcu

SEQ ID NO: 1319552 - RNA, 16 nt, Mycobacterium tuberculosis H37Rv
ccgagauuggugcaga

SEQ ID NO: 1319553 - RNA, 20 nt, Mycobacterium tuberculosis H37Rv
ccgagcaaacauccacccgc

SEQ ID NO: 1319554 - RNA, 15 nt, Mycobacterium tuberculosis H37Rv
ccgagccgcacagca

SEQ ID NO: 1319555 - RNA, 16 nt, Mycobacterium tuberculosis H37Rv
ccgagcccgucagcuc

SEQ ID NO: 1319556 - RNA, 15 nt, Mycobacterium tuberculosis H37Rv
ccgagcaccucggcc

SEQ ID NO: 1319557 - RNA, 16 nt, Mycobacterium tuberculosis H37Rv
ccgagcaccccagggg

SEQ ID NO: 1319558 - RNA, 15 nt, Mycobacterium tuberculosis H37Rv
ccgagaagugggcgg

SEQ ID NO: 1319559 - RNA, 12 nt, Mycobacterium tuberculosis H37Rv
ccgagacaccac

SEQ ID NO: 1319560 - RNA, 16 nt, Mycobacterium tuberculosis H37Rv
ccgagacaccacguug

SEQ ID NO: 1319561 - RNA, 16 nt, Mycobacterium tuberculosis H37Rv
ccgagaauuccccagc

SEQ ID NO: 1319562 - RNA, 22 nt, Mycobacterium tuberculosis H37Rv
ccgagaagcccaccgucugcug

SEQ ID NO: 1319563 - RNA, 14 nt, Mycobacterium tuberculosis H37Rv
ccgagaacggcggg

SEQ ID NO: 1319564 - RNA, 19 nt, Mycobacterium tuberculosis H37Rv
ccgagaagagauccuggag

SEQ ID NO: 1319565 - RNA, 19 nt, Mycobacterium tuberculosis H37Rv
ccgacucaucggccgcggu

SEQ ID NO: 1319566 - RNA, 20 nt, Mycobacterium tuberculosis H37Rv
ccgacuccccgccgggcaau

SEQ ID NO: 1319567 - RNA, 15 nt, Mycobacterium tuberculosis H37Rv
ccgacucaucggccg

SEQ ID NO: 1319568 - RNA, 14 nt, Mycobacterium tuberculosis H37Rv
ccgacuaucggccg

SEQ ID NO: 1319569 - RNA, 18 nt, Mycobacterium tuberculosis H37Rv
ccgacguugcuggcuggg

SEQ ID NO: 1319570 - RNA, 20 nt, Mycobacterium tuberculosis H37Rv
ccgacgugguugccccgcag

SEQ ID NO: 1319571 - RNA, 18 nt, Mycobacterium tuberculosis H37Rv
ccgacguggccagcccgc

SEQ ID NO: 1319572 - RNA, 18 nt, Mycobacterium tuberculosis H37Rv
ccgacgucgaccacugcc

SEQ ID NO: 1319573 - RNA, 16 nt, Mycobacterium tuberculosis H37Rv
ccgacgucgccgacgg

SEQ ID NO: 1319574 - RNA, 22 nt, Mycobacterium tuberculosis H37Rv
ccgacgucaggcagcuccgccg

SEQ ID NO: 1319575 - RNA, 23 nt, Mycobacterium tuberculosis H37Rv
ccgacgucaggcagcuccgccgc

SEQ ID NO: 1319576 - RNA, 18 nt, Mycobacterium tuberculosis H37Rv
ccgacguauagaccaggu

SEQ ID NO: 1319577 - RNA, 20 nt, Mycobacterium tuberculosis H37Rv
ccgacguacaggacgguuga

SEQ ID NO: 1319578 - RNA, 14 nt, Mycobacterium tuberculosis H37Rv
ccgacgcggacagg

SEQ ID NO: 1319579 - RNA, 22 nt, Mycobacterium tuberculosis H37Rv
ccgacggugaugggggagccgg

SEQ ID NO: 1319580 - RNA, 16 nt, Mycobacterium tuberculosis H37Rv
ccgacgcgcggccagc

SEQ ID NO: 1319581 - RNA, 17 nt, Mycobacterium tuberculosis H37Rv
ccgacgcgcggccagcc

SEQ ID NO: 1319582 - RNA, 14 nt, Mycobacterium tuberculosis H37Rv
ccgacgccgguggg

SEQ ID NO: 1319583 - RNA, 16 nt, Mycobacterium tuberculosis H37Rv
ccgacgccgccggccc

SEQ ID NO: 1319584 - RNA, 18 nt, Mycobacterium tuberculosis H37Rv
ccgacgccgccggccccg

SEQ ID NO: 1319585 - RNA, 13 nt, Mycobacterium tuberculosis H37Rv
ccgacgccggugg

SEQ ID NO: 1319586 - RNA, 22 nt, Mycobacterium tuberculosis H37Rv
ccgacgccugggcacggccguc

SEQ ID NO: 1319587 - RNA, 17 nt, Mycobacterium tuberculosis H37Rv
ccgacgccuuccagccc

SEQ ID NO: 1319588 - RNA, 16 nt, Mycobacterium tuberculosis H37Rv
ccgacgccaccgccac

SEQ ID NO: 1319589 - RNA, 13 nt, Mycobacterium tuberculosis H37Rv
ccgacgccgccag

SEQ ID NO: 1319590 - RNA, 18 nt, Mycobacterium tuberculosis H37Rv
ccgaaucggcaccgugcg

SEQ ID NO: 1319591 - RNA, 15 nt, Mycobacterium tuberculosis H37Rv
ccgaaucgccggcgg

SEQ ID NO: 1319592 - RNA, 18 nt, Mycobacterium tuberculosis H37Rv
ccgaauccgauagcccgg

SEQ ID NO: 1319593 - RNA, 12 nt, Mycobacterium tuberculosis H37Rv
ccgacgaccagc

SEQ ID NO: 1319594 - RNA, 19 nt, Mycobacterium tuberculosis H37Rv
ccgacgaccgccugcaaca

SEQ ID NO: 1319595 - RNA, 20 nt, Mycobacterium tuberculosis H37Rv
ccgacgaacgaaccgccgcc

SEQ ID NO: 1319596 - RNA, 19 nt, Mycobacterium tuberculosis H37Rv
ccgacgaugugcacggugu

SEQ ID NO: 1319597 - RNA, 18 nt, Mycobacterium tuberculosis H37Rv
ccgacgauuaccagcggc

SEQ ID NO: 1319598 - RNA, 17 nt, Mycobacterium tuberculosis H37Rv
ccgacgaugcgggcgau

SEQ ID NO: 1319599 - RNA, 19 nt, Mycobacterium tuberculosis H37Rv
ccgacgaucgacgccgcca

SEQ ID NO: 1319600 - RNA, 17 nt, Mycobacterium tuberculosis H37Rv
ccgacgaucgacgccgc

SEQ ID NO: 1319601 - RNA, 17 nt, Mycobacterium tuberculosis H37Rv
ccgacgacaccagagcg

SEQ ID NO: 1319602 - RNA, 14 nt, Mycobacterium tuberculosis H37Rv
ccgacgacgcgcgc

SEQ ID NO: 1319603 - RNA, 14 nt, Mycobacterium tuberculosis H37Rv
ccgccggccgccag

SEQ ID NO: 1319604 - RNA, 15 nt, Mycobacterium tuberculosis H37Rv
ccgccggccccgccg

SEQ ID NO: 1319605 - RNA, 16 nt, Mycobacterium tuberculosis H37Rv
ccgccggccccgccgc

SEQ ID NO: 1319606 - RNA, 20 nt, Mycobacterium tuberculosis H37Rv
ccgccggccccgccggcccc

SEQ ID NO: 1319607 - RNA, 18 nt, Mycobacterium tuberculosis H37Rv
ccgccggccgucggccgg

SEQ ID NO: 1319608 - RNA, 15 nt, Mycobacterium tuberculosis H37Rv
ccgccggcgccgccc

SEQ ID NO: 1319609 - RNA, 18 nt, Mycobacterium tuberculosis H37Rv
ccgccggcgcccaggccg

SEQ ID NO: 1319610 - RNA, 14 nt, Mycobacterium tuberculosis H37Rv
ccgccggcgccccc

SEQ ID NO: 1319611 - RNA, 15 nt, Mycobacterium tuberculosis H37Rv
ccgccggcgcccccg

SEQ ID NO: 1319612 - RNA, 17 nt, Mycobacterium tuberculosis H37Rv
ccgccggcgccacccgc

SEQ ID NO: 1319613 - RNA, 23 nt, Mycobacterium tuberculosis H37Rv
ccgccggcuccgccacuggcgcc

SEQ ID NO: 1319614 - RNA, 18 nt, Mycobacterium tuberculosis H37Rv
ccgccggcuccgccagcg

SEQ ID NO: 1319615 - RNA, 16 nt, Mycobacterium tuberculosis H37Rv
ccgccgggccaggccg

SEQ ID NO: 1319616 - RNA, 13 nt, Mycobacterium tuberculosis H37Rv
ccgccgggccccg

SEQ ID NO: 1319617 - RNA, 13 nt, Mycobacterium tuberculosis H37Rv
ccgccgggcccuc

SEQ ID NO: 1319618 - RNA, 14 nt, Mycobacterium tuberculosis H37Rv
ccgccggcggcggc

SEQ ID NO: 1319619 - RNA, 23 nt, Mycobacterium tuberculosis H37Rv
ccgccggcggggugcgcccaccg

SEQ ID NO: 1319620 - RNA, 18 nt, Mycobacterium tuberculosis H37Rv
ccgccggcgccggugccg

SEQ ID NO: 1319621 - RNA, 14 nt, Mycobacterium tuberculosis H37Rv
ccgccggcgccggc

SEQ ID NO: 1319622 - RNA, 18 nt, Mycobacterium tuberculosis H37Rv
ccgccggcgcuggcgggc

SEQ ID NO: 1319623 - RNA, 17 nt, Mycobacterium tuberculosis H37Rv
ccgccgcugccgccugc

SEQ ID NO: 1319624 - RNA, 16 nt, Mycobacterium tuberculosis H37Rv
ccgccgcugccgccgg

SEQ ID NO: 1319625 - RNA, 15 nt, Mycobacterium tuberculosis H37Rv
ccgccggacccaccg

SEQ ID NO: 1319626 - RNA, 14 nt, Mycobacterium tuberculosis H37Rv
ccgccggacccgcc

SEQ ID NO: 1319627 - RNA, 15 nt, Mycobacterium tuberculosis H37Rv
ccgccggacccgccc

SEQ ID NO: 1319628 - RNA, 15 nt, Mycobacterium tuberculosis H37Rv
ccgccggaacugcgc

SEQ ID NO: 1319629 - RNA, 23 nt, Mycobacterium tuberculosis H37Rv
ccgccggcaccgccggcaccgcc

SEQ ID NO: 1319630 - RNA, 16 nt, Mycobacterium tuberculosis H37Rv
ccgccggcaccgccgc

SEQ ID NO: 1319631 - RNA, 14 nt, Mycobacterium tuberculosis H37Rv
ccgccggcaccgcc

SEQ ID NO: 1319632 - RNA, 21 nt, Mycobacterium tuberculosis H37Rv
ccgccggcaauaccgccagcg

SEQ ID NO: 1319633 - RNA, 14 nt, Mycobacterium tuberculosis H37Rv
ccgccggaguuggu

SEQ ID NO: 1319634 - RNA, 19 nt, Mycobacterium tuberculosis H37Rv
ccgccggauagcaccggca

SEQ ID NO: 1319635 - RNA, 21 nt, Mycobacterium tuberculosis H37Rv
ccgccggcagugagucgguga

SEQ ID NO: 1319636 - RNA, 14 nt, Mycobacterium tuberculosis H37Rv
ccgccggccccacc

SEQ ID NO: 1319637 - RNA, 18 nt, Mycobacterium tuberculosis H37Rv
ccgccgccaagcucggcc

SEQ ID NO: 1319638 - RNA, 19 nt, Mycobacterium tuberculosis H37Rv
ccgccgcagcuccccgacc

SEQ ID NO: 1319639 - RNA, 13 nt, Mycobacterium tuberculosis H37Rv
ccgccgcagcgca

SEQ ID NO: 1319640 - RNA, 15 nt, Mycobacterium tuberculosis H37Rv
ccgccgcaccgccgc

SEQ ID NO: 1319641 - RNA, 12 nt, Mycobacterium tuberculosis H37Rv
ccgccgcacgca

SEQ ID NO: 1319642 - RNA, 21 nt, Mycobacterium tuberculosis H37Rv
ccgccgcacgcuagccgacag

SEQ ID NO: 1319643 - RNA, 14 nt, Mycobacterium tuberculosis H37Rv
ccgccgccaccggc

SEQ ID NO: 1319644 - RNA, 16 nt, Mycobacterium tuberculosis H37Rv
ccgccgccaccggcgc

SEQ ID NO: 1319645 - RNA, 20 nt, Mycobacterium tuberculosis H37Rv
ccgccgcgaccgccucgccg

SEQ ID NO: 1319646 - RNA, 18 nt, Mycobacterium tuberculosis H37Rv
ccgccgcgaccgccucgc

SEQ ID NO: 1319647 - RNA, 19 nt, Mycobacterium tuberculosis H37Rv
ccgccgcgaccacgcaccg

SEQ ID NO: 1319648 - RNA, 23 nt, Mycobacterium tuberculosis H37Rv
ccgccgcgacgcacugccccgca

SEQ ID NO: 1319649 - RNA, 20 nt, Mycobacterium tuberculosis H37Rv
ccgccgcgaggaugcugagc

SEQ ID NO: 1319650 - RNA, 13 nt, Mycobacterium tuberculosis H37Rv
ccgccgcgcgucg

SEQ ID NO: 1319651 - RNA, 18 nt, Mycobacterium tuberculosis H37Rv
ccgccgcggccaccaccg

SEQ ID NO: 1319652 - RNA, 19 nt, Mycobacterium tuberculosis H37Rv
ccgccgcggccaccaccgc

SEQ ID NO: 1319653 - RNA, 20 nt, Mycobacterium tuberculosis H37Rv
ccgccgcgggacaccaccgc

SEQ ID NO: 1319654 - RNA, 16 nt, Mycobacterium tuberculosis H37Rv
ccgccgcuaccgaaca

SEQ ID NO: 1319655 - RNA, 14 nt, Mycobacterium tuberculosis H37Rv
ccgccgcggccggc

SEQ ID NO: 1319656 - RNA, 14 nt, Mycobacterium tuberculosis H37Rv
ccgccgcggccacc

SEQ ID NO: 1319657 - RNA, 14 nt, Mycobacterium tuberculosis H37Rv
ccgccgcgaccacg

SEQ ID NO: 1319658 - RNA, 14 nt, Mycobacterium tuberculosis H37Rv
ccgccgcgcccggc

SEQ ID NO: 1319659 - RNA, 15 nt, Mycobacterium tuberculosis H37Rv
ccgccgcgcagccgc

SEQ ID NO: 1319660 - RNA, 15 nt, Mycobacterium tuberculosis H37Rv
ccgccgaagccgcgc

SEQ ID NO: 1319661 - RNA, 19 nt, Mycobacterium tuberculosis H37Rv
ccgccgaagccgcgcaucu

SEQ ID NO: 1319662 - RNA, 16 nt, Mycobacterium tuberculosis H37Rv
ccgccgaagccgcgca

SEQ ID NO: 1319663 - RNA, 15 nt, Mycobacterium tuberculosis H37Rv
ccgcccugaccgccc

SEQ ID NO: 1319664 - RNA, 16 nt, Mycobacterium tuberculosis H37Rv
ccgcccugaccgcccg

SEQ ID NO: 1319665 - RNA, 18 nt, Mycobacterium tuberculosis H37Rv
ccgcccugaccgcccgca

SEQ ID NO: 1319666 - RNA, 15 nt, Mycobacterium tuberculosis H37Rv
ccgccgagauagcaa

SEQ ID NO: 1319667 - RNA, 15 nt, Mycobacterium tuberculosis H37Rv
ccgccgacuccccgc

SEQ ID NO: 1319668 - RNA, 14 nt, Mycobacterium tuberculosis H37Rv
ccgccgacuccccg

SEQ ID NO: 1319669 - RNA, 13 nt, Mycobacterium tuberculosis H37Rv
ccgccgacgccgc

SEQ ID NO: 1319670 - RNA, 15 nt, Mycobacterium tuberculosis H37Rv
ccgccgacaccaccg

SEQ ID NO: 1319671 - RNA, 19 nt, Mycobacterium tuberculosis H37Rv
ccgccgacaccaccggcgc

SEQ ID NO: 1319672 - RNA, 14 nt, Mycobacterium tuberculosis H37Rv
ccgccgacaccacg

SEQ ID NO: 1319673 - RNA, 13 nt, Mycobacterium tuberculosis H37Rv
ccgccgaccggac

SEQ ID NO: 1319674 - RNA, 12 nt, Mycobacterium tuberculosis H37Rv
ccgccgaccaga

SEQ ID NO: 1319675 - RNA, 17 nt, Mycobacterium tuberculosis H37Rv
ccgccgaccagaacgcc

SEQ ID NO: 1319676 - RNA, 14 nt, Mycobacterium tuberculosis H37Rv
ccgccgaccaggcc

SEQ ID NO: 1319677 - RNA, 17 nt, Mycobacterium tuberculosis H37Rv
ccgccgacgaccgccug

SEQ ID NO: 1319678 - RNA, 15 nt, Mycobacterium tuberculosis H37Rv
ccgccccgggccacc

SEQ ID NO: 1319679 - RNA, 20 nt, Mycobacterium tuberculosis H37Rv
ccgccccguugugucaccgg

SEQ ID NO: 1319680 - RNA, 16 nt, Mycobacterium tuberculosis H37Rv
ccgccccggcggcggc

SEQ ID NO: 1319681 - RNA, 19 nt, Mycobacterium tuberculosis H37Rv
ccgcccgcaucgcggcauc

SEQ ID NO: 1319682 - RNA, 18 nt, Mycobacterium tuberculosis H37Rv
ccgcccguaucggcuucg

SEQ ID NO: 1319683 - RNA, 14 nt, Mycobacterium tuberculosis H37Rv
ccgcccggucgggc

SEQ ID NO: 1319684 - RNA, 23 nt, Mycobacterium tuberculosis H37Rv
ccgcccggucgggcgcggggcgg

SEQ ID NO: 1319685 - RNA, 12 nt, Mycobacterium tuberculosis H37Rv
ccgcccgccagc

SEQ ID NO: 1319686 - RNA, 14 nt, Mycobacterium tuberculosis H37Rv
ccgccccgggccac

SEQ ID NO: 1319687 - RNA, 23 nt, Mycobacterium tuberculosis H37Rv
ccgcauacgcggcuuugacgccc

SEQ ID NO: 1319688 - RNA, 23 nt, Mycobacterium tuberculosis H37Rv
ccgcauaaggcccaugccgucgg

SEQ ID NO: 1319689 - RNA, 22 nt, Mycobacterium tuberculosis H37Rv
ccgccaucgucgaagaccucaa

SEQ ID NO: 1319690 - RNA, 13 nt, Mycobacterium tuberculosis H37Rv
ccgccaucugccu

SEQ ID NO: 1319691 - RNA, 22 nt, Mycobacterium tuberculosis H37Rv
ccgccaugagguaggucgccgc

SEQ ID NO: 1319692 - RNA, 14 nt, Mycobacterium tuberculosis H37Rv
ccgccauggccgcc

SEQ ID NO: 1319693 - RNA, 21 nt, Mycobacterium tuberculosis H37Rv
ccgccauuccagccggugccg

SEQ ID NO: 1319694 - RNA, 19 nt, Mycobacterium tuberculosis H37Rv
ccgccauugccgccggcgc

SEQ ID NO: 1319695 - RNA, 20 nt, Mycobacterium tuberculosis H37Rv
ccgccauguacaggccccac

SEQ ID NO: 1319696 - RNA, 18 nt, Mycobacterium tuberculosis H37Rv
ccgcccaugccuccagaa

SEQ ID NO: 1319697 - RNA, 22 nt, Mycobacterium tuberculosis H37Rv
ccgcccauucccagaggcccgc

SEQ ID NO: 1319698 - RNA, 23 nt, Mycobacterium tuberculosis H37Rv
ccgcccccgccggccgcgccggc

SEQ ID NO: 1319699 - RNA, 21 nt, Mycobacterium tuberculosis H37Rv
ccgccccacaacaugcuggag

SEQ ID NO: 1319700 - RNA, 14 nt, Mycobacterium tuberculosis H37Rv
ccgcccccagcggu

SEQ ID NO: 1319701 - RNA, 22 nt, Mycobacterium tuberculosis H37Rv
ccgcccccguuuacggcccggc

SEQ ID NO: 1319702 - RNA, 15 nt, Mycobacterium tuberculosis H37Rv
ccgcgcaccaacacc

SEQ ID NO: 1319703 - RNA, 15 nt, Mycobacterium tuberculosis H37Rv
ccgcgcaccgaccgc

SEQ ID NO: 1319704 - RNA, 22 nt, Mycobacterium tuberculosis H37Rv
ccgcgcacgacaacuucgccgg

SEQ ID NO: 1319705 - RNA, 16 nt, Mycobacterium tuberculosis H37Rv
ccgcgcagccggcccg

SEQ ID NO: 1319706 - RNA, 17 nt, Mycobacterium tuberculosis H37Rv
ccgcgccccagacgcgc

SEQ ID NO: 1319707 - RNA, 13 nt, Mycobacterium tuberculosis H37Rv
ccgcgcccgccgc

SEQ ID NO: 1319708 - RNA, 17 nt, Mycobacterium tuberculosis H37Rv
ccgcgcccaccccggcc

SEQ ID NO: 1319709 - RNA, 19 nt, Mycobacterium tuberculosis H37Rv
ccgcgcagcgguccgccgc

SEQ ID NO: 1319710 - RNA, 13 nt, Mycobacterium tuberculosis H37Rv
ccgcgcagcggug

SEQ ID NO: 1319711 - RNA, 21 nt, Mycobacterium tuberculosis H37Rv
ccgcgccauagcagagccggg

SEQ ID NO: 1319712 - RNA, 17 nt, Mycobacterium tuberculosis H37Rv
ccgcgccgaucaccacc

SEQ ID NO: 1319713 - RNA, 21 nt, Mycobacterium tuberculosis H37Rv
ccgcgccgaucaccaccggca

SEQ ID NO: 1319714 - RNA, 19 nt, Mycobacterium tuberculosis H37Rv
ccgcgccgauuccaccgcc

SEQ ID NO: 1319715 - RNA, 16 nt, Mycobacterium tuberculosis H37Rv
ccgcgccgccagcgcc

SEQ ID NO: 1319716 - RNA, 19 nt, Mycobacterium tuberculosis H37Rv
ccgcgccgccgccaccacc

SEQ ID NO: 1319717 - RNA, 20 nt, Mycobacterium tuberculosis H37Rv
ccgcgccgccucgggcaccu

SEQ ID NO: 1319718 - RNA, 14 nt, Mycobacterium tuberculosis H37Rv
ccgcgcccuggccu

SEQ ID NO: 1319719 - RNA, 18 nt, Mycobacterium tuberculosis H37Rv
ccgcgccgaaucgcgggc

SEQ ID NO: 1319720 - RNA, 23 nt, Mycobacterium tuberculosis H37Rv
ccgcgcccgcgggcaguggcagc

SEQ ID NO: 1319721 - RNA, 19 nt, Mycobacterium tuberculosis H37Rv
ccgcgcccgccgcggcagc

SEQ ID NO: 1319722 - RNA, 13 nt, Mycobacterium tuberculosis H37Rv
ccgcgacggccuu

SEQ ID NO: 1319723 - RNA, 17 nt, Mycobacterium tuberculosis H37Rv
ccgcgacggcacgauca

SEQ ID NO: 1319724 - RNA, 22 nt, Mycobacterium tuberculosis H37Rv
ccgcgacgacugucccagcucc

SEQ ID NO: 1319725 - RNA, 12 nt, Mycobacterium tuberculosis H37Rv
ccgcgagcagca

SEQ ID NO: 1319726 - RNA, 13 nt, Mycobacterium tuberculosis H37Rv
ccgcgagcagcac

SEQ ID NO: 1319727 - RNA, 13 nt, Mycobacterium tuberculosis H37Rv
ccgcgacugacga

SEQ ID NO: 1319728 - RNA, 19 nt, Mycobacterium tuberculosis H37Rv
ccgcgagguacccaucguc

SEQ ID NO: 1319729 - RNA, 15 nt, Mycobacterium tuberculosis H37Rv
ccgcgagcccggccu

SEQ ID NO: 1319730 - RNA, 20 nt, Mycobacterium tuberculosis H37Rv
ccgcgagacgcaugucgggc

SEQ ID NO: 1319731 - RNA, 14 nt, Mycobacterium tuberculosis H37Rv
ccgcgagcccggcc

SEQ ID NO: 1319732 - RNA, 14 nt, Mycobacterium tuberculosis H37Rv
ccgccuucuccggc

SEQ ID NO: 1319733 - RNA, 16 nt, Mycobacterium tuberculosis H37Rv
ccgccuuacgcaccga

SEQ ID NO: 1319734 - RNA, 14 nt, Mycobacterium tuberculosis H37Rv
ccgccugccgacgg

SEQ ID NO: 1319735 - RNA, 16 nt, Mycobacterium tuberculosis H37Rv
ccgccugcccggcccg

SEQ ID NO: 1319736 - RNA, 17 nt, Mycobacterium tuberculosis H37Rv
ccgccugcccggcccgc

SEQ ID NO: 1319737 - RNA, 14 nt, Mycobacterium tuberculosis H37Rv
ccgccuugaggccc

SEQ ID NO: 1319738 - RNA, 15 nt, Mycobacterium tuberculosis H37Rv
ccgccuucuccggcg

SEQ ID NO: 1319739 - RNA, 22 nt, Mycobacterium tuberculosis H37Rv
ccgccuuggucaccuucuuggc

SEQ ID NO: 1319740 - RNA, 23 nt, Mycobacterium tuberculosis H37Rv
ccgccuuggucaccuucuuggcg

SEQ ID NO: 1319741 - RNA, 22 nt, Mycobacterium tuberculosis H37Rv
ccgccucgcggaugagcucggc

SEQ ID NO: 1319742 - RNA, 18 nt, Mycobacterium tuberculosis H37Rv
ccgccucgggcaccuggu

SEQ ID NO: 1319743 - RNA, 15 nt, Mycobacterium tuberculosis H37Rv
ccgccucgggccggc

SEQ ID NO: 1319744 - RNA, 12 nt, Mycobacterium tuberculosis H37Rv
ccgccugcaccg

SEQ ID NO: 1319745 - RNA, 17 nt, Mycobacterium tuberculosis H37Rv
ccgccugcaccgccgcc

SEQ ID NO: 1319746 - RNA, 15 nt, Mycobacterium tuberculosis H37Rv
ccgccugaccgccac

SEQ ID NO: 1319747 - RNA, 14 nt, Mycobacterium tuberculosis H37Rv
ccgccuccgccugc

SEQ ID NO: 1319748 - RNA, 16 nt, Mycobacterium tuberculosis H37Rv
ccgccuccgccugccc

SEQ ID NO: 1319749 - RNA, 15 nt, Mycobacterium tuberculosis H37Rv
ccgccucgaccgcca

SEQ ID NO: 1319750 - RNA, 17 nt, Mycobacterium tuberculosis H37Rv
ccgccucgaccgccagc

SEQ ID NO: 1319751 - RNA, 14 nt, Mycobacterium tuberculosis H37Rv
ccgccucgccguag

SEQ ID NO: 1319752 - RNA, 16 nt, Mycobacterium tuberculosis H37Rv
ccgccguugggccgcg

SEQ ID NO: 1319753 - RNA, 20 nt, Mycobacterium tuberculosis H37Rv
ccgccuaggugaguaagccc

SEQ ID NO: 1319754 - RNA, 18 nt, Mycobacterium tuberculosis H37Rv
ccgccuacccguucuucg

SEQ ID NO: 1319755 - RNA, 23 nt, Mycobacterium tuberculosis H37Rv
ccgccuaagcauucagcgcgccg

SEQ ID NO: 1319756 - RNA, 16 nt, Mycobacterium tuberculosis H37Rv
ccgccguuuccgccgc

SEQ ID NO: 1319757 - RNA, 16 nt, Mycobacterium tuberculosis H37Rv
ccgccguuaccgccgu

SEQ ID NO: 1319758 - RNA, 21 nt, Mycobacterium tuberculosis H37Rv
ccgccguuaccgagcccgaag

SEQ ID NO: 1319759 - RNA, 20 nt, Mycobacterium tuberculosis H37Rv
ccgccguucccgccggcccc

SEQ ID NO: 1319760 - RNA, 22 nt, Mycobacterium tuberculosis H37Rv
ccgccguugaacggcaccagcg

SEQ ID NO: 1319761 - RNA, 16 nt, Mycobacterium tuberculosis H37Rv
ccgccguugccguugg

SEQ ID NO: 1319762 - RNA, 19 nt, Mycobacterium tuberculosis H37Rv
ccgccguugccgucgucgc

SEQ ID NO: 1319763 - RNA, 21 nt, Mycobacterium tuberculosis H37Rv
ccgccguugccgaucaguccg

SEQ ID NO: 1319764 - RNA, 15 nt, Mycobacterium tuberculosis H37Rv
ccgccguugccgucg

SEQ ID NO: 1319765 - RNA, 16 nt, Mycobacterium tuberculosis H37Rv
ccgccguugccgccgc

SEQ ID NO: 1319766 - RNA, 21 nt, Mycobacterium tuberculosis H37Rv
ccgccguugccgccgccuccg

SEQ ID NO: 1319767 - RNA, 20 nt, Mycobacterium tuberculosis H37Rv
ccgccgguggcgccggggcc

SEQ ID NO: 1319768 - RNA, 15 nt, Mycobacterium tuberculosis H37Rv
ccgccgguggcgccg

SEQ ID NO: 1319769 - RNA, 18 nt, Mycobacterium tuberculosis H37Rv
ccgccggugccaccggcu

SEQ ID NO: 1319770 - RNA, 17 nt, Mycobacterium tuberculosis H37Rv
ccgccggugccaccggc

SEQ ID NO: 1319771 - RNA, 16 nt, Mycobacterium tuberculosis H37Rv
ccgccggugccgccgc

SEQ ID NO: 1319772 - RNA, 21 nt, Mycobacterium tuberculosis H37Rv
ccgccggugccgccggugccg

SEQ ID NO: 1319773 - RNA, 16 nt, Mycobacterium tuberculosis H37Rv
ccgccggugccgcccg

SEQ ID NO: 1319774 - RNA, 19 nt, Mycobacterium tuberculosis H37Rv
ccgccggugccaccgacgc

SEQ ID NO: 1319775 - RNA, 19 nt, Mycobacterium tuberculosis H37Rv
ccgccggguccgccgggcc

SEQ ID NO: 1319776 - RNA, 20 nt, Mycobacterium tuberculosis H37Rv
ccgccggguccgccgggccc

SEQ ID NO: 1319777 - RNA, 15 nt, Mycobacterium tuberculosis H37Rv
ccgccggguuggcgc

SEQ ID NO: 1319778 - RNA, 13 nt, Mycobacterium tuberculosis H37Rv
ccgccgggcucca

SEQ ID NO: 1319779 - RNA, 15 nt, Mycobacterium tuberculosis H37Rv
ccgccgggggcaccg

SEQ ID NO: 1319780 - RNA, 21 nt, Mycobacterium tuberculosis H37Rv
ccgccgggaugccggccccca

SEQ ID NO: 1319781 - RNA, 20 nt, Mycobacterium tuberculosis H37Rv
ccgccguagaccagccgucg

SEQ ID NO: 1319782 - RNA, 17 nt, Mycobacterium tuberculosis H37Rv
ccgccgucgccacgccc

SEQ ID NO: 1319783 - RNA, 15 nt, Mycobacterium tuberculosis H37Rv
ccgccgucgccgaac

SEQ ID NO: 1319784 - RNA, 14 nt, Mycobacterium tuberculosis H37Rv
ccgccgucgccucc

SEQ ID NO: 1319785 - RNA, 15 nt, Mycobacterium tuberculosis H37Rv
ccgccgucgccuccg

SEQ ID NO: 1319786 - RNA, 16 nt, Mycobacterium tuberculosis H37Rv
ccgccguccagcgccg

SEQ ID NO: 1319787 - RNA, 19 nt, Mycobacterium tuberculosis H37Rv
ccgccguccccaccgacgc

SEQ ID NO: 1319788 - RNA, 13 nt, Mycobacterium tuberculosis H37Rv
ccgccguccccgc

SEQ ID NO: 1319789 - RNA, 15 nt, Mycobacterium tuberculosis H37Rv
ccgccguccagcgcc

SEQ ID NO: 1319790 - RNA, 16 nt, Mycobacterium tuberculosis H37Rv
ccgccgucaccgccga

SEQ ID NO: 1319791 - RNA, 18 nt, Mycobacterium tuberculosis H37Rv
ccgccgucaccgccgacc

SEQ ID NO: 1319792 - RNA, 16 nt, Mycobacterium tuberculosis H37Rv
ccgccgucaccgccgu

SEQ ID NO: 1319793 - RNA, 21 nt, Mycobacterium tuberculosis H37Rv
ccgccguaugccgccaaccgc

SEQ ID NO: 1319794 - RNA, 21 nt, Mycobacterium tuberculosis H37Rv
ccgccgguguuagccccgaag

SEQ ID NO: 1319795 - RNA, 21 nt, Mycobacterium tuberculosis H37Rv
ccgccgguggugccggcgccg

SEQ ID NO: 1319796 - RNA, 17 nt, Mycobacterium tuberculosis H37Rv
ccgccgguuccgccggc

SEQ ID NO: 1319797 - RNA, 20 nt, Mycobacterium tuberculosis H37Rv
ccgccgguuccgccggcccc

SEQ ID NO: 1319798 - RNA, 20 nt, Mycobacterium tuberculosis H37Rv
ccgcuauggcccgggccgaa

SEQ ID NO: 1319799 - RNA, 15 nt, Mycobacterium tuberculosis H37Rv
ccgcuaugaggcagu

SEQ ID NO: 1319800 - RNA, 23 nt, Mycobacterium tuberculosis H37Rv
ccgcuaugaugccgccggugccg

SEQ ID NO: 1319801 - RNA, 16 nt, Mycobacterium tuberculosis H37Rv
ccgcuauggcccgggc

SEQ ID NO: 1319802 - RNA, 16 nt, Mycobacterium tuberculosis H37Rv
ccgcucacccgcccgg

SEQ ID NO: 1319803 - RNA, 15 nt, Mycobacterium tuberculosis H37Rv
ccgcucaccccgcgc

SEQ ID NO: 1319804 - RNA, 15 nt, Mycobacterium tuberculosis H37Rv
ccgcucagccguccg

SEQ ID NO: 1319805 - RNA, 18 nt, Mycobacterium tuberculosis H37Rv
ccgcucgguccagccggu

SEQ ID NO: 1319806 - RNA, 15 nt, Mycobacterium tuberculosis H37Rv
ccgcucgguccagcc

SEQ ID NO: 1319807 - RNA, 20 nt, Mycobacterium tuberculosis H37Rv
ccgcugccgaagcggccacc

SEQ ID NO: 1319808 - RNA, 12 nt, Mycobacterium tuberculosis H37Rv
ccgcucugcggc

SEQ ID NO: 1319809 - RNA, 16 nt, Mycobacterium tuberculosis H37Rv
ccgcuggacggaucug

SEQ ID NO: 1319810 - RNA, 12 nt, Mycobacterium tuberculosis H37Rv
ccgcuggccagc

SEQ ID NO: 1319811 - RNA, 20 nt, Mycobacterium tuberculosis H37Rv
ccgcuggccaugcggaaagc

SEQ ID NO: 1319812 - RNA, 23 nt, Mycobacterium tuberculosis H37Rv
ccgcugccgccgagcuggcgcgc

SEQ ID NO: 1319813 - RNA, 13 nt, Mycobacterium tuberculosis H37Rv
ccgcugccggcac

SEQ ID NO: 1319814 - RNA, 12 nt, Mycobacterium tuberculosis H37Rv
ccgcugccgccc

SEQ ID NO: 1319815 - RNA, 16 nt, Mycobacterium tuberculosis H37Rv
ccgcugccggcacgca

SEQ ID NO: 1319816 - RNA, 14 nt, Mycobacterium tuberculosis H37Rv
ccgcugccggcagc

SEQ ID NO: 1319817 - RNA, 14 nt, Mycobacterium tuberculosis H37Rv
ccgcugccggcacg

SEQ ID NO: 1319818 - RNA, 20 nt, Mycobacterium tuberculosis H37Rv
ccgcugccgguagcacagca

SEQ ID NO: 1319819 - RNA, 14 nt, Mycobacterium tuberculosis H37Rv
ccgcuggccuccug

SEQ ID NO: 1319820 - RNA, 15 nt, Mycobacterium tuberculosis H37Rv
ccgcuggcccgccag

SEQ ID NO: 1319821 - RNA, 19 nt, Mycobacterium tuberculosis H37Rv
ccgcuguucuuggugacca

SEQ ID NO: 1319822 - RNA, 13 nt, Mycobacterium tuberculosis H37Rv
ccgcuugguguga

SEQ ID NO: 1319823 - RNA, 13 nt, Mycobacterium tuberculosis H37Rv
ccgcuugggccug

SEQ ID NO: 1319824 - RNA, 17 nt, Mycobacterium tuberculosis H37Rv
ccgcgucacggaccugg

SEQ ID NO: 1319825 - RNA, 15 nt, Mycobacterium tuberculosis H37Rv
ccgcgucaccggagg

SEQ ID NO: 1319826 - RNA, 17 nt, Mycobacterium tuberculosis H37Rv
ccgcguagguggccagc

SEQ ID NO: 1319827 - RNA, 17 nt, Mycobacterium tuberculosis H37Rv
ccgcguaguccaggccg

SEQ ID NO: 1319828 - RNA, 17 nt, Mycobacterium tuberculosis H37Rv
ccgcguagagcagcagc

SEQ ID NO: 1319829 - RNA, 17 nt, Mycobacterium tuberculosis H37Rv
ccgcguacaggccggcc

SEQ ID NO: 1319830 - RNA, 21 nt, Mycobacterium tuberculosis H37Rv
ccgcggguuugaucuccaccu

SEQ ID NO: 1319831 - RNA, 17 nt, Mycobacterium tuberculosis H37Rv
ccgcgggguaguucguu

SEQ ID NO: 1319832 - RNA, 22 nt, Mycobacterium tuberculosis H37Rv
ccgcgggucguccggcggcagg

SEQ ID NO: 1319833 - RNA, 20 nt, Mycobacterium tuberculosis H37Rv
ccgcguucgagagccccgac

SEQ ID NO: 1319834 - RNA, 16 nt, Mycobacterium tuberculosis H37Rv
ccgcgucgaacugggc

SEQ ID NO: 1319835 - RNA, 19 nt, Mycobacterium tuberculosis H37Rv
ccgcguugaugaccgccgc

SEQ ID NO: 1319836 - RNA, 23 nt, Mycobacterium tuberculosis H37Rv
ccgcguuuauaccucgccgcccu

SEQ ID NO: 1319837 - RNA, 23 nt, Mycobacterium tuberculosis H37Rv
ccgcguuucgcgacgucugccag

SEQ ID NO: 1319838 - RNA, 23 nt, Mycobacterium tuberculosis H37Rv
ccgcuaacgcaccugcgcgcggc

SEQ ID NO: 1319839 - RNA, 22 nt, Mycobacterium tuberculosis H37Rv
ccgcguuuauaccucgccgccc

SEQ ID NO: 1319840 - RNA, 14 nt, Mycobacterium tuberculosis H37Rv
ccgcuaauggaucc

SEQ ID NO: 1319841 - RNA, 16 nt, Mycobacterium tuberculosis H37Rv
ccgcgccggcggaagc

SEQ ID NO: 1319842 - RNA, 24 nt, Mycobacterium tuberculosis H37Rv
ccgcgccggccgcacgccggccag

SEQ ID NO: 1319843 - RNA, 12 nt, Mycobacterium tuberculosis H37Rv
ccgcgccgucgu

SEQ ID NO: 1319844 - RNA, 23 nt, Mycobacterium tuberculosis H37Rv
ccgcgccgucgucgagcaccacc

SEQ ID NO: 1319845 - RNA, 15 nt, Mycobacterium tuberculosis H37Rv
ccgcggcgccgccac

SEQ ID NO: 1319846 - RNA, 17 nt, Mycobacterium tuberculosis H37Rv
ccgcggcggcagcggcg

SEQ ID NO: 1319847 - RNA, 15 nt, Mycobacterium tuberculosis H37Rv
ccgcggcggccagcg

SEQ ID NO: 1319848 - RNA, 17 nt, Mycobacterium tuberculosis H37Rv
ccgcggcggccccgcgc

SEQ ID NO: 1319849 - RNA, 20 nt, Mycobacterium tuberculosis H37Rv
ccgcggcgcggcgggcagcg

SEQ ID NO: 1319850 - RNA, 13 nt, Mycobacterium tuberculosis H37Rv
ccgcgccuccguu

SEQ ID NO: 1319851 - RNA, 17 nt, Mycobacterium tuberculosis H37Rv
ccgcgccuuggcacccu

SEQ ID NO: 1319852 - RNA, 11 nt, Mycobacterium tuberculosis H37Rv
ccgcggcggcg

SEQ ID NO: 1319853 - RNA, 19 nt, Mycobacterium tuberculosis H37Rv
ccgcgggaucgguggcggc

SEQ ID NO: 1319854 - RNA, 19 nt, Mycobacterium tuberculosis H37Rv
ccgcgggacagauggcggc

SEQ ID NO: 1319855 - RNA, 21 nt, Mycobacterium tuberculosis H37Rv
ccgcgggaccuucgagccgca

SEQ ID NO: 1319856 - RNA, 23 nt, Mycobacterium tuberculosis H37Rv
ccgcggcguuaagguacccgguc

SEQ ID NO: 1319857 - RNA, 16 nt, Mycobacterium tuberculosis H37Rv
ccgcgggggaccgccc

SEQ ID NO: 1319858 - RNA, 18 nt, Mycobacterium tuberculosis H37Rv
ccgcgggggaccgcccga

SEQ ID NO: 1319859 - RNA, 21 nt, Mycobacterium tuberculosis H37Rv
ccgcgggcgccuuccaggcgg

SEQ ID NO: 1319860 - RNA, 17 nt, Mycobacterium tuberculosis H37Rv
ccgcgggcggcaucgcc

SEQ ID NO: 1319861 - RNA, 18 nt, Mycobacterium tuberculosis H37Rv
ccgcgggcaguggcagcc

SEQ ID NO: 1319862 - RNA, 20 nt, Mycobacterium tuberculosis H37Rv
ccgcgggcagcguguaaccg

SEQ ID NO: 1319863 - RNA, 19 nt, Mycobacterium tuberculosis H37Rv
ccggcagcaucggcacccc

SEQ ID NO: 1319864 - RNA, 13 nt, Mycobacterium tuberculosis H37Rv
ccggcagcccggc

SEQ ID NO: 1319865 - RNA, 17 nt, Mycobacterium tuberculosis H37Rv
ccggcacugcccagcag

SEQ ID NO: 1319866 - RNA, 18 nt, Mycobacterium tuberculosis H37Rv
ccggcacugcggccaguc

SEQ ID NO: 1319867 - RNA, 14 nt, Mycobacterium tuberculosis H37Rv
ccggcacugcccag

SEQ ID NO: 1319868 - RNA, 15 nt, Mycobacterium tuberculosis H37Rv
ccggcacgccggcgg

SEQ ID NO: 1319869 - RNA, 12 nt, Mycobacterium tuberculosis H37Rv
ccggcaccggcc

SEQ ID NO: 1319870 - RNA, 20 nt, Mycobacterium tuberculosis H37Rv
ccggcaugcgugccggcagc

SEQ ID NO: 1319871 - RNA, 23 nt, Mycobacterium tuberculosis H37Rv
ccggcaugccgccaugcgcacca

SEQ ID NO: 1319872 - RNA, 22 nt, Mycobacterium tuberculosis H37Rv
ccggcauuccguaggccacagc

SEQ ID NO: 1319873 - RNA, 23 nt, Mycobacterium tuberculosis H37Rv
ccggccaaaacauaucggugccg

SEQ ID NO: 1319874 - RNA, 13 nt, Mycobacterium tuberculosis H37Rv
ccggccaaccacc

SEQ ID NO: 1319875 - RNA, 18 nt, Mycobacterium tuberculosis H37Rv
ccggccaagaccgcggcc

SEQ ID NO: 1319876 - RNA, 13 nt, Mycobacterium tuberculosis H37Rv
ccggccaagccgg

SEQ ID NO: 1319877 - RNA, 22 nt, Mycobacterium tuberculosis H37Rv
ccggcaggcccgacggcgccca

SEQ ID NO: 1319878 - RNA, 13 nt, Mycobacterium tuberculosis H37Rv
ccggcagcggcgc

SEQ ID NO: 1319879 - RNA, 22 nt, Mycobacterium tuberculosis H37Rv
ccggcagcguccgaaccaccug

SEQ ID NO: 1319880 - RNA, 15 nt, Mycobacterium tuberculosis H37Rv
ccggauacagccacg

SEQ ID NO: 1319881 - RNA, 15 nt, Mycobacterium tuberculosis H37Rv
ccggcaaccuggacu

SEQ ID NO: 1319882 - RNA, 14 nt, Mycobacterium tuberculosis H37Rv
ccggauacaccggc

SEQ ID NO: 1319883 - RNA, 15 nt, Mycobacterium tuberculosis H37Rv
ccggcaagcgcagac

SEQ ID NO: 1319884 - RNA, 14 nt, Mycobacterium tuberculosis H37Rv
ccggcaagcgcaga

SEQ ID NO: 1319885 - RNA, 22 nt, Mycobacterium tuberculosis H37Rv
ccggcaccgccugcgccgcccg

SEQ ID NO: 1319886 - RNA, 21 nt, Mycobacterium tuberculosis H37Rv
ccggcaccgccugcgccgccc

SEQ ID NO: 1319887 - RNA, 16 nt, Mycobacterium tuberculosis H37Rv
ccggcaccgccggcgc

SEQ ID NO: 1319888 - RNA, 21 nt, Mycobacterium tuberculosis H37Rv
ccggcaccgccggcgcccagg

SEQ ID NO: 1319889 - RNA, 21 nt, Mycobacterium tuberculosis H37Rv
ccggcaccucccuggcccccg

SEQ ID NO: 1319890 - RNA, 17 nt, Mycobacterium tuberculosis H37Rv
ccggcaccuccgccggc

SEQ ID NO: 1319891 - RNA, 23 nt, Mycobacterium tuberculosis H37Rv
ccggcaccuccgccggcaccucc

SEQ ID NO: 1319892 - RNA, 15 nt, Mycobacterium tuberculosis H37Rv
ccggcacgcaugccg

SEQ ID NO: 1319893 - RNA, 21 nt, Mycobacterium tuberculosis H37Rv
ccggcaccguagagcaugccg

SEQ ID NO: 1319894 - RNA, 17 nt, Mycobacterium tuberculosis H37Rv
ccggcacgaccgcuccc

SEQ ID NO: 1319895 - RNA, 20 nt, Mycobacterium tuberculosis H37Rv
ccggcacgaccgcucccggu

SEQ ID NO: 1319896 - RNA, 17 nt, Mycobacterium tuberculosis H37Rv
ccggcaaucggcggcac

SEQ ID NO: 1319897 - RNA, 21 nt, Mycobacterium tuberculosis H37Rv
ccggcaaucggcggcacccgg

SEQ ID NO: 1319898 - RNA, 14 nt, Mycobacterium tuberculosis H37Rv
ccggcacccgucgg

SEQ ID NO: 1319899 - RNA, 18 nt, Mycobacterium tuberculosis H37Rv
ccggcaccgccagugccc

SEQ ID NO: 1319900 - RNA, 17 nt, Mycobacterium tuberculosis H37Rv
ccggcaccgccgccccc

SEQ ID NO: 1319901 - RNA, 15 nt, Mycobacterium tuberculosis H37Rv
ccggcaccgccgccc

SEQ ID NO: 1319902 - RNA, 23 nt, Mycobacterium tuberculosis H37Rv
ccggcacccgcggcgaaccgucu

SEQ ID NO: 1319903 - RNA, 13 nt, Mycobacterium tuberculosis H37Rv
ccggcaccgcccu

SEQ ID NO: 1319904 - RNA, 17 nt, Mycobacterium tuberculosis H37Rv
ccggcaccgcccuugcc

SEQ ID NO: 1319905 - RNA, 15 nt, Mycobacterium tuberculosis H37Rv
ccggaaacgccaggg

SEQ ID NO: 1319906 - RNA, 14 nt, Mycobacterium tuberculosis H37Rv
ccggaaaccacagc

SEQ ID NO: 1319907 - RNA, 16 nt, Mycobacterium tuberculosis H37Rv
ccggaaccagccgcgg

SEQ ID NO: 1319908 - RNA, 14 nt, Mycobacterium tuberculosis H37Rv
ccggaaccaccagu

SEQ ID NO: 1319909 - RNA, 17 nt, Mycobacterium tuberculosis H37Rv
ccggaacccccagcugc

SEQ ID NO: 1319910 - RNA, 12 nt, Mycobacterium tuberculosis H37Rv
ccggaauacacc

SEQ ID NO: 1319911 - RNA, 21 nt, Mycobacterium tuberculosis H37Rv
ccggaagcggcguucgaugcc

SEQ ID NO: 1319912 - RNA, 17 nt, Mycobacterium tuberculosis H37Rv
ccggaagauccgggccu

SEQ ID NO: 1319913 - RNA, 17 nt, Mycobacterium tuberculosis H37Rv
ccggacaugcgggcagc

SEQ ID NO: 1319914 - RNA, 18 nt, Mycobacterium tuberculosis H37Rv
ccggacagggugggggca

SEQ ID NO: 1319915 - RNA, 16 nt, Mycobacterium tuberculosis H37Rv
ccggaauccgggccgc

SEQ ID NO: 1319916 - RNA, 21 nt, Mycobacterium tuberculosis H37Rv
ccggaaucgucgcggccgucg

SEQ ID NO: 1319917 - RNA, 20 nt, Mycobacterium tuberculosis H37Rv
ccggacaaccuggggccacc

SEQ ID NO: 1319918 - RNA, 21 nt, Mycobacterium tuberculosis H37Rv
ccggacugcggcccgacccgg

SEQ ID NO: 1319919 - RNA, 20 nt, Mycobacterium tuberculosis H37Rv
ccggacuaccgccggcggcg

SEQ ID NO: 1319920 - RNA, 18 nt, Mycobacterium tuberculosis H37Rv
ccggacuaccgccggcgg

SEQ ID NO: 1319921 - RNA, 18 nt, Mycobacterium tuberculosis H37Rv
ccggacucuccccuggcc

SEQ ID NO: 1319922 - RNA, 19 nt, Mycobacterium tuberculosis H37Rv
ccggacucuccccuggccc

SEQ ID NO: 1319923 - RNA, 19 nt, Mycobacterium tuberculosis H37Rv
ccggauaacccagcggcgc

SEQ ID NO: 1319924 - RNA, 18 nt, Mycobacterium tuberculosis H37Rv
ccggagaucccgguccca

SEQ ID NO: 1319925 - RNA, 14 nt, Mycobacterium tuberculosis H37Rv
ccggagacacccgc

SEQ ID NO: 1319926 - RNA, 16 nt, Mycobacterium tuberculosis H37Rv
ccggagacgucgccgc

SEQ ID NO: 1319927 - RNA, 19 nt, Mycobacterium tuberculosis H37Rv
ccggagaucccggucccaa

SEQ ID NO: 1319928 - RNA, 13 nt, Mycobacterium tuberculosis H37Rv
ccggcgucggcgc

SEQ ID NO: 1319929 - RNA, 22 nt, Mycobacterium tuberculosis H37Rv
ccggcgucgaaggugaccaggc

SEQ ID NO: 1319930 - RNA, 16 nt, Mycobacterium tuberculosis H37Rv
ccggcgucggcgccca

SEQ ID NO: 1319931 - RNA, 18 nt, Mycobacterium tuberculosis H37Rv
ccggcgucggcgcggccg

SEQ ID NO: 1319932 - RNA, 19 nt, Mycobacterium tuberculosis H37Rv
ccggcgucggcgcccagcu

SEQ ID NO: 1319933 - RNA, 23 nt, Mycobacterium tuberculosis H37Rv
ccggcgucggcgcccagcucgau

SEQ ID NO: 1319934 - RNA, 22 nt, Mycobacterium tuberculosis H37Rv
ccggcgucggucgucggguagg

SEQ ID NO: 1319935 - RNA, 17 nt, Mycobacterium tuberculosis H37Rv
ccggcgucggucgucgg

SEQ ID NO: 1319936 - RNA, 15 nt, Mycobacterium tuberculosis H37Rv
ccggcgugucgccgc

SEQ ID NO: 1319937 - RNA, 18 nt, Mycobacterium tuberculosis H37Rv
ccggcguucccacuggag

SEQ ID NO: 1319938 - RNA, 17 nt, Mycobacterium tuberculosis H37Rv
ccggcguucccccacuc

SEQ ID NO: 1319939 - RNA, 16 nt, Mycobacterium tuberculosis H37Rv
ccggcguggccccacc

SEQ ID NO: 1319940 - RNA, 13 nt, Mycobacterium tuberculosis H37Rv
ccggcgugcauga

SEQ ID NO: 1319941 - RNA, 22 nt, Mycobacterium tuberculosis H37Rv
ccggcuaccgccuugucggcga

SEQ ID NO: 1319942 - RNA, 14 nt, Mycobacterium tuberculosis H37Rv
ccggcuaccgcgcu

SEQ ID NO: 1319943 - RNA, 23 nt, Mycobacterium tuberculosis H37Rv
ccggcucaaggacgcaccgccag

SEQ ID NO: 1319944 - RNA, 17 nt, Mycobacterium tuberculosis H37Rv
ccggcuauaucccgccc

SEQ ID NO: 1319945 - RNA, 18 nt, Mycobacterium tuberculosis H37Rv
ccggcuauaucccgcccc

SEQ ID NO: 1319946 - RNA, 23 nt, Mycobacterium tuberculosis H37Rv
ccggcuucggcgaacccuccgca

SEQ ID NO: 1319947 - RNA, 15 nt, Mycobacterium tuberculosis H37Rv
ccggcuucgucggcc

SEQ ID NO: 1319948 - RNA, 18 nt, Mycobacterium tuberculosis H37Rv
ccggcuucgucggccagc

SEQ ID NO: 1319949 - RNA, 16 nt, Mycobacterium tuberculosis H37Rv
ccggcuugggccaggc

SEQ ID NO: 1319950 - RNA, 13 nt, Mycobacterium tuberculosis H37Rv
ccggcuugggcca

SEQ ID NO: 1319951 - RNA, 21 nt, Mycobacterium tuberculosis H37Rv
ccggcuuggccuuugccgucg

SEQ ID NO: 1319952 - RNA, 16 nt, Mycobacterium tuberculosis H37Rv
ccggcuuggcggcgau

SEQ ID NO: 1319953 - RNA, 13 nt, Mycobacterium tuberculosis H37Rv
ccggcuuggauac

SEQ ID NO: 1319954 - RNA, 16 nt, Mycobacterium tuberculosis H37Rv
ccggcuucgccgcgcu

SEQ ID NO: 1319955 - RNA, 23 nt, Mycobacterium tuberculosis H37Rv
ccggcuggugccuuaccaccguc

SEQ ID NO: 1319956 - RNA, 19 nt, Mycobacterium tuberculosis H37Rv
ccggcugccgucagcugac

SEQ ID NO: 1319957 - RNA, 17 nt, Mycobacterium tuberculosis H37Rv
ccggcugaccgacccgg

SEQ ID NO: 1319958 - RNA, 20 nt, Mycobacterium tuberculosis H37Rv
ccggcucggaaaccgccccg

SEQ ID NO: 1319959 - RNA, 14 nt, Mycobacterium tuberculosis H37Rv
ccggcucggccagc

SEQ ID NO: 1319960 - RNA, 12 nt, Mycobacterium tuberculosis H37Rv
ccggcucgccgg

SEQ ID NO: 1319961 - RNA, 21 nt, Mycobacterium tuberculosis H37Rv
ccggcucggccagccagcggg

SEQ ID NO: 1319962 - RNA, 16 nt, Mycobacterium tuberculosis H37Rv
ccggcucggugcgcca

SEQ ID NO: 1319963 - RNA, 16 nt, Mycobacterium tuberculosis H37Rv
ccggcugcgccgggcu

SEQ ID NO: 1319964 - RNA, 16 nt, Mycobacterium tuberculosis H37Rv
ccggcugcugaggaga

SEQ ID NO: 1319965 - RNA, 22 nt, Mycobacterium tuberculosis H37Rv
ccggcugcgguaaucgccaccg

SEQ ID NO: 1319966 - RNA, 19 nt, Mycobacterium tuberculosis H37Rv
ccggcugcauccuccucgu

SEQ ID NO: 1319967 - RNA, 15 nt, Mycobacterium tuberculosis H37Rv
ccggcugccacacag

SEQ ID NO: 1319968 - RNA, 16 nt, Mycobacterium tuberculosis H37Rv
ccggcgucgacgucgg

SEQ ID NO: 1319969 - RNA, 19 nt, Mycobacterium tuberculosis H37Rv
ccggcguccggagccccug

SEQ ID NO: 1319970 - RNA, 14 nt, Mycobacterium tuberculosis H37Rv
ccggcgucagcccc

SEQ ID NO: 1319971 - RNA, 12 nt, Mycobacterium tuberculosis H37Rv
ccggcgguggug

SEQ ID NO: 1319972 - RNA, 20 nt, Mycobacterium tuberculosis H37Rv
ccggcgguggggccggcguc

SEQ ID NO: 1319973 - RNA, 16 nt, Mycobacterium tuberculosis H37Rv
ccggcgguguuggcgc

SEQ ID NO: 1319974 - RNA, 23 nt, Mycobacterium tuberculosis H37Rv
ccggcgguguuggcgccagcccc

SEQ ID NO: 1319975 - RNA, 16 nt, Mycobacterium tuberculosis H37Rv
ccggcggugccgucag

SEQ ID NO: 1319976 - RNA, 20 nt, Mycobacterium tuberculosis H37Rv
ccggcgggaugcgcgcccga

SEQ ID NO: 1319977 - RNA, 19 nt, Mycobacterium tuberculosis H37Rv
ccggcgggcccgccggccc

SEQ ID NO: 1319978 - RNA, 18 nt, Mycobacterium tuberculosis H37Rv
ccggcggcuggucucugg

SEQ ID NO: 1319979 - RNA, 21 nt, Mycobacterium tuberculosis H37Rv
ccggcggcgcaucaccuccgc

SEQ ID NO: 1319980 - RNA, 15 nt, Mycobacterium tuberculosis H37Rv
ccggcggcggccgca

SEQ ID NO: 1319981 - RNA, 19 nt, Mycobacterium tuberculosis H37Rv
ccggcggcggugcgccccg

SEQ ID NO: 1319982 - RNA, 22 nt, Mycobacterium tuberculosis H37Rv
ccggcggcggugguaccggcgc

SEQ ID NO: 1319983 - RNA, 16 nt, Mycobacterium tuberculosis H37Rv
ccggcggcgcgcccgg

SEQ ID NO: 1319984 - RNA, 18 nt, Mycobacterium tuberculosis H37Rv
ccggcgguaccgccgcgg

SEQ ID NO: 1319985 - RNA, 17 nt, Mycobacterium tuberculosis H37Rv
ccggcgguagucggcca

SEQ ID NO: 1319986 - RNA, 23 nt, Mycobacterium tuberculosis H37Rv
ccggcggucagcagcgccgucag

SEQ ID NO: 1319987 - RNA, 21 nt, Mycobacterium tuberculosis H37Rv
ccggcgggugccgagcuggcg

SEQ ID NO: 1319988 - RNA, 15 nt, Mycobacterium tuberculosis H37Rv
ccggcgggccugccc

SEQ ID NO: 1319989 - RNA, 21 nt, Mycobacterium tuberculosis H37Rv
ccggcgggcucuacucgcggc

SEQ ID NO: 1319990 - RNA, 23 nt, Mycobacterium tuberculosis H37Rv
ccggcggggugcgcccaccgacc

SEQ ID NO: 1319991 - RNA, 20 nt, Mycobacterium tuberculosis H37Rv
ccggcgggugccgagcuggc

SEQ ID NO: 1319992 - RNA, 16 nt, Mycobacterium tuberculosis H37Rv
ccggcggauucggcgc

SEQ ID NO: 1319993 - RNA, 23 nt, Mycobacterium tuberculosis H37Rv
ccggcggcaaagagcagccggcc

SEQ ID NO: 1319994 - RNA, 14 nt, Mycobacterium tuberculosis H37Rv
ccggccaucuugag

SEQ ID NO: 1319995 - RNA, 14 nt, Mycobacterium tuberculosis H37Rv
ccggcggccacgcc

SEQ ID NO: 1319996 - RNA, 16 nt, Mycobacterium tuberculosis H37Rv
ccggcggcagcggcgc

SEQ ID NO: 1319997 - RNA, 21 nt, Mycobacterium tuberculosis H37Rv
ccggcggcgaccagcucagcu

SEQ ID NO: 1319998 - RNA, 23 nt, Mycobacterium tuberculosis H37Rv
ccggcggcgagcggccuccagca

SEQ ID NO: 1319999 - RNA, 18 nt, Mycobacterium tuberculosis H37Rv
ccggcggccgcggugccc

SEQ ID NO: 1320000 - RNA, 13 nt, Mycobacterium tuberculosis H37Rv
ccggcggccgccc

SEQ ID NO: 1320001 - RNA, 18 nt, Mycobacterium tuberculosis H37Rv
ccggcggccgccaucagc

SEQ ID NO: 1320002 - RNA, 23 nt, Mycobacterium tuberculosis H37Rv
ccggcggccgccaucagccgcug

SEQ ID NO: 1320003 - RNA, 14 nt, Mycobacterium tuberculosis H37Rv
ccggcggccgccau

SEQ ID NO: 1320004 - RNA, 13 nt, Mycobacterium tuberculosis H37Rv
ccggcggccagcu

SEQ ID NO: 1320005 - RNA, 12 nt, Mycobacterium tuberculosis H37Rv
ccggccaccagg

SEQ ID NO: 1320006 - RNA, 11 nt, Mycobacterium tuberculosis H37Rv
ccggccagcgg

SEQ ID NO: 1320007 - RNA, 12 nt, Mycobacterium tuberculosis H37Rv
ccggccagcggc

SEQ ID NO: 1320008 - RNA, 12 nt, Mycobacterium tuberculosis H37Rv
ccggccaggccg

SEQ ID NO: 1320009 - RNA, 19 nt, Mycobacterium tuberculosis H37Rv
ccggccaggggaucaccgg

SEQ ID NO: 1320010 - RNA, 17 nt, Mycobacterium tuberculosis H37Rv
ccggccaggggcgcagc

SEQ ID NO: 1320011 - RNA, 17 nt, Mycobacterium tuberculosis H37Rv
ccggccauaccgcucgc

SEQ ID NO: 1320012 - RNA, 16 nt, Mycobacterium tuberculosis H37Rv
ccgggcccgccguccc

SEQ ID NO: 1320013 - RNA, 20 nt, Mycobacterium tuberculosis H37Rv
ccgggcccgccguccccgcc

SEQ ID NO: 1320014 - RNA, 21 nt, Mycobacterium tuberculosis H37Rv
ccgggccccggggugcccccg

SEQ ID NO: 1320015 - RNA, 22 nt, Mycobacterium tuberculosis H37Rv
ccgggcggccucccgggccgcc

SEQ ID NO: 1320016 - RNA, 17 nt, Mycobacterium tuberculosis H37Rv
ccgggcggccucccggg

SEQ ID NO: 1320017 - RNA, 21 nt, Mycobacterium tuberculosis H37Rv
ccgggccgagugcccagcgau

SEQ ID NO: 1320018 - RNA, 13 nt, Mycobacterium tuberculosis H37Rv
ccgggcggccgcc

SEQ ID NO: 1320019 - RNA, 17 nt, Mycobacterium tuberculosis H37Rv
ccgggcucagcugggcc

SEQ ID NO: 1320020 - RNA, 14 nt, Mycobacterium tuberculosis H37Rv
ccgggcgugggugu

SEQ ID NO: 1320021 - RNA, 19 nt, Mycobacterium tuberculosis H37Rv
ccgggcgggauccacccag

SEQ ID NO: 1320022 - RNA, 14 nt, Mycobacterium tuberculosis H37Rv
ccgggcggugucug

SEQ ID NO: 1320023 - RNA, 13 nt, Mycobacterium tuberculosis H37Rv
ccgggcggcggcg

SEQ ID NO: 1320024 - RNA, 20 nt, Mycobacterium tuberculosis H37Rv
ccgggcggcgccggcgcaga

SEQ ID NO: 1320025 - RNA, 13 nt, Mycobacterium tuberculosis H37Rv
ccggggccacccg

SEQ ID NO: 1320026 - RNA, 18 nt, Mycobacterium tuberculosis H37Rv
ccggggacgccgcggcgc

SEQ ID NO: 1320027 - RNA, 15 nt, Mycobacterium tuberculosis H37Rv
ccgggcuggccagcg

SEQ ID NO: 1320028 - RNA, 16 nt, Mycobacterium tuberculosis H37Rv
ccgggcuggccagcgc

SEQ ID NO: 1320029 - RNA, 19 nt, Mycobacterium tuberculosis H37Rv
ccgggcuggccagcgcgcu

SEQ ID NO: 1320030 - RNA, 17 nt, Mycobacterium tuberculosis H37Rv
ccgggcuguuggccacc

SEQ ID NO: 1320031 - RNA, 22 nt, Mycobacterium tuberculosis H37Rv
ccgggcucggcgaaggccgcgc

SEQ ID NO: 1320032 - RNA, 20 nt, Mycobacterium tuberculosis H37Rv
ccgggcucggcgucgccgcc

SEQ ID NO: 1320033 - RNA, 19 nt, Mycobacterium tuberculosis H37Rv
ccgggcucggugacccccg

SEQ ID NO: 1320034 - RNA, 17 nt, Mycobacterium tuberculosis H37Rv
ccgggcucuggccaguc

SEQ ID NO: 1320035 - RNA, 20 nt, Mycobacterium tuberculosis H37Rv
ccgggcucggcgaaggccgc

SEQ ID NO: 1320036 - RNA, 23 nt, Mycobacterium tuberculosis H37Rv
ccgggcuccaauugcggccgcgc

SEQ ID NO: 1320037 - RNA, 20 nt, Mycobacterium tuberculosis H37Rv
ccggcuugggccaggcccag

SEQ ID NO: 1320038 - RNA, 21 nt, Mycobacterium tuberculosis H37Rv
ccggcuugggccaggcccagc

SEQ ID NO: 1320039 - RNA, 17 nt, Mycobacterium tuberculosis H37Rv
ccggcuugggccaggcc

SEQ ID NO: 1320040 - RNA, 18 nt, Mycobacterium tuberculosis H37Rv
ccggcuuucccaccgcuu

SEQ ID NO: 1320041 - RNA, 14 nt, Mycobacterium tuberculosis H37Rv
ccgggaauggcgac

SEQ ID NO: 1320042 - RNA, 21 nt, Mycobacterium tuberculosis H37Rv
ccgggaauggacaggucgggc

SEQ ID NO: 1320043 - RNA, 18 nt, Mycobacterium tuberculosis H37Rv
ccgggaccgcgaacccgu

SEQ ID NO: 1320044 - RNA, 15 nt, Mycobacterium tuberculosis H37Rv
ccgggaaccaacacc

SEQ ID NO: 1320045 - RNA, 22 nt, Mycobacterium tuberculosis H37Rv
ccgggaacgccucaggggcgcc

SEQ ID NO: 1320046 - RNA, 19 nt, Mycobacterium tuberculosis H37Rv
ccgggaacgcugacgcccu

SEQ ID NO: 1320047 - RNA, 15 nt, Mycobacterium tuberculosis H37Rv
ccgggauaacccagc

SEQ ID NO: 1320048 - RNA, 16 nt, Mycobacterium tuberculosis H37Rv
ccgggagucgucggca

SEQ ID NO: 1320049 - RNA, 14 nt, Mycobacterium tuberculosis H37Rv
ccgggagucgucgg

SEQ ID NO: 1320050 - RNA, 22 nt, Mycobacterium tuberculosis H37Rv
ccgggagucgacggugccgucg

SEQ ID NO: 1320051 - RNA, 20 nt, Mycobacterium tuberculosis H37Rv
ccgggacguuguccaccgcc

SEQ ID NO: 1320052 - RNA, 13 nt, Mycobacterium tuberculosis H37Rv
ccgggacggcgau

SEQ ID NO: 1320053 - RNA, 18 nt, Mycobacterium tuberculosis H37Rv
ccgggauaacccagcacc

SEQ ID NO: 1320054 - RNA, 15 nt, Mycobacterium tuberculosis H37Rv
ccgggccaaugccgu

SEQ ID NO: 1320055 - RNA, 12 nt, Mycobacterium tuberculosis H37Rv
ccgggccaagac

SEQ ID NO: 1320056 - RNA, 19 nt, Mycobacterium tuberculosis H37Rv
ccgggccaagacggcgggc

SEQ ID NO: 1320057 - RNA, 12 nt, Mycobacterium tuberculosis H37Rv
ccgggccaaugc

SEQ ID NO: 1320058 - RNA, 17 nt, Mycobacterium tuberculosis H37Rv
ccgggccaucgcauccc

SEQ ID NO: 1320059 - RNA, 17 nt, Mycobacterium tuberculosis H37Rv
ccgggucacgugggcca

SEQ ID NO: 1320060 - RNA, 19 nt, Mycobacterium tuberculosis H37Rv
ccgggucagcccggcgcga

SEQ ID NO: 1320061 - RNA, 20 nt, Mycobacterium tuberculosis H37Rv
ccgggucagcccggcgcgau

SEQ ID NO: 1320062 - RNA, 19 nt, Mycobacterium tuberculosis H37Rv
ccggguugagccgccgcga

SEQ ID NO: 1320063 - RNA, 19 nt, Mycobacterium tuberculosis H37Rv
ccggguuugaucagcucgg

SEQ ID NO: 1320064 - RNA, 13 nt, Mycobacterium tuberculosis H37Rv
ccggguuggcgcc

SEQ ID NO: 1320065 - RNA, 22 nt, Mycobacterium tuberculosis H37Rv
ccggguaaagcgaugggaacgg

SEQ ID NO: 1320066 - RNA, 19 nt, Mycobacterium tuberculosis H37Rv
ccggguagcucccugggcg

SEQ ID NO: 1320067 - RNA, 18 nt, Mycobacterium tuberculosis H37Rv
ccggguagccggcgugca

SEQ ID NO: 1320068 - RNA, 13 nt, Mycobacterium tuberculosis H37Rv
ccgggucaccagc

SEQ ID NO: 1320069 - RNA, 17 nt, Mycobacterium tuberculosis H37Rv
ccgggucaacgccauca

SEQ ID NO: 1320070 - RNA, 16 nt, Mycobacterium tuberculosis H37Rv
ccggguagcggcgccg

SEQ ID NO: 1320071 - RNA, 21 nt, Mycobacterium tuberculosis H37Rv
ccggggcgcccggccaggucg

SEQ ID NO: 1320072 - RNA, 20 nt, Mycobacterium tuberculosis H37Rv
ccggggcgggauauagccgg

SEQ ID NO: 1320073 - RNA, 15 nt, Mycobacterium tuberculosis H37Rv
ccggggcgcccggcc

SEQ ID NO: 1320074 - RNA, 20 nt, Mycobacterium tuberculosis H37Rv
ccggggcgaugucggcuggu

SEQ ID NO: 1320075 - RNA, 16 nt, Mycobacterium tuberculosis H37Rv
ccggggccgccgucgc

SEQ ID NO: 1320076 - RNA, 18 nt, Mycobacterium tuberculosis H37Rv
ccgguccgucaccaccgc

SEQ ID NO: 1320077 - RNA, 22 nt, Mycobacterium tuberculosis H37Rv
ccggucagcaauacggcggcgc

SEQ ID NO: 1320078 - RNA, 16 nt, Mycobacterium tuberculosis H37Rv
ccgguccggucggcgg

SEQ ID NO: 1320079 - RNA, 21 nt, Mycobacterium tuberculosis H37Rv
ccgguaucgccaaauccggug

SEQ ID NO: 1320080 - RNA, 18 nt, Mycobacterium tuberculosis H37Rv
ccgguauuaccgccgugg

SEQ ID NO: 1320081 - RNA, 17 nt, Mycobacterium tuberculosis H37Rv
ccgguaggcggccagcg

SEQ ID NO: 1320082 - RNA, 16 nt, Mycobacterium tuberculosis H37Rv
ccgguagucgccgucg

SEQ ID NO: 1320083 - RNA, 17 nt, Mycobacterium tuberculosis H37Rv
ccgguagucgccgucgg

SEQ ID NO: 1320084 - RNA, 16 nt, Mycobacterium tuberculosis H37Rv
ccggugaacggcagca

SEQ ID NO: 1320085 - RNA, 16 nt, Mycobacterium tuberculosis H37Rv
ccggucgccucaccgg

SEQ ID NO: 1320086 - RNA, 16 nt, Mycobacterium tuberculosis H37Rv
ccggucgccggcuggg

SEQ ID NO: 1320087 - RNA, 14 nt, Mycobacterium tuberculosis H37Rv
ccggucgcggaacu

SEQ ID NO: 1320088 - RNA, 19 nt, Mycobacterium tuberculosis H37Rv
ccggucgacgggucggcgc

SEQ ID NO: 1320089 - RNA, 16 nt, Mycobacterium tuberculosis H37Rv
ccggucgacuccagca

SEQ ID NO: 1320090 - RNA, 14 nt, Mycobacterium tuberculosis H37Rv
ccggucgaggugac

SEQ ID NO: 1320091 - RNA, 17 nt, Mycobacterium tuberculosis H37Rv
ccggucgaugaccucca

SEQ ID NO: 1320092 - RNA, 14 nt, Mycobacterium tuberculosis H37Rv
ccgucgacgcggcc

SEQ ID NO: 1320093 - RNA, 14 nt, Mycobacterium tuberculosis H37Rv
ccguccuuuccagg

SEQ ID NO: 1320094 - RNA, 18 nt, Mycobacterium tuberculosis H37Rv
ccgucgaaauacccgguc

SEQ ID NO: 1320095 - RNA, 23 nt, Mycobacterium tuberculosis H37Rv
ccgucagcggcaacaugucaccu

SEQ ID NO: 1320096 - RNA, 17 nt, Mycobacterium tuberculosis H37Rv
ccgucagcgccgcgcgc

SEQ ID NO: 1320097 - RNA, 22 nt, Mycobacterium tuberculosis H37Rv
ccgucagcgccgcugacuccug

SEQ ID NO: 1320098 - RNA, 17 nt, Mycobacterium tuberculosis H37Rv
ccgucagcgcgaccguc

SEQ ID NO: 1320099 - RNA, 15 nt, Mycobacterium tuberculosis H37Rv
ccgucagcggacagu

SEQ ID NO: 1320100 - RNA, 18 nt, Mycobacterium tuberculosis H37Rv
ccgucagccaggugccca

SEQ ID NO: 1320101 - RNA, 14 nt, Mycobacterium tuberculosis H37Rv
ccgucgcuacccgc

SEQ ID NO: 1320102 - RNA, 15 nt, Mycobacterium tuberculosis H37Rv
ccgucgcugggaggc

SEQ ID NO: 1320103 - RNA, 18 nt, Mycobacterium tuberculosis H37Rv
ccgucgcuacccgccacg

SEQ ID NO: 1320104 - RNA, 15 nt, Mycobacterium tuberculosis H37Rv
ccgucgcggcggcac

SEQ ID NO: 1320105 - RNA, 15 nt, Mycobacterium tuberculosis H37Rv
ccgucgaucccgguc

SEQ ID NO: 1320106 - RNA, 19 nt, Mycobacterium tuberculosis H37Rv
ccgucgaguuccggccggu

SEQ ID NO: 1320107 - RNA, 13 nt, Mycobacterium tuberculosis H37Rv
ccgucgagcgucu

SEQ ID NO: 1320108 - RNA, 17 nt, Mycobacterium tuberculosis H37Rv
ccgucggcagcagcggu

SEQ ID NO: 1320109 - RNA, 12 nt, Mycobacterium tuberculosis H37Rv
ccgucggcagca

SEQ ID NO: 1320110 - RNA, 23 nt, Mycobacterium tuberculosis H37Rv
ccgucggauggaaggcggccagg

SEQ ID NO: 1320111 - RNA, 13 nt, Mycobacterium tuberculosis H37Rv
ccgucggcgagca

SEQ ID NO: 1320112 - RNA, 14 nt, Mycobacterium tuberculosis H37Rv
ccgucggcccgcuc

SEQ ID NO: 1320113 - RNA, 18 nt, Mycobacterium tuberculosis H37Rv
ccgucggcgcgcaccucg

SEQ ID NO: 1320114 - RNA, 22 nt, Mycobacterium tuberculosis H37Rv
ccgucugcgacccgggccgcgg

SEQ ID NO: 1320115 - RNA, 14 nt, Mycobacterium tuberculosis H37Rv
ccgucugacagcau

SEQ ID NO: 1320116 - RNA, 12 nt, Mycobacterium tuberculosis H37Rv
ccgucugaucac

SEQ ID NO: 1320117 - RNA, 17 nt, Mycobacterium tuberculosis H37Rv
ccgucugcgacccgggc

SEQ ID NO: 1320118 - RNA, 12 nt, Mycobacterium tuberculosis H37Rv
ccgucucugcca

SEQ ID NO: 1320119 - RNA, 14 nt, Mycobacterium tuberculosis H37Rv
ccgucucgccgcgc

SEQ ID NO: 1320120 - RNA, 13 nt, Mycobacterium tuberculosis H37Rv
ccgucucgccccc

SEQ ID NO: 1320121 - RNA, 19 nt, Mycobacterium tuberculosis H37Rv
ccgucguugcccgacccgc

SEQ ID NO: 1320122 - RNA, 23 nt, Mycobacterium tuberculosis H37Rv
ccgucgggugcagcacggcgccg

SEQ ID NO: 1320123 - RNA, 20 nt, Mycobacterium tuberculosis H37Rv
ccgucggugggugccagccg

SEQ ID NO: 1320124 - RNA, 21 nt, Mycobacterium tuberculosis H37Rv
ccgucguccgcugacccgcca

SEQ ID NO: 1320125 - RNA, 16 nt, Mycobacterium tuberculosis H37Rv
ccgucgucgagcacca

SEQ ID NO: 1320126 - RNA, 15 nt, Mycobacterium tuberculosis H37Rv
ccgucgggcccagcc

SEQ ID NO: 1320127 - RNA, 16 nt, Mycobacterium tuberculosis H37Rv
ccgucgggcccagccg

SEQ ID NO: 1320128 - RNA, 19 nt, Mycobacterium tuberculosis H37Rv
ccgucgggcacaccgacgc

SEQ ID NO: 1320129 - RNA, 20 nt, Mycobacterium tuberculosis H37Rv
ccgucgggcaguuugcgggc

SEQ ID NO: 1320130 - RNA, 14 nt, Mycobacterium tuberculosis H37Rv
ccgucggcgcccgg

SEQ ID NO: 1320131 - RNA, 22 nt, Mycobacterium tuberculosis H37Rv
ccgucggggguaauugccagcc

SEQ ID NO: 1320132 - RNA, 18 nt, Mycobacterium tuberculosis H37Rv
ccgucggugccgccgccg

SEQ ID NO: 1320133 - RNA, 23 nt, Mycobacterium tuberculosis H37Rv
ccgucgggugcugaugggucagg

SEQ ID NO: 1320134 - RNA, 14 nt, Mycobacterium tuberculosis H37Rv
ccguaguggccggc

SEQ ID NO: 1320135 - RNA, 15 nt, Mycobacterium tuberculosis H37Rv
ccguagugucggcgu

SEQ ID NO: 1320136 - RNA, 23 nt, Mycobacterium tuberculosis H37Rv
ccgucagaacaccggccaggccg

SEQ ID NO: 1320137 - RNA, 21 nt, Mycobacterium tuberculosis H37Rv
ccguagugcacgucggcgggc

SEQ ID NO: 1320138 - RNA, 20 nt, Mycobacterium tuberculosis H37Rv
ccguagagcaugccgcccgc

SEQ ID NO: 1320139 - RNA, 13 nt, Mycobacterium tuberculosis H37Rv
ccguagaccagcc

SEQ ID NO: 1320140 - RNA, 15 nt, Mycobacterium tuberculosis H37Rv
ccguacgccggcggu

SEQ ID NO: 1320141 - RNA, 18 nt, Mycobacterium tuberculosis H37Rv
ccguagcgcaggagcgcg

SEQ ID NO: 1320142 - RNA, 22 nt, Mycobacterium tuberculosis H37Rv
ccguagcggucuccccagagcu

SEQ ID NO: 1320143 - RNA, 18 nt, Mycobacterium tuberculosis H37Rv
ccguagcugcgcagcgca

SEQ ID NO: 1320144 - RNA, 18 nt, Mycobacterium tuberculosis H37Rv
ccguagcacaccggugga

SEQ ID NO: 1320145 - RNA, 22 nt, Mycobacterium tuberculosis H37Rv
ccggugccgccggugccgccug

SEQ ID NO: 1320146 - RNA, 19 nt, Mycobacterium tuberculosis H37Rv
ccggugccgccgucgccgc

SEQ ID NO: 1320147 - RNA, 22 nt, Mycobacterium tuberculosis H37Rv
ccggugccgccguucccaccac

SEQ ID NO: 1320148 - RNA, 23 nt, Mycobacterium tuberculosis H37Rv
ccggugccgccguugccauugcc

SEQ ID NO: 1320149 - RNA, 20 nt, Mycobacterium tuberculosis H37Rv
ccggugccgccggugccgcc

SEQ ID NO: 1320150 - RNA, 20 nt, Mycobacterium tuberculosis H37Rv
ccggugccgcccgcgccgcc

SEQ ID NO: 1320151 - RNA, 15 nt, Mycobacterium tuberculosis H37Rv
ccggugccgccgcgg

SEQ ID NO: 1320152 - RNA, 13 nt, Mycobacterium tuberculosis H37Rv
ccggugccgccgg

SEQ ID NO: 1320153 - RNA, 14 nt, Mycobacterium tuberculosis H37Rv
ccggugccgcccgc

SEQ ID NO: 1320154 - RNA, 18 nt, Mycobacterium tuberculosis H37Rv
ccggugccgacggcgccg

SEQ ID NO: 1320155 - RNA, 21 nt, Mycobacterium tuberculosis H37Rv
ccguaaauaucggggccacug

SEQ ID NO: 1320156 - RNA, 21 nt, Mycobacterium tuberculosis H37Rv
ccggugcagaugcggcugaau

SEQ ID NO: 1320157 - RNA, 14 nt, Mycobacterium tuberculosis H37Rv
ccggugccagucca

SEQ ID NO: 1320158 - RNA, 14 nt, Mycobacterium tuberculosis H37Rv
ccggugccaccggc

SEQ ID NO: 1320159 - RNA, 19 nt, Mycobacterium tuberculosis H37Rv
ccggugcccgcaccacacc

SEQ ID NO: 1320160 - RNA, 17 nt, Mycobacterium tuberculosis H37Rv
ccggugccgcccgagcc

SEQ ID NO: 1320161 - RNA, 21 nt, Mycobacterium tuberculosis H37Rv
ccggugccgccaucgccgccg

SEQ ID NO: 1320162 - RNA, 18 nt, Mycobacterium tuberculosis H37Rv
ccggugagcgagcgcgcg

SEQ ID NO: 1320163 - RNA, 22 nt, Mycobacterium tuberculosis H37Rv
ccggugagcgcagcuugauccc

SEQ ID NO: 1320164 - RNA, 19 nt, Mycobacterium tuberculosis H37Rv
ccggugauggugugcagca

SEQ ID NO: 1320165 - RNA, 19 nt, Mycobacterium tuberculosis H37Rv
ccggugauggccgaccagc

SEQ ID NO: 1320166 - RNA, 22 nt, Mycobacterium tuberculosis H37Rv
ccggugauccaacuggccgcgu

SEQ ID NO: 1320167 - RNA, 18 nt, Mycobacterium tuberculosis H37Rv
ccguuugagcggccaccg

SEQ ID NO: 1320168 - RNA, 20 nt, Mycobacterium tuberculosis H37Rv
ccguuucgaucucgagcagg

SEQ ID NO: 1320169 - RNA, 19 nt, Mycobacterium tuberculosis H37Rv
ccuaaauugccgggcccag

SEQ ID NO: 1320170 - RNA, 22 nt, Mycobacterium tuberculosis H37Rv
ccguucgcccgcccgucuucca

SEQ ID NO: 1320171 - RNA, 16 nt, Mycobacterium tuberculosis H37Rv
ccguucgcccgcccgu

SEQ ID NO: 1320172 - RNA, 17 nt, Mycobacterium tuberculosis H37Rv
ccguucgacccagcggu

SEQ ID NO: 1320173 - RNA, 13 nt, Mycobacterium tuberculosis H37Rv
ccguucgaggucg

SEQ ID NO: 1320174 - RNA, 15 nt, Mycobacterium tuberculosis H37Rv
ccguuccggcugcuu

SEQ ID NO: 1320175 - RNA, 17 nt, Mycobacterium tuberculosis H37Rv
ccguugccgccauuggc

SEQ ID NO: 1320176 - RNA, 21 nt, Mycobacterium tuberculosis H37Rv
ccguugccgaucagcccggcc

SEQ ID NO: 1320177 - RNA, 20 nt, Mycobacterium tuberculosis H37Rv
ccguugccgauccccaggcc

SEQ ID NO: 1320178 - RNA, 18 nt, Mycobacterium tuberculosis H37Rv
ccguugccgaucagcccg

SEQ ID NO: 1320179 - RNA, 18 nt, Mycobacterium tuberculosis H37Rv
ccguugcccccauugccg

SEQ ID NO: 1320180 - RNA, 13 nt, Mycobacterium tuberculosis H37Rv
ccguuggagccgc

SEQ ID NO: 1320181 - RNA, 20 nt, Mycobacterium tuberculosis H37Rv
ccguugccgccguugccacc

SEQ ID NO: 1320182 - RNA, 22 nt, Mycobacterium tuberculosis H37Rv
ccguugccgccggugccacccu

SEQ ID NO: 1320183 - RNA, 16 nt, Mycobacterium tuberculosis H37Rv
ccguugccgcccacua

SEQ ID NO: 1320184 - RNA, 17 nt, Mycobacterium tuberculosis H37Rv
ccguugccgcccguccc

SEQ ID NO: 1320185 - RNA, 17 nt, Mycobacterium tuberculosis H37Rv
ccuaacaucguugaucu

SEQ ID NO: 1320186 - RNA, 19 nt, Mycobacterium tuberculosis H37Rv
ccuaacgaaccagcccgcc

SEQ ID NO: 1320187 - RNA, 13 nt, Mycobacterium tuberculosis H37Rv
ccgugccgcccgg

SEQ ID NO: 1320188 - RNA, 19 nt, Mycobacterium tuberculosis H37Rv
ccgugccgcccgcgccgcc

SEQ ID NO: 1320189 - RNA, 21 nt, Mycobacterium tuberculosis H37Rv
ccgugccgaaaaucgcagcca

SEQ ID NO: 1320190 - RNA, 14 nt, Mycobacterium tuberculosis H37Rv
ccgugcccaggcca

SEQ ID NO: 1320191 - RNA, 19 nt, Mycobacterium tuberculosis H37Rv
ccgugcgcgcgcagcugac

SEQ ID NO: 1320192 - RNA, 15 nt, Mycobacterium tuberculosis H37Rv
ccgugcgcgcgcagc

SEQ ID NO: 1320193 - RNA, 22 nt, Mycobacterium tuberculosis H37Rv
ccgugccgguguguccagcgga

SEQ ID NO: 1320194 - RNA, 20 nt, Mycobacterium tuberculosis H37Rv
ccgugccgccgaugccgccg

SEQ ID NO: 1320195 - RNA, 18 nt, Mycobacterium tuberculosis H37Rv
ccgugcgaugcacaaccg

SEQ ID NO: 1320196 - RNA, 15 nt, Mycobacterium tuberculosis H37Rv
ccgugccgucggcgu

SEQ ID NO: 1320197 - RNA, 18 nt, Mycobacterium tuberculosis H37Rv
ccgugccgucggcgugca

SEQ ID NO: 1320198 - RNA, 16 nt, Mycobacterium tuberculosis H37Rv
ccgucuuggcccgguc

SEQ ID NO: 1320199 - RNA, 15 nt, Mycobacterium tuberculosis H37Rv
ccgugaaccgcccgc

SEQ ID NO: 1320200 - RNA, 20 nt, Mycobacterium tuberculosis H37Rv
ccgugacguagggcagcgcc

SEQ ID NO: 1320201 - RNA, 18 nt, Mycobacterium tuberculosis H37Rv
ccgugaaucgagcaccgc

SEQ ID NO: 1320202 - RNA, 14 nt, Mycobacterium tuberculosis H37Rv
ccgugaccagccgg

SEQ ID NO: 1320203 - RNA, 15 nt, Mycobacterium tuberculosis H37Rv
ccgugaccgccgcgc

SEQ ID NO: 1320204 - RNA, 17 nt, Mycobacterium tuberculosis H37Rv
ccguggguagcgaagaa

SEQ ID NO: 1320205 - RNA, 18 nt, Mycobacterium tuberculosis H37Rv
ccgugguggaugagccgg

SEQ ID NO: 1320206 - RNA, 19 nt, Mycobacterium tuberculosis H37Rv
ccguggugcuagcgccgcc

SEQ ID NO: 1320207 - RNA, 21 nt, Mycobacterium tuberculosis H37Rv
ccguggugguugaucagccag

SEQ ID NO: 1320208 - RNA, 20 nt, Mycobacterium tuberculosis H37Rv
ccgugcgcgcgcagcugacg

SEQ ID NO: 1320209 - RNA, 16 nt, Mycobacterium tuberculosis H37Rv
ccgugcggggggcagc

SEQ ID NO: 1320210 - RNA, 14 nt, Mycobacterium tuberculosis H37Rv
ccgugcggucgcgc

SEQ ID NO: 1320211 - RNA, 14 nt, Mycobacterium tuberculosis H37Rv
ccgugcggcggcug

SEQ ID NO: 1320212 - RNA, 17 nt, Mycobacterium tuberculosis H37Rv
ccgugcggcggcugccg

SEQ ID NO: 1320213 - RNA, 23 nt, Mycobacterium tuberculosis H37Rv
ccgugugcggacaguucccggcc

SEQ ID NO: 1320214 - RNA, 12 nt, Mycobacterium tuberculosis H37Rv
ccgugucgccgg

SEQ ID NO: 1320215 - RNA, 17 nt, Mycobacterium tuberculosis H37Rv
ccguguaggccauguug

SEQ ID NO: 1320216 - RNA, 16 nt, Mycobacterium tuberculosis H37Rv
ccguucccgccggccc

SEQ ID NO: 1320217 - RNA, 22 nt, Mycobacterium tuberculosis H37Rv
ccguucaacguggaaaccgcuc

SEQ ID NO: 1320218 - RNA, 17 nt, Mycobacterium tuberculosis H37Rv
ccuccgacggccgcggc

SEQ ID NO: 1320219 - RNA, 15 nt, Mycobacterium tuberculosis H37Rv
ccucccuggcccccg

SEQ ID NO: 1320220 - RNA, 17 nt, Mycobacterium tuberculosis H37Rv
ccuccgcugccgcccgc

SEQ ID NO: 1320221 - RNA, 20 nt, Mycobacterium tuberculosis H37Rv
ccuccggauaacccagcggc

SEQ ID NO: 1320222 - RNA, 17 nt, Mycobacterium tuberculosis H37Rv
ccuccggauccucggcc

SEQ ID NO: 1320223 - RNA, 20 nt, Mycobacterium tuberculosis H37Rv
ccuccggauccucggccgcc

SEQ ID NO: 1320224 - RNA, 17 nt, Mycobacterium tuberculosis H37Rv
ccuccggaaggcucgcc

SEQ ID NO: 1320225 - RNA, 21 nt, Mycobacterium tuberculosis H37Rv
ccuccggaaucgcccgggcgg

SEQ ID NO: 1320226 - RNA, 16 nt, Mycobacterium tuberculosis H37Rv
ccuccgcugccgcccg

SEQ ID NO: 1320227 - RNA, 14 nt, Mycobacterium tuberculosis H37Rv
ccuccgccugcccc

SEQ ID NO: 1320228 - RNA, 18 nt, Mycobacterium tuberculosis H37Rv
ccuccgcguagagcagca

SEQ ID NO: 1320229 - RNA, 19 nt, Mycobacterium tuberculosis H37Rv
ccuccgcgaucaccgacga

SEQ ID NO: 1320230 - RNA, 21 nt, Mycobacterium tuberculosis H37Rv
ccuccgccgaggaaaccacca

SEQ ID NO: 1320231 - RNA, 13 nt, Mycobacterium tuberculosis H37Rv
ccucccacccccg

SEQ ID NO: 1320232 - RNA, 15 nt, Mycobacterium tuberculosis H37Rv
ccucccaccagcggc

SEQ ID NO: 1320233 - RNA, 22 nt, Mycobacterium tuberculosis H37Rv
ccucccagggcucggcggcccg

SEQ ID NO: 1320234 - RNA, 20 nt, Mycobacterium tuberculosis H37Rv
ccuccccgaccgccaccgcc

SEQ ID NO: 1320235 - RNA, 12 nt, Mycobacterium tuberculosis H37Rv
ccuccccgagcg

SEQ ID NO: 1320236 - RNA, 15 nt, Mycobacterium tuberculosis H37Rv
ccuccccgaccgcca

SEQ ID NO: 1320237 - RNA, 20 nt, Mycobacterium tuberculosis H37Rv
ccucccgauucucgaucugg

SEQ ID NO: 1320238 - RNA, 13 nt, Mycobacterium tuberculosis H37Rv
ccucccgcggcac

SEQ ID NO: 1320239 - RNA, 14 nt, Mycobacterium tuberculosis H37Rv
ccucccgcggcacc

SEQ ID NO: 1320240 - RNA, 17 nt, Mycobacterium tuberculosis H37Rv
ccucccgggccgccgcg

SEQ ID NO: 1320241 - RNA, 21 nt, Mycobacterium tuberculosis H37Rv
ccucccgggcccgcugggcuu

SEQ ID NO: 1320242 - RNA, 16 nt, Mycobacterium tuberculosis H37Rv
ccucccgggccgccgc

SEQ ID NO: 1320243 - RNA, 14 nt, Mycobacterium tuberculosis H37Rv
ccucccgcgugcgg

SEQ ID NO: 1320244 - RNA, 19 nt, Mycobacterium tuberculosis H37Rv
ccucccgggcccgcugggc

SEQ ID NO: 1320245 - RNA, 15 nt, Mycobacterium tuberculosis H37Rv
ccuccgucagcgccg

SEQ ID NO: 1320246 - RNA, 19 nt, Mycobacterium tuberculosis H37Rv
ccuccgucagcgccgcgcg

SEQ ID NO: 1320247 - RNA, 18 nt, Mycobacterium tuberculosis H37Rv
ccuccgguaucggcgacc

SEQ ID NO: 1320248 - RNA, 11 nt, Mycobacterium tuberculosis H37Rv
ccuccgggcca

SEQ ID NO: 1320249 - RNA, 19 nt, Mycobacterium tuberculosis H37Rv
ccuccggggugaacgcgga

SEQ ID NO: 1320250 - RNA, 20 nt, Mycobacterium tuberculosis H37Rv
ccuccguaacgccaagcucg

SEQ ID NO: 1320251 - RNA, 14 nt, Mycobacterium tuberculosis H37Rv
ccuccuccccgacc

SEQ ID NO: 1320252 - RNA, 14 nt, Mycobacterium tuberculosis H37Rv
ccuccucgagcagg

SEQ ID NO: 1320253 - RNA, 20 nt, Mycobacterium tuberculosis H37Rv
ccuccggcgcagcgaccggu

SEQ ID NO: 1320254 - RNA, 15 nt, Mycobacterium tuberculosis H37Rv
ccuccggcaccgccc

SEQ ID NO: 1320255 - RNA, 23 nt, Mycobacterium tuberculosis H37Rv
ccuccggaaagcucucggcaccc

SEQ ID NO: 1320256 - RNA, 17 nt, Mycobacterium tuberculosis H37Rv
ccuccggccgugagccc

SEQ ID NO: 1320257 - RNA, 17 nt, Mycobacterium tuberculosis H37Rv
ccuccggcgccgcccga

SEQ ID NO: 1320258 - RNA, 20 nt, Mycobacterium tuberculosis H37Rv
ccuccucgaugaggcgcagc

SEQ ID NO: 1320259 - RNA, 18 nt, Mycobacterium tuberculosis H37Rv
ccuccucggcaggaagga

SEQ ID NO: 1320260 - RNA, 16 nt, Mycobacterium tuberculosis H37Rv
ccuccucgugcaggac

SEQ ID NO: 1320261 - RNA, 15 nt, Mycobacterium tuberculosis H37Rv
ccuccucggcgcgaa

SEQ ID NO: 1320262 - RNA, 11 nt, Mycobacterium tuberculosis H37Rv
ccuccugugcg

SEQ ID NO: 1320263 - RNA, 17 nt, Mycobacterium tuberculosis H37Rv
ccuccagugcggccuug

SEQ ID NO: 1320264 - RNA, 21 nt, Mycobacterium tuberculosis H37Rv
ccuccagauaccaccgccgcu

SEQ ID NO: 1320265 - RNA, 11 nt, Mycobacterium tuberculosis H37Rv
ccuccagcacc

SEQ ID NO: 1320266 - RNA, 16 nt, Mycobacterium tuberculosis H37Rv
ccuccagcagcgacgg

SEQ ID NO: 1320267 - RNA, 19 nt, Mycobacterium tuberculosis H37Rv
ccuccagcagcgacgguca

SEQ ID NO: 1320268 - RNA, 15 nt, Mycobacterium tuberculosis H37Rv
ccuccagccggcgaa

SEQ ID NO: 1320269 - RNA, 16 nt, Mycobacterium tuberculosis H37Rv
ccuccagcgcaccggu

SEQ ID NO: 1320270 - RNA, 14 nt, Mycobacterium tuberculosis H37Rv
ccuccacagcggcc

SEQ ID NO: 1320271 - RNA, 14 nt, Mycobacterium tuberculosis H37Rv
ccuccaagcccgcc

SEQ ID NO: 1320272 - RNA, 15 nt, Mycobacterium tuberculosis H37Rv
ccuccaagcccgccg

SEQ ID NO: 1320273 - RNA, 20 nt, Mycobacterium tuberculosis H37Rv
ccuccaagcccgccggaccc

SEQ ID NO: 1320274 - RNA, 22 nt, Mycobacterium tuberculosis H37Rv
ccuccaauugcgaaccggccgu

SEQ ID NO: 1320275 - RNA, 12 nt, Mycobacterium tuberculosis H37Rv
ccuccacccgcc

SEQ ID NO: 1320276 - RNA, 18 nt, Mycobacterium tuberculosis H37Rv
ccuccacccgccacgguu

SEQ ID NO: 1320277 - RNA, 20 nt, Mycobacterium tuberculosis H37Rv
ccuccacugggucggugccg

SEQ ID NO: 1320278 - RNA, 17 nt, Mycobacterium tuberculosis H37Rv
ccuccacgcuggcgccc

SEQ ID NO: 1320279 - RNA, 22 nt, Mycobacterium tuberculosis H37Rv
ccuccacgcuggcgcccccgac

SEQ ID NO: 1320280 - RNA, 19 nt, Mycobacterium tuberculosis H37Rv
ccuaccgagaucaccgcca

SEQ ID NO: 1320281 - RNA, 12 nt, Mycobacterium tuberculosis H37Rv
ccuaccaggcgc

SEQ ID NO: 1320282 - RNA, 12 nt, Mycobacterium tuberculosis H37Rv
ccuaccgggccc

SEQ ID NO: 1320283 - RNA, 15 nt, Mycobacterium tuberculosis H37Rv
ccucaucacugauca

SEQ ID NO: 1320284 - RNA, 13 nt, Mycobacterium tuberculosis H37Rv
ccucaucgugggg

SEQ ID NO: 1320285 - RNA, 23 nt, Mycobacterium tuberculosis H37Rv
ccucaucggacagcgccuggccg

SEQ ID NO: 1320286 - RNA, 19 nt, Mycobacterium tuberculosis H37Rv
ccucggcuuugccgcugug

SEQ ID NO: 1320287 - RNA, 13 nt, Mycobacterium tuberculosis H37Rv
ccucgggccggcg

SEQ ID NO: 1320288 - RNA, 20 nt, Mycobacterium tuberculosis H37Rv
ccucgggacggccgccgccg

SEQ ID NO: 1320289 - RNA, 15 nt, Mycobacterium tuberculosis H37Rv
ccucgggacugcgcg

SEQ ID NO: 1320290 - RNA, 21 nt, Mycobacterium tuberculosis H37Rv
ccucgcuaauugcggccgccg

SEQ ID NO: 1320291 - RNA, 19 nt, Mycobacterium tuberculosis H37Rv
ccucgcuaauugcggccgc

SEQ ID NO: 1320292 - RNA, 12 nt, Mycobacterium tuberculosis H37Rv
ccucggcgccgu

SEQ ID NO: 1320293 - RNA, 20 nt, Mycobacterium tuberculosis H37Rv
ccucggcggccagcucggcc

SEQ ID NO: 1320294 - RNA, 23 nt, Mycobacterium tuberculosis H37Rv
ccucggcgccgucggagccggcc

SEQ ID NO: 1320295 - RNA, 21 nt, Mycobacterium tuberculosis H37Rv
ccucggcgcgaaaccagucca

SEQ ID NO: 1320296 - RNA, 18 nt, Mycobacterium tuberculosis H37Rv
ccucggcgcugcgcaccg

SEQ ID NO: 1320297 - RNA, 22 nt, Mycobacterium tuberculosis H37Rv
ccucggugacuucacucguuga

SEQ ID NO: 1320298 - RNA, 19 nt, Mycobacterium tuberculosis H37Rv
ccucggugagcugcacgcc

SEQ ID NO: 1320299 - RNA, 23 nt, Mycobacterium tuberculosis H37Rv
ccucggugcggaacaccgcccgg

SEQ ID NO: 1320300 - RNA, 20 nt, Mycobacterium tuberculosis H37Rv
ccucgucgcucccgguuggg

SEQ ID NO: 1320301 - RNA, 23 nt, Mycobacterium tuberculosis H37Rv
ccucgucggccgacaccgccacc

SEQ ID NO: 1320302 - RNA, 14 nt, Mycobacterium tuberculosis H37Rv
ccucggucaccgag

SEQ ID NO: 1320303 - RNA, 14 nt, Mycobacterium tuberculosis H37Rv
ccucggucugcucc

SEQ ID NO: 1320304 - RNA, 20 nt, Mycobacterium tuberculosis H37Rv
ccucggugaccaggccggcc

SEQ ID NO: 1320305 - RNA, 23 nt, Mycobacterium tuberculosis H37Rv
ccucggugaccaggccggcccgc

SEQ ID NO: 1320306 - RNA, 23 nt, Mycobacterium tuberculosis H37Rv
ccucgggguucuuccacagcgcg

SEQ ID NO: 1320307 - RNA, 22 nt, Mycobacterium tuberculosis H37Rv
ccucggcguaggcgauggcggc

SEQ ID NO: 1320308 - RNA, 17 nt, Mycobacterium tuberculosis H37Rv
ccucgacccggcgcagc

SEQ ID NO: 1320309 - RNA, 18 nt, Mycobacterium tuberculosis H37Rv
ccucgacacccagccgca

SEQ ID NO: 1320310 - RNA, 13 nt, Mycobacterium tuberculosis H37Rv
ccucgacacccag

SEQ ID NO: 1320311 - RNA, 15 nt, Mycobacterium tuberculosis H37Rv
ccucgaagcccagca

SEQ ID NO: 1320312 - RNA, 23 nt, Mycobacterium tuberculosis H37Rv
ccucgaagcccagcaccaccacc

SEQ ID NO: 1320313 - RNA, 20 nt, Mycobacterium tuberculosis H37Rv
ccucgaagggcuugucgccg

SEQ ID NO: 1320314 - RNA, 16 nt, Mycobacterium tuberculosis H37Rv
ccucgacgaucagcac

SEQ ID NO: 1320315 - RNA, 22 nt, Mycobacterium tuberculosis H37Rv
ccucgacguaggccaggucgcc

SEQ ID NO: 1320316 - RNA, 15 nt, Mycobacterium tuberculosis H37Rv
ccucgacgcggcagg

SEQ ID NO: 1320317 - RNA, 17 nt, Mycobacterium tuberculosis H37Rv
ccucgacgcggcaggcc

SEQ ID NO: 1320318 - RNA, 20 nt, Mycobacterium tuberculosis H37Rv
ccucgacgcggcaggccggu

SEQ ID NO: 1320319 - RNA, 16 nt, Mycobacterium tuberculosis H37Rv
ccucgacgccgcgcag

SEQ ID NO: 1320320 - RNA, 14 nt, Mycobacterium tuberculosis H37Rv
ccucgacgccccag

SEQ ID NO: 1320321 - RNA, 19 nt, Mycobacterium tuberculosis H37Rv
ccucgcgggcuuaugcacg

SEQ ID NO: 1320322 - RNA, 17 nt, Mycobacterium tuberculosis H37Rv
ccucgcgggaagucccg

SEQ ID NO: 1320323 - RNA, 18 nt, Mycobacterium tuberculosis H37Rv
ccucgcggaugagcucgg

SEQ ID NO: 1320324 - RNA, 22 nt, Mycobacterium tuberculosis H37Rv
ccucuaugcgggcagcgaucuu

SEQ ID NO: 1320325 - RNA, 21 nt, Mycobacterium tuberculosis H37Rv
ccucgugcgugggcgcggcgc

SEQ ID NO: 1320326 - RNA, 19 nt, Mycobacterium tuberculosis H37Rv
ccucgugaguugacggugg

SEQ ID NO: 1320327 - RNA, 22 nt, Mycobacterium tuberculosis H37Rv
ccucguuaucgaccgccgcgag

SEQ ID NO: 1320328 - RNA, 14 nt, Mycobacterium tuberculosis H37Rv
ccucucugcgccag

SEQ ID NO: 1320329 - RNA, 14 nt, Mycobacterium tuberculosis H37Rv
ccucugaaccugcu

SEQ ID NO: 1320330 - RNA, 17 nt, Mycobacterium tuberculosis H37Rv
ccucuucgggcagcgcg

SEQ ID NO: 1320331 - RNA, 22 nt, Mycobacterium tuberculosis H37Rv
ccucuucgggguagaccuucuc

SEQ ID NO: 1320332 - RNA, 15 nt, Mycobacterium tuberculosis H37Rv
ccucuucggagguga

SEQ ID NO: 1320333 - RNA, 23 nt, Mycobacterium tuberculosis H37Rv
ccugaaacgauugcugcggcuuu

SEQ ID NO: 1320334 - RNA, 14 nt, Mycobacterium tuberculosis H37Rv
ccugaagccgcgcu

SEQ ID NO: 1320335 - RNA, 22 nt, Mycobacterium tuberculosis H37Rv
ccugccguauggcaucggccug

SEQ ID NO: 1320336 - RNA, 15 nt, Mycobacterium tuberculosis H37Rv
ccugccggaccaccg

SEQ ID NO: 1320337 - RNA, 13 nt, Mycobacterium tuberculosis H37Rv
ccugccguuccgg

SEQ ID NO: 1320338 - RNA, 20 nt, Mycobacterium tuberculosis H37Rv
ccugcgacuaagggcacucc

SEQ ID NO: 1320339 - RNA, 23 nt, Mycobacterium tuberculosis H37Rv
ccugcgacuaagggcacuccacc

SEQ ID NO: 1320340 - RNA, 14 nt, Mycobacterium tuberculosis H37Rv
ccugcgaccaggcg

SEQ ID NO: 1320341 - RNA, 16 nt, Mycobacterium tuberculosis H37Rv
ccugccucggcgagcc

SEQ ID NO: 1320342 - RNA, 22 nt, Mycobacterium tuberculosis H37Rv
ccugcgcaaauugcaacagagc

SEQ ID NO: 1320343 - RNA, 13 nt, Mycobacterium tuberculosis H37Rv
ccugcgccacacc

SEQ ID NO: 1320344 - RNA, 18 nt, Mycobacterium tuberculosis H37Rv
ccugcgccgcccgcgcca

SEQ ID NO: 1320345 - RNA, 13 nt, Mycobacterium tuberculosis H37Rv
ccugcgccgcccg

SEQ ID NO: 1320346 - RNA, 19 nt, Mycobacterium tuberculosis H37Rv
ccugcgccgguaacugucc

SEQ ID NO: 1320347 - RNA, 17 nt, Mycobacterium tuberculosis H37Rv
ccugcgccgccacagca

SEQ ID NO: 1320348 - RNA, 17 nt, Mycobacterium tuberculosis H37Rv
ccugcgccacacccggc

SEQ ID NO: 1320349 - RNA, 19 nt, Mycobacterium tuberculosis H37Rv
ccugcgccacacccggcac

SEQ ID NO: 1320350 - RNA, 23 nt, Mycobacterium tuberculosis H37Rv
ccugcgggaaguugcccagguga

SEQ ID NO: 1320351 - RNA, 21 nt, Mycobacterium tuberculosis H37Rv
ccugcguccgacgccugggca

SEQ ID NO: 1320352 - RNA, 18 nt, Mycobacterium tuberculosis H37Rv
ccugcgucgaaauccaca

SEQ ID NO: 1320353 - RNA, 18 nt, Mycobacterium tuberculosis H37Rv
ccugcgcgcggccgcgcu

SEQ ID NO: 1320354 - RNA, 13 nt, Mycobacterium tuberculosis H37Rv
ccugcgcugcagc

SEQ ID NO: 1320355 - RNA, 16 nt, Mycobacterium tuberculosis H37Rv
ccugcgcgaccgacca

SEQ ID NO: 1320356 - RNA, 17 nt, Mycobacterium tuberculosis H37Rv
ccugcgcgagugccagu

SEQ ID NO: 1320357 - RNA, 21 nt, Mycobacterium tuberculosis H37Rv
ccugcgcgagugccaguccga

SEQ ID NO: 1320358 - RNA, 19 nt, Mycobacterium tuberculosis H37Rv
ccugcgcgacggcgcugug

SEQ ID NO: 1320359 - RNA, 19 nt, Mycobacterium tuberculosis H37Rv
ccugcggcagcggaccgcu

SEQ ID NO: 1320360 - RNA, 19 nt, Mycobacterium tuberculosis H37Rv
ccugcggcaggugcgguca

SEQ ID NO: 1320361 - RNA, 16 nt, Mycobacterium tuberculosis H37Rv
ccugcggcaacggcuc

SEQ ID NO: 1320362 - RNA, 22 nt, Mycobacterium tuberculosis H37Rv
ccugcaccgucacgucguuugg

SEQ ID NO: 1320363 - RNA, 22 nt, Mycobacterium tuberculosis H37Rv
ccugcagcacgacgugcgucgg

SEQ ID NO: 1320364 - RNA, 12 nt, Mycobacterium tuberculosis H37Rv
ccugcccggccc

SEQ ID NO: 1320365 - RNA, 15 nt, Mycobacterium tuberculosis H37Rv
ccugcccggcccgcc

SEQ ID NO: 1320366 - RNA, 17 nt, Mycobacterium tuberculosis H37Rv
ccugcccggcccgcccg

SEQ ID NO: 1320367 - RNA, 20 nt, Mycobacterium tuberculosis H37Rv
ccugcccggcccgcucagcc

SEQ ID NO: 1320368 - RNA, 13 nt, Mycobacterium tuberculosis H37Rv
ccugcccuccgug

SEQ ID NO: 1320369 - RNA, 16 nt, Mycobacterium tuberculosis H37Rv
ccugccgacgcuccag

SEQ ID NO: 1320370 - RNA, 22 nt, Mycobacterium tuberculosis H37Rv
ccugccgaaacgccgaccgcgc

SEQ ID NO: 1320371 - RNA, 17 nt, Mycobacterium tuberculosis H37Rv
ccugccgaacccggcgg

SEQ ID NO: 1320372 - RNA, 16 nt, Mycobacterium tuberculosis H37Rv
ccugccgccggccccg

SEQ ID NO: 1320373 - RNA, 19 nt, Mycobacterium tuberculosis H37Rv
ccugcaagaaccacugcau

SEQ ID NO: 1320374 - RNA, 22 nt, Mycobacterium tuberculosis H37Rv
ccugaaucaccggagcgccgag

SEQ ID NO: 1320375 - RNA, 19 nt, Mycobacterium tuberculosis H37Rv
ccugcacgugacccugggg

SEQ ID NO: 1320376 - RNA, 22 nt, Mycobacterium tuberculosis H37Rv
ccugcacgccggcgcuggagac

SEQ ID NO: 1320377 - RNA, 15 nt, Mycobacterium tuberculosis H37Rv
ccugcacgccggcgc

SEQ ID NO: 1320378 - RNA, 16 nt, Mycobacterium tuberculosis H37Rv
ccugcacgccggcgcu

SEQ ID NO: 1320379 - RNA, 17 nt, Mycobacterium tuberculosis H37Rv
ccugcacgacccgcugg

SEQ ID NO: 1320380 - RNA, 21 nt, Mycobacterium tuberculosis H37Rv
ccugcaccgccgccgcccgua

SEQ ID NO: 1320381 - RNA, 13 nt, Mycobacterium tuberculosis H37Rv
ccugcacccaggc

SEQ ID NO: 1320382 - RNA, 12 nt, Mycobacterium tuberculosis H37Rv
ccugcacagcag

SEQ ID NO: 1320383 - RNA, 12 nt, Mycobacterium tuberculosis H37Rv
ccugcacccggc

SEQ ID NO: 1320384 - RNA, 14 nt, Mycobacterium tuberculosis H37Rv
ccugcacagcagcg

SEQ ID NO: 1320385 - RNA, 23 nt, Mycobacterium tuberculosis H37Rv
ccugcaccacggcggccaccugc

SEQ ID NO: 1320386 - RNA, 13 nt, Mycobacterium tuberculosis H37Rv
ccugucgcaccag

SEQ ID NO: 1320387 - RNA, 23 nt, Mycobacterium tuberculosis H37Rv
ccuguccggugauccaacuggcc

SEQ ID NO: 1320388 - RNA, 20 nt, Mycobacterium tuberculosis H37Rv
ccuguccugcgggaggcagc

SEQ ID NO: 1320389 - RNA, 22 nt, Mycobacterium tuberculosis H37Rv
ccuguccugcgggaggcagcgu

SEQ ID NO: 1320390 - RNA, 23 nt, Mycobacterium tuberculosis H37Rv
ccugucgaccgccacguaauucc

SEQ ID NO: 1320391 - RNA, 21 nt, Mycobacterium tuberculosis H37Rv
ccugucauguccugggccgcc

SEQ ID NO: 1320392 - RNA, 13 nt, Mycobacterium tuberculosis H37Rv
ccuguccacccag

SEQ ID NO: 1320393 - RNA, 17 nt, Mycobacterium tuberculosis H37Rv
ccugucccgcacccggc

SEQ ID NO: 1320394 - RNA, 14 nt, Mycobacterium tuberculosis H37Rv
ccuguaugccgcgg

SEQ ID NO: 1320395 - RNA, 17 nt, Mycobacterium tuberculosis H37Rv
ccugggcugccggccag

SEQ ID NO: 1320396 - RNA, 19 nt, Mycobacterium tuberculosis H37Rv
ccugggcgcgcuggcgggc

SEQ ID NO: 1320397 - RNA, 12 nt, Mycobacterium tuberculosis H37Rv
ccugggcgcgcu

SEQ ID NO: 1320398 - RNA, 12 nt, Mycobacterium tuberculosis H37Rv
ccuggggcagcc

SEQ ID NO: 1320399 - RNA, 19 nt, Mycobacterium tuberculosis H37Rv
ccuggggccaccagaacca

SEQ ID NO: 1320400 - RNA, 14 nt, Mycobacterium tuberculosis H37Rv
ccuggguggcgucg

SEQ ID NO: 1320401 - RNA, 18 nt, Mycobacterium tuberculosis H37Rv
ccuggguugugccgcccu

SEQ ID NO: 1320402 - RNA, 16 nt, Mycobacterium tuberculosis H37Rv
ccugguaaggccggcc

SEQ ID NO: 1320403 - RNA, 17 nt, Mycobacterium tuberculosis H37Rv
ccugguaaggccggccg

SEQ ID NO: 1320404 - RNA, 18 nt, Mycobacterium tuberculosis H37Rv
ccugguaaggccggccgg

SEQ ID NO: 1320405 - RNA, 14 nt, Mycobacterium tuberculosis H37Rv
ccugguacucccgc

SEQ ID NO: 1320406 - RNA, 14 nt, Mycobacterium tuberculosis H37Rv
ccugguagucgccc

SEQ ID NO: 1320407 - RNA, 21 nt, Mycobacterium tuberculosis H37Rv
ccugguaugccgcccgcagcg

SEQ ID NO: 1320408 - RNA, 17 nt, Mycobacterium tuberculosis H37Rv
ccuggucaccagccacc

SEQ ID NO: 1320409 - RNA, 19 nt, Mycobacterium tuberculosis H37Rv
ccugcucgggggccgacca

SEQ ID NO: 1320410 - RNA, 16 nt, Mycobacterium tuberculosis H37Rv
ccuggacgucggcgau

SEQ ID NO: 1320411 - RNA, 15 nt, Mycobacterium tuberculosis H37Rv
ccugcugagccgucg

SEQ ID NO: 1320412 - RNA, 19 nt, Mycobacterium tuberculosis H37Rv
ccuggaucagccaguugau

SEQ ID NO: 1320413 - RNA, 17 nt, Mycobacterium tuberculosis H37Rv
ccuggcguagugcagcu

SEQ ID NO: 1320414 - RNA, 15 nt, Mycobacterium tuberculosis H37Rv
ccuggcgugucgccg

SEQ ID NO: 1320415 - RNA, 15 nt, Mycobacterium tuberculosis H37Rv
ccugggccgccgccc

SEQ ID NO: 1320416 - RNA, 16 nt, Mycobacterium tuberculosis H37Rv
ccugggccgccgcccu

SEQ ID NO: 1320417 - RNA, 21 nt, Mycobacterium tuberculosis H37Rv
ccuggcggcgccgcagaucac

SEQ ID NO: 1320418 - RNA, 13 nt, Mycobacterium tuberculosis H37Rv
ccuggcggcccgg

SEQ ID NO: 1320419 - RNA, 12 nt, Mycobacterium tuberculosis H37Rv
ccuggcgggcgc

SEQ ID NO: 1320420 - RNA, 18 nt, Mycobacterium tuberculosis H37Rv
ccuggcguagugcagcug

SEQ ID NO: 1320421 - RNA, 13 nt, Mycobacterium tuberculosis H37Rv
ccuggcggucccg

SEQ ID NO: 1320422 - RNA, 15 nt, Mycobacterium tuberculosis H37Rv
ccuggcaacgacacg

SEQ ID NO: 1320423 - RNA, 13 nt, Mycobacterium tuberculosis H37Rv
ccuggauggcgcc

SEQ ID NO: 1320424 - RNA, 15 nt, Mycobacterium tuberculosis H37Rv
ccuggcaccucgccc

SEQ ID NO: 1320425 - RNA, 18 nt, Mycobacterium tuberculosis H37Rv
ccuggcaccucgcccucc

SEQ ID NO: 1320426 - RNA, 19 nt, Mycobacterium tuberculosis H37Rv
ccuggcaccucgcccuccc

SEQ ID NO: 1320427 - RNA, 22 nt, Mycobacterium tuberculosis H37Rv
ccuggcagacgcccuugccuug

SEQ ID NO: 1320428 - RNA, 16 nt, Mycobacterium tuberculosis H37Rv
ccuggcggcgccgcag

SEQ ID NO: 1320429 - RNA, 14 nt, Mycobacterium tuberculosis H37Rv
cgagcaacgccacc

SEQ ID NO: 1320430 - RNA, 21 nt, Mycobacterium tuberculosis H37Rv
cgagcaacucguccagcagug

SEQ ID NO: 1320431 - RNA, 15 nt, Mycobacterium tuberculosis H37Rv
cgagcaaggggaucu

SEQ ID NO: 1320432 - RNA, 19 nt, Mycobacterium tuberculosis H37Rv
cgagcaaacauccacccgc

SEQ ID NO: 1320433 - RNA, 14 nt, Mycobacterium tuberculosis H37Rv
cgagcacgccaacg

SEQ ID NO: 1320434 - RNA, 23 nt, Mycobacterium tuberculosis H37Rv
cgagcacgggacuucgugccucg

SEQ ID NO: 1320435 - RNA, 14 nt, Mycobacterium tuberculosis H37Rv
cgagcacucggcca

SEQ ID NO: 1320436 - RNA, 14 nt, Mycobacterium tuberculosis H37Rv
cgagcacguccucg

SEQ ID NO: 1320437 - RNA, 20 nt, Mycobacterium tuberculosis H37Rv
cgagcacuccggagcccaca

SEQ ID NO: 1320438 - RNA, 17 nt, Mycobacterium tuberculosis H37Rv
cgagcaccucggccucg

SEQ ID NO: 1320439 - RNA, 22 nt, Mycobacterium tuberculosis H37Rv
cgagcaccuugcgauugcgcac

SEQ ID NO: 1320440 - RNA, 18 nt, Mycobacterium tuberculosis H37Rv
cgagcacaggaucaccca

SEQ ID NO: 1320441 - RNA, 15 nt, Mycobacterium tuberculosis H37Rv
cgagcaccccagggg

SEQ ID NO: 1320442 - RNA, 13 nt, Mycobacterium tuberculosis H37Rv
cgagcacccgcug

SEQ ID NO: 1320443 - RNA, 14 nt, Mycobacterium tuberculosis H37Rv
cgagcagcccggcg

SEQ ID NO: 1320444 - RNA, 18 nt, Mycobacterium tuberculosis H37Rv
cgagcagcagaaacggcg

SEQ ID NO: 1320445 - RNA, 13 nt, Mycobacterium tuberculosis H37Rv
cgagcagcaggua

SEQ ID NO: 1320446 - RNA, 14 nt, Mycobacterium tuberculosis H37Rv
cgagcagcuacagc

SEQ ID NO: 1320447 - RNA, 21 nt, Mycobacterium tuberculosis H37Rv
cgagcagcuagcccggcagca

SEQ ID NO: 1320448 - RNA, 20 nt, Mycobacterium tuberculosis H37Rv
cgagcagauacuccgcgguu

SEQ ID NO: 1320449 - RNA, 18 nt, Mycobacterium tuberculosis H37Rv
cgagcagauacuuguuga

SEQ ID NO: 1320450 - RNA, 14 nt, Mycobacterium tuberculosis H37Rv
cgagcagaggauca

SEQ ID NO: 1320451 - RNA, 20 nt, Mycobacterium tuberculosis H37Rv
cgagcagacacuaaagcccu

SEQ ID NO: 1320452 - RNA, 15 nt, Mycobacterium tuberculosis H37Rv
cgagcagacgcagaa

SEQ ID NO: 1320453 - RNA, 14 nt, Mycobacterium tuberculosis H37Rv
cgagcagacgccgc

SEQ ID NO: 1320454 - RNA, 22 nt, Mycobacterium tuberculosis H37Rv
cgagcccgccggccucuggauc

SEQ ID NO: 1320455 - RNA, 20 nt, Mycobacterium tuberculosis H37Rv
cgagcccgccacagccccag

SEQ ID NO: 1320456 - RNA, 22 nt, Mycobacterium tuberculosis H37Rv
cgagccgaccaccccgagcggc

SEQ ID NO: 1320457 - RNA, 17 nt, Mycobacterium tuberculosis H37Rv
cgagcccgccagcgccg

SEQ ID NO: 1320458 - RNA, 14 nt, Mycobacterium tuberculosis H37Rv
cgagcccguccucg

SEQ ID NO: 1320459 - RNA, 14 nt, Mycobacterium tuberculosis H37Rv
cgagccagcggagc

SEQ ID NO: 1320460 - RNA, 13 nt, Mycobacterium tuberculosis H37Rv
cgagccagcuccg

SEQ ID NO: 1320461 - RNA, 21 nt, Mycobacterium tuberculosis H37Rv
cgagccagcugcuccacccga

SEQ ID NO: 1320462 - RNA, 14 nt, Mycobacterium tuberculosis H37Rv
cgagccacgccagc

SEQ ID NO: 1320463 - RNA, 16 nt, Mycobacterium tuberculosis H37Rv
cgagcccagccgggca

SEQ ID NO: 1320464 - RNA, 14 nt, Mycobacterium tuberculosis H37Rv
cgagcccaccuggg

SEQ ID NO: 1320465 - RNA, 20 nt, Mycobacterium tuberculosis H37Rv
cgagccaucgucgagcgcga

SEQ ID NO: 1320466 - RNA, 19 nt, Mycobacterium tuberculosis H37Rv
cgagcccagcgccuccagc

SEQ ID NO: 1320467 - RNA, 15 nt, Mycobacterium tuberculosis H37Rv
cgagcccagcgccuc

SEQ ID NO: 1320468 - RNA, 22 nt, Mycobacterium tuberculosis H37Rv
cgagcaucaacgaaccagcuug

SEQ ID NO: 1320469 - RNA, 20 nt, Mycobacterium tuberculosis H37Rv
cgagcaucaauugaguagau

SEQ ID NO: 1320470 - RNA, 13 nt, Mycobacterium tuberculosis H37Rv
cgagcaggcuggc

SEQ ID NO: 1320471 - RNA, 16 nt, Mycobacterium tuberculosis H37Rv
cgagcagggcgucgac

SEQ ID NO: 1320472 - RNA, 17 nt, Mycobacterium tuberculosis H37Rv
cgagcaggggaguugcu

SEQ ID NO: 1320473 - RNA, 20 nt, Mycobacterium tuberculosis H37Rv
cgagccaacuccacccaacg

SEQ ID NO: 1320474 - RNA, 13 nt, Mycobacterium tuberculosis H37Rv
cgagccaacgcau

SEQ ID NO: 1320475 - RNA, 14 nt, Mycobacterium tuberculosis H37Rv
cgagcaugcccagc

SEQ ID NO: 1320476 - RNA, 19 nt, Mycobacterium tuberculosis H37Rv
cgagauacggccaccaggu

SEQ ID NO: 1320477 - RNA, 13 nt, Mycobacterium tuberculosis H37Rv
cgagauacggcca

SEQ ID NO: 1320478 - RNA, 16 nt, Mycobacterium tuberculosis H37Rv
cgagaggagggcggcc

SEQ ID NO: 1320479 - RNA, 22 nt, Mycobacterium tuberculosis H37Rv
cgagagccccgaccagcagacc

SEQ ID NO: 1320480 - RNA, 14 nt, Mycobacterium tuberculosis H37Rv
cgagagcagccagc

SEQ ID NO: 1320481 - RNA, 19 nt, Mycobacterium tuberculosis H37Rv
cgagagcagccagccaccg

SEQ ID NO: 1320482 - RNA, 13 nt, Mycobacterium tuberculosis H37Rv
cgagaugccgcga

SEQ ID NO: 1320483 - RNA, 22 nt, Mycobacterium tuberculosis H37Rv
cgagauggaauggcugagcccg

SEQ ID NO: 1320484 - RNA, 22 nt, Mycobacterium tuberculosis H37Rv
cgagaugccgcgaucgugcagg

SEQ ID NO: 1320485 - RNA, 20 nt, Mycobacterium tuberculosis H37Rv
cgagaugccgcgaucgugca

SEQ ID NO: 1320486 - RNA, 16 nt, Mycobacterium tuberculosis H37Rv
cgagaucgccgagcag

SEQ ID NO: 1320487 - RNA, 24 nt, Mycobacterium tuberculosis H37Rv
cgagaucccagcgggacaaaauca

SEQ ID NO: 1320488 - RNA, 17 nt, Mycobacterium tuberculosis H37Rv
cgagaccaacgcgcagg

SEQ ID NO: 1320489 - RNA, 16 nt, Mycobacterium tuberculosis H37Rv
cgagaccgccgcugcc

SEQ ID NO: 1320490 - RNA, 20 nt, Mycobacterium tuberculosis H37Rv
cgagaccgcgagcagcacag

SEQ ID NO: 1320491 - RNA, 14 nt, Mycobacterium tuberculosis H37Rv
cgagacggccacgu

SEQ ID NO: 1320492 - RNA, 21 nt, Mycobacterium tuberculosis H37Rv
cgagaagcguugcacugcugg

SEQ ID NO: 1320493 - RNA, 14 nt, Mycobacterium tuberculosis H37Rv
cgagaagcugugcc

SEQ ID NO: 1320494 - RNA, 18 nt, Mycobacterium tuberculosis H37Rv
cgagaacccacgcaugca

SEQ ID NO: 1320495 - RNA, 21 nt, Mycobacterium tuberculosis H37Rv
cgagaagaucucguagccgcc

SEQ ID NO: 1320496 - RNA, 20 nt, Mycobacterium tuberculosis H37Rv
cgagaaacacgacagccagu

SEQ ID NO: 1320497 - RNA, 18 nt, Mycobacterium tuberculosis H37Rv
cgagaacaccggccaaca

SEQ ID NO: 1320498 - RNA, 16 nt, Mycobacterium tuberculosis H37Rv
cgacggcgucacccgc

SEQ ID NO: 1320499 - RNA, 19 nt, Mycobacterium tuberculosis H37Rv
cgacgggcacccgagccgc

SEQ ID NO: 1320500 - RNA, 16 nt, Mycobacterium tuberculosis H37Rv
cgacggcggccgcgau

SEQ ID NO: 1320501 - RNA, 18 nt, Mycobacterium tuberculosis H37Rv
cgacggcgcucggcgagc

SEQ ID NO: 1320502 - RNA, 15 nt, Mycobacterium tuberculosis H37Rv
cgacggcgauggcgc

SEQ ID NO: 1320503 - RNA, 23 nt, Mycobacterium tuberculosis H37Rv
cgacggccuggggcagccgggcg

SEQ ID NO: 1320504 - RNA, 14 nt, Mycobacterium tuberculosis H37Rv
cgacggcgccggca

SEQ ID NO: 1320505 - RNA, 14 nt, Mycobacterium tuberculosis H37Rv
cgacggcgccgcuc

SEQ ID NO: 1320506 - RNA, 15 nt, Mycobacterium tuberculosis H37Rv
cgacgucgccggacg

SEQ ID NO: 1320507 - RNA, 14 nt, Mycobacterium tuberculosis H37Rv
cgacgucgcggcgc

SEQ ID NO: 1320508 - RNA, 14 nt, Mycobacterium tuberculosis H37Rv
cgacgucgccgccg

SEQ ID NO: 1320509 - RNA, 15 nt, Mycobacterium tuberculosis H37Rv
cgacgucgccgccgc

SEQ ID NO: 1320510 - RNA, 24 nt, Mycobacterium tuberculosis H37Rv
cgacguccucgacgaucagcacgu

SEQ ID NO: 1320511 - RNA, 18 nt, Mycobacterium tuberculosis H37Rv
cgacguaguugccggcuu

SEQ ID NO: 1320512 - RNA, 21 nt, Mycobacterium tuberculosis H37Rv
cgacguauaccgcacccuggg

SEQ ID NO: 1320513 - RNA, 20 nt, Mycobacterium tuberculosis H37Rv
cgacguaguggaagccgacc

SEQ ID NO: 1320514 - RNA, 13 nt, Mycobacterium tuberculosis H37Rv
cgacgucagggua

SEQ ID NO: 1320515 - RNA, 17 nt, Mycobacterium tuberculosis H37Rv
cgacgucaucgccgacc

SEQ ID NO: 1320516 - RNA, 16 nt, Mycobacterium tuberculosis H37Rv
cgacgggggucgggcg

SEQ ID NO: 1320517 - RNA, 18 nt, Mycobacterium tuberculosis H37Rv
cgacggugaccggaucca

SEQ ID NO: 1320518 - RNA, 22 nt, Mycobacterium tuberculosis H37Rv
cgacgguuacccagccgugcuu

SEQ ID NO: 1320519 - RNA, 15 nt, Mycobacterium tuberculosis H37Rv
cgacgcucgcugcag

SEQ ID NO: 1320520 - RNA, 17 nt, Mycobacterium tuberculosis H37Rv
cgacgcgucgccggccg

SEQ ID NO: 1320521 - RNA, 20 nt, Mycobacterium tuberculosis H37Rv
cgacgcggccagcggcaagg

SEQ ID NO: 1320522 - RNA, 16 nt, Mycobacterium tuberculosis H37Rv
cgacgcggccggccgc

SEQ ID NO: 1320523 - RNA, 17 nt, Mycobacterium tuberculosis H37Rv
cgacgcguagcacggcg

SEQ ID NO: 1320524 - RNA, 22 nt, Mycobacterium tuberculosis H37Rv
cgacgcgcucgggcgagaucuu

SEQ ID NO: 1320525 - RNA, 18 nt, Mycobacterium tuberculosis H37Rv
cgacgcgcccgcgcgcuc

SEQ ID NO: 1320526 - RNA, 17 nt, Mycobacterium tuberculosis H37Rv
cgacgccuugucggcgu

SEQ ID NO: 1320527 - RNA, 15 nt, Mycobacterium tuberculosis H37Rv
cgacgcgacacacgc

SEQ ID NO: 1320528 - RNA, 18 nt, Mycobacterium tuberculosis H37Rv
cgacgcgauggccgccag

SEQ ID NO: 1320529 - RNA, 23 nt, Mycobacterium tuberculosis H37Rv
cgacggcaagcgcaucgcacagc

SEQ ID NO: 1320530 - RNA, 15 nt, Mycobacterium tuberculosis H37Rv
cgacgcugccgccag

SEQ ID NO: 1320531 - RNA, 16 nt, Mycobacterium tuberculosis H37Rv
cgacggccagugcgca

SEQ ID NO: 1320532 - RNA, 14 nt, Mycobacterium tuberculosis H37Rv
cgacggccagccca

SEQ ID NO: 1320533 - RNA, 12 nt, Mycobacterium tuberculosis H37Rv
cgacggccaccc

SEQ ID NO: 1320534 - RNA, 13 nt, Mycobacterium tuberculosis H37Rv
cgacggccacccc

SEQ ID NO: 1320535 - RNA, 19 nt, Mycobacterium tuberculosis H37Rv
cgacggccaucgugcggca

SEQ ID NO: 1320536 - RNA, 15 nt, Mycobacterium tuberculosis H37Rv
cgacggccggcaagc

SEQ ID NO: 1320537 - RNA, 14 nt, Mycobacterium tuberculosis H37Rv
cgacggccgcggcg

SEQ ID NO: 1320538 - RNA, 14 nt, Mycobacterium tuberculosis H37Rv
cgacggcccgccgu

SEQ ID NO: 1320539 - RNA, 13 nt, Mycobacterium tuberculosis H37Rv
cgacggccaagau

SEQ ID NO: 1320540 - RNA, 20 nt, Mycobacterium tuberculosis H37Rv
cgacggcauguaccgaccgc

SEQ ID NO: 1320541 - RNA, 13 nt, Mycobacterium tuberculosis H37Rv
cgacggccagcag

SEQ ID NO: 1320542 - RNA, 19 nt, Mycobacterium tuberculosis H37Rv
cgacugacgaguccgugga

SEQ ID NO: 1320543 - RNA, 17 nt, Mycobacterium tuberculosis H37Rv
cgacugagaucgcuucc

SEQ ID NO: 1320544 - RNA, 13 nt, Mycobacterium tuberculosis H37Rv
cgacugccagcgc

SEQ ID NO: 1320545 - RNA, 17 nt, Mycobacterium tuberculosis H37Rv
cgacuggccccgccagc

SEQ ID NO: 1320546 - RNA, 17 nt, Mycobacterium tuberculosis H37Rv
cgacugcgucggcggcu

SEQ ID NO: 1320547 - RNA, 16 nt, Mycobacterium tuberculosis H37Rv
cgacugucccagcucc

SEQ ID NO: 1320548 - RNA, 16 nt, Mycobacterium tuberculosis H37Rv
cgacugucccgcgcaa

SEQ ID NO: 1320549 - RNA, 18 nt, Mycobacterium tuberculosis H37Rv
cgacuggcgcccagccgg

SEQ ID NO: 1320550 - RNA, 23 nt, Mycobacterium tuberculosis H37Rv
cgacuuugagucguuggacggca

SEQ ID NO: 1320551 - RNA, 20 nt, Mycobacterium tuberculosis H37Rv
cgacuugccuagcgcgggcu

SEQ ID NO: 1320552 - RNA, 13 nt, Mycobacterium tuberculosis H37Rv
cgacuuggcaucg

SEQ ID NO: 1320553 - RNA, 17 nt, Mycobacterium tuberculosis H37Rv
cgacuucuccaggcuga

SEQ ID NO: 1320554 - RNA, 14 nt, Mycobacterium tuberculosis H37Rv
cgacuucgcccggg

SEQ ID NO: 1320555 - RNA, 17 nt, Mycobacterium tuberculosis H37Rv
cgacuagacgccgccgc

SEQ ID NO: 1320556 - RNA, 19 nt, Mycobacterium tuberculosis H37Rv
cgacuagacgccgccgcug

SEQ ID NO: 1320557 - RNA, 13 nt, Mycobacterium tuberculosis H37Rv
cgacucacacacc

SEQ ID NO: 1320558 - RNA, 16 nt, Mycobacterium tuberculosis H37Rv
cgacucacccacccgc

SEQ ID NO: 1320559 - RNA, 22 nt, Mycobacterium tuberculosis H37Rv
cgacuccagcaccagcacggca

SEQ ID NO: 1320560 - RNA, 17 nt, Mycobacterium tuberculosis H37Rv
cgacucaguucugcaca

SEQ ID NO: 1320561 - RNA, 16 nt, Mycobacterium tuberculosis H37Rv
cgacucgugucugccu

SEQ ID NO: 1320562 - RNA, 18 nt, Mycobacterium tuberculosis H37Rv
cgacucgugucugccucg

SEQ ID NO: 1320563 - RNA, 21 nt, Mycobacterium tuberculosis H37Rv
cgacuccagcaccagcacggc

SEQ ID NO: 1320564 - RNA, 18 nt, Mycobacterium tuberculosis H37Rv
cgacucggccgugaccga

SEQ ID NO: 1320565 - RNA, 19 nt, Mycobacterium tuberculosis H37Rv
cgacucgccacauuucacc

SEQ ID NO: 1320566 - RNA, 15 nt, Mycobacterium tuberculosis H37Rv
cgacguuccagcagu

SEQ ID NO: 1320567 - RNA, 22 nt, Mycobacterium tuberculosis H37Rv
cgacgucugccaggcgcagcug

SEQ ID NO: 1320568 - RNA, 12 nt, Mycobacterium tuberculosis H37Rv
cgacgucugccc

SEQ ID NO: 1320569 - RNA, 18 nt, Mycobacterium tuberculosis H37Rv
cgacgucgggaacuucuc

SEQ ID NO: 1320570 - RNA, 12 nt, Mycobacterium tuberculosis H37Rv
cgacgucugcca

SEQ ID NO: 1320571 - RNA, 18 nt, Mycobacterium tuberculosis H37Rv
cgacguucuuguccagga

SEQ ID NO: 1320572 - RNA, 17 nt, Mycobacterium tuberculosis H37Rv
cgaggcauucucccggu

SEQ ID NO: 1320573 - RNA, 23 nt, Mycobacterium tuberculosis H37Rv
cgaggccaaguugcagcgggcca

SEQ ID NO: 1320574 - RNA, 12 nt, Mycobacterium tuberculosis H37Rv
cgaggccagcgg

SEQ ID NO: 1320575 - RNA, 21 nt, Mycobacterium tuberculosis H37Rv
cgaggccagcagcugcuccag

SEQ ID NO: 1320576 - RNA, 17 nt, Mycobacterium tuberculosis H37Rv
cgaggccgcugccaggg

SEQ ID NO: 1320577 - RNA, 21 nt, Mycobacterium tuberculosis H37Rv
cgaggcagcgucgucgacgac

SEQ ID NO: 1320578 - RNA, 17 nt, Mycobacterium tuberculosis H37Rv
cgaggcagcacccgcac

SEQ ID NO: 1320579 - RNA, 16 nt, Mycobacterium tuberculosis H37Rv
cgaggcacccgugccg

SEQ ID NO: 1320580 - RNA, 20 nt, Mycobacterium tuberculosis H37Rv
cgaggcacaaucaccgccgc

SEQ ID NO: 1320581 - RNA, 22 nt, Mycobacterium tuberculosis H37Rv
cgaggcacaaucaccgccgcga

SEQ ID NO: 1320582 - RNA, 14 nt, Mycobacterium tuberculosis H37Rv
cgaggcaacaagca

SEQ ID NO: 1320583 - RNA, 15 nt, Mycobacterium tuberculosis H37Rv
cgaggauguugugcc

SEQ ID NO: 1320584 - RNA, 17 nt, Mycobacterium tuberculosis H37Rv
cgaggaugccgaaccgc

SEQ ID NO: 1320585 - RNA, 20 nt, Mycobacterium tuberculosis H37Rv
cgaggaugcugagcgccagg

SEQ ID NO: 1320586 - RNA, 21 nt, Mycobacterium tuberculosis H37Rv
cgaggcgggcagaagaguguc

SEQ ID NO: 1320587 - RNA, 17 nt, Mycobacterium tuberculosis H37Rv
cgaggcggguacaccac

SEQ ID NO: 1320588 - RNA, 20 nt, Mycobacterium tuberculosis H37Rv
cgaggccacgccagcucgcc

SEQ ID NO: 1320589 - RNA, 23 nt, Mycobacterium tuberculosis H37Rv
cgaggccgcugccagggugcgcc

SEQ ID NO: 1320590 - RNA, 21 nt, Mycobacterium tuberculosis H37Rv
cgaggcgacgucguucuuugu

SEQ ID NO: 1320591 - RNA, 14 nt, Mycobacterium tuberculosis H37Rv
cgaggcuggcaucc

SEQ ID NO: 1320592 - RNA, 22 nt, Mycobacterium tuberculosis H37Rv
cgaggcuggcaucccgggcagu

SEQ ID NO: 1320593 - RNA, 19 nt, Mycobacterium tuberculosis H37Rv
cgaggcucccccaccaggg

SEQ ID NO: 1320594 - RNA, 21 nt, Mycobacterium tuberculosis H37Rv
cgaggcgucaccccggucccg

SEQ ID NO: 1320595 - RNA, 19 nt, Mycobacterium tuberculosis H37Rv
cgaggaccugcucgggcgu

SEQ ID NO: 1320596 - RNA, 15 nt, Mycobacterium tuberculosis H37Rv
cgaggacggcggcca

SEQ ID NO: 1320597 - RNA, 17 nt, Mycobacterium tuberculosis H37Rv
cgaggacuggaaagcag

SEQ ID NO: 1320598 - RNA, 22 nt, Mycobacterium tuberculosis H37Rv
cgaggacuggaaagcagcagcg

SEQ ID NO: 1320599 - RNA, 21 nt, Mycobacterium tuberculosis H37Rv
cgaggaauuccgcuaccgcac

SEQ ID NO: 1320600 - RNA, 22 nt, Mycobacterium tuberculosis H37Rv
cgaggaaggagccaagggcugu

SEQ ID NO: 1320601 - RNA, 19 nt, Mycobacterium tuberculosis H37Rv
cgaggaucccgcugcacga

SEQ ID NO: 1320602 - RNA, 16 nt, Mycobacterium tuberculosis H37Rv
cgaggauccauuggaa

SEQ ID NO: 1320603 - RNA, 18 nt, Mycobacterium tuberculosis H37Rv
cgaggaguuggugcagcg

SEQ ID NO: 1320604 - RNA, 12 nt, Mycobacterium tuberculosis H37Rv
cgaggagcccgg

SEQ ID NO: 1320605 - RNA, 14 nt, Mycobacterium tuberculosis H37Rv
cgagcuuggccgcc

SEQ ID NO: 1320606 - RNA, 18 nt, Mycobacterium tuberculosis H37Rv
cgagcuggcgcgcggggu

SEQ ID NO: 1320607 - RNA, 14 nt, Mycobacterium tuberculosis H37Rv
cgaggaacgccggg

SEQ ID NO: 1320608 - RNA, 16 nt, Mycobacterium tuberculosis H37Rv
cgaggaacucggaccc

SEQ ID NO: 1320609 - RNA, 24 nt, Mycobacterium tuberculosis H37Rv
cgaggaacuggaccggugccagca

SEQ ID NO: 1320610 - RNA, 23 nt, Mycobacterium tuberculosis H37Rv
cgagcggcaucggucaccgcggc

SEQ ID NO: 1320611 - RNA, 17 nt, Mycobacterium tuberculosis H37Rv
cgagcgcuugaccccgc

SEQ ID NO: 1320612 - RNA, 16 nt, Mycobacterium tuberculosis H37Rv
cgagcgcuguggccca

SEQ ID NO: 1320613 - RNA, 19 nt, Mycobacterium tuberculosis H37Rv
cgagcgcuaucaccgccuc

SEQ ID NO: 1320614 - RNA, 22 nt, Mycobacterium tuberculosis H37Rv
cgagcgcgucggucaccgaacg

SEQ ID NO: 1320615 - RNA, 20 nt, Mycobacterium tuberculosis H37Rv
cgagcgcggugccgccaccg

SEQ ID NO: 1320616 - RNA, 17 nt, Mycobacterium tuberculosis H37Rv
cgagcgggaucgggccc

SEQ ID NO: 1320617 - RNA, 16 nt, Mycobacterium tuberculosis H37Rv
cgagcggccuccagca

SEQ ID NO: 1320618 - RNA, 19 nt, Mycobacterium tuberculosis H37Rv
cgagcggccuccagcaccc

SEQ ID NO: 1320619 - RNA, 14 nt, Mycobacterium tuberculosis H37Rv
cgagcggcugaggc

SEQ ID NO: 1320620 - RNA, 15 nt, Mycobacterium tuberculosis H37Rv
cgagcggcugaggcu

SEQ ID NO: 1320621 - RNA, 17 nt, Mycobacterium tuberculosis H37Rv
cgagcggcuucagcacg

SEQ ID NO: 1320622 - RNA, 22 nt, Mycobacterium tuberculosis H37Rv
cgagcguaaugcugcugcagca

SEQ ID NO: 1320623 - RNA, 15 nt, Mycobacterium tuberculosis H37Rv
cgagcggugccggcg

SEQ ID NO: 1320624 - RNA, 17 nt, Mycobacterium tuberculosis H37Rv
cgagcgucgggcacauc

SEQ ID NO: 1320625 - RNA, 14 nt, Mycobacterium tuberculosis H37Rv
cgagcucggcgccc

SEQ ID NO: 1320626 - RNA, 21 nt, Mycobacterium tuberculosis H37Rv
cgagcucggcgaacggcacca

SEQ ID NO: 1320627 - RNA, 17 nt, Mycobacterium tuberculosis H37Rv
cgagcucggucaccacg

SEQ ID NO: 1320628 - RNA, 17 nt, Mycobacterium tuberculosis H37Rv
cgagcugagcggccagc

SEQ ID NO: 1320629 - RNA, 12 nt, Mycobacterium tuberculosis H37Rv
cgagcugccagg

SEQ ID NO: 1320630 - RNA, 18 nt, Mycobacterium tuberculosis H37Rv
cgagcugccgucgcugcc

SEQ ID NO: 1320631 - RNA, 13 nt, Mycobacterium tuberculosis H37Rv
cgagcugcggguc

SEQ ID NO: 1320632 - RNA, 17 nt, Mycobacterium tuberculosis H37Rv
cgagcucaccaaggucg

SEQ ID NO: 1320633 - RNA, 16 nt, Mycobacterium tuberculosis H37Rv
cgagcucgaagcccgg

SEQ ID NO: 1320634 - RNA, 18 nt, Mycobacterium tuberculosis H37Rv
cgagcucgaagcccggac

SEQ ID NO: 1320635 - RNA, 19 nt, Mycobacterium tuberculosis H37Rv
cgagcgcaccgcugaccgc

SEQ ID NO: 1320636 - RNA, 17 nt, Mycobacterium tuberculosis H37Rv
cgagcgcaccgcugacc

SEQ ID NO: 1320637 - RNA, 20 nt, Mycobacterium tuberculosis H37Rv
cgagcgcacuggggaggcca

SEQ ID NO: 1320638 - RNA, 23 nt, Mycobacterium tuberculosis H37Rv
cgagcgcauguugcaggcgcagc

SEQ ID NO: 1320639 - RNA, 17 nt, Mycobacterium tuberculosis H37Rv
cgagcgcacaccggcuu

SEQ ID NO: 1320640 - RNA, 14 nt, Mycobacterium tuberculosis H37Rv
cgagcgagccaacu

SEQ ID NO: 1320641 - RNA, 15 nt, Mycobacterium tuberculosis H37Rv
cgagcgcccgcagcg

SEQ ID NO: 1320642 - RNA, 18 nt, Mycobacterium tuberculosis H37Rv
cgagcgcccgcagcgcuu

SEQ ID NO: 1320643 - RNA, 20 nt, Mycobacterium tuberculosis H37Rv
cgagcgcccgcagcgcuucc

SEQ ID NO: 1320644 - RNA, 15 nt, Mycobacterium tuberculosis H37Rv
cgagcgcgccggcca

SEQ ID NO: 1320645 - RNA, 14 nt, Mycobacterium tuberculosis H37Rv
cgagcgcgccuuca

SEQ ID NO: 1320646 - RNA, 18 nt, Mycobacterium tuberculosis H37Rv
cgagcgcggugccgccac

SEQ ID NO: 1320647 - RNA, 17 nt, Mycobacterium tuberculosis H37Rv
cgagcgcgaucgggccg

SEQ ID NO: 1320648 - RNA, 17 nt, Mycobacterium tuberculosis H37Rv
cgagcgcgccgaaggcg

SEQ ID NO: 1320649 - RNA, 17 nt, Mycobacterium tuberculosis H37Rv
cgagcgaccgucccagc

SEQ ID NO: 1320650 - RNA, 21 nt, Mycobacterium tuberculosis H37Rv
cgagcgaccgucccagcgccg

SEQ ID NO: 1320651 - RNA, 14 nt, Mycobacterium tuberculosis H37Rv
cgagccucgcgcgc

SEQ ID NO: 1320652 - RNA, 16 nt, Mycobacterium tuberculosis H37Rv
cgagccucgcgcgcca

SEQ ID NO: 1320653 - RNA, 20 nt, Mycobacterium tuberculosis H37Rv
cgagccugauaaagcccggc

SEQ ID NO: 1320654 - RNA, 23 nt, Mycobacterium tuberculosis H37Rv
cgagccugauaaagcccggcggc

SEQ ID NO: 1320655 - RNA, 18 nt, Mycobacterium tuberculosis H37Rv
cgagccgguggcgugggc

SEQ ID NO: 1320656 - RNA, 19 nt, Mycobacterium tuberculosis H37Rv
cgagccggugccacugccg

SEQ ID NO: 1320657 - RNA, 14 nt, Mycobacterium tuberculosis H37Rv
cgagccgcccgccc

SEQ ID NO: 1320658 - RNA, 14 nt, Mycobacterium tuberculosis H37Rv
cgagccgccaccgu

SEQ ID NO: 1320659 - RNA, 14 nt, Mycobacterium tuberculosis H37Rv
cgagccgcggcaac

SEQ ID NO: 1320660 - RNA, 21 nt, Mycobacterium tuberculosis H37Rv
cgagccgcggcaacaccaccu

SEQ ID NO: 1320661 - RNA, 13 nt, Mycobacterium tuberculosis H37Rv
cgagccggcgcgc

SEQ ID NO: 1320662 - RNA, 20 nt, Mycobacterium tuberculosis H37Rv
cgaggugagguugacccccg

SEQ ID NO: 1320663 - RNA, 19 nt, Mycobacterium tuberculosis H37Rv
cgaggugagguugaccccc

SEQ ID NO: 1320664 - RNA, 24 nt, Mycobacterium tuberculosis H37Rv
cgaggucccggccgagcguggcca

SEQ ID NO: 1320665 - RNA, 22 nt, Mycobacterium tuberculosis H37Rv
cgagguccucgagguccucguc

SEQ ID NO: 1320666 - RNA, 15 nt, Mycobacterium tuberculosis H37Rv
cgaggucgagcgccg

SEQ ID NO: 1320667 - RNA, 12 nt, Mycobacterium tuberculosis H37Rv
cgaggucggaga

SEQ ID NO: 1320668 - RNA, 23 nt, Mycobacterium tuberculosis H37Rv
cgaggucggccagcagcagugcc

SEQ ID NO: 1320669 - RNA, 14 nt, Mycobacterium tuberculosis H37Rv
cgagguggucgacc

SEQ ID NO: 1320670 - RNA, 15 nt, Mycobacterium tuberculosis H37Rv
cgagguggcgggcga

SEQ ID NO: 1320671 - RNA, 23 nt, Mycobacterium tuberculosis H37Rv
cgaggugcugcacacugccgcgc

SEQ ID NO: 1320672 - RNA, 16 nt, Mycobacterium tuberculosis H37Rv
cgagguugcgccgacc

SEQ ID NO: 1320673 - RNA, 13 nt, Mycobacterium tuberculosis H37Rv
cgagguugcgccg

SEQ ID NO: 1320674 - RNA, 19 nt, Mycobacterium tuberculosis H37Rv
cgagguugacgucaggcug

SEQ ID NO: 1320675 - RNA, 20 nt, Mycobacterium tuberculosis H37Rv
cgagguugacgucaggcuga

SEQ ID NO: 1320676 - RNA, 19 nt, Mycobacterium tuberculosis H37Rv
cgagggcaacggcacuagc

SEQ ID NO: 1320677 - RNA, 16 nt, Mycobacterium tuberculosis H37Rv
cgagggcaacggcacu

SEQ ID NO: 1320678 - RNA, 19 nt, Mycobacterium tuberculosis H37Rv
cgagggccacguagcagca

SEQ ID NO: 1320679 - RNA, 17 nt, Mycobacterium tuberculosis H37Rv
cgagggcuuuagugucu

SEQ ID NO: 1320680 - RNA, 15 nt, Mycobacterium tuberculosis H37Rv
cgagggcgggacccg

SEQ ID NO: 1320681 - RNA, 19 nt, Mycobacterium tuberculosis H37Rv
cgagggcggucagcggcca

SEQ ID NO: 1320682 - RNA, 19 nt, Mycobacterium tuberculosis H37Rv
cgagggcugacgggauggu

SEQ ID NO: 1320683 - RNA, 13 nt, Mycobacterium tuberculosis H37Rv
cgaggggcggcaa

SEQ ID NO: 1320684 - RNA, 19 nt, Mycobacterium tuberculosis H37Rv
cgagggggguguugaggcc

SEQ ID NO: 1320685 - RNA, 20 nt, Mycobacterium tuberculosis H37Rv
cgagggggguguugaggccg

SEQ ID NO: 1320686 - RNA, 23 nt, Mycobacterium tuberculosis H37Rv
cgagguauaaacgcggcgcgcug

SEQ ID NO: 1320687 - RNA, 21 nt, Mycobacterium tuberculosis H37Rv
cgagugggugaggccaaccac

SEQ ID NO: 1320688 - RNA, 16 nt, Mycobacterium tuberculosis H37Rv
cgagugccgccaccgc

SEQ ID NO: 1320689 - RNA, 21 nt, Mycobacterium tuberculosis H37Rv
cgagugcggacuucgccgccc

SEQ ID NO: 1320690 - RNA, 23 nt, Mycobacterium tuberculosis H37Rv
cgagugcggugugugcaagccga

SEQ ID NO: 1320691 - RNA, 17 nt, Mycobacterium tuberculosis H37Rv
cgaguccgcugcuucuc

SEQ ID NO: 1320692 - RNA, 15 nt, Mycobacterium tuberculosis H37Rv
cgagucgccagaccg

SEQ ID NO: 1320693 - RNA, 19 nt, Mycobacterium tuberculosis H37Rv
cgaguaccggccagccgcg

SEQ ID NO: 1320694 - RNA, 18 nt, Mycobacterium tuberculosis H37Rv
cgaguaggcgugggucca

SEQ ID NO: 1320695 - RNA, 14 nt, Mycobacterium tuberculosis H37Rv
cgaguccaggcagc

SEQ ID NO: 1320696 - RNA, 18 nt, Mycobacterium tuberculosis H37Rv
cgaguccccuuagcucca

SEQ ID NO: 1320697 - RNA, 14 nt, Mycobacterium tuberculosis H37Rv
cgaguccaccaccu

SEQ ID NO: 1320698 - RNA, 21 nt, Mycobacterium tuberculosis H37Rv
cgauaucguuggcgaccaccg

SEQ ID NO: 1320699 - RNA, 13 nt, Mycobacterium tuberculosis H37Rv
cgauauugggaua

SEQ ID NO: 1320700 - RNA, 20 nt, Mycobacterium tuberculosis H37Rv
cgauagucauucgcuccggu

SEQ ID NO: 1320701 - RNA, 15 nt, Mycobacterium tuberculosis H37Rv
cgauaggugaacgcu

SEQ ID NO: 1320702 - RNA, 16 nt, Mycobacterium tuberculosis H37Rv
cgauaucggcccccaa

SEQ ID NO: 1320703 - RNA, 15 nt, Mycobacterium tuberculosis H37Rv
cgauaucgggcucag

SEQ ID NO: 1320704 - RNA, 23 nt, Mycobacterium tuberculosis H37Rv
cgauagcggcccgaucaccagcc

SEQ ID NO: 1320705 - RNA, 17 nt, Mycobacterium tuberculosis H37Rv
cgauagcggauucacgc

SEQ ID NO: 1320706 - RNA, 13 nt, Mycobacterium tuberculosis H37Rv
cgauagcggcggc

SEQ ID NO: 1320707 - RNA, 23 nt, Mycobacterium tuberculosis H37Rv
cgaguugaacaauccgguguuga

SEQ ID NO: 1320708 - RNA, 12 nt, Mycobacterium tuberculosis H37Rv
cgaguuggccau

SEQ ID NO: 1320709 - RNA, 21 nt, Mycobacterium tuberculosis H37Rv
cgaguuggucguggcugugcg

SEQ ID NO: 1320710 - RNA, 17 nt, Mycobacterium tuberculosis H37Rv
cgaguuggcgaagcccg

SEQ ID NO: 1320711 - RNA, 15 nt, Mycobacterium tuberculosis H37Rv
cgaguuaggccgcca

SEQ ID NO: 1320712 - RNA, 17 nt, Mycobacterium tuberculosis H37Rv
cgaguuaggccgccagc

SEQ ID NO: 1320713 - RNA, 14 nt, Mycobacterium tuberculosis H37Rv
cgagugucagcaga

SEQ ID NO: 1320714 - RNA, 13 nt, Mycobacterium tuberculosis H37Rv
cgauaagcagcuc

SEQ ID NO: 1320715 - RNA, 17 nt, Mycobacterium tuberculosis H37Rv
cgauggcuaccccaggg

SEQ ID NO: 1320716 - RNA, 20 nt, Mycobacterium tuberculosis H37Rv
cgaugggccgguccggggca

SEQ ID NO: 1320717 - RNA, 18 nt, Mycobacterium tuberculosis H37Rv
cgaugggagcccggcggc

SEQ ID NO: 1320718 - RNA, 14 nt, Mycobacterium tuberculosis H37Rv
cgauggauggcguc

SEQ ID NO: 1320719 - RNA, 16 nt, Mycobacterium tuberculosis H37Rv
cgauggauccaaccgu

SEQ ID NO: 1320720 - RNA, 22 nt, Mycobacterium tuberculosis H37Rv
cgauggauuggcgucagcagca

SEQ ID NO: 1320721 - RNA, 23 nt, Mycobacterium tuberculosis H37Rv
cgaugcuuucguauucggccgcg

SEQ ID NO: 1320722 - RNA, 17 nt, Mycobacterium tuberculosis H37Rv
cgauguggcgcuccggc

SEQ ID NO: 1320723 - RNA, 15 nt, Mycobacterium tuberculosis H37Rv
cgaugugcccgccag

SEQ ID NO: 1320724 - RNA, 22 nt, Mycobacterium tuberculosis H37Rv
cgaugucggcucggcccccgag

SEQ ID NO: 1320725 - RNA, 19 nt, Mycobacterium tuberculosis H37Rv
cgaugugaaccgggcacca

SEQ ID NO: 1320726 - RNA, 21 nt, Mycobacterium tuberculosis H37Rv
cgaugucguuguacggggccg

SEQ ID NO: 1320727 - RNA, 14 nt, Mycobacterium tuberculosis H37Rv
cgauguccuggaag

SEQ ID NO: 1320728 - RNA, 15 nt, Mycobacterium tuberculosis H37Rv
cgauguccuggaagc

SEQ ID NO: 1320729 - RNA, 20 nt, Mycobacterium tuberculosis H37Rv
cgaugucgguaaucuccuca

SEQ ID NO: 1320730 - RNA, 18 nt, Mycobacterium tuberculosis H37Rv
cgaugguacccgcgccgc

SEQ ID NO: 1320731 - RNA, 14 nt, Mycobacterium tuberculosis H37Rv
cgaugggugcaccg

SEQ ID NO: 1320732 - RNA, 15 nt, Mycobacterium tuberculosis H37Rv
cgauguccccggcgg

SEQ ID NO: 1320733 - RNA, 14 nt, Mycobacterium tuberculosis H37Rv
cgauggucaucuug

SEQ ID NO: 1320734 - RNA, 16 nt, Mycobacterium tuberculosis H37Rv
cgaugcgacgcagacc

SEQ ID NO: 1320735 - RNA, 13 nt, Mycobacterium tuberculosis H37Rv
cgaugcugaucac

SEQ ID NO: 1320736 - RNA, 15 nt, Mycobacterium tuberculosis H37Rv
cgaugcucagcuggu

SEQ ID NO: 1320737 - RNA, 17 nt, Mycobacterium tuberculosis H37Rv
cgaugccguguucagca

SEQ ID NO: 1320738 - RNA, 17 nt, Mycobacterium tuberculosis H37Rv
cgaugccgugcugggcc

SEQ ID NO: 1320739 - RNA, 16 nt, Mycobacterium tuberculosis H37Rv
cgaugccgugcugggc

SEQ ID NO: 1320740 - RNA, 16 nt, Mycobacterium tuberculosis H37Rv
cgaugccggguguguu

SEQ ID NO: 1320741 - RNA, 17 nt, Mycobacterium tuberculosis H37Rv
cgaucacccacauggug

SEQ ID NO: 1320742 - RNA, 20 nt, Mycobacterium tuberculosis H37Rv
cgaugccgccggccccgccg

SEQ ID NO: 1320743 - RNA, 17 nt, Mycobacterium tuberculosis H37Rv
cgaugccgccggcgggc

SEQ ID NO: 1320744 - RNA, 17 nt, Mycobacterium tuberculosis H37Rv
cgaugccgccccgcagc

SEQ ID NO: 1320745 - RNA, 19 nt, Mycobacterium tuberculosis H37Rv
cgaugccgccccgcagcug

SEQ ID NO: 1320746 - RNA, 18 nt, Mycobacterium tuberculosis H37Rv
cgaucaaagccagcaccu

SEQ ID NO: 1320747 - RNA, 21 nt, Mycobacterium tuberculosis H37Rv
cgaucaacaacagccgcagcc

SEQ ID NO: 1320748 - RNA, 24 nt, Mycobacterium tuberculosis H37Rv
cgaucacggcgggaugcagcugcc

SEQ ID NO: 1320749 - RNA, 13 nt, Mycobacterium tuberculosis H37Rv
cgaucaccggcau

SEQ ID NO: 1320750 - RNA, 18 nt, Mycobacterium tuberculosis H37Rv
cgaucacccgcacuccac

SEQ ID NO: 1320751 - RNA, 14 nt, Mycobacterium tuberculosis H37Rv
cgaucaccccgcca

SEQ ID NO: 1320752 - RNA, 16 nt, Mycobacterium tuberculosis H37Rv
cgaucaccucgcgggu

SEQ ID NO: 1320753 - RNA, 21 nt, Mycobacterium tuberculosis H37Rv
cgauucgccuagcgagcgcac

SEQ ID NO: 1320754 - RNA, 16 nt, Mycobacterium tuberculosis H37Rv
cgauucugugucugcu

SEQ ID NO: 1320755 - RNA, 14 nt, Mycobacterium tuberculosis H37Rv
cgauuggcucgccg

SEQ ID NO: 1320756 - RNA, 14 nt, Mycobacterium tuberculosis H37Rv
cgauugcaccaugg

SEQ ID NO: 1320757 - RNA, 13 nt, Mycobacterium tuberculosis H37Rv
cgauugagcccca

SEQ ID NO: 1320758 - RNA, 13 nt, Mycobacterium tuberculosis H37Rv
cgauugccgucgu

SEQ ID NO: 1320759 - RNA, 23 nt, Mycobacterium tuberculosis H37Rv
cgauuggcaggcaaugcccgacc

SEQ ID NO: 1320760 - RNA, 20 nt, Mycobacterium tuberculosis H37Rv
cgauuucgagcgcugcuccc

SEQ ID NO: 1320761 - RNA, 18 nt, Mycobacterium tuberculosis H37Rv
cgauuuccaucgcgaccu

SEQ ID NO: 1320762 - RNA, 22 nt, Mycobacterium tuberculosis H37Rv
cgauuuuggcaagcugccccgc

SEQ ID NO: 1320763 - RNA, 18 nt, Mycobacterium tuberculosis H37Rv
cgcaccggaucaccgcgc

SEQ ID NO: 1320764 - RNA, 13 nt, Mycobacterium tuberculosis H37Rv
cgcaccgcugacc

SEQ ID NO: 1320765 - RNA, 21 nt, Mycobacterium tuberculosis H37Rv
cgcaccgcugaccccggcagc

SEQ ID NO: 1320766 - RNA, 22 nt, Mycobacterium tuberculosis H37Rv
cgcaccgccgcgcgacaggccc

SEQ ID NO: 1320767 - RNA, 17 nt, Mycobacterium tuberculosis H37Rv
cgcaccgaggccgccga

SEQ ID NO: 1320768 - RNA, 15 nt, Mycobacterium tuberculosis H37Rv
cgcaccgccacccug

SEQ ID NO: 1320769 - RNA, 14 nt, Mycobacterium tuberculosis H37Rv
cgcaccacaccacg

SEQ ID NO: 1320770 - RNA, 18 nt, Mycobacterium tuberculosis H37Rv
cgcaccacaauccacgca

SEQ ID NO: 1320771 - RNA, 23 nt, Mycobacterium tuberculosis H37Rv
cgcaccacaccacgguggccgcu

SEQ ID NO: 1320772 - RNA, 12 nt, Mycobacterium tuberculosis H37Rv
cgcaccaccacg

SEQ ID NO: 1320773 - RNA, 15 nt, Mycobacterium tuberculosis H37Rv
cgcaccaccgccccg

SEQ ID NO: 1320774 - RNA, 16 nt, Mycobacterium tuberculosis H37Rv
cgcaccaccgccccgc

SEQ ID NO: 1320775 - RNA, 12 nt, Mycobacterium tuberculosis H37Rv
cgcaccaccgcg

SEQ ID NO: 1320776 - RNA, 13 nt, Mycobacterium tuberculosis H37Rv
cgcacgccggcau

SEQ ID NO: 1320777 - RNA, 14 nt, Mycobacterium tuberculosis H37Rv
cgcacgccggcaug

SEQ ID NO: 1320778 - RNA, 13 nt, Mycobacterium tuberculosis H37Rv
cgcacgccaccgg

SEQ ID NO: 1320779 - RNA, 19 nt, Mycobacterium tuberculosis H37Rv
cgcacgccgaccagcaccc

SEQ ID NO: 1320780 - RNA, 13 nt, Mycobacterium tuberculosis H37Rv
cgcacgcacggcg

SEQ ID NO: 1320781 - RNA, 18 nt, Mycobacterium tuberculosis H37Rv
cgcacgcaaugcgggccc

SEQ ID NO: 1320782 - RNA, 18 nt, Mycobacterium tuberculosis H37Rv
cgcacgaucugcaggccc

SEQ ID NO: 1320783 - RNA, 18 nt, Mycobacterium tuberculosis H37Rv
cgcacgauuucgagcgcu

SEQ ID NO: 1320784 - RNA, 20 nt, Mycobacterium tuberculosis H37Rv
cgcacgacgcgacacgccgg

SEQ ID NO: 1320785 - RNA, 20 nt, Mycobacterium tuberculosis H37Rv
cgcacgacugugcgccgcag

SEQ ID NO: 1320786 - RNA, 19 nt, Mycobacterium tuberculosis H37Rv
cgcacgauagccaccgacg

SEQ ID NO: 1320787 - RNA, 22 nt, Mycobacterium tuberculosis H37Rv
cgcacgaucagggaagccugcg

SEQ ID NO: 1320788 - RNA, 17 nt, Mycobacterium tuberculosis H37Rv
cgcacgaaaccgcagcg

SEQ ID NO: 1320789 - RNA, 21 nt, Mycobacterium tuberculosis H37Rv
cgcaccguggacaccuggcug

SEQ ID NO: 1320790 - RNA, 22 nt, Mycobacterium tuberculosis H37Rv
cgcaccguggcggaucgcgagc

SEQ ID NO: 1320791 - RNA, 18 nt, Mycobacterium tuberculosis H37Rv
cgcagaucaggguggcgc

SEQ ID NO: 1320792 - RNA, 17 nt, Mycobacterium tuberculosis H37Rv
cgcagaucaccgccagc

SEQ ID NO: 1320793 - RNA, 18 nt, Mycobacterium tuberculosis H37Rv
cgcagaccugcaucacaa

SEQ ID NO: 1320794 - RNA, 19 nt, Mycobacterium tuberculosis H37Rv
cgcagaacggcguugcgga

SEQ ID NO: 1320795 - RNA, 16 nt, Mycobacterium tuberculosis H37Rv
cgcagaccugcaucac

SEQ ID NO: 1320796 - RNA, 17 nt, Mycobacterium tuberculosis H37Rv
cgcagaccgccaccggc

SEQ ID NO: 1320797 - RNA, 22 nt, Mycobacterium tuberculosis H37Rv
cgcagacucgauaugcagcucg

SEQ ID NO: 1320798 - RNA, 15 nt, Mycobacterium tuberculosis H37Rv
cgcagacguccuggg

SEQ ID NO: 1320799 - RNA, 21 nt, Mycobacterium tuberculosis H37Rv
cgcacgguugccgucaggguc

SEQ ID NO: 1320800 - RNA, 23 nt, Mycobacterium tuberculosis H37Rv
cgcacgguuggcgcucaacucag

SEQ ID NO: 1320801 - RNA, 15 nt, Mycobacterium tuberculosis H37Rv
cgcacgguucgggug

SEQ ID NO: 1320802 - RNA, 19 nt, Mycobacterium tuberculosis H37Rv
cgcacggcuagcgccguga

SEQ ID NO: 1320803 - RNA, 21 nt, Mycobacterium tuberculosis H37Rv
cgcacggucagcgcgcacgac

SEQ ID NO: 1320804 - RNA, 23 nt, Mycobacterium tuberculosis H37Rv
cgcacgucgaccucggcaaccac

SEQ ID NO: 1320805 - RNA, 21 nt, Mycobacterium tuberculosis H37Rv
cgcacguauccacggucgacc

SEQ ID NO: 1320806 - RNA, 20 nt, Mycobacterium tuberculosis H37Rv
cgcacgugaugcccuggggg

SEQ ID NO: 1320807 - RNA, 23 nt, Mycobacterium tuberculosis H37Rv
cgcagaauccggcaaccaccggc

SEQ ID NO: 1320808 - RNA, 14 nt, Mycobacterium tuberculosis H37Rv
cgcacuaccgccuu

SEQ ID NO: 1320809 - RNA, 20 nt, Mycobacterium tuberculosis H37Rv
cgcacuaccgccuuugcccg

SEQ ID NO: 1320810 - RNA, 16 nt, Mycobacterium tuberculosis H37Rv
cgcacaauggcggcgc

SEQ ID NO: 1320811 - RNA, 13 nt, Mycobacterium tuberculosis H37Rv
cgcacaacugcgc

SEQ ID NO: 1320812 - RNA, 15 nt, Mycobacterium tuberculosis H37Rv
cgcacaaacgggcgu

SEQ ID NO: 1320813 - RNA, 19 nt, Mycobacterium tuberculosis H37Rv
cgcaccaagacgccaccca

SEQ ID NO: 1320814 - RNA, 12 nt, Mycobacterium tuberculosis H37Rv
cgcaccaacacc

SEQ ID NO: 1320815 - RNA, 22 nt, Mycobacterium tuberculosis H37Rv
cgcaacaugggugaugcaacgc

SEQ ID NO: 1320816 - RNA, 22 nt, Mycobacterium tuberculosis H37Rv
cgcaaaagaacccgauucuggu

SEQ ID NO: 1320817 - RNA, 14 nt, Mycobacterium tuberculosis H37Rv
cgcaaccgccgcca

SEQ ID NO: 1320818 - RNA, 21 nt, Mycobacterium tuberculosis H37Rv
cgcaaccgcgcuuggagcggg

SEQ ID NO: 1320819 - RNA, 22 nt, Mycobacterium tuberculosis H37Rv
cgcaaccuaaauugccgggccc

SEQ ID NO: 1320820 - RNA, 17 nt, Mycobacterium tuberculosis H37Rv
cgcaaccgguggaugaa

SEQ ID NO: 1320821 - RNA, 18 nt, Mycobacterium tuberculosis H37Rv
cgcaaccggcggacaccu

SEQ ID NO: 1320822 - RNA, 23 nt, Mycobacterium tuberculosis H37Rv
cgcaaccauguuaacgcgcgucc

SEQ ID NO: 1320823 - RNA, 15 nt, Mycobacterium tuberculosis H37Rv
cgcaacgccgauggc

SEQ ID NO: 1320824 - RNA, 21 nt, Mycobacterium tuberculosis H37Rv
cgcaacgacugaucaagugcc

SEQ ID NO: 1320825 - RNA, 14 nt, Mycobacterium tuberculosis H37Rv
cgcaagaaugccgc

SEQ ID NO: 1320826 - RNA, 15 nt, Mycobacterium tuberculosis H37Rv
cgcaacgccgccagc

SEQ ID NO: 1320827 - RNA, 24 nt, Mycobacterium tuberculosis H37Rv
cgcaagccucguggugagaucaug

SEQ ID NO: 1320828 - RNA, 14 nt, Mycobacterium tuberculosis H37Rv
cgccagaccgcggc

SEQ ID NO: 1320829 - RNA, 13 nt, Mycobacterium tuberculosis H37Rv
cgccagaacggcg

SEQ ID NO: 1320830 - RNA, 21 nt, Mycobacterium tuberculosis H37Rv
cgccacgcucggcggccagcu

SEQ ID NO: 1320831 - RNA, 13 nt, Mycobacterium tuberculosis H37Rv
cgccacuggcgcu

SEQ ID NO: 1320832 - RNA, 20 nt, Mycobacterium tuberculosis H37Rv
cgccacggcaucggccaccu

SEQ ID NO: 1320833 - RNA, 19 nt, Mycobacterium tuberculosis H37Rv
cgccacugccagccgugca

SEQ ID NO: 1320834 - RNA, 19 nt, Mycobacterium tuberculosis H37Rv
cgccacccgacaugcgccg

SEQ ID NO: 1320835 - RNA, 18 nt, Mycobacterium tuberculosis H37Rv
cgccacccggcgggcggu

SEQ ID NO: 1320836 - RNA, 13 nt, Mycobacterium tuberculosis H37Rv
cgccacccgcgcc

SEQ ID NO: 1320837 - RNA, 14 nt, Mycobacterium tuberculosis H37Rv
cgccacccgcgccg

SEQ ID NO: 1320838 - RNA, 19 nt, Mycobacterium tuberculosis H37Rv
cgccacccgcgccgccagc

SEQ ID NO: 1320839 - RNA, 16 nt, Mycobacterium tuberculosis H37Rv
cgccaccgaacgcacc

SEQ ID NO: 1320840 - RNA, 13 nt, Mycobacterium tuberculosis H37Rv
cgccaccgaagcc

SEQ ID NO: 1320841 - RNA, 17 nt, Mycobacterium tuberculosis H37Rv
cgccaccgcgacgagcg

SEQ ID NO: 1320842 - RNA, 15 nt, Mycobacterium tuberculosis H37Rv
cgccacgcacccggc

SEQ ID NO: 1320843 - RNA, 16 nt, Mycobacterium tuberculosis H37Rv
cgccaccgccggcagc

SEQ ID NO: 1320844 - RNA, 19 nt, Mycobacterium tuberculosis H37Rv
cgccaccgauaccgucagc

SEQ ID NO: 1320845 - RNA, 23 nt, Mycobacterium tuberculosis H37Rv
cgccaccgauaccgucagcgccg

SEQ ID NO: 1320846 - RNA, 21 nt, Mycobacterium tuberculosis H37Rv
cgccaaguccgcucaccuuug

SEQ ID NO: 1320847 - RNA, 19 nt, Mycobacterium tuberculosis H37Rv
cgccaagugcagggcugcu

SEQ ID NO: 1320848 - RNA, 15 nt, Mycobacterium tuberculosis H37Rv
cgccaaggucugccg

SEQ ID NO: 1320849 - RNA, 13 nt, Mycobacterium tuberculosis H37Rv
cgccaaggaggcc

SEQ ID NO: 1320850 - RNA, 19 nt, Mycobacterium tuberculosis H37Rv
cgccaaguccgcucaccuu

SEQ ID NO: 1320851 - RNA, 22 nt, Mycobacterium tuberculosis H37Rv
cgccaaagccgggauugccgcc

SEQ ID NO: 1320852 - RNA, 23 nt, Mycobacterium tuberculosis H37Rv
cgccaaacccaugucggcgcgcc

SEQ ID NO: 1320853 - RNA, 19 nt, Mycobacterium tuberculosis H37Rv
cgccaacugcggcaggucu

SEQ ID NO: 1320854 - RNA, 21 nt, Mycobacterium tuberculosis H37Rv
cgccaacuccucagccgccug

SEQ ID NO: 1320855 - RNA, 15 nt, Mycobacterium tuberculosis H37Rv
cgccaacuucaccac

SEQ ID NO: 1320856 - RNA, 17 nt, Mycobacterium tuberculosis H37Rv
cgccaagacgucggcgu

SEQ ID NO: 1320857 - RNA, 17 nt, Mycobacterium tuberculosis H37Rv
cgccaacgugacgccgg

SEQ ID NO: 1320858 - RNA, 19 nt, Mycobacterium tuberculosis H37Rv
cgccaacgcccccauccgg

SEQ ID NO: 1320859 - RNA, 14 nt, Mycobacterium tuberculosis H37Rv
cgccaacggcaccu

SEQ ID NO: 1320860 - RNA, 18 nt, Mycobacterium tuberculosis H37Rv
cgccaacgggcugccccu

SEQ ID NO: 1320861 - RNA, 16 nt, Mycobacterium tuberculosis H37Rv
cgccaaccgcgugcgu

SEQ ID NO: 1320862 - RNA, 15 nt, Mycobacterium tuberculosis H37Rv
cgccaaccccaacau

SEQ ID NO: 1320863 - RNA, 15 nt, Mycobacterium tuberculosis H37Rv
cgccaacccggccaa

SEQ ID NO: 1320864 - RNA, 22 nt, Mycobacterium tuberculosis H37Rv
cgccaacgacucacccacccgc

SEQ ID NO: 1320865 - RNA, 20 nt, Mycobacterium tuberculosis H37Rv
cgccaaccguucccggcaga

SEQ ID NO: 1320866 - RNA, 14 nt, Mycobacterium tuberculosis H37Rv
cgccaacgccagca

SEQ ID NO: 1320867 - RNA, 12 nt, Mycobacterium tuberculosis H37Rv
cgccaacgccaa

SEQ ID NO: 1320868 - RNA, 23 nt, Mycobacterium tuberculosis H37Rv
cgcauuagccugcguggagcgcu

SEQ ID NO: 1320869 - RNA, 19 nt, Mycobacterium tuberculosis H37Rv
cgcaugucgggccaggcga

SEQ ID NO: 1320870 - RNA, 17 nt, Mycobacterium tuberculosis H37Rv
cgcauguucuccacgcc

SEQ ID NO: 1320871 - RNA, 14 nt, Mycobacterium tuberculosis H37Rv
cgcauggacaacag

SEQ ID NO: 1320872 - RNA, 20 nt, Mycobacterium tuberculosis H37Rv
cgcauggacgaacgcggcca

SEQ ID NO: 1320873 - RNA, 15 nt, Mycobacterium tuberculosis H37Rv
cgcaugcccuggacc

SEQ ID NO: 1320874 - RNA, 13 nt, Mycobacterium tuberculosis H37Rv
cgcaugggccagg

SEQ ID NO: 1320875 - RNA, 20 nt, Mycobacterium tuberculosis H37Rv
cgcauucguggagccggccg

SEQ ID NO: 1320876 - RNA, 19 nt, Mycobacterium tuberculosis H37Rv
cgcauuuguugcugcugcc

SEQ ID NO: 1320877 - RNA, 16 nt, Mycobacterium tuberculosis H37Rv
cgcauuuggugucggc

SEQ ID NO: 1320878 - RNA, 18 nt, Mycobacterium tuberculosis H37Rv
cgcaggguucgucgggac

SEQ ID NO: 1320879 - RNA, 12 nt, Mycobacterium tuberculosis H37Rv
cgcaggucgcgc

SEQ ID NO: 1320880 - RNA, 13 nt, Mycobacterium tuberculosis H37Rv
cgcagucugacga

SEQ ID NO: 1320881 - RNA, 14 nt, Mycobacterium tuberculosis H37Rv
cgcagucgggcagc

SEQ ID NO: 1320882 - RNA, 15 nt, Mycobacterium tuberculosis H37Rv
cgcagucgcggcaga

SEQ ID NO: 1320883 - RNA, 15 nt, Mycobacterium tuberculosis H37Rv
cgcaggccggcggcg

SEQ ID NO: 1320884 - RNA, 16 nt, Mycobacterium tuberculosis H37Rv
cgcaggcgcagauucc

SEQ ID NO: 1320885 - RNA, 21 nt, Mycobacterium tuberculosis H37Rv
cgcaggcgcagauuccucuuc

SEQ ID NO: 1320886 - RNA, 19 nt, Mycobacterium tuberculosis H37Rv
cgcaggcgauugcagcuuc

SEQ ID NO: 1320887 - RNA, 21 nt, Mycobacterium tuberculosis H37Rv
cgcagcaccgucgggcccagc

SEQ ID NO: 1320888 - RNA, 16 nt, Mycobacterium tuberculosis H37Rv
cgcagcaccaaggucu

SEQ ID NO: 1320889 - RNA, 20 nt, Mycobacterium tuberculosis H37Rv
cgcagcaccggcucgacugc

SEQ ID NO: 1320890 - RNA, 23 nt, Mycobacterium tuberculosis H37Rv
cgcagcaacaccucgucacccgg

SEQ ID NO: 1320891 - RNA, 13 nt, Mycobacterium tuberculosis H37Rv
cgcagcaacggcg

SEQ ID NO: 1320892 - RNA, 18 nt, Mycobacterium tuberculosis H37Rv
cgcagcaacugggcggcc

SEQ ID NO: 1320893 - RNA, 19 nt, Mycobacterium tuberculosis H37Rv
cgcagauccccgccaccga

SEQ ID NO: 1320894 - RNA, 16 nt, Mycobacterium tuberculosis H37Rv
cgcagcucgaccagga

SEQ ID NO: 1320895 - RNA, 19 nt, Mycobacterium tuberculosis H37Rv
cgcagcugccgcacccccu

SEQ ID NO: 1320896 - RNA, 15 nt, Mycobacterium tuberculosis H37Rv
cgcagcugccgcacc

SEQ ID NO: 1320897 - RNA, 19 nt, Mycobacterium tuberculosis H37Rv
cgcagcuaacccgccacgu

SEQ ID NO: 1320898 - RNA, 19 nt, Mycobacterium tuberculosis H37Rv
cgcagcacugcggcagcga

SEQ ID NO: 1320899 - RNA, 18 nt, Mycobacterium tuberculosis H37Rv
cgcagcacugcggcagcg

SEQ ID NO: 1320900 - RNA, 15 nt, Mycobacterium tuberculosis H37Rv
cgcagcuaacccgcc

SEQ ID NO: 1320901 - RNA, 18 nt, Mycobacterium tuberculosis H37Rv
cgcagcguuggccgcugu

SEQ ID NO: 1320902 - RNA, 22 nt, Mycobacterium tuberculosis H37Rv
cgcauaggcggccaucgacgac

SEQ ID NO: 1320903 - RNA, 16 nt, Mycobacterium tuberculosis H37Rv
cgcauagggccaccgc

SEQ ID NO: 1320904 - RNA, 18 nt, Mycobacterium tuberculosis H37Rv
cgcauagugcggcugcaa

SEQ ID NO: 1320905 - RNA, 15 nt, Mycobacterium tuberculosis H37Rv
cgcauaugccgccgg

SEQ ID NO: 1320906 - RNA, 20 nt, Mycobacterium tuberculosis H37Rv
cgcauaugccgccggcagcg

SEQ ID NO: 1320907 - RNA, 23 nt, Mycobacterium tuberculosis H37Rv
cgcaucacccgggaugaccaccg

SEQ ID NO: 1320908 - RNA, 17 nt, Mycobacterium tuberculosis H37Rv
cgcaucagggugggcga

SEQ ID NO: 1320909 - RNA, 20 nt, Mycobacterium tuberculosis H37Rv
cgcauccagccgugcggcgg

SEQ ID NO: 1320910 - RNA, 21 nt, Mycobacterium tuberculosis H37Rv
cgcaucccgaaguagaagccc

SEQ ID NO: 1320911 - RNA, 19 nt, Mycobacterium tuberculosis H37Rv
cgcaucauagacagggccg

SEQ ID NO: 1320912 - RNA, 20 nt, Mycobacterium tuberculosis H37Rv
cgcaucgacgugcgcggcau

SEQ ID NO: 1320913 - RNA, 23 nt, Mycobacterium tuberculosis H37Rv
cgcauccgguuuggucgccgcgu

SEQ ID NO: 1320914 - RNA, 19 nt, Mycobacterium tuberculosis H37Rv
cgcauccgcgacggcgccc

SEQ ID NO: 1320915 - RNA, 22 nt, Mycobacterium tuberculosis H37Rv
cgcauccgcgguuggcaguggc

SEQ ID NO: 1320916 - RNA, 17 nt, Mycobacterium tuberculosis H37Rv
cgcaucgagcaccucca

SEQ ID NO: 1320917 - RNA, 15 nt, Mycobacterium tuberculosis H37Rv
cgcaucgccucacca

SEQ ID NO: 1320918 - RNA, 19 nt, Mycobacterium tuberculosis H37Rv
ccuucuccagauccacgcc

SEQ ID NO: 1320919 - RNA, 15 nt, Mycobacterium tuberculosis H37Rv
ccuucugguccagca

SEQ ID NO: 1320920 - RNA, 15 nt, Mycobacterium tuberculosis H37Rv
ccuucucgccgccgc

SEQ ID NO: 1320921 - RNA, 11 nt, Mycobacterium tuberculosis H37Rv
ccuucuuggcg

SEQ ID NO: 1320922 - RNA, 11 nt, Mycobacterium tuberculosis H37Rv
ccuucuuggca

SEQ ID NO: 1320923 - RNA, 20 nt, Mycobacterium tuberculosis H37Rv
ccuucuucgcuaccuucuug

SEQ ID NO: 1320924 - RNA, 13 nt, Mycobacterium tuberculosis H37Rv
ccuucuucucggc

SEQ ID NO: 1320925 - RNA, 22 nt, Mycobacterium tuberculosis H37Rv
ccuugacgcgcaacgccgccag

SEQ ID NO: 1320926 - RNA, 14 nt, Mycobacterium tuberculosis H37Rv
ccuugacgcggcca

SEQ ID NO: 1320927 - RNA, 14 nt, Mycobacterium tuberculosis H37Rv
ccuugaccgaccag

SEQ ID NO: 1320928 - RNA, 13 nt, Mycobacterium tuberculosis H37Rv
ccuugacggugag

SEQ ID NO: 1320929 - RNA, 21 nt, Mycobacterium tuberculosis H37Rv
ccuugaccacagcggagacga

SEQ ID NO: 1320930 - RNA, 17 nt, Mycobacterium tuberculosis H37Rv
ccuugacagcuuucuug

SEQ ID NO: 1320931 - RNA, 20 nt, Mycobacterium tuberculosis H37Rv
ccuugacagcuuucuuggcg

SEQ ID NO: 1320932 - RNA, 19 nt, Mycobacterium tuberculosis H37Rv
ccuguguugagcggcagcc

SEQ ID NO: 1320933 - RNA, 22 nt, Mycobacterium tuberculosis H37Rv
ccuucgcggugugcggcagccc

SEQ ID NO: 1320934 - RNA, 23 nt, Mycobacterium tuberculosis H37Rv
ccuucgcagcauguggccgccgu

SEQ ID NO: 1320935 - RNA, 22 nt, Mycobacterium tuberculosis H37Rv
ccuucgaaugccgugccgaagu

SEQ ID NO: 1320936 - RNA, 16 nt, Mycobacterium tuberculosis H37Rv
ccuuggugcccagcag

SEQ ID NO: 1320937 - RNA, 22 nt, Mycobacterium tuberculosis H37Rv
ccuuggugggcagauacgagcu

SEQ ID NO: 1320938 - RNA, 16 nt, Mycobacterium tuberculosis H37Rv
ccuuggucaccuucuu

SEQ ID NO: 1320939 - RNA, 20 nt, Mycobacterium tuberculosis H37Rv
ccuugggcgacgcggcgccg

SEQ ID NO: 1320940 - RNA, 16 nt, Mycobacterium tuberculosis H37Rv
ccuugguagccggccg

SEQ ID NO: 1320941 - RNA, 12 nt, Mycobacterium tuberculosis H37Rv
ccuuggucaccu

SEQ ID NO: 1320942 - RNA, 12 nt, Mycobacterium tuberculosis H37Rv
ccuuggacucgg

SEQ ID NO: 1320943 - RNA, 14 nt, Mycobacterium tuberculosis H37Rv
ccuuggcaguccag

SEQ ID NO: 1320944 - RNA, 18 nt, Mycobacterium tuberculosis H37Rv
ccuuggcaguccagccgg

SEQ ID NO: 1320945 - RNA, 14 nt, Mycobacterium tuberculosis H37Rv
ccuuggcacccucc

SEQ ID NO: 1320946 - RNA, 22 nt, Mycobacterium tuberculosis H37Rv
ccuuggccagcagggccaccac

SEQ ID NO: 1320947 - RNA, 12 nt, Mycobacterium tuberculosis H37Rv
ccuuggccagca

SEQ ID NO: 1320948 - RNA, 16 nt, Mycobacterium tuberculosis H37Rv
ccuuggcggucggcag

SEQ ID NO: 1320949 - RNA, 17 nt, Mycobacterium tuberculosis H37Rv
ccuuggcugggcccgcc

SEQ ID NO: 1320950 - RNA, 14 nt, Mycobacterium tuberculosis H37Rv
ccuuguucgcccac

SEQ ID NO: 1320951 - RNA, 18 nt, Mycobacterium tuberculosis H37Rv
ccuuguucccgaaacccg

SEQ ID NO: 1320952 - RNA, 18 nt, Mycobacterium tuberculosis H37Rv
ccuuguuggccugcaacg

SEQ ID NO: 1320953 - RNA, 20 nt, Mycobacterium tuberculosis H37Rv
ccuuguuguccuucagccag

SEQ ID NO: 1320954 - RNA, 17 nt, Mycobacterium tuberculosis H37Rv
ccuuguugaccaccacc

SEQ ID NO: 1320955 - RNA, 21 nt, Mycobacterium tuberculosis H37Rv
ccuuguguggcgaaucuuugg

SEQ ID NO: 1320956 - RNA, 19 nt, Mycobacterium tuberculosis H37Rv
ccuuguggcacacccgcac

SEQ ID NO: 1320957 - RNA, 13 nt, Mycobacterium tuberculosis H37Rv
ccuuguggacccg

SEQ ID NO: 1320958 - RNA, 21 nt, Mycobacterium tuberculosis H37Rv
ccuugucuaguugacgcagcc

SEQ ID NO: 1320959 - RNA, 14 nt, Mycobacterium tuberculosis H37Rv
ccuugugaccccgg

SEQ ID NO: 1320960 - RNA, 16 nt, Mycobacterium tuberculosis H37Rv
ccuugaugcgccccau

SEQ ID NO: 1320961 - RNA, 13 nt, Mycobacterium tuberculosis H37Rv
ccuugcacaagcu

SEQ ID NO: 1320962 - RNA, 12 nt, Mycobacterium tuberculosis H37Rv
ccuugcagcgcc

SEQ ID NO: 1320963 - RNA, 19 nt, Mycobacterium tuberculosis H37Rv
ccuugccaaucgccgucag

SEQ ID NO: 1320964 - RNA, 15 nt, Mycobacterium tuberculosis H37Rv
ccuugcagcgccccc

SEQ ID NO: 1320965 - RNA, 21 nt, Mycobacterium tuberculosis H37Rv
ccuugcagcgcccccgcugcc

SEQ ID NO: 1320966 - RNA, 15 nt, Mycobacterium tuberculosis H37Rv
ccuugaucugagcgc

SEQ ID NO: 1320967 - RNA, 16 nt, Mycobacterium tuberculosis H37Rv
ccuugagcaaaauggc

SEQ ID NO: 1320968 - RNA, 17 nt, Mycobacterium tuberculosis H37Rv
ccuugccgccagcccca

SEQ ID NO: 1320969 - RNA, 16 nt, Mycobacterium tuberculosis H37Rv
ccuugccgccauucca

SEQ ID NO: 1320970 - RNA, 16 nt, Mycobacterium tuberculosis H37Rv
ccuugccgcccgcucc

SEQ ID NO: 1320971 - RNA, 16 nt, Mycobacterium tuberculosis H37Rv
ccuugccgccggcccc

SEQ ID NO: 1320972 - RNA, 19 nt, Mycobacterium tuberculosis H37Rv
ccuugccgccggcuccgcc

SEQ ID NO: 1320973 - RNA, 23 nt, Mycobacterium tuberculosis H37Rv
ccuugccgccuuggcccccgggu

SEQ ID NO: 1320974 - RNA, 21 nt, Mycobacterium tuberculosis H37Rv
ccuugccgaugacgaugcccu

SEQ ID NO: 1320975 - RNA, 16 nt, Mycobacterium tuberculosis H37Rv
ccuugcgacguucuug

SEQ ID NO: 1320976 - RNA, 16 nt, Mycobacterium tuberculosis H37Rv
ccuugccuagccgcag

SEQ ID NO: 1320977 - RNA, 13 nt, Mycobacterium tuberculosis H37Rv
ccuugccuccggc

SEQ ID NO: 1320978 - RNA, 21 nt, Mycobacterium tuberculosis H37Rv
ccuugccuccggcgccgcccg

SEQ ID NO: 1320979 - RNA, 21 nt, Mycobacterium tuberculosis H37Rv
ccuugcgguccaggccggcac

SEQ ID NO: 1320980 - RNA, 16 nt, Mycobacterium tuberculosis H37Rv
ccuugcggccgggcgg

SEQ ID NO: 1320981 - RNA, 14 nt, Mycobacterium tuberculosis H37Rv
ccuugcuccacauc

SEQ ID NO: 1320982 - RNA, 16 nt, Mycobacterium tuberculosis H37Rv
ccuugcucagcacgcc

SEQ ID NO: 1320983 - RNA, 15 nt, Mycobacterium tuberculosis H37Rv
ccuugcguguaccag

SEQ ID NO: 1320984 - RNA, 13 nt, Mycobacterium tuberculosis H37Rv
ccuugcugcgcga

SEQ ID NO: 1320985 - RNA, 16 nt, Mycobacterium tuberculosis H37Rv
ccuuuccggccgccug

SEQ ID NO: 1320986 - RNA, 15 nt, Mycobacterium tuberculosis H37Rv
ccuuuccggccgccu

SEQ ID NO: 1320987 - RNA, 13 nt, Mycobacterium tuberculosis H37Rv
ccuuugccaccuc

SEQ ID NO: 1320988 - RNA, 16 nt, Mycobacterium tuberculosis H37Rv
ccuuuggccgcgaccg

SEQ ID NO: 1320989 - RNA, 20 nt, Mycobacterium tuberculosis H37Rv
ccuuugucgccuucuuggca

SEQ ID NO: 1320990 - RNA, 18 nt, Mycobacterium tuberculosis H37Rv
ccuuuguggggccgggcu

SEQ ID NO: 1320991 - RNA, 18 nt, Mycobacterium tuberculosis H37Rv
ccuuuugccgcagcaucc

SEQ ID NO: 1320992 - RNA, 13 nt, Mycobacterium tuberculosis H37Rv
cgaaaauugcucc

SEQ ID NO: 1320993 - RNA, 17 nt, Mycobacterium tuberculosis H37Rv
cgaaaacaacccgaaca

SEQ ID NO: 1320994 - RNA, 17 nt, Mycobacterium tuberculosis H37Rv
cgaaaaccuccgggucc

SEQ ID NO: 1320995 - RNA, 13 nt, Mycobacterium tuberculosis H37Rv
cgaaaaaccucga

SEQ ID NO: 1320996 - RNA, 23 nt, Mycobacterium tuberculosis H37Rv
cgaaaaacgaccccucacccagc

SEQ ID NO: 1320997 - RNA, 15 nt, Mycobacterium tuberculosis H37Rv
cgaaaaacaccagcg

SEQ ID NO: 1320998 - RNA, 23 nt, Mycobacterium tuberculosis H37Rv
cgaacaccagcgcgccguagacc

SEQ ID NO: 1320999 - RNA, 16 nt, Mycobacterium tuberculosis H37Rv
cgaacaccagcgcgcc

SEQ ID NO: 1321000 - RNA, 12 nt, Mycobacterium tuberculosis H37Rv
cgaacaccagcg

SEQ ID NO: 1321001 - RNA, 23 nt, Mycobacterium tuberculosis H37Rv
cgaacaaguggccagcgccaacu

SEQ ID NO: 1321002 - RNA, 20 nt, Mycobacterium tuberculosis H37Rv
cgaacaaguggccagcgcca

SEQ ID NO: 1321003 - RNA, 13 nt, Mycobacterium tuberculosis H37Rv
cgaacaauucacg

SEQ ID NO: 1321004 - RNA, 17 nt, Mycobacterium tuberculosis H37Rv
cgaacaccagauggcuc

SEQ ID NO: 1321005 - RNA, 15 nt, Mycobacterium tuberculosis H37Rv
cgaaauucucgcccu

SEQ ID NO: 1321006 - RNA, 19 nt, Mycobacterium tuberculosis H37Rv
cgaacaacgcgacgaagca

SEQ ID NO: 1321007 - RNA, 19 nt, Mycobacterium tuberculosis H37Rv
cgaaaucggccagcuuccc

SEQ ID NO: 1321008 - RNA, 16 nt, Mycobacterium tuberculosis H37Rv
cgaaauccugguggca

SEQ ID NO: 1321009 - RNA, 17 nt, Mycobacterium tuberculosis H37Rv
cgaaaucaguugcgcuc

SEQ ID NO: 1321010 - RNA, 19 nt, Mycobacterium tuberculosis H37Rv
cgaaacgcuuacccagccc

SEQ ID NO: 1321011 - RNA, 20 nt, Mycobacterium tuberculosis H37Rv
cgaaacgcgcggaucgucga

SEQ ID NO: 1321012 - RNA, 14 nt, Mycobacterium tuberculosis H37Rv
cgaaacucaccagc

SEQ ID NO: 1321013 - RNA, 18 nt, Mycobacterium tuberculosis H37Rv
cgaaacucaccagcaccc

SEQ ID NO: 1321014 - RNA, 16 nt, Mycobacterium tuberculosis H37Rv
cgaaacucgacgugaa

SEQ ID NO: 1321015 - RNA, 12 nt, Mycobacterium tuberculosis H37Rv
cgaaacugaccc

SEQ ID NO: 1321016 - RNA, 15 nt, Mycobacterium tuberculosis H37Rv
cgaaaccggaccuga

SEQ ID NO: 1321017 - RNA, 15 nt, Mycobacterium tuberculosis H37Rv
cgaaacagcacccag

SEQ ID NO: 1321018 - RNA, 15 nt, Mycobacterium tuberculosis H37Rv
cgaaaccgcagcgcg

SEQ ID NO: 1321019 - RNA, 16 nt, Mycobacterium tuberculosis H37Rv
cgaaagccucucuucc

SEQ ID NO: 1321020 - RNA, 22 nt, Mycobacterium tuberculosis H37Rv
cgaacagcgguccagccaccgc

SEQ ID NO: 1321021 - RNA, 19 nt, Mycobacterium tuberculosis H37Rv
cgaacaguaggccuccgcu

SEQ ID NO: 1321022 - RNA, 16 nt, Mycobacterium tuberculosis H37Rv
cgaacacuuugcgcac

SEQ ID NO: 1321023 - RNA, 14 nt, Mycobacterium tuberculosis H37Rv
cgaacagacaugcg

SEQ ID NO: 1321024 - RNA, 12 nt, Mycobacterium tuberculosis H37Rv
cgaacagcccca

SEQ ID NO: 1321025 - RNA, 13 nt, Mycobacterium tuberculosis H37Rv
cgaacagccccag

SEQ ID NO: 1321026 - RNA, 18 nt, Mycobacterium tuberculosis H37Rv
cgaacagccccagggugc

SEQ ID NO: 1321027 - RNA, 21 nt, Mycobacterium tuberculosis H37Rv
cgaacauggccagcaucagcg

SEQ ID NO: 1321028 - RNA, 17 nt, Mycobacterium tuberculosis H37Rv
cgaacaucaucgggucc

SEQ ID NO: 1321029 - RNA, 13 nt, Mycobacterium tuberculosis H37Rv
cgaaccacggcag

SEQ ID NO: 1321030 - RNA, 22 nt, Mycobacterium tuberculosis H37Rv
cgaaccacgcgcccgcaccacc

SEQ ID NO: 1321031 - RNA, 21 nt, Mycobacterium tuberculosis H37Rv
cgaaccagcuugcgccgcagc

SEQ ID NO: 1321032 - RNA, 22 nt, Mycobacterium tuberculosis H37Rv
cgaaccagcuugcgccgcagcg

SEQ ID NO: 1321033 - RNA, 17 nt, Mycobacterium tuberculosis H37Rv
cgaaccgccggcaccgc

SEQ ID NO: 1321034 - RNA, 14 nt, Mycobacterium tuberculosis H37Rv
cgaaccgcugcggg

SEQ ID NO: 1321035 - RNA, 19 nt, Mycobacterium tuberculosis H37Rv
cgaaccgguguagcagcgc

SEQ ID NO: 1321036 - RNA, 14 nt, Mycobacterium tuberculosis H37Rv
cgaaccggcugggc

SEQ ID NO: 1321037 - RNA, 17 nt, Mycobacterium tuberculosis H37Rv
cgaaccgggacaaccgc

SEQ ID NO: 1321038 - RNA, 16 nt, Mycobacterium tuberculosis H37Rv
cgaaccggcaccagcg

SEQ ID NO: 1321039 - RNA, 18 nt, Mycobacterium tuberculosis H37Rv
cgaaccgacguuccccuu

SEQ ID NO: 1321040 - RNA, 16 nt, Mycobacterium tuberculosis H37Rv
cgaacccucagccgcg

SEQ ID NO: 1321041 - RNA, 15 nt, Mycobacterium tuberculosis H37Rv
cgaacccuccgcagc

SEQ ID NO: 1321042 - RNA, 15 nt, Mycobacterium tuberculosis H37Rv
cgaacccgccaccgc

SEQ ID NO: 1321043 - RNA, 21 nt, Mycobacterium tuberculosis H37Rv
cgaacccgccgaugccgccgc

SEQ ID NO: 1321044 - RNA, 17 nt, Mycobacterium tuberculosis H37Rv
cgaaccccacgcagaag

SEQ ID NO: 1321045 - RNA, 13 nt, Mycobacterium tuberculosis H37Rv
cgaacccccgccg

SEQ ID NO: 1321046 - RNA, 21 nt, Mycobacterium tuberculosis H37Rv
cgaaccccgggcggcgccggc

SEQ ID NO: 1321047 - RNA, 19 nt, Mycobacterium tuberculosis H37Rv
cgaaccugccgcagugaca

SEQ ID NO: 1321048 - RNA, 16 nt, Mycobacterium tuberculosis H37Rv
cgaacgcccugacggu

SEQ ID NO: 1321049 - RNA, 21 nt, Mycobacterium tuberculosis H37Rv
cgaacgccacggcaucggcca

SEQ ID NO: 1321050 - RNA, 17 nt, Mycobacterium tuberculosis H37Rv
cgaacgauuucggccca

SEQ ID NO: 1321051 - RNA, 14 nt, Mycobacterium tuberculosis H37Rv
cgaacgcugccgag

SEQ ID NO: 1321052 - RNA, 14 nt, Mycobacterium tuberculosis H37Rv
cgaacgcugcuccg

SEQ ID NO: 1321053 - RNA, 17 nt, Mycobacterium tuberculosis H37Rv
cgaacgccucaccgacg

SEQ ID NO: 1321054 - RNA, 18 nt, Mycobacterium tuberculosis H37Rv
cgaacgccucgccggccg

SEQ ID NO: 1321055 - RNA, 18 nt, Mycobacterium tuberculosis H37Rv
cgaacgccguggugcgca

SEQ ID NO: 1321056 - RNA, 17 nt, Mycobacterium tuberculosis H37Rv
cgaccgcaccgugccga

SEQ ID NO: 1321057 - RNA, 19 nt, Mycobacterium tuberculosis H37Rv
cgaccgacuuuggccaucu

SEQ ID NO: 1321058 - RNA, 14 nt, Mycobacterium tuberculosis H37Rv
cgaccgagacggcg

SEQ ID NO: 1321059 - RNA, 20 nt, Mycobacterium tuberculosis H37Rv
cgaccgaccuggucggugac

SEQ ID NO: 1321060 - RNA, 18 nt, Mycobacterium tuberculosis H37Rv
cgaccgauagcuggccga

SEQ ID NO: 1321061 - RNA, 14 nt, Mycobacterium tuberculosis H37Rv
cgaccgaacgccag

SEQ ID NO: 1321062 - RNA, 19 nt, Mycobacterium tuberculosis H37Rv
cgacccgucgaacgcgcgc

SEQ ID NO: 1321063 - RNA, 16 nt, Mycobacterium tuberculosis H37Rv
cgaccgaaagccgcac

SEQ ID NO: 1321064 - RNA, 16 nt, Mycobacterium tuberculosis H37Rv
cgacccgcgcgccggc

SEQ ID NO: 1321065 - RNA, 18 nt, Mycobacterium tuberculosis H37Rv
cgacccgcgcgccggcga

SEQ ID NO: 1321066 - RNA, 18 nt, Mycobacterium tuberculosis H37Rv
cgacccggcccagcgccc

SEQ ID NO: 1321067 - RNA, 17 nt, Mycobacterium tuberculosis H37Rv
cgacccgcugccaccca

SEQ ID NO: 1321068 - RNA, 11 nt, Mycobacterium tuberculosis H37Rv
cgacccgggcc

SEQ ID NO: 1321069 - RNA, 14 nt, Mycobacterium tuberculosis H37Rv
cgacccgggucggc

SEQ ID NO: 1321070 - RNA, 20 nt, Mycobacterium tuberculosis H37Rv
cgacccgggucggcacgacc

SEQ ID NO: 1321071 - RNA, 13 nt, Mycobacterium tuberculosis H37Rv
cgacccgggccgc

SEQ ID NO: 1321072 - RNA, 16 nt, Mycobacterium tuberculosis H37Rv
cgaccgcggccgggug

SEQ ID NO: 1321073 - RNA, 16 nt, Mycobacterium tuberculosis H37Rv
cgaccgcggccccgcc

SEQ ID NO: 1321074 - RNA, 16 nt, Mycobacterium tuberculosis H37Rv
cgaccgcgagcaucug

SEQ ID NO: 1321075 - RNA, 18 nt, Mycobacterium tuberculosis H37Rv
cgaccgccgcuaccccag

SEQ ID NO: 1321076 - RNA, 12 nt, Mycobacterium tuberculosis H37Rv
cgaccgccuccu

SEQ ID NO: 1321077 - RNA, 15 nt, Mycobacterium tuberculosis H37Rv
cgaccgccgagcggg

SEQ ID NO: 1321078 - RNA, 15 nt, Mycobacterium tuberculosis H37Rv
cgaccgccaccgcca

SEQ ID NO: 1321079 - RNA, 16 nt, Mycobacterium tuberculosis H37Rv
cgaccggcacccgcgg

SEQ ID NO: 1321080 - RNA, 17 nt, Mycobacterium tuberculosis H37Rv
cgaccggcgagcccgca

SEQ ID NO: 1321081 - RNA, 16 nt, Mycobacterium tuberculosis H37Rv
cgaccggcgaccggcg

SEQ ID NO: 1321082 - RNA, 20 nt, Mycobacterium tuberculosis H37Rv
cgaccggcccgcauccgcac

SEQ ID NO: 1321083 - RNA, 13 nt, Mycobacterium tuberculosis H37Rv
cgaccggccggcc

SEQ ID NO: 1321084 - RNA, 13 nt, Mycobacterium tuberculosis H37Rv
cgaccgcucccgg

SEQ ID NO: 1321085 - RNA, 21 nt, Mycobacterium tuberculosis H37Rv
cgaccggaacuguggugccug

SEQ ID NO: 1321086 - RNA, 20 nt, Mycobacterium tuberculosis H37Rv
cgaccgcguacaggccggcc

SEQ ID NO: 1321087 - RNA, 21 nt, Mycobacterium tuberculosis H37Rv
cgaccgcguacaggccggcca

SEQ ID NO: 1321088 - RNA, 15 nt, Mycobacterium tuberculosis H37Rv
cgaccgcggccuugg

SEQ ID NO: 1321089 - RNA, 14 nt, Mycobacterium tuberculosis H37Rv
cgaccgcggcggca

SEQ ID NO: 1321090 - RNA, 21 nt, Mycobacterium tuberculosis H37Rv
cgaccuccggaaucgcccggg

SEQ ID NO: 1321091 - RNA, 16 nt, Mycobacterium tuberculosis H37Rv
cgaccucgcgggcgau

SEQ ID NO: 1321092 - RNA, 14 nt, Mycobacterium tuberculosis H37Rv
cgaccuccacgccc

SEQ ID NO: 1321093 - RNA, 18 nt, Mycobacterium tuberculosis H37Rv
cgaccuccacgcccuggc

SEQ ID NO: 1321094 - RNA, 21 nt, Mycobacterium tuberculosis H37Rv
cgaccuccaccaaugcuccug

SEQ ID NO: 1321095 - RNA, 15 nt, Mycobacterium tuberculosis H37Rv
cgaccugaggcaccu

SEQ ID NO: 1321096 - RNA, 21 nt, Mycobacterium tuberculosis H37Rv
cgaccugcucgauacggcccu

SEQ ID NO: 1321097 - RNA, 16 nt, Mycobacterium tuberculosis H37Rv
cgaccuguccacccag

SEQ ID NO: 1321098 - RNA, 12 nt, Mycobacterium tuberculosis H37Rv
cgaccguccggg

SEQ ID NO: 1321099 - RNA, 16 nt, Mycobacterium tuberculosis H37Rv
cgaccguauugaccag

SEQ ID NO: 1321100 - RNA, 17 nt, Mycobacterium tuberculosis H37Rv
cgaccguggcggccucc

SEQ ID NO: 1321101 - RNA, 19 nt, Mycobacterium tuberculosis H37Rv
cgaccgugguggucgggcg

SEQ ID NO: 1321102 - RNA, 17 nt, Mycobacterium tuberculosis H37Rv
cgaccgugcugggcgcc

SEQ ID NO: 1321103 - RNA, 16 nt, Mycobacterium tuberculosis H37Rv
cgaccgucgucaccgc

SEQ ID NO: 1321104 - RNA, 17 nt, Mycobacterium tuberculosis H37Rv
cgaccgucgucgugcag

SEQ ID NO: 1321105 - RNA, 18 nt, Mycobacterium tuberculosis H37Rv
cgaccgggcucuggccag

SEQ ID NO: 1321106 - RNA, 22 nt, Mycobacterium tuberculosis H37Rv
cgaccgguacccguagcaccac

SEQ ID NO: 1321107 - RNA, 21 nt, Mycobacterium tuberculosis H37Rv
cgaccggcgggaugcgcgccc

SEQ ID NO: 1321108 - RNA, 20 nt, Mycobacterium tuberculosis H37Rv
cgaccgggccgcacggucag

SEQ ID NO: 1321109 - RNA, 20 nt, Mycobacterium tuberculosis H37Rv
cgaccggcuugcccuccggg

SEQ ID NO: 1321110 - RNA, 15 nt, Mycobacterium tuberculosis H37Rv
cgacgccggccuggc

SEQ ID NO: 1321111 - RNA, 14 nt, Mycobacterium tuberculosis H37Rv
cgacgccgcgcagc

SEQ ID NO: 1321112 - RNA, 14 nt, Mycobacterium tuberculosis H37Rv
cgacgccgccaccc

SEQ ID NO: 1321113 - RNA, 17 nt, Mycobacterium tuberculosis H37Rv
cgacgccgccacccggc

SEQ ID NO: 1321114 - RNA, 21 nt, Mycobacterium tuberculosis H37Rv
cgacgccgccacccggcgggc

SEQ ID NO: 1321115 - RNA, 22 nt, Mycobacterium tuberculosis H37Rv
cgacgccgccacccggcgggcg

SEQ ID NO: 1321116 - RNA, 23 nt, Mycobacterium tuberculosis H37Rv
cgacgccgaaaaugccgcccagc

SEQ ID NO: 1321117 - RNA, 16 nt, Mycobacterium tuberculosis H37Rv
cgacgccgccggcccc

SEQ ID NO: 1321118 - RNA, 14 nt, Mycobacterium tuberculosis H37Rv
cgacgccgccggcg

SEQ ID NO: 1321119 - RNA, 16 nt, Mycobacterium tuberculosis H37Rv
cgacgccaaugccgcg

SEQ ID NO: 1321120 - RNA, 16 nt, Mycobacterium tuberculosis H37Rv
cgacgccaacgccagc

SEQ ID NO: 1321121 - RNA, 15 nt, Mycobacterium tuberculosis H37Rv
cgacgccaccgccac

SEQ ID NO: 1321122 - RNA, 17 nt, Mycobacterium tuberculosis H37Rv
cgacgccagcugcccga

SEQ ID NO: 1321123 - RNA, 15 nt, Mycobacterium tuberculosis H37Rv
cgacgccauggucag

SEQ ID NO: 1321124 - RNA, 19 nt, Mycobacterium tuberculosis H37Rv
cgacgcccgauacgccacc

SEQ ID NO: 1321125 - RNA, 17 nt, Mycobacterium tuberculosis H37Rv
cgacgccgaaaaugccg

SEQ ID NO: 1321126 - RNA, 19 nt, Mycobacterium tuberculosis H37Rv
cgacgauaucgggagcggc

SEQ ID NO: 1321127 - RNA, 15 nt, Mycobacterium tuberculosis H37Rv
cgacgauccacggcg

SEQ ID NO: 1321128 - RNA, 15 nt, Mycobacterium tuberculosis H37Rv
cgacgaucugcagca

SEQ ID NO: 1321129 - RNA, 14 nt, Mycobacterium tuberculosis H37Rv
cgacgaugacgcgc

SEQ ID NO: 1321130 - RNA, 17 nt, Mycobacterium tuberculosis H37Rv
cgacgaucucgccggcg

SEQ ID NO: 1321131 - RNA, 15 nt, Mycobacterium tuberculosis H37Rv
cgacgcaaagcagcg

SEQ ID NO: 1321132 - RNA, 14 nt, Mycobacterium tuberculosis H37Rv
cgacgcaccaacgc

SEQ ID NO: 1321133 - RNA, 22 nt, Mycobacterium tuberculosis H37Rv
cgacgauuaccagcggcaccgc

SEQ ID NO: 1321134 - RNA, 15 nt, Mycobacterium tuberculosis H37Rv
cgacgcacucggggc

SEQ ID NO: 1321135 - RNA, 16 nt, Mycobacterium tuberculosis H37Rv
cgacgcauaaccggcg

SEQ ID NO: 1321136 - RNA, 22 nt, Mycobacterium tuberculosis H37Rv
cgacgacgccaaugccgcggag

SEQ ID NO: 1321137 - RNA, 13 nt, Mycobacterium tuberculosis H37Rv
cgacgacgcgcgc

SEQ ID NO: 1321138 - RNA, 20 nt, Mycobacterium tuberculosis H37Rv
cgacgacaucgagccaacgc

SEQ ID NO: 1321139 - RNA, 12 nt, Mycobacterium tuberculosis H37Rv
cgacgaccaccu

SEQ ID NO: 1321140 - RNA, 16 nt, Mycobacterium tuberculosis H37Rv
cgacgacaccagagcg

SEQ ID NO: 1321141 - RNA, 13 nt, Mycobacterium tuberculosis H37Rv
cgacgacaccgcg

SEQ ID NO: 1321142 - RNA, 17 nt, Mycobacterium tuberculosis H37Rv
cgacgacaccgcgcagc

SEQ ID NO: 1321143 - RNA, 20 nt, Mycobacterium tuberculosis H37Rv
cgacgacaagugcccggcca

SEQ ID NO: 1321144 - RNA, 20 nt, Mycobacterium tuberculosis H37Rv
cgacgacauacgagcaguga

SEQ ID NO: 1321145 - RNA, 22 nt, Mycobacterium tuberculosis H37Rv
cgacgacuucgaaucaggcucc

SEQ ID NO: 1321146 - RNA, 17 nt, Mycobacterium tuberculosis H37Rv
cgacgagaagacaccgc

SEQ ID NO: 1321147 - RNA, 11 nt, Mycobacterium tuberculosis H37Rv
cgacgacugga

SEQ ID NO: 1321148 - RNA, 18 nt, Mycobacterium tuberculosis H37Rv
cgacgaggccacggggcu

SEQ ID NO: 1321149 - RNA, 13 nt, Mycobacterium tuberculosis H37Rv
cgacgagcaccau

SEQ ID NO: 1321150 - RNA, 16 nt, Mycobacterium tuberculosis H37Rv
cgacgagauccagcgc

SEQ ID NO: 1321151 - RNA, 18 nt, Mycobacterium tuberculosis H37Rv
cgacgagauugccgggcc

SEQ ID NO: 1321152 - RNA, 17 nt, Mycobacterium tuberculosis H37Rv
cgacgagaucagccucg

SEQ ID NO: 1321153 - RNA, 15 nt, Mycobacterium tuberculosis H37Rv
cgacgaacaccagcg

SEQ ID NO: 1321154 - RNA, 14 nt, Mycobacterium tuberculosis H37Rv
cgacgaaccgccag

SEQ ID NO: 1321155 - RNA, 14 nt, Mycobacterium tuberculosis H37Rv
cgacgaacugcagc

SEQ ID NO: 1321156 - RNA, 17 nt, Mycobacterium tuberculosis H37Rv
cgacgaacugcagccau

SEQ ID NO: 1321157 - RNA, 14 nt, Mycobacterium tuberculosis H37Rv
cgaccuucaccgcg

SEQ ID NO: 1321158 - RNA, 13 nt, Mycobacterium tuberculosis H37Rv
cgaccagccccgc

SEQ ID NO: 1321159 - RNA, 16 nt, Mycobacterium tuberculosis H37Rv
cgaccagcccgcucuu

SEQ ID NO: 1321160 - RNA, 16 nt, Mycobacterium tuberculosis H37Rv
cgaccagcggccgacc

SEQ ID NO: 1321161 - RNA, 20 nt, Mycobacterium tuberculosis H37Rv
cgaccagcucagcugcggau

SEQ ID NO: 1321162 - RNA, 15 nt, Mycobacterium tuberculosis H37Rv
cgaccagaacgccag

SEQ ID NO: 1321163 - RNA, 16 nt, Mycobacterium tuberculosis H37Rv
cgaccacuucccgcuu

SEQ ID NO: 1321164 - RNA, 15 nt, Mycobacterium tuberculosis H37Rv
cgaccagcagaucca

SEQ ID NO: 1321165 - RNA, 20 nt, Mycobacterium tuberculosis H37Rv
cgaccagcacccgcucggcc

SEQ ID NO: 1321166 - RNA, 11 nt, Mycobacterium tuberculosis H37Rv
cgaccagcaga

SEQ ID NO: 1321167 - RNA, 15 nt, Mycobacterium tuberculosis H37Rv
cgaccaccagcgccg

SEQ ID NO: 1321168 - RNA, 14 nt, Mycobacterium tuberculosis H37Rv
cgaccaccgccgag

SEQ ID NO: 1321169 - RNA, 12 nt, Mycobacterium tuberculosis H37Rv
cgaccaccaccc

SEQ ID NO: 1321170 - RNA, 12 nt, Mycobacterium tuberculosis H37Rv
cgaccaccacca

SEQ ID NO: 1321171 - RNA, 19 nt, Mycobacterium tuberculosis H37Rv
cgaccacauuccgcagucc

SEQ ID NO: 1321172 - RNA, 17 nt, Mycobacterium tuberculosis H37Rv
cgaccaauaccaguccg

SEQ ID NO: 1321173 - RNA, 22 nt, Mycobacterium tuberculosis H37Rv
cgaccacaucaugccagccguc

SEQ ID NO: 1321174 - RNA, 20 nt, Mycobacterium tuberculosis H37Rv
cgaccaccucagcugcggac

SEQ ID NO: 1321175 - RNA, 19 nt, Mycobacterium tuberculosis H37Rv
cgaccaccucagcugcgga

SEQ ID NO: 1321176 - RNA, 22 nt, Mycobacterium tuberculosis H37Rv
cgaccaccugcugcacggucau

SEQ ID NO: 1321177 - RNA, 16 nt, Mycobacterium tuberculosis H37Rv
cgaccacgcaccgccc

SEQ ID NO: 1321178 - RNA, 16 nt, Mycobacterium tuberculosis H37Rv
cgaccacgccgccggc

SEQ ID NO: 1321179 - RNA, 18 nt, Mycobacterium tuberculosis H37Rv
cgaccacuccacgcagcc

SEQ ID NO: 1321180 - RNA, 13 nt, Mycobacterium tuberculosis H37Rv
cgacccagcugac

SEQ ID NO: 1321181 - RNA, 13 nt, Mycobacterium tuberculosis H37Rv
cgacccagcgcgc

SEQ ID NO: 1321182 - RNA, 12 nt, Mycobacterium tuberculosis H37Rv
cgacccagcggu

SEQ ID NO: 1321183 - RNA, 14 nt, Mycobacterium tuberculosis H37Rv
cgacccaucaccag

SEQ ID NO: 1321184 - RNA, 13 nt, Mycobacterium tuberculosis H37Rv
cgacccaucacca

SEQ ID NO: 1321185 - RNA, 17 nt, Mycobacterium tuberculosis H37Rv
cgacccagcugaccuga

SEQ ID NO: 1321186 - RNA, 20 nt, Mycobacterium tuberculosis H37Rv
cgaccauucgagagccucua

SEQ ID NO: 1321187 - RNA, 16 nt, Mycobacterium tuberculosis H37Rv
cgaccaugguagcgcc

SEQ ID NO: 1321188 - RNA, 19 nt, Mycobacterium tuberculosis H37Rv
cgaccccgaagaugaccuc

SEQ ID NO: 1321189 - RNA, 19 nt, Mycobacterium tuberculosis H37Rv
cgaccccgaacauccgccg

SEQ ID NO: 1321190 - RNA, 13 nt, Mycobacterium tuberculosis H37Rv
cgaccccggcggu

SEQ ID NO: 1321191 - RNA, 21 nt, Mycobacterium tuberculosis H37Rv
cgaccccggcgguaccgccgc

SEQ ID NO: 1321192 - RNA, 19 nt, Mycobacterium tuberculosis H37Rv
cgaccccucacccagcugg

SEQ ID NO: 1321193 - RNA, 13 nt, Mycobacterium tuberculosis H37Rv
cgacccgccgccc

SEQ ID NO: 1321194 - RNA, 15 nt, Mycobacterium tuberculosis H37Rv
cgacccgccgcgccc

SEQ ID NO: 1321195 - RNA, 18 nt, Mycobacterium tuberculosis H37Rv
cgacccgccgcgcccggc

SEQ ID NO: 1321196 - RNA, 13 nt, Mycobacterium tuberculosis H37Rv
cgacccgacgcug

SEQ ID NO: 1321197 - RNA, 22 nt, Mycobacterium tuberculosis H37Rv
cgacccgccgacgccgccggcc

SEQ ID NO: 1321198 - RNA, 20 nt, Mycobacterium tuberculosis H37Rv
cgacccgcgcaaccggccgu

SEQ ID NO: 1321199 - RNA, 21 nt, Mycobacterium tuberculosis H37Rv
cgacccgcagaccgccaccgg

SEQ ID NO: 1321200 - RNA, 15 nt, Mycobacterium tuberculosis H37Rv
cgacccgaugaccca

SEQ ID NO: 1321201 - RNA, 20 nt, Mycobacterium tuberculosis H37Rv
cgaccagggccgccgcugcc

SEQ ID NO: 1321202 - RNA, 14 nt, Mycobacterium tuberculosis H37Rv
cgaccagugguggc

SEQ ID NO: 1321203 - RNA, 22 nt, Mycobacterium tuberculosis H37Rv
cgaccaggccagagccgcccuu

SEQ ID NO: 1321204 - RNA, 12 nt, Mycobacterium tuberculosis H37Rv
cgaccagggccg

SEQ ID NO: 1321205 - RNA, 20 nt, Mycobacterium tuberculosis H37Rv
cgaccaucaccacggccgcc

SEQ ID NO: 1321206 - RNA, 19 nt, Mycobacterium tuberculosis H37Rv
cgaccaucucaccgggccc

SEQ ID NO: 1321207 - RNA, 17 nt, Mycobacterium tuberculosis H37Rv
cgaccaugguagcgccc

SEQ ID NO: 1321208 - RNA, 14 nt, Mycobacterium tuberculosis H37Rv
cgaccaugcuccua

SEQ ID NO: 1321209 - RNA, 17 nt, Mycobacterium tuberculosis H37Rv
cgacaucgguggcggcc

SEQ ID NO: 1321210 - RNA, 20 nt, Mycobacterium tuberculosis H37Rv
cgacaucgguggcggccucc

SEQ ID NO: 1321211 - RNA, 22 nt, Mycobacterium tuberculosis H37Rv
cgacaucgguggcggccuccga

SEQ ID NO: 1321212 - RNA, 16 nt, Mycobacterium tuberculosis H37Rv
cgacaucgucaucagc

SEQ ID NO: 1321213 - RNA, 14 nt, Mycobacterium tuberculosis H37Rv
cgacaucaccaccg

SEQ ID NO: 1321214 - RNA, 12 nt, Mycobacterium tuberculosis H37Rv
cgacaucaccac

SEQ ID NO: 1321215 - RNA, 17 nt, Mycobacterium tuberculosis H37Rv
cgacaucacucgcgcca

SEQ ID NO: 1321216 - RNA, 21 nt, Mycobacterium tuberculosis H37Rv
cgacauuugcccgaugguacc

SEQ ID NO: 1321217 - RNA, 14 nt, Mycobacterium tuberculosis H37Rv
cgacagcgcggcgg

SEQ ID NO: 1321218 - RNA, 20 nt, Mycobacterium tuberculosis H37Rv
cgacagcugccugaccggcg

SEQ ID NO: 1321219 - RNA, 15 nt, Mycobacterium tuberculosis H37Rv
cgacagccguggcgc

SEQ ID NO: 1321220 - RNA, 17 nt, Mycobacterium tuberculosis H37Rv
cgacagccccaucacca

SEQ ID NO: 1321221 - RNA, 12 nt, Mycobacterium tuberculosis H37Rv
cgacagcagccg

SEQ ID NO: 1321222 - RNA, 14 nt, Mycobacterium tuberculosis H37Rv
cgacagcaucacgc

SEQ ID NO: 1321223 - RNA, 23 nt, Mycobacterium tuberculosis H37Rv
cgacaggugccagaccagggcag

SEQ ID NO: 1321224 - RNA, 18 nt, Mycobacterium tuberculosis H37Rv
cgacagucaacagggcca

SEQ ID NO: 1321225 - RNA, 23 nt, Mycobacterium tuberculosis H37Rv
cgacaguuuaccgugccgcccgg

SEQ ID NO: 1321226 - RNA, 13 nt, Mycobacterium tuberculosis H37Rv
cgacagugcgcau

SEQ ID NO: 1321227 - RNA, 16 nt, Mycobacterium tuberculosis H37Rv
cgacaggccgagcaga

SEQ ID NO: 1321228 - RNA, 19 nt, Mycobacterium tuberculosis H37Rv
cgacaggccggccaccagu

SEQ ID NO: 1321229 - RNA, 19 nt, Mycobacterium tuberculosis H37Rv
cgacagggacccgagauca

SEQ ID NO: 1321230 - RNA, 21 nt, Mycobacterium tuberculosis H37Rv
cgaagcccagcaccaccaccc

SEQ ID NO: 1321231 - RNA, 15 nt, Mycobacterium tuberculosis H37Rv
cgaagcaccucccga

SEQ ID NO: 1321232 - RNA, 18 nt, Mycobacterium tuberculosis H37Rv
cgaagaugaccgcucgug

SEQ ID NO: 1321233 - RNA, 21 nt, Mycobacterium tuberculosis H37Rv
cgaagauccagcgcaccggcg

SEQ ID NO: 1321234 - RNA, 22 nt, Mycobacterium tuberculosis H37Rv
cgaagaucggcgcuagccaggg

SEQ ID NO: 1321235 - RNA, 20 nt, Mycobacterium tuberculosis H37Rv
cgaagauggccagcgcggcg

SEQ ID NO: 1321236 - RNA, 22 nt, Mycobacterium tuberculosis H37Rv
cgaagaccaagagcgcgcagca

SEQ ID NO: 1321237 - RNA, 20 nt, Mycobacterium tuberculosis H37Rv
cgaagaccuggccugcggca

SEQ ID NO: 1321238 - RNA, 16 nt, Mycobacterium tuberculosis H37Rv
cgaagagccagcaacg

SEQ ID NO: 1321239 - RNA, 13 nt, Mycobacterium tuberculosis H37Rv
cgaagagggcgcc

SEQ ID NO: 1321240 - RNA, 22 nt, Mycobacterium tuberculosis H37Rv
cgaagaaugggauggcaccacc

SEQ ID NO: 1321241 - RNA, 18 nt, Mycobacterium tuberculosis H37Rv
cgaagaaccgccaccaga

SEQ ID NO: 1321242 - RNA, 14 nt, Mycobacterium tuberculosis H37Rv
cgaacucgccccgc

SEQ ID NO: 1321243 - RNA, 21 nt, Mycobacterium tuberculosis H37Rv
cgaacugguuucgcaccgugu

SEQ ID NO: 1321244 - RNA, 18 nt, Mycobacterium tuberculosis H37Rv
cgaacucggcggccagcg

SEQ ID NO: 1321245 - RNA, 19 nt, Mycobacterium tuberculosis H37Rv
cgaacucggcggccagcgc

SEQ ID NO: 1321246 - RNA, 14 nt, Mycobacterium tuberculosis H37Rv
cgaacucgggcgac

SEQ ID NO: 1321247 - RNA, 15 nt, Mycobacterium tuberculosis H37Rv
cgaacuccaucacca

SEQ ID NO: 1321248 - RNA, 14 nt, Mycobacterium tuberculosis H37Rv
cgaacugaucgacc

SEQ ID NO: 1321249 - RNA, 17 nt, Mycobacterium tuberculosis H37Rv
cgaacgguugcucgucc

SEQ ID NO: 1321250 - RNA, 23 nt, Mycobacterium tuberculosis H37Rv
cgaacuaucguugugcggacauc

SEQ ID NO: 1321251 - RNA, 19 nt, Mycobacterium tuberculosis H37Rv
cgaacuccagcagcccggu

SEQ ID NO: 1321252 - RNA, 17 nt, Mycobacterium tuberculosis H37Rv
cgaagcggccaccgccg

SEQ ID NO: 1321253 - RNA, 19 nt, Mycobacterium tuberculosis H37Rv
cgaagcgggcuugagcgcc

SEQ ID NO: 1321254 - RNA, 18 nt, Mycobacterium tuberculosis H37Rv
cgaagcgggacugcagcg

SEQ ID NO: 1321255 - RNA, 18 nt, Mycobacterium tuberculosis H37Rv
cgaagcgaucgccggccg

SEQ ID NO: 1321256 - RNA, 22 nt, Mycobacterium tuberculosis H37Rv
cgaagccgguucgcccagcagg

SEQ ID NO: 1321257 - RNA, 12 nt, Mycobacterium tuberculosis H37Rv
cgaagcccgaca

SEQ ID NO: 1321258 - RNA, 19 nt, Mycobacterium tuberculosis H37Rv
cgaagccgguucgcccagc

SEQ ID NO: 1321259 - RNA, 19 nt, Mycobacterium tuberculosis H37Rv
cgaagccgccgggugcgcc

SEQ ID NO: 1321260 - RNA, 17 nt, Mycobacterium tuberculosis H37Rv
cgaagcccgaguugaag

SEQ ID NO: 1321261 - RNA, 19 nt, Mycobacterium tuberculosis H37Rv
cgaaggccgccaaccguuc

SEQ ID NO: 1321262 - RNA, 14 nt, Mycobacterium tuberculosis H37Rv
cgaaggcggcucca

SEQ ID NO: 1321263 - RNA, 23 nt, Mycobacterium tuberculosis H37Rv
cgaaggaaaaugauagcggcgca

SEQ ID NO: 1321264 - RNA, 17 nt, Mycobacterium tuberculosis H37Rv
cgaaggaugcugucaga

SEQ ID NO: 1321265 - RNA, 15 nt, Mycobacterium tuberculosis H37Rv
cgaagcugaccagac

SEQ ID NO: 1321266 - RNA, 21 nt, Mycobacterium tuberculosis H37Rv
cgaagcgucuggucagccgcg

SEQ ID NO: 1321267 - RNA, 18 nt, Mycobacterium tuberculosis H37Rv
cgaagcguucccgguccu

SEQ ID NO: 1321268 - RNA, 17 nt, Mycobacterium tuberculosis H37Rv
cgaagcggugacccacu

SEQ ID NO: 1321269 - RNA, 14 nt, Mycobacterium tuberculosis H37Rv
cgaaggucuccggc

SEQ ID NO: 1321270 - RNA, 20 nt, Mycobacterium tuberculosis H37Rv
cgaaggucucgaaagccgcg

SEQ ID NO: 1321271 - RNA, 22 nt, Mycobacterium tuberculosis H37Rv
cgaaggucgguaccccagcgcu

SEQ ID NO: 1321272 - RNA, 23 nt, Mycobacterium tuberculosis H37Rv
cgaaggucgcggucgagcaggug

SEQ ID NO: 1321273 - RNA, 20 nt, Mycobacterium tuberculosis H37Rv
cgaaggugaaucgacugauc

SEQ ID NO: 1321274 - RNA, 17 nt, Mycobacterium tuberculosis H37Rv
cgaaggugaaucgacug

SEQ ID NO: 1321275 - RNA, 22 nt, Mycobacterium tuberculosis H37Rv
cgaaggugaacgacaugggcag

SEQ ID NO: 1321276 - RNA, 17 nt, Mycobacterium tuberculosis H37Rv
cgaaguacgacgacccg

SEQ ID NO: 1321277 - RNA, 20 nt, Mycobacterium tuberculosis H37Rv
cgaagguguccuccagcugc

SEQ ID NO: 1321278 - RNA, 22 nt, Mycobacterium tuberculosis H37Rv
cgaagugucgcugcaaccgccg

SEQ ID NO: 1321279 - RNA, 15 nt, Mycobacterium tuberculosis H37Rv
cgaaguuggcuuucg

SEQ ID NO: 1321280 - RNA, 18 nt, Mycobacterium tuberculosis H37Rv
cgaaguuuuggaagcccg

SEQ ID NO: 1321281 - RNA, 15 nt, Mycobacterium tuberculosis H37Rv
cgaagucgcauggcg

SEQ ID NO: 1321282 - RNA, 14 nt, Mycobacterium tuberculosis H37Rv
cgaagugcuccacc

SEQ ID NO: 1321283 - RNA, 18 nt, Mycobacterium tuberculosis H37Rv
cgaaguacuggccgccgc

SEQ ID NO: 1321284 - RNA, 20 nt, Mycobacterium tuberculosis H37Rv
cgaaguagaagcccaggacg

SEQ ID NO: 1321285 - RNA, 15 nt, Mycobacterium tuberculosis H37Rv
cgaaguccuggcaga

SEQ ID NO: 1321286 - RNA, 19 nt, Mycobacterium tuberculosis H37Rv
cgaauugcguucgccgccc

SEQ ID NO: 1321287 - RNA, 14 nt, Mycobacterium tuberculosis H37Rv
cgaauuccggcuca

SEQ ID NO: 1321288 - RNA, 15 nt, Mycobacterium tuberculosis H37Rv
cgaauucagcugcac

SEQ ID NO: 1321289 - RNA, 17 nt, Mycobacterium tuberculosis H37Rv
cgaaucgagacggccac

SEQ ID NO: 1321290 - RNA, 19 nt, Mycobacterium tuberculosis H37Rv
cgaaucugaaaaagcauca

SEQ ID NO: 1321291 - RNA, 13 nt, Mycobacterium tuberculosis H37Rv
cgaaugacggcca

SEQ ID NO: 1321292 - RNA, 16 nt, Mycobacterium tuberculosis H37Rv
cgaaugggggcugguc

SEQ ID NO: 1321293 - RNA, 20 nt, Mycobacterium tuberculosis H37Rv
cgaaugcugggcccgccagc

SEQ ID NO: 1321294 - RNA, 18 nt, Mycobacterium tuberculosis H37Rv
cgaaugaucgucccgcgg

SEQ ID NO: 1321295 - RNA, 14 nt, Mycobacterium tuberculosis H37Rv
cgaaugcugacaug

SEQ ID NO: 1321296 - RNA, 17 nt, Mycobacterium tuberculosis H37Rv
cgaaucccgcgcccggc

SEQ ID NO: 1321297 - RNA, 19 nt, Mycobacterium tuberculosis H37Rv
cgaauagccaccaagcaca

SEQ ID NO: 1321298 - RNA, 21 nt, Mycobacterium tuberculosis H37Rv
cgaauaccgguggcagccugc

SEQ ID NO: 1321299 - RNA, 20 nt, Mycobacterium tuberculosis H37Rv
cgacagcacccggccaccgg

SEQ ID NO: 1321300 - RNA, 16 nt, Mycobacterium tuberculosis H37Rv
cgacaccguguugcug

SEQ ID NO: 1321301 - RNA, 18 nt, Mycobacterium tuberculosis H37Rv
cgacacccagccgcagcc

SEQ ID NO: 1321302 - RNA, 15 nt, Mycobacterium tuberculosis H37Rv
cgacaccggcugacc

SEQ ID NO: 1321303 - RNA, 23 nt, Mycobacterium tuberculosis H37Rv
cgacacccugggugccggcagcg

SEQ ID NO: 1321304 - RNA, 19 nt, Mycobacterium tuberculosis H37Rv
cgacacccgaugugcccgg

SEQ ID NO: 1321305 - RNA, 11 nt, Mycobacterium tuberculosis H37Rv
cgacacccucg

SEQ ID NO: 1321306 - RNA, 20 nt, Mycobacterium tuberculosis H37Rv
cgacaccgcggugccccgga

SEQ ID NO: 1321307 - RNA, 16 nt, Mycobacterium tuberculosis H37Rv
cgacaccggccgcgac

SEQ ID NO: 1321308 - RNA, 14 nt, Mycobacterium tuberculosis H37Rv
cgacaauucccuug

SEQ ID NO: 1321309 - RNA, 18 nt, Mycobacterium tuberculosis H37Rv
cgacaacccggccgggcc

SEQ ID NO: 1321310 - RNA, 14 nt, Mycobacterium tuberculosis H37Rv
cgacaacacccacg

SEQ ID NO: 1321311 - RNA, 16 nt, Mycobacterium tuberculosis H37Rv
cgacaagaccggcggg

SEQ ID NO: 1321312 - RNA, 22 nt, Mycobacterium tuberculosis H37Rv
cgacaagugcacgaaguccugg

SEQ ID NO: 1321313 - RNA, 15 nt, Mycobacterium tuberculosis H37Rv
cgacaaucaccaacg

SEQ ID NO: 1321314 - RNA, 21 nt, Mycobacterium tuberculosis H37Rv
cgaauuggugcgcaucgagcg

SEQ ID NO: 1321315 - RNA, 14 nt, Mycobacterium tuberculosis H37Rv
ccaaaggacgacac

SEQ ID NO: 1321316 - RNA, 22 nt, Mycobacterium tuberculosis H37Rv
ccaaagcacuucacgaguagcg

SEQ ID NO: 1321317 - RNA, 23 nt, Mycobacterium tuberculosis H37Rv
ccaaaaugccuuggcagcccagu

SEQ ID NO: 1321318 - RNA, 23 nt, Mycobacterium tuberculosis H37Rv
ccaaaauccuucgcgcucauugc

SEQ ID NO: 1321319 - RNA, 21 nt, Mycobacterium tuberculosis H37Rv
ccaaacacccuugcccacggc

SEQ ID NO: 1321320 - RNA, 22 nt, Mycobacterium tuberculosis H37Rv
ccaaaccggcccgcagcagcau

SEQ ID NO: 1321321 - RNA, 14 nt, Mycobacterium tuberculosis H37Rv
ccaaccgggccgcc

SEQ ID NO: 1321322 - RNA, 21 nt, Mycobacterium tuberculosis H37Rv
ccaaccucggaucgccaggcc

SEQ ID NO: 1321323 - RNA, 22 nt, Mycobacterium tuberculosis H37Rv
ccaaccucggaucgccaggccg

SEQ ID NO: 1321324 - RNA, 17 nt, Mycobacterium tuberculosis H37Rv
ccaacgacuguggcgcc

SEQ ID NO: 1321325 - RNA, 16 nt, Mycobacterium tuberculosis H37Rv
ccaacgccaccgucgc

SEQ ID NO: 1321326 - RNA, 20 nt, Mycobacterium tuberculosis H37Rv
ccaacgaucagucgucuuga

SEQ ID NO: 1321327 - RNA, 13 nt, Mycobacterium tuberculosis H37Rv
ccaacgccagcgg

SEQ ID NO: 1321328 - RNA, 13 nt, Mycobacterium tuberculosis H37Rv
ccaacgcccgggc

SEQ ID NO: 1321329 - RNA, 14 nt, Mycobacterium tuberculosis H37Rv
ccaacgcccgggcg

SEQ ID NO: 1321330 - RNA, 16 nt, Mycobacterium tuberculosis H37Rv
ccaacgcgcagagcgu

SEQ ID NO: 1321331 - RNA, 23 nt, Mycobacterium tuberculosis H37Rv
ccaacggggcagucaacucccga

SEQ ID NO: 1321332 - RNA, 15 nt, Mycobacterium tuberculosis H37Rv
ccaacgcuucugccu

SEQ ID NO: 1321333 - RNA, 18 nt, Mycobacterium tuberculosis H37Rv
ccaacggcagcgccaccg

SEQ ID NO: 1321334 - RNA, 23 nt, Mycobacterium tuberculosis H37Rv
ccaacgggcagguaggucugggc

SEQ ID NO: 1321335 - RNA, 22 nt, Mycobacterium tuberculosis H37Rv
ccaacgcgggaacgaugccgcc

SEQ ID NO: 1321336 - RNA, 19 nt, Mycobacterium tuberculosis H37Rv
ccaacgcgguaaagccccg

SEQ ID NO: 1321337 - RNA, 13 nt, Mycobacterium tuberculosis H37Rv
ccaacgcgguggg

SEQ ID NO: 1321338 - RNA, 21 nt, Mycobacterium tuberculosis H37Rv
ccaacgcggugggcacagcca

SEQ ID NO: 1321339 - RNA, 22 nt, Mycobacterium tuberculosis H37Rv
ccaacgcggugggcacagccag

SEQ ID NO: 1321340 - RNA, 18 nt, Mycobacterium tuberculosis H37Rv
ccaacuccucagccgccu

SEQ ID NO: 1321341 - RNA, 18 nt, Mycobacterium tuberculosis H37Rv
ccaacuccaagaugccgc

SEQ ID NO: 1321342 - RNA, 21 nt, Mycobacterium tuberculosis H37Rv
ccaacuccaagaugccgcccc

SEQ ID NO: 1321343 - RNA, 18 nt, Mycobacterium tuberculosis H37Rv
ccaacguuuugggcgccg

SEQ ID NO: 1321344 - RNA, 22 nt, Mycobacterium tuberculosis H37Rv
ccaacucuucagcaagccaacc

SEQ ID NO: 1321345 - RNA, 12 nt, Mycobacterium tuberculosis H37Rv
ccaacucggcca

SEQ ID NO: 1321346 - RNA, 15 nt, Mycobacterium tuberculosis H37Rv
ccaaccagcccggcc

SEQ ID NO: 1321347 - RNA, 20 nt, Mycobacterium tuberculosis H37Rv
ccaacagucgcagcacggcu

SEQ ID NO: 1321348 - RNA, 20 nt, Mycobacterium tuberculosis H37Rv
ccaaccaugcgguuagcagc

SEQ ID NO: 1321349 - RNA, 13 nt, Mycobacterium tuberculosis H37Rv
ccaacccggcggc

SEQ ID NO: 1321350 - RNA, 19 nt, Mycobacterium tuberculosis H37Rv
ccaacccggcgggcccgcc

SEQ ID NO: 1321351 - RNA, 20 nt, Mycobacterium tuberculosis H37Rv
ccaacccggcgggcccgccg

SEQ ID NO: 1321352 - RNA, 15 nt, Mycobacterium tuberculosis H37Rv
ccaacccgggccgcc

SEQ ID NO: 1321353 - RNA, 16 nt, Mycobacterium tuberculosis H37Rv
ccaacccgggccgcca

SEQ ID NO: 1321354 - RNA, 22 nt, Mycobacterium tuberculosis H37Rv
ccaacccuaaaccagccaccac

SEQ ID NO: 1321355 - RNA, 20 nt, Mycobacterium tuberculosis H37Rv
ccaaccgagcgcccuccucg

SEQ ID NO: 1321356 - RNA, 20 nt, Mycobacterium tuberculosis H37Rv
ccaaccgcgggaacccccca

SEQ ID NO: 1321357 - RNA, 17 nt, Mycobacterium tuberculosis H37Rv
ccaaccgcauauucacc

SEQ ID NO: 1321358 - RNA, 18 nt, Mycobacterium tuberculosis H37Rv
ccaacacaaacgccgccg

SEQ ID NO: 1321359 - RNA, 19 nt, Mycobacterium tuberculosis H37Rv
ccaacacaaacgccgccgg

SEQ ID NO: 1321360 - RNA, 14 nt, Mycobacterium tuberculosis H37Rv
ccaacaccgcccgc

SEQ ID NO: 1321361 - RNA, 17 nt, Mycobacterium tuberculosis H37Rv
ccaacagcacccgggcc

SEQ ID NO: 1321362 - RNA, 21 nt, Mycobacterium tuberculosis H37Rv
ccaacaccuguuugagcgcac

SEQ ID NO: 1321363 - RNA, 20 nt, Mycobacterium tuberculosis H37Rv
ccaagcugucaagcgggcug

SEQ ID NO: 1321364 - RNA, 16 nt, Mycobacterium tuberculosis H37Rv
ccaaggcucagcagcg

SEQ ID NO: 1321365 - RNA, 13 nt, Mycobacterium tuberculosis H37Rv
ccaaggcucagca

SEQ ID NO: 1321366 - RNA, 20 nt, Mycobacterium tuberculosis H37Rv
ccaagggauccgaagagcca

SEQ ID NO: 1321367 - RNA, 15 nt, Mycobacterium tuberculosis H37Rv
ccaagguguccagca

SEQ ID NO: 1321368 - RNA, 20 nt, Mycobacterium tuberculosis H37Rv
ccaaggucuucaggccgcgc

SEQ ID NO: 1321369 - RNA, 15 nt, Mycobacterium tuberculosis H37Rv
ccaagguaguucgac

SEQ ID NO: 1321370 - RNA, 16 nt, Mycobacterium tuberculosis H37Rv
ccaaguugaccuucac

SEQ ID NO: 1321371 - RNA, 17 nt, Mycobacterium tuberculosis H37Rv
ccaaguucuaagcguuu

SEQ ID NO: 1321372 - RNA, 14 nt, Mycobacterium tuberculosis H37Rv
ccaaguccagcagc

SEQ ID NO: 1321373 - RNA, 22 nt, Mycobacterium tuberculosis H37Rv
ccaagucagaacggcggcagcg

SEQ ID NO: 1321374 - RNA, 18 nt, Mycobacterium tuberculosis H37Rv
ccaagaucggcgccccug

SEQ ID NO: 1321375 - RNA, 12 nt, Mycobacterium tuberculosis H37Rv
ccaagauggcgc

SEQ ID NO: 1321376 - RNA, 18 nt, Mycobacterium tuberculosis H37Rv
ccaagagcgcgcagcagu

SEQ ID NO: 1321377 - RNA, 21 nt, Mycobacterium tuberculosis H37Rv
ccaagccgggugggagcagcc

SEQ ID NO: 1321378 - RNA, 12 nt, Mycobacterium tuberculosis H37Rv
ccaagccgugcc

SEQ ID NO: 1321379 - RNA, 19 nt, Mycobacterium tuberculosis H37Rv
ccaagccggcugcauccuc

SEQ ID NO: 1321380 - RNA, 15 nt, Mycobacterium tuberculosis H37Rv
ccaagccggagcccg

SEQ ID NO: 1321381 - RNA, 16 nt, Mycobacterium tuberculosis H37Rv
ccaagccggagcccgg

SEQ ID NO: 1321382 - RNA, 16 nt, Mycobacterium tuberculosis H37Rv
ccaagccgcggcuagg

SEQ ID NO: 1321383 - RNA, 19 nt, Mycobacterium tuberculosis H37Rv
ccaaucuucucgagccgcc

SEQ ID NO: 1321384 - RNA, 18 nt, Mycobacterium tuberculosis H37Rv
ccaaugacuuggccagca

SEQ ID NO: 1321385 - RNA, 15 nt, Mycobacterium tuberculosis H37Rv
ccaaucgaguagcug

SEQ ID NO: 1321386 - RNA, 23 nt, Mycobacterium tuberculosis H37Rv
ccaauccggaauagcaacgcugc

SEQ ID NO: 1321387 - RNA, 15 nt, Mycobacterium tuberculosis H37Rv
ccaaucagcccgccg

SEQ ID NO: 1321388 - RNA, 23 nt, Mycobacterium tuberculosis H37Rv
ccaauaggcgaaaauugcuccac

SEQ ID NO: 1321389 - RNA, 14 nt, Mycobacterium tuberculosis H37Rv
ccacagcgacagcg

SEQ ID NO: 1321390 - RNA, 11 nt, Mycobacterium tuberculosis H37Rv
ccacagcccca

SEQ ID NO: 1321391 - RNA, 11 nt, Mycobacterium tuberculosis H37Rv
ccacagcgcca

SEQ ID NO: 1321392 - RNA, 19 nt, Mycobacterium tuberculosis H37Rv
ccacagcgccaucagacca

SEQ ID NO: 1321393 - RNA, 13 nt, Mycobacterium tuberculosis H37Rv
ccacagcucgccg

SEQ ID NO: 1321394 - RNA, 22 nt, Mycobacterium tuberculosis H37Rv
ccacaggggcagcgcggccacc

SEQ ID NO: 1321395 - RNA, 18 nt, Mycobacterium tuberculosis H37Rv
ccacagucgucgagcgcu

SEQ ID NO: 1321396 - RNA, 23 nt, Mycobacterium tuberculosis H37Rv
ccacagguuugcgccgcgcagcg

SEQ ID NO: 1321397 - RNA, 14 nt, Mycobacterium tuberculosis H37Rv
ccacaggugaccuu

SEQ ID NO: 1321398 - RNA, 16 nt, Mycobacterium tuberculosis H37Rv
ccacagguagaccguc

SEQ ID NO: 1321399 - RNA, 23 nt, Mycobacterium tuberculosis H37Rv
ccacaggggcagcgcggccaccc

SEQ ID NO: 1321400 - RNA, 12 nt, Mycobacterium tuberculosis H37Rv
ccacagacgacg

SEQ ID NO: 1321401 - RNA, 19 nt, Mycobacterium tuberculosis H37Rv
ccacagacgacgucggcgu

SEQ ID NO: 1321402 - RNA, 23 nt, Mycobacterium tuberculosis H37Rv
ccacacucgccagggccaucugg

SEQ ID NO: 1321403 - RNA, 17 nt, Mycobacterium tuberculosis H37Rv
ccacacggggccgccag

SEQ ID NO: 1321404 - RNA, 12 nt, Mycobacterium tuberculosis H37Rv
ccacacgcugcc

SEQ ID NO: 1321405 - RNA, 13 nt, Mycobacterium tuberculosis H37Rv
ccacacgaagugg

SEQ ID NO: 1321406 - RNA, 17 nt, Mycobacterium tuberculosis H37Rv
ccacaccuucggcuggu

SEQ ID NO: 1321407 - RNA, 16 nt, Mycobacterium tuberculosis H37Rv
ccacaccuuggccgcc

SEQ ID NO: 1321408 - RNA, 19 nt, Mycobacterium tuberculosis H37Rv
ccacaccuccucgagcagg

SEQ ID NO: 1321409 - RNA, 16 nt, Mycobacterium tuberculosis H37Rv
ccacaccggggcggcc

SEQ ID NO: 1321410 - RNA, 18 nt, Mycobacterium tuberculosis H37Rv
ccacacaccgagcacggg

SEQ ID NO: 1321411 - RNA, 11 nt, Mycobacterium tuberculosis H37Rv
ccacaccagcg

SEQ ID NO: 1321412 - RNA, 15 nt, Mycobacterium tuberculosis H37Rv
ccacaccagcgcagc

SEQ ID NO: 1321413 - RNA, 15 nt, Mycobacterium tuberculosis H37Rv
ccacacccaguugau

SEQ ID NO: 1321414 - RNA, 15 nt, Mycobacterium tuberculosis H37Rv
ccacaccgaguugau

SEQ ID NO: 1321415 - RNA, 13 nt, Mycobacterium tuberculosis H37Rv
ccacaccggcagc

SEQ ID NO: 1321416 - RNA, 15 nt, Mycobacterium tuberculosis H37Rv
ccacaccggagccga

SEQ ID NO: 1321417 - RNA, 15 nt, Mycobacterium tuberculosis H37Rv
ccaauugcgccgcca

SEQ ID NO: 1321418 - RNA, 19 nt, Mycobacterium tuberculosis H37Rv
ccacaaucagcccgacacc

SEQ ID NO: 1321419 - RNA, 13 nt, Mycobacterium tuberculosis H37Rv
ccacaauccacgc

SEQ ID NO: 1321420 - RNA, 20 nt, Mycobacterium tuberculosis H37Rv
ccacaaccgugagcaccagc

SEQ ID NO: 1321421 - RNA, 22 nt, Mycobacterium tuberculosis H37Rv
ccaaugccgcggaggcggccag

SEQ ID NO: 1321422 - RNA, 19 nt, Mycobacterium tuberculosis H37Rv
ccaaugccuugagcaaaau

SEQ ID NO: 1321423 - RNA, 17 nt, Mycobacterium tuberculosis H37Rv
ccaaugccaccgcggcc

SEQ ID NO: 1321424 - RNA, 15 nt, Mycobacterium tuberculosis H37Rv
ccaauggcguucguc

SEQ ID NO: 1321425 - RNA, 20 nt, Mycobacterium tuberculosis H37Rv
ccaauggugggcgagcugcu

SEQ ID NO: 1321426 - RNA, 17 nt, Mycobacterium tuberculosis H37Rv
ccaauucgacugcaacu

SEQ ID NO: 1321427 - RNA, 23 nt, Mycobacterium tuberculosis H37Rv
ccaauucgacugcaacucuuccc

SEQ ID NO: 1321428 - RNA, 16 nt, Mycobacterium tuberculosis H37Rv
ccaauugauaggcccc

SEQ ID NO: 1321429 - RNA, 14 nt, Mycobacterium tuberculosis H37Rv
ccacggcagcgccg

SEQ ID NO: 1321430 - RNA, 23 nt, Mycobacterium tuberculosis H37Rv
ccacggcagccaaccggcgcagu

SEQ ID NO: 1321431 - RNA, 21 nt, Mycobacterium tuberculosis H37Rv
ccacggcagccaaccggcgca

SEQ ID NO: 1321432 - RNA, 12 nt, Mycobacterium tuberculosis H37Rv
ccacggcagcca

SEQ ID NO: 1321433 - RNA, 13 nt, Mycobacterium tuberculosis H37Rv
ccacggccgccga

SEQ ID NO: 1321434 - RNA, 13 nt, Mycobacterium tuberculosis H37Rv
ccacggccgccgc

SEQ ID NO: 1321435 - RNA, 20 nt, Mycobacterium tuberculosis H37Rv
ccacggcgaugcagccacau

SEQ ID NO: 1321436 - RNA, 15 nt, Mycobacterium tuberculosis H37Rv
ccacggcgaugcagc

SEQ ID NO: 1321437 - RNA, 16 nt, Mycobacterium tuberculosis H37Rv
ccacggcgaccacgcc

SEQ ID NO: 1321438 - RNA, 20 nt, Mycobacterium tuberculosis H37Rv
ccacggcggcaucaccuggc

SEQ ID NO: 1321439 - RNA, 19 nt, Mycobacterium tuberculosis H37Rv
ccacggcggccaccugcug

SEQ ID NO: 1321440 - RNA, 21 nt, Mycobacterium tuberculosis H37Rv
ccacggcggccaccugcuggc

SEQ ID NO: 1321441 - RNA, 23 nt, Mycobacterium tuberculosis H37Rv
ccacggcgcgcgcgccggcugcc

SEQ ID NO: 1321442 - RNA, 20 nt, Mycobacterium tuberculosis H37Rv
ccacggcgaccacgccgccg

SEQ ID NO: 1321443 - RNA, 23 nt, Mycobacterium tuberculosis H37Rv
ccacggcgaccaggagccuccag

SEQ ID NO: 1321444 - RNA, 16 nt, Mycobacterium tuberculosis H37Rv
ccacggccuucagcgg

SEQ ID NO: 1321445 - RNA, 18 nt, Mycobacterium tuberculosis H37Rv
ccacggccggccgcugcc

SEQ ID NO: 1321446 - RNA, 14 nt, Mycobacterium tuberculosis H37Rv
ccacggccggccgc

SEQ ID NO: 1321447 - RNA, 15 nt, Mycobacterium tuberculosis H37Rv
ccacggcguggcgcc

SEQ ID NO: 1321448 - RNA, 15 nt, Mycobacterium tuberculosis H37Rv
ccacggcgucggcca

SEQ ID NO: 1321449 - RNA, 17 nt, Mycobacterium tuberculosis H37Rv
ccacggcuuugcggcgc

SEQ ID NO: 1321450 - RNA, 16 nt, Mycobacterium tuberculosis H37Rv
ccacggucauugggug

SEQ ID NO: 1321451 - RNA, 14 nt, Mycobacterium tuberculosis H37Rv
ccacggggcagguc

SEQ ID NO: 1321452 - RNA, 18 nt, Mycobacterium tuberculosis H37Rv
ccacggugcgauccccaa

SEQ ID NO: 1321453 - RNA, 14 nt, Mycobacterium tuberculosis H37Rv
ccacggugcgguga

SEQ ID NO: 1321454 - RNA, 18 nt, Mycobacterium tuberculosis H37Rv
ccacggugccgacgauga

SEQ ID NO: 1321455 - RNA, 17 nt, Mycobacterium tuberculosis H37Rv
ccacgauggcggccacc

SEQ ID NO: 1321456 - RNA, 11 nt, Mycobacterium tuberculosis H37Rv
ccacgccaccg

SEQ ID NO: 1321457 - RNA, 18 nt, Mycobacterium tuberculosis H37Rv
ccacgccagcucgccggc

SEQ ID NO: 1321458 - RNA, 22 nt, Mycobacterium tuberculosis H37Rv
ccacgcucggcggccagcuccc

SEQ ID NO: 1321459 - RNA, 14 nt, Mycobacterium tuberculosis H37Rv
ccacgcugccgcag

SEQ ID NO: 1321460 - RNA, 15 nt, Mycobacterium tuberculosis H37Rv
ccacgcugccgcagu

SEQ ID NO: 1321461 - RNA, 23 nt, Mycobacterium tuberculosis H37Rv
ccacgcugguguuguacuggcuc

SEQ ID NO: 1321462 - RNA, 22 nt, Mycobacterium tuberculosis H37Rv
ccacggcaaaggcgcucugcug

SEQ ID NO: 1321463 - RNA, 18 nt, Mycobacterium tuberculosis H37Rv
ccacggcaaucaacgcaa

SEQ ID NO: 1321464 - RNA, 17 nt, Mycobacterium tuberculosis H37Rv
ccacggcaaaggcgcuc

SEQ ID NO: 1321465 - RNA, 17 nt, Mycobacterium tuberculosis H37Rv
ccacggacgugacgucg

SEQ ID NO: 1321466 - RNA, 17 nt, Mycobacterium tuberculosis H37Rv
ccacggagaccggccgg

SEQ ID NO: 1321467 - RNA, 14 nt, Mycobacterium tuberculosis H37Rv
ccaccgacagcccc

SEQ ID NO: 1321468 - RNA, 22 nt, Mycobacterium tuberculosis H37Rv
ccaccgacagcacccggccacc

SEQ ID NO: 1321469 - RNA, 19 nt, Mycobacterium tuberculosis H37Rv
ccaccgacguggccagccc

SEQ ID NO: 1321470 - RNA, 22 nt, Mycobacterium tuberculosis H37Rv
ccaccgacgacaucgguggccc

SEQ ID NO: 1321471 - RNA, 23 nt, Mycobacterium tuberculosis H37Rv
ccaccgacggaaugucagccggu

SEQ ID NO: 1321472 - RNA, 22 nt, Mycobacterium tuberculosis H37Rv
ccaccgacauguguggcagccc

SEQ ID NO: 1321473 - RNA, 20 nt, Mycobacterium tuberculosis H37Rv
ccaccgaagcggugacccac

SEQ ID NO: 1321474 - RNA, 24 nt, Mycobacterium tuberculosis H37Rv
ccaccgaacgcggccaccgaccgc

SEQ ID NO: 1321475 - RNA, 19 nt, Mycobacterium tuberculosis H37Rv
ccaccgaaaaguccgccgc

SEQ ID NO: 1321476 - RNA, 12 nt, Mycobacterium tuberculosis H37Rv
ccacccuugccg

SEQ ID NO: 1321477 - RNA, 15 nt, Mycobacterium tuberculosis H37Rv
ccacccuugccgccg

SEQ ID NO: 1321478 - RNA, 15 nt, Mycobacterium tuberculosis H37Rv
ccaccccgucugcag

SEQ ID NO: 1321479 - RNA, 14 nt, Mycobacterium tuberculosis H37Rv
ccaccccguagcgg

SEQ ID NO: 1321480 - RNA, 23 nt, Mycobacterium tuberculosis H37Rv
ccacccuaaucguuccgcagucu

SEQ ID NO: 1321481 - RNA, 19 nt, Mycobacterium tuberculosis H37Rv
ccaccccccagcgccgccg

SEQ ID NO: 1321482 - RNA, 14 nt, Mycobacterium tuberculosis H37Rv
ccacccccaccgaa

SEQ ID NO: 1321483 - RNA, 13 nt, Mycobacterium tuberculosis H37Rv
ccacccccgguuc

SEQ ID NO: 1321484 - RNA, 20 nt, Mycobacterium tuberculosis H37Rv
ccaccccgaggccgaccucg

SEQ ID NO: 1321485 - RNA, 19 nt, Mycobacterium tuberculosis H37Rv
ccaccccgcguaugccagg

SEQ ID NO: 1321486 - RNA, 17 nt, Mycobacterium tuberculosis H37Rv
ccaccgagaucaugccg

SEQ ID NO: 1321487 - RNA, 16 nt, Mycobacterium tuberculosis H37Rv
ccaccguuaccgccgu

SEQ ID NO: 1321488 - RNA, 24 nt, Mycobacterium tuberculosis H37Rv
ccaccguugccgaaccacgcgccc

SEQ ID NO: 1321489 - RNA, 19 nt, Mycobacterium tuberculosis H37Rv
ccaccguuugcgcaccggu

SEQ ID NO: 1321490 - RNA, 15 nt, Mycobacterium tuberculosis H37Rv
ccaccguuaccgccg

SEQ ID NO: 1321491 - RNA, 23 nt, Mycobacterium tuberculosis H37Rv
ccaccgugucacgcgaccaccgc

SEQ ID NO: 1321492 - RNA, 16 nt, Mycobacterium tuberculosis H37Rv
ccaccgucgccgccgg

SEQ ID NO: 1321493 - RNA, 16 nt, Mycobacterium tuberculosis H37Rv
ccaccguagccgaggg

SEQ ID NO: 1321494 - RNA, 18 nt, Mycobacterium tuberculosis H37Rv
ccaccgagcccuccaggg

SEQ ID NO: 1321495 - RNA, 17 nt, Mycobacterium tuberculosis H37Rv
ccaccgucucgccgcgc

SEQ ID NO: 1321496 - RNA, 16 nt, Mycobacterium tuberculosis H37Rv
ccaccgucaccgccgu

SEQ ID NO: 1321497 - RNA, 19 nt, Mycobacterium tuberculosis H37Rv
ccaccgucaccgccggcac

SEQ ID NO: 1321498 - RNA, 20 nt, Mycobacterium tuberculosis H37Rv
ccaccuuggcugggcccgcc

SEQ ID NO: 1321499 - RNA, 20 nt, Mycobacterium tuberculosis H37Rv
ccacgagcguagcgaccucg

SEQ ID NO: 1321500 - RNA, 15 nt, Mycobacterium tuberculosis H37Rv
ccacgaggcuugcgg

SEQ ID NO: 1321501 - RNA, 15 nt, Mycobacterium tuberculosis H37Rv
ccacgaguuggccaa

SEQ ID NO: 1321502 - RNA, 17 nt, Mycobacterium tuberculosis H37Rv
ccacgaacccucagccg

SEQ ID NO: 1321503 - RNA, 15 nt, Mycobacterium tuberculosis H37Rv
ccacgaucagcagcg

SEQ ID NO: 1321504 - RNA, 18 nt, Mycobacterium tuberculosis H37Rv
ccaccucgaugccgcccc

SEQ ID NO: 1321505 - RNA, 19 nt, Mycobacterium tuberculosis H37Rv
ccaccucggugaccaggcc

SEQ ID NO: 1321506 - RNA, 12 nt, Mycobacterium tuberculosis H37Rv
ccaccucccagg

SEQ ID NO: 1321507 - RNA, 19 nt, Mycobacterium tuberculosis H37Rv
ccaccuucggguagccccg

SEQ ID NO: 1321508 - RNA, 20 nt, Mycobacterium tuberculosis H37Rv
ccaccuuggaugcccugccc

SEQ ID NO: 1321509 - RNA, 20 nt, Mycobacterium tuberculosis H37Rv
ccaccucggugaccaggccg

SEQ ID NO: 1321510 - RNA, 22 nt, Mycobacterium tuberculosis H37Rv
ccaccucggugaccaggccggc

SEQ ID NO: 1321511 - RNA, 16 nt, Mycobacterium tuberculosis H37Rv
ccaccacugcgcccgc

SEQ ID NO: 1321512 - RNA, 18 nt, Mycobacterium tuberculosis H37Rv
ccaccacugcgcccgcca

SEQ ID NO: 1321513 - RNA, 13 nt, Mycobacterium tuberculosis H37Rv
ccaccagaaacac

SEQ ID NO: 1321514 - RNA, 23 nt, Mycobacterium tuberculosis H37Rv
ccaccacgucgggaugcccgcug

SEQ ID NO: 1321515 - RNA, 18 nt, Mycobacterium tuberculosis H37Rv
ccaccagaccaggaagca

SEQ ID NO: 1321516 - RNA, 14 nt, Mycobacterium tuberculosis H37Rv
ccaccaccuggccg

SEQ ID NO: 1321517 - RNA, 23 nt, Mycobacterium tuberculosis H37Rv
ccaccaccgucgagccggacagg

SEQ ID NO: 1321518 - RNA, 13 nt, Mycobacterium tuberculosis H37Rv
ccaccaccuccgc

SEQ ID NO: 1321519 - RNA, 19 nt, Mycobacterium tuberculosis H37Rv
ccaccacgccgucgacaac

SEQ ID NO: 1321520 - RNA, 23 nt, Mycobacterium tuberculosis H37Rv
ccaccacggucaagccggcgccc

SEQ ID NO: 1321521 - RNA, 22 nt, Mycobacterium tuberculosis H37Rv
ccaccacggccagaaacccggc

SEQ ID NO: 1321522 - RNA, 12 nt, Mycobacterium tuberculosis H37Rv
ccaccagcgccc

SEQ ID NO: 1321523 - RNA, 22 nt, Mycobacterium tuberculosis H37Rv
ccaccagcgacgaccacaccac

SEQ ID NO: 1321524 - RNA, 17 nt, Mycobacterium tuberculosis H37Rv
ccaccagcgcccggccc

SEQ ID NO: 1321525 - RNA, 13 nt, Mycobacterium tuberculosis H37Rv
ccacccagugcca

SEQ ID NO: 1321526 - RNA, 22 nt, Mycobacterium tuberculosis H37Rv
ccacccauggccucccacucac

SEQ ID NO: 1321527 - RNA, 23 nt, Mycobacterium tuberculosis H37Rv
ccaccauguauuucucccagccc

SEQ ID NO: 1321528 - RNA, 13 nt, Mycobacterium tuberculosis H37Rv
ccacccacccgca

SEQ ID NO: 1321529 - RNA, 16 nt, Mycobacterium tuberculosis H37Rv
ccacccacccgcacca

SEQ ID NO: 1321530 - RNA, 23 nt, Mycobacterium tuberculosis H37Rv
ccacccacauggcggcccggugg

SEQ ID NO: 1321531 - RNA, 17 nt, Mycobacterium tuberculosis H37Rv
ccacccaacagcccacc

SEQ ID NO: 1321532 - RNA, 21 nt, Mycobacterium tuberculosis H37Rv
ccaccaguggcgcgugcagcg

SEQ ID NO: 1321533 - RNA, 24 nt, Mycobacterium tuberculosis H37Rv
ccacccaacgcggugggcacagcc

SEQ ID NO: 1321534 - RNA, 23 nt, Mycobacterium tuberculosis H37Rv
ccaccaucgccgccguugccgcc

SEQ ID NO: 1321535 - RNA, 14 nt, Mycobacterium tuberculosis H37Rv
ccaccaucgccucg

SEQ ID NO: 1321536 - RNA, 19 nt, Mycobacterium tuberculosis H37Rv
ccaccagugagcccgcuuc

SEQ ID NO: 1321537 - RNA, 20 nt, Mycobacterium tuberculosis H37Rv
ccaccagugcaucgaucacc

SEQ ID NO: 1321538 - RNA, 17 nt, Mycobacterium tuberculosis H37Rv
ccaccagugagcccgcu

SEQ ID NO: 1321539 - RNA, 15 nt, Mycobacterium tuberculosis H37Rv
ccaccaggugccgug

SEQ ID NO: 1321540 - RNA, 23 nt, Mycobacterium tuberculosis H37Rv
ccaccagggcaacggccgcuagc

SEQ ID NO: 1321541 - RNA, 15 nt, Mycobacterium tuberculosis H37Rv
ccaccaccgacgagg

SEQ ID NO: 1321542 - RNA, 17 nt, Mycobacterium tuberculosis H37Rv
ccaccaccgccgccgaa

SEQ ID NO: 1321543 - RNA, 12 nt, Mycobacterium tuberculosis H37Rv
ccaccaccgcuc

SEQ ID NO: 1321544 - RNA, 23 nt, Mycobacterium tuberculosis H37Rv
ccaccaccggcacccgcuggcgg

SEQ ID NO: 1321545 - RNA, 14 nt, Mycobacterium tuberculosis H37Rv
ccaccaccuccgcg

SEQ ID NO: 1321546 - RNA, 15 nt, Mycobacterium tuberculosis H37Rv
ccaccaccggcgccu

SEQ ID NO: 1321547 - RNA, 13 nt, Mycobacterium tuberculosis H37Rv
ccaccaccggcgc

SEQ ID NO: 1321548 - RNA, 13 nt, Mycobacterium tuberculosis H37Rv
ccaccacccggcg

SEQ ID NO: 1321549 - RNA, 22 nt, Mycobacterium tuberculosis H37Rv
ccaccacaucgcgggcgugccg

SEQ ID NO: 1321550 - RNA, 14 nt, Mycobacterium tuberculosis H37Rv
ccaccaaaccccaa

SEQ ID NO: 1321551 - RNA, 15 nt, Mycobacterium tuberculosis H37Rv
ccaccaaaccgccgg

SEQ ID NO: 1321552 - RNA, 20 nt, Mycobacterium tuberculosis H37Rv
ccacauuccguagccggcgg

SEQ ID NO: 1321553 - RNA, 16 nt, Mycobacterium tuberculosis H37Rv
ccaccaacgagucagu

SEQ ID NO: 1321554 - RNA, 15 nt, Mycobacterium tuberculosis H37Rv
ccacaucaccaaaaa

SEQ ID NO: 1321555 - RNA, 15 nt, Mycobacterium tuberculosis H37Rv
ccacaucagccgcac

SEQ ID NO: 1321556 - RNA, 20 nt, Mycobacterium tuberculosis H37Rv
ccacauccaacgaccuccac

SEQ ID NO: 1321557 - RNA, 21 nt, Mycobacterium tuberculosis H37Rv
ccacagucgccggccggcccg

SEQ ID NO: 1321558 - RNA, 16 nt, Mycobacterium tuberculosis H37Rv
ccacagucgugagcca

SEQ ID NO: 1321559 - RNA, 20 nt, Mycobacterium tuberculosis H37Rv
ccacagugcauacgguugau

SEQ ID NO: 1321560 - RNA, 17 nt, Mycobacterium tuberculosis H37Rv
ccacauacaggcccgcc

SEQ ID NO: 1321561 - RNA, 13 nt, Mycobacterium tuberculosis H37Rv
ccacauaccccga

SEQ ID NO: 1321562 - RNA, 19 nt, Mycobacterium tuberculosis H37Rv
ccacauacgcggcggccug

SEQ ID NO: 1321563 - RNA, 23 nt, Mycobacterium tuberculosis H37Rv
ccacauguucuccucgucgcggg

SEQ ID NO: 1321564 - RNA, 13 nt, Mycobacterium tuberculosis H37Rv
ccacauguccagc

SEQ ID NO: 1321565 - RNA, 22 nt, Mycobacterium tuberculosis H37Rv
ccacaugaucgagcaguuccag

SEQ ID NO: 1321566 - RNA, 17 nt, Mycobacterium tuberculosis H37Rv
ccacaugacgaucgcgg

SEQ ID NO: 1321567 - RNA, 22 nt, Mycobacterium tuberculosis H37Rv
ccacauccuggcggcugcagcc

SEQ ID NO: 1321568 - RNA, 24 nt, Mycobacterium tuberculosis H37Rv
ccacauccuggcggcugcagccga

SEQ ID NO: 1321569 - RNA, 20 nt, Mycobacterium tuberculosis H37Rv
ccacauccuggcggcugcag

SEQ ID NO: 1321570 - RNA, 19 nt, Mycobacterium tuberculosis H37Rv
ccacaucgaugucggcucg

SEQ ID NO: 1321571 - RNA, 21 nt, Mycobacterium tuberculosis H37Rv
ccacaugacgaucgcggcggg

SEQ ID NO: 1321572 - RNA, 17 nt, Mycobacterium tuberculosis H37Rv
ccagccaacucaggccg

SEQ ID NO: 1321573 - RNA, 16 nt, Mycobacterium tuberculosis H37Rv
ccagccaacucaggcc

SEQ ID NO: 1321574 - RNA, 17 nt, Mycobacterium tuberculosis H37Rv
ccagccaaaucagccag

SEQ ID NO: 1321575 - RNA, 19 nt, Mycobacterium tuberculosis H37Rv
ccagccacagccgaccucg

SEQ ID NO: 1321576 - RNA, 15 nt, Mycobacterium tuberculosis H37Rv
ccagccaccaccagg

SEQ ID NO: 1321577 - RNA, 18 nt, Mycobacterium tuberculosis H37Rv
ccagccaccaccaggucg

SEQ ID NO: 1321578 - RNA, 14 nt, Mycobacterium tuberculosis H37Rv
ccagccaccgccgc

SEQ ID NO: 1321579 - RNA, 20 nt, Mycobacterium tuberculosis H37Rv
ccagccacgcugucccgcgg

SEQ ID NO: 1321580 - RNA, 19 nt, Mycobacterium tuberculosis H37Rv
ccagccagcaagcgguagc

SEQ ID NO: 1321581 - RNA, 20 nt, Mycobacterium tuberculosis H37Rv
ccagccagcuggacuccggu

SEQ ID NO: 1321582 - RNA, 19 nt, Mycobacterium tuberculosis H37Rv
ccagccagcagcggcgagc

SEQ ID NO: 1321583 - RNA, 18 nt, Mycobacterium tuberculosis H37Rv
ccagccagccugcuggcc

SEQ ID NO: 1321584 - RNA, 16 nt, Mycobacterium tuberculosis H37Rv
ccagccagccugcugg

SEQ ID NO: 1321585 - RNA, 23 nt, Mycobacterium tuberculosis H37Rv
ccagccauagugcggcagcggug

SEQ ID NO: 1321586 - RNA, 18 nt, Mycobacterium tuberculosis H37Rv
ccagcagcggcacgucgg

SEQ ID NO: 1321587 - RNA, 21 nt, Mycobacterium tuberculosis H37Rv
ccagcagcggcacgucggcgc

SEQ ID NO: 1321588 - RNA, 22 nt, Mycobacterium tuberculosis H37Rv
ccagcaucagcgccagcgagca

SEQ ID NO: 1321589 - RNA, 20 nt, Mycobacterium tuberculosis H37Rv
ccagcaucgcggugguuggg

SEQ ID NO: 1321590 - RNA, 20 nt, Mycobacterium tuberculosis H37Rv
ccagcaugacaccggccacc

SEQ ID NO: 1321591 - RNA, 21 nt, Mycobacterium tuberculosis H37Rv
ccagcaugacaccggccacca

SEQ ID NO: 1321592 - RNA, 23 nt, Mycobacterium tuberculosis H37Rv
ccagcauggcggaacagcaauuu

SEQ ID NO: 1321593 - RNA, 19 nt, Mycobacterium tuberculosis H37Rv
ccagcauggggucagcucg

SEQ ID NO: 1321594 - RNA, 17 nt, Mycobacterium tuberculosis H37Rv
ccagcaugcccgccauc

SEQ ID NO: 1321595 - RNA, 16 nt, Mycobacterium tuberculosis H37Rv
ccagcacccgcagccg

SEQ ID NO: 1321596 - RNA, 13 nt, Mycobacterium tuberculosis H37Rv
ccagcacccgcgc

SEQ ID NO: 1321597 - RNA, 20 nt, Mycobacterium tuberculosis H37Rv
ccagcacccgcuccagcucg

SEQ ID NO: 1321598 - RNA, 13 nt, Mycobacterium tuberculosis H37Rv
ccagcaccccgag

SEQ ID NO: 1321599 - RNA, 15 nt, Mycobacterium tuberculosis H37Rv
ccagcacccccugca

SEQ ID NO: 1321600 - RNA, 13 nt, Mycobacterium tuberculosis H37Rv
ccagcaccgccgc

SEQ ID NO: 1321601 - RNA, 16 nt, Mycobacterium tuberculosis H37Rv
ccagcacccgagcgau

SEQ ID NO: 1321602 - RNA, 13 nt, Mycobacterium tuberculosis H37Rv
ccagcacccggcu

SEQ ID NO: 1321603 - RNA, 23 nt, Mycobacterium tuberculosis H37Rv
ccagcacacccccgucugcgugg

SEQ ID NO: 1321604 - RNA, 13 nt, Mycobacterium tuberculosis H37Rv
ccagcacaaccag

SEQ ID NO: 1321605 - RNA, 23 nt, Mycobacterium tuberculosis H37Rv
ccagcaccagcgucgcggccacg

SEQ ID NO: 1321606 - RNA, 12 nt, Mycobacterium tuberculosis H37Rv
ccagcacaccgu

SEQ ID NO: 1321607 - RNA, 16 nt, Mycobacterium tuberculosis H37Rv
ccagcacccggucgau

SEQ ID NO: 1321608 - RNA, 21 nt, Mycobacterium tuberculosis H37Rv
ccagcacuccgcgggguugau

SEQ ID NO: 1321609 - RNA, 16 nt, Mycobacterium tuberculosis H37Rv
ccagcagauccaggcg

SEQ ID NO: 1321610 - RNA, 22 nt, Mycobacterium tuberculosis H37Rv
ccagcagacgccguagccggcc

SEQ ID NO: 1321611 - RNA, 23 nt, Mycobacterium tuberculosis H37Rv
ccagcaacuaccuguugacacaa

SEQ ID NO: 1321612 - RNA, 14 nt, Mycobacterium tuberculosis H37Rv
ccagcaacuaccug

SEQ ID NO: 1321613 - RNA, 14 nt, Mycobacterium tuberculosis H37Rv
ccagcaaggccagc

SEQ ID NO: 1321614 - RNA, 22 nt, Mycobacterium tuberculosis H37Rv
ccagcaagugugagcagaccca

SEQ ID NO: 1321615 - RNA, 17 nt, Mycobacterium tuberculosis H37Rv
ccagaucggcggguggc

SEQ ID NO: 1321616 - RNA, 18 nt, Mycobacterium tuberculosis H37Rv
ccagaucguuccaggccg

SEQ ID NO: 1321617 - RNA, 19 nt, Mycobacterium tuberculosis H37Rv
ccagaucggcguuggcaug

SEQ ID NO: 1321618 - RNA, 15 nt, Mycobacterium tuberculosis H37Rv
ccagaucgacgccaa

SEQ ID NO: 1321619 - RNA, 18 nt, Mycobacterium tuberculosis H37Rv
ccagaucgcuaggaccgc

SEQ ID NO: 1321620 - RNA, 22 nt, Mycobacterium tuberculosis H37Rv
ccagcaaccucgguugguccuc

SEQ ID NO: 1321621 - RNA, 19 nt, Mycobacterium tuberculosis H37Rv
ccagcaaccaccccagggc

SEQ ID NO: 1321622 - RNA, 18 nt, Mycobacterium tuberculosis H37Rv
ccagaccgccgacgccgu

SEQ ID NO: 1321623 - RNA, 16 nt, Mycobacterium tuberculosis H37Rv
ccagacccaccaccgc

SEQ ID NO: 1321624 - RNA, 15 nt, Mycobacterium tuberculosis H37Rv
ccagaccagggcagc

SEQ ID NO: 1321625 - RNA, 19 nt, Mycobacterium tuberculosis H37Rv
ccagaccggccgacgugac

SEQ ID NO: 1321626 - RNA, 13 nt, Mycobacterium tuberculosis H37Rv
ccagaccggcggc

SEQ ID NO: 1321627 - RNA, 14 nt, Mycobacterium tuberculosis H37Rv
ccagaccggcggcu

SEQ ID NO: 1321628 - RNA, 22 nt, Mycobacterium tuberculosis H37Rv
ccagagcuucgccgcgcagccu

SEQ ID NO: 1321629 - RNA, 21 nt, Mycobacterium tuberculosis H37Rv
ccagaucgaacgcagccagcg

SEQ ID NO: 1321630 - RNA, 21 nt, Mycobacterium tuberculosis H37Rv
ccagaggccggcgggcucgcc

SEQ ID NO: 1321631 - RNA, 20 nt, Mycobacterium tuberculosis H37Rv
ccagaggucacgcagcaccc

SEQ ID NO: 1321632 - RNA, 15 nt, Mycobacterium tuberculosis H37Rv
ccagaggucgagcgc

SEQ ID NO: 1321633 - RNA, 22 nt, Mycobacterium tuberculosis H37Rv
ccagagccgcccuugccuccgg

SEQ ID NO: 1321634 - RNA, 22 nt, Mycobacterium tuberculosis H37Rv
ccagagacagcgccaugcccuc

SEQ ID NO: 1321635 - RNA, 17 nt, Mycobacterium tuberculosis H37Rv
ccagacggugcagcucc

SEQ ID NO: 1321636 - RNA, 14 nt, Mycobacterium tuberculosis H37Rv
ccacgucgagcagg

SEQ ID NO: 1321637 - RNA, 21 nt, Mycobacterium tuberculosis H37Rv
ccacgucgagcacccgcucca

SEQ ID NO: 1321638 - RNA, 15 nt, Mycobacterium tuberculosis H37Rv
ccacgucgagcaccc

SEQ ID NO: 1321639 - RNA, 20 nt, Mycobacterium tuberculosis H37Rv
ccacgucgcggcguuguugc

SEQ ID NO: 1321640 - RNA, 16 nt, Mycobacterium tuberculosis H37Rv
ccacguucgcgggcgu

SEQ ID NO: 1321641 - RNA, 14 nt, Mycobacterium tuberculosis H37Rv
ccacgugaucagau

SEQ ID NO: 1321642 - RNA, 16 nt, Mycobacterium tuberculosis H37Rv
ccacuuugcguuccca

SEQ ID NO: 1321643 - RNA, 18 nt, Mycobacterium tuberculosis H37Rv
ccagaaucucgccgggcu

SEQ ID NO: 1321644 - RNA, 23 nt, Mycobacterium tuberculosis H37Rv
ccagaaugacaucgucgccaggg

SEQ ID NO: 1321645 - RNA, 18 nt, Mycobacterium tuberculosis H37Rv
ccagacagacccccagac

SEQ ID NO: 1321646 - RNA, 17 nt, Mycobacterium tuberculosis H37Rv
ccagacaauccgccgcc

SEQ ID NO: 1321647 - RNA, 15 nt, Mycobacterium tuberculosis H37Rv
ccagaacggcgucga

SEQ ID NO: 1321648 - RNA, 13 nt, Mycobacterium tuberculosis H37Rv
ccagggagcggcu

SEQ ID NO: 1321649 - RNA, 17 nt, Mycobacterium tuberculosis H37Rv
ccagggagcgcccggcu

SEQ ID NO: 1321650 - RNA, 16 nt, Mycobacterium tuberculosis H37Rv
ccagggcaacggccgc

SEQ ID NO: 1321651 - RNA, 21 nt, Mycobacterium tuberculosis H37Rv
ccaggcugucgcgggccacca

SEQ ID NO: 1321652 - RNA, 21 nt, Mycobacterium tuberculosis H37Rv
ccaggcuugcggcacccaguc

SEQ ID NO: 1321653 - RNA, 20 nt, Mycobacterium tuberculosis H37Rv
ccaggcuugcggcacccagu

SEQ ID NO: 1321654 - RNA, 23 nt, Mycobacterium tuberculosis H37Rv
ccaggcuguggccagcaucauca

SEQ ID NO: 1321655 - RNA, 17 nt, Mycobacterium tuberculosis H37Rv
ccagggccuucgggcca

SEQ ID NO: 1321656 - RNA, 16 nt, Mycobacterium tuberculosis H37Rv
ccagggccgagcagcu

SEQ ID NO: 1321657 - RNA, 21 nt, Mycobacterium tuberculosis H37Rv
ccagggccucgaccgccagcc

SEQ ID NO: 1321658 - RNA, 22 nt, Mycobacterium tuberculosis H37Rv
ccagggccucgaccgccagccg

SEQ ID NO: 1321659 - RNA, 18 nt, Mycobacterium tuberculosis H37Rv
ccagggcgacgagaucug

SEQ ID NO: 1321660 - RNA, 17 nt, Mycobacterium tuberculosis H37Rv
ccagggccucgaccgcc

SEQ ID NO: 1321661 - RNA, 18 nt, Mycobacterium tuberculosis H37Rv
ccagggccuccacccgcc

SEQ ID NO: 1321662 - RNA, 19 nt, Mycobacterium tuberculosis H37Rv
ccagggccuccacccgcca

SEQ ID NO: 1321663 - RNA, 16 nt, Mycobacterium tuberculosis H37Rv
ccagggccgaguccga

SEQ ID NO: 1321664 - RNA, 11 nt, Mycobacterium tuberculosis H37Rv
ccagggccgcc

SEQ ID NO: 1321665 - RNA, 17 nt, Mycobacterium tuberculosis H37Rv
ccaggcgcgaucgcgcc

SEQ ID NO: 1321666 - RNA, 15 nt, Mycobacterium tuberculosis H37Rv
ccaggcgcgccgcac

SEQ ID NO: 1321667 - RNA, 13 nt, Mycobacterium tuberculosis H37Rv
ccaggcgcagcug

SEQ ID NO: 1321668 - RNA, 16 nt, Mycobacterium tuberculosis H37Rv
ccaggcgagccgccac

SEQ ID NO: 1321669 - RNA, 15 nt, Mycobacterium tuberculosis H37Rv
ccaggcgagccggcg

SEQ ID NO: 1321670 - RNA, 12 nt, Mycobacterium tuberculosis H37Rv
ccaggcgagccg

SEQ ID NO: 1321671 - RNA, 14 nt, Mycobacterium tuberculosis H37Rv
ccaggcgagccgcc

SEQ ID NO: 1321672 - RNA, 21 nt, Mycobacterium tuberculosis H37Rv
ccaggcgagugaacucguccu

SEQ ID NO: 1321673 - RNA, 14 nt, Mycobacterium tuberculosis H37Rv
ccaggcacuccagc

SEQ ID NO: 1321674 - RNA, 16 nt, Mycobacterium tuberculosis H37Rv
ccaggcacuccagcgg

SEQ ID NO: 1321675 - RNA, 17 nt, Mycobacterium tuberculosis H37Rv
ccaggcacuccagcggc

SEQ ID NO: 1321676 - RNA, 20 nt, Mycobacterium tuberculosis H37Rv
ccaggcacuccagcggcggg

SEQ ID NO: 1321677 - RNA, 15 nt, Mycobacterium tuberculosis H37Rv
ccaggcaccacgacc

SEQ ID NO: 1321678 - RNA, 20 nt, Mycobacterium tuberculosis H37Rv
ccaggcaagccagcacugcc

SEQ ID NO: 1321679 - RNA, 13 nt, Mycobacterium tuberculosis H37Rv
ccaggccgucagg

SEQ ID NO: 1321680 - RNA, 14 nt, Mycobacterium tuberculosis H37Rv
ccaggccguugccc

SEQ ID NO: 1321681 - RNA, 22 nt, Mycobacterium tuberculosis H37Rv
ccaggccguugcuauucgccag

SEQ ID NO: 1321682 - RNA, 15 nt, Mycobacterium tuberculosis H37Rv
ccaggccucgcaccg

SEQ ID NO: 1321683 - RNA, 18 nt, Mycobacterium tuberculosis H37Rv
ccaggugcguccaggcca

SEQ ID NO: 1321684 - RNA, 15 nt, Mycobacterium tuberculosis H37Rv
ccagguggccgcucu

SEQ ID NO: 1321685 - RNA, 14 nt, Mycobacterium tuberculosis H37Rv
ccaggugggcagca

SEQ ID NO: 1321686 - RNA, 16 nt, Mycobacterium tuberculosis H37Rv
ccaggugcccgccccg

SEQ ID NO: 1321687 - RNA, 13 nt, Mycobacterium tuberculosis H37Rv
ccaggugcaggcu

SEQ ID NO: 1321688 - RNA, 15 nt, Mycobacterium tuberculosis H37Rv
ccagguagaccaggu

SEQ ID NO: 1321689 - RNA, 19 nt, Mycobacterium tuberculosis H37Rv
ccaggugcagcaccagcca

SEQ ID NO: 1321690 - RNA, 19 nt, Mycobacterium tuberculosis H37Rv
ccagguacgggagcccgag

SEQ ID NO: 1321691 - RNA, 20 nt, Mycobacterium tuberculosis H37Rv
ccagggcgguggccacccgg

SEQ ID NO: 1321692 - RNA, 14 nt, Mycobacterium tuberculosis H37Rv
ccagguaaccccgc

SEQ ID NO: 1321693 - RNA, 12 nt, Mycobacterium tuberculosis H37Rv
ccagggugucca

SEQ ID NO: 1321694 - RNA, 14 nt, Mycobacterium tuberculosis H37Rv
ccaggguggucagu

SEQ ID NO: 1321695 - RNA, 23 nt, Mycobacterium tuberculosis H37Rv
ccagguguucgccggagacccgg

SEQ ID NO: 1321696 - RNA, 17 nt, Mycobacterium tuberculosis H37Rv
ccagguucaugcaaaag

SEQ ID NO: 1321697 - RNA, 19 nt, Mycobacterium tuberculosis H37Rv
ccagguugugugacagccc

SEQ ID NO: 1321698 - RNA, 22 nt, Mycobacterium tuberculosis H37Rv
ccagguugugugacagcccgcu

SEQ ID NO: 1321699 - RNA, 23 nt, Mycobacterium tuberculosis H37Rv
ccagguugaagaaugccgucuga

SEQ ID NO: 1321700 - RNA, 16 nt, Mycobacterium tuberculosis H37Rv
ccagguugauccagug

SEQ ID NO: 1321701 - RNA, 23 nt, Mycobacterium tuberculosis H37Rv
ccagguucuucuccaccaccguc

SEQ ID NO: 1321702 - RNA, 14 nt, Mycobacterium tuberculosis H37Rv
ccagcucacccugc

SEQ ID NO: 1321703 - RNA, 15 nt, Mycobacterium tuberculosis H37Rv
ccagcuccagcgccg

SEQ ID NO: 1321704 - RNA, 17 nt, Mycobacterium tuberculosis H37Rv
ccagcuccagcgccgcg

SEQ ID NO: 1321705 - RNA, 20 nt, Mycobacterium tuberculosis H37Rv
ccagcuccgccugccgcugg

SEQ ID NO: 1321706 - RNA, 15 nt, Mycobacterium tuberculosis H37Rv
ccagcgugcccgcca

SEQ ID NO: 1321707 - RNA, 14 nt, Mycobacterium tuberculosis H37Rv
ccagcgugcccgcc

SEQ ID NO: 1321708 - RNA, 21 nt, Mycobacterium tuberculosis H37Rv
ccagcguggugaagucggugc

SEQ ID NO: 1321709 - RNA, 23 nt, Mycobacterium tuberculosis H37Rv
ccagcguggggccgccaccagcg

SEQ ID NO: 1321710 - RNA, 17 nt, Mycobacterium tuberculosis H37Rv
ccagcgguggaccaccg

SEQ ID NO: 1321711 - RNA, 23 nt, Mycobacterium tuberculosis H37Rv
ccagcggcggucuuuuugggcuu

SEQ ID NO: 1321712 - RNA, 14 nt, Mycobacterium tuberculosis H37Rv
ccagcgguggacca

SEQ ID NO: 1321713 - RNA, 14 nt, Mycobacterium tuberculosis H37Rv
ccagcggucggcgg

SEQ ID NO: 1321714 - RNA, 12 nt, Mycobacterium tuberculosis H37Rv
ccagcggccgcc

SEQ ID NO: 1321715 - RNA, 22 nt, Mycobacterium tuberculosis H37Rv
ccagccccgcgcccaccccggc

SEQ ID NO: 1321716 - RNA, 13 nt, Mycobacterium tuberculosis H37Rv
ccagccccccggc

SEQ ID NO: 1321717 - RNA, 21 nt, Mycobacterium tuberculosis H37Rv
ccagcggcauggugacgugcu

SEQ ID NO: 1321718 - RNA, 17 nt, Mycobacterium tuberculosis H37Rv
ccagcuuggcgagcagg

SEQ ID NO: 1321719 - RNA, 22 nt, Mycobacterium tuberculosis H37Rv
ccagcuugucguagcgacgcca

SEQ ID NO: 1321720 - RNA, 16 nt, Mycobacterium tuberculosis H37Rv
ccaggaacgggacgcc

SEQ ID NO: 1321721 - RNA, 17 nt, Mycobacterium tuberculosis H37Rv
ccaggaacucggcccac

SEQ ID NO: 1321722 - RNA, 20 nt, Mycobacterium tuberculosis H37Rv
ccaggagugcgggcaugccg

SEQ ID NO: 1321723 - RNA, 21 nt, Mycobacterium tuberculosis H37Rv
ccaggcaagccagcacugcca

SEQ ID NO: 1321724 - RNA, 22 nt, Mycobacterium tuberculosis H37Rv
ccaggcaaccggucagccugcc

SEQ ID NO: 1321725 - RNA, 21 nt, Mycobacterium tuberculosis H37Rv
ccagcuucucagcaccaugcu

SEQ ID NO: 1321726 - RNA, 18 nt, Mycobacterium tuberculosis H37Rv
ccagcuguucgagccgcg

SEQ ID NO: 1321727 - RNA, 20 nt, Mycobacterium tuberculosis H37Rv
ccagcuugccgaccugcgcg

SEQ ID NO: 1321728 - RNA, 16 nt, Mycobacterium tuberculosis H37Rv
ccagcuugcgccgcag

SEQ ID NO: 1321729 - RNA, 15 nt, Mycobacterium tuberculosis H37Rv
ccagcuugcgccgca

SEQ ID NO: 1321730 - RNA, 19 nt, Mycobacterium tuberculosis H37Rv
ccagcuguccucgcgggcu

SEQ ID NO: 1321731 - RNA, 16 nt, Mycobacterium tuberculosis H37Rv
ccagcugucgggcagc

SEQ ID NO: 1321732 - RNA, 18 nt, Mycobacterium tuberculosis H37Rv
ccagcugagcggccggca

SEQ ID NO: 1321733 - RNA, 16 nt, Mycobacterium tuberculosis H37Rv
ccaguuugugccgccg

SEQ ID NO: 1321734 - RNA, 19 nt, Mycobacterium tuberculosis H37Rv
ccaguucccuacacccauu

SEQ ID NO: 1321735 - RNA, 19 nt, Mycobacterium tuberculosis H37Rv
ccaguggcgcgugcagcgg

SEQ ID NO: 1321736 - RNA, 24 nt, Mycobacterium tuberculosis H37Rv
ccaguggauuggcgaugacaauca

SEQ ID NO: 1321737 - RNA, 21 nt, Mycobacterium tuberculosis H37Rv
ccaguggcgcccauggccacc

SEQ ID NO: 1321738 - RNA, 20 nt, Mycobacterium tuberculosis H37Rv
ccaguggcgcccauggccac

SEQ ID NO: 1321739 - RNA, 16 nt, Mycobacterium tuberculosis H37Rv
ccaguguguccugucg

SEQ ID NO: 1321740 - RNA, 15 nt, Mycobacterium tuberculosis H37Rv
ccaguguugcgcugc

SEQ ID NO: 1321741 - RNA, 16 nt, Mycobacterium tuberculosis H37Rv
ccauagcugccggccc

SEQ ID NO: 1321742 - RNA, 18 nt, Mycobacterium tuberculosis H37Rv
ccauagugaggccgacca

SEQ ID NO: 1321743 - RNA, 20 nt, Mycobacterium tuberculosis H37Rv
ccauagugaggccgaccagc

SEQ ID NO: 1321744 - RNA, 18 nt, Mycobacterium tuberculosis H37Rv
ccauagugcggcagcggu

SEQ ID NO: 1321745 - RNA, 18 nt, Mycobacterium tuberculosis H37Rv
ccaucacaucggccucug

SEQ ID NO: 1321746 - RNA, 17 nt, Mycobacterium tuberculosis H37Rv
ccaucaccccggccuug

SEQ ID NO: 1321747 - RNA, 16 nt, Mycobacterium tuberculosis H37Rv
ccaucacauccacgca

SEQ ID NO: 1321748 - RNA, 13 nt, Mycobacterium tuberculosis H37Rv
ccaucaaccccag

SEQ ID NO: 1321749 - RNA, 14 nt, Mycobacterium tuberculosis H37Rv
ccauaauggucguc

SEQ ID NO: 1321750 - RNA, 20 nt, Mycobacterium tuberculosis H37Rv
ccauaccucggcgaccuccg

SEQ ID NO: 1321751 - RNA, 14 nt, Mycobacterium tuberculosis H37Rv
ccauaccugaaugu

SEQ ID NO: 1321752 - RNA, 20 nt, Mycobacterium tuberculosis H37Rv
ccauacgcgcugacccgcca

SEQ ID NO: 1321753 - RNA, 12 nt, Mycobacterium tuberculosis H37Rv
ccauagccaggu

SEQ ID NO: 1321754 - RNA, 16 nt, Mycobacterium tuberculosis H37Rv
ccauagcgccgcgccc

SEQ ID NO: 1321755 - RNA, 23 nt, Mycobacterium tuberculosis H37Rv
ccauagcgccgcgcccaccauga

SEQ ID NO: 1321756 - RNA, 19 nt, Mycobacterium tuberculosis H37Rv
ccauagcaccucgaugaug

SEQ ID NO: 1321757 - RNA, 14 nt, Mycobacterium tuberculosis H37Rv
ccauagaugcccgc

SEQ ID NO: 1321758 - RNA, 15 nt, Mycobacterium tuberculosis H37Rv
ccauacucggcggcu

SEQ ID NO: 1321759 - RNA, 18 nt, Mycobacterium tuberculosis H37Rv
ccauccgggccgcggcca

SEQ ID NO: 1321760 - RNA, 19 nt, Mycobacterium tuberculosis H37Rv
ccauccgggcugccacggc

SEQ ID NO: 1321761 - RNA, 17 nt, Mycobacterium tuberculosis H37Rv
ccaucgaccgcccgcca

SEQ ID NO: 1321762 - RNA, 19 nt, Mycobacterium tuberculosis H37Rv
ccaucacgcccuguucucc

SEQ ID NO: 1321763 - RNA, 15 nt, Mycobacterium tuberculosis H37Rv
ccaucacggaccagg

SEQ ID NO: 1321764 - RNA, 16 nt, Mycobacterium tuberculosis H37Rv
ccaucacggaccaggc

SEQ ID NO: 1321765 - RNA, 20 nt, Mycobacterium tuberculosis H37Rv
ccaucacgacucccccggcu

SEQ ID NO: 1321766 - RNA, 13 nt, Mycobacterium tuberculosis H37Rv
ccaucaccgccag

SEQ ID NO: 1321767 - RNA, 14 nt, Mycobacterium tuberculosis H37Rv
ccaucaccgccagc

SEQ ID NO: 1321768 - RNA, 13 nt, Mycobacterium tuberculosis H37Rv
ccaucaccggcgg

SEQ ID NO: 1321769 - RNA, 17 nt, Mycobacterium tuberculosis H37Rv
ccaucucuugcaaccug

SEQ ID NO: 1321770 - RNA, 17 nt, Mycobacterium tuberculosis H37Rv
ccaucucggaccacauc

SEQ ID NO: 1321771 - RNA, 16 nt, Mycobacterium tuberculosis H37Rv
ccaucucggaccacau

SEQ ID NO: 1321772 - RNA, 13 nt, Mycobacterium tuberculosis H37Rv
ccaucucggacca

SEQ ID NO: 1321773 - RNA, 19 nt, Mycobacterium tuberculosis H37Rv
ccaucguuguugaccacca

SEQ ID NO: 1321774 - RNA, 14 nt, Mycobacterium tuberculosis H37Rv
ccaucucaugcauc

SEQ ID NO: 1321775 - RNA, 16 nt, Mycobacterium tuberculosis H37Rv
ccaucuaccagcucac

SEQ ID NO: 1321776 - RNA, 17 nt, Mycobacterium tuberculosis H37Rv
ccaucuaccagcucacc

SEQ ID NO: 1321777 - RNA, 23 nt, Mycobacterium tuberculosis H37Rv
ccaucuccgguguguuuggcaug

SEQ ID NO: 1321778 - RNA, 19 nt, Mycobacterium tuberculosis H37Rv
ccaucucgacgucggugaa

SEQ ID NO: 1321779 - RNA, 15 nt, Mycobacterium tuberculosis H37Rv
ccaucgcgacaucgg

SEQ ID NO: 1321780 - RNA, 18 nt, Mycobacterium tuberculosis H37Rv
ccaucgcggcguugugac

SEQ ID NO: 1321781 - RNA, 12 nt, Mycobacterium tuberculosis H37Rv
ccaucgccgccg

SEQ ID NO: 1321782 - RNA, 12 nt, Mycobacterium tuberculosis H37Rv
ccaucgccucca

SEQ ID NO: 1321783 - RNA, 16 nt, Mycobacterium tuberculosis H37Rv
ccaucgugcugaagcu

SEQ ID NO: 1321784 - RNA, 20 nt, Mycobacterium tuberculosis H37Rv
ccaucguucguugacucugc

SEQ ID NO: 1321785 - RNA, 16 nt, Mycobacterium tuberculosis H37Rv
ccaucgucgagccgcc

SEQ ID NO: 1321786 - RNA, 21 nt, Mycobacterium tuberculosis H37Rv
ccaucgcgucgucuucuucgc

SEQ ID NO: 1321787 - RNA, 14 nt, Mycobacterium tuberculosis H37Rv
ccaugaugaugaca

SEQ ID NO: 1321788 - RNA, 20 nt, Mycobacterium tuberculosis H37Rv
ccaugccgcucggcaaccug

SEQ ID NO: 1321789 - RNA, 15 nt, Mycobacterium tuberculosis H37Rv
ccaugccgggaacca

SEQ ID NO: 1321790 - RNA, 12 nt, Mycobacterium tuberculosis H37Rv
ccaugccuccag

SEQ ID NO: 1321791 - RNA, 15 nt, Mycobacterium tuberculosis H37Rv
ccaugcccgcacgcu

SEQ ID NO: 1321792 - RNA, 14 nt, Mycobacterium tuberculosis H37Rv
ccaugcccuguucg

SEQ ID NO: 1321793 - RNA, 15 nt, Mycobacterium tuberculosis H37Rv
ccaucugccugccug

SEQ ID NO: 1321794 - RNA, 22 nt, Mycobacterium tuberculosis H37Rv
ccaucuggccgcgggcgcggcc

SEQ ID NO: 1321795 - RNA, 21 nt, Mycobacterium tuberculosis H37Rv
ccaugaagaacuggcugcugu

SEQ ID NO: 1321796 - RNA, 18 nt, Mycobacterium tuberculosis H37Rv
ccaugaacucgaacuggg

SEQ ID NO: 1321797 - RNA, 23 nt, Mycobacterium tuberculosis H37Rv
ccaugcggaauuugcuugggccc

SEQ ID NO: 1321798 - RNA, 17 nt, Mycobacterium tuberculosis H37Rv
ccaugcgccacgccacu

SEQ ID NO: 1321799 - RNA, 17 nt, Mycobacterium tuberculosis H37Rv
ccaugcgguuagcagcc

SEQ ID NO: 1321800 - RNA, 18 nt, Mycobacterium tuberculosis H37Rv
ccaugcgguuagcagccg

SEQ ID NO: 1321801 - RNA, 17 nt, Mycobacterium tuberculosis H37Rv
ccaugcuaggaccacca

SEQ ID NO: 1321802 - RNA, 18 nt, Mycobacterium tuberculosis H37Rv
ccaugcuaggaccaccag

SEQ ID NO: 1321803 - RNA, 12 nt, Mycobacterium tuberculosis H37Rv
ccaugucggcca

SEQ ID NO: 1321804 - RNA, 15 nt, Mycobacterium tuberculosis H37Rv
ccaugucggccaggu

SEQ ID NO: 1321805 - RNA, 12 nt, Mycobacterium tuberculosis H37Rv
ccauguguuuga

SEQ ID NO: 1321806 - RNA, 17 nt, Mycobacterium tuberculosis H37Rv
ccaugugucccggacca

SEQ ID NO: 1321807 - RNA, 18 nt, Mycobacterium tuberculosis H37Rv
ccauggcgcgaccuccgc

SEQ ID NO: 1321808 - RNA, 14 nt, Mycobacterium tuberculosis H37Rv
ccauggcccgcucg

SEQ ID NO: 1321809 - RNA, 14 nt, Mycobacterium tuberculosis H37Rv
ccauggcgccgcgc

SEQ ID NO: 1321810 - RNA, 12 nt, Mycobacterium tuberculosis H37Rv
ccauggugggcc

SEQ ID NO: 1321811 - RNA, 18 nt, Mycobacterium tuberculosis H37Rv
ccauggugguauccaugu

SEQ ID NO: 1321812 - RNA, 20 nt, Mycobacterium tuberculosis H37Rv
ccauggucgcgccacccgcg

SEQ ID NO: 1321813 - RNA, 14 nt, Mycobacterium tuberculosis H37Rv
ccauucgcccggcc

SEQ ID NO: 1321814 - RNA, 13 nt, Mycobacterium tuberculosis H37Rv
ccauugccucccg

SEQ ID NO: 1321815 - RNA, 21 nt, Mycobacterium tuberculosis H37Rv
ccauuagcacaucgccggcgu

SEQ ID NO: 1321816 - RNA, 15 nt, Mycobacterium tuberculosis H37Rv
ccauuagcagcaccc

SEQ ID NO: 1321817 - RNA, 17 nt, Mycobacterium tuberculosis H37Rv
ccauuagcagcacccgg

SEQ ID NO: 1321818 - RNA, 17 nt, Mycobacterium tuberculosis H37Rv
ccauucacgagccgcuc

SEQ ID NO: 1321819 - RNA, 18 nt, Mycobacterium tuberculosis H37Rv
ccauguugcccugcaacc

SEQ ID NO: 1321820 - RNA, 14 nt, Mycobacterium tuberculosis H37Rv
cccacgaucagcag

SEQ ID NO: 1321821 - RNA, 19 nt, Mycobacterium tuberculosis H37Rv
cccacgaucagcagcgucg

SEQ ID NO: 1321822 - RNA, 21 nt, Mycobacterium tuberculosis H37Rv
cccaccgacauguguggcagc

SEQ ID NO: 1321823 - RNA, 19 nt, Mycobacterium tuberculosis H37Rv
cccacgcacagcaacgccc

SEQ ID NO: 1321824 - RNA, 13 nt, Mycobacterium tuberculosis H37Rv
cccacgcacagca

SEQ ID NO: 1321825 - RNA, 16 nt, Mycobacterium tuberculosis H37Rv
cccacgcacagcaacg

SEQ ID NO: 1321826 - RNA, 14 nt, Mycobacterium tuberculosis H37Rv
cccacgccagcgcg

SEQ ID NO: 1321827 - RNA, 15 nt, Mycobacterium tuberculosis H37Rv
cccacgcccaauguc

SEQ ID NO: 1321828 - RNA, 21 nt, Mycobacterium tuberculosis H37Rv
cccacucggacccgcaauucc

SEQ ID NO: 1321829 - RNA, 17 nt, Mycobacterium tuberculosis H37Rv
cccacugcaucacgccg

SEQ ID NO: 1321830 - RNA, 18 nt, Mycobacterium tuberculosis H37Rv
cccacuggugcagcgccg

SEQ ID NO: 1321831 - RNA, 15 nt, Mycobacterium tuberculosis H37Rv
cccagauccgcagcg

SEQ ID NO: 1321832 - RNA, 19 nt, Mycobacterium tuberculosis H37Rv
cccagaucuugcagugcgc

SEQ ID NO: 1321833 - RNA, 18 nt, Mycobacterium tuberculosis H37Rv
cccagaucggcgacgccg

SEQ ID NO: 1321834 - RNA, 19 nt, Mycobacterium tuberculosis H37Rv
cccagaugcaggcuuucau

SEQ ID NO: 1321835 - RNA, 15 nt, Mycobacterium tuberculosis H37Rv
cccagauacccgcgu

SEQ ID NO: 1321836 - RNA, 21 nt, Mycobacterium tuberculosis H37Rv
cccagauagagcuggugcaga

SEQ ID NO: 1321837 - RNA, 18 nt, Mycobacterium tuberculosis H37Rv
cccagcacacccccgucu

SEQ ID NO: 1321838 - RNA, 24 nt, Mycobacterium tuberculosis H37Rv
cccagcacauucugcagcgucucc

SEQ ID NO: 1321839 - RNA, 19 nt, Mycobacterium tuberculosis H37Rv
cccagcaaaggggugugug

SEQ ID NO: 1321840 - RNA, 22 nt, Mycobacterium tuberculosis H37Rv
cccagaccgccgaagaagguga

SEQ ID NO: 1321841 - RNA, 15 nt, Mycobacterium tuberculosis H37Rv
cccagaccgccgacg

SEQ ID NO: 1321842 - RNA, 16 nt, Mycobacterium tuberculosis H37Rv
cccagacagaccccca

SEQ ID NO: 1321843 - RNA, 20 nt, Mycobacterium tuberculosis H37Rv
cccagagcaucagguuguac

SEQ ID NO: 1321844 - RNA, 17 nt, Mycobacterium tuberculosis H37Rv
cccagagaaucagcgug

SEQ ID NO: 1321845 - RNA, 17 nt, Mycobacterium tuberculosis H37Rv
cccagaauuccggcgga

SEQ ID NO: 1321846 - RNA, 19 nt, Mycobacterium tuberculosis H37Rv
cccaaugccaccgcggccg

SEQ ID NO: 1321847 - RNA, 22 nt, Mycobacterium tuberculosis H37Rv
cccaaucgggaucgcugccagc

SEQ ID NO: 1321848 - RNA, 17 nt, Mycobacterium tuberculosis H37Rv
cccacaggggcagcgcg

SEQ ID NO: 1321849 - RNA, 15 nt, Mycobacterium tuberculosis H37Rv
cccacaggcuuuucc

SEQ ID NO: 1321850 - RNA, 15 nt, Mycobacterium tuberculosis H37Rv
cccacaacaugcugg

SEQ ID NO: 1321851 - RNA, 20 nt, Mycobacterium tuberculosis H37Rv
cccacagguuugcgccgcgc

SEQ ID NO: 1321852 - RNA, 18 nt, Mycobacterium tuberculosis H37Rv
cccacagucgccggccgg

SEQ ID NO: 1321853 - RNA, 19 nt, Mycobacterium tuberculosis H37Rv
cccacagucgccggccggc

SEQ ID NO: 1321854 - RNA, 22 nt, Mycobacterium tuberculosis H37Rv
cccacauggcccggaggccgcu

SEQ ID NO: 1321855 - RNA, 21 nt, Mycobacterium tuberculosis H37Rv
cccacaugacgaucgcggcgg

SEQ ID NO: 1321856 - RNA, 16 nt, Mycobacterium tuberculosis H37Rv
cccacaucgucggcgg

SEQ ID NO: 1321857 - RNA, 12 nt, Mycobacterium tuberculosis H37Rv
cccaccagugca

SEQ ID NO: 1321858 - RNA, 20 nt, Mycobacterium tuberculosis H37Rv
cccaccccccagcgccgccg

SEQ ID NO: 1321859 - RNA, 22 nt, Mycobacterium tuberculosis H37Rv
cccacccagcgacucggccagg

SEQ ID NO: 1321860 - RNA, 15 nt, Mycobacterium tuberculosis H37Rv
cccacccgcaccgcg

SEQ ID NO: 1321861 - RNA, 18 nt, Mycobacterium tuberculosis H37Rv
cccacccgcaccaccggc

SEQ ID NO: 1321862 - RNA, 19 nt, Mycobacterium tuberculosis H37Rv
cccacccucggguccaacc

SEQ ID NO: 1321863 - RNA, 21 nt, Mycobacterium tuberculosis H37Rv
cccaccgaagcggugacccac

SEQ ID NO: 1321864 - RNA, 15 nt, Mycobacterium tuberculosis H37Rv
cccaagcgugcugcc

SEQ ID NO: 1321865 - RNA, 21 nt, Mycobacterium tuberculosis H37Rv
cccaagcccgauucagcgccc

SEQ ID NO: 1321866 - RNA, 21 nt, Mycobacterium tuberculosis H37Rv
cccaagccauguggcgucgcu

SEQ ID NO: 1321867 - RNA, 15 nt, Mycobacterium tuberculosis H37Rv
cccaagccgccggcg

SEQ ID NO: 1321868 - RNA, 14 nt, Mycobacterium tuberculosis H37Rv
cccaagcaguccac

SEQ ID NO: 1321869 - RNA, 12 nt, Mycobacterium tuberculosis H37Rv
cccaagaucucg

SEQ ID NO: 1321870 - RNA, 15 nt, Mycobacterium tuberculosis H37Rv
cccaacgaccaccac

SEQ ID NO: 1321871 - RNA, 14 nt, Mycobacterium tuberculosis H37Rv
cccaacgaccacca

SEQ ID NO: 1321872 - RNA, 20 nt, Mycobacterium tuberculosis H37Rv
cccaacgcgguaaagccccg

SEQ ID NO: 1321873 - RNA, 14 nt, Mycobacterium tuberculosis H37Rv
ccccggaccgcggc

SEQ ID NO: 1321874 - RNA, 13 nt, Mycobacterium tuberculosis H37Rv
ccccggccaggac

SEQ ID NO: 1321875 - RNA, 16 nt, Mycobacterium tuberculosis H37Rv
ccccggccuuggcggc

SEQ ID NO: 1321876 - RNA, 19 nt, Mycobacterium tuberculosis H37Rv
ccccggcgguaccagagca

SEQ ID NO: 1321877 - RNA, 17 nt, Mycobacterium tuberculosis H37Rv
ccccggcgcggccagcu

SEQ ID NO: 1321878 - RNA, 19 nt, Mycobacterium tuberculosis H37Rv
ccccgggggaagcgccaac

SEQ ID NO: 1321879 - RNA, 15 nt, Mycobacterium tuberculosis H37Rv
ccccgggcggcgccg

SEQ ID NO: 1321880 - RNA, 19 nt, Mycobacterium tuberculosis H37Rv
ccccgggcggcgccggcgc

SEQ ID NO: 1321881 - RNA, 22 nt, Mycobacterium tuberculosis H37Rv
ccccgggcggcgccggcgcaga

SEQ ID NO: 1321882 - RNA, 19 nt, Mycobacterium tuberculosis H37Rv
ccccgaacauccgccgccc

SEQ ID NO: 1321883 - RNA, 18 nt, Mycobacterium tuberculosis H37Rv
ccccgaacauugcgccca

SEQ ID NO: 1321884 - RNA, 13 nt, Mycobacterium tuberculosis H37Rv
ccccgaccgccac

SEQ ID NO: 1321885 - RNA, 18 nt, Mycobacterium tuberculosis H37Rv
ccccgaccgccguggccg

SEQ ID NO: 1321886 - RNA, 21 nt, Mycobacterium tuberculosis H37Rv
ccccgacgagauacggccacc

SEQ ID NO: 1321887 - RNA, 23 nt, Mycobacterium tuberculosis H37Rv
ccccgacgaugcgcacucccggc

SEQ ID NO: 1321888 - RNA, 19 nt, Mycobacterium tuberculosis H37Rv
ccccggaaugcccgagcag

SEQ ID NO: 1321889 - RNA, 13 nt, Mycobacterium tuberculosis H37Rv
ccccgaccgccgu

SEQ ID NO: 1321890 - RNA, 12 nt, Mycobacterium tuberculosis H37Rv
ccccggagccag

SEQ ID NO: 1321891 - RNA, 14 nt, Mycobacterium tuberculosis H37Rv
ccccggagccagaa

SEQ ID NO: 1321892 - RNA, 12 nt, Mycobacterium tuberculosis H37Rv
cccccugccaca

SEQ ID NO: 1321893 - RNA, 14 nt, Mycobacterium tuberculosis H37Rv
cccccugguacacc

SEQ ID NO: 1321894 - RNA, 20 nt, Mycobacterium tuberculosis H37Rv
cccccugguacaccaggccg

SEQ ID NO: 1321895 - RNA, 17 nt, Mycobacterium tuberculosis H37Rv
ccccgaacauccgccgc

SEQ ID NO: 1321896 - RNA, 13 nt, Mycobacterium tuberculosis H37Rv
ccccgaaccgcgc

SEQ ID NO: 1321897 - RNA, 15 nt, Mycobacterium tuberculosis H37Rv
ccccgacaccgccga

SEQ ID NO: 1321898 - RNA, 15 nt, Mycobacterium tuberculosis H37Rv
ccccucccaccagcg

SEQ ID NO: 1321899 - RNA, 13 nt, Mycobacterium tuberculosis H37Rv
ccccguuucgcca

SEQ ID NO: 1321900 - RNA, 14 nt, Mycobacterium tuberculosis H37Rv
ccccguuucgccag

SEQ ID NO: 1321901 - RNA, 15 nt, Mycobacterium tuberculosis H37Rv
ccccguugccgcccg

SEQ ID NO: 1321902 - RNA, 14 nt, Mycobacterium tuberculosis H37Rv
ccccguugcgguaa

SEQ ID NO: 1321903 - RNA, 19 nt, Mycobacterium tuberculosis H37Rv
ccccguuggucagcgugga

SEQ ID NO: 1321904 - RNA, 19 nt, Mycobacterium tuberculosis H37Rv
ccccguuaccgccgucgcc

SEQ ID NO: 1321905 - RNA, 11 nt, Mycobacterium tuberculosis H37Rv
ccccuaaaccg

SEQ ID NO: 1321906 - RNA, 16 nt, Mycobacterium tuberculosis H37Rv
ccccggugccgcccgc

SEQ ID NO: 1321907 - RNA, 23 nt, Mycobacterium tuberculosis H37Rv
ccccggugccguuggagccgcca

SEQ ID NO: 1321908 - RNA, 21 nt, Mycobacterium tuberculosis H37Rv
ccccggucggcgacguauacc

SEQ ID NO: 1321909 - RNA, 19 nt, Mycobacterium tuberculosis H37Rv
ccccgguugacucgcuccg

SEQ ID NO: 1321910 - RNA, 15 nt, Mycobacterium tuberculosis H37Rv
ccccggucccgccga

SEQ ID NO: 1321911 - RNA, 13 nt, Mycobacterium tuberculosis H37Rv
ccccggucgccgc

SEQ ID NO: 1321912 - RNA, 14 nt, Mycobacterium tuberculosis H37Rv
ccccgguaccgccc

SEQ ID NO: 1321913 - RNA, 17 nt, Mycobacterium tuberculosis H37Rv
ccccgucgaccuccacc

SEQ ID NO: 1321914 - RNA, 19 nt, Mycobacterium tuberculosis H37Rv
ccccgugggguguggcggc

SEQ ID NO: 1321915 - RNA, 22 nt, Mycobacterium tuberculosis H37Rv
ccccguagauggugguggcccg

SEQ ID NO: 1321916 - RNA, 21 nt, Mycobacterium tuberculosis H37Rv
ccccguaaauaucggggccac

SEQ ID NO: 1321917 - RNA, 23 nt, Mycobacterium tuberculosis H37Rv
ccccguaggugcacaacccgugc

SEQ ID NO: 1321918 - RNA, 15 nt, Mycobacterium tuberculosis H37Rv
ccccagggagugccg

SEQ ID NO: 1321919 - RNA, 12 nt, Mycobacterium tuberculosis H37Rv
ccccaguucggc

SEQ ID NO: 1321920 - RNA, 23 nt, Mycobacterium tuberculosis H37Rv
ccccagugcagacaggcggcggc

SEQ ID NO: 1321921 - RNA, 21 nt, Mycobacterium tuberculosis H37Rv
ccccaggugggcagcaggccc

SEQ ID NO: 1321922 - RNA, 24 nt, Mycobacterium tuberculosis H37Rv
ccccaggugggcagcaggcccacc

SEQ ID NO: 1321923 - RNA, 13 nt, Mycobacterium tuberculosis H37Rv
ccccagcgccgcc

SEQ ID NO: 1321924 - RNA, 15 nt, Mycobacterium tuberculosis H37Rv
ccccagcgacggcaa

SEQ ID NO: 1321925 - RNA, 20 nt, Mycobacterium tuberculosis H37Rv
ccccagcgguuuccgcacga

SEQ ID NO: 1321926 - RNA, 18 nt, Mycobacterium tuberculosis H37Rv
ccccagcggccaccgagg

SEQ ID NO: 1321927 - RNA, 11 nt, Mycobacterium tuberculosis H37Rv
ccccaggcacc

SEQ ID NO: 1321928 - RNA, 20 nt, Mycobacterium tuberculosis H37Rv
ccccaggccgcuugccccgc

SEQ ID NO: 1321929 - RNA, 21 nt, Mycobacterium tuberculosis H37Rv
ccccaggccgcuugccccgcc

SEQ ID NO: 1321930 - RNA, 23 nt, Mycobacterium tuberculosis H37Rv
cccauucucggccggcggcgccc

SEQ ID NO: 1321931 - RNA, 12 nt, Mycobacterium tuberculosis H37Rv
cccauugcgccc

SEQ ID NO: 1321932 - RNA, 14 nt, Mycobacterium tuberculosis H37Rv
cccauugcgcccca

SEQ ID NO: 1321933 - RNA, 12 nt, Mycobacterium tuberculosis H37Rv
cccauuggaccg

SEQ ID NO: 1321934 - RNA, 23 nt, Mycobacterium tuberculosis H37Rv
cccauuggaccgagacuugcugg

SEQ ID NO: 1321935 - RNA, 16 nt, Mycobacterium tuberculosis H37Rv
cccauuugccuugagc

SEQ ID NO: 1321936 - RNA, 20 nt, Mycobacterium tuberculosis H37Rv
cccauuugccuugagccgcc

SEQ ID NO: 1321937 - RNA, 21 nt, Mycobacterium tuberculosis H37Rv
cccauuugccuugagccgccc

SEQ ID NO: 1321938 - RNA, 13 nt, Mycobacterium tuberculosis H37Rv
ccccagccgcggc

SEQ ID NO: 1321939 - RNA, 17 nt, Mycobacterium tuberculosis H37Rv
ccccagccggcagcagc

SEQ ID NO: 1321940 - RNA, 18 nt, Mycobacterium tuberculosis H37Rv
ccccagccggcagcagcg

SEQ ID NO: 1321941 - RNA, 14 nt, Mycobacterium tuberculosis H37Rv
ccccaugaccggga

SEQ ID NO: 1321942 - RNA, 18 nt, Mycobacterium tuberculosis H37Rv
ccccaugaucuggugcgc

SEQ ID NO: 1321943 - RNA, 20 nt, Mycobacterium tuberculosis H37Rv
ccccauacucggcggcuucg

SEQ ID NO: 1321944 - RNA, 21 nt, Mycobacterium tuberculosis H37Rv
ccccaguugugcggccaggcg

SEQ ID NO: 1321945 - RNA, 22 nt, Mycobacterium tuberculosis H37Rv
cccccaaaucaacagggugggc

SEQ ID NO: 1321946 - RNA, 19 nt, Mycobacterium tuberculosis H37Rv
cccccggcaccgccggcuc

SEQ ID NO: 1321947 - RNA, 23 nt, Mycobacterium tuberculosis H37Rv
cccccggcagcgugcggggcgcc

SEQ ID NO: 1321948 - RNA, 13 nt, Mycobacterium tuberculosis H37Rv
cccccgggcccgc

SEQ ID NO: 1321949 - RNA, 17 nt, Mycobacterium tuberculosis H37Rv
cccccggcaccgccggc

SEQ ID NO: 1321950 - RNA, 17 nt, Mycobacterium tuberculosis H37Rv
cccccgguaccgcccgc

SEQ ID NO: 1321951 - RNA, 18 nt, Mycobacterium tuberculosis H37Rv
cccccgguaccgcccgca

SEQ ID NO: 1321952 - RNA, 15 nt, Mycobacterium tuberculosis H37Rv
cccccggcgcggcgg

SEQ ID NO: 1321953 - RNA, 20 nt, Mycobacterium tuberculosis H37Rv
cccccggguagaccaccugc

SEQ ID NO: 1321954 - RNA, 14 nt, Mycobacterium tuberculosis H37Rv
cccccggugccggc

SEQ ID NO: 1321955 - RNA, 18 nt, Mycobacterium tuberculosis H37Rv
cccccuagaccgggcggu

SEQ ID NO: 1321956 - RNA, 16 nt, Mycobacterium tuberculosis H37Rv
cccccguugccgcccg

SEQ ID NO: 1321957 - RNA, 16 nt, Mycobacterium tuberculosis H37Rv
cccccguugccgccgu

SEQ ID NO: 1321958 - RNA, 19 nt, Mycobacterium tuberculosis H37Rv
cccaggugugugccucagu

SEQ ID NO: 1321959 - RNA, 14 nt, Mycobacterium tuberculosis H37Rv
cccaggugggcagc

SEQ ID NO: 1321960 - RNA, 21 nt, Mycobacterium tuberculosis H37Rv
cccagguugccuuggcggcca

SEQ ID NO: 1321961 - RNA, 21 nt, Mycobacterium tuberculosis H37Rv
cccagguuucauuccugguua

SEQ ID NO: 1321962 - RNA, 13 nt, Mycobacterium tuberculosis H37Rv
cccaggugggcag

SEQ ID NO: 1321963 - RNA, 19 nt, Mycobacterium tuberculosis H37Rv
cccaggcguuuggcgugcc

SEQ ID NO: 1321964 - RNA, 21 nt, Mycobacterium tuberculosis H37Rv
cccaggcgcucagcgcggcca

SEQ ID NO: 1321965 - RNA, 21 nt, Mycobacterium tuberculosis H37Rv
cccaggcgcucaucacccagc

SEQ ID NO: 1321966 - RNA, 20 nt, Mycobacterium tuberculosis H37Rv
cccaggcgcugccgguguug

SEQ ID NO: 1321967 - RNA, 20 nt, Mycobacterium tuberculosis H37Rv
cccaguccgaagcugcugcu

SEQ ID NO: 1321968 - RNA, 19 nt, Mycobacterium tuberculosis H37Rv
cccaguccgaagcugcugc

SEQ ID NO: 1321969 - RNA, 17 nt, Mycobacterium tuberculosis H37Rv
cccaguccgaagcugcu

SEQ ID NO: 1321970 - RNA, 21 nt, Mycobacterium tuberculosis H37Rv
cccagucccaacacggcgaca

SEQ ID NO: 1321971 - RNA, 16 nt, Mycobacterium tuberculosis H37Rv
cccagugccagaaccc

SEQ ID NO: 1321972 - RNA, 21 nt, Mycobacterium tuberculosis H37Rv
cccagugaacucgugacagcg

SEQ ID NO: 1321973 - RNA, 19 nt, Mycobacterium tuberculosis H37Rv
cccagugaaucggaccgac

SEQ ID NO: 1321974 - RNA, 20 nt, Mycobacterium tuberculosis H37Rv
cccagucguuccgccgccuc

SEQ ID NO: 1321975 - RNA, 17 nt, Mycobacterium tuberculosis H37Rv
cccaggcgaacagggcu

SEQ ID NO: 1321976 - RNA, 15 nt, Mycobacterium tuberculosis H37Rv
cccaggccgucgcgc

SEQ ID NO: 1321977 - RNA, 19 nt, Mycobacterium tuberculosis H37Rv
cccaggccgcuugccccgc

SEQ ID NO: 1321978 - RNA, 17 nt, Mycobacterium tuberculosis H37Rv
cccaggaacgggacgcc

SEQ ID NO: 1321979 - RNA, 22 nt, Mycobacterium tuberculosis H37Rv
cccaggacuccggccgcacgcc

SEQ ID NO: 1321980 - RNA, 23 nt, Mycobacterium tuberculosis H37Rv
cccaggacuccggccgcacgccg

SEQ ID NO: 1321981 - RNA, 23 nt, Mycobacterium tuberculosis H37Rv
cccagcccaugucgagcacgcca

SEQ ID NO: 1321982 - RNA, 13 nt, Mycobacterium tuberculosis H37Rv
cccagcccauguc

SEQ ID NO: 1321983 - RNA, 14 nt, Mycobacterium tuberculosis H37Rv
cccagcucgcgcac

SEQ ID NO: 1321984 - RNA, 21 nt, Mycobacterium tuberculosis H37Rv
cccagcucgcgcacccagccc

SEQ ID NO: 1321985 - RNA, 22 nt, Mycobacterium tuberculosis H37Rv
cccagcaucuuuggcggccgca

SEQ ID NO: 1321986 - RNA, 16 nt, Mycobacterium tuberculosis H37Rv
cccagcaugaaguccc

SEQ ID NO: 1321987 - RNA, 13 nt, Mycobacterium tuberculosis H37Rv
cccaucgcgucgg

SEQ ID NO: 1321988 - RNA, 16 nt, Mycobacterium tuberculosis H37Rv
cccaucgccacaccca

SEQ ID NO: 1321989 - RNA, 16 nt, Mycobacterium tuberculosis H37Rv
cccaucgccuggaugc

SEQ ID NO: 1321990 - RNA, 14 nt, Mycobacterium tuberculosis H37Rv
cccaucgaccgccc

SEQ ID NO: 1321991 - RNA, 19 nt, Mycobacterium tuberculosis H37Rv
cccaucuaccagcucaccc

SEQ ID NO: 1321992 - RNA, 14 nt, Mycobacterium tuberculosis H37Rv
cccaucgugcugaa

SEQ ID NO: 1321993 - RNA, 13 nt, Mycobacterium tuberculosis H37Rv
cccaucgggcgcc

SEQ ID NO: 1321994 - RNA, 16 nt, Mycobacterium tuberculosis H37Rv
cccaucucgucgucgg

SEQ ID NO: 1321995 - RNA, 16 nt, Mycobacterium tuberculosis H37Rv
cccaucugcucagggc

SEQ ID NO: 1321996 - RNA, 16 nt, Mycobacterium tuberculosis H37Rv
cccaucgaccgcccgc

SEQ ID NO: 1321997 - RNA, 15 nt, Mycobacterium tuberculosis H37Rv
cccaucaccaccggc

SEQ ID NO: 1321998 - RNA, 13 nt, Mycobacterium tuberculosis H37Rv
cccaucaccagcg

SEQ ID NO: 1321999 - RNA, 20 nt, Mycobacterium tuberculosis H37Rv
cccaucagaaugccuggccc

SEQ ID NO: 1322000 - RNA, 15 nt, Mycobacterium tuberculosis H37Rv
cccagugggacaggu

SEQ ID NO: 1322001 - RNA, 16 nt, Mycobacterium tuberculosis H37Rv
cccagugcggccaccu

SEQ ID NO: 1322002 - RNA, 13 nt, Mycobacterium tuberculosis H37Rv
cccaguucugcag

SEQ ID NO: 1322003 - RNA, 14 nt, Mycobacterium tuberculosis H37Rv
cccaguucugcagg

SEQ ID NO: 1322004 - RNA, 13 nt, Mycobacterium tuberculosis H37Rv
cccagugucagca

SEQ ID NO: 1322005 - RNA, 18 nt, Mycobacterium tuberculosis H37Rv
cagcgugaucuggccacg

SEQ ID NO: 1322006 - RNA, 16 nt, Mycobacterium tuberculosis H37Rv
cagcgugaucuggcca

SEQ ID NO: 1322007 - RNA, 15 nt, Mycobacterium tuberculosis H37Rv
cagcgugagugcagc

SEQ ID NO: 1322008 - RNA, 12 nt, Mycobacterium tuberculosis H37Rv
cagcgugaacug

SEQ ID NO: 1322009 - RNA, 13 nt, Mycobacterium tuberculosis H37Rv
cagcgugcccgcc

SEQ ID NO: 1322010 - RNA, 23 nt, Mycobacterium tuberculosis H37Rv
cagcgugccgguggcgccgccgc

SEQ ID NO: 1322011 - RNA, 19 nt, Mycobacterium tuberculosis H37Rv
cagcguggggccgccacca

SEQ ID NO: 1322012 - RNA, 22 nt, Mycobacterium tuberculosis H37Rv
cagcguggcgcccgugccgccc

SEQ ID NO: 1322013 - RNA, 16 nt, Mycobacterium tuberculosis H37Rv
cagcgucgguggcagc

SEQ ID NO: 1322014 - RNA, 14 nt, Mycobacterium tuberculosis H37Rv
cagcgucuccuuga

SEQ ID NO: 1322015 - RNA, 17 nt, Mycobacterium tuberculosis H37Rv
cagcgucucggaggcga

SEQ ID NO: 1322016 - RNA, 14 nt, Mycobacterium tuberculosis H37Rv
cagcgucucgccgg

SEQ ID NO: 1322017 - RNA, 14 nt, Mycobacterium tuberculosis H37Rv
cagcuaauaccugc

SEQ ID NO: 1322018 - RNA, 22 nt, Mycobacterium tuberculosis H37Rv
cagcgugucuugucgcgcagca

SEQ ID NO: 1322019 - RNA, 23 nt, Mycobacterium tuberculosis H37Rv
cagcguguggagcucgcggcgca

SEQ ID NO: 1322020 - RNA, 22 nt, Mycobacterium tuberculosis H37Rv
cagcguguaguggcccgcgggc

SEQ ID NO: 1322021 - RNA, 14 nt, Mycobacterium tuberculosis H37Rv
cagcguggugaucc

SEQ ID NO: 1322022 - RNA, 23 nt, Mycobacterium tuberculosis H37Rv
cagcguugucggguggcugcugg

SEQ ID NO: 1322023 - RNA, 15 nt, Mycobacterium tuberculosis H37Rv
cagcguugucgggug

SEQ ID NO: 1322024 - RNA, 14 nt, Mycobacterium tuberculosis H37Rv
cagcguuggccgcu

SEQ ID NO: 1322025 - RNA, 17 nt, Mycobacterium tuberculosis H37Rv
cagcguucccgccggcu

SEQ ID NO: 1322026 - RNA, 23 nt, Mycobacterium tuberculosis H37Rv
cagcguucccgccggcuccgcca

SEQ ID NO: 1322027 - RNA, 20 nt, Mycobacterium tuberculosis H37Rv
cagcggguugcggucaccgg

SEQ ID NO: 1322028 - RNA, 17 nt, Mycobacterium tuberculosis H37Rv
cagcggguuugccgggc

SEQ ID NO: 1322029 - RNA, 20 nt, Mycobacterium tuberculosis H37Rv
cagcggguucaacgcgcgca

SEQ ID NO: 1322030 - RNA, 17 nt, Mycobacterium tuberculosis H37Rv
cagcgggucgaccccgg

SEQ ID NO: 1322031 - RNA, 22 nt, Mycobacterium tuberculosis H37Rv
cagcggguggccaucaccgcgc

SEQ ID NO: 1322032 - RNA, 13 nt, Mycobacterium tuberculosis H37Rv
cagcggucagccg

SEQ ID NO: 1322033 - RNA, 18 nt, Mycobacterium tuberculosis H37Rv
cagcgguccagccaccgc

SEQ ID NO: 1322034 - RNA, 22 nt, Mycobacterium tuberculosis H37Rv
cacugaggagaugagcaccaaa

SEQ ID NO: 1322035 - RNA, 20 nt, Mycobacterium tuberculosis H37Rv
cacugaggagaugagcacca

SEQ ID NO: 1322036 - RNA, 18 nt, Mycobacterium tuberculosis H37Rv
cacugaguucggugcugu

SEQ ID NO: 1322037 - RNA, 21 nt, Mycobacterium tuberculosis H37Rv
cagcgggacauccagugcggu

SEQ ID NO: 1322038 - RNA, 17 nt, Mycobacterium tuberculosis H37Rv
cagcgggaucugaccca

SEQ ID NO: 1322039 - RNA, 14 nt, Mycobacterium tuberculosis H37Rv
cagcgggcgcgcua

SEQ ID NO: 1322040 - RNA, 19 nt, Mycobacterium tuberculosis H37Rv
cagcgggcauaacccgcac

SEQ ID NO: 1322041 - RNA, 17 nt, Mycobacterium tuberculosis H37Rv
cagcgggccgaagcccc

SEQ ID NO: 1322042 - RNA, 19 nt, Mycobacterium tuberculosis H37Rv
cagcguaucucccaacggc

SEQ ID NO: 1322043 - RNA, 13 nt, Mycobacterium tuberculosis H37Rv
cagcgucagcugu

SEQ ID NO: 1322044 - RNA, 21 nt, Mycobacterium tuberculosis H37Rv
cagcgucagcuguuugccggc

SEQ ID NO: 1322045 - RNA, 17 nt, Mycobacterium tuberculosis H37Rv
cagcgucaucccgaugu

SEQ ID NO: 1322046 - RNA, 13 nt, Mycobacterium tuberculosis H37Rv
cagcguccaaccc

SEQ ID NO: 1322047 - RNA, 20 nt, Mycobacterium tuberculosis H37Rv
cagcgucaggugcgcgacca

SEQ ID NO: 1322048 - RNA, 21 nt, Mycobacterium tuberculosis H37Rv
cagcguccagccgcccucggg

SEQ ID NO: 1322049 - RNA, 17 nt, Mycobacterium tuberculosis H37Rv
cagcgguggcaagccua

SEQ ID NO: 1322050 - RNA, 22 nt, Mycobacterium tuberculosis H37Rv
cagcgguggcccgccggcaaca

SEQ ID NO: 1322051 - RNA, 13 nt, Mycobacterium tuberculosis H37Rv
cagcggugcuggu

SEQ ID NO: 1322052 - RNA, 19 nt, Mycobacterium tuberculosis H37Rv
cagcgguugaugcggccgc

SEQ ID NO: 1322053 - RNA, 13 nt, Mycobacterium tuberculosis H37Rv
cagcugaucccag

SEQ ID NO: 1322054 - RNA, 16 nt, Mycobacterium tuberculosis H37Rv
cagcugaccagcgucc

SEQ ID NO: 1322055 - RNA, 17 nt, Mycobacterium tuberculosis H37Rv
cagcugcccgccagcgc

SEQ ID NO: 1322056 - RNA, 21 nt, Mycobacterium tuberculosis H37Rv
cagcugcaccuccgacggccg

SEQ ID NO: 1322057 - RNA, 22 nt, Mycobacterium tuberculosis H37Rv
cagcugcaccuccgacggccgc

SEQ ID NO: 1322058 - RNA, 18 nt, Mycobacterium tuberculosis H37Rv
cagcugcaauagccuuac

SEQ ID NO: 1322059 - RNA, 20 nt, Mycobacterium tuberculosis H37Rv
cagcugcgggucgugccccg

SEQ ID NO: 1322060 - RNA, 20 nt, Mycobacterium tuberculosis H37Rv
cagcugcggauccaccacgc

SEQ ID NO: 1322061 - RNA, 21 nt, Mycobacterium tuberculosis H37Rv
cagcugcggauacagccgccg

SEQ ID NO: 1322062 - RNA, 22 nt, Mycobacterium tuberculosis H37Rv
cagcucacccggagcacccggg

SEQ ID NO: 1322063 - RNA, 15 nt, Mycobacterium tuberculosis H37Rv
cagcucaccacccag

SEQ ID NO: 1322064 - RNA, 17 nt, Mycobacterium tuberculosis H37Rv
cagcucacggacgcugg

SEQ ID NO: 1322065 - RNA, 13 nt, Mycobacterium tuberculosis H37Rv
cagcucagcugcg

SEQ ID NO: 1322066 - RNA, 14 nt, Mycobacterium tuberculosis H37Rv
cagcucagcugcgg

SEQ ID NO: 1322067 - RNA, 22 nt, Mycobacterium tuberculosis H37Rv
cagcucgauacccaggaugugu

SEQ ID NO: 1322068 - RNA, 15 nt, Mycobacterium tuberculosis H37Rv
cagcucgauacccag

SEQ ID NO: 1322069 - RNA, 19 nt, Mycobacterium tuberculosis H37Rv
cagcucgagguccucagcg

SEQ ID NO: 1322070 - RNA, 18 nt, Mycobacterium tuberculosis H37Rv
cagcucgaucacgccggc

SEQ ID NO: 1322071 - RNA, 16 nt, Mycobacterium tuberculosis H37Rv
cagcucgaucagccgg

SEQ ID NO: 1322072 - RNA, 20 nt, Mycobacterium tuberculosis H37Rv
cagcucguuggcgaaauccg

SEQ ID NO: 1322073 - RNA, 14 nt, Mycobacterium tuberculosis H37Rv
cagcucgaccagga

SEQ ID NO: 1322074 - RNA, 17 nt, Mycobacterium tuberculosis H37Rv
cagcucgaggaccaccu

SEQ ID NO: 1322075 - RNA, 23 nt, Mycobacterium tuberculosis H37Rv
cagcuccuuggcuaacaccgcag

SEQ ID NO: 1322076 - RNA, 20 nt, Mycobacterium tuberculosis H37Rv
cagcugggucccgcuggcau

SEQ ID NO: 1322077 - RNA, 20 nt, Mycobacterium tuberculosis H37Rv
cagcugggugaccucgucga

SEQ ID NO: 1322078 - RNA, 21 nt, Mycobacterium tuberculosis H37Rv
cagcugguaaccggcggcagc

SEQ ID NO: 1322079 - RNA, 23 nt, Mycobacterium tuberculosis H37Rv
cagcuggucgugggccaccaccu

SEQ ID NO: 1322080 - RNA, 19 nt, Mycobacterium tuberculosis H37Rv
cagcugguagcgcaccaca

SEQ ID NO: 1322081 - RNA, 19 nt, Mycobacterium tuberculosis H37Rv
cagcuggucgugggccacc

SEQ ID NO: 1322082 - RNA, 20 nt, Mycobacterium tuberculosis H37Rv
cagcuggcgcagccugccga

SEQ ID NO: 1322083 - RNA, 17 nt, Mycobacterium tuberculosis H37Rv
cagcugggcagccagau

SEQ ID NO: 1322084 - RNA, 14 nt, Mycobacterium tuberculosis H37Rv
cagcugggcagcca

SEQ ID NO: 1322085 - RNA, 13 nt, Mycobacterium tuberculosis H37Rv
cagcugggccgcu

SEQ ID NO: 1322086 - RNA, 17 nt, Mycobacterium tuberculosis H37Rv
cagcuggggcggauaug

SEQ ID NO: 1322087 - RNA, 16 nt, Mycobacterium tuberculosis H37Rv
cagcuugcggagccgc

SEQ ID NO: 1322088 - RNA, 21 nt, Mycobacterium tuberculosis H37Rv
cagcuucgccagguggccgcu

SEQ ID NO: 1322089 - RNA, 17 nt, Mycobacterium tuberculosis H37Rv
cagcuuucuuggcgggc

SEQ ID NO: 1322090 - RNA, 17 nt, Mycobacterium tuberculosis H37Rv
cagcuuuguucccuuca

SEQ ID NO: 1322091 - RNA, 20 nt, Mycobacterium tuberculosis H37Rv
caggaaaaccccggccacca

SEQ ID NO: 1322092 - RNA, 15 nt, Mycobacterium tuberculosis H37Rv
caggaaaaccccggc

SEQ ID NO: 1322093 - RNA, 21 nt, Mycobacterium tuberculosis H37Rv
cagcuugucguagcgacgcca

SEQ ID NO: 1322094 - RNA, 16 nt, Mycobacterium tuberculosis H37Rv
cagcuuggccagccac

SEQ ID NO: 1322095 - RNA, 14 nt, Mycobacterium tuberculosis H37Rv
cagcuuggccagcc

SEQ ID NO: 1322096 - RNA, 24 nt, Mycobacterium tuberculosis H37Rv
cagcuuggagaggcggugcagcuc

SEQ ID NO: 1322097 - RNA, 18 nt, Mycobacterium tuberculosis H37Rv
cagcuuggcgucgaugcg

SEQ ID NO: 1322098 - RNA, 21 nt, Mycobacterium tuberculosis H37Rv
cagcuuggccucagccaccgg

SEQ ID NO: 1322099 - RNA, 21 nt, Mycobacterium tuberculosis H37Rv
cagcuuuaaucguggcacuga

SEQ ID NO: 1322100 - RNA, 23 nt, Mycobacterium tuberculosis H37Rv
cagcuuguuuuccaccagcgagc

SEQ ID NO: 1322101 - RNA, 16 nt, Mycobacterium tuberculosis H37Rv
caggccagagccgccc

SEQ ID NO: 1322102 - RNA, 20 nt, Mycobacterium tuberculosis H37Rv
caggccaccgcagacgccgu

SEQ ID NO: 1322103 - RNA, 23 nt, Mycobacterium tuberculosis H37Rv
caggccacugccgaccagcgcgc

SEQ ID NO: 1322104 - RNA, 22 nt, Mycobacterium tuberculosis H37Rv
caggccacucacguaauccucg

SEQ ID NO: 1322105 - RNA, 20 nt, Mycobacterium tuberculosis H37Rv
caggcauuuucacugugccg

SEQ ID NO: 1322106 - RNA, 13 nt, Mycobacterium tuberculosis H37Rv
caggcauggcgcc

SEQ ID NO: 1322107 - RNA, 22 nt, Mycobacterium tuberculosis H37Rv
caggcaucaccggaacccccag

SEQ ID NO: 1322108 - RNA, 21 nt, Mycobacterium tuberculosis H37Rv
caggccagggugaccaggccg

SEQ ID NO: 1322109 - RNA, 19 nt, Mycobacterium tuberculosis H37Rv
caggccagggugaccaggc

SEQ ID NO: 1322110 - RNA, 21 nt, Mycobacterium tuberculosis H37Rv
caggccagggcgguggccacc

SEQ ID NO: 1322111 - RNA, 19 nt, Mycobacterium tuberculosis H37Rv
caggccagugccaccuggg

SEQ ID NO: 1322112 - RNA, 21 nt, Mycobacterium tuberculosis H37Rv
caggccagugccaccugggcg

SEQ ID NO: 1322113 - RNA, 18 nt, Mycobacterium tuberculosis H37Rv
caggccauccgggcugcc

SEQ ID NO: 1322114 - RNA, 17 nt, Mycobacterium tuberculosis H37Rv
caggcccgacggcgccc

SEQ ID NO: 1322115 - RNA, 19 nt, Mycobacterium tuberculosis H37Rv
caggccccacaccuuggcg

SEQ ID NO: 1322116 - RNA, 22 nt, Mycobacterium tuberculosis H37Rv
caggccccacuggugcagcgcc

SEQ ID NO: 1322117 - RNA, 13 nt, Mycobacterium tuberculosis H37Rv
caggcccagccga

SEQ ID NO: 1322118 - RNA, 22 nt, Mycobacterium tuberculosis H37Rv
caggcaaguugugagggaggcc

SEQ ID NO: 1322119 - RNA, 14 nt, Mycobacterium tuberculosis H37Rv
caggcacaacgcga

SEQ ID NO: 1322120 - RNA, 18 nt, Mycobacterium tuberculosis H37Rv
caggaugccugccacccg

SEQ ID NO: 1322121 - RNA, 14 nt, Mycobacterium tuberculosis H37Rv
caggauggccauca

SEQ ID NO: 1322122 - RNA, 21 nt, Mycobacterium tuberculosis H37Rv
caggauggccaucagcucgcc

SEQ ID NO: 1322123 - RNA, 16 nt, Mycobacterium tuberculosis H37Rv
caggauauuucuaaau

SEQ ID NO: 1322124 - RNA, 21 nt, Mycobacterium tuberculosis H37Rv
caggaucacacuggccugcuc

SEQ ID NO: 1322125 - RNA, 16 nt, Mycobacterium tuberculosis H37Rv
caggauccguggccaa

SEQ ID NO: 1322126 - RNA, 19 nt, Mycobacterium tuberculosis H37Rv
caggaugaugaccgccauc

SEQ ID NO: 1322127 - RNA, 20 nt, Mycobacterium tuberculosis H37Rv
caggaacaaguagccgucgu

SEQ ID NO: 1322128 - RNA, 20 nt, Mycobacterium tuberculosis H37Rv
caggcgaacaccagauggcu

SEQ ID NO: 1322129 - RNA, 15 nt, Mycobacterium tuberculosis H37Rv
caggcgaacaccaga

SEQ ID NO: 1322130 - RNA, 19 nt, Mycobacterium tuberculosis H37Rv
caggccuaguccggcacug

SEQ ID NO: 1322131 - RNA, 20 nt, Mycobacterium tuberculosis H37Rv
caggccuccucuugggucca

SEQ ID NO: 1322132 - RNA, 15 nt, Mycobacterium tuberculosis H37Rv
caggccucggcgccg

SEQ ID NO: 1322133 - RNA, 18 nt, Mycobacterium tuberculosis H37Rv
caggccucggcgccgccc

SEQ ID NO: 1322134 - RNA, 20 nt, Mycobacterium tuberculosis H37Rv
caggccuccaaaaucgcggc

SEQ ID NO: 1322135 - RNA, 17 nt, Mycobacterium tuberculosis H37Rv
caggccuccaagcccgc

SEQ ID NO: 1322136 - RNA, 15 nt, Mycobacterium tuberculosis H37Rv
caggcccuggccacc

SEQ ID NO: 1322137 - RNA, 16 nt, Mycobacterium tuberculosis H37Rv
caggcccuggccaccc

SEQ ID NO: 1322138 - RNA, 17 nt, Mycobacterium tuberculosis H37Rv
caggcccuggccaccca

SEQ ID NO: 1322139 - RNA, 23 nt, Mycobacterium tuberculosis H37Rv
caggcccgugccuggccggugcg

SEQ ID NO: 1322140 - RNA, 18 nt, Mycobacterium tuberculosis H37Rv
caggcccgugccuggccg

SEQ ID NO: 1322141 - RNA, 20 nt, Mycobacterium tuberculosis H37Rv
caggcccgguucgaggaucc

SEQ ID NO: 1322142 - RNA, 18 nt, Mycobacterium tuberculosis H37Rv
caggcccgccagcagggc

SEQ ID NO: 1322143 - RNA, 20 nt, Mycobacterium tuberculosis H37Rv
caggcccgccagcagggcca

SEQ ID NO: 1322144 - RNA, 22 nt, Mycobacterium tuberculosis H37Rv
caggcgagugaacucguccuga

SEQ ID NO: 1322145 - RNA, 18 nt, Mycobacterium tuberculosis H37Rv
caggcgagccggcgcgca

SEQ ID NO: 1322146 - RNA, 15 nt, Mycobacterium tuberculosis H37Rv
caggcgagccggcgc

SEQ ID NO: 1322147 - RNA, 19 nt, Mycobacterium tuberculosis H37Rv
caggcgcagauuccucuuc

SEQ ID NO: 1322148 - RNA, 14 nt, Mycobacterium tuberculosis H37Rv
caggcgcaccaggc

SEQ ID NO: 1322149 - RNA, 18 nt, Mycobacterium tuberculosis H37Rv
caggcgaucgcccggccc

SEQ ID NO: 1322150 - RNA, 22 nt, Mycobacterium tuberculosis H37Rv
caggcgcucgaaggccgcacuc

SEQ ID NO: 1322151 - RNA, 17 nt, Mycobacterium tuberculosis H37Rv
caggcggacgggacgca

SEQ ID NO: 1322152 - RNA, 21 nt, Mycobacterium tuberculosis H37Rv
caggcuugacugcacaccacc

SEQ ID NO: 1322153 - RNA, 14 nt, Mycobacterium tuberculosis H37Rv
caggcuucccugau

SEQ ID NO: 1322154 - RNA, 22 nt, Mycobacterium tuberculosis H37Rv
caggcugucgcgggccaccacc

SEQ ID NO: 1322155 - RNA, 15 nt, Mycobacterium tuberculosis H37Rv
caggcuguggccagc

SEQ ID NO: 1322156 - RNA, 18 nt, Mycobacterium tuberculosis H37Rv
caggcuguggccagcauc

SEQ ID NO: 1322157 - RNA, 21 nt, Mycobacterium tuberculosis H37Rv
cagggagugccgcacgauggc

SEQ ID NO: 1322158 - RNA, 18 nt, Mycobacterium tuberculosis H37Rv
caggcgucccagccgauc

SEQ ID NO: 1322159 - RNA, 16 nt, Mycobacterium tuberculosis H37Rv
caggcgucccagccga

SEQ ID NO: 1322160 - RNA, 22 nt, Mycobacterium tuberculosis H37Rv
caggcguagguccuugucggcc

SEQ ID NO: 1322161 - RNA, 13 nt, Mycobacterium tuberculosis H37Rv
caggcguaucccg

SEQ ID NO: 1322162 - RNA, 16 nt, Mycobacterium tuberculosis H37Rv
caggcugaaggacggc

SEQ ID NO: 1322163 - RNA, 22 nt, Mycobacterium tuberculosis H37Rv
caggcugaaaccuugcggcaga

SEQ ID NO: 1322164 - RNA, 20 nt, Mycobacterium tuberculosis H37Rv
caggcugcggauacuguucu

SEQ ID NO: 1322165 - RNA, 18 nt, Mycobacterium tuberculosis H37Rv
cagggaucagccgugcgg

SEQ ID NO: 1322166 - RNA, 22 nt, Mycobacterium tuberculosis H37Rv
cagggaucagccgugcgggccg

SEQ ID NO: 1322167 - RNA, 15 nt, Mycobacterium tuberculosis H37Rv
cagggauucuggaug

SEQ ID NO: 1322168 - RNA, 20 nt, Mycobacterium tuberculosis H37Rv
cagguaagcagccagcaaca

SEQ ID NO: 1322169 - RNA, 16 nt, Mycobacterium tuberculosis H37Rv
cagggauucuggaugc

SEQ ID NO: 1322170 - RNA, 14 nt, Mycobacterium tuberculosis H37Rv
cagguacucgcccc

SEQ ID NO: 1322171 - RNA, 20 nt, Mycobacterium tuberculosis H37Rv
cagguauuugccgugcucac

SEQ ID NO: 1322172 - RNA, 17 nt, Mycobacterium tuberculosis H37Rv
cagguccaccgcugccg

SEQ ID NO: 1322173 - RNA, 21 nt, Mycobacterium tuberculosis H37Rv
caggucaucggcggcggggac

SEQ ID NO: 1322174 - RNA, 18 nt, Mycobacterium tuberculosis H37Rv
caggucagccgcgcgggu

SEQ ID NO: 1322175 - RNA, 14 nt, Mycobacterium tuberculosis H37Rv
caggucagccgcgc

SEQ ID NO: 1322176 - RNA, 16 nt, Mycobacterium tuberculosis H37Rv
caggucauagccccgc

SEQ ID NO: 1322177 - RNA, 17 nt, Mycobacterium tuberculosis H37Rv
caggucagcgcugccac

SEQ ID NO: 1322178 - RNA, 15 nt, Mycobacterium tuberculosis H37Rv
caggucuucaagcuc

SEQ ID NO: 1322179 - RNA, 16 nt, Mycobacterium tuberculosis H37Rv
caggugauucgcgcag

SEQ ID NO: 1322180 - RNA, 21 nt, Mycobacterium tuberculosis H37Rv
caggucggcuucgacaaccuc

SEQ ID NO: 1322181 - RNA, 20 nt, Mycobacterium tuberculosis H37Rv
caggucggcgggcgcgggug

SEQ ID NO: 1322182 - RNA, 15 nt, Mycobacterium tuberculosis H37Rv
caggucggugacgaa

SEQ ID NO: 1322183 - RNA, 15 nt, Mycobacterium tuberculosis H37Rv
caggucggccgccuc

SEQ ID NO: 1322184 - RNA, 20 nt, Mycobacterium tuberculosis H37Rv
caggucggcggacgcgggug

SEQ ID NO: 1322185 - RNA, 15 nt, Mycobacterium tuberculosis H37Rv
caggucgugcccggg

SEQ ID NO: 1322186 - RNA, 22 nt, Mycobacterium tuberculosis H37Rv
caggucgauaccggcgugcagu

SEQ ID NO: 1322187 - RNA, 22 nt, Mycobacterium tuberculosis H37Rv
caggucgacaccgcggugcccc

SEQ ID NO: 1322188 - RNA, 22 nt, Mycobacterium tuberculosis H37Rv
cagguccgccggugccgccguc

SEQ ID NO: 1322189 - RNA, 14 nt, Mycobacterium tuberculosis H37Rv
cagguccgccaccg

SEQ ID NO: 1322190 - RNA, 15 nt, Mycobacterium tuberculosis H37Rv
cagguccgccaccgc

SEQ ID NO: 1322191 - RNA, 22 nt, Mycobacterium tuberculosis H37Rv
cagguccgccaccgcgagcaga

SEQ ID NO: 1322192 - RNA, 14 nt, Mycobacterium tuberculosis H37Rv
cagguccaguaccu

SEQ ID NO: 1322193 - RNA, 14 nt, Mycobacterium tuberculosis H37Rv
caggucgaugcugc

SEQ ID NO: 1322194 - RNA, 23 nt, Mycobacterium tuberculosis H37Rv
caggucgaugcugccagccaugg

SEQ ID NO: 1322195 - RNA, 14 nt, Mycobacterium tuberculosis H37Rv
caggucgcagacca

SEQ ID NO: 1322196 - RNA, 16 nt, Mycobacterium tuberculosis H37Rv
caggucgcagaccaga

SEQ ID NO: 1322197 - RNA, 19 nt, Mycobacterium tuberculosis H37Rv
caggucgcauucugcugcc

SEQ ID NO: 1322198 - RNA, 22 nt, Mycobacterium tuberculosis H37Rv
caggucgccuucuucgcggcgg

SEQ ID NO: 1322199 - RNA, 17 nt, Mycobacterium tuberculosis H37Rv
caguaugcggugcccgc

SEQ ID NO: 1322200 - RNA, 15 nt, Mycobacterium tuberculosis H37Rv
caguccaagcuguca

SEQ ID NO: 1322201 - RNA, 18 nt, Mycobacterium tuberculosis H37Rv
caguccaugugcccaggu

SEQ ID NO: 1322202 - RNA, 15 nt, Mycobacterium tuberculosis H37Rv
caguccaucgacagg

SEQ ID NO: 1322203 - RNA, 22 nt, Mycobacterium tuberculosis H37Rv
cagucccaagggcaacagugaa

SEQ ID NO: 1322204 - RNA, 15 nt, Mycobacterium tuberculosis H37Rv
caguccagcgggcau

SEQ ID NO: 1322205 - RNA, 23 nt, Mycobacterium tuberculosis H37Rv
caguacgaucucauccuccugcg

SEQ ID NO: 1322206 - RNA, 13 nt, Mycobacterium tuberculosis H37Rv
caguacgcgcuga

SEQ ID NO: 1322207 - RNA, 20 nt, Mycobacterium tuberculosis H37Rv
caguaggugucgggcucgca

SEQ ID NO: 1322208 - RNA, 16 nt, Mycobacterium tuberculosis H37Rv
caguaggccuccgcug

SEQ ID NO: 1322209 - RNA, 19 nt, Mycobacterium tuberculosis H37Rv
caguaggccuccgcugccg

SEQ ID NO: 1322210 - RNA, 16 nt, Mycobacterium tuberculosis H37Rv
caguacgguccggcgu

SEQ ID NO: 1322211 - RNA, 16 nt, Mycobacterium tuberculosis H37Rv
caguagcuguggcccg

SEQ ID NO: 1322212 - RNA, 19 nt, Mycobacterium tuberculosis H37Rv
cagguucuugaccagcagc

SEQ ID NO: 1322213 - RNA, 20 nt, Mycobacterium tuberculosis H37Rv
cagguucuucuccaccaccg

SEQ ID NO: 1322214 - RNA, 17 nt, Mycobacterium tuberculosis H37Rv
cagguugauccagugcu

SEQ ID NO: 1322215 - RNA, 15 nt, Mycobacterium tuberculosis H37Rv
cagguucuucuccac

SEQ ID NO: 1322216 - RNA, 22 nt, Mycobacterium tuberculosis H37Rv
cagguugaagaaugccgucuga

SEQ ID NO: 1322217 - RNA, 19 nt, Mycobacterium tuberculosis H37Rv
cagguucgagggugacccc

SEQ ID NO: 1322218 - RNA, 20 nt, Mycobacterium tuberculosis H37Rv
cagguuccacgcguugacga

SEQ ID NO: 1322219 - RNA, 19 nt, Mycobacterium tuberculosis H37Rv
cagguuccacggacggucg

SEQ ID NO: 1322220 - RNA, 19 nt, Mycobacterium tuberculosis H37Rv
caggugcagcaccagccac

SEQ ID NO: 1322221 - RNA, 19 nt, Mycobacterium tuberculosis H37Rv
caggugcagguugcccuca

SEQ ID NO: 1322222 - RNA, 12 nt, Mycobacterium tuberculosis H37Rv
caggugcccggc

SEQ ID NO: 1322223 - RNA, 23 nt, Mycobacterium tuberculosis H37Rv
caguggugucggaaugggcgcca

SEQ ID NO: 1322224 - RNA, 15 nt, Mycobacterium tuberculosis H37Rv
caguucgcgccacgc

SEQ ID NO: 1322225 - RNA, 21 nt, Mycobacterium tuberculosis H37Rv
caguucggccuugaucgugcu

SEQ ID NO: 1322226 - RNA, 15 nt, Mycobacterium tuberculosis H37Rv
caguucggcgaugcg

SEQ ID NO: 1322227 - RNA, 20 nt, Mycobacterium tuberculosis H37Rv
caguucggcgaugcgcgggu

SEQ ID NO: 1322228 - RNA, 16 nt, Mycobacterium tuberculosis H37Rv
caguuccagcucgcgg

SEQ ID NO: 1322229 - RNA, 19 nt, Mycobacterium tuberculosis H37Rv
caguucccggccauagccc

SEQ ID NO: 1322230 - RNA, 16 nt, Mycobacterium tuberculosis H37Rv
caguucccuacaccca

SEQ ID NO: 1322231 - RNA, 21 nt, Mycobacterium tuberculosis H37Rv
caguuccgcggcgaguggcuc

SEQ ID NO: 1322232 - RNA, 23 nt, Mycobacterium tuberculosis H37Rv
cagugcgaacucaucgugguaac

SEQ ID NO: 1322233 - RNA, 14 nt, Mycobacterium tuberculosis H37Rv
cagugcgcagaaca

SEQ ID NO: 1322234 - RNA, 23 nt, Mycobacterium tuberculosis H37Rv
cagugcgcaacccagccgcgcca

SEQ ID NO: 1322235 - RNA, 15 nt, Mycobacterium tuberculosis H37Rv
cagugcgcaacccag

SEQ ID NO: 1322236 - RNA, 22 nt, Mycobacterium tuberculosis H37Rv
cagugccgcccaccacacagcc

SEQ ID NO: 1322237 - RNA, 19 nt, Mycobacterium tuberculosis H37Rv
cagugccccgccgagcggu

SEQ ID NO: 1322238 - RNA, 16 nt, Mycobacterium tuberculosis H37Rv
cagugcgcgugcccgu

SEQ ID NO: 1322239 - RNA, 14 nt, Mycobacterium tuberculosis H37Rv
cagugcggccuugg

SEQ ID NO: 1322240 - RNA, 17 nt, Mycobacterium tuberculosis H37Rv
cagugggacuggcguga

SEQ ID NO: 1322241 - RNA, 20 nt, Mycobacterium tuberculosis H37Rv
cagugggacaaagacgccgu

SEQ ID NO: 1322242 - RNA, 18 nt, Mycobacterium tuberculosis H37Rv
cagugggacaggucggca

SEQ ID NO: 1322243 - RNA, 23 nt, Mycobacterium tuberculosis H37Rv
cagugauucggccugagcggcca

SEQ ID NO: 1322244 - RNA, 15 nt, Mycobacterium tuberculosis H37Rv
cagugaugcgccccg

SEQ ID NO: 1322245 - RNA, 16 nt, Mycobacterium tuberculosis H37Rv
cagugaucaccaaccc

SEQ ID NO: 1322246 - RNA, 16 nt, Mycobacterium tuberculosis H37Rv
caguccucaucgagcg

SEQ ID NO: 1322247 - RNA, 18 nt, Mycobacterium tuberculosis H37Rv
cagugccccgcagcacuc

SEQ ID NO: 1322248 - RNA, 20 nt, Mycobacterium tuberculosis H37Rv
cagugccagugccagcgucc

SEQ ID NO: 1322249 - RNA, 22 nt, Mycobacterium tuberculosis H37Rv
cagugauugagcagcaagccgc

SEQ ID NO: 1322250 - RNA, 17 nt, Mycobacterium tuberculosis H37Rv
caguccgaaagccgccg

SEQ ID NO: 1322251 - RNA, 18 nt, Mycobacterium tuberculosis H37Rv
caguccgaagcugcugcu

SEQ ID NO: 1322252 - RNA, 22 nt, Mycobacterium tuberculosis H37Rv
caguccgaugggaaucagugaa

SEQ ID NO: 1322253 - RNA, 18 nt, Mycobacterium tuberculosis H37Rv
caguccggccccccgacu

SEQ ID NO: 1322254 - RNA, 14 nt, Mycobacterium tuberculosis H37Rv
caguccgucggccu

SEQ ID NO: 1322255 - RNA, 14 nt, Mycobacterium tuberculosis H37Rv
caguccguccaggu

SEQ ID NO: 1322256 - RNA, 13 nt, Mycobacterium tuberculosis H37Rv
caguccgcuggcc

SEQ ID NO: 1322257 - RNA, 15 nt, Mycobacterium tuberculosis H37Rv
caguucgugacgugc

SEQ ID NO: 1322258 - RNA, 18 nt, Mycobacterium tuberculosis H37Rv
caguucggcggccgccgc

SEQ ID NO: 1322259 - RNA, 19 nt, Mycobacterium tuberculosis H37Rv
caguucggcgggcgcgggu

SEQ ID NO: 1322260 - RNA, 19 nt, Mycobacterium tuberculosis H37Rv
caugacaccggccaccagc

SEQ ID NO: 1322261 - RNA, 17 nt, Mycobacterium tuberculosis H37Rv
caugaacgccagcagcg

SEQ ID NO: 1322262 - RNA, 18 nt, Mycobacterium tuberculosis H37Rv
caugaacaucggccgggu

SEQ ID NO: 1322263 - RNA, 15 nt, Mycobacterium tuberculosis H37Rv
caugaacaucggccg

SEQ ID NO: 1322264 - RNA, 18 nt, Mycobacterium tuberculosis H37Rv
caugaagaacuggcugcu

SEQ ID NO: 1322265 - RNA, 23 nt, Mycobacterium tuberculosis H37Rv
caugaaggagaucccccaggcga

SEQ ID NO: 1322266 - RNA, 13 nt, Mycobacterium tuberculosis H37Rv
caugaucggcaga

SEQ ID NO: 1322267 - RNA, 16 nt, Mycobacterium tuberculosis H37Rv
caugagcguucagcac

SEQ ID NO: 1322268 - RNA, 21 nt, Mycobacterium tuberculosis H37Rv
caugaguacaaaccucgguuu

SEQ ID NO: 1322269 - RNA, 21 nt, Mycobacterium tuberculosis H37Rv
caugagcgaccgcgagggcca

SEQ ID NO: 1322270 - RNA, 22 nt, Mycobacterium tuberculosis H37Rv
caugcaucugcuucugcguaua

SEQ ID NO: 1322271 - RNA, 17 nt, Mycobacterium tuberculosis H37Rv
caugauugccaggaccg

SEQ ID NO: 1322272 - RNA, 15 nt, Mycobacterium tuberculosis H37Rv
caugaugaugacauc

SEQ ID NO: 1322273 - RNA, 15 nt, Mycobacterium tuberculosis H37Rv
caugaugaacagcuc

SEQ ID NO: 1322274 - RNA, 21 nt, Mycobacterium tuberculosis H37Rv
caugccgccaugcgcaccagu

SEQ ID NO: 1322275 - RNA, 19 nt, Mycobacterium tuberculosis H37Rv
caugccgcggaccccgacc

SEQ ID NO: 1322276 - RNA, 19 nt, Mycobacterium tuberculosis H37Rv
caugccgccgaagccgcgc

SEQ ID NO: 1322277 - RNA, 22 nt, Mycobacterium tuberculosis H37Rv
caugcuaggcaugccacacacu

SEQ ID NO: 1322278 - RNA, 17 nt, Mycobacterium tuberculosis H37Rv
caugcuaggaccaccag

SEQ ID NO: 1322279 - RNA, 14 nt, Mycobacterium tuberculosis H37Rv
caugccacagcggc

SEQ ID NO: 1322280 - RNA, 15 nt, Mycobacterium tuberculosis H37Rv
caugccaagcuccaa

SEQ ID NO: 1322281 - RNA, 18 nt, Mycobacterium tuberculosis H37Rv
caugccaagcuccaacca

SEQ ID NO: 1322282 - RNA, 14 nt, Mycobacterium tuberculosis H37Rv
caugccacacacug

SEQ ID NO: 1322283 - RNA, 15 nt, Mycobacterium tuberculosis H37Rv
caugccacacacugc

SEQ ID NO: 1322284 - RNA, 23 nt, Mycobacterium tuberculosis H37Rv
caugccgacgacaacagccagcu

SEQ ID NO: 1322285 - RNA, 21 nt, Mycobacterium tuberculosis H37Rv
caugccgaucggccugcagcg

SEQ ID NO: 1322286 - RNA, 14 nt, Mycobacterium tuberculosis H37Rv
cauggccgccaggu

SEQ ID NO: 1322287 - RNA, 22 nt, Mycobacterium tuberculosis H37Rv
cauggcccuggcgaccagccga

SEQ ID NO: 1322288 - RNA, 12 nt, Mycobacterium tuberculosis H37Rv
cauggccaccga

SEQ ID NO: 1322289 - RNA, 16 nt, Mycobacterium tuberculosis H37Rv
cauggccagugucccg

SEQ ID NO: 1322290 - RNA, 22 nt, Mycobacterium tuberculosis H37Rv
cauggcccgcucguaggaccuc

SEQ ID NO: 1322291 - RNA, 23 nt, Mycobacterium tuberculosis H37Rv
caugcuguguaucaacagauuuc

SEQ ID NO: 1322292 - RNA, 21 nt, Mycobacterium tuberculosis H37Rv
caugcuggaaguugugcgcac

SEQ ID NO: 1322293 - RNA, 22 nt, Mycobacterium tuberculosis H37Rv
caugcuggagaaaccacuggau

SEQ ID NO: 1322294 - RNA, 20 nt, Mycobacterium tuberculosis H37Rv
caugcucgacgcccgccacc

SEQ ID NO: 1322295 - RNA, 23 nt, Mycobacterium tuberculosis H37Rv
caugcucgagugggugaggccaa

SEQ ID NO: 1322296 - RNA, 17 nt, Mycobacterium tuberculosis H37Rv
cauggcgucgaaccagu

SEQ ID NO: 1322297 - RNA, 14 nt, Mycobacterium tuberculosis H37Rv
cauggcgugcccca

SEQ ID NO: 1322298 - RNA, 19 nt, Mycobacterium tuberculosis H37Rv
cauggcggcuccgcccggc

SEQ ID NO: 1322299 - RNA, 14 nt, Mycobacterium tuberculosis H37Rv
cauggcggcccggu

SEQ ID NO: 1322300 - RNA, 16 nt, Mycobacterium tuberculosis H37Rv
cauggcgcugggaugu

SEQ ID NO: 1322301 - RNA, 16 nt, Mycobacterium tuberculosis H37Rv
cauggcgcggguccag

SEQ ID NO: 1322302 - RNA, 15 nt, Mycobacterium tuberculosis H37Rv
cauggcuccgcccag

SEQ ID NO: 1322303 - RNA, 16 nt, Mycobacterium tuberculosis H37Rv
caugucagcggccugc

SEQ ID NO: 1322304 - RNA, 21 nt, Mycobacterium tuberculosis H37Rv
caugucacacccacacccagc

SEQ ID NO: 1322305 - RNA, 20 nt, Mycobacterium tuberculosis H37Rv
caugucagcgcugagccgcu

SEQ ID NO: 1322306 - RNA, 18 nt, Mycobacterium tuberculosis H37Rv
caugucaagcgauguccc

SEQ ID NO: 1322307 - RNA, 16 nt, Mycobacterium tuberculosis H37Rv
caugucgcggacccgc

SEQ ID NO: 1322308 - RNA, 15 nt, Mycobacterium tuberculosis H37Rv
caugucggcgcgccg

SEQ ID NO: 1322309 - RNA, 15 nt, Mycobacterium tuberculosis H37Rv
caugucgcgccaggc

SEQ ID NO: 1322310 - RNA, 17 nt, Mycobacterium tuberculosis H37Rv
caugucgauccggcgcc

SEQ ID NO: 1322311 - RNA, 14 nt, Mycobacterium tuberculosis H37Rv
caugucgaugucca

SEQ ID NO: 1322312 - RNA, 21 nt, Mycobacterium tuberculosis H37Rv
caugucgccgaacgccaccac

SEQ ID NO: 1322313 - RNA, 16 nt, Mycobacterium tuberculosis H37Rv
caugucggccacccgg

SEQ ID NO: 1322314 - RNA, 17 nt, Mycobacterium tuberculosis H37Rv
caugucggccggggcca

SEQ ID NO: 1322315 - RNA, 21 nt, Mycobacterium tuberculosis H37Rv
caugucgcugccgccgccggc

SEQ ID NO: 1322316 - RNA, 14 nt, Mycobacterium tuberculosis H37Rv
cauguccgcacgcu

SEQ ID NO: 1322317 - RNA, 15 nt, Mycobacterium tuberculosis H37Rv
caugucgagcacgcc

SEQ ID NO: 1322318 - RNA, 14 nt, Mycobacterium tuberculosis H37Rv
caugucgagcacgc

SEQ ID NO: 1322319 - RNA, 22 nt, Mycobacterium tuberculosis H37Rv
cauguccugggccgccgcccug

SEQ ID NO: 1322320 - RNA, 13 nt, Mycobacterium tuberculosis H37Rv
cauuccggcgcca

SEQ ID NO: 1322321 - RNA, 16 nt, Mycobacterium tuberculosis H37Rv
cauuccggcaccuccg

SEQ ID NO: 1322322 - RNA, 18 nt, Mycobacterium tuberculosis H37Rv
cauuccggcaccuccgcc

SEQ ID NO: 1322323 - RNA, 13 nt, Mycobacterium tuberculosis H37Rv
cauucgcccggcc

SEQ ID NO: 1322324 - RNA, 21 nt, Mycobacterium tuberculosis H37Rv
cauuccagcaggccacugcgu

SEQ ID NO: 1322325 - RNA, 13 nt, Mycobacterium tuberculosis H37Rv
cauguguggcagc

SEQ ID NO: 1322326 - RNA, 15 nt, Mycobacterium tuberculosis H37Rv
cauguuccacccggu

SEQ ID NO: 1322327 - RNA, 14 nt, Mycobacterium tuberculosis H37Rv
cauucaccgcgcac

SEQ ID NO: 1322328 - RNA, 18 nt, Mycobacterium tuberculosis H37Rv
cauucaacagauccgacg

SEQ ID NO: 1322329 - RNA, 23 nt, Mycobacterium tuberculosis H37Rv
cauucaacagauccgacgaccgc

SEQ ID NO: 1322330 - RNA, 19 nt, Mycobacterium tuberculosis H37Rv
cauugcugcucgugagccc

SEQ ID NO: 1322331 - RNA, 20 nt, Mycobacterium tuberculosis H37Rv
cauugccgcaugcucagcau

SEQ ID NO: 1322332 - RNA, 20 nt, Mycobacterium tuberculosis H37Rv
cauugccgauuacgacuugg

SEQ ID NO: 1322333 - RNA, 21 nt, Mycobacterium tuberculosis H37Rv
cauugcgggagccucgccugu

SEQ ID NO: 1322334 - RNA, 19 nt, Mycobacterium tuberculosis H37Rv
cauuggugagguggucagc

SEQ ID NO: 1322335 - RNA, 23 nt, Mycobacterium tuberculosis H37Rv
cauuggccuaggacaccggcacc

SEQ ID NO: 1322336 - RNA, 18 nt, Mycobacterium tuberculosis H37Rv
cauuggcgaucagcagcc

SEQ ID NO: 1322337 - RNA, 16 nt, Mycobacterium tuberculosis H37Rv
cauuggcuuguccggu

SEQ ID NO: 1322338 - RNA, 14 nt, Mycobacterium tuberculosis H37Rv
cauucgguguggcc

SEQ ID NO: 1322339 - RNA, 16 nt, Mycobacterium tuberculosis H37Rv
cauucggcgagccgcg

SEQ ID NO: 1322340 - RNA, 11 nt, Mycobacterium tuberculosis H37Rv
cauugcccaca

SEQ ID NO: 1322341 - RNA, 18 nt, Mycobacterium tuberculosis H37Rv
cauugccgacgcgcggcc

SEQ ID NO: 1322342 - RNA, 15 nt, Mycobacterium tuberculosis H37Rv
cauugcaucugccaa

SEQ ID NO: 1322343 - RNA, 22 nt, Mycobacterium tuberculosis H37Rv
cauugcaugguuucguuccucg

SEQ ID NO: 1322344 - RNA, 22 nt, Mycobacterium tuberculosis H37Rv
cauuucaacguauccccgacca

SEQ ID NO: 1322345 - RNA, 14 nt, Mycobacterium tuberculosis H37Rv
cauuuccacaucca

SEQ ID NO: 1322346 - RNA, 23 nt, Mycobacterium tuberculosis H37Rv
cauccaggggcgcaacucaucgu

SEQ ID NO: 1322347 - RNA, 21 nt, Mycobacterium tuberculosis H37Rv
cauccauccgggccgcggcca

SEQ ID NO: 1322348 - RNA, 15 nt, Mycobacterium tuberculosis H37Rv
cauccagcagcgccu

SEQ ID NO: 1322349 - RNA, 17 nt, Mycobacterium tuberculosis H37Rv
cauccacaccgcggcgg

SEQ ID NO: 1322350 - RNA, 18 nt, Mycobacterium tuberculosis H37Rv
cauccagaugcccagcag

SEQ ID NO: 1322351 - RNA, 14 nt, Mycobacterium tuberculosis H37Rv
cauccagccgugcg

SEQ ID NO: 1322352 - RNA, 11 nt, Mycobacterium tuberculosis H37Rv
cauccagccgu

SEQ ID NO: 1322353 - RNA, 20 nt, Mycobacterium tuberculosis H37Rv
cauccagcgcgcgcugagcc

SEQ ID NO: 1322354 - RNA, 16 nt, Mycobacterium tuberculosis H37Rv
cauccaauaucgcuuu

SEQ ID NO: 1322355 - RNA, 20 nt, Mycobacterium tuberculosis H37Rv
cauccaagaaagugcacaca

SEQ ID NO: 1322356 - RNA, 20 nt, Mycobacterium tuberculosis H37Rv
caucauggccggaucccagu

SEQ ID NO: 1322357 - RNA, 19 nt, Mycobacterium tuberculosis H37Rv
caucagcggcgccaguaug

SEQ ID NO: 1322358 - RNA, 17 nt, Mycobacterium tuberculosis H37Rv
cauccgaucgccgcgaa

SEQ ID NO: 1322359 - RNA, 14 nt, Mycobacterium tuberculosis H37Rv
cauccgacaagcug

SEQ ID NO: 1322360 - RNA, 15 nt, Mycobacterium tuberculosis H37Rv
cauccgacagcagcc

SEQ ID NO: 1322361 - RNA, 20 nt, Mycobacterium tuberculosis H37Rv
caucccuuucgcgccgcgag

SEQ ID NO: 1322362 - RNA, 13 nt, Mycobacterium tuberculosis H37Rv
caucccucggugu

SEQ ID NO: 1322363 - RNA, 18 nt, Mycobacterium tuberculosis H37Rv
caucccucgguguacacc

SEQ ID NO: 1322364 - RNA, 21 nt, Mycobacterium tuberculosis H37Rv
caucccucgguguacaccgcg

SEQ ID NO: 1322365 - RNA, 18 nt, Mycobacterium tuberculosis H37Rv
caucccguucagcgacca

SEQ ID NO: 1322366 - RNA, 17 nt, Mycobacterium tuberculosis H37Rv
caucccguucagcuucc

SEQ ID NO: 1322367 - RNA, 13 nt, Mycobacterium tuberculosis H37Rv
caucccugacgaa

SEQ ID NO: 1322368 - RNA, 21 nt, Mycobacterium tuberculosis H37Rv
cauccugccuuacacgccugg

SEQ ID NO: 1322369 - RNA, 17 nt, Mycobacterium tuberculosis H37Rv
cauccugcagcucgggc

SEQ ID NO: 1322370 - RNA, 12 nt, Mycobacterium tuberculosis H37Rv
cauccggcgccg

SEQ ID NO: 1322371 - RNA, 20 nt, Mycobacterium tuberculosis H37Rv
cauccggccgucggcgggca

SEQ ID NO: 1322372 - RNA, 15 nt, Mycobacterium tuberculosis H37Rv
caucccaacgagaug

SEQ ID NO: 1322373 - RNA, 22 nt, Mycobacterium tuberculosis H37Rv
caucccaacgagaugugagcac

SEQ ID NO: 1322374 - RNA, 15 nt, Mycobacterium tuberculosis H37Rv
caucccggcgccgcg

SEQ ID NO: 1322375 - RNA, 20 nt, Mycobacterium tuberculosis H37Rv
caucccgaucccggccagcu

SEQ ID NO: 1322376 - RNA, 14 nt, Mycobacterium tuberculosis H37Rv
caucccgccacacc

SEQ ID NO: 1322377 - RNA, 16 nt, Mycobacterium tuberculosis H37Rv
caucccgaucccggcc

SEQ ID NO: 1322378 - RNA, 19 nt, Mycobacterium tuberculosis H37Rv
caucccgaaguagaagccc

SEQ ID NO: 1322379 - RNA, 13 nt, Mycobacterium tuberculosis H37Rv
caucccgaccagc

SEQ ID NO: 1322380 - RNA, 19 nt, Mycobacterium tuberculosis H37Rv
cauccccuggccagcagag

SEQ ID NO: 1322381 - RNA, 21 nt, Mycobacterium tuberculosis H37Rv
caucggaaccguuugacgcgc

SEQ ID NO: 1322382 - RNA, 16 nt, Mycobacterium tuberculosis H37Rv
caucggaacgugaccg

SEQ ID NO: 1322383 - RNA, 15 nt, Mycobacterium tuberculosis H37Rv
caucggaucaaagcc

SEQ ID NO: 1322384 - RNA, 20 nt, Mycobacterium tuberculosis H37Rv
caucggaugaccagugauca

SEQ ID NO: 1322385 - RNA, 21 nt, Mycobacterium tuberculosis H37Rv
caucgcuguaggcagccucuc

SEQ ID NO: 1322386 - RNA, 15 nt, Mycobacterium tuberculosis H37Rv
caucgccucaccacg

SEQ ID NO: 1322387 - RNA, 14 nt, Mycobacterium tuberculosis H37Rv
caucgccuccucga

SEQ ID NO: 1322388 - RNA, 20 nt, Mycobacterium tuberculosis H37Rv
caucgccucgaggaccacca

SEQ ID NO: 1322389 - RNA, 13 nt, Mycobacterium tuberculosis H37Rv
caucgccgcuggc

SEQ ID NO: 1322390 - RNA, 14 nt, Mycobacterium tuberculosis H37Rv
caucgccagcagca

SEQ ID NO: 1322391 - RNA, 21 nt, Mycobacterium tuberculosis H37Rv
caucgccacuguugaagaagc

SEQ ID NO: 1322392 - RNA, 13 nt, Mycobacterium tuberculosis H37Rv
caucgccaccgcg

SEQ ID NO: 1322393 - RNA, 17 nt, Mycobacterium tuberculosis H37Rv
caucgccgacagcgccu

SEQ ID NO: 1322394 - RNA, 15 nt, Mycobacterium tuberculosis H37Rv
caucgccgacccgcc

SEQ ID NO: 1322395 - RNA, 23 nt, Mycobacterium tuberculosis H37Rv
caucgcccugggcgccggcgucc

SEQ ID NO: 1322396 - RNA, 18 nt, Mycobacterium tuberculosis H37Rv
caucgccaacaccaacca

SEQ ID NO: 1322397 - RNA, 13 nt, Mycobacterium tuberculosis H37Rv
caucgcaggcacc

SEQ ID NO: 1322398 - RNA, 14 nt, Mycobacterium tuberculosis H37Rv
caucgcagccgguc

SEQ ID NO: 1322399 - RNA, 18 nt, Mycobacterium tuberculosis H37Rv
caucgcacaacugcgcca

SEQ ID NO: 1322400 - RNA, 16 nt, Mycobacterium tuberculosis H37Rv
caucgcacagcgccgc

SEQ ID NO: 1322401 - RNA, 13 nt, Mycobacterium tuberculosis H37Rv
caucgcacccacc

SEQ ID NO: 1322402 - RNA, 22 nt, Mycobacterium tuberculosis H37Rv
caucgaugucagugaucaccaa

SEQ ID NO: 1322403 - RNA, 21 nt, Mycobacterium tuberculosis H37Rv
caucgaugucggcucggcccc

SEQ ID NO: 1322404 - RNA, 19 nt, Mycobacterium tuberculosis H37Rv
cauccuggcggcugcagcc

SEQ ID NO: 1322405 - RNA, 22 nt, Mycobacterium tuberculosis H37Rv
cauccuggucaccagccaccgc

SEQ ID NO: 1322406 - RNA, 16 nt, Mycobacterium tuberculosis H37Rv
caucgucgaagaccuc

SEQ ID NO: 1322407 - RNA, 16 nt, Mycobacterium tuberculosis H37Rv
caucgucugguggcag

SEQ ID NO: 1322408 - RNA, 14 nt, Mycobacterium tuberculosis H37Rv
caucgugcugaagc

SEQ ID NO: 1322409 - RNA, 20 nt, Mycobacterium tuberculosis H37Rv
caucgucguggugaugucca

SEQ ID NO: 1322410 - RNA, 14 nt, Mycobacterium tuberculosis H37Rv
caucgucaggaacc

SEQ ID NO: 1322411 - RNA, 16 nt, Mycobacterium tuberculosis H37Rv
caucgugcugaagcug

SEQ ID NO: 1322412 - RNA, 21 nt, Mycobacterium tuberculosis H37Rv
caucuacaucgucgagcgcgg

SEQ ID NO: 1322413 - RNA, 20 nt, Mycobacterium tuberculosis H37Rv
caucucgggcgaagccgcug

SEQ ID NO: 1322414 - RNA, 23 nt, Mycobacterium tuberculosis H37Rv
caucucggcggccaacagcaccc

SEQ ID NO: 1322415 - RNA, 14 nt, Mycobacterium tuberculosis H37Rv
caucagcagagccc

SEQ ID NO: 1322416 - RNA, 16 nt, Mycobacterium tuberculosis H37Rv
caucagaaugccuggc

SEQ ID NO: 1322417 - RNA, 15 nt, Mycobacterium tuberculosis H37Rv
caucacauccacgca

SEQ ID NO: 1322418 - RNA, 14 nt, Mycobacterium tuberculosis H37Rv
caucacauccacgc

SEQ ID NO: 1322419 - RNA, 20 nt, Mycobacterium tuberculosis H37Rv
caucaccacuggacccgccc

SEQ ID NO: 1322420 - RNA, 14 nt, Mycobacterium tuberculosis H37Rv
caucaccaccggca

SEQ ID NO: 1322421 - RNA, 20 nt, Mycobacterium tuberculosis H37Rv
caucaccaccggcaccgcug

SEQ ID NO: 1322422 - RNA, 11 nt, Mycobacterium tuberculosis H37Rv
caucaccagcg

SEQ ID NO: 1322423 - RNA, 13 nt, Mycobacterium tuberculosis H37Rv
cauauccgccggc

SEQ ID NO: 1322424 - RNA, 16 nt, Mycobacterium tuberculosis H37Rv
cauaucgcagcguugg

SEQ ID NO: 1322425 - RNA, 23 nt, Mycobacterium tuberculosis H37Rv
cauauuggcgcggccgaaagagc

SEQ ID NO: 1322426 - RNA, 21 nt, Mycobacterium tuberculosis H37Rv
cauagugcggcaccgccgccc

SEQ ID NO: 1322427 - RNA, 21 nt, Mycobacterium tuberculosis H37Rv
cauagugcggcagcgguggcu

SEQ ID NO: 1322428 - RNA, 16 nt, Mycobacterium tuberculosis H37Rv
cauagugcggcugcaa

SEQ ID NO: 1322429 - RNA, 13 nt, Mycobacterium tuberculosis H37Rv
cauauagaucacu

SEQ ID NO: 1322430 - RNA, 11 nt, Mycobacterium tuberculosis H37Rv
cauagcugccg

SEQ ID NO: 1322431 - RNA, 19 nt, Mycobacterium tuberculosis H37Rv
cauaggccccgccagcgcc

SEQ ID NO: 1322432 - RNA, 18 nt, Mycobacterium tuberculosis H37Rv
cauaggccgacggguugg

SEQ ID NO: 1322433 - RNA, 16 nt, Mycobacterium tuberculosis H37Rv
cauaggccugcagccg

SEQ ID NO: 1322434 - RNA, 16 nt, Mycobacterium tuberculosis H37Rv
cauagguaugcccgga

SEQ ID NO: 1322435 - RNA, 16 nt, Mycobacterium tuberculosis H37Rv
cauaggugcggggccg

SEQ ID NO: 1322436 - RNA, 22 nt, Mycobacterium tuberculosis H37Rv
cauagguuugggcacggaacgc

SEQ ID NO: 1322437 - RNA, 17 nt, Mycobacterium tuberculosis H37Rv
cauagcgccgcgcccac

SEQ ID NO: 1322438 - RNA, 19 nt, Mycobacterium tuberculosis H37Rv
cauagcaauccgcacagcg

SEQ ID NO: 1322439 - RNA, 23 nt, Mycobacterium tuberculosis H37Rv
caauucggugcgcuggcggcgca

SEQ ID NO: 1322440 - RNA, 19 nt, Mycobacterium tuberculosis H37Rv
caauuccacgaucggcuca

SEQ ID NO: 1322441 - RNA, 18 nt, Mycobacterium tuberculosis H37Rv
caauuccaugcaguuguc

SEQ ID NO: 1322442 - RNA, 18 nt, Mycobacterium tuberculosis H37Rv
caauuccguuaggcucca

SEQ ID NO: 1322443 - RNA, 15 nt, Mycobacterium tuberculosis H37Rv
caauuccgccgagcg

SEQ ID NO: 1322444 - RNA, 17 nt, Mycobacterium tuberculosis H37Rv
caauugcaccuucucca

SEQ ID NO: 1322445 - RNA, 15 nt, Mycobacterium tuberculosis H37Rv
caauugugcggcccc

SEQ ID NO: 1322446 - RNA, 16 nt, Mycobacterium tuberculosis H37Rv
caauucacgcaccaca

SEQ ID NO: 1322447 - RNA, 14 nt, Mycobacterium tuberculosis H37Rv
caaucagugcagcg

SEQ ID NO: 1322448 - RNA, 21 nt, Mycobacterium tuberculosis H37Rv
cacaaacgggcgugggccgcu

SEQ ID NO: 1322449 - RNA, 13 nt, Mycobacterium tuberculosis H37Rv
cacaaacccagca

SEQ ID NO: 1322450 - RNA, 14 nt, Mycobacterium tuberculosis H37Rv
cacaaacccagcau

SEQ ID NO: 1322451 - RNA, 12 nt, Mycobacterium tuberculosis H37Rv
cacaacaccggc

SEQ ID NO: 1322452 - RNA, 18 nt, Mycobacterium tuberculosis H37Rv
cacaaccgugagcaccag

SEQ ID NO: 1322453 - RNA, 20 nt, Mycobacterium tuberculosis H37Rv
cacaaccgugagcaccagca

SEQ ID NO: 1322454 - RNA, 17 nt, Mycobacterium tuberculosis H37Rv
cacaacgacgaauaagu

SEQ ID NO: 1322455 - RNA, 22 nt, Mycobacterium tuberculosis H37Rv
cacaaccgugagcaccagcagc

SEQ ID NO: 1322456 - RNA, 23 nt, Mycobacterium tuberculosis H37Rv
cacaaccguugcugcgcagcggc

SEQ ID NO: 1322457 - RNA, 21 nt, Mycobacterium tuberculosis H37Rv
cacaacccgucgagccgugcc

SEQ ID NO: 1322458 - RNA, 15 nt, Mycobacterium tuberculosis H37Rv
cacaaccgcugcugc

SEQ ID NO: 1322459 - RNA, 14 nt, Mycobacterium tuberculosis H37Rv
cacaacgucuucac

SEQ ID NO: 1322460 - RNA, 21 nt, Mycobacterium tuberculosis H37Rv
cacaacugcccgacgaccauu

SEQ ID NO: 1322461 - RNA, 23 nt, Mycobacterium tuberculosis H37Rv
cacaacgccucgauggcgguggc

SEQ ID NO: 1322462 - RNA, 17 nt, Mycobacterium tuberculosis H37Rv
cacaaccgugagcacca

SEQ ID NO: 1322463 - RNA, 15 nt, Mycobacterium tuberculosis H37Rv
cacaacggcggcgcc

SEQ ID NO: 1322464 - RNA, 19 nt, Mycobacterium tuberculosis H37Rv
cacacugaagaucgcgccc

SEQ ID NO: 1322465 - RNA, 18 nt, Mycobacterium tuberculosis H37Rv
cacacugaccccgccgcc

SEQ ID NO: 1322466 - RNA, 21 nt, Mycobacterium tuberculosis H37Rv
cacacuccuagccaacgagcg

SEQ ID NO: 1322467 - RNA, 14 nt, Mycobacterium tuberculosis H37Rv
cacacucgccaggg

SEQ ID NO: 1322468 - RNA, 15 nt, Mycobacterium tuberculosis H37Rv
cacacucccgcgccc

SEQ ID NO: 1322469 - RNA, 15 nt, Mycobacterium tuberculosis H37Rv
cacacggggccgcca

SEQ ID NO: 1322470 - RNA, 18 nt, Mycobacterium tuberculosis H37Rv
cacacggggccgccagcu

SEQ ID NO: 1322471 - RNA, 18 nt, Mycobacterium tuberculosis H37Rv
cacacguuggcagcccuc

SEQ ID NO: 1322472 - RNA, 22 nt, Mycobacterium tuberculosis H37Rv
cacacuguuacuccgacggccc

SEQ ID NO: 1322473 - RNA, 15 nt, Mycobacterium tuberculosis H37Rv
cacacuguucccaca

SEQ ID NO: 1322474 - RNA, 14 nt, Mycobacterium tuberculosis H37Rv
cacacuugcaacuc

SEQ ID NO: 1322475 - RNA, 17 nt, Mycobacterium tuberculosis H37Rv
cacaccgagcacgggua

SEQ ID NO: 1322476 - RNA, 12 nt, Mycobacterium tuberculosis H37Rv
cacaccgccgcc

SEQ ID NO: 1322477 - RNA, 13 nt, Mycobacterium tuberculosis H37Rv
cacaccgccgcca

SEQ ID NO: 1322478 - RNA, 18 nt, Mycobacterium tuberculosis H37Rv
cacacccggcacacccuc

SEQ ID NO: 1322479 - RNA, 16 nt, Mycobacterium tuberculosis H37Rv
cacaccgacagcaccc

SEQ ID NO: 1322480 - RNA, 14 nt, Mycobacterium tuberculosis H37Rv
cacaccgaccgcgg

SEQ ID NO: 1322481 - RNA, 18 nt, Mycobacterium tuberculosis H37Rv
cacaccccaggcacccug

SEQ ID NO: 1322482 - RNA, 14 nt, Mycobacterium tuberculosis H37Rv
cacacccagcgcgc

SEQ ID NO: 1322483 - RNA, 14 nt, Mycobacterium tuberculosis H37Rv
cacacccacaccca

SEQ ID NO: 1322484 - RNA, 13 nt, Mycobacterium tuberculosis H37Rv
cacacccagaugc

SEQ ID NO: 1322485 - RNA, 13 nt, Mycobacterium tuberculosis H37Rv
cacaccccaggca

SEQ ID NO: 1322486 - RNA, 16 nt, Mycobacterium tuberculosis H37Rv
cacacccaucagcccu

SEQ ID NO: 1322487 - RNA, 20 nt, Mycobacterium tuberculosis H37Rv
cacaccaggccgagccgccc

SEQ ID NO: 1322488 - RNA, 21 nt, Mycobacterium tuberculosis H37Rv
cacacgcccucgacgccgcgc

SEQ ID NO: 1322489 - RNA, 19 nt, Mycobacterium tuberculosis H37Rv
cacaccuuggccgccggcc

SEQ ID NO: 1322490 - RNA, 19 nt, Mycobacterium tuberculosis H37Rv
cacaccucgugcggcgcuc

SEQ ID NO: 1322491 - RNA, 14 nt, Mycobacterium tuberculosis H37Rv
cacaccgggcacca

SEQ ID NO: 1322492 - RNA, 14 nt, Mycobacterium tuberculosis H37Rv
cacaccggcacugc

SEQ ID NO: 1322493 - RNA, 17 nt, Mycobacterium tuberculosis H37Rv
cacaccaaggccgagcg

SEQ ID NO: 1322494 - RNA, 19 nt, Mycobacterium tuberculosis H37Rv
cacacacccgacacggcuc

SEQ ID NO: 1322495 - RNA, 23 nt, Mycobacterium tuberculosis H37Rv
cacacagaggucggucagccacc

SEQ ID NO: 1322496 - RNA, 23 nt, Mycobacterium tuberculosis H37Rv
cacacacugccggacagccacgc

SEQ ID NO: 1322497 - RNA, 17 nt, Mycobacterium tuberculosis H37Rv
cacaagcgauggcacca

SEQ ID NO: 1322498 - RNA, 13 nt, Mycobacterium tuberculosis H37Rv
cacaagccgugca

SEQ ID NO: 1322499 - RNA, 13 nt, Mycobacterium tuberculosis H37Rv
cacaagcgauggc

SEQ ID NO: 1322500 - RNA, 20 nt, Mycobacterium tuberculosis H37Rv
cacaggacaauggacaccaa

SEQ ID NO: 1322501 - RNA, 21 nt, Mycobacterium tuberculosis H37Rv
cacaggcauuuucacugugcc

SEQ ID NO: 1322502 - RNA, 12 nt, Mycobacterium tuberculosis H37Rv
cacaggcggcca

SEQ ID NO: 1322503 - RNA, 13 nt, Mycobacterium tuberculosis H37Rv
cacaggcggcgcu

SEQ ID NO: 1322504 - RNA, 17 nt, Mycobacterium tuberculosis H37Rv
cacagguuugcgccgcg

SEQ ID NO: 1322505 - RNA, 15 nt, Mycobacterium tuberculosis H37Rv
cacagguuugcgccg

SEQ ID NO: 1322506 - RNA, 22 nt, Mycobacterium tuberculosis H37Rv
cacaguuaucagccgcgcgcca

SEQ ID NO: 1322507 - RNA, 15 nt, Mycobacterium tuberculosis H37Rv
cacagucgugagcca

SEQ ID NO: 1322508 - RNA, 14 nt, Mycobacterium tuberculosis H37Rv
cacagucgccggcc

SEQ ID NO: 1322509 - RNA, 15 nt, Mycobacterium tuberculosis H37Rv
cacagucgccggccg

SEQ ID NO: 1322510 - RNA, 15 nt, Mycobacterium tuberculosis H37Rv
cacauagccggucag

SEQ ID NO: 1322511 - RNA, 13 nt, Mycobacterium tuberculosis H37Rv
cacauaagccccc

SEQ ID NO: 1322512 - RNA, 15 nt, Mycobacterium tuberculosis H37Rv
cacagccaguaaaaa

SEQ ID NO: 1322513 - RNA, 22 nt, Mycobacterium tuberculosis H37Rv
cacagccaguaaaaaggcagga

SEQ ID NO: 1322514 - RNA, 15 nt, Mycobacterium tuberculosis H37Rv
cacagccaccagccg

SEQ ID NO: 1322515 - RNA, 19 nt, Mycobacterium tuberculosis H37Rv
cacagcccgaugccgugcc

SEQ ID NO: 1322516 - RNA, 13 nt, Mycobacterium tuberculosis H37Rv
cacagccccaggg

SEQ ID NO: 1322517 - RNA, 14 nt, Mycobacterium tuberculosis H37Rv
cacagccccagggu

SEQ ID NO: 1322518 - RNA, 22 nt, Mycobacterium tuberculosis H37Rv
cacagccggguuuggugcagcc

SEQ ID NO: 1322519 - RNA, 13 nt, Mycobacterium tuberculosis H37Rv
cacagcuugcccg

SEQ ID NO: 1322520 - RNA, 20 nt, Mycobacterium tuberculosis H37Rv
cacagcagcgucaucagguc

SEQ ID NO: 1322521 - RNA, 13 nt, Mycobacterium tuberculosis H37Rv
cacagcaccgucc

SEQ ID NO: 1322522 - RNA, 15 nt, Mycobacterium tuberculosis H37Rv
cacagcacagcgcag

SEQ ID NO: 1322523 - RNA, 19 nt, Mycobacterium tuberculosis H37Rv
cacagcaacgugugcacca

SEQ ID NO: 1322524 - RNA, 19 nt, Mycobacterium tuberculosis H37Rv
cacagaccgaacagcaccg

SEQ ID NO: 1322525 - RNA, 13 nt, Mycobacterium tuberculosis H37Rv
cacagacacggca

SEQ ID NO: 1322526 - RNA, 13 nt, Mycobacterium tuberculosis H37Rv
cacagacagacag

SEQ ID NO: 1322527 - RNA, 15 nt, Mycobacterium tuberculosis H37Rv
cacagaccgaacagc

SEQ ID NO: 1322528 - RNA, 19 nt, Mycobacterium tuberculosis H37Rv
cacaucguugucauagaaa

SEQ ID NO: 1322529 - RNA, 20 nt, Mycobacterium tuberculosis H37Rv
cacaucgcucaucgucaccu

SEQ ID NO: 1322530 - RNA, 20 nt, Mycobacterium tuberculosis H37Rv
cacaucgcacaacugcgcca

SEQ ID NO: 1322531 - RNA, 20 nt, Mycobacterium tuberculosis H37Rv
cacaugcucgacgcccgcca

SEQ ID NO: 1322532 - RNA, 13 nt, Mycobacterium tuberculosis H37Rv
cacaugcucaggg

SEQ ID NO: 1322533 - RNA, 17 nt, Mycobacterium tuberculosis H37Rv
cacauggaacucacccu

SEQ ID NO: 1322534 - RNA, 19 nt, Mycobacterium tuberculosis H37Rv
cacauggaacucacccuau

SEQ ID NO: 1322535 - RNA, 21 nt, Mycobacterium tuberculosis H37Rv
cacauccuggcggcugcagcc

SEQ ID NO: 1322536 - RNA, 19 nt, Mycobacterium tuberculosis H37Rv
cacauccgcuugcggggcc

SEQ ID NO: 1322537 - RNA, 22 nt, Mycobacterium tuberculosis H37Rv
cacaucaccaaaaacccgguga

SEQ ID NO: 1322538 - RNA, 17 nt, Mycobacterium tuberculosis H37Rv
cacaucaugccagccgu

SEQ ID NO: 1322539 - RNA, 19 nt, Mycobacterium tuberculosis H37Rv
cacaucaugggcgcugcca

SEQ ID NO: 1322540 - RNA, 17 nt, Mycobacterium tuberculosis H37Rv
caccaacccacccccca

SEQ ID NO: 1322541 - RNA, 15 nt, Mycobacterium tuberculosis H37Rv
caccaacgaacuggg

SEQ ID NO: 1322542 - RNA, 14 nt, Mycobacterium tuberculosis H37Rv
caccaacgccaccg

SEQ ID NO: 1322543 - RNA, 15 nt, Mycobacterium tuberculosis H37Rv
caccaacgccaccgu

SEQ ID NO: 1322544 - RNA, 14 nt, Mycobacterium tuberculosis H37Rv
caccaaaugccccg

SEQ ID NO: 1322545 - RNA, 23 nt, Mycobacterium tuberculosis H37Rv
caccaaaugccccgaaccgcgcu

SEQ ID NO: 1322546 - RNA, 15 nt, Mycobacterium tuberculosis H37Rv
caccaagacaccggc

SEQ ID NO: 1322547 - RNA, 13 nt, Mycobacterium tuberculosis H37Rv
caccaagacgcca

SEQ ID NO: 1322548 - RNA, 15 nt, Mycobacterium tuberculosis H37Rv
caccaagacgccacc

SEQ ID NO: 1322549 - RNA, 20 nt, Mycobacterium tuberculosis H37Rv
caccaaggccgccugcaaca

SEQ ID NO: 1322550 - RNA, 23 nt, Mycobacterium tuberculosis H37Rv
caccaaggccgugaugccacggc

SEQ ID NO: 1322551 - RNA, 19 nt, Mycobacterium tuberculosis H37Rv
caccaaggucuucaggccg

SEQ ID NO: 1322552 - RNA, 15 nt, Mycobacterium tuberculosis H37Rv
cacauuggcgaucag

SEQ ID NO: 1322553 - RNA, 18 nt, Mycobacterium tuberculosis H37Rv
cacauuuuuguuguuauu

SEQ ID NO: 1322554 - RNA, 12 nt, Mycobacterium tuberculosis H37Rv
cacauugaccag

SEQ ID NO: 1322555 - RNA, 21 nt, Mycobacterium tuberculosis H37Rv
cacauugaucgacggccagcc

SEQ ID NO: 1322556 - RNA, 20 nt, Mycobacterium tuberculosis H37Rv
caccacuaggucgccggcca

SEQ ID NO: 1322557 - RNA, 14 nt, Mycobacterium tuberculosis H37Rv
caccacguggcccu

SEQ ID NO: 1322558 - RNA, 14 nt, Mycobacterium tuberculosis H37Rv
caccacgugcgcca

SEQ ID NO: 1322559 - RNA, 16 nt, Mycobacterium tuberculosis H37Rv
caccacgugcgccacu

SEQ ID NO: 1322560 - RNA, 16 nt, Mycobacterium tuberculosis H37Rv
caccacgucccggaau

SEQ ID NO: 1322561 - RNA, 20 nt, Mycobacterium tuberculosis H37Rv
caccacggugccgacgauga

SEQ ID NO: 1322562 - RNA, 18 nt, Mycobacterium tuberculosis H37Rv
caccacgguuggccacca

SEQ ID NO: 1322563 - RNA, 15 nt, Mycobacterium tuberculosis H37Rv
caccacggccagcgg

SEQ ID NO: 1322564 - RNA, 17 nt, Mycobacterium tuberculosis H37Rv
caccacggcggccaccu

SEQ ID NO: 1322565 - RNA, 19 nt, Mycobacterium tuberculosis H37Rv
caccacgaucaacucgugc

SEQ ID NO: 1322566 - RNA, 22 nt, Mycobacterium tuberculosis H37Rv
caccacgacgcgauggccgcca

SEQ ID NO: 1322567 - RNA, 20 nt, Mycobacterium tuberculosis H37Rv
caccacgcaugcgcgcgccg

SEQ ID NO: 1322568 - RNA, 23 nt, Mycobacterium tuberculosis H37Rv
caccacgaacacguucggguacc

SEQ ID NO: 1322569 - RNA, 18 nt, Mycobacterium tuberculosis H37Rv
caccaccuuggaugcccu

SEQ ID NO: 1322570 - RNA, 16 nt, Mycobacterium tuberculosis H37Rv
caccaccuggugcaac

SEQ ID NO: 1322571 - RNA, 18 nt, Mycobacterium tuberculosis H37Rv
caccaccuggugcaaccg

SEQ ID NO: 1322572 - RNA, 22 nt, Mycobacterium tuberculosis H37Rv
caccaccuggccggccaucuug

SEQ ID NO: 1322573 - RNA, 17 nt, Mycobacterium tuberculosis H37Rv
caccacuggacccgccc

SEQ ID NO: 1322574 - RNA, 19 nt, Mycobacterium tuberculosis H37Rv
caccacugcggccgcgccg

SEQ ID NO: 1322575 - RNA, 20 nt, Mycobacterium tuberculosis H37Rv
caccacugcggccgcgccgu

SEQ ID NO: 1322576 - RNA, 12 nt, Mycobacterium tuberculosis H37Rv
caccagaaacac

SEQ ID NO: 1322577 - RNA, 22 nt, Mycobacterium tuberculosis H37Rv
caccagaaaugguucgcacacc

SEQ ID NO: 1322578 - RNA, 13 nt, Mycobacterium tuberculosis H37Rv
caccagaaccggu

SEQ ID NO: 1322579 - RNA, 22 nt, Mycobacterium tuberculosis H37Rv
caccagaugcaccucgcccugc

SEQ ID NO: 1322580 - RNA, 22 nt, Mycobacterium tuberculosis H37Rv
caccagagucaacaucagcacc

SEQ ID NO: 1322581 - RNA, 20 nt, Mycobacterium tuberculosis H37Rv
caccagaucgcacaccaaca

SEQ ID NO: 1322582 - RNA, 16 nt, Mycobacterium tuberculosis H37Rv
caccagauggcucucg

SEQ ID NO: 1322583 - RNA, 17 nt, Mycobacterium tuberculosis H37Rv
caccagaauccugcuuu

SEQ ID NO: 1322584 - RNA, 15 nt, Mycobacterium tuberculosis H37Rv
caccagaauccugcu

SEQ ID NO: 1322585 - RNA, 13 nt, Mycobacterium tuberculosis H37Rv
caccaccgccaga

SEQ ID NO: 1322586 - RNA, 20 nt, Mycobacterium tuberculosis H37Rv
caccaccgccgccggcaccg

SEQ ID NO: 1322587 - RNA, 23 nt, Mycobacterium tuberculosis H37Rv
caccaccgcgaccucgcggcgcu

SEQ ID NO: 1322588 - RNA, 14 nt, Mycobacterium tuberculosis H37Rv
caccaccgcgccgu

SEQ ID NO: 1322589 - RNA, 15 nt, Mycobacterium tuberculosis H37Rv
caccaccgccgccac

SEQ ID NO: 1322590 - RNA, 19 nt, Mycobacterium tuberculosis H37Rv
caccaccggaucgcucccg

SEQ ID NO: 1322591 - RNA, 18 nt, Mycobacterium tuberculosis H37Rv
caccaccggcaacaucag

SEQ ID NO: 1322592 - RNA, 20 nt, Mycobacterium tuberculosis H37Rv
caccaccggccccaccggca

SEQ ID NO: 1322593 - RNA, 14 nt, Mycobacterium tuberculosis H37Rv
caccaccggcaccg

SEQ ID NO: 1322594 - RNA, 15 nt, Mycobacterium tuberculosis H37Rv
caccaccgccgccgg

SEQ ID NO: 1322595 - RNA, 13 nt, Mycobacterium tuberculosis H37Rv
caccaccggcccc

SEQ ID NO: 1322596 - RNA, 14 nt, Mycobacterium tuberculosis H37Rv
caccaccggcgccu

SEQ ID NO: 1322597 - RNA, 16 nt, Mycobacterium tuberculosis H37Rv
caccaccguugccgcc

SEQ ID NO: 1322598 - RNA, 17 nt, Mycobacterium tuberculosis H37Rv
caccaccguugccgccg

SEQ ID NO: 1322599 - RNA, 20 nt, Mycobacterium tuberculosis H37Rv
caccaccguugccgccguca

SEQ ID NO: 1322600 - RNA, 21 nt, Mycobacterium tuberculosis H37Rv
caccaccagguccaccccgcc

SEQ ID NO: 1322601 - RNA, 17 nt, Mycobacterium tuberculosis H37Rv
caccaccccagcggcca

SEQ ID NO: 1322602 - RNA, 20 nt, Mycobacterium tuberculosis H37Rv
caccaccccagcggccaccg

SEQ ID NO: 1322603 - RNA, 22 nt, Mycobacterium tuberculosis H37Rv
caccacccgucggcccgcucau

SEQ ID NO: 1322604 - RNA, 17 nt, Mycobacterium tuberculosis H37Rv
caccacccgauuggcca

SEQ ID NO: 1322605 - RNA, 21 nt, Mycobacterium tuberculosis H37Rv
caccacccgauuggccaaccc

SEQ ID NO: 1322606 - RNA, 16 nt, Mycobacterium tuberculosis H37Rv
caccaccccagcggcc

SEQ ID NO: 1322607 - RNA, 14 nt, Mycobacterium tuberculosis H37Rv
caccaccgcacggg

SEQ ID NO: 1322608 - RNA, 14 nt, Mycobacterium tuberculosis H37Rv
caccaccgaccugg

SEQ ID NO: 1322609 - RNA, 22 nt, Mycobacterium tuberculosis H37Rv
caccaccgaccuggacgcggcc

SEQ ID NO: 1322610 - RNA, 14 nt, Mycobacterium tuberculosis H37Rv
caccacaacgccag

SEQ ID NO: 1322611 - RNA, 19 nt, Mycobacterium tuberculosis H37Rv
caccacaccggagccgaac

SEQ ID NO: 1322612 - RNA, 14 nt, Mycobacterium tuberculosis H37Rv
caccacaccggcag

SEQ ID NO: 1322613 - RNA, 19 nt, Mycobacterium tuberculosis H37Rv
caccacaccugcggcugcu

SEQ ID NO: 1322614 - RNA, 17 nt, Mycobacterium tuberculosis H37Rv
caccacaccgagcaccu

SEQ ID NO: 1322615 - RNA, 14 nt, Mycobacterium tuberculosis H37Rv
caccacaccgagca

SEQ ID NO: 1322616 - RNA, 15 nt, Mycobacterium tuberculosis H37Rv
caccaccacggccag

SEQ ID NO: 1322617 - RNA, 14 nt, Mycobacterium tuberculosis H37Rv
caccaccacugcgg

SEQ ID NO: 1322618 - RNA, 14 nt, Mycobacterium tuberculosis H37Rv
caccaccacggcca

SEQ ID NO: 1322619 - RNA, 13 nt, Mycobacterium tuberculosis H37Rv
caccacagugcca

SEQ ID NO: 1322620 - RNA, 20 nt, Mycobacterium tuberculosis H37Rv
caccaccaagcucggccagc

SEQ ID NO: 1322621 - RNA, 19 nt, Mycobacterium tuberculosis H37Rv
caccaucggggaaggggcu

SEQ ID NO: 1322622 - RNA, 17 nt, Mycobacterium tuberculosis H37Rv
caccaugaucaggcccc

SEQ ID NO: 1322623 - RNA, 22 nt, Mycobacterium tuberculosis H37Rv
caccaugaucaggccccacacg

SEQ ID NO: 1322624 - RNA, 19 nt, Mycobacterium tuberculosis H37Rv
caccaugguggugaugcca

SEQ ID NO: 1322625 - RNA, 21 nt, Mycobacterium tuberculosis H37Rv
caccaugggucuggcaggcca

SEQ ID NO: 1322626 - RNA, 17 nt, Mycobacterium tuberculosis H37Rv
caccauggcgccgcgcc

SEQ ID NO: 1322627 - RNA, 17 nt, Mycobacterium tuberculosis H37Rv
caccaugauugccagga

SEQ ID NO: 1322628 - RNA, 20 nt, Mycobacterium tuberculosis H37Rv
caccaugauugccaggaccg

SEQ ID NO: 1322629 - RNA, 21 nt, Mycobacterium tuberculosis H37Rv
caccaugcucggaaacagcga

SEQ ID NO: 1322630 - RNA, 14 nt, Mycobacterium tuberculosis H37Rv
caccauccgguccc

SEQ ID NO: 1322631 - RNA, 19 nt, Mycobacterium tuberculosis H37Rv
caccaucgcggccgcuggg

SEQ ID NO: 1322632 - RNA, 11 nt, Mycobacterium tuberculosis H37Rv
caccaucauca

SEQ ID NO: 1322633 - RNA, 16 nt, Mycobacterium tuberculosis H37Rv
cacccaccggccacca

SEQ ID NO: 1322634 - RNA, 19 nt, Mycobacterium tuberculosis H37Rv
cacccaccggccaccaggg

SEQ ID NO: 1322635 - RNA, 17 nt, Mycobacterium tuberculosis H37Rv
cacccacccgcaccgcg

SEQ ID NO: 1322636 - RNA, 15 nt, Mycobacterium tuberculosis H37Rv
cacccaccggccacc

SEQ ID NO: 1322637 - RNA, 14 nt, Mycobacterium tuberculosis H37Rv
cacccacuggacca

SEQ ID NO: 1322638 - RNA, 18 nt, Mycobacterium tuberculosis H37Rv
cacccacuggaccaccgc

SEQ ID NO: 1322639 - RNA, 15 nt, Mycobacterium tuberculosis H37Rv
cacccacacccagcg

SEQ ID NO: 1322640 - RNA, 23 nt, Mycobacterium tuberculosis H37Rv
cacccaauucacgacgccgagca

SEQ ID NO: 1322641 - RNA, 16 nt, Mycobacterium tuberculosis H37Rv
cacccaccacaccaag

SEQ ID NO: 1322642 - RNA, 23 nt, Mycobacterium tuberculosis H37Rv
cacccacaugacgaucgcggcgg

SEQ ID NO: 1322643 - RNA, 14 nt, Mycobacterium tuberculosis H37Rv
cacccaaccccgcc

SEQ ID NO: 1322644 - RNA, 17 nt, Mycobacterium tuberculosis H37Rv
cacccaauggagccgcg

SEQ ID NO: 1322645 - RNA, 19 nt, Mycobacterium tuberculosis H37Rv
cacccaauggagccgcgac

SEQ ID NO: 1322646 - RNA, 16 nt, Mycobacterium tuberculosis H37Rv
cacccaaugccaccgc

SEQ ID NO: 1322647 - RNA, 17 nt, Mycobacterium tuberculosis H37Rv
cacccaauccggcgcca

SEQ ID NO: 1322648 - RNA, 19 nt, Mycobacterium tuberculosis H37Rv
caccaugucggccacccgg

SEQ ID NO: 1322649 - RNA, 16 nt, Mycobacterium tuberculosis H37Rv
caccauucgcaccggc

SEQ ID NO: 1322650 - RNA, 15 nt, Mycobacterium tuberculosis H37Rv
cacccaacuccauca

SEQ ID NO: 1322651 - RNA, 21 nt, Mycobacterium tuberculosis H37Rv
cacccaaaccggcccgcagca

SEQ ID NO: 1322652 - RNA, 23 nt, Mycobacterium tuberculosis H37Rv
cacccaaaccggcccgcagcagc

SEQ ID NO: 1322653 - RNA, 17 nt, Mycobacterium tuberculosis H37Rv
cacccaaaccggcccgc

SEQ ID NO: 1322654 - RNA, 22 nt, Mycobacterium tuberculosis H37Rv
caccauuguuccguccccgacg

SEQ ID NO: 1322655 - RNA, 19 nt, Mycobacterium tuberculosis H37Rv
caccauuggccaagucagc

SEQ ID NO: 1322656 - RNA, 16 nt, Mycobacterium tuberculosis H37Rv
caccccgccaugcggc

SEQ ID NO: 1322657 - RNA, 16 nt, Mycobacterium tuberculosis H37Rv
caccccgagcucacca

SEQ ID NO: 1322658 - RNA, 14 nt, Mycobacterium tuberculosis H37Rv
cacccccgauagcg

SEQ ID NO: 1322659 - RNA, 14 nt, Mycobacterium tuberculosis H37Rv
caccccgaccacca

SEQ ID NO: 1322660 - RNA, 17 nt, Mycobacterium tuberculosis H37Rv
caccccgaccaccagag

SEQ ID NO: 1322661 - RNA, 15 nt, Mycobacterium tuberculosis H37Rv
caccccgacaccacg

SEQ ID NO: 1322662 - RNA, 19 nt, Mycobacterium tuberculosis H37Rv
caccccggucccgccgacc

SEQ ID NO: 1322663 - RNA, 17 nt, Mycobacterium tuberculosis H37Rv
caccccggugcccgcgg

SEQ ID NO: 1322664 - RNA, 13 nt, Mycobacterium tuberculosis H37Rv
caccccggcggcc

SEQ ID NO: 1322665 - RNA, 20 nt, Mycobacterium tuberculosis H37Rv
caccccggaauccccaagcc

SEQ ID NO: 1322666 - RNA, 13 nt, Mycobacterium tuberculosis H37Rv
caccccggccacu

SEQ ID NO: 1322667 - RNA, 14 nt, Mycobacterium tuberculosis H37Rv
caccccuuugacgc

SEQ ID NO: 1322668 - RNA, 19 nt, Mycobacterium tuberculosis H37Rv
cacccgauuggccaacccc

SEQ ID NO: 1322669 - RNA, 22 nt, Mycobacterium tuberculosis H37Rv
cacccgcaccaccggccccacc

SEQ ID NO: 1322670 - RNA, 17 nt, Mycobacterium tuberculosis H37Rv
cacccgcaccaccggcc

SEQ ID NO: 1322671 - RNA, 13 nt, Mycobacterium tuberculosis H37Rv
cacccgcaccacc

SEQ ID NO: 1322672 - RNA, 16 nt, Mycobacterium tuberculosis H37Rv
cacccgcaccaccggc

SEQ ID NO: 1322673 - RNA, 14 nt, Mycobacterium tuberculosis H37Rv
cacccgcaccgcgg

SEQ ID NO: 1322674 - RNA, 18 nt, Mycobacterium tuberculosis H37Rv
cacccgcaccucaccggg

SEQ ID NO: 1322675 - RNA, 20 nt, Mycobacterium tuberculosis H37Rv
cacccgcaggucgcaccaca

SEQ ID NO: 1322676 - RNA, 23 nt, Mycobacterium tuberculosis H37Rv
cacccgcacggccuccggaccga

SEQ ID NO: 1322677 - RNA, 13 nt, Mycobacterium tuberculosis H37Rv
cacccgcacucca

SEQ ID NO: 1322678 - RNA, 18 nt, Mycobacterium tuberculosis H37Rv
cacccagggcguuggcgg

SEQ ID NO: 1322679 - RNA, 22 nt, Mycobacterium tuberculosis H37Rv
cacccaggugucgcugcugaac

SEQ ID NO: 1322680 - RNA, 15 nt, Mycobacterium tuberculosis H37Rv
cacccagugccacgc

SEQ ID NO: 1322681 - RNA, 16 nt, Mycobacterium tuberculosis H37Rv
cacccagugccacgcc

SEQ ID NO: 1322682 - RNA, 18 nt, Mycobacterium tuberculosis H37Rv
cacccaguuccacccggu

SEQ ID NO: 1322683 - RNA, 14 nt, Mycobacterium tuberculosis H37Rv
cacccaucaccgcc

SEQ ID NO: 1322684 - RNA, 23 nt, Mycobacterium tuberculosis H37Rv
cacccaucaacgccggcgacggc

SEQ ID NO: 1322685 - RNA, 20 nt, Mycobacterium tuberculosis H37Rv
cacccaucgaccgcccgcca

SEQ ID NO: 1322686 - RNA, 22 nt, Mycobacterium tuberculosis H37Rv
cacccaucguuucgaagugccg

SEQ ID NO: 1322687 - RNA, 12 nt, Mycobacterium tuberculosis H37Rv
cacccaucucga

SEQ ID NO: 1322688 - RNA, 17 nt, Mycobacterium tuberculosis H37Rv
cacccaucgaccgcccg

SEQ ID NO: 1322689 - RNA, 14 nt, Mycobacterium tuberculosis H37Rv
cacccaucccguuc

SEQ ID NO: 1322690 - RNA, 16 nt, Mycobacterium tuberculosis H37Rv
cacccagcgccgaccc

SEQ ID NO: 1322691 - RNA, 13 nt, Mycobacterium tuberculosis H37Rv
cacccagccgcag

SEQ ID NO: 1322692 - RNA, 17 nt, Mycobacterium tuberculosis H37Rv
cacccagauugccuggg

SEQ ID NO: 1322693 - RNA, 15 nt, Mycobacterium tuberculosis H37Rv
cacccagacaccggc

SEQ ID NO: 1322694 - RNA, 19 nt, Mycobacterium tuberculosis H37Rv
cacccaggugucgcugcug

SEQ ID NO: 1322695 - RNA, 16 nt, Mycobacterium tuberculosis H37Rv
cacccaggccgaugug

SEQ ID NO: 1322696 - RNA, 21 nt, Mycobacterium tuberculosis H37Rv
cacccagcgugcccgccaccg

SEQ ID NO: 1322697 - RNA, 17 nt, Mycobacterium tuberculosis H37Rv
cacccagcgacucggcc

SEQ ID NO: 1322698 - RNA, 22 nt, Mycobacterium tuberculosis H37Rv
cacccagcucgcgcacccagcc

SEQ ID NO: 1322699 - RNA, 17 nt, Mycobacterium tuberculosis H37Rv
caccccaaaaccgccgg

SEQ ID NO: 1322700 - RNA, 11 nt, Mycobacterium tuberculosis H37Rv
caccccaccac

SEQ ID NO: 1322701 - RNA, 14 nt, Mycobacterium tuberculosis H37Rv
caccccacacaguc

SEQ ID NO: 1322702 - RNA, 22 nt, Mycobacterium tuberculosis H37Rv
cacccauggccucccacucacc

SEQ ID NO: 1322703 - RNA, 13 nt, Mycobacterium tuberculosis H37Rv
caccccaggcacc

SEQ ID NO: 1322704 - RNA, 22 nt, Mycobacterium tuberculosis H37Rv
caccccacccagcgacucggcc

SEQ ID NO: 1322705 - RNA, 23 nt, Mycobacterium tuberculosis H37Rv
cacccccgacgagauacggccac

SEQ ID NO: 1322706 - RNA, 14 nt, Mycobacterium tuberculosis H37Rv
caccccccagcgcc

SEQ ID NO: 1322707 - RNA, 20 nt, Mycobacterium tuberculosis H37Rv
caccccccagcgccgccgcg

SEQ ID NO: 1322708 - RNA, 18 nt, Mycobacterium tuberculosis H37Rv
caccccccccacccacca

SEQ ID NO: 1322709 - RNA, 17 nt, Mycobacterium tuberculosis H37Rv
caccagcgucgcggcca

SEQ ID NO: 1322710 - RNA, 16 nt, Mycobacterium tuberculosis H37Rv
caccagcgcuccagca

SEQ ID NO: 1322711 - RNA, 19 nt, Mycobacterium tuberculosis H37Rv
caccagcgcuccagcaccc

SEQ ID NO: 1322712 - RNA, 21 nt, Mycobacterium tuberculosis H37Rv
caccagcgcuccagcacccgc

SEQ ID NO: 1322713 - RNA, 17 nt, Mycobacterium tuberculosis H37Rv
caccagcgcgagcccga

SEQ ID NO: 1322714 - RNA, 14 nt, Mycobacterium tuberculosis H37Rv
caccagcgacgcca

SEQ ID NO: 1322715 - RNA, 16 nt, Mycobacterium tuberculosis H37Rv
caccagcgaggccagc

SEQ ID NO: 1322716 - RNA, 21 nt, Mycobacterium tuberculosis H37Rv
caccagcgcagcauugaccaa

SEQ ID NO: 1322717 - RNA, 13 nt, Mycobacterium tuberculosis H37Rv
caccagcgcagcc

SEQ ID NO: 1322718 - RNA, 13 nt, Mycobacterium tuberculosis H37Rv
caccagccagccu

SEQ ID NO: 1322719 - RNA, 19 nt, Mycobacterium tuberculosis H37Rv
caccagcaucguggccgca

SEQ ID NO: 1322720 - RNA, 20 nt, Mycobacterium tuberculosis H37Rv
caccagcaucguggccgcac

SEQ ID NO: 1322721 - RNA, 14 nt, Mycobacterium tuberculosis H37Rv
caccagcagcacca

SEQ ID NO: 1322722 - RNA, 18 nt, Mycobacterium tuberculosis H37Rv
caccagccgucagcgcgg

SEQ ID NO: 1322723 - RNA, 23 nt, Mycobacterium tuberculosis H37Rv
caccagccgggcaaggcccgguc

SEQ ID NO: 1322724 - RNA, 12 nt, Mycobacterium tuberculosis H37Rv
caccagcccggc

SEQ ID NO: 1322725 - RNA, 23 nt, Mycobacterium tuberculosis H37Rv
caccagcccggcggcggucacca

SEQ ID NO: 1322726 - RNA, 14 nt, Mycobacterium tuberculosis H37Rv
caccagccccaacc

SEQ ID NO: 1322727 - RNA, 16 nt, Mycobacterium tuberculosis H37Rv
caccagcacggcaacc

SEQ ID NO: 1322728 - RNA, 22 nt, Mycobacterium tuberculosis H37Rv
caccagcaagugugagcagacc

SEQ ID NO: 1322729 - RNA, 14 nt, Mycobacterium tuberculosis H37Rv
caccagcaagugug

SEQ ID NO: 1322730 - RNA, 16 nt, Mycobacterium tuberculosis H37Rv
caccagcaccgccgcu

SEQ ID NO: 1322731 - RNA, 22 nt, Mycobacterium tuberculosis H37Rv
caccagggccuccacccgccac

SEQ ID NO: 1322732 - RNA, 17 nt, Mycobacterium tuberculosis H37Rv
caccaggggaccgcggc

SEQ ID NO: 1322733 - RNA, 21 nt, Mycobacterium tuberculosis H37Rv
caccaggcgagccggcgcgca

SEQ ID NO: 1322734 - RNA, 17 nt, Mycobacterium tuberculosis H37Rv
caccaggguguauggcc

SEQ ID NO: 1322735 - RNA, 18 nt, Mycobacterium tuberculosis H37Rv
caccagguccaccccgcc

SEQ ID NO: 1322736 - RNA, 14 nt, Mycobacterium tuberculosis H37Rv
caccaucaaggacu

SEQ ID NO: 1322737 - RNA, 17 nt, Mycobacterium tuberculosis H37Rv
caccagguguccccgcc

SEQ ID NO: 1322738 - RNA, 18 nt, Mycobacterium tuberculosis H37Rv
caccagguguccccgccc

SEQ ID NO: 1322739 - RNA, 19 nt, Mycobacterium tuberculosis H37Rv
caccaguguggcgaugacc

SEQ ID NO: 1322740 - RNA, 15 nt, Mycobacterium tuberculosis H37Rv
caccaguggcgccca

SEQ ID NO: 1322741 - RNA, 19 nt, Mycobacterium tuberculosis H37Rv
caccagucacgcccaccac

SEQ ID NO: 1322742 - RNA, 14 nt, Mycobacterium tuberculosis H37Rv
caccaguccagcgg

SEQ ID NO: 1322743 - RNA, 13 nt, Mycobacterium tuberculosis H37Rv
caccaguccagcg

SEQ ID NO: 1322744 - RNA, 18 nt, Mycobacterium tuberculosis H37Rv
caccggucaccgcgcagc

SEQ ID NO: 1322745 - RNA, 14 nt, Mycobacterium tuberculosis H37Rv
caccggugcccacc

SEQ ID NO: 1322746 - RNA, 22 nt, Mycobacterium tuberculosis H37Rv
caccggugccgcccgcgccgcc

SEQ ID NO: 1322747 - RNA, 19 nt, Mycobacterium tuberculosis H37Rv
caccggugccggcgacgcu

SEQ ID NO: 1322748 - RNA, 18 nt, Mycobacterium tuberculosis H37Rv
caccggugccgcccgcgc

SEQ ID NO: 1322749 - RNA, 13 nt, Mycobacterium tuberculosis H37Rv
caccgguaccgau

SEQ ID NO: 1322750 - RNA, 15 nt, Mycobacterium tuberculosis H37Rv
caccggucaccgcgc

SEQ ID NO: 1322751 - RNA, 23 nt, Mycobacterium tuberculosis H37Rv
caccgggguuacucgcagcgccg

SEQ ID NO: 1322752 - RNA, 18 nt, Mycobacterium tuberculosis H37Rv
caccgggguuacucgcag

SEQ ID NO: 1322753 - RNA, 18 nt, Mycobacterium tuberculosis H37Rv
caccguccgucggcgcuc

SEQ ID NO: 1322754 - RNA, 14 nt, Mycobacterium tuberculosis H37Rv
caccgucgcggcgg

SEQ ID NO: 1322755 - RNA, 18 nt, Mycobacterium tuberculosis H37Rv
caccgucgcugcccgcgc

SEQ ID NO: 1322756 - RNA, 21 nt, Mycobacterium tuberculosis H37Rv
caccgucggaacugaccacgu

SEQ ID NO: 1322757 - RNA, 18 nt, Mycobacterium tuberculosis H37Rv
caccgucggcagcagcgg

SEQ ID NO: 1322758 - RNA, 13 nt, Mycobacterium tuberculosis H37Rv
caccgucgggccc

SEQ ID NO: 1322759 - RNA, 21 nt, Mycobacterium tuberculosis H37Rv
caccgucguacucggcggcca

SEQ ID NO: 1322760 - RNA, 16 nt, Mycobacterium tuberculosis H37Rv
caccgucucgccgcgc

SEQ ID NO: 1322761 - RNA, 14 nt, Mycobacterium tuberculosis H37Rv
caccgucugcuggc

SEQ ID NO: 1322762 - RNA, 22 nt, Mycobacterium tuberculosis H37Rv
caccguagccgcugcacguggc

SEQ ID NO: 1322763 - RNA, 17 nt, Mycobacterium tuberculosis H37Rv
caccgucacgccaccgc

SEQ ID NO: 1322764 - RNA, 16 nt, Mycobacterium tuberculosis H37Rv
caccguuagccagguc

SEQ ID NO: 1322765 - RNA, 18 nt, Mycobacterium tuberculosis H37Rv
caccguguugcacgcggg

SEQ ID NO: 1322766 - RNA, 15 nt, Mycobacterium tuberculosis H37Rv
caccguuaccgccgu

SEQ ID NO: 1322767 - RNA, 19 nt, Mycobacterium tuberculosis H37Rv
caccguugcguuggcgcca

SEQ ID NO: 1322768 - RNA, 22 nt, Mycobacterium tuberculosis H37Rv
caccguugcguuggcgccacca

SEQ ID NO: 1322769 - RNA, 12 nt, Mycobacterium tuberculosis H37Rv
caccguugcguu

SEQ ID NO: 1322770 - RNA, 13 nt, Mycobacterium tuberculosis H37Rv
caccguggccucg

SEQ ID NO: 1322771 - RNA, 20 nt, Mycobacterium tuberculosis H37Rv
caccgugggcccuucacugu

SEQ ID NO: 1322772 - RNA, 14 nt, Mycobacterium tuberculosis H37Rv
caccgugccgggcg

SEQ ID NO: 1322773 - RNA, 19 nt, Mycobacterium tuberculosis H37Rv
caccgugcggaucgcgcug

SEQ ID NO: 1322774 - RNA, 18 nt, Mycobacterium tuberculosis H37Rv
caccgugaccgccgcgcc

SEQ ID NO: 1322775 - RNA, 17 nt, Mycobacterium tuberculosis H37Rv
caccgugccgacgcccc

SEQ ID NO: 1322776 - RNA, 17 nt, Mycobacterium tuberculosis H37Rv
caccuagucgcggccgu

SEQ ID NO: 1322777 - RNA, 18 nt, Mycobacterium tuberculosis H37Rv
caccucaaacgccugguc

SEQ ID NO: 1322778 - RNA, 16 nt, Mycobacterium tuberculosis H37Rv
caccuccaccgcgccg

SEQ ID NO: 1322779 - RNA, 13 nt, Mycobacterium tuberculosis H37Rv
caccucccgcagc

SEQ ID NO: 1322780 - RNA, 16 nt, Mycobacterium tuberculosis H37Rv
caccucccacgccgcc

SEQ ID NO: 1322781 - RNA, 16 nt, Mycobacterium tuberculosis H37Rv
caccuccagcaccacc

SEQ ID NO: 1322782 - RNA, 13 nt, Mycobacterium tuberculosis H37Rv
caccucccacgcc

SEQ ID NO: 1322783 - RNA, 17 nt, Mycobacterium tuberculosis H37Rv
caccucccgcagccggg

SEQ ID NO: 1322784 - RNA, 19 nt, Mycobacterium tuberculosis H37Rv
caccuccgaggccgccauc

SEQ ID NO: 1322785 - RNA, 13 nt, Mycobacterium tuberculosis H37Rv
caccuccgccccg

SEQ ID NO: 1322786 - RNA, 14 nt, Mycobacterium tuberculosis H37Rv
caccuccgccggca

SEQ ID NO: 1322787 - RNA, 17 nt, Mycobacterium tuberculosis H37Rv
caccuccgccggcaccu

SEQ ID NO: 1322788 - RNA, 22 nt, Mycobacterium tuberculosis H37Rv
caccuccgccggcaccuccggc

SEQ ID NO: 1322789 - RNA, 18 nt, Mycobacterium tuberculosis H37Rv
caccucagaaaguccccg

SEQ ID NO: 1322790 - RNA, 18 nt, Mycobacterium tuberculosis H37Rv
caccucggugccggccgc

SEQ ID NO: 1322791 - RNA, 22 nt, Mycobacterium tuberculosis H37Rv
caccucggugaccaggccggcc

SEQ ID NO: 1322792 - RNA, 23 nt, Mycobacterium tuberculosis H37Rv
caccucggguguggucaccaggc

SEQ ID NO: 1322793 - RNA, 14 nt, Mycobacterium tuberculosis H37Rv
caccucgggcgccc

SEQ ID NO: 1322794 - RNA, 22 nt, Mycobacterium tuberculosis H37Rv
caccucggccagcuccgccugc

SEQ ID NO: 1322795 - RNA, 19 nt, Mycobacterium tuberculosis H37Rv
caccuccggcaccgcccuu

SEQ ID NO: 1322796 - RNA, 22 nt, Mycobacterium tuberculosis H37Rv
caccuccggcaccgcccuugcc

SEQ ID NO: 1322797 - RNA, 16 nt, Mycobacterium tuberculosis H37Rv
caccuccgucagcgcc

SEQ ID NO: 1322798 - RNA, 15 nt, Mycobacterium tuberculosis H37Rv
caccucgaaggcacu

SEQ ID NO: 1322799 - RNA, 23 nt, Mycobacterium tuberculosis H37Rv
caccucgaugaugcgcucggccu

SEQ ID NO: 1322800 - RNA, 18 nt, Mycobacterium tuberculosis H37Rv
caccucgaugccgccccg

SEQ ID NO: 1322801 - RNA, 17 nt, Mycobacterium tuberculosis H37Rv
caccucgaucgcgccgu

SEQ ID NO: 1322802 - RNA, 20 nt, Mycobacterium tuberculosis H37Rv
caccucuucucggacacgcu

SEQ ID NO: 1322803 - RNA, 23 nt, Mycobacterium tuberculosis H37Rv
caccucguguccggggaccucgg

SEQ ID NO: 1322804 - RNA, 19 nt, Mycobacterium tuberculosis H37Rv
caccucgguacuugccacg

SEQ ID NO: 1322805 - RNA, 21 nt, Mycobacterium tuberculosis H37Rv
caccucgucacaguucugccu

SEQ ID NO: 1322806 - RNA, 23 nt, Mycobacterium tuberculosis H37Rv
caccugccgacucaucggccgcg

SEQ ID NO: 1322807 - RNA, 16 nt, Mycobacterium tuberculosis H37Rv
cacgaccugcucaucc

SEQ ID NO: 1322808 - RNA, 13 nt, Mycobacterium tuberculosis H37Rv
cacgaccugguua

SEQ ID NO: 1322809 - RNA, 14 nt, Mycobacterium tuberculosis H37Rv
cacgacccagcaug

SEQ ID NO: 1322810 - RNA, 19 nt, Mycobacterium tuberculosis H37Rv
cacgaccgcgcaacaccuc

SEQ ID NO: 1322811 - RNA, 16 nt, Mycobacterium tuberculosis H37Rv
cacgaccgcggcggca

SEQ ID NO: 1322812 - RNA, 18 nt, Mycobacterium tuberculosis H37Rv
cacgacgacaucgagcca

SEQ ID NO: 1322813 - RNA, 20 nt, Mycobacterium tuberculosis H37Rv
cacgacgaagucguugggaa

SEQ ID NO: 1322814 - RNA, 22 nt, Mycobacterium tuberculosis H37Rv
cacgacgaacaccagcgcgccg

SEQ ID NO: 1322815 - RNA, 22 nt, Mycobacterium tuberculosis H37Rv
cacgacgccggccuggccgcca

SEQ ID NO: 1322816 - RNA, 17 nt, Mycobacterium tuberculosis H37Rv
cacgacgcgacacgccg

SEQ ID NO: 1322817 - RNA, 20 nt, Mycobacterium tuberculosis H37Rv
cacgacgggggagcacuacc

SEQ ID NO: 1322818 - RNA, 15 nt, Mycobacterium tuberculosis H37Rv
cacgacggcacgcca

SEQ ID NO: 1322819 - RNA, 22 nt, Mycobacterium tuberculosis H37Rv
cacgaggacugggugcgcggcc

SEQ ID NO: 1322820 - RNA, 14 nt, Mycobacterium tuberculosis H37Rv
cacgaguuggccaa

SEQ ID NO: 1322821 - RNA, 14 nt, Mycobacterium tuberculosis H37Rv
cacgagugcaagac

SEQ ID NO: 1322822 - RNA, 22 nt, Mycobacterium tuberculosis H37Rv
cacgagcacgggacuucgugcc

SEQ ID NO: 1322823 - RNA, 17 nt, Mycobacterium tuberculosis H37Rv
cacgagcagccgaugcu

SEQ ID NO: 1322824 - RNA, 17 nt, Mycobacterium tuberculosis H37Rv
cacgacgugcaggaaca

SEQ ID NO: 1322825 - RNA, 17 nt, Mycobacterium tuberculosis H37Rv
cacgacugugcgccgca

SEQ ID NO: 1322826 - RNA, 15 nt, Mycobacterium tuberculosis H37Rv
cacgaacccucagcc

SEQ ID NO: 1322827 - RNA, 22 nt, Mycobacterium tuberculosis H37Rv
cacgaacccucagccgcgccgg

SEQ ID NO: 1322828 - RNA, 13 nt, Mycobacterium tuberculosis H37Rv
cacgaacgccugc

SEQ ID NO: 1322829 - RNA, 14 nt, Mycobacterium tuberculosis H37Rv
cacgaauccggcca

SEQ ID NO: 1322830 - RNA, 13 nt, Mycobacterium tuberculosis H37Rv
cacgaagugaccc

SEQ ID NO: 1322831 - RNA, 21 nt, Mycobacterium tuberculosis H37Rv
caccugggcugccggccagac

SEQ ID NO: 1322832 - RNA, 20 nt, Mycobacterium tuberculosis H37Rv
caccugggcgcgcuggcggg

SEQ ID NO: 1322833 - RNA, 22 nt, Mycobacterium tuberculosis H37Rv
caccugggucgacgagauccag

SEQ ID NO: 1322834 - RNA, 16 nt, Mycobacterium tuberculosis H37Rv
caccuggucggccgca

SEQ ID NO: 1322835 - RNA, 22 nt, Mycobacterium tuberculosis H37Rv
caccuguccgguggaauccacc

SEQ ID NO: 1322836 - RNA, 19 nt, Mycobacterium tuberculosis H37Rv
caccuguccgguggaaucc

SEQ ID NO: 1322837 - RNA, 21 nt, Mycobacterium tuberculosis H37Rv
caccuguaguucgaugacuga

SEQ ID NO: 1322838 - RNA, 24 nt, Mycobacterium tuberculosis H37Rv
caccugcgaugaugugcgaccaca

SEQ ID NO: 1322839 - RNA, 14 nt, Mycobacterium tuberculosis H37Rv
caccugcgcgcggc

SEQ ID NO: 1322840 - RNA, 20 nt, Mycobacterium tuberculosis H37Rv
caccugcgcgcggccgcgcu

SEQ ID NO: 1322841 - RNA, 17 nt, Mycobacterium tuberculosis H37Rv
caccugcuggaagccgu

SEQ ID NO: 1322842 - RNA, 17 nt, Mycobacterium tuberculosis H37Rv
caccugcgucggcccgc

SEQ ID NO: 1322843 - RNA, 23 nt, Mycobacterium tuberculosis H37Rv
caccuggcgugucgccgccacca

SEQ ID NO: 1322844 - RNA, 19 nt, Mycobacterium tuberculosis H37Rv
caccuggcgugucgccgcc

SEQ ID NO: 1322845 - RNA, 20 nt, Mycobacterium tuberculosis H37Rv
caccuggaaggucagcgccc

SEQ ID NO: 1322846 - RNA, 14 nt, Mycobacterium tuberculosis H37Rv
caccuuggacacca

SEQ ID NO: 1322847 - RNA, 21 nt, Mycobacterium tuberculosis H37Rv
caccuugccgaacacucgcag

SEQ ID NO: 1322848 - RNA, 13 nt, Mycobacterium tuberculosis H37Rv
caccuugccuagc

SEQ ID NO: 1322849 - RNA, 18 nt, Mycobacterium tuberculosis H37Rv
caccuuggaugcccugcc

SEQ ID NO: 1322850 - RNA, 14 nt, Mycobacterium tuberculosis H37Rv
caccuugcuccaca

SEQ ID NO: 1322851 - RNA, 19 nt, Mycobacterium tuberculosis H37Rv
caccuugacgcccaucuca

SEQ ID NO: 1322852 - RNA, 20 nt, Mycobacterium tuberculosis H37Rv
caccuuguggacccgccagg

SEQ ID NO: 1322853 - RNA, 17 nt, Mycobacterium tuberculosis H37Rv
caccuucugguccagca

SEQ ID NO: 1322854 - RNA, 18 nt, Mycobacterium tuberculosis H37Rv
caccuucugacgcggccg

SEQ ID NO: 1322855 - RNA, 23 nt, Mycobacterium tuberculosis H37Rv
caccuucgucgcggccgcggccu

SEQ ID NO: 1322856 - RNA, 22 nt, Mycobacterium tuberculosis H37Rv
caccuucaccgggugacccgcc

SEQ ID NO: 1322857 - RNA, 20 nt, Mycobacterium tuberculosis H37Rv
caccuguuggcaugccgccc

SEQ ID NO: 1322858 - RNA, 23 nt, Mycobacterium tuberculosis H37Rv
caccgccugugccgccggcgcca

SEQ ID NO: 1322859 - RNA, 18 nt, Mycobacterium tuberculosis H37Rv
caccgccugcgccgcccg

SEQ ID NO: 1322860 - RNA, 20 nt, Mycobacterium tuberculosis H37Rv
caccgccguugggccgcgcc

SEQ ID NO: 1322861 - RNA, 19 nt, Mycobacterium tuberculosis H37Rv
caccgcgccgcgccgcgcc

SEQ ID NO: 1322862 - RNA, 14 nt, Mycobacterium tuberculosis H37Rv
caccgcgccgagca

SEQ ID NO: 1322863 - RNA, 17 nt, Mycobacterium tuberculosis H37Rv
caccgcgaucaccaccg

SEQ ID NO: 1322864 - RNA, 17 nt, Mycobacterium tuberculosis H37Rv
caccgcgcgcuccagau

SEQ ID NO: 1322865 - RNA, 16 nt, Mycobacterium tuberculosis H37Rv
caccgcgcgcuccaga

SEQ ID NO: 1322866 - RNA, 14 nt, Mycobacterium tuberculosis H37Rv
caccgcggacccgc

SEQ ID NO: 1322867 - RNA, 18 nt, Mycobacterium tuberculosis H37Rv
caccgcggaaggccagcu

SEQ ID NO: 1322868 - RNA, 16 nt, Mycobacterium tuberculosis H37Rv
caccgcggccgcggac

SEQ ID NO: 1322869 - RNA, 15 nt, Mycobacterium tuberculosis H37Rv
caccgcggccagcac

SEQ ID NO: 1322870 - RNA, 16 nt, Mycobacterium tuberculosis H37Rv
caccgcggccgaggga

SEQ ID NO: 1322871 - RNA, 13 nt, Mycobacterium tuberculosis H37Rv
caccgcggccgcg

SEQ ID NO: 1322872 - RNA, 16 nt, Mycobacterium tuberculosis H37Rv
caccgcgguacgccgg

SEQ ID NO: 1322873 - RNA, 19 nt, Mycobacterium tuberculosis H37Rv
caccgcgguagccgagcuu

SEQ ID NO: 1322874 - RNA, 20 nt, Mycobacterium tuberculosis H37Rv
caccgcgguagccgagcuug

SEQ ID NO: 1322875 - RNA, 15 nt, Mycobacterium tuberculosis H37Rv
caccgcgucggccga

SEQ ID NO: 1322876 - RNA, 20 nt, Mycobacterium tuberculosis H37Rv
caccgcguaguccaggccgu

SEQ ID NO: 1322877 - RNA, 13 nt, Mycobacterium tuberculosis H37Rv
caccgcguccagg

SEQ ID NO: 1322878 - RNA, 16 nt, Mycobacterium tuberculosis H37Rv
caccgcggcggcggcc

SEQ ID NO: 1322879 - RNA, 12 nt, Mycobacterium tuberculosis H37Rv
caccgcgggcag

SEQ ID NO: 1322880 - RNA, 15 nt, Mycobacterium tuberculosis H37Rv
caccgcggcggcgcg

SEQ ID NO: 1322881 - RNA, 21 nt, Mycobacterium tuberculosis H37Rv
caccgcggcggcgcguggugc

SEQ ID NO: 1322882 - RNA, 20 nt, Mycobacterium tuberculosis H37Rv
caccgccgacauggcggugc

SEQ ID NO: 1322883 - RNA, 16 nt, Mycobacterium tuberculosis H37Rv
caccgccgaccaggcc

SEQ ID NO: 1322884 - RNA, 17 nt, Mycobacterium tuberculosis H37Rv
caccgcccuugccgccg

SEQ ID NO: 1322885 - RNA, 14 nt, Mycobacterium tuberculosis H37Rv
caccgcccggcccg

SEQ ID NO: 1322886 - RNA, 15 nt, Mycobacterium tuberculosis H37Rv
caccgcccggcccgg

SEQ ID NO: 1322887 - RNA, 15 nt, Mycobacterium tuberculosis H37Rv
caccgccgccgccac

SEQ ID NO: 1322888 - RNA, 19 nt, Mycobacterium tuberculosis H37Rv
caccgccgcccccgccggc

SEQ ID NO: 1322889 - RNA, 14 nt, Mycobacterium tuberculosis H37Rv
caccgccgccgcca

SEQ ID NO: 1322890 - RNA, 17 nt, Mycobacterium tuberculosis H37Rv
caccgccaugaacucga

SEQ ID NO: 1322891 - RNA, 22 nt, Mycobacterium tuberculosis H37Rv
caccgccccggcggcggcggcc

SEQ ID NO: 1322892 - RNA, 16 nt, Mycobacterium tuberculosis H37Rv
caccgccccgcgccca

SEQ ID NO: 1322893 - RNA, 12 nt, Mycobacterium tuberculosis H37Rv
caccgccccgcc

SEQ ID NO: 1322894 - RNA, 14 nt, Mycobacterium tuberculosis H37Rv
caccgccccgccgc

SEQ ID NO: 1322895 - RNA, 22 nt, Mycobacterium tuberculosis H37Rv
caccgccgccgccaccggcgcc

SEQ ID NO: 1322896 - RNA, 19 nt, Mycobacterium tuberculosis H37Rv
caccgccgccgccaccggc

SEQ ID NO: 1322897 - RNA, 14 nt, Mycobacterium tuberculosis H37Rv
caccgccgccgccc

SEQ ID NO: 1322898 - RNA, 19 nt, Mycobacterium tuberculosis H37Rv
caccgccgcgaccgccucg

SEQ ID NO: 1322899 - RNA, 12 nt, Mycobacterium tuberculosis H37Rv
caccgccgccug

SEQ ID NO: 1322900 - RNA, 19 nt, Mycobacterium tuberculosis H37Rv
caccgccgcgccggcggcc

SEQ ID NO: 1322901 - RNA, 14 nt, Mycobacterium tuberculosis H37Rv
caccgccgcugcca

SEQ ID NO: 1322902 - RNA, 15 nt, Mycobacterium tuberculosis H37Rv
caccgccgcgcgaca

SEQ ID NO: 1322903 - RNA, 20 nt, Mycobacterium tuberculosis H37Rv
caccgccgcgccggcggcca

SEQ ID NO: 1322904 - RNA, 23 nt, Mycobacterium tuberculosis H37Rv
caccgccgcggccgccguccccg

SEQ ID NO: 1322905 - RNA, 14 nt, Mycobacterium tuberculosis H37Rv
caccgccggcgccc

SEQ ID NO: 1322906 - RNA, 18 nt, Mycobacterium tuberculosis H37Rv
caccgccggcgcccaggc

SEQ ID NO: 1322907 - RNA, 15 nt, Mycobacterium tuberculosis H37Rv
caccgccggcgcccc

SEQ ID NO: 1322908 - RNA, 13 nt, Mycobacterium tuberculosis H37Rv
caccgccggcgcc

SEQ ID NO: 1322909 - RNA, 20 nt, Mycobacterium tuberculosis H37Rv
caccgccgggaugccggccc

SEQ ID NO: 1322910 - RNA, 24 nt, Mycobacterium tuberculosis H37Rv
caccgccguugccgccggcgccgc

SEQ ID NO: 1322911 - RNA, 17 nt, Mycobacterium tuberculosis H37Rv
caccgccguugccgccg

SEQ ID NO: 1322912 - RNA, 18 nt, Mycobacterium tuberculosis H37Rv
caccgccguugccgccgg

SEQ ID NO: 1322913 - RNA, 18 nt, Mycobacterium tuberculosis H37Rv
caccgccguugccgaucg

SEQ ID NO: 1322914 - RNA, 17 nt, Mycobacterium tuberculosis H37Rv
caccgccggugccgcca

SEQ ID NO: 1322915 - RNA, 19 nt, Mycobacterium tuberculosis H37Rv
caccgccggugccgccauc

SEQ ID NO: 1322916 - RNA, 17 nt, Mycobacterium tuberculosis H37Rv
caccgccggugcggcca

SEQ ID NO: 1322917 - RNA, 18 nt, Mycobacterium tuberculosis H37Rv
caccgccggugcugacga

SEQ ID NO: 1322918 - RNA, 23 nt, Mycobacterium tuberculosis H37Rv
caccggcuugggccaggcccagc

SEQ ID NO: 1322919 - RNA, 20 nt, Mycobacterium tuberculosis H37Rv
caccggcuucuccuccagag

SEQ ID NO: 1322920 - RNA, 17 nt, Mycobacterium tuberculosis H37Rv
caccggcuucuccucca

SEQ ID NO: 1322921 - RNA, 18 nt, Mycobacterium tuberculosis H37Rv
caccggcugaccgacccg

SEQ ID NO: 1322922 - RNA, 14 nt, Mycobacterium tuberculosis H37Rv
caccggcgugcugu

SEQ ID NO: 1322923 - RNA, 15 nt, Mycobacterium tuberculosis H37Rv
caccggcugcaacca

SEQ ID NO: 1322924 - RNA, 21 nt, Mycobacterium tuberculosis H37Rv
caccggcugaccgacccggac

SEQ ID NO: 1322925 - RNA, 16 nt, Mycobacterium tuberculosis H37Rv
caccggcugcugagga

SEQ ID NO: 1322926 - RNA, 20 nt, Mycobacterium tuberculosis H37Rv
caccgggcaccagucgcccc

SEQ ID NO: 1322927 - RNA, 18 nt, Mycobacterium tuberculosis H37Rv
caccgggcccgccguccc

SEQ ID NO: 1322928 - RNA, 13 nt, Mycobacterium tuberculosis H37Rv
caccgggcccuug

SEQ ID NO: 1322929 - RNA, 16 nt, Mycobacterium tuberculosis H37Rv
caccggcuuggugaac

SEQ ID NO: 1322930 - RNA, 21 nt, Mycobacterium tuberculosis H37Rv
caccggcuuggugaaccgcgc

SEQ ID NO: 1322931 - RNA, 11 nt, Mycobacterium tuberculosis H37Rv
caccggcgccu

SEQ ID NO: 1322932 - RNA, 16 nt, Mycobacterium tuberculosis H37Rv
caccggcgccgccguc

SEQ ID NO: 1322933 - RNA, 15 nt, Mycobacterium tuberculosis H37Rv
caccggcgccgccgg

SEQ ID NO: 1322934 - RNA, 20 nt, Mycobacterium tuberculosis H37Rv
caccggcgccgcccgcgcca

SEQ ID NO: 1322935 - RNA, 14 nt, Mycobacterium tuberculosis H37Rv
caccggcggcgccg

SEQ ID NO: 1322936 - RNA, 19 nt, Mycobacterium tuberculosis H37Rv
caccggcggucugcagugc

SEQ ID NO: 1322937 - RNA, 14 nt, Mycobacterium tuberculosis H37Rv
caccggccccaccg

SEQ ID NO: 1322938 - RNA, 12 nt, Mycobacterium tuberculosis H37Rv
caccggccggcg

SEQ ID NO: 1322939 - RNA, 23 nt, Mycobacterium tuberculosis H37Rv
caccggccgguggguagccagcg

SEQ ID NO: 1322940 - RNA, 17 nt, Mycobacterium tuberculosis H37Rv
caccggccugcgcgacc

SEQ ID NO: 1322941 - RNA, 11 nt, Mycobacterium tuberculosis H37Rv
caccggcgccg

SEQ ID NO: 1322942 - RNA, 13 nt, Mycobacterium tuberculosis H37Rv
caccggcgccccu

SEQ ID NO: 1322943 - RNA, 14 nt, Mycobacterium tuberculosis H37Rv
caccggccgcgcag

SEQ ID NO: 1322944 - RNA, 14 nt, Mycobacterium tuberculosis H37Rv
caccggcaccggcc

SEQ ID NO: 1322945 - RNA, 13 nt, Mycobacterium tuberculosis H37Rv
caccggcaccgcu

SEQ ID NO: 1322946 - RNA, 23 nt, Mycobacterium tuberculosis H37Rv
caccggaucgucgaacagcaccg

SEQ ID NO: 1322947 - RNA, 19 nt, Mycobacterium tuberculosis H37Rv
caccggcaacaucagcagg

SEQ ID NO: 1322948 - RNA, 13 nt, Mycobacterium tuberculosis H37Rv
caccggcaccacg

SEQ ID NO: 1322949 - RNA, 18 nt, Mycobacterium tuberculosis H37Rv
caccggcaaucggcggca

SEQ ID NO: 1322950 - RNA, 15 nt, Mycobacterium tuberculosis H37Rv
caccggauccacgga

SEQ ID NO: 1322951 - RNA, 17 nt, Mycobacterium tuberculosis H37Rv
caccggauacagccacg

SEQ ID NO: 1322952 - RNA, 23 nt, Mycobacterium tuberculosis H37Rv
caccggacgaaacgaucgcgcca

SEQ ID NO: 1322953 - RNA, 16 nt, Mycobacterium tuberculosis H37Rv
caccggaggccgccgc

SEQ ID NO: 1322954 - RNA, 22 nt, Mycobacterium tuberculosis H37Rv
caccggaggccgccgcgccggu

SEQ ID NO: 1322955 - RNA, 16 nt, Mycobacterium tuberculosis H37Rv
caccgcugagcccccc

SEQ ID NO: 1322956 - RNA, 17 nt, Mycobacterium tuberculosis H37Rv
caccgcugagccccccg

SEQ ID NO: 1322957 - RNA, 20 nt, Mycobacterium tuberculosis H37Rv
caccgcuacgaccaauagca

SEQ ID NO: 1322958 - RNA, 17 nt, Mycobacterium tuberculosis H37Rv
caccgcgucgggccgca

SEQ ID NO: 1322959 - RNA, 18 nt, Mycobacterium tuberculosis H37Rv
caccgcgucguagccacg

SEQ ID NO: 1322960 - RNA, 21 nt, Mycobacterium tuberculosis H37Rv
caccgcguccaggugcgccgu

SEQ ID NO: 1322961 - RNA, 17 nt, Mycobacterium tuberculosis H37Rv
caccgcguucugguugu

SEQ ID NO: 1322962 - RNA, 14 nt, Mycobacterium tuberculosis H37Rv
caccgcguuggcca

SEQ ID NO: 1322963 - RNA, 19 nt, Mycobacterium tuberculosis H37Rv
caccggaauccgggccgcc

SEQ ID NO: 1322964 - RNA, 17 nt, Mycobacterium tuberculosis H37Rv
caccggaacccccagcu

SEQ ID NO: 1322965 - RNA, 17 nt, Mycobacterium tuberculosis H37Rv
caccgcugccggcgccg

SEQ ID NO: 1322966 - RNA, 19 nt, Mycobacterium tuberculosis H37Rv
caccgcuguguucagcgca

SEQ ID NO: 1322967 - RNA, 16 nt, Mycobacterium tuberculosis H37Rv
caccgcugcggcacca

SEQ ID NO: 1322968 - RNA, 17 nt, Mycobacterium tuberculosis H37Rv
caccgcuugaccccugg

SEQ ID NO: 1322969 - RNA, 21 nt, Mycobacterium tuberculosis H37Rv
caccgacggaaugucagccgg

SEQ ID NO: 1322970 - RNA, 20 nt, Mycobacterium tuberculosis H37Rv
caccgacgcgaacgcggcca

SEQ ID NO: 1322971 - RNA, 14 nt, Mycobacterium tuberculosis H37Rv
caccgacgccgcca

SEQ ID NO: 1322972 - RNA, 15 nt, Mycobacterium tuberculosis H37Rv
caccgacgcugacca

SEQ ID NO: 1322973 - RNA, 16 nt, Mycobacterium tuberculosis H37Rv
caccgacgcugaccaa

SEQ ID NO: 1322974 - RNA, 19 nt, Mycobacterium tuberculosis H37Rv
caccgagaagcugugccuu

SEQ ID NO: 1322975 - RNA, 18 nt, Mycobacterium tuberculosis H37Rv
caccgacgucggcuucac

SEQ ID NO: 1322976 - RNA, 20 nt, Mycobacterium tuberculosis H37Rv
caccgaccagggccgccgcu

SEQ ID NO: 1322977 - RNA, 15 nt, Mycobacterium tuberculosis H37Rv
caccgaccgcgggcu

SEQ ID NO: 1322978 - RNA, 20 nt, Mycobacterium tuberculosis H37Rv
caccgacgacaccagagcga

SEQ ID NO: 1322979 - RNA, 14 nt, Mycobacterium tuberculosis H37Rv
caccgacagcaccc

SEQ ID NO: 1322980 - RNA, 16 nt, Mycobacterium tuberculosis H37Rv
caccgacagccccauc

SEQ ID NO: 1322981 - RNA, 22 nt, Mycobacterium tuberculosis H37Rv
caccgacauguguggcagcccc

SEQ ID NO: 1322982 - RNA, 17 nt, Mycobacterium tuberculosis H37Rv
caccgacauuggugugg

SEQ ID NO: 1322983 - RNA, 18 nt, Mycobacterium tuberculosis H37Rv
caccgacaucgucaucca

SEQ ID NO: 1322984 - RNA, 17 nt, Mycobacterium tuberculosis H37Rv
caccgagucgacggcca

SEQ ID NO: 1322985 - RNA, 14 nt, Mycobacterium tuberculosis H37Rv
caccgaguuccucu

SEQ ID NO: 1322986 - RNA, 15 nt, Mycobacterium tuberculosis H37Rv
caccgauccggccgc

SEQ ID NO: 1322987 - RNA, 22 nt, Mycobacterium tuberculosis H37Rv
caccgauaccgucagcgccgcu

SEQ ID NO: 1322988 - RNA, 21 nt, Mycobacterium tuberculosis H37Rv
caccgaggccgccgagaugau

SEQ ID NO: 1322989 - RNA, 23 nt, Mycobacterium tuberculosis H37Rv
caccgaggugccgcgcagcugcc

SEQ ID NO: 1322990 - RNA, 14 nt, Mycobacterium tuberculosis H37Rv
caccgagguugcgc

SEQ ID NO: 1322991 - RNA, 20 nt, Mycobacterium tuberculosis H37Rv
caccgaggugccgcgcagcu

SEQ ID NO: 1322992 - RNA, 22 nt, Mycobacterium tuberculosis H37Rv
caccgaggucgagcgaccccac

SEQ ID NO: 1322993 - RNA, 13 nt, Mycobacterium tuberculosis H37Rv
caccgagcaucuc

SEQ ID NO: 1322994 - RNA, 15 nt, Mycobacterium tuberculosis H37Rv
caccgagcaucucgu

SEQ ID NO: 1322995 - RNA, 15 nt, Mycobacterium tuberculosis H37Rv
caccgagaucggaca

SEQ ID NO: 1322996 - RNA, 18 nt, Mycobacterium tuberculosis H37Rv
caccgagcugagcggcca

SEQ ID NO: 1322997 - RNA, 20 nt, Mycobacterium tuberculosis H37Rv
caccgagcuuguccagcggc

SEQ ID NO: 1322998 - RNA, 17 nt, Mycobacterium tuberculosis H37Rv
caccgaggaccucguca

SEQ ID NO: 1322999 - RNA, 14 nt, Mycobacterium tuberculosis H37Rv
caccgaggccgccg

SEQ ID NO: 1323000 - RNA, 20 nt, Mycobacterium tuberculosis H37Rv
caccgaggccgccgagauga

SEQ ID NO: 1323001 - RNA, 16 nt, Mycobacterium tuberculosis H37Rv
caccgccaccacccag

SEQ ID NO: 1323002 - RNA, 15 nt, Mycobacterium tuberculosis H37Rv
caccgccagccccgc

SEQ ID NO: 1323003 - RNA, 20 nt, Mycobacterium tuberculosis H37Rv
caccgcauuguugaagaaag

SEQ ID NO: 1323004 - RNA, 13 nt, Mycobacterium tuberculosis H37Rv
caccgauccugga

SEQ ID NO: 1323005 - RNA, 17 nt, Mycobacterium tuberculosis H37Rv
caccgaucgacugcagc

SEQ ID NO: 1323006 - RNA, 15 nt, Mycobacterium tuberculosis H37Rv
caccgaugccacauc

SEQ ID NO: 1323007 - RNA, 15 nt, Mycobacterium tuberculosis H37Rv
caccgaugccuugac

SEQ ID NO: 1323008 - RNA, 20 nt, Mycobacterium tuberculosis H37Rv
caccgaugccgaagcccccg

SEQ ID NO: 1323009 - RNA, 15 nt, Mycobacterium tuberculosis H37Rv
caccgcaaccacgcc

SEQ ID NO: 1323010 - RNA, 14 nt, Mycobacterium tuberculosis H37Rv
caccgcacgcuggc

SEQ ID NO: 1323011 - RNA, 15 nt, Mycobacterium tuberculosis H37Rv
caccgcaaccaaagc

SEQ ID NO: 1323012 - RNA, 21 nt, Mycobacterium tuberculosis H37Rv
caccgaaagccucucuuccca

SEQ ID NO: 1323013 - RNA, 15 nt, Mycobacterium tuberculosis H37Rv
caccgaaccgccgcu

SEQ ID NO: 1323014 - RNA, 13 nt, Mycobacterium tuberculosis H37Rv
caccgaacgcggc

SEQ ID NO: 1323015 - RNA, 14 nt, Mycobacterium tuberculosis H37Rv
caccgaaccgccgc

SEQ ID NO: 1323016 - RNA, 16 nt, Mycobacterium tuberculosis H37Rv
caccgacaccggccgc

SEQ ID NO: 1323017 - RNA, 14 nt, Mycobacterium tuberculosis H37Rv
cacccuugccgccg

SEQ ID NO: 1323018 - RNA, 17 nt, Mycobacterium tuberculosis H37Rv
cacccuguuccagcggg

SEQ ID NO: 1323019 - RNA, 16 nt, Mycobacterium tuberculosis H37Rv
cacccguugcgacacc

SEQ ID NO: 1323020 - RNA, 19 nt, Mycobacterium tuberculosis H37Rv
cacccguguugagggugcc

SEQ ID NO: 1323021 - RNA, 15 nt, Mycobacterium tuberculosis H37Rv
cacccuccgccgguc

SEQ ID NO: 1323022 - RNA, 15 nt, Mycobacterium tuberculosis H37Rv
cacccugcggcaccu

SEQ ID NO: 1323023 - RNA, 22 nt, Mycobacterium tuberculosis H37Rv
cacccugaugugaguccagccg

SEQ ID NO: 1323024 - RNA, 12 nt, Mycobacterium tuberculosis H37Rv
cacccucgggca

SEQ ID NO: 1323025 - RNA, 13 nt, Mycobacterium tuberculosis H37Rv
cacccgcgccgcc

SEQ ID NO: 1323026 - RNA, 12 nt, Mycobacterium tuberculosis H37Rv
cacccgcggcga

SEQ ID NO: 1323027 - RNA, 23 nt, Mycobacterium tuberculosis H37Rv
cacccgcgucgagugccgccacc

SEQ ID NO: 1323028 - RNA, 18 nt, Mycobacterium tuberculosis H37Rv
cacccgcuggcgguaagc

SEQ ID NO: 1323029 - RNA, 16 nt, Mycobacterium tuberculosis H37Rv
cacccgcucggccgcc

SEQ ID NO: 1323030 - RNA, 19 nt, Mycobacterium tuberculosis H37Rv
cacccgcaucggcacgcca

SEQ ID NO: 1323031 - RNA, 14 nt, Mycobacterium tuberculosis H37Rv
cacccgcgccgccc

SEQ ID NO: 1323032 - RNA, 13 nt, Mycobacterium tuberculosis H37Rv
cacccgccggccg

SEQ ID NO: 1323033 - RNA, 17 nt, Mycobacterium tuberculosis H37Rv
cacccgcucggcgcgcg

SEQ ID NO: 1323034 - RNA, 18 nt, Mycobacterium tuberculosis H37Rv
cacccggcaaucucccga

SEQ ID NO: 1323035 - RNA, 22 nt, Mycobacterium tuberculosis H37Rv
cacccggacugcgaagaguccu

SEQ ID NO: 1323036 - RNA, 21 nt, Mycobacterium tuberculosis H37Rv
cacccggcgggcggugggcag

SEQ ID NO: 1323037 - RNA, 19 nt, Mycobacterium tuberculosis H37Rv
cacccggcugaaacguccu

SEQ ID NO: 1323038 - RNA, 18 nt, Mycobacterium tuberculosis H37Rv
cacccggggugcccggcc

SEQ ID NO: 1323039 - RNA, 19 nt, Mycobacterium tuberculosis H37Rv
cacccggugagaagaagcc

SEQ ID NO: 1323040 - RNA, 18 nt, Mycobacterium tuberculosis H37Rv
cacccggugccgcagcag

SEQ ID NO: 1323041 - RNA, 18 nt, Mycobacterium tuberculosis H37Rv
cacccgggccucggcgcc

SEQ ID NO: 1323042 - RNA, 23 nt, Mycobacterium tuberculosis H37Rv
cacccgggacguuguccaccgcc

SEQ ID NO: 1323043 - RNA, 15 nt, Mycobacterium tuberculosis H37Rv
cacggcgugaccacu

SEQ ID NO: 1323044 - RNA, 14 nt, Mycobacterium tuberculosis H37Rv
cacggcggccaggg

SEQ ID NO: 1323045 - RNA, 14 nt, Mycobacterium tuberculosis H37Rv
cacggcggccacgu

SEQ ID NO: 1323046 - RNA, 15 nt, Mycobacterium tuberculosis H37Rv
cacggcggccaccug

SEQ ID NO: 1323047 - RNA, 18 nt, Mycobacterium tuberculosis H37Rv
cacggcgguugccccgac

SEQ ID NO: 1323048 - RNA, 22 nt, Mycobacterium tuberculosis H37Rv
cacggcggcggcguagcagaag

SEQ ID NO: 1323049 - RNA, 18 nt, Mycobacterium tuberculosis H37Rv
cacggcgcguugggacca

SEQ ID NO: 1323050 - RNA, 12 nt, Mycobacterium tuberculosis H37Rv
cacggccagcgg

SEQ ID NO: 1323051 - RNA, 18 nt, Mycobacterium tuberculosis H37Rv
cacggccagaaacccggc

SEQ ID NO: 1323052 - RNA, 17 nt, Mycobacterium tuberculosis H37Rv
cacggccgucauuucca

SEQ ID NO: 1323053 - RNA, 14 nt, Mycobacterium tuberculosis H37Rv
cacggccgagcagg

SEQ ID NO: 1323054 - RNA, 14 nt, Mycobacterium tuberculosis H37Rv
cacggccgcagccg

SEQ ID NO: 1323055 - RNA, 14 nt, Mycobacterium tuberculosis H37Rv
cacggccggccgcu

SEQ ID NO: 1323056 - RNA, 14 nt, Mycobacterium tuberculosis H37Rv
cacggcgccgccac

SEQ ID NO: 1323057 - RNA, 22 nt, Mycobacterium tuberculosis H37Rv
cacggccuugccgaucagcugg

SEQ ID NO: 1323058 - RNA, 15 nt, Mycobacterium tuberculosis H37Rv
cacggcgauugcccg

SEQ ID NO: 1323059 - RNA, 19 nt, Mycobacterium tuberculosis H37Rv
cacggcgaugcagccacau

SEQ ID NO: 1323060 - RNA, 18 nt, Mycobacterium tuberculosis H37Rv
cacggcgacgaucucggc

SEQ ID NO: 1323061 - RNA, 19 nt, Mycobacterium tuberculosis H37Rv
cacggauccgccggugcca

SEQ ID NO: 1323062 - RNA, 13 nt, Mycobacterium tuberculosis H37Rv
cacggcagccaac

SEQ ID NO: 1323063 - RNA, 20 nt, Mycobacterium tuberculosis H37Rv
cacggcaggcagggcagccc

SEQ ID NO: 1323064 - RNA, 17 nt, Mycobacterium tuberculosis H37Rv
cacggcaucggccaccu

SEQ ID NO: 1323065 - RNA, 13 nt, Mycobacterium tuberculosis H37Rv
cacggaccuggaa

SEQ ID NO: 1323066 - RNA, 13 nt, Mycobacterium tuberculosis H37Rv
cacggaccgccac

SEQ ID NO: 1323067 - RNA, 20 nt, Mycobacterium tuberculosis H37Rv
cacgcuucuuccgcgcgccg

SEQ ID NO: 1323068 - RNA, 12 nt, Mycobacterium tuberculosis H37Rv
cacgcuugcggc

SEQ ID NO: 1323069 - RNA, 20 nt, Mycobacterium tuberculosis H37Rv
cacgcuugcggcugcccacc

SEQ ID NO: 1323070 - RNA, 18 nt, Mycobacterium tuberculosis H37Rv
cacgcgcucaccgacgcu

SEQ ID NO: 1323071 - RNA, 23 nt, Mycobacterium tuberculosis H37Rv
cacgcgcguuuagucuccggcgu

SEQ ID NO: 1323072 - RNA, 17 nt, Mycobacterium tuberculosis H37Rv
cacgcgcccgcaccacc

SEQ ID NO: 1323073 - RNA, 14 nt, Mycobacterium tuberculosis H37Rv
cacgcgggaagugc

SEQ ID NO: 1323074 - RNA, 22 nt, Mycobacterium tuberculosis H37Rv
cacgcgggucguuaccaggcgu

SEQ ID NO: 1323075 - RNA, 20 nt, Mycobacterium tuberculosis H37Rv
cacgccguuugggccguaca

SEQ ID NO: 1323076 - RNA, 22 nt, Mycobacterium tuberculosis H37Rv
cacgccugccgaaacgccgacc

SEQ ID NO: 1323077 - RNA, 19 nt, Mycobacterium tuberculosis H37Rv
cacgcgacuugcaccccgu

SEQ ID NO: 1323078 - RNA, 22 nt, Mycobacterium tuberculosis H37Rv
cacgcgacuugcaccccgucuc

SEQ ID NO: 1323079 - RNA, 21 nt, Mycobacterium tuberculosis H37Rv
cacgcugcccacgggccggcc

SEQ ID NO: 1323080 - RNA, 22 nt, Mycobacterium tuberculosis H37Rv
cacgcugcccacgggccggccg

SEQ ID NO: 1323081 - RNA, 19 nt, Mycobacterium tuberculosis H37Rv
cacgcucugcgccacagca

SEQ ID NO: 1323082 - RNA, 18 nt, Mycobacterium tuberculosis H37Rv
cacgcuggcgcccccgac

SEQ ID NO: 1323083 - RNA, 14 nt, Mycobacterium tuberculosis H37Rv
cacgcuggcgcccc

SEQ ID NO: 1323084 - RNA, 18 nt, Mycobacterium tuberculosis H37Rv
cacgcuggccuccagcuu

SEQ ID NO: 1323085 - RNA, 20 nt, Mycobacterium tuberculosis H37Rv
cacgcuggccuccagcuugg

SEQ ID NO: 1323086 - RNA, 17 nt, Mycobacterium tuberculosis H37Rv
cacgcucaacccgugcg

SEQ ID NO: 1323087 - RNA, 20 nt, Mycobacterium tuberculosis H37Rv
cacgcguuccuccagcagcg

SEQ ID NO: 1323088 - RNA, 23 nt, Mycobacterium tuberculosis H37Rv
cacgcuccagcucggccagugcc

SEQ ID NO: 1323089 - RNA, 17 nt, Mycobacterium tuberculosis H37Rv
cacgcuccagcucggcc

SEQ ID NO: 1323090 - RNA, 22 nt, Mycobacterium tuberculosis H37Rv
cacgcucguuugcgagcagggg

SEQ ID NO: 1323091 - RNA, 20 nt, Mycobacterium tuberculosis H37Rv
cacgcucguuugcgagcagg

SEQ ID NO: 1323092 - RNA, 20 nt, Mycobacterium tuberculosis H37Rv
cacgcucgugacgaucagcg

SEQ ID NO: 1323093 - RNA, 20 nt, Mycobacterium tuberculosis H37Rv
cacgcucggcguccgcccag

SEQ ID NO: 1323094 - RNA, 21 nt, Mycobacterium tuberculosis H37Rv
cacgcucggugaaggucaccg

SEQ ID NO: 1323095 - RNA, 13 nt, Mycobacterium tuberculosis H37Rv
cacgcccgcgagc

SEQ ID NO: 1323096 - RNA, 15 nt, Mycobacterium tuberculosis H37Rv
cacgcccgacgccag

SEQ ID NO: 1323097 - RNA, 17 nt, Mycobacterium tuberculosis H37Rv
cacgccgaccagcaccc

SEQ ID NO: 1323098 - RNA, 18 nt, Mycobacterium tuberculosis H37Rv
cacgccgaccggcccgca

SEQ ID NO: 1323099 - RNA, 15 nt, Mycobacterium tuberculosis H37Rv
cacgccgaucaacau

SEQ ID NO: 1323100 - RNA, 20 nt, Mycobacterium tuberculosis H37Rv
cacgccgaugauggacacca

SEQ ID NO: 1323101 - RNA, 20 nt, Mycobacterium tuberculosis H37Rv
cacgccguagcgcagcgccu

SEQ ID NO: 1323102 - RNA, 23 nt, Mycobacterium tuberculosis H37Rv
cacgccguagcgcagcgccuccu

SEQ ID NO: 1323103 - RNA, 16 nt, Mycobacterium tuberculosis H37Rv
cacgccguagcgcagc

SEQ ID NO: 1323104 - RNA, 20 nt, Mycobacterium tuberculosis H37Rv
cacgccgccggccgccagcg

SEQ ID NO: 1323105 - RNA, 23 nt, Mycobacterium tuberculosis H37Rv
cacgccgccggccgccagcgcac

SEQ ID NO: 1323106 - RNA, 15 nt, Mycobacterium tuberculosis H37Rv
cacgccggcaugcca

SEQ ID NO: 1323107 - RNA, 15 nt, Mycobacterium tuberculosis H37Rv
cacgccagcccgucc

SEQ ID NO: 1323108 - RNA, 20 nt, Mycobacterium tuberculosis H37Rv
cacgccaccgcggucaccga

SEQ ID NO: 1323109 - RNA, 20 nt, Mycobacterium tuberculosis H37Rv
cacgccaacguugcgccagc

SEQ ID NO: 1323110 - RNA, 22 nt, Mycobacterium tuberculosis H37Rv
cacgccaugguaugacccgccu

SEQ ID NO: 1323111 - RNA, 13 nt, Mycobacterium tuberculosis H37Rv
cacgcccacagcu

SEQ ID NO: 1323112 - RNA, 14 nt, Mycobacterium tuberculosis H37Rv
cacgcccaggcaag

SEQ ID NO: 1323113 - RNA, 15 nt, Mycobacterium tuberculosis H37Rv
cacgccagccgugcc

SEQ ID NO: 1323114 - RNA, 13 nt, Mycobacterium tuberculosis H37Rv
cacgccagccggu

SEQ ID NO: 1323115 - RNA, 23 nt, Mycobacterium tuberculosis H37Rv
cacgccauaccggcuggccaggu

SEQ ID NO: 1323116 - RNA, 23 nt, Mycobacterium tuberculosis H37Rv
cacgaugaucuugccgcggcgca

SEQ ID NO: 1323117 - RNA, 20 nt, Mycobacterium tuberculosis H37Rv
cacgaugaucuugccgcggc

SEQ ID NO: 1323118 - RNA, 23 nt, Mycobacterium tuberculosis H37Rv
cacgaucugcaggcccaggcugu

SEQ ID NO: 1323119 - RNA, 16 nt, Mycobacterium tuberculosis H37Rv
cacgaucugcgcguca

SEQ ID NO: 1323120 - RNA, 20 nt, Mycobacterium tuberculosis H37Rv
cacgaucugcaggcccaggc

SEQ ID NO: 1323121 - RNA, 22 nt, Mycobacterium tuberculosis H37Rv
cacgaucucguggaucugccuc

SEQ ID NO: 1323122 - RNA, 22 nt, Mycobacterium tuberculosis H37Rv
cacgaucggcagucccagcgcc

SEQ ID NO: 1323123 - RNA, 17 nt, Mycobacterium tuberculosis H37Rv
cacgaucgucgcggcca

SEQ ID NO: 1323124 - RNA, 18 nt, Mycobacterium tuberculosis H37Rv
cacgaugcgguucucgag

SEQ ID NO: 1323125 - RNA, 17 nt, Mycobacterium tuberculosis H37Rv
cacgaucaguugcccca

SEQ ID NO: 1323126 - RNA, 22 nt, Mycobacterium tuberculosis H37Rv
cacgaucgcggugauggugaau

SEQ ID NO: 1323127 - RNA, 23 nt, Mycobacterium tuberculosis H37Rv
cacgaucaucgggguggccacca

SEQ ID NO: 1323128 - RNA, 17 nt, Mycobacterium tuberculosis H37Rv
cacgcaccacaaacacc

SEQ ID NO: 1323129 - RNA, 20 nt, Mycobacterium tuberculosis H37Rv
cacgauuucgagcgcugcuc

SEQ ID NO: 1323130 - RNA, 23 nt, Mycobacterium tuberculosis H37Rv
cacgcacccggcgcaacaaccgg

SEQ ID NO: 1323131 - RNA, 15 nt, Mycobacterium tuberculosis H37Rv
cacgcaccacaaaca

SEQ ID NO: 1323132 - RNA, 13 nt, Mycobacterium tuberculosis H37Rv
cacgcacccggca

SEQ ID NO: 1323133 - RNA, 13 nt, Mycobacterium tuberculosis H37Rv
cacgcacccggcg

SEQ ID NO: 1323134 - RNA, 17 nt, Mycobacterium tuberculosis H37Rv
cacgcacugccgcggac

SEQ ID NO: 1323135 - RNA, 22 nt, Mycobacterium tuberculosis H37Rv
cacgcacugaugucacccgccc

SEQ ID NO: 1323136 - RNA, 16 nt, Mycobacterium tuberculosis H37Rv
cacgcacucccgagcc

SEQ ID NO: 1323137 - RNA, 12 nt, Mycobacterium tuberculosis H37Rv
cacgcagagcca

SEQ ID NO: 1323138 - RNA, 17 nt, Mycobacterium tuberculosis H37Rv
cacgcagucgggcagcg

SEQ ID NO: 1323139 - RNA, 17 nt, Mycobacterium tuberculosis H37Rv
cacgggaugcaugucuu

SEQ ID NO: 1323140 - RNA, 16 nt, Mycobacterium tuberculosis H37Rv
cacgggccguccagga

SEQ ID NO: 1323141 - RNA, 23 nt, Mycobacterium tuberculosis H37Rv
cacggucaagccggcgcccgccg

SEQ ID NO: 1323142 - RNA, 12 nt, Mycobacterium tuberculosis H37Rv
cacggucacacg

SEQ ID NO: 1323143 - RNA, 18 nt, Mycobacterium tuberculosis H37Rv
cacgggucgucaugccag

SEQ ID NO: 1323144 - RNA, 17 nt, Mycobacterium tuberculosis H37Rv
cacgggugcgccacaac

SEQ ID NO: 1323145 - RNA, 16 nt, Mycobacterium tuberculosis H37Rv
cacggucauugggugu

SEQ ID NO: 1323146 - RNA, 17 nt, Mycobacterium tuberculosis H37Rv
cacggugaucagcagca

SEQ ID NO: 1323147 - RNA, 23 nt, Mycobacterium tuberculosis H37Rv
cacgguccggcccaccagcgcag

SEQ ID NO: 1323148 - RNA, 14 nt, Mycobacterium tuberculosis H37Rv
cacggucgccgacc

SEQ ID NO: 1323149 - RNA, 20 nt, Mycobacterium tuberculosis H37Rv
cacggucagcacgcugacca

SEQ ID NO: 1323150 - RNA, 15 nt, Mycobacterium tuberculosis H37Rv
cacggucagcgcgca

SEQ ID NO: 1323151 - RNA, 17 nt, Mycobacterium tuberculosis H37Rv
cacggucaggcguaggu

SEQ ID NO: 1323152 - RNA, 16 nt, Mycobacterium tuberculosis H37Rv
cacggugccgccgucg

SEQ ID NO: 1323153 - RNA, 18 nt, Mycobacterium tuberculosis H37Rv
cacgguggugucagccac

SEQ ID NO: 1323154 - RNA, 16 nt, Mycobacterium tuberculosis H37Rv
cacgguguaccccgcg

SEQ ID NO: 1323155 - RNA, 23 nt, Mycobacterium tuberculosis H37Rv
cacgguguauugggguggcagcu

SEQ ID NO: 1323156 - RNA, 20 nt, Mycobacterium tuberculosis H37Rv
cacggugucgcgcgaccugg

SEQ ID NO: 1323157 - RNA, 17 nt, Mycobacterium tuberculosis H37Rv
cacguccgcggagcuca

SEQ ID NO: 1323158 - RNA, 22 nt, Mycobacterium tuberculosis H37Rv
cacguccgcgggggaccgcccg

SEQ ID NO: 1323159 - RNA, 17 nt, Mycobacterium tuberculosis H37Rv
cacgucaaacaacgcaa

SEQ ID NO: 1323160 - RNA, 13 nt, Mycobacterium tuberculosis H37Rv
cacgguuggcgcu

SEQ ID NO: 1323161 - RNA, 17 nt, Mycobacterium tuberculosis H37Rv
cacguaauuccccaggg

SEQ ID NO: 1323162 - RNA, 14 nt, Mycobacterium tuberculosis H37Rv
cacguacuccaccg

SEQ ID NO: 1323163 - RNA, 16 nt, Mycobacterium tuberculosis H37Rv
cacguucucaccacca

SEQ ID NO: 1323164 - RNA, 19 nt, Mycobacterium tuberculosis H37Rv
cacguuauucaugcccaug

SEQ ID NO: 1323165 - RNA, 14 nt, Mycobacterium tuberculosis H37Rv
cacguuauucaugc

SEQ ID NO: 1323166 - RNA, 15 nt, Mycobacterium tuberculosis H37Rv
cacgugggccaugcu

SEQ ID NO: 1323167 - RNA, 19 nt, Mycobacterium tuberculosis H37Rv
cacguggucggccacccca

SEQ ID NO: 1323168 - RNA, 15 nt, Mycobacterium tuberculosis H37Rv
cacguggugggcgca

SEQ ID NO: 1323169 - RNA, 19 nt, Mycobacterium tuberculosis H37Rv
cacgucguuuggccucagc

SEQ ID NO: 1323170 - RNA, 17 nt, Mycobacterium tuberculosis H37Rv
cacgucuaacacgcggu

SEQ ID NO: 1323171 - RNA, 21 nt, Mycobacterium tuberculosis H37Rv
cacgucgucgucccagggcug

SEQ ID NO: 1323172 - RNA, 17 nt, Mycobacterium tuberculosis H37Rv
cacgugcccgcgcggcg

SEQ ID NO: 1323173 - RNA, 16 nt, Mycobacterium tuberculosis H37Rv
cacgugaugcccuggg

SEQ ID NO: 1323174 - RNA, 15 nt, Mycobacterium tuberculosis H37Rv
cacuaccgaucacau

SEQ ID NO: 1323175 - RNA, 22 nt, Mycobacterium tuberculosis H37Rv
cacuaaccuggcguagaucauc

SEQ ID NO: 1323176 - RNA, 13 nt, Mycobacterium tuberculosis H37Rv
cacucuagccggg

SEQ ID NO: 1323177 - RNA, 21 nt, Mycobacterium tuberculosis H37Rv
cacucgccgaaucgcugaccg

SEQ ID NO: 1323178 - RNA, 19 nt, Mycobacterium tuberculosis H37Rv
cacucgccggcggacgccc

SEQ ID NO: 1323179 - RNA, 15 nt, Mycobacterium tuberculosis H37Rv
cacucgcccgauccg

SEQ ID NO: 1323180 - RNA, 23 nt, Mycobacterium tuberculosis H37Rv
cacucgccagggccaucuggcug

SEQ ID NO: 1323181 - RNA, 19 nt, Mycobacterium tuberculosis H37Rv
cacucgcccaagcgcagcc

SEQ ID NO: 1323182 - RNA, 15 nt, Mycobacterium tuberculosis H37Rv
cacucgggacuuccc

SEQ ID NO: 1323183 - RNA, 17 nt, Mycobacterium tuberculosis H37Rv
cacucgcgccagugugg

SEQ ID NO: 1323184 - RNA, 16 nt, Mycobacterium tuberculosis H37Rv
cacucgcucaggaaca

SEQ ID NO: 1323185 - RNA, 14 nt, Mycobacterium tuberculosis H37Rv
cacuccgguggcca

SEQ ID NO: 1323186 - RNA, 21 nt, Mycobacterium tuberculosis H37Rv
cacuccugcacacaggacuug

SEQ ID NO: 1323187 - RNA, 13 nt, Mycobacterium tuberculosis H37Rv
cacuccucggugu

SEQ ID NO: 1323188 - RNA, 19 nt, Mycobacterium tuberculosis H37Rv
cacucgaccaggaccggcu

SEQ ID NO: 1323189 - RNA, 18 nt, Mycobacterium tuberculosis H37Rv
cacucgauccggauucag

SEQ ID NO: 1323190 - RNA, 13 nt, Mycobacterium tuberculosis H37Rv
cacuccgcggggu

SEQ ID NO: 1323191 - RNA, 15 nt, Mycobacterium tuberculosis H37Rv
cacucccgccccgcu

SEQ ID NO: 1323192 - RNA, 14 nt, Mycobacterium tuberculosis H37Rv
cacucccgccccgc

SEQ ID NO: 1323193 - RNA, 16 nt, Mycobacterium tuberculosis H37Rv
cacucccccacacacc

SEQ ID NO: 1323194 - RNA, 20 nt, Mycobacterium tuberculosis H37Rv
cacugacgucucaucaaacc

SEQ ID NO: 1323195 - RNA, 21 nt, Mycobacterium tuberculosis H37Rv
cacugacgcgcccgacgaaca

SEQ ID NO: 1323196 - RNA, 19 nt, Mycobacterium tuberculosis H37Rv
cacugaccaggucugcggu

SEQ ID NO: 1323197 - RNA, 14 nt, Mycobacterium tuberculosis H37Rv
cacugagccacagg

SEQ ID NO: 1323198 - RNA, 17 nt, Mycobacterium tuberculosis H37Rv
cacucuucgggcggcgu

SEQ ID NO: 1323199 - RNA, 23 nt, Mycobacterium tuberculosis H37Rv
cacucucggugaacgccgccccg

SEQ ID NO: 1323200 - RNA, 23 nt, Mycobacterium tuberculosis H37Rv
cacucaucuucucgcagccacgc

SEQ ID NO: 1323201 - RNA, 23 nt, Mycobacterium tuberculosis H37Rv
cacuccaagucacagcucaccau

SEQ ID NO: 1323202 - RNA, 14 nt, Mycobacterium tuberculosis H37Rv
cacuccagcggcgg

SEQ ID NO: 1323203 - RNA, 20 nt, Mycobacterium tuberculosis H37Rv
cacucauagaacucgccgcu

SEQ ID NO: 1323204 - RNA, 13 nt, Mycobacterium tuberculosis H37Rv
cacucacccagcu

SEQ ID NO: 1323205 - RNA, 15 nt, Mycobacterium tuberculosis H37Rv
cacucacauuggcca

SEQ ID NO: 1323206 - RNA, 16 nt, Mycobacterium tuberculosis H37Rv
cacucacguaauccuc

SEQ ID NO: 1323207 - RNA, 18 nt, Mycobacterium tuberculosis H37Rv
cacuacucgaacaacccc

SEQ ID NO: 1323208 - RNA, 13 nt, Mycobacterium tuberculosis H37Rv
cacuacgcagccg

SEQ ID NO: 1323209 - RNA, 14 nt, Mycobacterium tuberculosis H37Rv
cacuacggccuggc

SEQ ID NO: 1323210 - RNA, 19 nt, Mycobacterium tuberculosis H37Rv
caacgguuggucgaacaga

SEQ ID NO: 1323211 - RNA, 22 nt, Mycobacterium tuberculosis H37Rv
caacggggcagucaacucccga

SEQ ID NO: 1323212 - RNA, 23 nt, Mycobacterium tuberculosis H37Rv
caacgggauccgcgcgcuggacc

SEQ ID NO: 1323213 - RNA, 11 nt, Mycobacterium tuberculosis H37Rv
caacgcggcga

SEQ ID NO: 1323214 - RNA, 21 nt, Mycobacterium tuberculosis H37Rv
caacgccgccuugacccuccg

SEQ ID NO: 1323215 - RNA, 14 nt, Mycobacterium tuberculosis H37Rv
caacgccucugcuc

SEQ ID NO: 1323216 - RNA, 20 nt, Mycobacterium tuberculosis H37Rv
caacgccucugcucagccgu

SEQ ID NO: 1323217 - RNA, 21 nt, Mycobacterium tuberculosis H37Rv
caacgcgacgccgcucccgca

SEQ ID NO: 1323218 - RNA, 20 nt, Mycobacterium tuberculosis H37Rv
caacuccaagaugccgcccc

SEQ ID NO: 1323219 - RNA, 14 nt, Mycobacterium tuberculosis H37Rv
caacucccagcacg

SEQ ID NO: 1323220 - RNA, 12 nt, Mycobacterium tuberculosis H37Rv
caacuccucagc

SEQ ID NO: 1323221 - RNA, 21 nt, Mycobacterium tuberculosis H37Rv
caacuccggucaacacccgcc

SEQ ID NO: 1323222 - RNA, 22 nt, Mycobacterium tuberculosis H37Rv
caacuccugcagcccgggcagc

SEQ ID NO: 1323223 - RNA, 19 nt, Mycobacterium tuberculosis H37Rv
caacucgagaguggccucg

SEQ ID NO: 1323224 - RNA, 15 nt, Mycobacterium tuberculosis H37Rv
caacgugucccaagc

SEQ ID NO: 1323225 - RNA, 21 nt, Mycobacterium tuberculosis H37Rv
caacguucggcacaaccaacg

SEQ ID NO: 1323226 - RNA, 18 nt, Mycobacterium tuberculosis H37Rv
caacguucggcacaacca

SEQ ID NO: 1323227 - RNA, 18 nt, Mycobacterium tuberculosis H37Rv
caacuagccgcugccugg

SEQ ID NO: 1323228 - RNA, 14 nt, Mycobacterium tuberculosis H37Rv
caacaucagcaccg

SEQ ID NO: 1323229 - RNA, 23 nt, Mycobacterium tuberculosis H37Rv
caaccuguuccagcgugccuggu

SEQ ID NO: 1323230 - RNA, 15 nt, Mycobacterium tuberculosis H37Rv
caaccuggggccacc

SEQ ID NO: 1323231 - RNA, 13 nt, Mycobacterium tuberculosis H37Rv
caacgcacacacc

SEQ ID NO: 1323232 - RNA, 15 nt, Mycobacterium tuberculosis H37Rv
caacgaugaugauga

SEQ ID NO: 1323233 - RNA, 21 nt, Mycobacterium tuberculosis H37Rv
caacgauugcgaagggcaccg

SEQ ID NO: 1323234 - RNA, 13 nt, Mycobacterium tuberculosis H37Rv
caacgaucugcug

SEQ ID NO: 1323235 - RNA, 12 nt, Mycobacterium tuberculosis H37Rv
caacgaucaggu

SEQ ID NO: 1323236 - RNA, 15 nt, Mycobacterium tuberculosis H37Rv
caacgacaccagauc

SEQ ID NO: 1323237 - RNA, 18 nt, Mycobacterium tuberculosis H37Rv
caacgaagccggcgccgg

SEQ ID NO: 1323238 - RNA, 19 nt, Mycobacterium tuberculosis H37Rv
caacgaagagggcgccgcg

SEQ ID NO: 1323239 - RNA, 18 nt, Mycobacterium tuberculosis H37Rv
caacgacuucgggaacgc

SEQ ID NO: 1323240 - RNA, 23 nt, Mycobacterium tuberculosis H37Rv
caacgacucucaucgacucgacc

SEQ ID NO: 1323241 - RNA, 15 nt, Mycobacterium tuberculosis H37Rv
caacgacuccuggcg

SEQ ID NO: 1323242 - RNA, 17 nt, Mycobacterium tuberculosis H37Rv
caacgacaugagcgcca

SEQ ID NO: 1323243 - RNA, 13 nt, Mycobacterium tuberculosis H37Rv
caacgaccaccac

SEQ ID NO: 1323244 - RNA, 22 nt, Mycobacterium tuberculosis H37Rv
caagagugcucagcgcgcgccg

SEQ ID NO: 1323245 - RNA, 14 nt, Mycobacterium tuberculosis H37Rv
caagauggcgcgcu

SEQ ID NO: 1323246 - RNA, 21 nt, Mycobacterium tuberculosis H37Rv
caagaucagcgguuugccagu

SEQ ID NO: 1323247 - RNA, 16 nt, Mycobacterium tuberculosis H37Rv
caagacgaacagcacg

SEQ ID NO: 1323248 - RNA, 17 nt, Mycobacterium tuberculosis H37Rv
caagacgaacagcacga

SEQ ID NO: 1323249 - RNA, 15 nt, Mycobacterium tuberculosis H37Rv
caagacggcgggccc

SEQ ID NO: 1323250 - RNA, 21 nt, Mycobacterium tuberculosis H37Rv
caagagccguccgaccaggga

SEQ ID NO: 1323251 - RNA, 13 nt, Mycobacterium tuberculosis H37Rv
caagaccggcggg

SEQ ID NO: 1323252 - RNA, 19 nt, Mycobacterium tuberculosis H37Rv
caagacaugcugauggauc

SEQ ID NO: 1323253 - RNA, 18 nt, Mycobacterium tuberculosis H37Rv
caagaauggccgccuuga

SEQ ID NO: 1323254 - RNA, 16 nt, Mycobacterium tuberculosis H37Rv
caacuucuucagcagc

SEQ ID NO: 1323255 - RNA, 21 nt, Mycobacterium tuberculosis H37Rv
caacuuggcggccagccgcuc

SEQ ID NO: 1323256 - RNA, 19 nt, Mycobacterium tuberculosis H37Rv
caacuuggcggccagccgc

SEQ ID NO: 1323257 - RNA, 15 nt, Mycobacterium tuberculosis H37Rv
caacucggccacggc

SEQ ID NO: 1323258 - RNA, 17 nt, Mycobacterium tuberculosis H37Rv
caagaaguacagcuggc

SEQ ID NO: 1323259 - RNA, 17 nt, Mycobacterium tuberculosis H37Rv
caagaaucaccggcaau

SEQ ID NO: 1323260 - RNA, 16 nt, Mycobacterium tuberculosis H37Rv
caagaaucagcagcag

SEQ ID NO: 1323261 - RNA, 17 nt, Mycobacterium tuberculosis H37Rv
caaguugguucaccgcg

SEQ ID NO: 1323262 - RNA, 16 nt, Mycobacterium tuberculosis H37Rv
caaguucgccagcaac

SEQ ID NO: 1323263 - RNA, 21 nt, Mycobacterium tuberculosis H37Rv
caaguucgccagcaacgucgg

SEQ ID NO: 1323264 - RNA, 20 nt, Mycobacterium tuberculosis H37Rv
caaguugggcguucaggugu

SEQ ID NO: 1323265 - RNA, 21 nt, Mycobacterium tuberculosis H37Rv
caauaccgccagcgccaccgu

SEQ ID NO: 1323266 - RNA, 17 nt, Mycobacterium tuberculosis H37Rv
caauaccgccagcgcca

SEQ ID NO: 1323267 - RNA, 12 nt, Mycobacterium tuberculosis H37Rv
caaucaccaccg

SEQ ID NO: 1323268 - RNA, 17 nt, Mycobacterium tuberculosis H37Rv
caagggcauacagcaug

SEQ ID NO: 1323269 - RNA, 19 nt, Mycobacterium tuberculosis H37Rv
caagggaauccgaacucgc

SEQ ID NO: 1323270 - RNA, 17 nt, Mycobacterium tuberculosis H37Rv
caagggauccgaagagc

SEQ ID NO: 1323271 - RNA, 15 nt, Mycobacterium tuberculosis H37Rv
caaggcucagcagcg

SEQ ID NO: 1323272 - RNA, 17 nt, Mycobacterium tuberculosis H37Rv
caaggcucagcagcgcc

SEQ ID NO: 1323273 - RNA, 22 nt, Mycobacterium tuberculosis H37Rv
caaggcgugagcuaugcuggca

SEQ ID NO: 1323274 - RNA, 16 nt, Mycobacterium tuberculosis H37Rv
caaggcgugcaccccc

SEQ ID NO: 1323275 - RNA, 14 nt, Mycobacterium tuberculosis H37Rv
caaguccagcagcg

SEQ ID NO: 1323276 - RNA, 13 nt, Mycobacterium tuberculosis H37Rv
caaguccagcagc

SEQ ID NO: 1323277 - RNA, 15 nt, Mycobacterium tuberculosis H37Rv
caagugucgccgcuc

SEQ ID NO: 1323278 - RNA, 19 nt, Mycobacterium tuberculosis H37Rv
caagugucuccggcaacag

SEQ ID NO: 1323279 - RNA, 21 nt, Mycobacterium tuberculosis H37Rv
caagugucuccggcaacagca

SEQ ID NO: 1323280 - RNA, 14 nt, Mycobacterium tuberculosis H37Rv
caagugguccaagu

SEQ ID NO: 1323281 - RNA, 23 nt, Mycobacterium tuberculosis H37Rv
caagugccggcgcggagugccca

SEQ ID NO: 1323282 - RNA, 18 nt, Mycobacterium tuberculosis H37Rv
caagugcuggccgaagaa

SEQ ID NO: 1323283 - RNA, 23 nt, Mycobacterium tuberculosis H37Rv
caaguggugguaggccgggagga

SEQ ID NO: 1323284 - RNA, 15 nt, Mycobacterium tuberculosis H37Rv
caagugggugagaaa

SEQ ID NO: 1323285 - RNA, 14 nt, Mycobacterium tuberculosis H37Rv
caagucgacacgcc

SEQ ID NO: 1323286 - RNA, 14 nt, Mycobacterium tuberculosis H37Rv
caagucgauguaca

SEQ ID NO: 1323287 - RNA, 12 nt, Mycobacterium tuberculosis H37Rv
caagcacaccgc

SEQ ID NO: 1323288 - RNA, 21 nt, Mycobacterium tuberculosis H37Rv
caagccucuauacgccugcuc

SEQ ID NO: 1323289 - RNA, 15 nt, Mycobacterium tuberculosis H37Rv
caagccuuaccccgc

SEQ ID NO: 1323290 - RNA, 22 nt, Mycobacterium tuberculosis H37Rv
caagcgcaucgcacagcgccgc

SEQ ID NO: 1323291 - RNA, 14 nt, Mycobacterium tuberculosis H37Rv
caaggauggucgcc

SEQ ID NO: 1323292 - RNA, 19 nt, Mycobacterium tuberculosis H37Rv
caagcucuuccauuaggcu

SEQ ID NO: 1323293 - RNA, 23 nt, Mycobacterium tuberculosis H37Rv
caagcucuuccauuaggcucucg

SEQ ID NO: 1323294 - RNA, 16 nt, Mycobacterium tuberculosis H37Rv
caagcucggcccagcg

SEQ ID NO: 1323295 - RNA, 21 nt, Mycobacterium tuberculosis H37Rv
caagcucggcccagcgcgcca

SEQ ID NO: 1323296 - RNA, 14 nt, Mycobacterium tuberculosis H37Rv
caaaccacagacug

SEQ ID NO: 1323297 - RNA, 18 nt, Mycobacterium tuberculosis H37Rv
caaaccacccgcaacaca

SEQ ID NO: 1323298 - RNA, 16 nt, Mycobacterium tuberculosis H37Rv
caaacaucgcacccac

SEQ ID NO: 1323299 - RNA, 15 nt, Mycobacterium tuberculosis H37Rv
caaacaucgcaccca

SEQ ID NO: 1323300 - RNA, 14 nt, Mycobacterium tuberculosis H37Rv
caaacccguugaag

SEQ ID NO: 1323301 - RNA, 21 nt, Mycobacterium tuberculosis H37Rv
caaacccguugaagacggcca

SEQ ID NO: 1323302 - RNA, 23 nt, Mycobacterium tuberculosis H37Rv
caaacaccccggccuugccaccg

SEQ ID NO: 1323303 - RNA, 15 nt, Mycobacterium tuberculosis H37Rv
caaacaccccacaca

SEQ ID NO: 1323304 - RNA, 18 nt, Mycobacterium tuberculosis H37Rv
caaacggaugguucugga

SEQ ID NO: 1323305 - RNA, 21 nt, Mycobacterium tuberculosis H37Rv
caaacgcugcgcccggaccac

SEQ ID NO: 1323306 - RNA, 14 nt, Mycobacterium tuberculosis H37Rv
caaacgcgcagguc

SEQ ID NO: 1323307 - RNA, 20 nt, Mycobacterium tuberculosis H37Rv
caaacggcuuggcugccucc

SEQ ID NO: 1323308 - RNA, 19 nt, Mycobacterium tuberculosis H37Rv
caaacgggcgugggccgcu

SEQ ID NO: 1323309 - RNA, 14 nt, Mycobacterium tuberculosis H37Rv
caaacggcgaccca

SEQ ID NO: 1323310 - RNA, 17 nt, Mycobacterium tuberculosis H37Rv
caaacucagacucugcc

SEQ ID NO: 1323311 - RNA, 15 nt, Mycobacterium tuberculosis H37Rv
caaacuccugcagga

SEQ ID NO: 1323312 - RNA, 18 nt, Mycobacterium tuberculosis H37Rv
caaacuccugcaggauca

SEQ ID NO: 1323313 - RNA, 17 nt, Mycobacterium tuberculosis H37Rv
caaaaucgucagcgccg

SEQ ID NO: 1323314 - RNA, 16 nt, Mycobacterium tuberculosis H37Rv
caaaaucgcggccaca

SEQ ID NO: 1323315 - RNA, 18 nt, Mycobacterium tuberculosis H37Rv
caaaaucgcccaauucgg

SEQ ID NO: 1323316 - RNA, 13 nt, Mycobacterium tuberculosis H37Rv
caaaaucaucugc

SEQ ID NO: 1323317 - RNA, 17 nt, Mycobacterium tuberculosis H37Rv
caaacaagaucagaccc

SEQ ID NO: 1323318 - RNA, 23 nt, Mycobacterium tuberculosis H37Rv
caacagccgcucgcacagccgcu

SEQ ID NO: 1323319 - RNA, 12 nt, Mycobacterium tuberculosis H37Rv
caacagccagcu

SEQ ID NO: 1323320 - RNA, 17 nt, Mycobacterium tuberculosis H37Rv
caacagccgcagccagg

SEQ ID NO: 1323321 - RNA, 17 nt, Mycobacterium tuberculosis H37Rv
caacagcaacggcagcg

SEQ ID NO: 1323322 - RNA, 22 nt, Mycobacterium tuberculosis H37Rv
caacacccggcuagagugcgca

SEQ ID NO: 1323323 - RNA, 16 nt, Mycobacterium tuberculosis H37Rv
caacaccgccagcaug

SEQ ID NO: 1323324 - RNA, 17 nt, Mycobacterium tuberculosis H37Rv
caacacccgggccuugu

SEQ ID NO: 1323325 - RNA, 14 nt, Mycobacterium tuberculosis H37Rv
caacacccccccca

SEQ ID NO: 1323326 - RNA, 16 nt, Mycobacterium tuberculosis H37Rv
caacaccgugcaccag

SEQ ID NO: 1323327 - RNA, 20 nt, Mycobacterium tuberculosis H37Rv
caacaccgucggcagcagcg

SEQ ID NO: 1323328 - RNA, 13 nt, Mycobacterium tuberculosis H37Rv
caacaccgcccgc

SEQ ID NO: 1323329 - RNA, 14 nt, Mycobacterium tuberculosis H37Rv
caacaccgcggccg

SEQ ID NO: 1323330 - RNA, 14 nt, Mycobacterium tuberculosis H37Rv
caacaccgcggcgc

SEQ ID NO: 1323331 - RNA, 15 nt, Mycobacterium tuberculosis H37Rv
caacaacuccagcag

SEQ ID NO: 1323332 - RNA, 14 nt, Mycobacterium tuberculosis H37Rv
caaaugggguguuu

SEQ ID NO: 1323333 - RNA, 14 nt, Mycobacterium tuberculosis H37Rv
caaaugcgcugucg

SEQ ID NO: 1323334 - RNA, 19 nt, Mycobacterium tuberculosis H37Rv
caaaugugcgagaagcagg

SEQ ID NO: 1323335 - RNA, 14 nt, Mycobacterium tuberculosis H37Rv
caaacugggcaccg

SEQ ID NO: 1323336 - RNA, 16 nt, Mycobacterium tuberculosis H37Rv
caaagaucgccucucg

SEQ ID NO: 1323337 - RNA, 23 nt, Mycobacterium tuberculosis H37Rv
caaagcugcucgucggcgccggc

SEQ ID NO: 1323338 - RNA, 21 nt, Mycobacterium tuberculosis H37Rv
caaagcguauugcaccgcggc

SEQ ID NO: 1323339 - RNA, 19 nt, Mycobacterium tuberculosis H37Rv
caaaggcgccgggucacgu

SEQ ID NO: 1323340 - RNA, 21 nt, Mycobacterium tuberculosis H37Rv
caaaggcuugcggaacgaaag

SEQ ID NO: 1323341 - RNA, 15 nt, Mycobacterium tuberculosis H37Rv
caaaggggugugugc

SEQ ID NO: 1323342 - RNA, 16 nt, Mycobacterium tuberculosis H37Rv
caaaggccuugacgua

SEQ ID NO: 1323343 - RNA, 16 nt, Mycobacterium tuberculosis H37Rv
auuucaccgaagccau

SEQ ID NO: 1323344 - RNA, 16 nt, Mycobacterium tuberculosis H37Rv
auuuccacauccaacg

SEQ ID NO: 1323345 - RNA, 11 nt, Mycobacterium tuberculosis H37Rv
auuuccucugg

SEQ ID NO: 1323346 - RNA, 20 nt, Mycobacterium tuberculosis H37Rv
auuuccuacggugcagucga

SEQ ID NO: 1323347 - RNA, 18 nt, Mycobacterium tuberculosis H37Rv
auuggcgucagcagcaac

SEQ ID NO: 1323348 - RNA, 16 nt, Mycobacterium tuberculosis H37Rv
auuggcgucagcagca

SEQ ID NO: 1323349 - RNA, 17 nt, Mycobacterium tuberculosis H37Rv
auuggcgucagcagcaa

SEQ ID NO: 1323350 - RNA, 19 nt, Mycobacterium tuberculosis H37Rv
auuggugggccagcagcaa

SEQ ID NO: 1323351 - RNA, 20 nt, Mycobacterium tuberculosis H37Rv
auuggugggccagcagcaac

SEQ ID NO: 1323352 - RNA, 21 nt, Mycobacterium tuberculosis H37Rv
auuggugaguagauugcugac

SEQ ID NO: 1323353 - RNA, 13 nt, Mycobacterium tuberculosis H37Rv
auugguguagcca

SEQ ID NO: 1323354 - RNA, 13 nt, Mycobacterium tuberculosis H37Rv
auuucggcccacu

SEQ ID NO: 1323355 - RNA, 14 nt, Mycobacterium tuberculosis H37Rv
auuucggaucucga

SEQ ID NO: 1323356 - RNA, 20 nt, Mycobacterium tuberculosis H37Rv
auuuuggcaagcugccccgc

SEQ ID NO: 1323357 - RNA, 17 nt, Mycobacterium tuberculosis H37Rv
auucuucggugaagaac

SEQ ID NO: 1323358 - RNA, 15 nt, Mycobacterium tuberculosis H37Rv
auucgguguggccgu

SEQ ID NO: 1323359 - RNA, 18 nt, Mycobacterium tuberculosis H37Rv
auucguggagccggccgu

SEQ ID NO: 1323360 - RNA, 21 nt, Mycobacterium tuberculosis H37Rv
auucgugggaaccaccagcac

SEQ ID NO: 1323361 - RNA, 9 nt, Mycobacterium tuberculosis H37Rv
auugccaua

SEQ ID NO: 1323362 - RNA, 22 nt, Mycobacterium tuberculosis H37Rv
auugcggaaacccggccgccga

SEQ ID NO: 1323363 - RNA, 19 nt, Mycobacterium tuberculosis H37Rv
auugcgcgcugagcucgau

SEQ ID NO: 1323364 - RNA, 21 nt, Mycobacterium tuberculosis H37Rv
auugcgcccagcgacccggcc

SEQ ID NO: 1323365 - RNA, 18 nt, Mycobacterium tuberculosis H37Rv
auugcugcggcuuucagc

SEQ ID NO: 1323366 - RNA, 17 nt, Mycobacterium tuberculosis H37Rv
auugcugcggcuuucag

SEQ ID NO: 1323367 - RNA, 14 nt, Mycobacterium tuberculosis H37Rv
auuggacgcugccg

SEQ ID NO: 1323368 - RNA, 22 nt, Mycobacterium tuberculosis H37Rv
auugaucgacggccagcccagc

SEQ ID NO: 1323369 - RNA, 17 nt, Mycobacterium tuberculosis H37Rv
auugauacugcccgcgu

SEQ ID NO: 1323370 - RNA, 16 nt, Mycobacterium tuberculosis H37Rv
auugaugcgugguugg

SEQ ID NO: 1323371 - RNA, 15 nt, Mycobacterium tuberculosis H37Rv
auuccacugggccug

SEQ ID NO: 1323372 - RNA, 14 nt, Mycobacterium tuberculosis H37Rv
auuccacaggggcc

SEQ ID NO: 1323373 - RNA, 13 nt, Mycobacterium tuberculosis H37Rv
auucaucacggga

SEQ ID NO: 1323374 - RNA, 18 nt, Mycobacterium tuberculosis H37Rv
auucgcccggccgcagcg

SEQ ID NO: 1323375 - RNA, 15 nt, Mycobacterium tuberculosis H37Rv
auucgcgcuggccau

SEQ ID NO: 1323376 - RNA, 23 nt, Mycobacterium tuberculosis H37Rv
auucgcucaccaccgaccucgac

SEQ ID NO: 1323377 - RNA, 13 nt, Mycobacterium tuberculosis H37Rv
auucggcugccac

SEQ ID NO: 1323378 - RNA, 12 nt, Mycobacterium tuberculosis H37Rv
auuccguagccg

SEQ ID NO: 1323379 - RNA, 17 nt, Mycobacterium tuberculosis H37Rv
auuccggcggccacgcc

SEQ ID NO: 1323380 - RNA, 21 nt, Mycobacterium tuberculosis H37Rv
auuccggaguucuuguagccg

SEQ ID NO: 1323381 - RNA, 14 nt, Mycobacterium tuberculosis H37Rv
auuccgggccuggc

SEQ ID NO: 1323382 - RNA, 21 nt, Mycobacterium tuberculosis H37Rv
auuccucaaggucggccaggc

SEQ ID NO: 1323383 - RNA, 18 nt, Mycobacterium tuberculosis H37Rv
auuccucaaggucggcca

SEQ ID NO: 1323384 - RNA, 15 nt, Mycobacterium tuberculosis H37Rv
auuccccagccgcau

SEQ ID NO: 1323385 - RNA, 13 nt, Mycobacterium tuberculosis H37Rv
auucccgcuuggc

SEQ ID NO: 1323386 - RNA, 18 nt, Mycobacterium tuberculosis H37Rv
auucccgccuucucccgc

SEQ ID NO: 1323387 - RNA, 18 nt, Mycobacterium tuberculosis H37Rv
auucccgcccagcagcac

SEQ ID NO: 1323388 - RNA, 13 nt, Mycobacterium tuberculosis H37Rv
aucugguggaccu

SEQ ID NO: 1323389 - RNA, 17 nt, Mycobacterium tuberculosis H37Rv
aucugguccagugggau

SEQ ID NO: 1323390 - RNA, 20 nt, Mycobacterium tuberculosis H37Rv
aucugguugaaccgguacaa

SEQ ID NO: 1323391 - RNA, 23 nt, Mycobacterium tuberculosis H37Rv
aucugcuccucggucagcggggu

SEQ ID NO: 1323392 - RNA, 13 nt, Mycobacterium tuberculosis H37Rv
aucugcuccucgg

SEQ ID NO: 1323393 - RNA, 20 nt, Mycobacterium tuberculosis H37Rv
aucuggaugucccaugcacg

SEQ ID NO: 1323394 - RNA, 13 nt, Mycobacterium tuberculosis H37Rv
aucuuggccagca

SEQ ID NO: 1323395 - RNA, 22 nt, Mycobacterium tuberculosis H37Rv
aucuuggcgcgguccuccagau

SEQ ID NO: 1323396 - RNA, 14 nt, Mycobacterium tuberculosis H37Rv
aucuugggccacgc

SEQ ID NO: 1323397 - RNA, 15 nt, Mycobacterium tuberculosis H37Rv
aucuuggugggaagc

SEQ ID NO: 1323398 - RNA, 12 nt, Mycobacterium tuberculosis H37Rv
aucuugguguug

SEQ ID NO: 1323399 - RNA, 16 nt, Mycobacterium tuberculosis H37Rv
aucuugguguuggugg

SEQ ID NO: 1323400 - RNA, 14 nt, Mycobacterium tuberculosis H37Rv
aucuugugccaggc

SEQ ID NO: 1323401 - RNA, 17 nt, Mycobacterium tuberculosis H37Rv
aucuugucgaucugccc

SEQ ID NO: 1323402 - RNA, 18 nt, Mycobacterium tuberculosis H37Rv
aucuugccgucggccggc

SEQ ID NO: 1323403 - RNA, 15 nt, Mycobacterium tuberculosis H37Rv
aucuugcgcaaugcc

SEQ ID NO: 1323404 - RNA, 15 nt, Mycobacterium tuberculosis H37Rv
aucuugccggccagc

SEQ ID NO: 1323405 - RNA, 15 nt, Mycobacterium tuberculosis H37Rv
aucuuuggcggccgc

SEQ ID NO: 1323406 - RNA, 14 nt, Mycobacterium tuberculosis H37Rv
augaccgccagcag

SEQ ID NO: 1323407 - RNA, 14 nt, Mycobacterium tuberculosis H37Rv
augacccacacacc

SEQ ID NO: 1323408 - RNA, 22 nt, Mycobacterium tuberculosis H37Rv
augacaaaccugcaugcccaga

SEQ ID NO: 1323409 - RNA, 15 nt, Mycobacterium tuberculosis H37Rv
augacaaagaagugg

SEQ ID NO: 1323410 - RNA, 15 nt, Mycobacterium tuberculosis H37Rv
augaacgccagcagc

SEQ ID NO: 1323411 - RNA, 17 nt, Mycobacterium tuberculosis H37Rv
augaaccacggcaggca

SEQ ID NO: 1323412 - RNA, 22 nt, Mycobacterium tuberculosis H37Rv
augaaccacggcaggcagggca

SEQ ID NO: 1323413 - RNA, 17 nt, Mycobacterium tuberculosis H37Rv
augaaccgggcagcaaa

SEQ ID NO: 1323414 - RNA, 13 nt, Mycobacterium tuberculosis H37Rv
augauaauuccag

SEQ ID NO: 1323415 - RNA, 19 nt, Mycobacterium tuberculosis H37Rv
augacucggccgcaccagc

SEQ ID NO: 1323416 - RNA, 16 nt, Mycobacterium tuberculosis H37Rv
augacguugcagccgg

SEQ ID NO: 1323417 - RNA, 20 nt, Mycobacterium tuberculosis H37Rv
augacgugaguuucaccacu

SEQ ID NO: 1323418 - RNA, 21 nt, Mycobacterium tuberculosis H37Rv
augagcgcucgggcaaccgga

SEQ ID NO: 1323419 - RNA, 17 nt, Mycobacterium tuberculosis H37Rv
augagcaugcccagcgc

SEQ ID NO: 1323420 - RNA, 17 nt, Mycobacterium tuberculosis H37Rv
augagccgcagaugcac

SEQ ID NO: 1323421 - RNA, 17 nt, Mycobacterium tuberculosis H37Rv
augagccggaugucacg

SEQ ID NO: 1323422 - RNA, 20 nt, Mycobacterium tuberculosis H37Rv
augaucucggcgaacgcgaa

SEQ ID NO: 1323423 - RNA, 18 nt, Mycobacterium tuberculosis H37Rv
augauguuuuccccgccc

SEQ ID NO: 1323424 - RNA, 19 nt, Mycobacterium tuberculosis H37Rv
augaucccgccaccgaaca

SEQ ID NO: 1323425 - RNA, 13 nt, Mycobacterium tuberculosis H37Rv
augaucaugaacg

SEQ ID NO: 1323426 - RNA, 14 nt, Mycobacterium tuberculosis H37Rv
augaucucaccacg

SEQ ID NO: 1323427 - RNA, 15 nt, Mycobacterium tuberculosis H37Rv
augaucgcgccgggc

SEQ ID NO: 1323428 - RNA, 20 nt, Mycobacterium tuberculosis H37Rv
augaucgcgaacaucgccag

SEQ ID NO: 1323429 - RNA, 14 nt, Mycobacterium tuberculosis H37Rv
augcacgccgggca

SEQ ID NO: 1323430 - RNA, 17 nt, Mycobacterium tuberculosis H37Rv
augcaccucgcccugca

SEQ ID NO: 1323431 - RNA, 20 nt, Mycobacterium tuberculosis H37Rv
augcaccucgcccugcagac

SEQ ID NO: 1323432 - RNA, 18 nt, Mycobacterium tuberculosis H37Rv
augcauccagcugcugcc

SEQ ID NO: 1323433 - RNA, 13 nt, Mycobacterium tuberculosis H37Rv
auggcgucggcca

SEQ ID NO: 1323434 - RNA, 16 nt, Mycobacterium tuberculosis H37Rv
auggcgucggccagga

SEQ ID NO: 1323435 - RNA, 14 nt, Mycobacterium tuberculosis H37Rv
auggcgccuguccu

SEQ ID NO: 1323436 - RNA, 16 nt, Mycobacterium tuberculosis H37Rv
auggcgccgcggcugg

SEQ ID NO: 1323437 - RNA, 22 nt, Mycobacterium tuberculosis H37Rv
auggcgagcguuuggacgggcg

SEQ ID NO: 1323438 - RNA, 19 nt, Mycobacterium tuberculosis H37Rv
auggccgaacauucccaug

SEQ ID NO: 1323439 - RNA, 12 nt, Mycobacterium tuberculosis H37Rv
auggccgucagc

SEQ ID NO: 1323440 - RNA, 21 nt, Mycobacterium tuberculosis H37Rv
auggccgaccagccgaucauc

SEQ ID NO: 1323441 - RNA, 13 nt, Mycobacterium tuberculosis H37Rv
auggccgccgaca

SEQ ID NO: 1323442 - RNA, 11 nt, Mycobacterium tuberculosis H37Rv
auggccgccga

SEQ ID NO: 1323443 - RNA, 17 nt, Mycobacterium tuberculosis H37Rv
auggccccugucauguc

SEQ ID NO: 1323444 - RNA, 17 nt, Mycobacterium tuberculosis H37Rv
auggccccgggcgguga

SEQ ID NO: 1323445 - RNA, 21 nt, Mycobacterium tuberculosis H37Rv
auggauuggcgucagcagcaa

SEQ ID NO: 1323446 - RNA, 21 nt, Mycobacterium tuberculosis H37Rv
auggcaaccagcuucucagca

SEQ ID NO: 1323447 - RNA, 14 nt, Mycobacterium tuberculosis H37Rv
auggugauggggga

SEQ ID NO: 1323448 - RNA, 21 nt, Mycobacterium tuberculosis H37Rv
auggugaccagcaggccgggc

SEQ ID NO: 1323449 - RNA, 22 nt, Mycobacterium tuberculosis H37Rv
auggugaaguugccggucaggc

SEQ ID NO: 1323450 - RNA, 15 nt, Mycobacterium tuberculosis H37Rv
augguggccgccacc

SEQ ID NO: 1323451 - RNA, 20 nt, Mycobacterium tuberculosis H37Rv
augguucgcacaccuccucg

SEQ ID NO: 1323452 - RNA, 22 nt, Mycobacterium tuberculosis H37Rv
augguuccguugaugccgccgg

SEQ ID NO: 1323453 - RNA, 15 nt, Mycobacterium tuberculosis H37Rv
auggcuugcucugcg

SEQ ID NO: 1323454 - RNA, 15 nt, Mycobacterium tuberculosis H37Rv
augggucaccucgga

SEQ ID NO: 1323455 - RNA, 22 nt, Mycobacterium tuberculosis H37Rv
augguaugcccgccguagacca

SEQ ID NO: 1323456 - RNA, 21 nt, Mycobacterium tuberculosis H37Rv
augucgcugccgccgccggcg

SEQ ID NO: 1323457 - RNA, 12 nt, Mycobacterium tuberculosis H37Rv
augucggccacc

SEQ ID NO: 1323458 - RNA, 17 nt, Mycobacterium tuberculosis H37Rv
augucggcugguggggg

SEQ ID NO: 1323459 - RNA, 14 nt, Mycobacterium tuberculosis H37Rv
augucgggccaggc

SEQ ID NO: 1323460 - RNA, 17 nt, Mycobacterium tuberculosis H37Rv
augucagugccccgccc

SEQ ID NO: 1323461 - RNA, 20 nt, Mycobacterium tuberculosis H37Rv
augucgauuucgaugacgaa

SEQ ID NO: 1323462 - RNA, 14 nt, Mycobacterium tuberculosis H37Rv
augucgaugacgaa

SEQ ID NO: 1323463 - RNA, 21 nt, Mycobacterium tuberculosis H37Rv
augucgccgcccacaugaacg

SEQ ID NO: 1323464 - RNA, 20 nt, Mycobacterium tuberculosis H37Rv
augucacggaugugcucagg

SEQ ID NO: 1323465 - RNA, 18 nt, Mycobacterium tuberculosis H37Rv
augucagcggccugcucg

SEQ ID NO: 1323466 - RNA, 18 nt, Mycobacterium tuberculosis H37Rv
augucaaguucgccagca

SEQ ID NO: 1323467 - RNA, 14 nt, Mycobacterium tuberculosis H37Rv
augucacccucccg

SEQ ID NO: 1323468 - RNA, 18 nt, Mycobacterium tuberculosis H37Rv
augucaacgcccagcucg

SEQ ID NO: 1323469 - RNA, 14 nt, Mycobacterium tuberculosis H37Rv
auguggucggcugu

SEQ ID NO: 1323470 - RNA, 14 nt, Mycobacterium tuberculosis H37Rv
augugcgccaccuc

SEQ ID NO: 1323471 - RNA, 18 nt, Mycobacterium tuberculosis H37Rv
augugcccggcucucagc

SEQ ID NO: 1323472 - RNA, 20 nt, Mycobacterium tuberculosis H37Rv
augugccgauuggccugcca

SEQ ID NO: 1323473 - RNA, 21 nt, Mycobacterium tuberculosis H37Rv
augugcggugaccgugaacgg

SEQ ID NO: 1323474 - RNA, 21 nt, Mycobacterium tuberculosis H37Rv
augucuaccaacaccgcccgc

SEQ ID NO: 1323475 - RNA, 20 nt, Mycobacterium tuberculosis H37Rv
augucuaccaacaccgcccg

SEQ ID NO: 1323476 - RNA, 21 nt, Mycobacterium tuberculosis H37Rv
auguucgaaagcaccgaugcu

SEQ ID NO: 1323477 - RNA, 20 nt, Mycobacterium tuberculosis H37Rv
auggacggcagccagccacc

SEQ ID NO: 1323478 - RNA, 14 nt, Mycobacterium tuberculosis H37Rv
auggacaccaaccc

SEQ ID NO: 1323479 - RNA, 17 nt, Mycobacterium tuberculosis H37Rv
auggacaccaacccacc

SEQ ID NO: 1323480 - RNA, 13 nt, Mycobacterium tuberculosis H37Rv
auggacaccaacc

SEQ ID NO: 1323481 - RNA, 18 nt, Mycobacterium tuberculosis H37Rv
auggagccgcgaccaugg

SEQ ID NO: 1323482 - RNA, 19 nt, Mycobacterium tuberculosis H37Rv
auggaaaacgccaugccgg

SEQ ID NO: 1323483 - RNA, 15 nt, Mycobacterium tuberculosis H37Rv
auggacaacagcuug

SEQ ID NO: 1323484 - RNA, 14 nt, Mycobacterium tuberculosis H37Rv
auggaaggcggcca

SEQ ID NO: 1323485 - RNA, 13 nt, Mycobacterium tuberculosis H37Rv
augcugccagcca

SEQ ID NO: 1323486 - RNA, 18 nt, Mycobacterium tuberculosis H37Rv
augcugccagccauggcc

SEQ ID NO: 1323487 - RNA, 14 nt, Mycobacterium tuberculosis H37Rv
augcuggcagcucg

SEQ ID NO: 1323488 - RNA, 23 nt, Mycobacterium tuberculosis H37Rv
augcuggagaaaccacuggaugg

SEQ ID NO: 1323489 - RNA, 23 nt, Mycobacterium tuberculosis H37Rv
augcugggcccgccagcccagca

SEQ ID NO: 1323490 - RNA, 20 nt, Mycobacterium tuberculosis H37Rv
augcuuguguucgugguugu

SEQ ID NO: 1323491 - RNA, 15 nt, Mycobacterium tuberculosis H37Rv
augcucgacaaccac

SEQ ID NO: 1323492 - RNA, 18 nt, Mycobacterium tuberculosis H37Rv
augcucgccguugauguc

SEQ ID NO: 1323493 - RNA, 15 nt, Mycobacterium tuberculosis H37Rv
augcucacgaucacc

SEQ ID NO: 1323494 - RNA, 14 nt, Mycobacterium tuberculosis H37Rv
augcguucggccgg

SEQ ID NO: 1323495 - RNA, 21 nt, Mycobacterium tuberculosis H37Rv
augcgucugcucgcccucaga

SEQ ID NO: 1323496 - RNA, 15 nt, Mycobacterium tuberculosis H37Rv
augcgggcgccccac

SEQ ID NO: 1323497 - RNA, 19 nt, Mycobacterium tuberculosis H37Rv
augcgggccgccaggcggc

SEQ ID NO: 1323498 - RNA, 17 nt, Mycobacterium tuberculosis H37Rv
augcgggaaacccaugc

SEQ ID NO: 1323499 - RNA, 15 nt, Mycobacterium tuberculosis H37Rv
augcggucggccaca

SEQ ID NO: 1323500 - RNA, 19 nt, Mycobacterium tuberculosis H37Rv
augcggguaaaccaggugg

SEQ ID NO: 1323501 - RNA, 13 nt, Mycobacterium tuberculosis H37Rv
augcggucccucc

SEQ ID NO: 1323502 - RNA, 16 nt, Mycobacterium tuberculosis H37Rv
augcgguuagcagccg

SEQ ID NO: 1323503 - RNA, 20 nt, Mycobacterium tuberculosis H37Rv
augcgaucgacgauccacuu

SEQ ID NO: 1323504 - RNA, 18 nt, Mycobacterium tuberculosis H37Rv
augcgacgucaggguauc

SEQ ID NO: 1323505 - RNA, 18 nt, Mycobacterium tuberculosis H37Rv
augcgacagcgcugggcc

SEQ ID NO: 1323506 - RNA, 18 nt, Mycobacterium tuberculosis H37Rv
augcgccaggcugaagaa

SEQ ID NO: 1323507 - RNA, 16 nt, Mycobacterium tuberculosis H37Rv
augcgcguccccagcg

SEQ ID NO: 1323508 - RNA, 20 nt, Mycobacterium tuberculosis H37Rv
augcgcugcucacgcagcag

SEQ ID NO: 1323509 - RNA, 18 nt, Mycobacterium tuberculosis H37Rv
augcgcuggcgccgccgg

SEQ ID NO: 1323510 - RNA, 14 nt, Mycobacterium tuberculosis H37Rv
augcgcuaggugcg

SEQ ID NO: 1323511 - RNA, 23 nt, Mycobacterium tuberculosis H37Rv
augcggcccucgaauucggccgg

SEQ ID NO: 1323512 - RNA, 18 nt, Mycobacterium tuberculosis H37Rv
augcgcuuccaucgccac

SEQ ID NO: 1323513 - RNA, 23 nt, Mycobacterium tuberculosis H37Rv
augcggaaagccccuccggccgu

SEQ ID NO: 1323514 - RNA, 15 nt, Mycobacterium tuberculosis H37Rv
augcggaaaucggac

SEQ ID NO: 1323515 - RNA, 22 nt, Mycobacterium tuberculosis H37Rv
aucaggccuugggauaggccgu

SEQ ID NO: 1323516 - RNA, 18 nt, Mycobacterium tuberculosis H37Rv
aucagguacgccaggugc

SEQ ID NO: 1323517 - RNA, 20 nt, Mycobacterium tuberculosis H37Rv
aucaggugagaccagguucu

SEQ ID NO: 1323518 - RNA, 23 nt, Mycobacterium tuberculosis H37Rv
aucaggugcgccuggcuggccag

SEQ ID NO: 1323519 - RNA, 21 nt, Mycobacterium tuberculosis H37Rv
aucaggucuucgauggccaug

SEQ ID NO: 1323520 - RNA, 21 nt, Mycobacterium tuberculosis H37Rv
aucagugaagacaccaggccc

SEQ ID NO: 1323521 - RNA, 15 nt, Mycobacterium tuberculosis H37Rv
aucagugcagcgugg

SEQ ID NO: 1323522 - RNA, 20 nt, Mycobacterium tuberculosis H37Rv
aucaguccggcguucccgcc

SEQ ID NO: 1323523 - RNA, 17 nt, Mycobacterium tuberculosis H37Rv
aucaguuccuguagccg

SEQ ID NO: 1323524 - RNA, 18 nt, Mycobacterium tuberculosis H37Rv
aucaguucccgaaccccg

SEQ ID NO: 1323525 - RNA, 16 nt, Mycobacterium tuberculosis H37Rv
aucaguucccgaaccc

SEQ ID NO: 1323526 - RNA, 16 nt, Mycobacterium tuberculosis H37Rv
aucaucuggucgacca

SEQ ID NO: 1323527 - RNA, 21 nt, Mycobacterium tuberculosis H37Rv
aucaucucgguggacggcagg

SEQ ID NO: 1323528 - RNA, 14 nt, Mycobacterium tuberculosis H37Rv
aucaucgcuuggcc

SEQ ID NO: 1323529 - RNA, 23 nt, Mycobacterium tuberculosis H37Rv
aucaucauauccgccccagcugc

SEQ ID NO: 1323530 - RNA, 12 nt, Mycobacterium tuberculosis H37Rv
aucauguggugg

SEQ ID NO: 1323531 - RNA, 16 nt, Mycobacterium tuberculosis H37Rv
aucaugugguggcgcc

SEQ ID NO: 1323532 - RNA, 13 nt, Mycobacterium tuberculosis H37Rv
aucaugucggccg

SEQ ID NO: 1323533 - RNA, 20 nt, Mycobacterium tuberculosis H37Rv
aucauggugaaggcaaacac

SEQ ID NO: 1323534 - RNA, 16 nt, Mycobacterium tuberculosis H37Rv
aucauggauaauccau

SEQ ID NO: 1323535 - RNA, 23 nt, Mycobacterium tuberculosis H37Rv
aucauggcgagcguuuggacggg

SEQ ID NO: 1323536 - RNA, 14 nt, Mycobacterium tuberculosis H37Rv
aucaugaacgccag

SEQ ID NO: 1323537 - RNA, 15 nt, Mycobacterium tuberculosis H37Rv
aucaugaacgccagc

SEQ ID NO: 1323538 - RNA, 18 nt, Mycobacterium tuberculosis H37Rv
aucaugaacgccagcagc

SEQ ID NO: 1323539 - RNA, 12 nt, Mycobacterium tuberculosis H37Rv
aucaugaccauc

SEQ ID NO: 1323540 - RNA, 21 nt, Mycobacterium tuberculosis H37Rv
auccacaccggauaggugguc

SEQ ID NO: 1323541 - RNA, 15 nt, Mycobacterium tuberculosis H37Rv
auccaaggcucagca

SEQ ID NO: 1323542 - RNA, 18 nt, Mycobacterium tuberculosis H37Rv
auccaaggcucagcagcg

SEQ ID NO: 1323543 - RNA, 13 nt, Mycobacterium tuberculosis H37Rv
auccacugcggcg

SEQ ID NO: 1323544 - RNA, 21 nt, Mycobacterium tuberculosis H37Rv
auccacggcgaugcagccaca

SEQ ID NO: 1323545 - RNA, 18 nt, Mycobacterium tuberculosis H37Rv
auccagaaguaggcgacc

SEQ ID NO: 1323546 - RNA, 21 nt, Mycobacterium tuberculosis H37Rv
auccaugauggccgucagcca

SEQ ID NO: 1323547 - RNA, 19 nt, Mycobacterium tuberculosis H37Rv
aucccagauaugcaggacu

SEQ ID NO: 1323548 - RNA, 15 nt, Mycobacterium tuberculosis H37Rv
aucccaggggcaccg

SEQ ID NO: 1323549 - RNA, 21 nt, Mycobacterium tuberculosis H37Rv
aucccaggggcaccgagcuga

SEQ ID NO: 1323550 - RNA, 16 nt, Mycobacterium tuberculosis H37Rv
aucccagcccgaaggu

SEQ ID NO: 1323551 - RNA, 14 nt, Mycobacterium tuberculosis H37Rv
aucccaacuccucc

SEQ ID NO: 1323552 - RNA, 15 nt, Mycobacterium tuberculosis H37Rv
aucccaacgcccggg

SEQ ID NO: 1323553 - RNA, 22 nt, Mycobacterium tuberculosis H37Rv
auccagggccgacgcgaaccca

SEQ ID NO: 1323554 - RNA, 21 nt, Mycobacterium tuberculosis H37Rv
auccaggggcgcaacucaucg

SEQ ID NO: 1323555 - RNA, 19 nt, Mycobacterium tuberculosis H37Rv
auccaggcuguggccagca

SEQ ID NO: 1323556 - RNA, 13 nt, Mycobacterium tuberculosis H37Rv
auccccagcacaa

SEQ ID NO: 1323557 - RNA, 13 nt, Mycobacterium tuberculosis H37Rv
auccccagcacca

SEQ ID NO: 1323558 - RNA, 18 nt, Mycobacterium tuberculosis H37Rv
aucccgacgaagguggca

SEQ ID NO: 1323559 - RNA, 15 nt, Mycobacterium tuberculosis H37Rv
aucccgaccagcaga

SEQ ID NO: 1323560 - RNA, 20 nt, Mycobacterium tuberculosis H37Rv
aucccguucagcgaccaaug

SEQ ID NO: 1323561 - RNA, 21 nt, Mycobacterium tuberculosis H37Rv
aucccguauugauacugcccg

SEQ ID NO: 1323562 - RNA, 22 nt, Mycobacterium tuberculosis H37Rv
aucccggucuuuaauccagcgc

SEQ ID NO: 1323563 - RNA, 14 nt, Mycobacterium tuberculosis H37Rv
aucccggccaggcc

SEQ ID NO: 1323564 - RNA, 19 nt, Mycobacterium tuberculosis H37Rv
aucccgccaucugccugcc

SEQ ID NO: 1323565 - RNA, 17 nt, Mycobacterium tuberculosis H37Rv
aucccgaucccggccag

SEQ ID NO: 1323566 - RNA, 19 nt, Mycobacterium tuberculosis H37Rv
aucccgaucgaucagcaac

SEQ ID NO: 1323567 - RNA, 20 nt, Mycobacterium tuberculosis H37Rv
auccggaauagcaacgcugc

SEQ ID NO: 1323568 - RNA, 21 nt, Mycobacterium tuberculosis H37Rv
auccggaucccaccaccgcuc

SEQ ID NO: 1323569 - RNA, 13 nt, Mycobacterium tuberculosis H37Rv
auccggaucggcc

SEQ ID NO: 1323570 - RNA, 18 nt, Mycobacterium tuberculosis H37Rv
auccgcgguuggcagugg

SEQ ID NO: 1323571 - RNA, 13 nt, Mycobacterium tuberculosis H37Rv
auccgcggcaugc

SEQ ID NO: 1323572 - RNA, 14 nt, Mycobacterium tuberculosis H37Rv
auccgcuguuccuc

SEQ ID NO: 1323573 - RNA, 19 nt, Mycobacterium tuberculosis H37Rv
auccgcccuaaugaagccg

SEQ ID NO: 1323574 - RNA, 19 nt, Mycobacterium tuberculosis H37Rv
auccgccgcccccgcccgu

SEQ ID NO: 1323575 - RNA, 12 nt, Mycobacterium tuberculosis H37Rv
auccgccgccgg

SEQ ID NO: 1323576 - RNA, 15 nt, Mycobacterium tuberculosis H37Rv
auccgcaggcccgcc

SEQ ID NO: 1323577 - RNA, 13 nt, Mycobacterium tuberculosis H37Rv
auccgccagaccg

SEQ ID NO: 1323578 - RNA, 20 nt, Mycobacterium tuberculosis H37Rv
auccgacgaccgcauugaac

SEQ ID NO: 1323579 - RNA, 16 nt, Mycobacterium tuberculosis H37Rv
auccgacgaaccggga

SEQ ID NO: 1323580 - RNA, 13 nt, Mycobacterium tuberculosis H37Rv
auccgaccugcuc

SEQ ID NO: 1323581 - RNA, 13 nt, Mycobacterium tuberculosis H37Rv
auccgaccacucc

SEQ ID NO: 1323582 - RNA, 18 nt, Mycobacterium tuberculosis H37Rv
auccgugugucuugaccu

SEQ ID NO: 1323583 - RNA, 21 nt, Mycobacterium tuberculosis H37Rv
auccgugaauggcagcacgac

SEQ ID NO: 1323584 - RNA, 15 nt, Mycobacterium tuberculosis H37Rv
auccgguguugagau

SEQ ID NO: 1323585 - RNA, 13 nt, Mycobacterium tuberculosis H37Rv
auccgguguugag

SEQ ID NO: 1323586 - RNA, 17 nt, Mycobacterium tuberculosis H37Rv
auccggucggccaggcc

SEQ ID NO: 1323587 - RNA, 18 nt, Mycobacterium tuberculosis H37Rv
auccgguaggccaucugc

SEQ ID NO: 1323588 - RNA, 18 nt, Mycobacterium tuberculosis H37Rv
auccuccugcgccgcagu

SEQ ID NO: 1323589 - RNA, 15 nt, Mycobacterium tuberculosis H37Rv
auccugaccagccag

SEQ ID NO: 1323590 - RNA, 19 nt, Mycobacterium tuberculosis H37Rv
auccugguggcagacaugg

SEQ ID NO: 1323591 - RNA, 19 nt, Mycobacterium tuberculosis H37Rv
auccuggcggcugcagccg

SEQ ID NO: 1323592 - RNA, 19 nt, Mycobacterium tuberculosis H37Rv
aucgucaggaaccacccac

SEQ ID NO: 1323593 - RNA, 23 nt, Mycobacterium tuberculosis H37Rv
aucggcugguuacucaccaaccg

SEQ ID NO: 1323594 - RNA, 18 nt, Mycobacterium tuberculosis H37Rv
aucggcuaggccggccgg

SEQ ID NO: 1323595 - RNA, 23 nt, Mycobacterium tuberculosis H37Rv
aucgguuguggucagcugcugcc

SEQ ID NO: 1323596 - RNA, 15 nt, Mycobacterium tuberculosis H37Rv
aucggcuaggccggc

SEQ ID NO: 1323597 - RNA, 20 nt, Mycobacterium tuberculosis H37Rv
aucggcguuaucgaaggcga

SEQ ID NO: 1323598 - RNA, 18 nt, Mycobacterium tuberculosis H37Rv
aucguuguugaccaccac

SEQ ID NO: 1323599 - RNA, 21 nt, Mycobacterium tuberculosis H37Rv
aucgucggguaccagcaccga

SEQ ID NO: 1323600 - RNA, 19 nt, Mycobacterium tuberculosis H37Rv
aucgucgugucgccgccgu

SEQ ID NO: 1323601 - RNA, 22 nt, Mycobacterium tuberculosis H37Rv
aucgucugacgaaauccgccgg

SEQ ID NO: 1323602 - RNA, 18 nt, Mycobacterium tuberculosis H37Rv
aucgugaaaguaagccgc

SEQ ID NO: 1323603 - RNA, 20 nt, Mycobacterium tuberculosis H37Rv
aucgugacguuguaggagaa

SEQ ID NO: 1323604 - RNA, 19 nt, Mycobacterium tuberculosis H37Rv
aucgccucggcgcugcgca

SEQ ID NO: 1323605 - RNA, 22 nt, Mycobacterium tuberculosis H37Rv
aucgcgaaacagcuugcugcgc

SEQ ID NO: 1323606 - RNA, 13 nt, Mycobacterium tuberculosis H37Rv
aucgcuguaggca

SEQ ID NO: 1323607 - RNA, 14 nt, Mycobacterium tuberculosis H37Rv
aucgcugccgccga

SEQ ID NO: 1323608 - RNA, 13 nt, Mycobacterium tuberculosis H37Rv
aucgcugccagcg

SEQ ID NO: 1323609 - RNA, 21 nt, Mycobacterium tuberculosis H37Rv
aucgcucucggucaguuccuc

SEQ ID NO: 1323610 - RNA, 14 nt, Mycobacterium tuberculosis H37Rv
aucgcuucgagcau

SEQ ID NO: 1323611 - RNA, 12 nt, Mycobacterium tuberculosis H37Rv
aucggaagaaac

SEQ ID NO: 1323612 - RNA, 12 nt, Mycobacterium tuberculosis H37Rv
aucggcaccccg

SEQ ID NO: 1323613 - RNA, 21 nt, Mycobacterium tuberculosis H37Rv
aucggcaccccacgccugccg

SEQ ID NO: 1323614 - RNA, 14 nt, Mycobacterium tuberculosis H37Rv
aucggcaccgugcg

SEQ ID NO: 1323615 - RNA, 12 nt, Mycobacterium tuberculosis H37Rv
aucggcagcagg

SEQ ID NO: 1323616 - RNA, 15 nt, Mycobacterium tuberculosis H37Rv
aucggcagccccugc

SEQ ID NO: 1323617 - RNA, 18 nt, Mycobacterium tuberculosis H37Rv
aucggcaggguggccagc

SEQ ID NO: 1323618 - RNA, 21 nt, Mycobacterium tuberculosis H37Rv
aucgccgcgaagcgcucggca

SEQ ID NO: 1323619 - RNA, 11 nt, Mycobacterium tuberculosis H37Rv
aucgccgccgc

SEQ ID NO: 1323620 - RNA, 13 nt, Mycobacterium tuberculosis H37Rv
aucgccgacggcg

SEQ ID NO: 1323621 - RNA, 17 nt, Mycobacterium tuberculosis H37Rv
aucgccgcuacgccggc

SEQ ID NO: 1323622 - RNA, 16 nt, Mycobacterium tuberculosis H37Rv
aucgcccaacaacgcu

SEQ ID NO: 1323623 - RNA, 14 nt, Mycobacterium tuberculosis H37Rv
aucgccaggcccug

SEQ ID NO: 1323624 - RNA, 21 nt, Mycobacterium tuberculosis H37Rv
aucgccaggccgagcccggug

SEQ ID NO: 1323625 - RNA, 22 nt, Mycobacterium tuberculosis H37Rv
aucgccacuguugaagaagccc

SEQ ID NO: 1323626 - RNA, 16 nt, Mycobacterium tuberculosis H37Rv
aucgacggcggccuuc

SEQ ID NO: 1323627 - RNA, 22 nt, Mycobacterium tuberculosis H37Rv
aucgauccggcuccacccccac

SEQ ID NO: 1323628 - RNA, 19 nt, Mycobacterium tuberculosis H37Rv
aucgccacgacaggucgcc

SEQ ID NO: 1323629 - RNA, 18 nt, Mycobacterium tuberculosis H37Rv
auccuugacgcggccaca

SEQ ID NO: 1323630 - RNA, 13 nt, Mycobacterium tuberculosis H37Rv
auccuugccaauc

SEQ ID NO: 1323631 - RNA, 18 nt, Mycobacterium tuberculosis H37Rv
auccuugccaaucgccgu

SEQ ID NO: 1323632 - RNA, 18 nt, Mycobacterium tuberculosis H37Rv
auccuucgcgcucauugc

SEQ ID NO: 1323633 - RNA, 16 nt, Mycobacterium tuberculosis H37Rv
auccuugacgcggcca

SEQ ID NO: 1323634 - RNA, 17 nt, Mycobacterium tuberculosis H37Rv
aucgacccuccagcacg

SEQ ID NO: 1323635 - RNA, 14 nt, Mycobacterium tuberculosis H37Rv
aucgaaccgcugcu

SEQ ID NO: 1323636 - RNA, 15 nt, Mycobacterium tuberculosis H37Rv
aucgaagcggcugcu

SEQ ID NO: 1323637 - RNA, 21 nt, Mycobacterium tuberculosis H37Rv
aucgaacgucucggccagcuc

SEQ ID NO: 1323638 - RNA, 21 nt, Mycobacterium tuberculosis H37Rv
aucgaauugcguucgccgccc

SEQ ID NO: 1323639 - RNA, 19 nt, Mycobacterium tuberculosis H37Rv
auagaacucgccgcuggca

SEQ ID NO: 1323640 - RNA, 19 nt, Mycobacterium tuberculosis H37Rv
auagacgaccccggugagc

SEQ ID NO: 1323641 - RNA, 21 nt, Mycobacterium tuberculosis H37Rv
auagacuagccgauccagcag

SEQ ID NO: 1323642 - RNA, 20 nt, Mycobacterium tuberculosis H37Rv
auagccgaccagguagacca

SEQ ID NO: 1323643 - RNA, 19 nt, Mycobacterium tuberculosis H37Rv
auagccggacaacuggugg

SEQ ID NO: 1323644 - RNA, 13 nt, Mycobacterium tuberculosis H37Rv
auagccgaacagc

SEQ ID NO: 1323645 - RNA, 16 nt, Mycobacterium tuberculosis H37Rv
auaccgugcaccucca

SEQ ID NO: 1323646 - RNA, 18 nt, Mycobacterium tuberculosis H37Rv
auaccgugcaccuccagg

SEQ ID NO: 1323647 - RNA, 16 nt, Mycobacterium tuberculosis H37Rv
auaccgaggaucucgc

SEQ ID NO: 1323648 - RNA, 15 nt, Mycobacterium tuberculosis H37Rv
auacccgcuggcccg

SEQ ID NO: 1323649 - RNA, 21 nt, Mycobacterium tuberculosis H37Rv
auaccagcguuugaacgcaug

SEQ ID NO: 1323650 - RNA, 17 nt, Mycobacterium tuberculosis H37Rv
auaccagggcaucagca

SEQ ID NO: 1323651 - RNA, 17 nt, Mycobacterium tuberculosis H37Rv
auacagaucuggguucc

SEQ ID NO: 1323652 - RNA, 23 nt, Mycobacterium tuberculosis H37Rv
auacaggccacgcaccgggugca

SEQ ID NO: 1323653 - RNA, 21 nt, Mycobacterium tuberculosis H37Rv
auauagccggugucugggugg

SEQ ID NO: 1323654 - RNA, 22 nt, Mycobacterium tuberculosis H37Rv
auaucgucgggcgucccggcgg

SEQ ID NO: 1323655 - RNA, 16 nt, Mycobacterium tuberculosis H37Rv
auaucggcacggucac

SEQ ID NO: 1323656 - RNA, 23 nt, Mycobacterium tuberculosis H37Rv
auaucggcacggucacacgccag

SEQ ID NO: 1323657 - RNA, 20 nt, Mycobacterium tuberculosis H37Rv
auauccgggagugcgccggc

SEQ ID NO: 1323658 - RNA, 17 nt, Mycobacterium tuberculosis H37Rv
auauggaccgccgccga

SEQ ID NO: 1323659 - RNA, 13 nt, Mycobacterium tuberculosis H37Rv
auauggaucaacg

SEQ ID NO: 1323660 - RNA, 12 nt, Mycobacterium tuberculosis H37Rv
auaugccgccgg

SEQ ID NO: 1323661 - RNA, 16 nt, Mycobacterium tuberculosis H37Rv
auaugacggcagacca

SEQ ID NO: 1323662 - RNA, 22 nt, Mycobacterium tuberculosis H37Rv
auauggucaccggacugcgccg

SEQ ID NO: 1323663 - RNA, 16 nt, Mycobacterium tuberculosis H37Rv
auauuggacgcgcaug

SEQ ID NO: 1323664 - RNA, 14 nt, Mycobacterium tuberculosis H37Rv
aucaacaggcgucc

SEQ ID NO: 1323665 - RNA, 14 nt, Mycobacterium tuberculosis H37Rv
aucaaagccagcac

SEQ ID NO: 1323666 - RNA, 15 nt, Mycobacterium tuberculosis H37Rv
aucaaagccagcacc

SEQ ID NO: 1323667 - RNA, 19 nt, Mycobacterium tuberculosis H37Rv
agcuggcgcgcgggguggc

SEQ ID NO: 1323668 - RNA, 22 nt, Mycobacterium tuberculosis H37Rv
agcuggccgcggcgaguacuga

SEQ ID NO: 1323669 - RNA, 12 nt, Mycobacterium tuberculosis H37Rv
aguacggcaggc

SEQ ID NO: 1323670 - RNA, 16 nt, Mycobacterium tuberculosis H37Rv
aguacgcaagcucaag

SEQ ID NO: 1323671 - RNA, 13 nt, Mycobacterium tuberculosis H37Rv
aguacgcggcuga

SEQ ID NO: 1323672 - RNA, 14 nt, Mycobacterium tuberculosis H37Rv
aguacuggaauggc

SEQ ID NO: 1323673 - RNA, 20 nt, Mycobacterium tuberculosis H37Rv
aguacuggaauggcucacgc

SEQ ID NO: 1323674 - RNA, 20 nt, Mycobacterium tuberculosis H37Rv
aguacugguagaggcggcga

SEQ ID NO: 1323675 - RNA, 18 nt, Mycobacterium tuberculosis H37Rv
aguagccguagccgccgu

SEQ ID NO: 1323676 - RNA, 14 nt, Mycobacterium tuberculosis H37Rv
aguagccguagccg

SEQ ID NO: 1323677 - RNA, 14 nt, Mycobacterium tuberculosis H37Rv
aguagccgcuagga

SEQ ID NO: 1323678 - RNA, 12 nt, Mycobacterium tuberculosis H37Rv
aguagcccgcgu

SEQ ID NO: 1323679 - RNA, 15 nt, Mycobacterium tuberculosis H37Rv
aguagcccgcgucga

SEQ ID NO: 1323680 - RNA, 22 nt, Mycobacterium tuberculosis H37Rv
aguaggccaccacugcgcccgc

SEQ ID NO: 1323681 - RNA, 15 nt, Mycobacterium tuberculosis H37Rv
aguagucgcuggcca

SEQ ID NO: 1323682 - RNA, 16 nt, Mycobacterium tuberculosis H37Rv
aguagucgcuggccag

SEQ ID NO: 1323683 - RNA, 15 nt, Mycobacterium tuberculosis H37Rv
aguaguggccgccac

SEQ ID NO: 1323684 - RNA, 15 nt, Mycobacterium tuberculosis H37Rv
aguagugcaggugcc

SEQ ID NO: 1323685 - RNA, 16 nt, Mycobacterium tuberculosis H37Rv
aguaguggugggcgug

SEQ ID NO: 1323686 - RNA, 18 nt, Mycobacterium tuberculosis H37Rv
agucaccggguccaccgc

SEQ ID NO: 1323687 - RNA, 15 nt, Mycobacterium tuberculosis H37Rv
agucacgcacccggc

SEQ ID NO: 1323688 - RNA, 20 nt, Mycobacterium tuberculosis H37Rv
agucacgcacucccgagcca

SEQ ID NO: 1323689 - RNA, 22 nt, Mycobacterium tuberculosis H37Rv
agucaaucgcgucaucaacguu

SEQ ID NO: 1323690 - RNA, 21 nt, Mycobacterium tuberculosis H37Rv
agucaaucgcgucaucaacgu

SEQ ID NO: 1323691 - RNA, 18 nt, Mycobacterium tuberculosis H37Rv
agucaagauugaccgcgg

SEQ ID NO: 1323692 - RNA, 18 nt, Mycobacterium tuberculosis H37Rv
agucaacaccgcggccga

SEQ ID NO: 1323693 - RNA, 19 nt, Mycobacterium tuberculosis H37Rv
agucaacagggccaggaca

SEQ ID NO: 1323694 - RNA, 18 nt, Mycobacterium tuberculosis H37Rv
agucacggucguggugca

SEQ ID NO: 1323695 - RNA, 17 nt, Mycobacterium tuberculosis H37Rv
aguccccgaaccgagcg

SEQ ID NO: 1323696 - RNA, 15 nt, Mycobacterium tuberculosis H37Rv
aguccgacaccacgg

SEQ ID NO: 1323697 - RNA, 17 nt, Mycobacterium tuberculosis H37Rv
aguccgacaccacggac

SEQ ID NO: 1323698 - RNA, 22 nt, Mycobacterium tuberculosis H37Rv
aguccgagggcgucgccgccgu

SEQ ID NO: 1323699 - RNA, 21 nt, Mycobacterium tuberculosis H37Rv
aguccgaucacccgcacucca

SEQ ID NO: 1323700 - RNA, 19 nt, Mycobacterium tuberculosis H37Rv
aguccgcgccgacggccag

SEQ ID NO: 1323701 - RNA, 15 nt, Mycobacterium tuberculosis H37Rv
aguccgagggcgucg

SEQ ID NO: 1323702 - RNA, 12 nt, Mycobacterium tuberculosis H37Rv
aguccgccgccu

SEQ ID NO: 1323703 - RNA, 22 nt, Mycobacterium tuberculosis H37Rv
aguccucgggcaggcggccagc

SEQ ID NO: 1323704 - RNA, 14 nt, Mycobacterium tuberculosis H37Rv
agucgcuaagacuu

SEQ ID NO: 1323705 - RNA, 16 nt, Mycobacterium tuberculosis H37Rv
agucgaugaccccggu

SEQ ID NO: 1323706 - RNA, 15 nt, Mycobacterium tuberculosis H37Rv
agucgcacugcgccg

SEQ ID NO: 1323707 - RNA, 20 nt, Mycobacterium tuberculosis H37Rv
agucgauuggcugcgccgau

SEQ ID NO: 1323708 - RNA, 18 nt, Mycobacterium tuberculosis H37Rv
agucgauuucggcggcga

SEQ ID NO: 1323709 - RNA, 21 nt, Mycobacterium tuberculosis H37Rv
agucgauuucggcggcgaggc

SEQ ID NO: 1323710 - RNA, 22 nt, Mycobacterium tuberculosis H37Rv
aguccaaucuucucgagccgcc

SEQ ID NO: 1323711 - RNA, 13 nt, Mycobacterium tuberculosis H37Rv
aguccaccgcgcg

SEQ ID NO: 1323712 - RNA, 16 nt, Mycobacterium tuberculosis H37Rv
aguccaggcagcuugc

SEQ ID NO: 1323713 - RNA, 19 nt, Mycobacterium tuberculosis H37Rv
aguccaugugcccaggucu

SEQ ID NO: 1323714 - RNA, 15 nt, Mycobacterium tuberculosis H37Rv
agucccacugccacu

SEQ ID NO: 1323715 - RNA, 18 nt, Mycobacterium tuberculosis H37Rv
agucccacugccacuccu

SEQ ID NO: 1323716 - RNA, 18 nt, Mycobacterium tuberculosis H37Rv
aguccccaggugggcagc

SEQ ID NO: 1323717 - RNA, 22 nt, Mycobacterium tuberculosis H37Rv
agucauccaggucgccuuccca

SEQ ID NO: 1323718 - RNA, 14 nt, Mycobacterium tuberculosis H37Rv
agucauccuugagg

SEQ ID NO: 1323719 - RNA, 22 nt, Mycobacterium tuberculosis H37Rv
agucauucgcuccggucggguu

SEQ ID NO: 1323720 - RNA, 17 nt, Mycobacterium tuberculosis H37Rv
agucaucuggcgcgcca

SEQ ID NO: 1323721 - RNA, 20 nt, Mycobacterium tuberculosis H37Rv
agucauguccauagccggca

SEQ ID NO: 1323722 - RNA, 15 nt, Mycobacterium tuberculosis H37Rv
agugcggcugcaacg

SEQ ID NO: 1323723 - RNA, 15 nt, Mycobacterium tuberculosis H37Rv
agugcggcagcggug

SEQ ID NO: 1323724 - RNA, 14 nt, Mycobacterium tuberculosis H37Rv
agugcggcaccgcc

SEQ ID NO: 1323725 - RNA, 23 nt, Mycobacterium tuberculosis H37Rv
agugcgggccgugacccucagca

SEQ ID NO: 1323726 - RNA, 18 nt, Mycobacterium tuberculosis H37Rv
agugcgcggaucaacagg

SEQ ID NO: 1323727 - RNA, 23 nt, Mycobacterium tuberculosis H37Rv
agugcgcgcuggaucgugcuggu

SEQ ID NO: 1323728 - RNA, 16 nt, Mycobacterium tuberculosis H37Rv
agugcgcggaucaaca

SEQ ID NO: 1323729 - RNA, 22 nt, Mycobacterium tuberculosis H37Rv
agugcggacaucguugacccgg

SEQ ID NO: 1323730 - RNA, 16 nt, Mycobacterium tuberculosis H37Rv
agugcccggccaacca

SEQ ID NO: 1323731 - RNA, 18 nt, Mycobacterium tuberculosis H37Rv
agugcgguggcaggugau

SEQ ID NO: 1323732 - RNA, 20 nt, Mycobacterium tuberculosis H37Rv
agugcggugugugcaagccg

SEQ ID NO: 1323733 - RNA, 23 nt, Mycobacterium tuberculosis H37Rv
agugcuuuggguccgggcggccg

SEQ ID NO: 1323734 - RNA, 17 nt, Mycobacterium tuberculosis H37Rv
agugccacgaggacccg

SEQ ID NO: 1323735 - RNA, 17 nt, Mycobacterium tuberculosis H37Rv
agugccaguccgauggu

SEQ ID NO: 1323736 - RNA, 18 nt, Mycobacterium tuberculosis H37Rv
agugcccgcacugccgcc

SEQ ID NO: 1323737 - RNA, 17 nt, Mycobacterium tuberculosis H37Rv
agugcacccggaucugg

SEQ ID NO: 1323738 - RNA, 19 nt, Mycobacterium tuberculosis H37Rv
agugcacgcuugaaagcgu

SEQ ID NO: 1323739 - RNA, 17 nt, Mycobacterium tuberculosis H37Rv
agugcacccgggccgcc

SEQ ID NO: 1323740 - RNA, 20 nt, Mycobacterium tuberculosis H37Rv
agugcaccgcgucguagcca

SEQ ID NO: 1323741 - RNA, 15 nt, Mycobacterium tuberculosis H37Rv
agugaugcgccccgg

SEQ ID NO: 1323742 - RNA, 14 nt, Mycobacterium tuberculosis H37Rv
agugaugcgccccg

SEQ ID NO: 1323743 - RNA, 14 nt, Mycobacterium tuberculosis H37Rv
agugaucaccaacc

SEQ ID NO: 1323744 - RNA, 15 nt, Mycobacterium tuberculosis H37Rv
agugaucaccaaccc

SEQ ID NO: 1323745 - RNA, 14 nt, Mycobacterium tuberculosis H37Rv
agugagggucccac

SEQ ID NO: 1323746 - RNA, 22 nt, Mycobacterium tuberculosis H37Rv
agugaaguuguuggccagaccg

SEQ ID NO: 1323747 - RNA, 19 nt, Mycobacterium tuberculosis H37Rv
agugaggccgaccagcaca

SEQ ID NO: 1323748 - RNA, 15 nt, Mycobacterium tuberculosis H37Rv
agucgucggcaacgc

SEQ ID NO: 1323749 - RNA, 14 nt, Mycobacterium tuberculosis H37Rv
agucgucgagcuga

SEQ ID NO: 1323750 - RNA, 19 nt, Mycobacterium tuberculosis H37Rv
agucgucgacuugcaggcg

SEQ ID NO: 1323751 - RNA, 19 nt, Mycobacterium tuberculosis H37Rv
agucgugccgcgucggccg

SEQ ID NO: 1323752 - RNA, 19 nt, Mycobacterium tuberculosis H37Rv
agugaaauccgagccgcga

SEQ ID NO: 1323753 - RNA, 22 nt, Mycobacterium tuberculosis H37Rv
agucucgacaaagcggcugccc

SEQ ID NO: 1323754 - RNA, 18 nt, Mycobacterium tuberculosis H37Rv
aguggcagccagcggcga

SEQ ID NO: 1323755 - RNA, 19 nt, Mycobacterium tuberculosis H37Rv
aguggccgcauuagccugc

SEQ ID NO: 1323756 - RNA, 13 nt, Mycobacterium tuberculosis H37Rv
aguggccguggau

SEQ ID NO: 1323757 - RNA, 14 nt, Mycobacterium tuberculosis H37Rv
aguggcgaguggcu

SEQ ID NO: 1323758 - RNA, 20 nt, Mycobacterium tuberculosis H37Rv
aguggcgcgcggcgccgcaa

SEQ ID NO: 1323759 - RNA, 13 nt, Mycobacterium tuberculosis H37Rv
aguucaccgcgcu

SEQ ID NO: 1323760 - RNA, 14 nt, Mycobacterium tuberculosis H37Rv
aguuaucagccgcg

SEQ ID NO: 1323761 - RNA, 15 nt, Mycobacterium tuberculosis H37Rv
aguuccgggguggac

SEQ ID NO: 1323762 - RNA, 22 nt, Mycobacterium tuberculosis H37Rv
aguuccggucgacuccagcacc

SEQ ID NO: 1323763 - RNA, 20 nt, Mycobacterium tuberculosis H37Rv
aguuccggucgacuccagca

SEQ ID NO: 1323764 - RNA, 15 nt, Mycobacterium tuberculosis H37Rv
aguucgccagcaacg

SEQ ID NO: 1323765 - RNA, 21 nt, Mycobacterium tuberculosis H37Rv
aguucgcaugcuugaaaccca

SEQ ID NO: 1323766 - RNA, 21 nt, Mycobacterium tuberculosis H37Rv
aguucagcgccguccuagcgu

SEQ ID NO: 1323767 - RNA, 22 nt, Mycobacterium tuberculosis H37Rv
aguucuuggucaggcuggaggu

SEQ ID NO: 1323768 - RNA, 19 nt, Mycobacterium tuberculosis H37Rv
aguucuccucgugcagcac

SEQ ID NO: 1323769 - RNA, 20 nt, Mycobacterium tuberculosis H37Rv
aguucuugauuagccauuaa

SEQ ID NO: 1323770 - RNA, 16 nt, Mycobacterium tuberculosis H37Rv
aguucuaccaccuugc

SEQ ID NO: 1323771 - RNA, 13 nt, Mycobacterium tuberculosis H37Rv
aguucgcggcugc

SEQ ID NO: 1323772 - RNA, 21 nt, Mycobacterium tuberculosis H37Rv
aguuggucacgaagaccaggc

SEQ ID NO: 1323773 - RNA, 21 nt, Mycobacterium tuberculosis H37Rv
aguugugcgcacucuuuccuu

SEQ ID NO: 1323774 - RNA, 16 nt, Mycobacterium tuberculosis H37Rv
aguugccggucaggca

SEQ ID NO: 1323775 - RNA, 13 nt, Mycobacterium tuberculosis H37Rv
aguugcggcuggc

SEQ ID NO: 1323776 - RNA, 13 nt, Mycobacterium tuberculosis H37Rv
aguugcgcggcau

SEQ ID NO: 1323777 - RNA, 15 nt, Mycobacterium tuberculosis H37Rv
aguuggcgaccugcg

SEQ ID NO: 1323778 - RNA, 11 nt, Mycobacterium tuberculosis H37Rv
aguugaggccg

SEQ ID NO: 1323779 - RNA, 15 nt, Mycobacterium tuberculosis H37Rv
aguugagcagcuugg

SEQ ID NO: 1323780 - RNA, 14 nt, Mycobacterium tuberculosis H37Rv
aguugagcagcuug

SEQ ID NO: 1323781 - RNA, 19 nt, Mycobacterium tuberculosis H37Rv
aguugaccgccgugggugu

SEQ ID NO: 1323782 - RNA, 20 nt, Mycobacterium tuberculosis H37Rv
aguuuuucgggguggcggca

SEQ ID NO: 1323783 - RNA, 10 nt, Mycobacterium tuberculosis H37Rv
auaaaugccg

SEQ ID NO: 1323784 - RNA, 17 nt, Mycobacterium tuberculosis H37Rv
agcccgccacagcccca

SEQ ID NO: 1323785 - RNA, 19 nt, Mycobacterium tuberculosis H37Rv
agcccgccacccuuggccc

SEQ ID NO: 1323786 - RNA, 17 nt, Mycobacterium tuberculosis H37Rv
agcccgccagcgccgcu

SEQ ID NO: 1323787 - RNA, 16 nt, Mycobacterium tuberculosis H37Rv
agcccgauucagcgcc

SEQ ID NO: 1323788 - RNA, 17 nt, Mycobacterium tuberculosis H37Rv
agcccgauucagcgccc

SEQ ID NO: 1323789 - RNA, 13 nt, Mycobacterium tuberculosis H37Rv
agcccgaguugaa

SEQ ID NO: 1323790 - RNA, 14 nt, Mycobacterium tuberculosis H37Rv
agcccgcugcgccg

SEQ ID NO: 1323791 - RNA, 19 nt, Mycobacterium tuberculosis H37Rv
agcccgccggacccgcccu

SEQ ID NO: 1323792 - RNA, 20 nt, Mycobacterium tuberculosis H37Rv
agcccgcccgguguguucgg

SEQ ID NO: 1323793 - RNA, 19 nt, Mycobacterium tuberculosis H37Rv
agccccugaaggccagcca

SEQ ID NO: 1323794 - RNA, 22 nt, Mycobacterium tuberculosis H37Rv
agccccuuuugccgcagcaucc

SEQ ID NO: 1323795 - RNA, 21 nt, Mycobacterium tuberculosis H37Rv
agcccgacuggucacugcccu

SEQ ID NO: 1323796 - RNA, 19 nt, Mycobacterium tuberculosis H37Rv
agcccgagcucaccgcaca

SEQ ID NO: 1323797 - RNA, 17 nt, Mycobacterium tuberculosis H37Rv
agccccgcggccagcag

SEQ ID NO: 1323798 - RNA, 13 nt, Mycobacterium tuberculosis H37Rv
agccccgcgccca

SEQ ID NO: 1323799 - RNA, 19 nt, Mycobacterium tuberculosis H37Rv
agccccgcgcccaccccgg

SEQ ID NO: 1323800 - RNA, 17 nt, Mycobacterium tuberculosis H37Rv
agcccggcgcgccgagu

SEQ ID NO: 1323801 - RNA, 15 nt, Mycobacterium tuberculosis H37Rv
agcccggagcgguca

SEQ ID NO: 1323802 - RNA, 15 nt, Mycobacterium tuberculosis H37Rv
agcccggugugcugc

SEQ ID NO: 1323803 - RNA, 13 nt, Mycobacterium tuberculosis H37Rv
agcccggugcuac

SEQ ID NO: 1323804 - RNA, 22 nt, Mycobacterium tuberculosis H37Rv
agcccggucccuuuguggggcc

SEQ ID NO: 1323805 - RNA, 22 nt, Mycobacterium tuberculosis H37Rv
agcccggucgcugauccgggcg

SEQ ID NO: 1323806 - RNA, 19 nt, Mycobacterium tuberculosis H37Rv
agcccggugcuaccggcuu

SEQ ID NO: 1323807 - RNA, 21 nt, Mycobacterium tuberculosis H37Rv
agcccggcggcaugggucgug

SEQ ID NO: 1323808 - RNA, 17 nt, Mycobacterium tuberculosis H37Rv
agcccggccgcggccca

SEQ ID NO: 1323809 - RNA, 14 nt, Mycobacterium tuberculosis H37Rv
agcccggccuugcc

SEQ ID NO: 1323810 - RNA, 15 nt, Mycobacterium tuberculosis H37Rv
agcccgguagccugg

SEQ ID NO: 1323811 - RNA, 18 nt, Mycobacterium tuberculosis H37Rv
agcccucgacguccaucc

SEQ ID NO: 1323812 - RNA, 14 nt, Mycobacterium tuberculosis H37Rv
agcccguugcagga

SEQ ID NO: 1323813 - RNA, 12 nt, Mycobacterium tuberculosis H37Rv
agcccagcgccu

SEQ ID NO: 1323814 - RNA, 16 nt, Mycobacterium tuberculosis H37Rv
agcccagcgccuccag

SEQ ID NO: 1323815 - RNA, 17 nt, Mycobacterium tuberculosis H37Rv
agcccagauagagcugg

SEQ ID NO: 1323816 - RNA, 18 nt, Mycobacterium tuberculosis H37Rv
agcccagauccagcaacg

SEQ ID NO: 1323817 - RNA, 18 nt, Mycobacterium tuberculosis H37Rv
agcccacgugggcacuca

SEQ ID NO: 1323818 - RNA, 18 nt, Mycobacterium tuberculosis H37Rv
agcccacucgucgaacac

SEQ ID NO: 1323819 - RNA, 18 nt, Mycobacterium tuberculosis H37Rv
agcccacccauggccucc

SEQ ID NO: 1323820 - RNA, 15 nt, Mycobacterium tuberculosis H37Rv
agcccacccauggcc

SEQ ID NO: 1323821 - RNA, 12 nt, Mycobacterium tuberculosis H37Rv
agcccacccggg

SEQ ID NO: 1323822 - RNA, 16 nt, Mycobacterium tuberculosis H37Rv
agcccaaaucccagag

SEQ ID NO: 1323823 - RNA, 18 nt, Mycobacterium tuberculosis H37Rv
agcccaacucggccagcu

SEQ ID NO: 1323824 - RNA, 14 nt, Mycobacterium tuberculosis H37Rv
agccccccgagccc

SEQ ID NO: 1323825 - RNA, 15 nt, Mycobacterium tuberculosis H37Rv
agccccgaccagcag

SEQ ID NO: 1323826 - RNA, 16 nt, Mycobacterium tuberculosis H37Rv
agccccgaccagcaga

SEQ ID NO: 1323827 - RNA, 14 nt, Mycobacterium tuberculosis H37Rv
agccccgcaggggg

SEQ ID NO: 1323828 - RNA, 14 nt, Mycobacterium tuberculosis H37Rv
agccccaaaucgua

SEQ ID NO: 1323829 - RNA, 15 nt, Mycobacterium tuberculosis H37Rv
agcccaggugggccg

SEQ ID NO: 1323830 - RNA, 18 nt, Mycobacterium tuberculosis H37Rv
agcccaucuaccagcuca

SEQ ID NO: 1323831 - RNA, 19 nt, Mycobacterium tuberculosis H37Rv
agcccaugccgaugcccau

SEQ ID NO: 1323832 - RNA, 16 nt, Mycobacterium tuberculosis H37Rv
agcccaugucgagcac

SEQ ID NO: 1323833 - RNA, 20 nt, Mycobacterium tuberculosis H37Rv
agccgcgcgguacugcgcag

SEQ ID NO: 1323834 - RNA, 21 nt, Mycobacterium tuberculosis H37Rv
agccgcgcgccaucgccucca

SEQ ID NO: 1323835 - RNA, 16 nt, Mycobacterium tuberculosis H37Rv
agccgcgcaucugucg

SEQ ID NO: 1323836 - RNA, 23 nt, Mycobacterium tuberculosis H37Rv
agccgcgccgaccucaucggcac

SEQ ID NO: 1323837 - RNA, 15 nt, Mycobacterium tuberculosis H37Rv
agccgcgaaaucacc

SEQ ID NO: 1323838 - RNA, 16 nt, Mycobacterium tuberculosis H37Rv
agccgccggccccgcc

SEQ ID NO: 1323839 - RNA, 13 nt, Mycobacterium tuberculosis H37Rv
agccgccggcccc

SEQ ID NO: 1323840 - RNA, 17 nt, Mycobacterium tuberculosis H37Rv
agccgccgggugcgccg

SEQ ID NO: 1323841 - RNA, 17 nt, Mycobacterium tuberculosis H37Rv
agccgccggugccgccg

SEQ ID NO: 1323842 - RNA, 11 nt, Mycobacterium tuberculosis H37Rv
agccgccaccg

SEQ ID NO: 1323843 - RNA, 22 nt, Mycobacterium tuberculosis H37Rv
agccgccaccguacgacagucg

SEQ ID NO: 1323844 - RNA, 12 nt, Mycobacterium tuberculosis H37Rv
agccgccaggac

SEQ ID NO: 1323845 - RNA, 21 nt, Mycobacterium tuberculosis H37Rv
agccgccauugagcucccgca

SEQ ID NO: 1323846 - RNA, 16 nt, Mycobacterium tuberculosis H37Rv
agccgcccucccuggg

SEQ ID NO: 1323847 - RNA, 13 nt, Mycobacterium tuberculosis H37Rv
agccgcccuugcc

SEQ ID NO: 1323848 - RNA, 21 nt, Mycobacterium tuberculosis H37Rv
agccgcuacguuacgccgaga

SEQ ID NO: 1323849 - RNA, 17 nt, Mycobacterium tuberculosis H37Rv
agccgcggucggcgugc

SEQ ID NO: 1323850 - RNA, 17 nt, Mycobacterium tuberculosis H37Rv
agccgcgggcaccuucc

SEQ ID NO: 1323851 - RNA, 22 nt, Mycobacterium tuberculosis H37Rv
agccgcggggcgaaguggaucu

SEQ ID NO: 1323852 - RNA, 15 nt, Mycobacterium tuberculosis H37Rv
agccgcggccacaau

SEQ ID NO: 1323853 - RNA, 17 nt, Mycobacterium tuberculosis H37Rv
agccgcggccacaugau

SEQ ID NO: 1323854 - RNA, 13 nt, Mycobacterium tuberculosis H37Rv
agccgcggccacg

SEQ ID NO: 1323855 - RNA, 23 nt, Mycobacterium tuberculosis H37Rv
agccgcucgcugaaccggaucga

SEQ ID NO: 1323856 - RNA, 23 nt, Mycobacterium tuberculosis H37Rv
agccgcugcacguggccacggca

SEQ ID NO: 1323857 - RNA, 17 nt, Mycobacterium tuberculosis H37Rv
agccgcugaucugccgc

SEQ ID NO: 1323858 - RNA, 18 nt, Mycobacterium tuberculosis H37Rv
agccgcuuucccggcugg

SEQ ID NO: 1323859 - RNA, 19 nt, Mycobacterium tuberculosis H37Rv
agccggacaacugguggcc

SEQ ID NO: 1323860 - RNA, 21 nt, Mycobacterium tuberculosis H37Rv
agccggccaauggccugcagc

SEQ ID NO: 1323861 - RNA, 16 nt, Mycobacterium tuberculosis H37Rv
agccgacgaccagcag

SEQ ID NO: 1323862 - RNA, 16 nt, Mycobacterium tuberculosis H37Rv
agccgaccucgagugc

SEQ ID NO: 1323863 - RNA, 16 nt, Mycobacterium tuberculosis H37Rv
agccgacgccuuccag

SEQ ID NO: 1323864 - RNA, 17 nt, Mycobacterium tuberculosis H37Rv
agccgacgaccagcaga

SEQ ID NO: 1323865 - RNA, 16 nt, Mycobacterium tuberculosis H37Rv
agccgacgauccacgg

SEQ ID NO: 1323866 - RNA, 15 nt, Mycobacterium tuberculosis H37Rv
agccgagcguggcgu

SEQ ID NO: 1323867 - RNA, 15 nt, Mycobacterium tuberculosis H37Rv
agccgagccaguccu

SEQ ID NO: 1323868 - RNA, 14 nt, Mycobacterium tuberculosis H37Rv
agccgagccucgcu

SEQ ID NO: 1323869 - RNA, 17 nt, Mycobacterium tuberculosis H37Rv
agccgagcggcggcacu

SEQ ID NO: 1323870 - RNA, 14 nt, Mycobacterium tuberculosis H37Rv
agccgagacaccac

SEQ ID NO: 1323871 - RNA, 10 nt, Mycobacterium tuberculosis H37Rv
agccgagcac

SEQ ID NO: 1323872 - RNA, 17 nt, Mycobacterium tuberculosis H37Rv
agccgaccaccccgagc

SEQ ID NO: 1323873 - RNA, 13 nt, Mycobacterium tuberculosis H37Rv
agccgaccaccgc

SEQ ID NO: 1323874 - RNA, 12 nt, Mycobacterium tuberculosis H37Rv
agccgaccagcg

SEQ ID NO: 1323875 - RNA, 20 nt, Mycobacterium tuberculosis H37Rv
agccgaccaggaccaccgca

SEQ ID NO: 1323876 - RNA, 14 nt, Mycobacterium tuberculosis H37Rv
agcccuguuugacu

SEQ ID NO: 1323877 - RNA, 22 nt, Mycobacterium tuberculosis H37Rv
agccgaugaucgaacacggcac

SEQ ID NO: 1323878 - RNA, 15 nt, Mycobacterium tuberculosis H37Rv
agccgauccagcagg

SEQ ID NO: 1323879 - RNA, 20 nt, Mycobacterium tuberculosis H37Rv
agccgaugcucgucccagaa

SEQ ID NO: 1323880 - RNA, 22 nt, Mycobacterium tuberculosis H37Rv
agccgaugauaauuccagcacc

SEQ ID NO: 1323881 - RNA, 16 nt, Mycobacterium tuberculosis H37Rv
agccgauauaccaggg

SEQ ID NO: 1323882 - RNA, 22 nt, Mycobacterium tuberculosis H37Rv
agccgaucaguuccuguagccg

SEQ ID NO: 1323883 - RNA, 20 nt, Mycobacterium tuberculosis H37Rv
agccgaucggugccagaaug

SEQ ID NO: 1323884 - RNA, 23 nt, Mycobacterium tuberculosis H37Rv
agccgaggacuggaaagcagcag

SEQ ID NO: 1323885 - RNA, 21 nt, Mycobacterium tuberculosis H37Rv
agccgacccgcccgaagaugc

SEQ ID NO: 1323886 - RNA, 14 nt, Mycobacterium tuberculosis H37Rv
agccgagcuugagc

SEQ ID NO: 1323887 - RNA, 22 nt, Mycobacterium tuberculosis H37Rv
agccgaggacuggaaagcagca

SEQ ID NO: 1323888 - RNA, 18 nt, Mycobacterium tuberculosis H37Rv
agccgcaccaguggcgcc

SEQ ID NO: 1323889 - RNA, 14 nt, Mycobacterium tuberculosis H37Rv
agccgcacagcaug

SEQ ID NO: 1323890 - RNA, 17 nt, Mycobacterium tuberculosis H37Rv
agccgcagaugcaccug

SEQ ID NO: 1323891 - RNA, 13 nt, Mycobacterium tuberculosis H37Rv
agccgcagaugca

SEQ ID NO: 1323892 - RNA, 12 nt, Mycobacterium tuberculosis H37Rv
agccgcaccccg

SEQ ID NO: 1323893 - RNA, 13 nt, Mycobacterium tuberculosis H37Rv
agccgcacgaugc

SEQ ID NO: 1323894 - RNA, 22 nt, Mycobacterium tuberculosis H37Rv
agccgcagcccgugacugguga

SEQ ID NO: 1323895 - RNA, 14 nt, Mycobacterium tuberculosis H37Rv
agccgcagcaccuc

SEQ ID NO: 1323896 - RNA, 18 nt, Mycobacterium tuberculosis H37Rv
agccgcauaggccccgcc

SEQ ID NO: 1323897 - RNA, 19 nt, Mycobacterium tuberculosis H37Rv
agccgggugggagcagccg

SEQ ID NO: 1323898 - RNA, 15 nt, Mycobacterium tuberculosis H37Rv
agccgggcggccucg

SEQ ID NO: 1323899 - RNA, 19 nt, Mycobacterium tuberculosis H37Rv
agccggcucaucgcagccg

SEQ ID NO: 1323900 - RNA, 23 nt, Mycobacterium tuberculosis H37Rv
agccgggagucgucggcaugggc

SEQ ID NO: 1323901 - RNA, 22 nt, Mycobacterium tuberculosis H37Rv
agccgggcaaccagcagcaggu

SEQ ID NO: 1323902 - RNA, 22 nt, Mycobacterium tuberculosis H37Rv
agccggccacuacggccuggcc

SEQ ID NO: 1323903 - RNA, 16 nt, Mycobacterium tuberculosis H37Rv
agccggccacgcauuc

SEQ ID NO: 1323904 - RNA, 22 nt, Mycobacterium tuberculosis H37Rv
agccggccacgcauuccagcag

SEQ ID NO: 1323905 - RNA, 17 nt, Mycobacterium tuberculosis H37Rv
agccggccgcuuggccg

SEQ ID NO: 1323906 - RNA, 14 nt, Mycobacterium tuberculosis H37Rv
agccggccgcgacc

SEQ ID NO: 1323907 - RNA, 14 nt, Mycobacterium tuberculosis H37Rv
agccggcgaagugc

SEQ ID NO: 1323908 - RNA, 14 nt, Mycobacterium tuberculosis H37Rv
agccggcgcggcgg

SEQ ID NO: 1323909 - RNA, 19 nt, Mycobacterium tuberculosis H37Rv
agccggcgcgccccaccgc

SEQ ID NO: 1323910 - RNA, 13 nt, Mycobacterium tuberculosis H37Rv
agccggcgguggg

SEQ ID NO: 1323911 - RNA, 13 nt, Mycobacterium tuberculosis H37Rv
agccggcggcugg

SEQ ID NO: 1323912 - RNA, 16 nt, Mycobacterium tuberculosis H37Rv
agccguaguaguggcc

SEQ ID NO: 1323913 - RNA, 20 nt, Mycobacterium tuberculosis H37Rv
agccgucaccgcgaccccug

SEQ ID NO: 1323914 - RNA, 19 nt, Mycobacterium tuberculosis H37Rv
agccguaguaguggccgcc

SEQ ID NO: 1323915 - RNA, 17 nt, Mycobacterium tuberculosis H37Rv
agccgucgccaccagag

SEQ ID NO: 1323916 - RNA, 18 nt, Mycobacterium tuberculosis H37Rv
agccguccgaccagggau

SEQ ID NO: 1323917 - RNA, 18 nt, Mycobacterium tuberculosis H37Rv
agccguccgggcggccuc

SEQ ID NO: 1323918 - RNA, 13 nt, Mycobacterium tuberculosis H37Rv
agccgguguugau

SEQ ID NO: 1323919 - RNA, 20 nt, Mycobacterium tuberculosis H37Rv
agccguagcugggcaccccg

SEQ ID NO: 1323920 - RNA, 16 nt, Mycobacterium tuberculosis H37Rv
agccguaaaugguggc

SEQ ID NO: 1323921 - RNA, 21 nt, Mycobacterium tuberculosis H37Rv
agccgucgcgacgucggccgu

SEQ ID NO: 1323922 - RNA, 15 nt, Mycobacterium tuberculosis H37Rv
agccgucgucgagcc

SEQ ID NO: 1323923 - RNA, 16 nt, Mycobacterium tuberculosis H37Rv
agccgugccgugguga

SEQ ID NO: 1323924 - RNA, 12 nt, Mycobacterium tuberculosis H37Rv
agccgugccucg

SEQ ID NO: 1323925 - RNA, 16 nt, Mycobacterium tuberculosis H37Rv
agccgugcggcggcug

SEQ ID NO: 1323926 - RNA, 19 nt, Mycobacterium tuberculosis H37Rv
agccgugcggucgcgcccu

SEQ ID NO: 1323927 - RNA, 15 nt, Mycobacterium tuberculosis H37Rv
agccgugccucgagg

SEQ ID NO: 1323928 - RNA, 22 nt, Mycobacterium tuberculosis H37Rv
agccguggugguugaucagcca

SEQ ID NO: 1323929 - RNA, 12 nt, Mycobacterium tuberculosis H37Rv
agccguggcggc

SEQ ID NO: 1323930 - RNA, 14 nt, Mycobacterium tuberculosis H37Rv
agccguugccgccg

SEQ ID NO: 1323931 - RNA, 22 nt, Mycobacterium tuberculosis H37Rv
agccguucucgcccacccgcug

SEQ ID NO: 1323932 - RNA, 13 nt, Mycobacterium tuberculosis H37Rv
agccguuguccaa

SEQ ID NO: 1323933 - RNA, 17 nt, Mycobacterium tuberculosis H37Rv
agccguucggcaucugg

SEQ ID NO: 1323934 - RNA, 12 nt, Mycobacterium tuberculosis H37Rv
agccgugguggu

SEQ ID NO: 1323935 - RNA, 14 nt, Mycobacterium tuberculosis H37Rv
agccucucuuccca

SEQ ID NO: 1323936 - RNA, 15 nt, Mycobacterium tuberculosis H37Rv
agccucgcgggcagg

SEQ ID NO: 1323937 - RNA, 20 nt, Mycobacterium tuberculosis H37Rv
agccucgcgggcagggccuc

SEQ ID NO: 1323938 - RNA, 20 nt, Mycobacterium tuberculosis H37Rv
agccucggcaugcagcccca

SEQ ID NO: 1323939 - RNA, 19 nt, Mycobacterium tuberculosis H37Rv
agccugauaaagcccggcg

SEQ ID NO: 1323940 - RNA, 21 nt, Mycobacterium tuberculosis H37Rv
agccugccagguacucagugu

SEQ ID NO: 1323941 - RNA, 19 nt, Mycobacterium tuberculosis H37Rv
agccugcgcuguucggcac

SEQ ID NO: 1323942 - RNA, 20 nt, Mycobacterium tuberculosis H37Rv
agccugccgaugacgauggc

SEQ ID NO: 1323943 - RNA, 23 nt, Mycobacterium tuberculosis H37Rv
agccugccgaugacgauggccgc

SEQ ID NO: 1323944 - RNA, 13 nt, Mycobacterium tuberculosis H37Rv
agccucagccgcu

SEQ ID NO: 1323945 - RNA, 15 nt, Mycobacterium tuberculosis H37Rv
agccugcgggccggc

SEQ ID NO: 1323946 - RNA, 19 nt, Mycobacterium tuberculosis H37Rv
agccugcggcggucauggg

SEQ ID NO: 1323947 - RNA, 16 nt, Mycobacterium tuberculosis H37Rv
agccugcggcggcguu

SEQ ID NO: 1323948 - RNA, 15 nt, Mycobacterium tuberculosis H37Rv
agccugugcugccaa

SEQ ID NO: 1323949 - RNA, 23 nt, Mycobacterium tuberculosis H37Rv
agccuuggacgugcgcgccaagu

SEQ ID NO: 1323950 - RNA, 12 nt, Mycobacterium tuberculosis H37Rv
agccuugcagcg

SEQ ID NO: 1323951 - RNA, 15 nt, Mycobacterium tuberculosis H37Rv
agccuugcagcgccc

SEQ ID NO: 1323952 - RNA, 17 nt, Mycobacterium tuberculosis H37Rv
agccuugcagcgccccc

SEQ ID NO: 1323953 - RNA, 16 nt, Mycobacterium tuberculosis H37Rv
agccuuguugccgccg

SEQ ID NO: 1323954 - RNA, 15 nt, Mycobacterium tuberculosis H37Rv
agccuugacccaugg

SEQ ID NO: 1323955 - RNA, 17 nt, Mycobacterium tuberculosis H37Rv
agccuugacccauggcu

SEQ ID NO: 1323956 - RNA, 19 nt, Mycobacterium tuberculosis H37Rv
agcgaaaugcccaucacca

SEQ ID NO: 1323957 - RNA, 14 nt, Mycobacterium tuberculosis H37Rv
agcgaaagugugga

SEQ ID NO: 1323958 - RNA, 17 nt, Mycobacterium tuberculosis H37Rv
agcgaaccggcugggcg

SEQ ID NO: 1323959 - RNA, 15 nt, Mycobacterium tuberculosis H37Rv
agcgaacggccagga

SEQ ID NO: 1323960 - RNA, 17 nt, Mycobacterium tuberculosis H37Rv
agcgaacggccaggaca

SEQ ID NO: 1323961 - RNA, 17 nt, Mycobacterium tuberculosis H37Rv
agcgaaccaccggcgcc

SEQ ID NO: 1323962 - RNA, 20 nt, Mycobacterium tuberculosis H37Rv
agcgaaccgccggcaccgcc

SEQ ID NO: 1323963 - RNA, 14 nt, Mycobacterium tuberculosis H37Rv
agcgaacacccggu

SEQ ID NO: 1323964 - RNA, 16 nt, Mycobacterium tuberculosis H37Rv
agcgaagccgggucug

SEQ ID NO: 1323965 - RNA, 15 nt, Mycobacterium tuberculosis H37Rv
agcgaaggugaacga

SEQ ID NO: 1323966 - RNA, 18 nt, Mycobacterium tuberculosis H37Rv
agcgacaugcccgccaau

SEQ ID NO: 1323967 - RNA, 16 nt, Mycobacterium tuberculosis H37Rv
agcgacagcagcgcca

SEQ ID NO: 1323968 - RNA, 23 nt, Mycobacterium tuberculosis H37Rv
agcgacacguuggcggaugcccg

SEQ ID NO: 1323969 - RNA, 12 nt, Mycobacterium tuberculosis H37Rv
agcgaauccagc

SEQ ID NO: 1323970 - RNA, 22 nt, Mycobacterium tuberculosis H37Rv
agcgaaugucugcgcagguggu

SEQ ID NO: 1323971 - RNA, 17 nt, Mycobacterium tuberculosis H37Rv
agcgacuccaccccacc

SEQ ID NO: 1323972 - RNA, 18 nt, Mycobacterium tuberculosis H37Rv
agcgacuccagcgcccgg

SEQ ID NO: 1323973 - RNA, 21 nt, Mycobacterium tuberculosis H37Rv
agcgaccuagcagcgcugcga

SEQ ID NO: 1323974 - RNA, 23 nt, Mycobacterium tuberculosis H37Rv
agcgacgaccacaccacgauggc

SEQ ID NO: 1323975 - RNA, 23 nt, Mycobacterium tuberculosis H37Rv
agcgaccgucccagcgccgcagu

SEQ ID NO: 1323976 - RNA, 20 nt, Mycobacterium tuberculosis H37Rv
agcgaccgucgggacggcca

SEQ ID NO: 1323977 - RNA, 20 nt, Mycobacterium tuberculosis H37Rv
agcgagcucagcgaugcggc

SEQ ID NO: 1323978 - RNA, 16 nt, Mycobacterium tuberculosis H37Rv
agcgagaaucacgguc

SEQ ID NO: 1323979 - RNA, 14 nt, Mycobacterium tuberculosis H37Rv
agcgagcccagcug

SEQ ID NO: 1323980 - RNA, 21 nt, Mycobacterium tuberculosis H37Rv
agcugcucgucuuggcggcgg

SEQ ID NO: 1323981 - RNA, 18 nt, Mycobacterium tuberculosis H37Rv
agcugcguccggaaccaa

SEQ ID NO: 1323982 - RNA, 22 nt, Mycobacterium tuberculosis H37Rv
agcugcuagcccggcggcgaga

SEQ ID NO: 1323983 - RNA, 23 nt, Mycobacterium tuberculosis H37Rv
agcugcucacgguccggcgggga

SEQ ID NO: 1323984 - RNA, 12 nt, Mycobacterium tuberculosis H37Rv
agcugcugccac

SEQ ID NO: 1323985 - RNA, 16 nt, Mycobacterium tuberculosis H37Rv
agcugcugcugcuuga

SEQ ID NO: 1323986 - RNA, 18 nt, Mycobacterium tuberculosis H37Rv
agcugcgggucagcgccg

SEQ ID NO: 1323987 - RNA, 23 nt, Mycobacterium tuberculosis H37Rv
agcugcgggucgugccccggcgc

SEQ ID NO: 1323988 - RNA, 23 nt, Mycobacterium tuberculosis H37Rv
agcugcggauuaagucggcggcc

SEQ ID NO: 1323989 - RNA, 18 nt, Mycobacterium tuberculosis H37Rv
agcugagcggccggcaug

SEQ ID NO: 1323990 - RNA, 15 nt, Mycobacterium tuberculosis H37Rv
agcugagcggccggc

SEQ ID NO: 1323991 - RNA, 14 nt, Mycobacterium tuberculosis H37Rv
agcugaucuuggca

SEQ ID NO: 1323992 - RNA, 18 nt, Mycobacterium tuberculosis H37Rv
agcucuugcgggcagccg

SEQ ID NO: 1323993 - RNA, 13 nt, Mycobacterium tuberculosis H37Rv
agcugacgcugcu

SEQ ID NO: 1323994 - RNA, 17 nt, Mycobacterium tuberculosis H37Rv
agcugaccacgguagac

SEQ ID NO: 1323995 - RNA, 13 nt, Mycobacterium tuberculosis H37Rv
agcugaccgccag

SEQ ID NO: 1323996 - RNA, 19 nt, Mycobacterium tuberculosis H37Rv
agcugacgauggccaggcc

SEQ ID NO: 1323997 - RNA, 15 nt, Mycobacterium tuberculosis H37Rv
agcugacgucaccac

SEQ ID NO: 1323998 - RNA, 21 nt, Mycobacterium tuberculosis H37Rv
agcucgucgaggaagaucacc

SEQ ID NO: 1323999 - RNA, 18 nt, Mycobacterium tuberculosis H37Rv
agcucgggcagggaccgc

SEQ ID NO: 1324000 - RNA, 18 nt, Mycobacterium tuberculosis H37Rv
agcucguaggugaagagc

SEQ ID NO: 1324001 - RNA, 14 nt, Mycobacterium tuberculosis H37Rv
agcucggcugcucg

SEQ ID NO: 1324002 - RNA, 15 nt, Mycobacterium tuberculosis H37Rv
agcucggcugcucga

SEQ ID NO: 1324003 - RNA, 20 nt, Mycobacterium tuberculosis H37Rv
agcucgggugcgaacaacgc

SEQ ID NO: 1324004 - RNA, 22 nt, Mycobacterium tuberculosis H37Rv
agcuccgugucggacaaggacu

SEQ ID NO: 1324005 - RNA, 19 nt, Mycobacterium tuberculosis H37Rv
agcuccgugacaccgggga

SEQ ID NO: 1324006 - RNA, 23 nt, Mycobacterium tuberculosis H37Rv
agcuccguggugcuagcgccgcc

SEQ ID NO: 1324007 - RNA, 15 nt, Mycobacterium tuberculosis H37Rv
agcuccgucgcggcc

SEQ ID NO: 1324008 - RNA, 14 nt, Mycobacterium tuberculosis H37Rv
agcucccacaggac

SEQ ID NO: 1324009 - RNA, 20 nt, Mycobacterium tuberculosis H37Rv
agcucccgcggcgccacccg

SEQ ID NO: 1324010 - RNA, 24 nt, Mycobacterium tuberculosis H37Rv
agcucccgcggcgccacccgcgcc

SEQ ID NO: 1324011 - RNA, 12 nt, Mycobacterium tuberculosis H37Rv
agcucggccacc

SEQ ID NO: 1324012 - RNA, 20 nt, Mycobacterium tuberculosis H37Rv
agcucgcugacggcaaacga

SEQ ID NO: 1324013 - RNA, 17 nt, Mycobacterium tuberculosis H37Rv
agcucggcgcccagcuc

SEQ ID NO: 1324014 - RNA, 19 nt, Mycobacterium tuberculosis H37Rv
agcucggcgaacggcacca

SEQ ID NO: 1324015 - RNA, 16 nt, Mycobacterium tuberculosis H37Rv
agcucggcccuguucg

SEQ ID NO: 1324016 - RNA, 16 nt, Mycobacterium tuberculosis H37Rv
agcucgccgugaccag

SEQ ID NO: 1324017 - RNA, 22 nt, Mycobacterium tuberculosis H37Rv
agcucgcgcacccagcccagcc

SEQ ID NO: 1324018 - RNA, 14 nt, Mycobacterium tuberculosis H37Rv
agcucgccggugcg

SEQ ID NO: 1324019 - RNA, 18 nt, Mycobacterium tuberculosis H37Rv
agcucgcggugggcuucc

SEQ ID NO: 1324020 - RNA, 18 nt, Mycobacterium tuberculosis H37Rv
agcucgacaacugcccga

SEQ ID NO: 1324021 - RNA, 19 nt, Mycobacterium tuberculosis H37Rv
agcucgaggaccaccuggu

SEQ ID NO: 1324022 - RNA, 14 nt, Mycobacterium tuberculosis H37Rv
agcucgaagcccgg

SEQ ID NO: 1324023 - RNA, 20 nt, Mycobacterium tuberculosis H37Rv
agcuccuguaacugcuccug

SEQ ID NO: 1324024 - RNA, 17 nt, Mycobacterium tuberculosis H37Rv
agcuccucagccaccgc

SEQ ID NO: 1324025 - RNA, 13 nt, Mycobacterium tuberculosis H37Rv
agcuccucagcca

SEQ ID NO: 1324026 - RNA, 15 nt, Mycobacterium tuberculosis H37Rv
agcuccugcaugccg

SEQ ID NO: 1324027 - RNA, 17 nt, Mycobacterium tuberculosis H37Rv
agcggcacacccaucac

SEQ ID NO: 1324028 - RNA, 18 nt, Mycobacterium tuberculosis H37Rv
agcggcagcaccgcacgg

SEQ ID NO: 1324029 - RNA, 13 nt, Mycobacterium tuberculosis H37Rv
agcggcagccaag

SEQ ID NO: 1324030 - RNA, 16 nt, Mycobacterium tuberculosis H37Rv
agcggcaccgcgccgg

SEQ ID NO: 1324031 - RNA, 17 nt, Mycobacterium tuberculosis H37Rv
agcggcaaucgggucug

SEQ ID NO: 1324032 - RNA, 19 nt, Mycobacterium tuberculosis H37Rv
agcggcaauggccagcacc

SEQ ID NO: 1324033 - RNA, 19 nt, Mycobacterium tuberculosis H37Rv
agcgguugacccacagcau

SEQ ID NO: 1324034 - RNA, 20 nt, Mycobacterium tuberculosis H37Rv
agcgguaagcgcaucgagca

SEQ ID NO: 1324035 - RNA, 17 nt, Mycobacterium tuberculosis H37Rv
agcgguguugccggaga

SEQ ID NO: 1324036 - RNA, 15 nt, Mycobacterium tuberculosis H37Rv
agcggguggccggga

SEQ ID NO: 1324037 - RNA, 16 nt, Mycobacterium tuberculosis H37Rv
agcggguggugccagg

SEQ ID NO: 1324038 - RNA, 14 nt, Mycobacterium tuberculosis H37Rv
agcggggucuugac

SEQ ID NO: 1324039 - RNA, 22 nt, Mycobacterium tuberculosis H37Rv
agcgggucgaccccggccagga

SEQ ID NO: 1324040 - RNA, 20 nt, Mycobacterium tuberculosis H37Rv
agcggguccuucugccggga

SEQ ID NO: 1324041 - RNA, 20 nt, Mycobacterium tuberculosis H37Rv
agcggguccccggucaggac

SEQ ID NO: 1324042 - RNA, 17 nt, Mycobacterium tuberculosis H37Rv
agcggguccgucagcac

SEQ ID NO: 1324043 - RNA, 17 nt, Mycobacterium tuberculosis H37Rv
agcggguccccggucag

SEQ ID NO: 1324044 - RNA, 21 nt, Mycobacterium tuberculosis H37Rv
agcguccagcgccugcgccca

SEQ ID NO: 1324045 - RNA, 20 nt, Mycobacterium tuberculosis H37Rv
agcgucaggccuccaaaauc

SEQ ID NO: 1324046 - RNA, 21 nt, Mycobacterium tuberculosis H37Rv
agcguccgcugcagguccagg

SEQ ID NO: 1324047 - RNA, 22 nt, Mycobacterium tuberculosis H37Rv
agcguccauggucgcgccaccc

SEQ ID NO: 1324048 - RNA, 23 nt, Mycobacterium tuberculosis H37Rv
agcguccuggcguagugcagcug

SEQ ID NO: 1324049 - RNA, 17 nt, Mycobacterium tuberculosis H37Rv
agcguccccaugcagcg

SEQ ID NO: 1324050 - RNA, 16 nt, Mycobacterium tuberculosis H37Rv
agcgguugccuucuug

SEQ ID NO: 1324051 - RNA, 22 nt, Mycobacterium tuberculosis H37Rv
agcgguugccuucuuggcggga

SEQ ID NO: 1324052 - RNA, 20 nt, Mycobacterium tuberculosis H37Rv
agcguaaugcugcugcagca

SEQ ID NO: 1324053 - RNA, 17 nt, Mycobacterium tuberculosis H37Rv
agcgugagugcagcacg

SEQ ID NO: 1324054 - RNA, 23 nt, Mycobacterium tuberculosis H37Rv
agcgugagccaugccgcucggca

SEQ ID NO: 1324055 - RNA, 14 nt, Mycobacterium tuberculosis H37Rv
agcgugagugcagc

SEQ ID NO: 1324056 - RNA, 15 nt, Mycobacterium tuberculosis H37Rv
agcuaaacccccacc

SEQ ID NO: 1324057 - RNA, 14 nt, Mycobacterium tuberculosis H37Rv
agcuagcccggcag

SEQ ID NO: 1324058 - RNA, 15 nt, Mycobacterium tuberculosis H37Rv
agcuagcccggcagc

SEQ ID NO: 1324059 - RNA, 22 nt, Mycobacterium tuberculosis H37Rv
agcuagcgguggaaaaagcccg

SEQ ID NO: 1324060 - RNA, 19 nt, Mycobacterium tuberculosis H37Rv
agcuagcgcccgcgagaga

SEQ ID NO: 1324061 - RNA, 22 nt, Mycobacterium tuberculosis H37Rv
agcuagcccggcagcacgugga

SEQ ID NO: 1324062 - RNA, 19 nt, Mycobacterium tuberculosis H37Rv
agcgccucgccggccaccc

SEQ ID NO: 1324063 - RNA, 19 nt, Mycobacterium tuberculosis H37Rv
agcgccucgguggucuugg

SEQ ID NO: 1324064 - RNA, 20 nt, Mycobacterium tuberculosis H37Rv
agcgccucgccggccacccg

SEQ ID NO: 1324065 - RNA, 17 nt, Mycobacterium tuberculosis H37Rv
agcgccugagcggccuc

SEQ ID NO: 1324066 - RNA, 19 nt, Mycobacterium tuberculosis H37Rv
agcgccgcugaagccagga

SEQ ID NO: 1324067 - RNA, 14 nt, Mycobacterium tuberculosis H37Rv
agcgccggcaccga

SEQ ID NO: 1324068 - RNA, 13 nt, Mycobacterium tuberculosis H37Rv
agcgccgcggcga

SEQ ID NO: 1324069 - RNA, 11 nt, Mycobacterium tuberculosis H37Rv
agcgccgccga

SEQ ID NO: 1324070 - RNA, 18 nt, Mycobacterium tuberculosis H37Rv
agcgccggggugugcggg

SEQ ID NO: 1324071 - RNA, 15 nt, Mycobacterium tuberculosis H37Rv
agcgccgucagcaug

SEQ ID NO: 1324072 - RNA, 19 nt, Mycobacterium tuberculosis H37Rv
agcgccggccgcggcggcc

SEQ ID NO: 1324073 - RNA, 15 nt, Mycobacterium tuberculosis H37Rv
agcgcccgcgcggcc

SEQ ID NO: 1324074 - RNA, 17 nt, Mycobacterium tuberculosis H37Rv
agcgcccgcgagagagu

SEQ ID NO: 1324075 - RNA, 20 nt, Mycobacterium tuberculosis H37Rv
agcgcccguuggccaagaau

SEQ ID NO: 1324076 - RNA, 13 nt, Mycobacterium tuberculosis H37Rv
agcgcccuccucg

SEQ ID NO: 1324077 - RNA, 14 nt, Mycobacterium tuberculosis H37Rv
agcgcccuccucga

SEQ ID NO: 1324078 - RNA, 15 nt, Mycobacterium tuberculosis H37Rv
agcgcccccagcagc

SEQ ID NO: 1324079 - RNA, 13 nt, Mycobacterium tuberculosis H37Rv
agcgcccccgcug

SEQ ID NO: 1324080 - RNA, 16 nt, Mycobacterium tuberculosis H37Rv
agcgcccccagcagcu

SEQ ID NO: 1324081 - RNA, 11 nt, Mycobacterium tuberculosis H37Rv
agcgccgccgg

SEQ ID NO: 1324082 - RNA, 23 nt, Mycobacterium tuberculosis H37Rv
agcgcccggauguccgccgacgu

SEQ ID NO: 1324083 - RNA, 16 nt, Mycobacterium tuberculosis H37Rv
agcgccgaaacagcac

SEQ ID NO: 1324084 - RNA, 13 nt, Mycobacterium tuberculosis H37Rv
agcgccgcacaga

SEQ ID NO: 1324085 - RNA, 18 nt, Mycobacterium tuberculosis H37Rv
agcgccgcacagaaaacg

SEQ ID NO: 1324086 - RNA, 15 nt, Mycobacterium tuberculosis H37Rv
agcgcuccagccgcg

SEQ ID NO: 1324087 - RNA, 20 nt, Mycobacterium tuberculosis H37Rv
agcgcuugaccccgccgaac

SEQ ID NO: 1324088 - RNA, 16 nt, Mycobacterium tuberculosis H37Rv
agcggaucgcggucag

SEQ ID NO: 1324089 - RNA, 16 nt, Mycobacterium tuberculosis H37Rv
agcggauccaggccuc

SEQ ID NO: 1324090 - RNA, 19 nt, Mycobacterium tuberculosis H37Rv
agcggauucagcgucgcca

SEQ ID NO: 1324091 - RNA, 18 nt, Mycobacterium tuberculosis H37Rv
agcggcaacgccuccgga

SEQ ID NO: 1324092 - RNA, 18 nt, Mycobacterium tuberculosis H37Rv
agcgcgaccgucaggguc

SEQ ID NO: 1324093 - RNA, 18 nt, Mycobacterium tuberculosis H37Rv
agcgcgacguccaccagc

SEQ ID NO: 1324094 - RNA, 17 nt, Mycobacterium tuberculosis H37Rv
agcgccuugacgccagu

SEQ ID NO: 1324095 - RNA, 22 nt, Mycobacterium tuberculosis H37Rv
agcgccuugcgggccuggugga

SEQ ID NO: 1324096 - RNA, 17 nt, Mycobacterium tuberculosis H37Rv
agcgccuugaccagcag

SEQ ID NO: 1324097 - RNA, 18 nt, Mycobacterium tuberculosis H37Rv
agcgccuugaccagcagc

SEQ ID NO: 1324098 - RNA, 18 nt, Mycobacterium tuberculosis H37Rv
agcgcgugcuguggaugc

SEQ ID NO: 1324099 - RNA, 19 nt, Mycobacterium tuberculosis H37Rv
agcgcgucggagccgggca

SEQ ID NO: 1324100 - RNA, 19 nt, Mycobacterium tuberculosis H37Rv
agcgcguauggcucacccc

SEQ ID NO: 1324101 - RNA, 19 nt, Mycobacterium tuberculosis H37Rv
agcgcgguuucggcgauga

SEQ ID NO: 1324102 - RNA, 17 nt, Mycobacterium tuberculosis H37Rv
agcgcggugccgccacc

SEQ ID NO: 1324103 - RNA, 18 nt, Mycobacterium tuberculosis H37Rv
agcgcguaguccgcaucc

SEQ ID NO: 1324104 - RNA, 15 nt, Mycobacterium tuberculosis H37Rv
agcgccacgccgagg

SEQ ID NO: 1324105 - RNA, 13 nt, Mycobacterium tuberculosis H37Rv
agcgccagcagcu

SEQ ID NO: 1324106 - RNA, 24 nt, Mycobacterium tuberculosis H37Rv
agcgccagugccucgcggggucug

SEQ ID NO: 1324107 - RNA, 19 nt, Mycobacterium tuberculosis H37Rv
agcgccaggccgcacagca

SEQ ID NO: 1324108 - RNA, 18 nt, Mycobacterium tuberculosis H37Rv
agcgcaucgcacagcgcc

SEQ ID NO: 1324109 - RNA, 22 nt, Mycobacterium tuberculosis H37Rv
agcgcaucgccgcuggccagca

SEQ ID NO: 1324110 - RNA, 13 nt, Mycobacterium tuberculosis H37Rv
agcgcaucggcca

SEQ ID NO: 1324111 - RNA, 17 nt, Mycobacterium tuberculosis H37Rv
agcgcaucggccagcag

SEQ ID NO: 1324112 - RNA, 18 nt, Mycobacterium tuberculosis H37Rv
agcgcaucggccagcagc

SEQ ID NO: 1324113 - RNA, 19 nt, Mycobacterium tuberculosis H37Rv
agcgcaucggucaccaacu

SEQ ID NO: 1324114 - RNA, 19 nt, Mycobacterium tuberculosis H37Rv
agcgcaucguugccgcaga

SEQ ID NO: 1324115 - RNA, 17 nt, Mycobacterium tuberculosis H37Rv
agcgcauguugcaggcg

SEQ ID NO: 1324116 - RNA, 21 nt, Mycobacterium tuberculosis H37Rv
agcgccaagccgugccgcaca

SEQ ID NO: 1324117 - RNA, 19 nt, Mycobacterium tuberculosis H37Rv
agcgccaacgcccccaucc

SEQ ID NO: 1324118 - RNA, 21 nt, Mycobacterium tuberculosis H37Rv
agcgcagcguguugagggcug

SEQ ID NO: 1324119 - RNA, 17 nt, Mycobacterium tuberculosis H37Rv
agcgcagcgccggcagc

SEQ ID NO: 1324120 - RNA, 19 nt, Mycobacterium tuberculosis H37Rv
agcgcaggguucgucggga

SEQ ID NO: 1324121 - RNA, 14 nt, Mycobacterium tuberculosis H37Rv
agcgcaucgagcac

SEQ ID NO: 1324122 - RNA, 14 nt, Mycobacterium tuberculosis H37Rv
agcgcagccaggcu

SEQ ID NO: 1324123 - RNA, 21 nt, Mycobacterium tuberculosis H37Rv
agcgcagcauugaccaaucca

SEQ ID NO: 1324124 - RNA, 12 nt, Mycobacterium tuberculosis H37Rv
agcgcagcagcg

SEQ ID NO: 1324125 - RNA, 21 nt, Mycobacterium tuberculosis H37Rv
agcgcagcaucgucgccacga

SEQ ID NO: 1324126 - RNA, 21 nt, Mycobacterium tuberculosis H37Rv
agcgcagcaacugggcggccu

SEQ ID NO: 1324127 - RNA, 21 nt, Mycobacterium tuberculosis H37Rv
agcgcacccggucggcggcau

SEQ ID NO: 1324128 - RNA, 20 nt, Mycobacterium tuberculosis H37Rv
agcgcaccgcugaccgcaac

SEQ ID NO: 1324129 - RNA, 15 nt, Mycobacterium tuberculosis H37Rv
agcgcacugcccggg

SEQ ID NO: 1324130 - RNA, 15 nt, Mycobacterium tuberculosis H37Rv
agcgcacugccgggu

SEQ ID NO: 1324131 - RNA, 14 nt, Mycobacterium tuberculosis H37Rv
agcgcacgcagccg

SEQ ID NO: 1324132 - RNA, 15 nt, Mycobacterium tuberculosis H37Rv
agcgcacugaaaugg

SEQ ID NO: 1324133 - RNA, 18 nt, Mycobacterium tuberculosis H37Rv
agcgcaacccguuguggc

SEQ ID NO: 1324134 - RNA, 17 nt, Mycobacterium tuberculosis H37Rv
agcgcaacucccagcac

SEQ ID NO: 1324135 - RNA, 22 nt, Mycobacterium tuberculosis H37Rv
agcgauaucggcggcuuggccg

SEQ ID NO: 1324136 - RNA, 16 nt, Mycobacterium tuberculosis H37Rv
agcgagucgaacccgc

SEQ ID NO: 1324137 - RNA, 22 nt, Mycobacterium tuberculosis H37Rv
agcgagucgacgaacgccucac

SEQ ID NO: 1324138 - RNA, 17 nt, Mycobacterium tuberculosis H37Rv
agcgaucuugguggccu

SEQ ID NO: 1324139 - RNA, 13 nt, Mycobacterium tuberculosis H37Rv
agcgaucggggcg

SEQ ID NO: 1324140 - RNA, 15 nt, Mycobacterium tuberculosis H37Rv
agcgaucgugcugcc

SEQ ID NO: 1324141 - RNA, 16 nt, Mycobacterium tuberculosis H37Rv
agcgauccucgccggg

SEQ ID NO: 1324142 - RNA, 18 nt, Mycobacterium tuberculosis H37Rv
agcgaugcggugucgggc

SEQ ID NO: 1324143 - RNA, 18 nt, Mycobacterium tuberculosis H37Rv
agcgaugggaacggggug

SEQ ID NO: 1324144 - RNA, 18 nt, Mycobacterium tuberculosis H37Rv
agcauggcccuggcgacc

SEQ ID NO: 1324145 - RNA, 17 nt, Mycobacterium tuberculosis H37Rv
agcaugguggacgaggc

SEQ ID NO: 1324146 - RNA, 14 nt, Mycobacterium tuberculosis H37Rv
agcaugguccacag

SEQ ID NO: 1324147 - RNA, 22 nt, Mycobacterium tuberculosis H37Rv
agcaugauccgcucguggucgg

SEQ ID NO: 1324148 - RNA, 18 nt, Mycobacterium tuberculosis H37Rv
agcaugauccgcugggcc

SEQ ID NO: 1324149 - RNA, 18 nt, Mycobacterium tuberculosis H37Rv
agcaugacaccggccacc

SEQ ID NO: 1324150 - RNA, 19 nt, Mycobacterium tuberculosis H37Rv
agcaugacaccggccacca

SEQ ID NO: 1324151 - RNA, 20 nt, Mycobacterium tuberculosis H37Rv
agcauugaguucggccacca

SEQ ID NO: 1324152 - RNA, 12 nt, Mycobacterium tuberculosis H37Rv
agcauugaagaa

SEQ ID NO: 1324153 - RNA, 15 nt, Mycobacterium tuberculosis H37Rv
agcauugaagaagcc

SEQ ID NO: 1324154 - RNA, 21 nt, Mycobacterium tuberculosis H37Rv
agccaacccgucuuaucggcg

SEQ ID NO: 1324155 - RNA, 23 nt, Mycobacterium tuberculosis H37Rv
agccaaaugcgcugucgcccucg

SEQ ID NO: 1324156 - RNA, 18 nt, Mycobacterium tuberculosis H37Rv
agccaaacuacccgccca

SEQ ID NO: 1324157 - RNA, 16 nt, Mycobacterium tuberculosis H37Rv
agccacagggaagcaa

SEQ ID NO: 1324158 - RNA, 23 nt, Mycobacterium tuberculosis H37Rv
agccaaugcccuuggccagcagg

SEQ ID NO: 1324159 - RNA, 18 nt, Mycobacterium tuberculosis H37Rv
agccaaggcuuccuccga

SEQ ID NO: 1324160 - RNA, 14 nt, Mycobacterium tuberculosis H37Rv
agccaagaaucacg

SEQ ID NO: 1324161 - RNA, 16 nt, Mycobacterium tuberculosis H37Rv
agccagagguggauca

SEQ ID NO: 1324162 - RNA, 14 nt, Mycobacterium tuberculosis H37Rv
agccagcagcacau

SEQ ID NO: 1324163 - RNA, 20 nt, Mycobacterium tuberculosis H37Rv
agccagcagcggcgagccaa

SEQ ID NO: 1324164 - RNA, 18 nt, Mycobacterium tuberculosis H37Rv
agccagcaacaccagaug

SEQ ID NO: 1324165 - RNA, 13 nt, Mycobacterium tuberculosis H37Rv
agccagcagcaca

SEQ ID NO: 1324166 - RNA, 15 nt, Mycobacterium tuberculosis H37Rv
agccagcggagcagc

SEQ ID NO: 1324167 - RNA, 16 nt, Mycobacterium tuberculosis H37Rv
agccagcgggcgauga

SEQ ID NO: 1324168 - RNA, 15 nt, Mycobacterium tuberculosis H37Rv
agccagcgcagccag

SEQ ID NO: 1324169 - RNA, 22 nt, Mycobacterium tuberculosis H37Rv
agccagcgguagcugcccagcg

SEQ ID NO: 1324170 - RNA, 17 nt, Mycobacterium tuberculosis H37Rv
agccagcguccaugguc

SEQ ID NO: 1324171 - RNA, 14 nt, Mycobacterium tuberculosis H37Rv
agccagcugaacac

SEQ ID NO: 1324172 - RNA, 22 nt, Mycobacterium tuberculosis H37Rv
agccagcugaacacgaauccgg

SEQ ID NO: 1324173 - RNA, 15 nt, Mycobacterium tuberculosis H37Rv
agccagccugcuggc

SEQ ID NO: 1324174 - RNA, 22 nt, Mycobacterium tuberculosis H37Rv
agccagccaccggggaagaucu

SEQ ID NO: 1324175 - RNA, 15 nt, Mycobacterium tuberculosis H37Rv
agccacggcugccca

SEQ ID NO: 1324176 - RNA, 17 nt, Mycobacterium tuberculosis H37Rv
agccacgcaugggccag

SEQ ID NO: 1324177 - RNA, 22 nt, Mycobacterium tuberculosis H37Rv
agccacgcaugggccaggucag

SEQ ID NO: 1324178 - RNA, 21 nt, Mycobacterium tuberculosis H37Rv
agccacgcacaauacggucag

SEQ ID NO: 1324179 - RNA, 22 nt, Mycobacterium tuberculosis H37Rv
agccaccgaucgacugcagccc

SEQ ID NO: 1324180 - RNA, 18 nt, Mycobacterium tuberculosis H37Rv
agccaccugacaaacggc

SEQ ID NO: 1324181 - RNA, 23 nt, Mycobacterium tuberculosis H37Rv
agccaccugccgacucaucggcc

SEQ ID NO: 1324182 - RNA, 14 nt, Mycobacterium tuberculosis H37Rv
agccacucgaucac

SEQ ID NO: 1324183 - RNA, 23 nt, Mycobacterium tuberculosis H37Rv
agccacggcuucgccgcgggaca

SEQ ID NO: 1324184 - RNA, 23 nt, Mycobacterium tuberculosis H37Rv
agccacguucgcggccaacccau

SEQ ID NO: 1324185 - RNA, 18 nt, Mycobacterium tuberculosis H37Rv
agccaugggauucggcca

SEQ ID NO: 1324186 - RNA, 18 nt, Mycobacterium tuberculosis H37Rv
agccaggaagcgguggcc

SEQ ID NO: 1324187 - RNA, 17 nt, Mycobacterium tuberculosis H37Rv
agccaggauugccgccg

SEQ ID NO: 1324188 - RNA, 23 nt, Mycobacterium tuberculosis H37Rv
agccaggcacguccgaucggcgc

SEQ ID NO: 1324189 - RNA, 20 nt, Mycobacterium tuberculosis H37Rv
agccaggccuuggugcggcc

SEQ ID NO: 1324190 - RNA, 22 nt, Mycobacterium tuberculosis H37Rv
agccaggucgauaccggcgugc

SEQ ID NO: 1324191 - RNA, 21 nt, Mycobacterium tuberculosis H37Rv
agccaggccuuggugcggccg

SEQ ID NO: 1324192 - RNA, 21 nt, Mycobacterium tuberculosis H37Rv
agccaggcgugcacaggucag

SEQ ID NO: 1324193 - RNA, 10 nt, Mycobacterium tuberculosis H37Rv
agccagucca

SEQ ID NO: 1324194 - RNA, 22 nt, Mycobacterium tuberculosis H37Rv
agccaguaaaaaggcaggacug

SEQ ID NO: 1324195 - RNA, 21 nt, Mycobacterium tuberculosis H37Rv
agccaguaccagguacgggag

SEQ ID NO: 1324196 - RNA, 14 nt, Mycobacterium tuberculosis H37Rv
agcaucacgcccac

SEQ ID NO: 1324197 - RNA, 18 nt, Mycobacterium tuberculosis H37Rv
agcaucaccguaaagccg

SEQ ID NO: 1324198 - RNA, 14 nt, Mycobacterium tuberculosis H37Rv
agcaucaaagcggu

SEQ ID NO: 1324199 - RNA, 17 nt, Mycobacterium tuberculosis H37Rv
agcaucuuuggcggccg

SEQ ID NO: 1324200 - RNA, 21 nt, Mycobacterium tuberculosis H37Rv
agcaucuccgucggccaggcc

SEQ ID NO: 1324201 - RNA, 20 nt, Mycobacterium tuberculosis H37Rv
agcaucuccucgccugcccg

SEQ ID NO: 1324202 - RNA, 21 nt, Mycobacterium tuberculosis H37Rv
agcaucggcaccccggccacu

SEQ ID NO: 1324203 - RNA, 20 nt, Mycobacterium tuberculosis H37Rv
agcauccucgacuugcuugg

SEQ ID NO: 1324204 - RNA, 14 nt, Mycobacterium tuberculosis H37Rv
agcaguccacgagc

SEQ ID NO: 1324205 - RNA, 18 nt, Mycobacterium tuberculosis H37Rv
agcagcccggggaugccu

SEQ ID NO: 1324206 - RNA, 23 nt, Mycobacterium tuberculosis H37Rv
agcagcccgcccugaccgcccgc

SEQ ID NO: 1324207 - RNA, 12 nt, Mycobacterium tuberculosis H37Rv
agcagcccggcg

SEQ ID NO: 1324208 - RNA, 13 nt, Mycobacterium tuberculosis H37Rv
agcagccagccac

SEQ ID NO: 1324209 - RNA, 14 nt, Mycobacterium tuberculosis H37Rv
agcagcgaccagca

SEQ ID NO: 1324210 - RNA, 20 nt, Mycobacterium tuberculosis H37Rv
agcagcgacgcugccgccag

SEQ ID NO: 1324211 - RNA, 14 nt, Mycobacterium tuberculosis H37Rv
agcagcaucggcac

SEQ ID NO: 1324212 - RNA, 22 nt, Mycobacterium tuberculosis H37Rv
agcagcauccggccgucaucug

SEQ ID NO: 1324213 - RNA, 14 nt, Mycobacterium tuberculosis H37Rv
agcagccagcaaca

SEQ ID NO: 1324214 - RNA, 22 nt, Mycobacterium tuberculosis H37Rv
agcagccacgauccuuggcgua

SEQ ID NO: 1324215 - RNA, 12 nt, Mycobacterium tuberculosis H37Rv
agcagcagugcc

SEQ ID NO: 1324216 - RNA, 22 nt, Mycobacterium tuberculosis H37Rv
agcagcucggccgaggcggucu

SEQ ID NO: 1324217 - RNA, 12 nt, Mycobacterium tuberculosis H37Rv
agcagcuggucg

SEQ ID NO: 1324218 - RNA, 20 nt, Mycobacterium tuberculosis H37Rv
agcagcugggcaucaccgcc

SEQ ID NO: 1324219 - RNA, 21 nt, Mycobacterium tuberculosis H37Rv
agcagcuggucgugggccacc

SEQ ID NO: 1324220 - RNA, 23 nt, Mycobacterium tuberculosis H37Rv
agcagcuccuugaggucacccau

SEQ ID NO: 1324221 - RNA, 14 nt, Mycobacterium tuberculosis H37Rv
agcagcgccacccg

SEQ ID NO: 1324222 - RNA, 17 nt, Mycobacterium tuberculosis H37Rv
agcagcgcgggaucuga

SEQ ID NO: 1324223 - RNA, 20 nt, Mycobacterium tuberculosis H37Rv
agcagcgccgcguucagggc

SEQ ID NO: 1324224 - RNA, 18 nt, Mycobacterium tuberculosis H37Rv
agcagcgccucauccucc

SEQ ID NO: 1324225 - RNA, 20 nt, Mycobacterium tuberculosis H37Rv
agcagcgguugaugcggccg

SEQ ID NO: 1324226 - RNA, 13 nt, Mycobacterium tuberculosis H37Rv
agcagcgcggcuu

SEQ ID NO: 1324227 - RNA, 17 nt, Mycobacterium tuberculosis H37Rv
agcagcuugacaucggu

SEQ ID NO: 1324228 - RNA, 12 nt, Mycobacterium tuberculosis H37Rv
agcaggacaccu

SEQ ID NO: 1324229 - RNA, 13 nt, Mycobacterium tuberculosis H37Rv
agcaggcauuccc

SEQ ID NO: 1324230 - RNA, 16 nt, Mycobacterium tuberculosis H37Rv
agcaggcgaugcgcca

SEQ ID NO: 1324231 - RNA, 15 nt, Mycobacterium tuberculosis H37Rv
agcaggcgagugaag

SEQ ID NO: 1324232 - RNA, 15 nt, Mycobacterium tuberculosis H37Rv
agcaggucgaugcug

SEQ ID NO: 1324233 - RNA, 24 nt, Mycobacterium tuberculosis H37Rv
agcaggucgaugcugccagccaug

SEQ ID NO: 1324234 - RNA, 19 nt, Mycobacterium tuberculosis H37Rv
agcaggugcccgaggugcu

SEQ ID NO: 1324235 - RNA, 23 nt, Mycobacterium tuberculosis H37Rv
agcagguuccgcacgaucaggga

SEQ ID NO: 1324236 - RNA, 15 nt, Mycobacterium tuberculosis H37Rv
agcaggcuggcugcc

SEQ ID NO: 1324237 - RNA, 13 nt, Mycobacterium tuberculosis H37Rv
agcagggccacca

SEQ ID NO: 1324238 - RNA, 17 nt, Mycobacterium tuberculosis H37Rv
agcagggccaccaccac

SEQ ID NO: 1324239 - RNA, 16 nt, Mycobacterium tuberculosis H37Rv
agcagggauucuggau

SEQ ID NO: 1324240 - RNA, 13 nt, Mycobacterium tuberculosis H37Rv
agcaccagcagca

SEQ ID NO: 1324241 - RNA, 12 nt, Mycobacterium tuberculosis H37Rv
agcaccagcagc

SEQ ID NO: 1324242 - RNA, 19 nt, Mycobacterium tuberculosis H37Rv
agcaccagcacggcaacca

SEQ ID NO: 1324243 - RNA, 20 nt, Mycobacterium tuberculosis H37Rv
agcaccagccagccugcugg

SEQ ID NO: 1324244 - RNA, 21 nt, Mycobacterium tuberculosis H37Rv
agcaccagcgucgcggccacg

SEQ ID NO: 1324245 - RNA, 21 nt, Mycobacterium tuberculosis H37Rv
agcaccagggcgcggaucugc

SEQ ID NO: 1324246 - RNA, 13 nt, Mycobacterium tuberculosis H37Rv
agcacccacgccg

SEQ ID NO: 1324247 - RNA, 17 nt, Mycobacterium tuberculosis H37Rv
agcaccaguucccuaca

SEQ ID NO: 1324248 - RNA, 14 nt, Mycobacterium tuberculosis H37Rv
agcacccggccacc

SEQ ID NO: 1324249 - RNA, 12 nt, Mycobacterium tuberculosis H37Rv
agcacccgcucc

SEQ ID NO: 1324250 - RNA, 22 nt, Mycobacterium tuberculosis H37Rv
agcacccgcucggccgccgggu

SEQ ID NO: 1324251 - RNA, 23 nt, Mycobacterium tuberculosis H37Rv
agcacccgcuggucgagcagugc

SEQ ID NO: 1324252 - RNA, 17 nt, Mycobacterium tuberculosis H37Rv
agcaccccgccgggggc

SEQ ID NO: 1324253 - RNA, 19 nt, Mycobacterium tuberculosis H37Rv
agcaccgucgggcccagcc

SEQ ID NO: 1324254 - RNA, 16 nt, Mycobacterium tuberculosis H37Rv
agcaccgugacccuga

SEQ ID NO: 1324255 - RNA, 20 nt, Mycobacterium tuberculosis H37Rv
agcaccgucggcaccagcag

SEQ ID NO: 1324256 - RNA, 12 nt, Mycobacterium tuberculosis H37Rv
agcaccgccggu

SEQ ID NO: 1324257 - RNA, 18 nt, Mycobacterium tuberculosis H37Rv
agcaccgccggugcggcc

SEQ ID NO: 1324258 - RNA, 16 nt, Mycobacterium tuberculosis H37Rv
agcaccgcgacgacga

SEQ ID NO: 1324259 - RNA, 20 nt, Mycobacterium tuberculosis H37Rv
agcaccgcgacgacgagguc

SEQ ID NO: 1324260 - RNA, 13 nt, Mycobacterium tuberculosis H37Rv
agcaccgcgccga

SEQ ID NO: 1324261 - RNA, 18 nt, Mycobacterium tuberculosis H37Rv
agcaccgcaaccacgccc

SEQ ID NO: 1324262 - RNA, 19 nt, Mycobacterium tuberculosis H37Rv
agcaccgacgugaugguga

SEQ ID NO: 1324263 - RNA, 12 nt, Mycobacterium tuberculosis H37Rv
agcaccgaugcu

SEQ ID NO: 1324264 - RNA, 14 nt, Mycobacterium tuberculosis H37Rv
agcaccgaugcuga

SEQ ID NO: 1324265 - RNA, 14 nt, Mycobacterium tuberculosis H37Rv
agcaccgacgugau

SEQ ID NO: 1324266 - RNA, 14 nt, Mycobacterium tuberculosis H37Rv
agcacccugcgggc

SEQ ID NO: 1324267 - RNA, 19 nt, Mycobacterium tuberculosis H37Rv
agcaccgaccagggccgcc

SEQ ID NO: 1324268 - RNA, 19 nt, Mycobacterium tuberculosis H37Rv
agcacacgucgggaguaag

SEQ ID NO: 1324269 - RNA, 19 nt, Mycobacterium tuberculosis H37Rv
agcacacccagaugcaggc

SEQ ID NO: 1324270 - RNA, 17 nt, Mycobacterium tuberculosis H37Rv
agcacaccgccagcggc

SEQ ID NO: 1324271 - RNA, 14 nt, Mycobacterium tuberculosis H37Rv
agcacaccgccagc

SEQ ID NO: 1324272 - RNA, 12 nt, Mycobacterium tuberculosis H37Rv
agcacacccaga

SEQ ID NO: 1324273 - RNA, 15 nt, Mycobacterium tuberculosis H37Rv
agcaccaaggucuuc

SEQ ID NO: 1324274 - RNA, 22 nt, Mycobacterium tuberculosis H37Rv
agcacauuauucuucgcggcga

SEQ ID NO: 1324275 - RNA, 19 nt, Mycobacterium tuberculosis H37Rv
agcaccacaacgucggcac

SEQ ID NO: 1324276 - RNA, 16 nt, Mycobacterium tuberculosis H37Rv
agcaccacccgggccu

SEQ ID NO: 1324277 - RNA, 14 nt, Mycobacterium tuberculosis H37Rv
agcaccaccagcag

SEQ ID NO: 1324278 - RNA, 22 nt, Mycobacterium tuberculosis H37Rv
agcaccaccccagcggccaccg

SEQ ID NO: 1324279 - RNA, 23 nt, Mycobacterium tuberculosis H37Rv
agcaccaccccagcggccaccga

SEQ ID NO: 1324280 - RNA, 19 nt, Mycobacterium tuberculosis H37Rv
agcaccacccgcaccucac

SEQ ID NO: 1324281 - RNA, 18 nt, Mycobacterium tuberculosis H37Rv
agcaccaccgcggugugc

SEQ ID NO: 1324282 - RNA, 14 nt, Mycobacterium tuberculosis H37Rv
agcaccacggccag

SEQ ID NO: 1324283 - RNA, 15 nt, Mycobacterium tuberculosis H37Rv
agcacagcagcaacg

SEQ ID NO: 1324284 - RNA, 12 nt, Mycobacterium tuberculosis H37Rv
agcacagcagca

SEQ ID NO: 1324285 - RNA, 14 nt, Mycobacterium tuberculosis H37Rv
agcacagcccggcg

SEQ ID NO: 1324286 - RNA, 17 nt, Mycobacterium tuberculosis H37Rv
agcacauccugcagcuc

SEQ ID NO: 1324287 - RNA, 15 nt, Mycobacterium tuberculosis H37Rv
agcacauccugcagc

SEQ ID NO: 1324288 - RNA, 16 nt, Mycobacterium tuberculosis H37Rv
agcacaucgccggcgu

SEQ ID NO: 1324289 - RNA, 18 nt, Mycobacterium tuberculosis H37Rv
agcacauccugcagcucg

SEQ ID NO: 1324290 - RNA, 13 nt, Mycobacterium tuberculosis H37Rv
agcacgcugacca

SEQ ID NO: 1324291 - RNA, 15 nt, Mycobacterium tuberculosis H37Rv
agcacgcugaccaca

SEQ ID NO: 1324292 - RNA, 18 nt, Mycobacterium tuberculosis H37Rv
agcacgcugaccacaacc

SEQ ID NO: 1324293 - RNA, 22 nt, Mycobacterium tuberculosis H37Rv
agcacgggacuucgugccucgg

SEQ ID NO: 1324294 - RNA, 20 nt, Mycobacterium tuberculosis H37Rv
agcacggcgccgccacggau

SEQ ID NO: 1324295 - RNA, 15 nt, Mycobacterium tuberculosis H37Rv
agcacgggugagcac

SEQ ID NO: 1324296 - RNA, 20 nt, Mycobacterium tuberculosis H37Rv
agcacgccgccggccgccag

SEQ ID NO: 1324297 - RNA, 18 nt, Mycobacterium tuberculosis H37Rv
agcacgaugucgaugccg

SEQ ID NO: 1324298 - RNA, 21 nt, Mycobacterium tuberculosis H37Rv
agcacucuucgaugaagcugg

SEQ ID NO: 1324299 - RNA, 24 nt, Mycobacterium tuberculosis H37Rv
agcacucgcccaagcgcagccugg

SEQ ID NO: 1324300 - RNA, 20 nt, Mycobacterium tuberculosis H37Rv
agcacgugccccaugcgcag

SEQ ID NO: 1324301 - RNA, 19 nt, Mycobacterium tuberculosis H37Rv
agcacgucuugcugcacgc

SEQ ID NO: 1324302 - RNA, 21 nt, Mycobacterium tuberculosis H37Rv
agcacggugggcgcugggucg

SEQ ID NO: 1324303 - RNA, 16 nt, Mycobacterium tuberculosis H37Rv
agcacggcggccacgu

SEQ ID NO: 1324304 - RNA, 19 nt, Mycobacterium tuberculosis H37Rv
agcacggugaucagcagca

SEQ ID NO: 1324305 - RNA, 12 nt, Mycobacterium tuberculosis H37Rv
agcagcaccugc

SEQ ID NO: 1324306 - RNA, 16 nt, Mycobacterium tuberculosis H37Rv
agcagcaacgacccga

SEQ ID NO: 1324307 - RNA, 15 nt, Mycobacterium tuberculosis H37Rv
agcagaugggcgucg

SEQ ID NO: 1324308 - RNA, 19 nt, Mycobacterium tuberculosis H37Rv
agcagcaaacaucgcaggc

SEQ ID NO: 1324309 - RNA, 15 nt, Mycobacterium tuberculosis H37Rv
agcagauccaggcgu

SEQ ID NO: 1324310 - RNA, 15 nt, Mycobacterium tuberculosis H37Rv
agcagacacagaauc

SEQ ID NO: 1324311 - RNA, 20 nt, Mycobacterium tuberculosis H37Rv
agcagaauccugcgcugcac

SEQ ID NO: 1324312 - RNA, 14 nt, Mycobacterium tuberculosis H37Rv
agcagacugcccuc

SEQ ID NO: 1324313 - RNA, 16 nt, Mycobacterium tuberculosis H37Rv
agcagaaacggcgacu

SEQ ID NO: 1324314 - RNA, 13 nt, Mycobacterium tuberculosis H37Rv
agcaaagccagcg

SEQ ID NO: 1324315 - RNA, 15 nt, Mycobacterium tuberculosis H37Rv
agcaacaccagggcc

SEQ ID NO: 1324316 - RNA, 24 nt, Mycobacterium tuberculosis H37Rv
agcaacugggcggccuggucggcc

SEQ ID NO: 1324317 - RNA, 20 nt, Mycobacterium tuberculosis H37Rv
agcaacucguccagcagugc

SEQ ID NO: 1324318 - RNA, 16 nt, Mycobacterium tuberculosis H37Rv
agcaacucgaucgccu

SEQ ID NO: 1324319 - RNA, 13 nt, Mycobacterium tuberculosis H37Rv
agcaacgucggua

SEQ ID NO: 1324320 - RNA, 14 nt, Mycobacterium tuberculosis H37Rv
agcaacgcugcagc

SEQ ID NO: 1324321 - RNA, 17 nt, Mycobacterium tuberculosis H37Rv
agcaacgccacccgaau

SEQ ID NO: 1324322 - RNA, 13 nt, Mycobacterium tuberculosis H37Rv
agcaacgcccaac

SEQ ID NO: 1324323 - RNA, 13 nt, Mycobacterium tuberculosis H37Rv
agcaaugcccgca

SEQ ID NO: 1324324 - RNA, 19 nt, Mycobacterium tuberculosis H37Rv
agcaauaccugagcgcgcg

SEQ ID NO: 1324325 - RNA, 22 nt, Mycobacterium tuberculosis H37Rv
agcaauccaaggcucagcagcg

SEQ ID NO: 1324326 - RNA, 14 nt, Mycobacterium tuberculosis H37Rv
agcaagaucggcag

SEQ ID NO: 1324327 - RNA, 16 nt, Mycobacterium tuberculosis H37Rv
agcaagccaacccaau

SEQ ID NO: 1324328 - RNA, 13 nt, Mycobacterium tuberculosis H37Rv
agcaaguccugca

SEQ ID NO: 1324329 - RNA, 19 nt, Mycobacterium tuberculosis H37Rv
agaagugcucacauccggu

SEQ ID NO: 1324330 - RNA, 14 nt, Mycobacterium tuberculosis H37Rv
agaagcgcuccagc

SEQ ID NO: 1324331 - RNA, 15 nt, Mycobacterium tuberculosis H37Rv
agaagcccccaaacc

SEQ ID NO: 1324332 - RNA, 22 nt, Mycobacterium tuberculosis H37Rv
agaagcccaggacggcuaccac

SEQ ID NO: 1324333 - RNA, 21 nt, Mycobacterium tuberculosis H37Rv
agaagcccaggacggcuacca

SEQ ID NO: 1324334 - RNA, 22 nt, Mycobacterium tuberculosis H37Rv
agaaugacaucgucgccagggc

SEQ ID NO: 1324335 - RNA, 18 nt, Mycobacterium tuberculosis H37Rv
agaaguucuucgcgaaga

SEQ ID NO: 1324336 - RNA, 23 nt, Mycobacterium tuberculosis H37Rv
agacaccggcgucgaaggugacc

SEQ ID NO: 1324337 - RNA, 13 nt, Mycobacterium tuberculosis H37Rv
agacaccccacca

SEQ ID NO: 1324338 - RNA, 14 nt, Mycobacterium tuberculosis H37Rv
agacagcaccgccg

SEQ ID NO: 1324339 - RNA, 17 nt, Mycobacterium tuberculosis H37Rv
agacagcgccaugcccu

SEQ ID NO: 1324340 - RNA, 15 nt, Mycobacterium tuberculosis H37Rv
agacaacagucgaca

SEQ ID NO: 1324341 - RNA, 17 nt, Mycobacterium tuberculosis H37Rv
agaccgcgagcagcaca

SEQ ID NO: 1324342 - RNA, 12 nt, Mycobacterium tuberculosis H37Rv
agaccgccgcug

SEQ ID NO: 1324343 - RNA, 15 nt, Mycobacterium tuberculosis H37Rv
agaccgccgcugccg

SEQ ID NO: 1324344 - RNA, 15 nt, Mycobacterium tuberculosis H37Rv
agaccgaacagcggc

SEQ ID NO: 1324345 - RNA, 19 nt, Mycobacterium tuberculosis H37Rv
agaccgacugcgggccagc

SEQ ID NO: 1324346 - RNA, 14 nt, Mycobacterium tuberculosis H37Rv
agaccgcggccggc

SEQ ID NO: 1324347 - RNA, 21 nt, Mycobacterium tuberculosis H37Rv
agaccggaaaccacagcgcca

SEQ ID NO: 1324348 - RNA, 20 nt, Mycobacterium tuberculosis H37Rv
agaccgggucguagccgaac

SEQ ID NO: 1324349 - RNA, 14 nt, Mycobacterium tuberculosis H37Rv
agaccguccagcaa

SEQ ID NO: 1324350 - RNA, 19 nt, Mycobacterium tuberculosis H37Rv
agaccguccagcaacagcg

SEQ ID NO: 1324351 - RNA, 12 nt, Mycobacterium tuberculosis H37Rv
agaccugguuga

SEQ ID NO: 1324352 - RNA, 11 nt, Mycobacterium tuberculosis H37Rv
agaccuucuug

SEQ ID NO: 1324353 - RNA, 16 nt, Mycobacterium tuberculosis H37Rv
agacgaacgaccaggc

SEQ ID NO: 1324354 - RNA, 20 nt, Mycobacterium tuberculosis H37Rv
agacgcaugucgggccaggc

SEQ ID NO: 1324355 - RNA, 19 nt, Mycobacterium tuberculosis H37Rv
agaccaacauacagcaauc

SEQ ID NO: 1324356 - RNA, 21 nt, Mycobacterium tuberculosis H37Rv
agaccaagagcgcgcagcagu

SEQ ID NO: 1324357 - RNA, 13 nt, Mycobacterium tuberculosis H37Rv
agacaugggugaa

SEQ ID NO: 1324358 - RNA, 20 nt, Mycobacterium tuberculosis H37Rv
agacaugccggcgagggcgc

SEQ ID NO: 1324359 - RNA, 16 nt, Mycobacterium tuberculosis H37Rv
agacccgggccaguuc

SEQ ID NO: 1324360 - RNA, 13 nt, Mycobacterium tuberculosis H37Rv
agaccgaacagcg

SEQ ID NO: 1324361 - RNA, 14 nt, Mycobacterium tuberculosis H37Rv
agacccguccggag

SEQ ID NO: 1324362 - RNA, 18 nt, Mycobacterium tuberculosis H37Rv
agaccaaugaccgccagc

SEQ ID NO: 1324363 - RNA, 17 nt, Mycobacterium tuberculosis H37Rv
agaccaagugucgccgc

SEQ ID NO: 1324364 - RNA, 11 nt, Mycobacterium tuberculosis H37Rv
agaccaagucc

SEQ ID NO: 1324365 - RNA, 22 nt, Mycobacterium tuberculosis H37Rv
agacgcgggucuuggcacacag

SEQ ID NO: 1324366 - RNA, 18 nt, Mycobacterium tuberculosis H37Rv
agacgcucuugaauagga

SEQ ID NO: 1324367 - RNA, 14 nt, Mycobacterium tuberculosis H37Rv
agacgcgaaagcac

SEQ ID NO: 1324368 - RNA, 18 nt, Mycobacterium tuberculosis H37Rv
agacgccacugccagccg

SEQ ID NO: 1324369 - RNA, 13 nt, Mycobacterium tuberculosis H37Rv
agacggcaccccc

SEQ ID NO: 1324370 - RNA, 19 nt, Mycobacterium tuberculosis H37Rv
agacgcugcccaaaagcgc

SEQ ID NO: 1324371 - RNA, 19 nt, Mycobacterium tuberculosis H37Rv
agacugggcgcuggaggcc

SEQ ID NO: 1324372 - RNA, 22 nt, Mycobacterium tuberculosis H37Rv
agacugggcgcuggaggccacc

SEQ ID NO: 1324373 - RNA, 23 nt, Mycobacterium tuberculosis H37Rv
agagaaggcggcgucgagcaccu

SEQ ID NO: 1324374 - RNA, 16 nt, Mycobacterium tuberculosis H37Rv
agacuugcugcuccuu

SEQ ID NO: 1324375 - RNA, 12 nt, Mycobacterium tuberculosis H37Rv
agagccagcaac

SEQ ID NO: 1324376 - RNA, 13 nt, Mycobacterium tuberculosis H37Rv
agagccaacgcgc

SEQ ID NO: 1324377 - RNA, 14 nt, Mycobacterium tuberculosis H37Rv
agagccaacgcgcg

SEQ ID NO: 1324378 - RNA, 18 nt, Mycobacterium tuberculosis H37Rv
agagcaugccgcccgcgc

SEQ ID NO: 1324379 - RNA, 19 nt, Mycobacterium tuberculosis H37Rv
agagccccgaccagcagac

SEQ ID NO: 1324380 - RNA, 14 nt, Mycobacterium tuberculosis H37Rv
agagccccgaccag

SEQ ID NO: 1324381 - RNA, 17 nt, Mycobacterium tuberculosis H37Rv
agagccccgaccagcag

SEQ ID NO: 1324382 - RNA, 18 nt, Mycobacterium tuberculosis H37Rv
agagccccgaccagcaga

SEQ ID NO: 1324383 - RNA, 11 nt, Mycobacterium tuberculosis H37Rv
agagccgccgu

SEQ ID NO: 1324384 - RNA, 19 nt, Mycobacterium tuberculosis H37Rv
agagccggcggcgaccaga

SEQ ID NO: 1324385 - RNA, 22 nt, Mycobacterium tuberculosis H37Rv
agagcagaucuuccgagcacuc

SEQ ID NO: 1324386 - RNA, 13 nt, Mycobacterium tuberculosis H37Rv
agagcagccagcc

SEQ ID NO: 1324387 - RNA, 18 nt, Mycobacterium tuberculosis H37Rv
agagacaugucgcugccg

SEQ ID NO: 1324388 - RNA, 11 nt, Mycobacterium tuberculosis H37Rv
agagaccaagg

SEQ ID NO: 1324389 - RNA, 23 nt, Mycobacterium tuberculosis H37Rv
agagcucgaaguuggcuuucggu

SEQ ID NO: 1324390 - RNA, 14 nt, Mycobacterium tuberculosis H37Rv
agagcgucgaacac

SEQ ID NO: 1324391 - RNA, 12 nt, Mycobacterium tuberculosis H37Rv
agaggacugcgg

SEQ ID NO: 1324392 - RNA, 18 nt, Mycobacterium tuberculosis H37Rv
agaggacugcggucugga

SEQ ID NO: 1324393 - RNA, 14 nt, Mycobacterium tuberculosis H37Rv
agagguuggcggcc

SEQ ID NO: 1324394 - RNA, 17 nt, Mycobacterium tuberculosis H37Rv
agaaacacgacagccag

SEQ ID NO: 1324395 - RNA, 15 nt, Mycobacterium tuberculosis H37Rv
agaaauccuuugaga

SEQ ID NO: 1324396 - RNA, 19 nt, Mycobacterium tuberculosis H37Rv
acuugugccacuucuucac

SEQ ID NO: 1324397 - RNA, 20 nt, Mycobacterium tuberculosis H37Rv
acuuugagucguuggacggc

SEQ ID NO: 1324398 - RNA, 19 nt, Mycobacterium tuberculosis H37Rv
acuuucgaagaaccgccac

SEQ ID NO: 1324399 - RNA, 19 nt, Mycobacterium tuberculosis H37Rv
acuuucgcccagucgccgc

SEQ ID NO: 1324400 - RNA, 21 nt, Mycobacterium tuberculosis H37Rv
acuucgcuggaaaccucuucg

SEQ ID NO: 1324401 - RNA, 12 nt, Mycobacterium tuberculosis H37Rv
acuucggccaca

SEQ ID NO: 1324402 - RNA, 15 nt, Mycobacterium tuberculosis H37Rv
acuucggccacaacc

SEQ ID NO: 1324403 - RNA, 16 nt, Mycobacterium tuberculosis H37Rv
acuuccagcccggcaa

SEQ ID NO: 1324404 - RNA, 17 nt, Mycobacterium tuberculosis H37Rv
acuuccagcccggcaau

SEQ ID NO: 1324405 - RNA, 22 nt, Mycobacterium tuberculosis H37Rv
acuuccaagccgaccugcugga

SEQ ID NO: 1324406 - RNA, 13 nt, Mycobacterium tuberculosis H37Rv
acuucgugccucg

SEQ ID NO: 1324407 - RNA, 18 nt, Mycobacterium tuberculosis H37Rv
acuucugguaggcggcca

SEQ ID NO: 1324408 - RNA, 19 nt, Mycobacterium tuberculosis H37Rv
acuugagcuccucacggau

SEQ ID NO: 1324409 - RNA, 19 nt, Mycobacterium tuberculosis H37Rv
acuugcaggcgucccagcc

SEQ ID NO: 1324410 - RNA, 18 nt, Mycobacterium tuberculosis H37Rv
acuugccacggcccgguu

SEQ ID NO: 1324411 - RNA, 13 nt, Mycobacterium tuberculosis H37Rv
acuugcacgcugu

SEQ ID NO: 1324412 - RNA, 23 nt, Mycobacterium tuberculosis H37Rv
acuuggcggucgguuccggugua

SEQ ID NO: 1324413 - RNA, 12 nt, Mycobacterium tuberculosis H37Rv
acuugcugcucc

SEQ ID NO: 1324414 - RNA, 14 nt, Mycobacterium tuberculosis H37Rv
acuugcucacccgu

SEQ ID NO: 1324415 - RNA, 22 nt, Mycobacterium tuberculosis H37Rv
acuugcgccaccguggccgcag

SEQ ID NO: 1324416 - RNA, 17 nt, Mycobacterium tuberculosis H37Rv
acuguuggugccgccac

SEQ ID NO: 1324417 - RNA, 20 nt, Mycobacterium tuberculosis H37Rv
acugugccgcugcauccgca

SEQ ID NO: 1324418 - RNA, 18 nt, Mycobacterium tuberculosis H37Rv
acuguccgcccggaaaaa

SEQ ID NO: 1324419 - RNA, 18 nt, Mycobacterium tuberculosis H37Rv
acuguccugccagaagac

SEQ ID NO: 1324420 - RNA, 21 nt, Mycobacterium tuberculosis H37Rv
acugugguggaacuccgggug

SEQ ID NO: 1324421 - RNA, 15 nt, Mycobacterium tuberculosis H37Rv
acugugcgccugcgu

SEQ ID NO: 1324422 - RNA, 20 nt, Mycobacterium tuberculosis H37Rv
acugugcucgccggaucuug

SEQ ID NO: 1324423 - RNA, 14 nt, Mycobacterium tuberculosis H37Rv
acugacccugaucg

SEQ ID NO: 1324424 - RNA, 17 nt, Mycobacterium tuberculosis H37Rv
acugaccucgucaauca

SEQ ID NO: 1324425 - RNA, 23 nt, Mycobacterium tuberculosis H37Rv
acugaccucgucaaucaccaccg

SEQ ID NO: 1324426 - RNA, 19 nt, Mycobacterium tuberculosis H37Rv
acugacgucgaacucccac

SEQ ID NO: 1324427 - RNA, 20 nt, Mycobacterium tuberculosis H37Rv
acuguccccguugagauacc

SEQ ID NO: 1324428 - RNA, 19 nt, Mycobacterium tuberculosis H37Rv
acuuaccgaggccaugcuc

SEQ ID NO: 1324429 - RNA, 16 nt, Mycobacterium tuberculosis H37Rv
acuuaccgagccguca

SEQ ID NO: 1324430 - RNA, 21 nt, Mycobacterium tuberculosis H37Rv
acgcccugaagggccgccucg

SEQ ID NO: 1324431 - RNA, 11 nt, Mycobacterium tuberculosis H37Rv
acgcccucggg

SEQ ID NO: 1324432 - RNA, 14 nt, Mycobacterium tuberculosis H37Rv
acgcccguguugaa

SEQ ID NO: 1324433 - RNA, 16 nt, Mycobacterium tuberculosis H37Rv
acgcccgcaucgccuc

SEQ ID NO: 1324434 - RNA, 18 nt, Mycobacterium tuberculosis H37Rv
acgcccgaguugaagaau

SEQ ID NO: 1324435 - RNA, 22 nt, Mycobacterium tuberculosis H37Rv
acgcccgaguuaaacgcagcgg

SEQ ID NO: 1324436 - RNA, 22 nt, Mycobacterium tuberculosis H37Rv
acgcccgcucggagaucgccac

SEQ ID NO: 1324437 - RNA, 19 nt, Mycobacterium tuberculosis H37Rv
acgcccgacgccagcugcc

SEQ ID NO: 1324438 - RNA, 17 nt, Mycobacterium tuberculosis H37Rv
acgcccgaaucgccggc

SEQ ID NO: 1324439 - RNA, 22 nt, Mycobacterium tuberculosis H37Rv
acgcccgaaucgccggcggcca

SEQ ID NO: 1324440 - RNA, 14 nt, Mycobacterium tuberculosis H37Rv
acgccccgccacaa

SEQ ID NO: 1324441 - RNA, 15 nt, Mycobacterium tuberculosis H37Rv
acgcccacuccagca

SEQ ID NO: 1324442 - RNA, 17 nt, Mycobacterium tuberculosis H37Rv
acgcccacuccagcagc

SEQ ID NO: 1324443 - RNA, 12 nt, Mycobacterium tuberculosis H37Rv
acgcccaccacg

SEQ ID NO: 1324444 - RNA, 22 nt, Mycobacterium tuberculosis H37Rv
acgcccagcgcccgcgcggcca

SEQ ID NO: 1324445 - RNA, 19 nt, Mycobacterium tuberculosis H37Rv
acgccgaccgcgccgcauc

SEQ ID NO: 1324446 - RNA, 22 nt, Mycobacterium tuberculosis H37Rv
acgccgaaaaugccgcccagcg

SEQ ID NO: 1324447 - RNA, 19 nt, Mycobacterium tuberculosis H37Rv
acgccgaacgcgagguucc

SEQ ID NO: 1324448 - RNA, 15 nt, Mycobacterium tuberculosis H37Rv
acgccgaaaaugccg

SEQ ID NO: 1324449 - RNA, 18 nt, Mycobacterium tuberculosis H37Rv
acgccgauaccgugcacc

SEQ ID NO: 1324450 - RNA, 19 nt, Mycobacterium tuberculosis H37Rv
acgccgagaugcugcaccc

SEQ ID NO: 1324451 - RNA, 15 nt, Mycobacterium tuberculosis H37Rv
acgccgcgcagccgg

SEQ ID NO: 1324452 - RNA, 17 nt, Mycobacterium tuberculosis H37Rv
acgccgccggccccgcc

SEQ ID NO: 1324453 - RNA, 14 nt, Mycobacterium tuberculosis H37Rv
acgccgccagcaga

SEQ ID NO: 1324454 - RNA, 19 nt, Mycobacterium tuberculosis H37Rv
acgccguagcgcagcgccu

SEQ ID NO: 1324455 - RNA, 22 nt, Mycobacterium tuberculosis H37Rv
acgccgucaccgcugagccccc

SEQ ID NO: 1324456 - RNA, 16 nt, Mycobacterium tuberculosis H37Rv
acgccgucggcgcgca

SEQ ID NO: 1324457 - RNA, 23 nt, Mycobacterium tuberculosis H37Rv
acgccgguggcacggccccugcc

SEQ ID NO: 1324458 - RNA, 23 nt, Mycobacterium tuberculosis H37Rv
acgccguagcaucgggcgagcuc

SEQ ID NO: 1324459 - RNA, 19 nt, Mycobacterium tuberculosis H37Rv
acgccggcccggugaugaa

SEQ ID NO: 1324460 - RNA, 14 nt, Mycobacterium tuberculosis H37Rv
acgccggccuggcc

SEQ ID NO: 1324461 - RNA, 14 nt, Mycobacterium tuberculosis H37Rv
acgccggcgccgcc

SEQ ID NO: 1324462 - RNA, 14 nt, Mycobacterium tuberculosis H37Rv
acgccggcaugcca

SEQ ID NO: 1324463 - RNA, 11 nt, Mycobacterium tuberculosis H37Rv
acgccggcauc

SEQ ID NO: 1324464 - RNA, 19 nt, Mycobacterium tuberculosis H37Rv
acgccgggaauuucgacac

SEQ ID NO: 1324465 - RNA, 13 nt, Mycobacterium tuberculosis H37Rv
acgccggcaccga

SEQ ID NO: 1324466 - RNA, 22 nt, Mycobacterium tuberculosis H37Rv
acgccucgccggccgccagccg

SEQ ID NO: 1324467 - RNA, 14 nt, Mycobacterium tuberculosis H37Rv
acgccugagccacc

SEQ ID NO: 1324468 - RNA, 15 nt, Mycobacterium tuberculosis H37Rv
acgccugagccacca

SEQ ID NO: 1324469 - RNA, 17 nt, Mycobacterium tuberculosis H37Rv
acgccugcucggagagc

SEQ ID NO: 1324470 - RNA, 22 nt, Mycobacterium tuberculosis H37Rv
acgccuuguuggcgcccgggcc

SEQ ID NO: 1324471 - RNA, 14 nt, Mycobacterium tuberculosis H37Rv
acgccuugcacaag

SEQ ID NO: 1324472 - RNA, 16 nt, Mycobacterium tuberculosis H37Rv
accggauccacggaga

SEQ ID NO: 1324473 - RNA, 12 nt, Mycobacterium tuberculosis H37Rv
accggaguucag

SEQ ID NO: 1324474 - RNA, 16 nt, Mycobacterium tuberculosis H37Rv
accggagaucccgguc

SEQ ID NO: 1324475 - RNA, 13 nt, Mycobacterium tuberculosis H37Rv
acgcacggccacc

SEQ ID NO: 1324476 - RNA, 17 nt, Mycobacterium tuberculosis H37Rv
acgcacgcagccccucg

SEQ ID NO: 1324477 - RNA, 13 nt, Mycobacterium tuberculosis H37Rv
acgcacccggcaa

SEQ ID NO: 1324478 - RNA, 15 nt, Mycobacterium tuberculosis H37Rv
acgcagaaucgccua

SEQ ID NO: 1324479 - RNA, 18 nt, Mycobacterium tuberculosis H37Rv
acgcagaccguccagcaa

SEQ ID NO: 1324480 - RNA, 19 nt, Mycobacterium tuberculosis H37Rv
acgcagaccguccagcaac

SEQ ID NO: 1324481 - RNA, 20 nt, Mycobacterium tuberculosis H37Rv
acgcacucccgagccacaaa

SEQ ID NO: 1324482 - RNA, 17 nt, Mycobacterium tuberculosis H37Rv
acgcacugccgcggacg

SEQ ID NO: 1324483 - RNA, 12 nt, Mycobacterium tuberculosis H37Rv
acgcagcccguc

SEQ ID NO: 1324484 - RNA, 19 nt, Mycobacterium tuberculosis H37Rv
acgcagcacguucaggugc

SEQ ID NO: 1324485 - RNA, 22 nt, Mycobacterium tuberculosis H37Rv
acgcagagccaacaaaucaggg

SEQ ID NO: 1324486 - RNA, 23 nt, Mycobacterium tuberculosis H37Rv
acgcauaagcccccgcacgcacg

SEQ ID NO: 1324487 - RNA, 15 nt, Mycobacterium tuberculosis H37Rv
acgccaacgccagcg

SEQ ID NO: 1324488 - RNA, 20 nt, Mycobacterium tuberculosis H37Rv
acgccaagcucggcccagcg

SEQ ID NO: 1324489 - RNA, 17 nt, Mycobacterium tuberculosis H37Rv
acgccaccaccuccgcg

SEQ ID NO: 1324490 - RNA, 20 nt, Mycobacterium tuberculosis H37Rv
acgcaugcgagaacgucgag

SEQ ID NO: 1324491 - RNA, 15 nt, Mycobacterium tuberculosis H37Rv
acgcaugggccaggu

SEQ ID NO: 1324492 - RNA, 17 nt, Mycobacterium tuberculosis H37Rv
acgcauguuggugauca

SEQ ID NO: 1324493 - RNA, 15 nt, Mycobacterium tuberculosis H37Rv
acgccaccggcaauc

SEQ ID NO: 1324494 - RNA, 12 nt, Mycobacterium tuberculosis H37Rv
acgccaccaccu

SEQ ID NO: 1324495 - RNA, 18 nt, Mycobacterium tuberculosis H37Rv
acgccacggcaucggcca

SEQ ID NO: 1324496 - RNA, 16 nt, Mycobacterium tuberculosis H37Rv
acgccagaacguggcc

SEQ ID NO: 1324497 - RNA, 20 nt, Mycobacterium tuberculosis H37Rv
acgccagaccgacugcgggc

SEQ ID NO: 1324498 - RNA, 15 nt, Mycobacterium tuberculosis H37Rv
acgccagcaccagcg

SEQ ID NO: 1324499 - RNA, 20 nt, Mycobacterium tuberculosis H37Rv
acgccaggggacccggggcc

SEQ ID NO: 1324500 - RNA, 22 nt, Mycobacterium tuberculosis H37Rv
acgccaguguugcgcugcggcc

SEQ ID NO: 1324501 - RNA, 23 nt, Mycobacterium tuberculosis H37Rv
acgccagugaacgcgcgugcagc

SEQ ID NO: 1324502 - RNA, 14 nt, Mycobacterium tuberculosis H37Rv
acgccaucgagcag

SEQ ID NO: 1324503 - RNA, 16 nt, Mycobacterium tuberculosis H37Rv
acgccaucgagcagca

SEQ ID NO: 1324504 - RNA, 23 nt, Mycobacterium tuberculosis H37Rv
acgccauucaucggcaucgacug

SEQ ID NO: 1324505 - RNA, 14 nt, Mycobacterium tuberculosis H37Rv
acgccaugcccgca

SEQ ID NO: 1324506 - RNA, 19 nt, Mycobacterium tuberculosis H37Rv
acgcugcccgccagcccau

SEQ ID NO: 1324507 - RNA, 15 nt, Mycobacterium tuberculosis H37Rv
acgcugcaggcggcc

SEQ ID NO: 1324508 - RNA, 19 nt, Mycobacterium tuberculosis H37Rv
acgcugcccacgggccggc

SEQ ID NO: 1324509 - RNA, 16 nt, Mycobacterium tuberculosis H37Rv
acgcugacgugaagca

SEQ ID NO: 1324510 - RNA, 20 nt, Mycobacterium tuberculosis H37Rv
acgcugaguccccagguggg

SEQ ID NO: 1324511 - RNA, 14 nt, Mycobacterium tuberculosis H37Rv
acgcuugcggcugc

SEQ ID NO: 1324512 - RNA, 15 nt, Mycobacterium tuberculosis H37Rv
acgcuucaccucguc

SEQ ID NO: 1324513 - RNA, 13 nt, Mycobacterium tuberculosis H37Rv
acggagggcagga

SEQ ID NO: 1324514 - RNA, 14 nt, Mycobacterium tuberculosis H37Rv
acggcagcacgguc

SEQ ID NO: 1324515 - RNA, 14 nt, Mycobacterium tuberculosis H37Rv
acggcagaccaugg

SEQ ID NO: 1324516 - RNA, 15 nt, Mycobacterium tuberculosis H37Rv
acggcagaccauggu

SEQ ID NO: 1324517 - RNA, 14 nt, Mycobacterium tuberculosis H37Rv
acggcacuagcccg

SEQ ID NO: 1324518 - RNA, 21 nt, Mycobacterium tuberculosis H37Rv
acggcacccugcggcaccuca

SEQ ID NO: 1324519 - RNA, 22 nt, Mycobacterium tuberculosis H37Rv
acggcacccaauccggcgccag

SEQ ID NO: 1324520 - RNA, 22 nt, Mycobacterium tuberculosis H37Rv
acggcacccaauuucgaccaga

SEQ ID NO: 1324521 - RNA, 18 nt, Mycobacterium tuberculosis H37Rv
acggcacccacccguucg

SEQ ID NO: 1324522 - RNA, 20 nt, Mycobacterium tuberculosis H37Rv
acggcaccaccaagcucggc

SEQ ID NO: 1324523 - RNA, 17 nt, Mycobacterium tuberculosis H37Rv
acggaggccuccacaua

SEQ ID NO: 1324524 - RNA, 15 nt, Mycobacterium tuberculosis H37Rv
acggcguccaagaac

SEQ ID NO: 1324525 - RNA, 14 nt, Mycobacterium tuberculosis H37Rv
acggcgcgccgacc

SEQ ID NO: 1324526 - RNA, 21 nt, Mycobacterium tuberculosis H37Rv
acggcgccaggcaccacgacc

SEQ ID NO: 1324527 - RNA, 16 nt, Mycobacterium tuberculosis H37Rv
acggcgccgaacccgg

SEQ ID NO: 1324528 - RNA, 14 nt, Mycobacterium tuberculosis H37Rv
acggcgccgaaccc

SEQ ID NO: 1324529 - RNA, 22 nt, Mycobacterium tuberculosis H37Rv
acggcaucugaaaauugacccc

SEQ ID NO: 1324530 - RNA, 16 nt, Mycobacterium tuberculosis H37Rv
acggcgauggcgcgca

SEQ ID NO: 1324531 - RNA, 15 nt, Mycobacterium tuberculosis H37Rv
acggcaggcagggca

SEQ ID NO: 1324532 - RNA, 20 nt, Mycobacterium tuberculosis H37Rv
acggcugccgucagccguuc

SEQ ID NO: 1324533 - RNA, 20 nt, Mycobacterium tuberculosis H37Rv
acggcuuccaacucggcggc

SEQ ID NO: 1324534 - RNA, 16 nt, Mycobacterium tuberculosis H37Rv
acggcuucuccauguc

SEQ ID NO: 1324535 - RNA, 15 nt, Mycobacterium tuberculosis H37Rv
acggcuuggcugccu

SEQ ID NO: 1324536 - RNA, 19 nt, Mycobacterium tuberculosis H37Rv
acggcuuugcggcgcgacc

SEQ ID NO: 1324537 - RNA, 17 nt, Mycobacterium tuberculosis H37Rv
acggcguugucgacgaa

SEQ ID NO: 1324538 - RNA, 18 nt, Mycobacterium tuberculosis H37Rv
acggcguuacguggugga

SEQ ID NO: 1324539 - RNA, 16 nt, Mycobacterium tuberculosis H37Rv
acggcguugccggaga

SEQ ID NO: 1324540 - RNA, 19 nt, Mycobacterium tuberculosis H37Rv
acggcguggucggcaaagc

SEQ ID NO: 1324541 - RNA, 16 nt, Mycobacterium tuberculosis H37Rv
acggcguggucggcaa

SEQ ID NO: 1324542 - RNA, 21 nt, Mycobacterium tuberculosis H37Rv
acggcgucuuccucggccacc

SEQ ID NO: 1324543 - RNA, 19 nt, Mycobacterium tuberculosis H37Rv
acggcgucggccaccgccu

SEQ ID NO: 1324544 - RNA, 15 nt, Mycobacterium tuberculosis H37Rv
acggcgucggccacc

SEQ ID NO: 1324545 - RNA, 18 nt, Mycobacterium tuberculosis H37Rv
acgcguugcacagcagcg

SEQ ID NO: 1324546 - RNA, 18 nt, Mycobacterium tuberculosis H37Rv
acgcguuccuccagcagc

SEQ ID NO: 1324547 - RNA, 18 nt, Mycobacterium tuberculosis H37Rv
acgcguggcauccagcag

SEQ ID NO: 1324548 - RNA, 17 nt, Mycobacterium tuberculosis H37Rv
acgcgugcacgauacuc

SEQ ID NO: 1324549 - RNA, 20 nt, Mycobacterium tuberculosis H37Rv
acgcguggcauccagcagcg

SEQ ID NO: 1324550 - RNA, 16 nt, Mycobacterium tuberculosis H37Rv
acgcgguuuugugcgg

SEQ ID NO: 1324551 - RNA, 17 nt, Mycobacterium tuberculosis H37Rv
acgcgucgugccacuuc

SEQ ID NO: 1324552 - RNA, 18 nt, Mycobacterium tuberculosis H37Rv
acgcgucguggucggcga

SEQ ID NO: 1324553 - RNA, 13 nt, Mycobacterium tuberculosis H37Rv
acgcucacgcugc

SEQ ID NO: 1324554 - RNA, 13 nt, Mycobacterium tuberculosis H37Rv
acgcuaccgccgg

SEQ ID NO: 1324555 - RNA, 13 nt, Mycobacterium tuberculosis H37Rv
acgcuaaagcccc

SEQ ID NO: 1324556 - RNA, 16 nt, Mycobacterium tuberculosis H37Rv
acgcuaaauuuugcgc

SEQ ID NO: 1324557 - RNA, 16 nt, Mycobacterium tuberculosis H37Rv
acgcucgcugcagcag

SEQ ID NO: 1324558 - RNA, 13 nt, Mycobacterium tuberculosis H37Rv
acgcucgcgcacc

SEQ ID NO: 1324559 - RNA, 14 nt, Mycobacterium tuberculosis H37Rv
acgcucaugaccgc

SEQ ID NO: 1324560 - RNA, 16 nt, Mycobacterium tuberculosis H37Rv
acgcuccccagcgaau

SEQ ID NO: 1324561 - RNA, 17 nt, Mycobacterium tuberculosis H37Rv
acgcuccagcucggcca

SEQ ID NO: 1324562 - RNA, 20 nt, Mycobacterium tuberculosis H37Rv
acgcucggugcugcgccgau

SEQ ID NO: 1324563 - RNA, 21 nt, Mycobacterium tuberculosis H37Rv
acgcucguuugcgagcagggg

SEQ ID NO: 1324564 - RNA, 19 nt, Mycobacterium tuberculosis H37Rv
acgcucguagaaccggggu

SEQ ID NO: 1324565 - RNA, 16 nt, Mycobacterium tuberculosis H37Rv
acgcucggcacggagu

SEQ ID NO: 1324566 - RNA, 23 nt, Mycobacterium tuberculosis H37Rv
acgcucggcggccagcucccgcg

SEQ ID NO: 1324567 - RNA, 21 nt, Mycobacterium tuberculosis H37Rv
acgcucggcgugucgggggcu

SEQ ID NO: 1324568 - RNA, 19 nt, Mycobacterium tuberculosis H37Rv
acgcucggcguccgcccag

SEQ ID NO: 1324569 - RNA, 23 nt, Mycobacterium tuberculosis H37Rv
acgcucggcguccgcccagcacc

SEQ ID NO: 1324570 - RNA, 14 nt, Mycobacterium tuberculosis H37Rv
acgcucggcgggga

SEQ ID NO: 1324571 - RNA, 20 nt, Mycobacterium tuberculosis H37Rv
acgcgcaacucgccacgguc

SEQ ID NO: 1324572 - RNA, 18 nt, Mycobacterium tuberculosis H37Rv
acgcgcacucgaccagga

SEQ ID NO: 1324573 - RNA, 20 nt, Mycobacterium tuberculosis H37Rv
acgcgaugaccgcaccgacc

SEQ ID NO: 1324574 - RNA, 12 nt, Mycobacterium tuberculosis H37Rv
acgcgaugcacg

SEQ ID NO: 1324575 - RNA, 17 nt, Mycobacterium tuberculosis H37Rv
acgcgagugcgugaucu

SEQ ID NO: 1324576 - RNA, 21 nt, Mycobacterium tuberculosis H37Rv
acgcgagcgcuaucaccgccu

SEQ ID NO: 1324577 - RNA, 19 nt, Mycobacterium tuberculosis H37Rv
acgcgaguccgcugcuucu

SEQ ID NO: 1324578 - RNA, 17 nt, Mycobacterium tuberculosis H37Rv
acgcgacgguguagccc

SEQ ID NO: 1324579 - RNA, 11 nt, Mycobacterium tuberculosis H37Rv
acgcgcaugcc

SEQ ID NO: 1324580 - RNA, 18 nt, Mycobacterium tuberculosis H37Rv
acgcgcauucgccgggcg

SEQ ID NO: 1324581 - RNA, 15 nt, Mycobacterium tuberculosis H37Rv
acgcgcaaccagccu

SEQ ID NO: 1324582 - RNA, 19 nt, Mycobacterium tuberculosis H37Rv
acgcggucugcuccaggcg

SEQ ID NO: 1324583 - RNA, 21 nt, Mycobacterium tuberculosis H37Rv
acgcggggcucaaccccgucc

SEQ ID NO: 1324584 - RNA, 23 nt, Mycobacterium tuberculosis H37Rv
acgcgggcguuggccagcagguu

SEQ ID NO: 1324585 - RNA, 15 nt, Mycobacterium tuberculosis H37Rv
acgcgggugccagau

SEQ ID NO: 1324586 - RNA, 12 nt, Mycobacterium tuberculosis H37Rv
acgcggcggccu

SEQ ID NO: 1324587 - RNA, 21 nt, Mycobacterium tuberculosis H37Rv
acgcggaucgggcaccccgac

SEQ ID NO: 1324588 - RNA, 12 nt, Mycobacterium tuberculosis H37Rv
acgcggacaccg

SEQ ID NO: 1324589 - RNA, 15 nt, Mycobacterium tuberculosis H37Rv
acgcggaucgggcac

SEQ ID NO: 1324590 - RNA, 12 nt, Mycobacterium tuberculosis H37Rv
acgcgcgcucgc

SEQ ID NO: 1324591 - RNA, 21 nt, Mycobacterium tuberculosis H37Rv
acgcgcggaucgucgaggcac

SEQ ID NO: 1324592 - RNA, 13 nt, Mycobacterium tuberculosis H37Rv
acguguucugguc

SEQ ID NO: 1324593 - RNA, 18 nt, Mycobacterium tuberculosis H37Rv
acgugugcaccaucauca

SEQ ID NO: 1324594 - RNA, 15 nt, Mycobacterium tuberculosis H37Rv
acguguuaaccgggc

SEQ ID NO: 1324595 - RNA, 14 nt, Mycobacterium tuberculosis H37Rv
acgugucccgcaug

SEQ ID NO: 1324596 - RNA, 16 nt, Mycobacterium tuberculosis H37Rv
acguggugggcuuggc

SEQ ID NO: 1324597 - RNA, 14 nt, Mycobacterium tuberculosis H37Rv
acguggucggccac

SEQ ID NO: 1324598 - RNA, 15 nt, Mycobacterium tuberculosis H37Rv
acguggucggccacc

SEQ ID NO: 1324599 - RNA, 18 nt, Mycobacterium tuberculosis H37Rv
acgugguggaccucacug

SEQ ID NO: 1324600 - RNA, 19 nt, Mycobacterium tuberculosis H37Rv
acguggguacgcaucucga

SEQ ID NO: 1324601 - RNA, 18 nt, Mycobacterium tuberculosis H37Rv
acguggcgaccggcgacc

SEQ ID NO: 1324602 - RNA, 15 nt, Mycobacterium tuberculosis H37Rv
acguggcccuccucg

SEQ ID NO: 1324603 - RNA, 18 nt, Mycobacterium tuberculosis H37Rv
acguggaucaccaugugg

SEQ ID NO: 1324604 - RNA, 16 nt, Mycobacterium tuberculosis H37Rv
acgugcaccagguugc

SEQ ID NO: 1324605 - RNA, 19 nt, Mycobacterium tuberculosis H37Rv
acgugcaaccauggcggcu

SEQ ID NO: 1324606 - RNA, 15 nt, Mycobacterium tuberculosis H37Rv
acgugcacaggcauc

SEQ ID NO: 1324607 - RNA, 21 nt, Mycobacterium tuberculosis H37Rv
acgugaucgcgguccaacagc

SEQ ID NO: 1324608 - RNA, 23 nt, Mycobacterium tuberculosis H37Rv
acgugaucgcgguccaacagcgc

SEQ ID NO: 1324609 - RNA, 17 nt, Mycobacterium tuberculosis H37Rv
acgugaguuucaccacu

SEQ ID NO: 1324610 - RNA, 23 nt, Mycobacterium tuberculosis H37Rv
acgucuucgggcucguccagcaa

SEQ ID NO: 1324611 - RNA, 15 nt, Mycobacterium tuberculosis H37Rv
acgucuggguugcgu

SEQ ID NO: 1324612 - RNA, 18 nt, Mycobacterium tuberculosis H37Rv
acgugaauuaaggugacc

SEQ ID NO: 1324613 - RNA, 20 nt, Mycobacterium tuberculosis H37Rv
acgggauaaaacccggaauc

SEQ ID NO: 1324614 - RNA, 20 nt, Mycobacterium tuberculosis H37Rv
acgggaucgcccaggcgcga

SEQ ID NO: 1324615 - RNA, 19 nt, Mycobacterium tuberculosis H37Rv
acguaggcggcggcccgca

SEQ ID NO: 1324616 - RNA, 15 nt, Mycobacterium tuberculosis H37Rv
acguagcgcccaccg

SEQ ID NO: 1324617 - RNA, 15 nt, Mycobacterium tuberculosis H37Rv
acguaggacugccag

SEQ ID NO: 1324618 - RNA, 20 nt, Mycobacterium tuberculosis H37Rv
acguagacgacgucggccgc

SEQ ID NO: 1324619 - RNA, 17 nt, Mycobacterium tuberculosis H37Rv
acguagacgguccgguc

SEQ ID NO: 1324620 - RNA, 13 nt, Mycobacterium tuberculosis H37Rv
acgucagugcccc

SEQ ID NO: 1324621 - RNA, 14 nt, Mycobacterium tuberculosis H37Rv
acgucagugccccg

SEQ ID NO: 1324622 - RNA, 21 nt, Mycobacterium tuberculosis H37Rv
acgucauaucucgagcccucg

SEQ ID NO: 1324623 - RNA, 18 nt, Mycobacterium tuberculosis H37Rv
acgucaucuggcgcugcu

SEQ ID NO: 1324624 - RNA, 15 nt, Mycobacterium tuberculosis H37Rv
acgucaaacccgaca

SEQ ID NO: 1324625 - RNA, 16 nt, Mycobacterium tuberculosis H37Rv
acguauuucgcccccu

SEQ ID NO: 1324626 - RNA, 14 nt, Mycobacterium tuberculosis H37Rv
acuaacaacaccac

SEQ ID NO: 1324627 - RNA, 21 nt, Mycobacterium tuberculosis H37Rv
acuaggcuuuccggggaauga

SEQ ID NO: 1324628 - RNA, 16 nt, Mycobacterium tuberculosis H37Rv
acuagguucagcgacu

SEQ ID NO: 1324629 - RNA, 17 nt, Mycobacterium tuberculosis H37Rv
acuagcgccccuggcac

SEQ ID NO: 1324630 - RNA, 20 nt, Mycobacterium tuberculosis H37Rv
acuagacgccgccgcugccg

SEQ ID NO: 1324631 - RNA, 15 nt, Mycobacterium tuberculosis H37Rv
acuagacgccgccgc

SEQ ID NO: 1324632 - RNA, 14 nt, Mycobacterium tuberculosis H37Rv
acuacggugcccug

SEQ ID NO: 1324633 - RNA, 16 nt, Mycobacterium tuberculosis H37Rv
acuccaccccacccag

SEQ ID NO: 1324634 - RNA, 22 nt, Mycobacterium tuberculosis H37Rv
acuccacgaucggcccagcccu

SEQ ID NO: 1324635 - RNA, 14 nt, Mycobacterium tuberculosis H37Rv
acuccaagucacag

SEQ ID NO: 1324636 - RNA, 11 nt, Mycobacterium tuberculosis H37Rv
acuccagcagc

SEQ ID NO: 1324637 - RNA, 11 nt, Mycobacterium tuberculosis H37Rv
acuccagcacc

SEQ ID NO: 1324638 - RNA, 13 nt, Mycobacterium tuberculosis H37Rv
acuccauggcauu

SEQ ID NO: 1324639 - RNA, 22 nt, Mycobacterium tuberculosis H37Rv
acuccaugagccguagugcaau

SEQ ID NO: 1324640 - RNA, 14 nt, Mycobacterium tuberculosis H37Rv
acuccagcuugccg

SEQ ID NO: 1324641 - RNA, 15 nt, Mycobacterium tuberculosis H37Rv
acucccacgaggacu

SEQ ID NO: 1324642 - RNA, 22 nt, Mycobacterium tuberculosis H37Rv
acucaucggccgcggucggcca

SEQ ID NO: 1324643 - RNA, 12 nt, Mycobacterium tuberculosis H37Rv
acuaugccaacg

SEQ ID NO: 1324644 - RNA, 23 nt, Mycobacterium tuberculosis H37Rv
acucacccgggcagccugcugca

SEQ ID NO: 1324645 - RNA, 12 nt, Mycobacterium tuberculosis H37Rv
acucaccagcac

SEQ ID NO: 1324646 - RNA, 15 nt, Mycobacterium tuberculosis H37Rv
acucaccgugaaccg

SEQ ID NO: 1324647 - RNA, 18 nt, Mycobacterium tuberculosis H37Rv
acucacauuggccagguc

SEQ ID NO: 1324648 - RNA, 23 nt, Mycobacterium tuberculosis H37Rv
acucacauuggccaggucggcca

SEQ ID NO: 1324649 - RNA, 15 nt, Mycobacterium tuberculosis H37Rv
acucacauuggccag

SEQ ID NO: 1324650 - RNA, 17 nt, Mycobacterium tuberculosis H37Rv
acucaccaaccgcauau

SEQ ID NO: 1324651 - RNA, 17 nt, Mycobacterium tuberculosis H37Rv
acucaguguuccgccac

SEQ ID NO: 1324652 - RNA, 17 nt, Mycobacterium tuberculosis H37Rv
acucagcccgucgggca

SEQ ID NO: 1324653 - RNA, 19 nt, Mycobacterium tuberculosis H37Rv
acucagaacguggccguua

SEQ ID NO: 1324654 - RNA, 18 nt, Mycobacterium tuberculosis H37Rv
acucacuaccgaucacau

SEQ ID NO: 1324655 - RNA, 20 nt, Mycobacterium tuberculosis H37Rv
acuccgccgauagcaccgga

SEQ ID NO: 1324656 - RNA, 18 nt, Mycobacterium tuberculosis H37Rv
acucccuggccgcuucga

SEQ ID NO: 1324657 - RNA, 22 nt, Mycobacterium tuberculosis H37Rv
acucccggauauugccaucccu

SEQ ID NO: 1324658 - RNA, 15 nt, Mycobacterium tuberculosis H37Rv
acucccccacacacc

SEQ ID NO: 1324659 - RNA, 20 nt, Mycobacterium tuberculosis H37Rv
acucguggcgccacggcagc

SEQ ID NO: 1324660 - RNA, 19 nt, Mycobacterium tuberculosis H37Rv
acucguucauguagcagcg

SEQ ID NO: 1324661 - RNA, 12 nt, Mycobacterium tuberculosis H37Rv
acucguagaacg

SEQ ID NO: 1324662 - RNA, 14 nt, Mycobacterium tuberculosis H37Rv
acucggcggccacc

SEQ ID NO: 1324663 - RNA, 16 nt, Mycobacterium tuberculosis H37Rv
acucggcggccagcgc

SEQ ID NO: 1324664 - RNA, 22 nt, Mycobacterium tuberculosis H37Rv
acucggcggccagcgcgucgcc

SEQ ID NO: 1324665 - RNA, 17 nt, Mycobacterium tuberculosis H37Rv
acucgggcaggccccac

SEQ ID NO: 1324666 - RNA, 15 nt, Mycobacterium tuberculosis H37Rv
acucgggcacgggug

SEQ ID NO: 1324667 - RNA, 18 nt, Mycobacterium tuberculosis H37Rv
acucggggcugucggcga

SEQ ID NO: 1324668 - RNA, 14 nt, Mycobacterium tuberculosis H37Rv
acucuccccuggcc

SEQ ID NO: 1324669 - RNA, 16 nt, Mycobacterium tuberculosis H37Rv
acucuucggaccggcu

SEQ ID NO: 1324670 - RNA, 18 nt, Mycobacterium tuberculosis H37Rv
acucuuguccagaaucca

SEQ ID NO: 1324671 - RNA, 15 nt, Mycobacterium tuberculosis H37Rv
acugaccaggucugc

SEQ ID NO: 1324672 - RNA, 23 nt, Mycobacterium tuberculosis H37Rv
acugaccgucugcgacccgggcc

SEQ ID NO: 1324673 - RNA, 15 nt, Mycobacterium tuberculosis H37Rv
acugaauuuggugaa

SEQ ID NO: 1324674 - RNA, 20 nt, Mycobacterium tuberculosis H37Rv
acugaaucgaccggaacugu

SEQ ID NO: 1324675 - RNA, 14 nt, Mycobacterium tuberculosis H37Rv
acaaaggugccgac

SEQ ID NO: 1324676 - RNA, 15 nt, Mycobacterium tuberculosis H37Rv
acaaacuccgacacc

SEQ ID NO: 1324677 - RNA, 20 nt, Mycobacterium tuberculosis H37Rv
acaaacaucgcacccaccac

SEQ ID NO: 1324678 - RNA, 23 nt, Mycobacterium tuberculosis H37Rv
acaaaccgugcacgucagcggau

SEQ ID NO: 1324679 - RNA, 22 nt, Mycobacterium tuberculosis H37Rv
acaaaccgucggggaugccgaa

SEQ ID NO: 1324680 - RNA, 16 nt, Mycobacterium tuberculosis H37Rv
acaaacaucgcaccca

SEQ ID NO: 1324681 - RNA, 13 nt, Mycobacterium tuberculosis H37Rv
acaacuccagcag

SEQ ID NO: 1324682 - RNA, 18 nt, Mycobacterium tuberculosis H37Rv
acaacuucgccggacccc

SEQ ID NO: 1324683 - RNA, 17 nt, Mycobacterium tuberculosis H37Rv
acaacgcccaccacgcg

SEQ ID NO: 1324684 - RNA, 18 nt, Mycobacterium tuberculosis H37Rv
acaaccgcccgccaggcc

SEQ ID NO: 1324685 - RNA, 20 nt, Mycobacterium tuberculosis H37Rv
acaaccgugagcaccagcag

SEQ ID NO: 1324686 - RNA, 22 nt, Mycobacterium tuberculosis H37Rv
acaaccgugagcaccagcagca

SEQ ID NO: 1324687 - RNA, 19 nt, Mycobacterium tuberculosis H37Rv
acaaccgcugcugcugccc

SEQ ID NO: 1324688 - RNA, 19 nt, Mycobacterium tuberculosis H37Rv
acaaccgugagcaccagca

SEQ ID NO: 1324689 - RNA, 15 nt, Mycobacterium tuberculosis H37Rv
acaacgccaggaacc

SEQ ID NO: 1324690 - RNA, 14 nt, Mycobacterium tuberculosis H37Rv
acaacgacaacacc

SEQ ID NO: 1324691 - RNA, 17 nt, Mycobacterium tuberculosis H37Rv
acaaccuggggccacca

SEQ ID NO: 1324692 - RNA, 20 nt, Mycobacterium tuberculosis H37Rv
acaaccacggcagauugacg

SEQ ID NO: 1324693 - RNA, 16 nt, Mycobacterium tuberculosis H37Rv
acaaacaccccacaca

SEQ ID NO: 1324694 - RNA, 12 nt, Mycobacterium tuberculosis H37Rv
acaaaaucagca

SEQ ID NO: 1324695 - RNA, 20 nt, Mycobacterium tuberculosis H37Rv
aauuuugcgccgacaccggg

SEQ ID NO: 1324696 - RNA, 20 nt, Mycobacterium tuberculosis H37Rv
acaauucacgcaccacaaac

SEQ ID NO: 1324697 - RNA, 14 nt, Mycobacterium tuberculosis H37Rv
acacagucggugca

SEQ ID NO: 1324698 - RNA, 16 nt, Mycobacterium tuberculosis H37Rv
acacagucggugcagc

SEQ ID NO: 1324699 - RNA, 13 nt, Mycobacterium tuberculosis H37Rv
acacaggacuugu

SEQ ID NO: 1324700 - RNA, 21 nt, Mycobacterium tuberculosis H37Rv
acacaggcguccaucgccacc

SEQ ID NO: 1324701 - RNA, 19 nt, Mycobacterium tuberculosis H37Rv
acacagccgucgcaccaga

SEQ ID NO: 1324702 - RNA, 18 nt, Mycobacterium tuberculosis H37Rv
acacagccgucgcaccag

SEQ ID NO: 1324703 - RNA, 17 nt, Mycobacterium tuberculosis H37Rv
acacagcguaugcacau

SEQ ID NO: 1324704 - RNA, 20 nt, Mycobacterium tuberculosis H37Rv
acacagcguaugcacaugau

SEQ ID NO: 1324705 - RNA, 14 nt, Mycobacterium tuberculosis H37Rv
acacagcaugguua

SEQ ID NO: 1324706 - RNA, 20 nt, Mycobacterium tuberculosis H37Rv
acaagugcccggccaaccac

SEQ ID NO: 1324707 - RNA, 17 nt, Mycobacterium tuberculosis H37Rv
acaaggggcagcacguc

SEQ ID NO: 1324708 - RNA, 12 nt, Mycobacterium tuberculosis H37Rv
acaagcugacac

SEQ ID NO: 1324709 - RNA, 16 nt, Mycobacterium tuberculosis H37Rv
acaaucucggccgcau

SEQ ID NO: 1324710 - RNA, 17 nt, Mycobacterium tuberculosis H37Rv
acaauaggcuccagcgc

SEQ ID NO: 1324711 - RNA, 13 nt, Mycobacterium tuberculosis H37Rv
acaaucaccgccg

SEQ ID NO: 1324712 - RNA, 23 nt, Mycobacterium tuberculosis H37Rv
acaaucagcccgacaccguccag

SEQ ID NO: 1324713 - RNA, 19 nt, Mycobacterium tuberculosis H37Rv
acaccuccgucagcgccgc

SEQ ID NO: 1324714 - RNA, 14 nt, Mycobacterium tuberculosis H37Rv
acaccuccucgagc

SEQ ID NO: 1324715 - RNA, 19 nt, Mycobacterium tuberculosis H37Rv
acaccucgaaggcacugcg

SEQ ID NO: 1324716 - RNA, 12 nt, Mycobacterium tuberculosis H37Rv
acaccugcggcg

SEQ ID NO: 1324717 - RNA, 15 nt, Mycobacterium tuberculosis H37Rv
acaccuucggcuggu

SEQ ID NO: 1324718 - RNA, 24 nt, Mycobacterium tuberculosis H37Rv
acaccuucggcugguagggcggaa

SEQ ID NO: 1324719 - RNA, 13 nt, Mycobacterium tuberculosis H37Rv
acacgccagguga

SEQ ID NO: 1324720 - RNA, 14 nt, Mycobacterium tuberculosis H37Rv
acacgaugcccggc

SEQ ID NO: 1324721 - RNA, 17 nt, Mycobacterium tuberculosis H37Rv
acacgaauccggccacu

SEQ ID NO: 1324722 - RNA, 18 nt, Mycobacterium tuberculosis H37Rv
acacgaauccggccacuc

SEQ ID NO: 1324723 - RNA, 13 nt, Mycobacterium tuberculosis H37Rv
acacgaccucuug

SEQ ID NO: 1324724 - RNA, 15 nt, Mycobacterium tuberculosis H37Rv
acacgacgucaucgu

SEQ ID NO: 1324725 - RNA, 22 nt, Mycobacterium tuberculosis H37Rv
acaccgcggacccgcagcugcg

SEQ ID NO: 1324726 - RNA, 13 nt, Mycobacterium tuberculosis H37Rv
acaccggcaagcc

SEQ ID NO: 1324727 - RNA, 21 nt, Mycobacterium tuberculosis H37Rv
acaccggcaagccacgccggu

SEQ ID NO: 1324728 - RNA, 21 nt, Mycobacterium tuberculosis H37Rv
acaccggcacugcccagcaga

SEQ ID NO: 1324729 - RNA, 21 nt, Mycobacterium tuberculosis H37Rv
acaccggccugcgcgaccgac

SEQ ID NO: 1324730 - RNA, 18 nt, Mycobacterium tuberculosis H37Rv
acaccggcuuugcuugcc

SEQ ID NO: 1324731 - RNA, 13 nt, Mycobacterium tuberculosis H37Rv
acaccgggcacca

SEQ ID NO: 1324732 - RNA, 15 nt, Mycobacterium tuberculosis H37Rv
acaccguccagcagc

SEQ ID NO: 1324733 - RNA, 16 nt, Mycobacterium tuberculosis H37Rv
acaccguccagcagcu

SEQ ID NO: 1324734 - RNA, 19 nt, Mycobacterium tuberculosis H37Rv
acaccguccgucggcgcuc

SEQ ID NO: 1324735 - RNA, 22 nt, Mycobacterium tuberculosis H37Rv
acaccgucgcgcucgcaccacc

SEQ ID NO: 1324736 - RNA, 18 nt, Mycobacterium tuberculosis H37Rv
acaccgugcaccagcuca

SEQ ID NO: 1324737 - RNA, 13 nt, Mycobacterium tuberculosis H37Rv
acaccgcccggcc

SEQ ID NO: 1324738 - RNA, 23 nt, Mycobacterium tuberculosis H37Rv
acaccgccagcggcaauggccag

SEQ ID NO: 1324739 - RNA, 13 nt, Mycobacterium tuberculosis H37Rv
acaccgcaggugc

SEQ ID NO: 1324740 - RNA, 17 nt, Mycobacterium tuberculosis H37Rv
acaccgcauaaggccca

SEQ ID NO: 1324741 - RNA, 15 nt, Mycobacterium tuberculosis H37Rv
acaccgccagcagau

SEQ ID NO: 1324742 - RNA, 24 nt, Mycobacterium tuberculosis H37Rv
acaccgagaagcugugccuucgcc

SEQ ID NO: 1324743 - RNA, 17 nt, Mycobacterium tuberculosis H37Rv
acaccgacgccgccagg

SEQ ID NO: 1324744 - RNA, 13 nt, Mycobacterium tuberculosis H37Rv
acaccgagcaccu

SEQ ID NO: 1324745 - RNA, 18 nt, Mycobacterium tuberculosis H37Rv
acacccuugcccacggcg

SEQ ID NO: 1324746 - RNA, 15 nt, Mycobacterium tuberculosis H37Rv
acaccgaaccgccgc

SEQ ID NO: 1324747 - RNA, 16 nt, Mycobacterium tuberculosis H37Rv
acaccgaacggugugc

SEQ ID NO: 1324748 - RNA, 12 nt, Mycobacterium tuberculosis H37Rv
acacccugcagc

SEQ ID NO: 1324749 - RNA, 14 nt, Mycobacterium tuberculosis H37Rv
acacccgcaccgga

SEQ ID NO: 1324750 - RNA, 15 nt, Mycobacterium tuberculosis H37Rv
acacccaucagcccu

SEQ ID NO: 1324751 - RNA, 22 nt, Mycobacterium tuberculosis H37Rv
acaccauaggccgacggguugg

SEQ ID NO: 1324752 - RNA, 17 nt, Mycobacterium tuberculosis H37Rv
acaccacggaccagcgc

SEQ ID NO: 1324753 - RNA, 16 nt, Mycobacterium tuberculosis H37Rv
acaccacgguuggcca

SEQ ID NO: 1324754 - RNA, 19 nt, Mycobacterium tuberculosis H37Rv
acaccacgguuggccacca

SEQ ID NO: 1324755 - RNA, 21 nt, Mycobacterium tuberculosis H37Rv
acaccacgucccggaaugaga

SEQ ID NO: 1324756 - RNA, 13 nt, Mycobacterium tuberculosis H37Rv
acaccaccgccag

SEQ ID NO: 1324757 - RNA, 16 nt, Mycobacterium tuberculosis H37Rv
acaccaccagcacgcu

SEQ ID NO: 1324758 - RNA, 21 nt, Mycobacterium tuberculosis H37Rv
acacauuucuuugggcggccc

SEQ ID NO: 1324759 - RNA, 13 nt, Mycobacterium tuberculosis H37Rv
acacauugaccag

SEQ ID NO: 1324760 - RNA, 18 nt, Mycobacterium tuberculosis H37Rv
acacaugcaucugaucag

SEQ ID NO: 1324761 - RNA, 14 nt, Mycobacterium tuberculosis H37Rv
acacaugccgcagg

SEQ ID NO: 1324762 - RNA, 14 nt, Mycobacterium tuberculosis H37Rv
acacguaccgacag

SEQ ID NO: 1324763 - RNA, 13 nt, Mycobacterium tuberculosis H37Rv
acacguccagugg

SEQ ID NO: 1324764 - RNA, 15 nt, Mycobacterium tuberculosis H37Rv
acacguccaguggca

SEQ ID NO: 1324765 - RNA, 21 nt, Mycobacterium tuberculosis H37Rv
acacgccggcccggugaugaa

SEQ ID NO: 1324766 - RNA, 16 nt, Mycobacterium tuberculosis H37Rv
acacgccguuggggcc

SEQ ID NO: 1324767 - RNA, 18 nt, Mycobacterium tuberculosis H37Rv
acacggauacccuuugca

SEQ ID NO: 1324768 - RNA, 12 nt, Mycobacterium tuberculosis H37Rv
acacggcagcug

SEQ ID NO: 1324769 - RNA, 14 nt, Mycobacterium tuberculosis H37Rv
acacggcagcugca

SEQ ID NO: 1324770 - RNA, 18 nt, Mycobacterium tuberculosis H37Rv
acacggcucgccggcucg

SEQ ID NO: 1324771 - RNA, 14 nt, Mycobacterium tuberculosis H37Rv
acagcagcgcgaca

SEQ ID NO: 1324772 - RNA, 22 nt, Mycobacterium tuberculosis H37Rv
acagcauggcgaagaacaacau

SEQ ID NO: 1324773 - RNA, 15 nt, Mycobacterium tuberculosis H37Rv
acagcaggcauuccc

SEQ ID NO: 1324774 - RNA, 18 nt, Mycobacterium tuberculosis H37Rv
acagaccgggcaccagaa

SEQ ID NO: 1324775 - RNA, 17 nt, Mycobacterium tuberculosis H37Rv
acagaccgggcaccaga

SEQ ID NO: 1324776 - RNA, 15 nt, Mycobacterium tuberculosis H37Rv
acagauaaggaccau

SEQ ID NO: 1324777 - RNA, 17 nt, Mycobacterium tuberculosis H37Rv
acauaggucacaaacgg

SEQ ID NO: 1324778 - RNA, 17 nt, Mycobacterium tuberculosis H37Rv
acauagccggucauuuc

SEQ ID NO: 1324779 - RNA, 16 nt, Mycobacterium tuberculosis H37Rv
acauacgaaacaugcg

SEQ ID NO: 1324780 - RNA, 15 nt, Mycobacterium tuberculosis H37Rv
acauacgcggcggcc

SEQ ID NO: 1324781 - RNA, 23 nt, Mycobacterium tuberculosis H37Rv
acagcaugucucgggcgcgggug

SEQ ID NO: 1324782 - RNA, 18 nt, Mycobacterium tuberculosis H37Rv
acaucauggugaaggcaa

SEQ ID NO: 1324783 - RNA, 22 nt, Mycobacterium tuberculosis H37Rv
acaucauggugaaggcaaacac

SEQ ID NO: 1324784 - RNA, 13 nt, Mycobacterium tuberculosis H37Rv
acauccugcagcu

SEQ ID NO: 1324785 - RNA, 15 nt, Mycobacterium tuberculosis H37Rv
acauccuggcggcug

SEQ ID NO: 1324786 - RNA, 19 nt, Mycobacterium tuberculosis H37Rv
acaucccccggcuggucac

SEQ ID NO: 1324787 - RNA, 17 nt, Mycobacterium tuberculosis H37Rv
acauccgacagcagccg

SEQ ID NO: 1324788 - RNA, 21 nt, Mycobacterium tuberculosis H37Rv
acaucaccccgauggucgaga

SEQ ID NO: 1324789 - RNA, 13 nt, Mycobacterium tuberculosis H37Rv
acaucggugccac

SEQ ID NO: 1324790 - RNA, 15 nt, Mycobacterium tuberculosis H37Rv
acaucggaacgugac

SEQ ID NO: 1324791 - RNA, 14 nt, Mycobacterium tuberculosis H37Rv
acaucguucugacg

SEQ ID NO: 1324792 - RNA, 16 nt, Mycobacterium tuberculosis H37Rv
acaugcgcaccauggg

SEQ ID NO: 1324793 - RNA, 22 nt, Mycobacterium tuberculosis H37Rv
acauucauccaccccugagcuc

SEQ ID NO: 1324794 - RNA, 23 nt, Mycobacterium tuberculosis H37Rv
acauucccgaguugcccucuggc

SEQ ID NO: 1324795 - RNA, 22 nt, Mycobacterium tuberculosis H37Rv
accaaacccgaugguacucagg

SEQ ID NO: 1324796 - RNA, 13 nt, Mycobacterium tuberculosis H37Rv
accaaacgcugcu

SEQ ID NO: 1324797 - RNA, 21 nt, Mycobacterium tuberculosis H37Rv
acauuggugcugacauuucca

SEQ ID NO: 1324798 - RNA, 22 nt, Mycobacterium tuberculosis H37Rv
acauugguguggaauacgcugc

SEQ ID NO: 1324799 - RNA, 23 nt, Mycobacterium tuberculosis H37Rv
acauuucuuugggcggcccaccg

SEQ ID NO: 1324800 - RNA, 14 nt, Mycobacterium tuberculosis H37Rv
accacaccggcagc

SEQ ID NO: 1324801 - RNA, 15 nt, Mycobacterium tuberculosis H37Rv
accacaauccacgca

SEQ ID NO: 1324802 - RNA, 21 nt, Mycobacterium tuberculosis H37Rv
accacaauccacgcacucguc

SEQ ID NO: 1324803 - RNA, 15 nt, Mycobacterium tuberculosis H37Rv
accaaugcagugcga

SEQ ID NO: 1324804 - RNA, 23 nt, Mycobacterium tuberculosis H37Rv
accaaugcuccugguggcagaaa

SEQ ID NO: 1324805 - RNA, 15 nt, Mycobacterium tuberculosis H37Rv
accaagcgugccugc

SEQ ID NO: 1324806 - RNA, 14 nt, Mycobacterium tuberculosis H37Rv
accaacaccgcccg

SEQ ID NO: 1324807 - RNA, 17 nt, Mycobacterium tuberculosis H37Rv
accaacaccccccccac

SEQ ID NO: 1324808 - RNA, 16 nt, Mycobacterium tuberculosis H37Rv
accaagacaccggccu

SEQ ID NO: 1324809 - RNA, 19 nt, Mycobacterium tuberculosis H37Rv
accaaugaccgccagcagc

SEQ ID NO: 1324810 - RNA, 18 nt, Mycobacterium tuberculosis H37Rv
accaauaccgcacccgcu

SEQ ID NO: 1324811 - RNA, 18 nt, Mycobacterium tuberculosis H37Rv
accagcacggcaaccagc

SEQ ID NO: 1324812 - RNA, 16 nt, Mycobacterium tuberculosis H37Rv
accagcguccagccgc

SEQ ID NO: 1324813 - RNA, 20 nt, Mycobacterium tuberculosis H37Rv
accagcguggggccgccacc

SEQ ID NO: 1324814 - RNA, 23 nt, Mycobacterium tuberculosis H37Rv
accagcguggggccgccaccagc

SEQ ID NO: 1324815 - RNA, 15 nt, Mycobacterium tuberculosis H37Rv
accagcggucagccg

SEQ ID NO: 1324816 - RNA, 23 nt, Mycobacterium tuberculosis H37Rv
accagcggucggcgaccaccagc

SEQ ID NO: 1324817 - RNA, 18 nt, Mycobacterium tuberculosis H37Rv
accagcucggugaucacc

SEQ ID NO: 1324818 - RNA, 13 nt, Mycobacterium tuberculosis H37Rv
accagcuccugca

SEQ ID NO: 1324819 - RNA, 18 nt, Mycobacterium tuberculosis H37Rv
accagccgcggaucaucc

SEQ ID NO: 1324820 - RNA, 12 nt, Mycobacterium tuberculosis H37Rv
accagccgcccc

SEQ ID NO: 1324821 - RNA, 14 nt, Mycobacterium tuberculosis H37Rv
accagcggcggccc

SEQ ID NO: 1324822 - RNA, 17 nt, Mycobacterium tuberculosis H37Rv
accagcggcacaucaug

SEQ ID NO: 1324823 - RNA, 17 nt, Mycobacterium tuberculosis H37Rv
accacccacccgcacca

SEQ ID NO: 1324824 - RNA, 20 nt, Mycobacterium tuberculosis H37Rv
accaccagggcaacggccgc

SEQ ID NO: 1324825 - RNA, 13 nt, Mycobacterium tuberculosis H37Rv
accaccaggcuga

SEQ ID NO: 1324826 - RNA, 21 nt, Mycobacterium tuberculosis H37Rv
accaccaguggcgcgugcagc

SEQ ID NO: 1324827 - RNA, 12 nt, Mycobacterium tuberculosis H37Rv
accaccagcacg

SEQ ID NO: 1324828 - RNA, 18 nt, Mycobacterium tuberculosis H37Rv
accacgcaccgccccgcc

SEQ ID NO: 1324829 - RNA, 14 nt, Mycobacterium tuberculosis H37Rv
accaccugguuugu

SEQ ID NO: 1324830 - RNA, 18 nt, Mycobacterium tuberculosis H37Rv
accaccguuugagcggcc

SEQ ID NO: 1324831 - RNA, 15 nt, Mycobacterium tuberculosis H37Rv
accaccucgugggcc

SEQ ID NO: 1324832 - RNA, 17 nt, Mycobacterium tuberculosis H37Rv
accaccucgugggccac

SEQ ID NO: 1324833 - RNA, 19 nt, Mycobacterium tuberculosis H37Rv
accacccaccggccaccag

SEQ ID NO: 1324834 - RNA, 18 nt, Mycobacterium tuberculosis H37Rv
accacgucccggaaugag

SEQ ID NO: 1324835 - RNA, 17 nt, Mycobacterium tuberculosis H37Rv
accacgcuggccucguc

SEQ ID NO: 1324836 - RNA, 17 nt, Mycobacterium tuberculosis H37Rv
accacgcgcccgcacca

SEQ ID NO: 1324837 - RNA, 22 nt, Mycobacterium tuberculosis H37Rv
accacgccguggcccgcucccu

SEQ ID NO: 1324838 - RNA, 20 nt, Mycobacterium tuberculosis H37Rv
accacuuccggcguggcccc

SEQ ID NO: 1324839 - RNA, 22 nt, Mycobacterium tuberculosis H37Rv
accacuguuggugccgccacca

SEQ ID NO: 1324840 - RNA, 18 nt, Mycobacterium tuberculosis H37Rv
accacuguuacggccaca

SEQ ID NO: 1324841 - RNA, 14 nt, Mycobacterium tuberculosis H37Rv
accaucaccgcgcc

SEQ ID NO: 1324842 - RNA, 20 nt, Mycobacterium tuberculosis H37Rv
accaucaccgcgccagccuc

SEQ ID NO: 1324843 - RNA, 22 nt, Mycobacterium tuberculosis H37Rv
accaucccugaaauaccagucc

SEQ ID NO: 1324844 - RNA, 20 nt, Mycobacterium tuberculosis H37Rv
accauccccggcaacaaagg

SEQ ID NO: 1324845 - RNA, 17 nt, Mycobacterium tuberculosis H37Rv
accaucaccacggccgc

SEQ ID NO: 1324846 - RNA, 21 nt, Mycobacterium tuberculosis H37Rv
accaggaccggcugcaggugc

SEQ ID NO: 1324847 - RNA, 22 nt, Mycobacterium tuberculosis H37Rv
accaggaccggcugcaggugcu

SEQ ID NO: 1324848 - RNA, 18 nt, Mycobacterium tuberculosis H37Rv
accaugagcuugguggcc

SEQ ID NO: 1324849 - RNA, 20 nt, Mycobacterium tuberculosis H37Rv
accaugauguagcggcguuc

SEQ ID NO: 1324850 - RNA, 23 nt, Mycobacterium tuberculosis H37Rv
accauccgggcaaccgaugacgc

SEQ ID NO: 1324851 - RNA, 20 nt, Mycobacterium tuberculosis H37Rv
accaugucggccacccggac

SEQ ID NO: 1324852 - RNA, 15 nt, Mycobacterium tuberculosis H37Rv
acccacgucgagcag

SEQ ID NO: 1324853 - RNA, 14 nt, Mycobacterium tuberculosis H37Rv
acccacgccgacua

SEQ ID NO: 1324854 - RNA, 23 nt, Mycobacterium tuberculosis H37Rv
acccacgagagcgcugucccgaa

SEQ ID NO: 1324855 - RNA, 14 nt, Mycobacterium tuberculosis H37Rv
acccaccggccacc

SEQ ID NO: 1324856 - RNA, 16 nt, Mycobacterium tuberculosis H37Rv
acccagcucgcgcacc

SEQ ID NO: 1324857 - RNA, 17 nt, Mycobacterium tuberculosis H37Rv
acccaggaucagcccgg

SEQ ID NO: 1324858 - RNA, 17 nt, Mycobacterium tuberculosis H37Rv
acccagugccacgccug

SEQ ID NO: 1324859 - RNA, 15 nt, Mycobacterium tuberculosis H37Rv
acccagugccacgcc

SEQ ID NO: 1324860 - RNA, 22 nt, Mycobacterium tuberculosis H37Rv
acccgcccgagaguggacgugu

SEQ ID NO: 1324861 - RNA, 20 nt, Mycobacterium tuberculosis H37Rv
acccgcaggucgaucugcgc

SEQ ID NO: 1324862 - RNA, 13 nt, Mycobacterium tuberculosis H37Rv
acccgcaccgccg

SEQ ID NO: 1324863 - RNA, 12 nt, Mycobacterium tuberculosis H37Rv
acccgcaaugcg

SEQ ID NO: 1324864 - RNA, 18 nt, Mycobacterium tuberculosis H37Rv
acccgauaucaauggcag

SEQ ID NO: 1324865 - RNA, 17 nt, Mycobacterium tuberculosis H37Rv
acccgcagaccgccacc

SEQ ID NO: 1324866 - RNA, 14 nt, Mycobacterium tuberculosis H37Rv
acccgcagccgcgc

SEQ ID NO: 1324867 - RNA, 17 nt, Mycobacterium tuberculosis H37Rv
acccgaugacccacugc

SEQ ID NO: 1324868 - RNA, 14 nt, Mycobacterium tuberculosis H37Rv
acccgaugugcccg

SEQ ID NO: 1324869 - RNA, 16 nt, Mycobacterium tuberculosis H37Rv
acccgaugugcccggc

SEQ ID NO: 1324870 - RNA, 14 nt, Mycobacterium tuberculosis H37Rv
acccgaaacaccgu

SEQ ID NO: 1324871 - RNA, 20 nt, Mycobacterium tuberculosis H37Rv
acccgaaaacugacccccug

SEQ ID NO: 1324872 - RNA, 17 nt, Mycobacterium tuberculosis H37Rv
acccgacacggcucgcc

SEQ ID NO: 1324873 - RNA, 17 nt, Mycobacterium tuberculosis H37Rv
acccgacaugguccgac

SEQ ID NO: 1324874 - RNA, 20 nt, Mycobacterium tuberculosis H37Rv
acccauggccucccacucac

SEQ ID NO: 1324875 - RNA, 16 nt, Mycobacterium tuberculosis H37Rv
acccaucccguucagc

SEQ ID NO: 1324876 - RNA, 15 nt, Mycobacterium tuberculosis H37Rv
acccaucgccacacc

SEQ ID NO: 1324877 - RNA, 15 nt, Mycobacterium tuberculosis H37Rv
acccaucgaccgccc

SEQ ID NO: 1324878 - RNA, 15 nt, Mycobacterium tuberculosis H37Rv
acccaugcaugcguu

SEQ ID NO: 1324879 - RNA, 18 nt, Mycobacterium tuberculosis H37Rv
accccgcgcggugcccug

SEQ ID NO: 1324880 - RNA, 19 nt, Mycobacterium tuberculosis H37Rv
accccggaccgcggccacc

SEQ ID NO: 1324881 - RNA, 13 nt, Mycobacterium tuberculosis H37Rv
accccggccggcu

SEQ ID NO: 1324882 - RNA, 12 nt, Mycobacterium tuberculosis H37Rv
accccggccacc

SEQ ID NO: 1324883 - RNA, 18 nt, Mycobacterium tuberculosis H37Rv
accccggccaccagcaug

SEQ ID NO: 1324884 - RNA, 14 nt, Mycobacterium tuberculosis H37Rv
accccggccacuug

SEQ ID NO: 1324885 - RNA, 21 nt, Mycobacterium tuberculosis H37Rv
accccggccuuggcggcggca

SEQ ID NO: 1324886 - RNA, 16 nt, Mycobacterium tuberculosis H37Rv
accccggugcccgcgg

SEQ ID NO: 1324887 - RNA, 14 nt, Mycobacterium tuberculosis H37Rv
accccggccuugcc

SEQ ID NO: 1324888 - RNA, 23 nt, Mycobacterium tuberculosis H37Rv
accccguaggcgccgaaccagcg

SEQ ID NO: 1324889 - RNA, 18 nt, Mycobacterium tuberculosis H37Rv
acccggcgcagcaacgca

SEQ ID NO: 1324890 - RNA, 21 nt, Mycobacterium tuberculosis H37Rv
acccggcgggcggugggcagc

SEQ ID NO: 1324891 - RNA, 15 nt, Mycobacterium tuberculosis H37Rv
acccggcgaccacgg

SEQ ID NO: 1324892 - RNA, 15 nt, Mycobacterium tuberculosis H37Rv
acccgggaaggaacc

SEQ ID NO: 1324893 - RNA, 16 nt, Mycobacterium tuberculosis H37Rv
acccgggaaggaaccg

SEQ ID NO: 1324894 - RNA, 18 nt, Mycobacterium tuberculosis H37Rv
acccgggccaggcugcgc

SEQ ID NO: 1324895 - RNA, 14 nt, Mycobacterium tuberculosis H37Rv
acccggcagcccgg

SEQ ID NO: 1324896 - RNA, 22 nt, Mycobacterium tuberculosis H37Rv
acccggccgccgaaacucacca

SEQ ID NO: 1324897 - RNA, 22 nt, Mycobacterium tuberculosis H37Rv
acccggccaggaguuugaccac

SEQ ID NO: 1324898 - RNA, 14 nt, Mycobacterium tuberculosis H37Rv
acccggucggccau

SEQ ID NO: 1324899 - RNA, 17 nt, Mycobacterium tuberculosis H37Rv
acccgucgagcagcaug

SEQ ID NO: 1324900 - RNA, 19 nt, Mycobacterium tuberculosis H37Rv
acccguauugccaaagccc

SEQ ID NO: 1324901 - RNA, 19 nt, Mycobacterium tuberculosis H37Rv
acccggugaugguggcggu

SEQ ID NO: 1324902 - RNA, 18 nt, Mycobacterium tuberculosis H37Rv
acccggugaccagcaacc

SEQ ID NO: 1324903 - RNA, 14 nt, Mycobacterium tuberculosis H37Rv
acccguaccagccc

SEQ ID NO: 1324904 - RNA, 13 nt, Mycobacterium tuberculosis H37Rv
acccguacccacg

SEQ ID NO: 1324905 - RNA, 16 nt, Mycobacterium tuberculosis H37Rv
acccgggcgugggugu

SEQ ID NO: 1324906 - RNA, 21 nt, Mycobacterium tuberculosis H37Rv
acccgggccugggacggcggc

SEQ ID NO: 1324907 - RNA, 14 nt, Mycobacterium tuberculosis H37Rv
acccgggccucggc

SEQ ID NO: 1324908 - RNA, 20 nt, Mycobacterium tuberculosis H37Rv
acccgggccggucggugagc

SEQ ID NO: 1324909 - RNA, 20 nt, Mycobacterium tuberculosis H37Rv
acccggugacccgcugggcc

SEQ ID NO: 1324910 - RNA, 16 nt, Mycobacterium tuberculosis H37Rv
acccggucggcagcug

SEQ ID NO: 1324911 - RNA, 17 nt, Mycobacterium tuberculosis H37Rv
acccggucggcagcugg

SEQ ID NO: 1324912 - RNA, 17 nt, Mycobacterium tuberculosis H37Rv
acccggucaucggccgu

SEQ ID NO: 1324913 - RNA, 18 nt, Mycobacterium tuberculosis H37Rv
acccggucaucggccguc

SEQ ID NO: 1324914 - RNA, 14 nt, Mycobacterium tuberculosis H37Rv
acccgcgcgcacca

SEQ ID NO: 1324915 - RNA, 12 nt, Mycobacterium tuberculosis H37Rv
acccgcgcgccg

SEQ ID NO: 1324916 - RNA, 22 nt, Mycobacterium tuberculosis H37Rv
acccgcggcgaaccgucucgcc

SEQ ID NO: 1324917 - RNA, 19 nt, Mycobacterium tuberculosis H37Rv
acccgcgggugauguucgu

SEQ ID NO: 1324918 - RNA, 15 nt, Mycobacterium tuberculosis H37Rv
acccgcgccgcccgc

SEQ ID NO: 1324919 - RNA, 19 nt, Mycobacterium tuberculosis H37Rv
acccgccggcggggugcgc

SEQ ID NO: 1324920 - RNA, 22 nt, Mycobacterium tuberculosis H37Rv
acccgccuaaagcgugucgccc

SEQ ID NO: 1324921 - RNA, 18 nt, Mycobacterium tuberculosis H37Rv
acccgccgacgccgccgg

SEQ ID NO: 1324922 - RNA, 19 nt, Mycobacterium tuberculosis H37Rv
acccgccgacgaccgccug

SEQ ID NO: 1324923 - RNA, 23 nt, Mycobacterium tuberculosis H37Rv
acccgccgacgaccgccugcaac

SEQ ID NO: 1324924 - RNA, 17 nt, Mycobacterium tuberculosis H37Rv
acccgccgaugccgccg

SEQ ID NO: 1324925 - RNA, 14 nt, Mycobacterium tuberculosis H37Rv
acccgccgccccac

SEQ ID NO: 1324926 - RNA, 15 nt, Mycobacterium tuberculosis H37Rv
acccggcacccaguu

SEQ ID NO: 1324927 - RNA, 22 nt, Mycobacterium tuberculosis H37Rv
acccggaucuggugggugcggc

SEQ ID NO: 1324928 - RNA, 15 nt, Mycobacterium tuberculosis H37Rv
acccgcuucgcccgg

SEQ ID NO: 1324929 - RNA, 18 nt, Mycobacterium tuberculosis H37Rv
acccgcuucgcccggcug

SEQ ID NO: 1324930 - RNA, 17 nt, Mycobacterium tuberculosis H37Rv
acccgcuccagcucggc

SEQ ID NO: 1324931 - RNA, 17 nt, Mycobacterium tuberculosis H37Rv
acccuaaaccagccacc

SEQ ID NO: 1324932 - RNA, 23 nt, Mycobacterium tuberculosis H37Rv
acccgucuuaucggcgucguaga

SEQ ID NO: 1324933 - RNA, 23 nt, Mycobacterium tuberculosis H37Rv
acccgugccuuacuuccauccac

SEQ ID NO: 1324934 - RNA, 17 nt, Mycobacterium tuberculosis H37Rv
acccgucgggugcugau

SEQ ID NO: 1324935 - RNA, 22 nt, Mycobacterium tuberculosis H37Rv
acccgugcggccacgguucuuc

SEQ ID NO: 1324936 - RNA, 23 nt, Mycobacterium tuberculosis H37Rv
acccucgcguagggccagcgccu

SEQ ID NO: 1324937 - RNA, 22 nt, Mycobacterium tuberculosis H37Rv
acccucgcguagggccagcgcc

SEQ ID NO: 1324938 - RNA, 21 nt, Mycobacterium tuberculosis H37Rv
acccuccggacccacccgcac

SEQ ID NO: 1324939 - RNA, 11 nt, Mycobacterium tuberculosis H37Rv
acccuccagca

SEQ ID NO: 1324940 - RNA, 13 nt, Mycobacterium tuberculosis H37Rv
acccuccacagcg

SEQ ID NO: 1324941 - RNA, 13 nt, Mycobacterium tuberculosis H37Rv
acccugcccggcc

SEQ ID NO: 1324942 - RNA, 16 nt, Mycobacterium tuberculosis H37Rv
acccugcuugggcagc

SEQ ID NO: 1324943 - RNA, 14 nt, Mycobacterium tuberculosis H37Rv
acccugaugaucgu

SEQ ID NO: 1324944 - RNA, 21 nt, Mycobacterium tuberculosis H37Rv
acccucggggguccaguucag

SEQ ID NO: 1324945 - RNA, 15 nt, Mycobacterium tuberculosis H37Rv
acccugucgcgcacc

SEQ ID NO: 1324946 - RNA, 18 nt, Mycobacterium tuberculosis H37Rv
acccuguuccagcgggug

SEQ ID NO: 1324947 - RNA, 22 nt, Mycobacterium tuberculosis H37Rv
acccuguuccagcggguggcca

SEQ ID NO: 1324948 - RNA, 20 nt, Mycobacterium tuberculosis H37Rv
acccugguggucagucacca

SEQ ID NO: 1324949 - RNA, 14 nt, Mycobacterium tuberculosis H37Rv
acccuugccgccgg

SEQ ID NO: 1324950 - RNA, 11 nt, Mycobacterium tuberculosis H37Rv
accgacgagga

SEQ ID NO: 1324951 - RNA, 23 nt, Mycobacterium tuberculosis H37Rv
accgacgaggacgucaccgucag

SEQ ID NO: 1324952 - RNA, 21 nt, Mycobacterium tuberculosis H37Rv
accgacgcguccggugcacca

SEQ ID NO: 1324953 - RNA, 15 nt, Mycobacterium tuberculosis H37Rv
accgacgccauuggc

SEQ ID NO: 1324954 - RNA, 13 nt, Mycobacterium tuberculosis H37Rv
accgaccgcgcug

SEQ ID NO: 1324955 - RNA, 17 nt, Mycobacterium tuberculosis H37Rv
accgaccgcgggcuccc

SEQ ID NO: 1324956 - RNA, 21 nt, Mycobacterium tuberculosis H37Rv
accgaccgcgggcuccccgca

SEQ ID NO: 1324957 - RNA, 22 nt, Mycobacterium tuberculosis H37Rv
accgaccgggucgcaaccgccg

SEQ ID NO: 1324958 - RNA, 15 nt, Mycobacterium tuberculosis H37Rv
accgacgacgcgcgc

SEQ ID NO: 1324959 - RNA, 12 nt, Mycobacterium tuberculosis H37Rv
accgaccagccg

SEQ ID NO: 1324960 - RNA, 21 nt, Mycobacterium tuberculosis H37Rv
accgaccccggaacgacccca

SEQ ID NO: 1324961 - RNA, 20 nt, Mycobacterium tuberculosis H37Rv
accgacagcacccggccacc

SEQ ID NO: 1324962 - RNA, 14 nt, Mycobacterium tuberculosis H37Rv
accgacagcaccca

SEQ ID NO: 1324963 - RNA, 23 nt, Mycobacterium tuberculosis H37Rv
accgagcccuccagggcccugcu

SEQ ID NO: 1324964 - RNA, 20 nt, Mycobacterium tuberculosis H37Rv
accgagcccuccagggcccu

SEQ ID NO: 1324965 - RNA, 11 nt, Mycobacterium tuberculosis H37Rv
accgagcagca

SEQ ID NO: 1324966 - RNA, 16 nt, Mycobacterium tuberculosis H37Rv
accgacgguaggcccg

SEQ ID NO: 1324967 - RNA, 16 nt, Mycobacterium tuberculosis H37Rv
accgagaagcccaccg

SEQ ID NO: 1324968 - RNA, 17 nt, Mycobacterium tuberculosis H37Rv
accgaaagccgcaccag

SEQ ID NO: 1324969 - RNA, 18 nt, Mycobacterium tuberculosis H37Rv
accgaaagccgcaccaga

SEQ ID NO: 1324970 - RNA, 16 nt, Mycobacterium tuberculosis H37Rv
accgaaauggucguuc

SEQ ID NO: 1324971 - RNA, 19 nt, Mycobacterium tuberculosis H37Rv
accgaacagcaccuccgua

SEQ ID NO: 1324972 - RNA, 15 nt, Mycobacterium tuberculosis H37Rv
accgaauugaacuga

SEQ ID NO: 1324973 - RNA, 14 nt, Mycobacterium tuberculosis H37Rv
accgaauugaacug

SEQ ID NO: 1324974 - RNA, 23 nt, Mycobacterium tuberculosis H37Rv
accgaaccgcguuaugccaggcg

SEQ ID NO: 1324975 - RNA, 23 nt, Mycobacterium tuberculosis H37Rv
accgaaccgguguagcagcgcca

SEQ ID NO: 1324976 - RNA, 19 nt, Mycobacterium tuberculosis H37Rv
accgaaccgucagcggcaa

SEQ ID NO: 1324977 - RNA, 23 nt, Mycobacterium tuberculosis H37Rv
accgaacccgccaccgcgacacc

SEQ ID NO: 1324978 - RNA, 15 nt, Mycobacterium tuberculosis H37Rv
accgaacgccagguc

SEQ ID NO: 1324979 - RNA, 15 nt, Mycobacterium tuberculosis H37Rv
accgaagcgaacggc

SEQ ID NO: 1324980 - RNA, 18 nt, Mycobacterium tuberculosis H37Rv
accgaagagcgcgcgcaa

SEQ ID NO: 1324981 - RNA, 17 nt, Mycobacterium tuberculosis H37Rv
accgaacuugcggaccu

SEQ ID NO: 1324982 - RNA, 21 nt, Mycobacterium tuberculosis H37Rv
accgccggcaauaccgccagc

SEQ ID NO: 1324983 - RNA, 16 nt, Mycobacterium tuberculosis H37Rv
accgccggcaccgccg

SEQ ID NO: 1324984 - RNA, 13 nt, Mycobacterium tuberculosis H37Rv
accgccggcgccg

SEQ ID NO: 1324985 - RNA, 15 nt, Mycobacterium tuberculosis H37Rv
accgccggcgccgcc

SEQ ID NO: 1324986 - RNA, 21 nt, Mycobacterium tuberculosis H37Rv
accgccggcgccgccgucgcc

SEQ ID NO: 1324987 - RNA, 18 nt, Mycobacterium tuberculosis H37Rv
accgcgagcagcacagca

SEQ ID NO: 1324988 - RNA, 14 nt, Mycobacterium tuberculosis H37Rv
accgcgagcaugau

SEQ ID NO: 1324989 - RNA, 13 nt, Mycobacterium tuberculosis H37Rv
accgccgccgccc

SEQ ID NO: 1324990 - RNA, 11 nt, Mycobacterium tuberculosis H37Rv
accgccgccga

SEQ ID NO: 1324991 - RNA, 22 nt, Mycobacterium tuberculosis H37Rv
accgccgccgacaaucaccaac

SEQ ID NO: 1324992 - RNA, 14 nt, Mycobacterium tuberculosis H37Rv
accgccgccggcac

SEQ ID NO: 1324993 - RNA, 17 nt, Mycobacterium tuberculosis H37Rv
accgccgcgaccgcgag

SEQ ID NO: 1324994 - RNA, 18 nt, Mycobacterium tuberculosis H37Rv
accgccgcgaccgccucg

SEQ ID NO: 1324995 - RNA, 19 nt, Mycobacterium tuberculosis H37Rv
accgccgcgucgagcaccu

SEQ ID NO: 1324996 - RNA, 17 nt, Mycobacterium tuberculosis H37Rv
accgccgcuaccgcccg

SEQ ID NO: 1324997 - RNA, 14 nt, Mycobacterium tuberculosis H37Rv
accgccgccugccc

SEQ ID NO: 1324998 - RNA, 15 nt, Mycobacterium tuberculosis H37Rv
accgccgcgcagccg

SEQ ID NO: 1324999 - RNA, 13 nt, Mycobacterium tuberculosis H37Rv
accgcgccagccu

SEQ ID NO: 1325000 - RNA, 14 nt, Mycobacterium tuberculosis H37Rv
accgcggccccgac

SEQ ID NO: 1325001 - RNA, 14 nt, Mycobacterium tuberculosis H37Rv
accgcggccccgcc

SEQ ID NO: 1325002 - RNA, 15 nt, Mycobacterium tuberculosis H37Rv
accgcggccccgccg

SEQ ID NO: 1325003 - RNA, 15 nt, Mycobacterium tuberculosis H37Rv
accgcgcccuucagc

SEQ ID NO: 1325004 - RNA, 21 nt, Mycobacterium tuberculosis H37Rv
accgcgcccuagcuggugcgc

SEQ ID NO: 1325005 - RNA, 15 nt, Mycobacterium tuberculosis H37Rv
accgcgaugacgacg

SEQ ID NO: 1325006 - RNA, 16 nt, Mycobacterium tuberculosis H37Rv
accgcgcaacccggac

SEQ ID NO: 1325007 - RNA, 21 nt, Mycobacterium tuberculosis H37Rv
accgcgggcgccuuccaggcg

SEQ ID NO: 1325008 - RNA, 18 nt, Mycobacterium tuberculosis H37Rv
accgcggcugucacgccu

SEQ ID NO: 1325009 - RNA, 21 nt, Mycobacterium tuberculosis H37Rv
accgcggcugucacgccugcc

SEQ ID NO: 1325010 - RNA, 17 nt, Mycobacterium tuberculosis H37Rv
accgcgggaacccccca

SEQ ID NO: 1325011 - RNA, 20 nt, Mycobacterium tuberculosis H37Rv
accgcgggccgccaucucgu

SEQ ID NO: 1325012 - RNA, 21 nt, Mycobacterium tuberculosis H37Rv
accgcgggucgugccagcagc

SEQ ID NO: 1325013 - RNA, 15 nt, Mycobacterium tuberculosis H37Rv
accgcggguggaugu

SEQ ID NO: 1325014 - RNA, 21 nt, Mycobacterium tuberculosis H37Rv
accgcggccggguggcccggc

SEQ ID NO: 1325015 - RNA, 14 nt, Mycobacterium tuberculosis H37Rv
accgcggcgucgcc

SEQ ID NO: 1325016 - RNA, 19 nt, Mycobacterium tuberculosis H37Rv
accgcguuguccgcggcca

SEQ ID NO: 1325017 - RNA, 18 nt, Mycobacterium tuberculosis H37Rv
accgcguuaugccaggcg

SEQ ID NO: 1325018 - RNA, 16 nt, Mycobacterium tuberculosis H37Rv
accgcguugaugaccg

SEQ ID NO: 1325019 - RNA, 19 nt, Mycobacterium tuberculosis H37Rv
accgcgucgggccgcaacu

SEQ ID NO: 1325020 - RNA, 13 nt, Mycobacterium tuberculosis H37Rv
accgcgugcaccg

SEQ ID NO: 1325021 - RNA, 15 nt, Mycobacterium tuberculosis H37Rv
accgcuaccagcugg

SEQ ID NO: 1325022 - RNA, 17 nt, Mycobacterium tuberculosis H37Rv
accggaaaugucuccuc

SEQ ID NO: 1325023 - RNA, 19 nt, Mycobacterium tuberculosis H37Rv
accggaaaccacagcgcca

SEQ ID NO: 1325024 - RNA, 16 nt, Mycobacterium tuberculosis H37Rv
accgcuugcccgcgca

SEQ ID NO: 1325025 - RNA, 17 nt, Mycobacterium tuberculosis H37Rv
accggacgaucagggug

SEQ ID NO: 1325026 - RNA, 22 nt, Mycobacterium tuberculosis H37Rv
accggacgaucagggugucgaa

SEQ ID NO: 1325027 - RNA, 21 nt, Mycobacterium tuberculosis H37Rv
accggaccgaagaccuccucg

SEQ ID NO: 1325028 - RNA, 18 nt, Mycobacterium tuberculosis H37Rv
accggacacuccugcaca

SEQ ID NO: 1325029 - RNA, 15 nt, Mycobacterium tuberculosis H37Rv
accgcccgcgccacc

SEQ ID NO: 1325030 - RNA, 16 nt, Mycobacterium tuberculosis H37Rv
accgcccgcgccaccg

SEQ ID NO: 1325031 - RNA, 20 nt, Mycobacterium tuberculosis H37Rv
accgcccgcgccaccggcac

SEQ ID NO: 1325032 - RNA, 16 nt, Mycobacterium tuberculosis H37Rv
accgcccgcacccccg

SEQ ID NO: 1325033 - RNA, 20 nt, Mycobacterium tuberculosis H37Rv
accgcccgcacccccgacac

SEQ ID NO: 1325034 - RNA, 23 nt, Mycobacterium tuberculosis H37Rv
accgcccgcaccguggacaccug

SEQ ID NO: 1325035 - RNA, 15 nt, Mycobacterium tuberculosis H37Rv
accgcccgccaggcc

SEQ ID NO: 1325036 - RNA, 19 nt, Mycobacterium tuberculosis H37Rv
accgcccgccaggccguug

SEQ ID NO: 1325037 - RNA, 13 nt, Mycobacterium tuberculosis H37Rv
accgccagcccgg

SEQ ID NO: 1325038 - RNA, 16 nt, Mycobacterium tuberculosis H37Rv
accgccagcgccaccg

SEQ ID NO: 1325039 - RNA, 22 nt, Mycobacterium tuberculosis H37Rv
accgccgauacuucaucggcac

SEQ ID NO: 1325040 - RNA, 16 nt, Mycobacterium tuberculosis H37Rv
accgcccuugccgccg

SEQ ID NO: 1325041 - RNA, 16 nt, Mycobacterium tuberculosis H37Rv
accgcaggugccaccu

SEQ ID NO: 1325042 - RNA, 24 nt, Mycobacterium tuberculosis H37Rv
accgcaggugccguggcuaccgca

SEQ ID NO: 1325043 - RNA, 12 nt, Mycobacterium tuberculosis H37Rv
accgcagggacc

SEQ ID NO: 1325044 - RNA, 13 nt, Mycobacterium tuberculosis H37Rv
accgcagcgggcg

SEQ ID NO: 1325045 - RNA, 19 nt, Mycobacterium tuberculosis H37Rv
accgcagcggaacugggcc

SEQ ID NO: 1325046 - RNA, 18 nt, Mycobacterium tuberculosis H37Rv
accgccagcagcaggcca

SEQ ID NO: 1325047 - RNA, 13 nt, Mycobacterium tuberculosis H37Rv
accgccagccacc

SEQ ID NO: 1325048 - RNA, 15 nt, Mycobacterium tuberculosis H37Rv
accgccaccgccagc

SEQ ID NO: 1325049 - RNA, 16 nt, Mycobacterium tuberculosis H37Rv
accgccaccgcggccu

SEQ ID NO: 1325050 - RNA, 17 nt, Mycobacterium tuberculosis H37Rv
accgccaccgcggccug

SEQ ID NO: 1325051 - RNA, 13 nt, Mycobacterium tuberculosis H37Rv
accgccaccuugg

SEQ ID NO: 1325052 - RNA, 15 nt, Mycobacterium tuberculosis H37Rv
accgccacggcggcu

SEQ ID NO: 1325053 - RNA, 22 nt, Mycobacterium tuberculosis H37Rv
accgauaucgcugcggaaauga

SEQ ID NO: 1325054 - RNA, 22 nt, Mycobacterium tuberculosis H37Rv
accgagucgacggccagugcgc

SEQ ID NO: 1325055 - RNA, 20 nt, Mycobacterium tuberculosis H37Rv
accgaggugccgcgcagcug

SEQ ID NO: 1325056 - RNA, 23 nt, Mycobacterium tuberculosis H37Rv
accgagucgacggccagugcgca

SEQ ID NO: 1325057 - RNA, 14 nt, Mycobacterium tuberculosis H37Rv
accgaguuccucug

SEQ ID NO: 1325058 - RNA, 13 nt, Mycobacterium tuberculosis H37Rv
accgaggaucucg

SEQ ID NO: 1325059 - RNA, 21 nt, Mycobacterium tuberculosis H37Rv
accgagggcaaggacaagccg

SEQ ID NO: 1325060 - RNA, 17 nt, Mycobacterium tuberculosis H37Rv
accgaggucgagcgacc

SEQ ID NO: 1325061 - RNA, 19 nt, Mycobacterium tuberculosis H37Rv
accgcagauccccgccacc

SEQ ID NO: 1325062 - RNA, 15 nt, Mycobacterium tuberculosis H37Rv
accgcagcacucccu

SEQ ID NO: 1325063 - RNA, 18 nt, Mycobacterium tuberculosis H37Rv
accgcaagaaucagcagc

SEQ ID NO: 1325064 - RNA, 15 nt, Mycobacterium tuberculosis H37Rv
accgcaauggcggcc

SEQ ID NO: 1325065 - RNA, 16 nt, Mycobacterium tuberculosis H37Rv
accgcaauggcggccu

SEQ ID NO: 1325066 - RNA, 22 nt, Mycobacterium tuberculosis H37Rv
accgcaaaggagaagacaugcc

SEQ ID NO: 1325067 - RNA, 15 nt, Mycobacterium tuberculosis H37Rv
accgauugucggcaa

SEQ ID NO: 1325068 - RNA, 15 nt, Mycobacterium tuberculosis H37Rv
accgcaaaggagaag

SEQ ID NO: 1325069 - RNA, 13 nt, Mycobacterium tuberculosis H37Rv
aaucagcacccca

SEQ ID NO: 1325070 - RNA, 14 nt, Mycobacterium tuberculosis H37Rv
aaucaagcacagcc

SEQ ID NO: 1325071 - RNA, 12 nt, Mycobacterium tuberculosis H37Rv
aaucaagcagcg

SEQ ID NO: 1325072 - RNA, 12 nt, Mycobacterium tuberculosis H37Rv
aaucaagcacag

SEQ ID NO: 1325073 - RNA, 12 nt, Mycobacterium tuberculosis H37Rv
aaucacaucgcc

SEQ ID NO: 1325074 - RNA, 21 nt, Mycobacterium tuberculosis H37Rv
aaucaccgccgcgaccgccuc

SEQ ID NO: 1325075 - RNA, 22 nt, Mycobacterium tuberculosis H37Rv
aauagucauagagcucgccggu

SEQ ID NO: 1325076 - RNA, 19 nt, Mycobacterium tuberculosis H37Rv
aauagcuguuggccagccg

SEQ ID NO: 1325077 - RNA, 17 nt, Mycobacterium tuberculosis H37Rv
aauacacuccugagaug

SEQ ID NO: 1325078 - RNA, 13 nt, Mycobacterium tuberculosis H37Rv
aauacagcuugau

SEQ ID NO: 1325079 - RNA, 15 nt, Mycobacterium tuberculosis H37Rv
aauacacauuuccaa

SEQ ID NO: 1325080 - RNA, 12 nt, Mycobacterium tuberculosis H37Rv
aauacaccuugu

SEQ ID NO: 1325081 - RNA, 14 nt, Mycobacterium tuberculosis H37Rv
aaucgacagcagcg

SEQ ID NO: 1325082 - RNA, 15 nt, Mycobacterium tuberculosis H37Rv
aaucgacaccgcccg

SEQ ID NO: 1325083 - RNA, 23 nt, Mycobacterium tuberculosis H37Rv
aaucgacugaucgccacccgguc

SEQ ID NO: 1325084 - RNA, 21 nt, Mycobacterium tuberculosis H37Rv
aaucguguugucaggacaugc

SEQ ID NO: 1325085 - RNA, 17 nt, Mycobacterium tuberculosis H37Rv
aaucggcggcacccggg

SEQ ID NO: 1325086 - RNA, 19 nt, Mycobacterium tuberculosis H37Rv
aaucucgcccccagugcac

SEQ ID NO: 1325087 - RNA, 22 nt, Mycobacterium tuberculosis H37Rv
aaucucguuccacugugcgagc

SEQ ID NO: 1325088 - RNA, 14 nt, Mycobacterium tuberculosis H37Rv
aaucucgaucuugg

SEQ ID NO: 1325089 - RNA, 16 nt, Mycobacterium tuberculosis H37Rv
aaucguuggccaugcc

SEQ ID NO: 1325090 - RNA, 16 nt, Mycobacterium tuberculosis H37Rv
aaugacuuggccagca

SEQ ID NO: 1325091 - RNA, 23 nt, Mycobacterium tuberculosis H37Rv
aaugcacaaaaaccgaccgcgcu

SEQ ID NO: 1325092 - RNA, 16 nt, Mycobacterium tuberculosis H37Rv
aaugaagugcaccgaa

SEQ ID NO: 1325093 - RNA, 14 nt, Mycobacterium tuberculosis H37Rv
aaugccagcggcac

SEQ ID NO: 1325094 - RNA, 15 nt, Mycobacterium tuberculosis H37Rv
aauggcaacacaccg

SEQ ID NO: 1325095 - RNA, 21 nt, Mycobacterium tuberculosis H37Rv
aaugcugacggugcaggacca

SEQ ID NO: 1325096 - RNA, 12 nt, Mycobacterium tuberculosis H37Rv
aaugcugcaggu

SEQ ID NO: 1325097 - RNA, 15 nt, Mycobacterium tuberculosis H37Rv
aaugcugcugcagca

SEQ ID NO: 1325098 - RNA, 12 nt, Mycobacterium tuberculosis H37Rv
aaugcugcugca

SEQ ID NO: 1325099 - RNA, 16 nt, Mycobacterium tuberculosis H37Rv
aauguccgcagacgac

SEQ ID NO: 1325100 - RNA, 16 nt, Mycobacterium tuberculosis H37Rv
aauguauugcggugag

SEQ ID NO: 1325101 - RNA, 14 nt, Mycobacterium tuberculosis H37Rv
aaugucggcagggc

SEQ ID NO: 1325102 - RNA, 19 nt, Mycobacterium tuberculosis H37Rv
aaugucuuuggucgccgga

SEQ ID NO: 1325103 - RNA, 18 nt, Mycobacterium tuberculosis H37Rv
aagcucugcgucgugccc

SEQ ID NO: 1325104 - RNA, 15 nt, Mycobacterium tuberculosis H37Rv
aagcgugcugccgcc

SEQ ID NO: 1325105 - RNA, 15 nt, Mycobacterium tuberculosis H37Rv
aagcguccgcugcag

SEQ ID NO: 1325106 - RNA, 17 nt, Mycobacterium tuberculosis H37Rv
aaggaucagcgcacugg

SEQ ID NO: 1325107 - RNA, 14 nt, Mycobacterium tuberculosis H37Rv
aagcugcugcugcu

SEQ ID NO: 1325108 - RNA, 19 nt, Mycobacterium tuberculosis H37Rv
aaggugcgcugggugauga

SEQ ID NO: 1325109 - RNA, 12 nt, Mycobacterium tuberculosis H37Rv
aaggugccggcg

SEQ ID NO: 1325110 - RNA, 13 nt, Mycobacterium tuberculosis H37Rv
aaggugcacugcc

SEQ ID NO: 1325111 - RNA, 17 nt, Mycobacterium tuberculosis H37Rv
aaggugaucagcaggau

SEQ ID NO: 1325112 - RNA, 20 nt, Mycobacterium tuberculosis H37Rv
aagguguggugacagagcgg

SEQ ID NO: 1325113 - RNA, 15 nt, Mycobacterium tuberculosis H37Rv
aaggccgccaaccgu

SEQ ID NO: 1325114 - RNA, 16 nt, Mycobacterium tuberculosis H37Rv
aaggccgcaauacccg

SEQ ID NO: 1325115 - RNA, 14 nt, Mycobacterium tuberculosis H37Rv
aaggccgagcgcga

SEQ ID NO: 1325116 - RNA, 18 nt, Mycobacterium tuberculosis H37Rv
aaggcauugcccacaaag

SEQ ID NO: 1325117 - RNA, 13 nt, Mycobacterium tuberculosis H37Rv
aaggcacgggugu

SEQ ID NO: 1325118 - RNA, 21 nt, Mycobacterium tuberculosis H37Rv
aaggcaaacaccagcccggcg

SEQ ID NO: 1325119 - RNA, 14 nt, Mycobacterium tuberculosis H37Rv
aaggcaaacaccag

SEQ ID NO: 1325120 - RNA, 22 nt, Mycobacterium tuberculosis H37Rv
aaguugugcgcacucuuuccuu

SEQ ID NO: 1325121 - RNA, 15 nt, Mycobacterium tuberculosis H37Rv
aaguuggccgcccga

SEQ ID NO: 1325122 - RNA, 11 nt, Mycobacterium tuberculosis H37Rv
aaguugaagaa

SEQ ID NO: 1325123 - RNA, 23 nt, Mycobacterium tuberculosis H37Rv
aaguuggcuugcgcgcaggugcu

SEQ ID NO: 1325124 - RNA, 17 nt, Mycobacterium tuberculosis H37Rv
aaguuggcugagcagcg

SEQ ID NO: 1325125 - RNA, 23 nt, Mycobacterium tuberculosis H37Rv
aagugcacccgguugugcgcgcg

SEQ ID NO: 1325126 - RNA, 20 nt, Mycobacterium tuberculosis H37Rv
aagugaauaccccagaccgc

SEQ ID NO: 1325127 - RNA, 20 nt, Mycobacterium tuberculosis H37Rv
aagucgucggccaucgaguc

SEQ ID NO: 1325128 - RNA, 18 nt, Mycobacterium tuberculosis H37Rv
aaguccgccgccugcgca

SEQ ID NO: 1325129 - RNA, 20 nt, Mycobacterium tuberculosis H37Rv
aaguccgcccgccgaccugg
